United States Patent 10,501,513 (MODIFIED POLYNUCLEOTIDES FOR THE PRODUCTION OF ONCOLOGY-RELATED PROTEINS AND PEPTIDES) - sequence listing, part 10

SEQ ID NO: 15823 - DNA, 13614 bp, Artificial Sequence
  Description of Artificial Sequence: Synthetic coding sequence
ttccttcattccggtcctgaagaggttgagatcaagtgtcccttaaatcacatcgcatgtctcgggacgaataaatgcgttcatctgtcccagctttgcaacggagtcctcgattgtcctgatggttatgacgaaggtgtacattgtcagggagagagcatttgccagcagctgaactgtactatgtacaaatataagtgtaccatggtgcggaactcaacaagatgctactgtgaagacggctttgaaatcacagaggacggccggagctgcaaggaccaagatgagtgcgctgtctacggcacttgttcacagacttgtcgcaacacgcacggttcatatacatgcagctgcgtggagggctatctaatgcagcctgacaacaggtcttgcaaggcaaaaattgagcccaccgaccggcccccgatcctccttatcgccaatttcgagacaatcgaagtcttttatttaaatggatccaagatggccactttgagttctgtgaatggaaacgagatacacaccttagatttcatatataatgaggacatgatctgctggattgagagcagggagtcatcgaaccagttgaaatgcatccagatcacaaaagctggagggctcacagacgagtggacgatcaacattttacaatcttttcacaacgtgcagcagatggccatagattggttgaccaggaacctgtacttcgttgaccacgtgggagatcggattttcgtgtgcaatagcaatggcagcgtgtgcgtaacccttatagatctggaattgcacaacccaaaagctattgccgttgatcctattgccggcaaactttttttcactgactatgggaatgttgcaaaggtcgaaaggtgcgatatggatggaatgaatcgtacaagaatcatcgactctaaaacagaacagcctgctgcccttgccctggatcttgtgaataaactcgtatactgggtggatctgtacctggactacgtcggggtagtcgattatcagggaaagaaccgacataccgtgatccaagggcggcaggtgaggcatctgtatggaattactgtgttcgaggactacctctatgccactaattcagacaattacaacattgttaggattaatcgctttaatggtaccgacatccacagcctcattaagattgagaacgcttggggcattaggatttaccagaaaaggactcagcctacagtacgcagccacgcttgtgaagttgacccgtacggtatgccaggaggttgttcgcacatatgcctcctgtcctcttcatacaagacccgaacatgtaggtgccgtacaggtttcaacctcggatcagacggacgatcttgcaagcgccctaagaacgagttgttcttattctatggcaagggccgccccggaatagtcagaggtatggacctgaatacaaagattgccgatgagtacatgattccaattgagaatcttgttaatcctcgcgccctagatttccacgccgagaccaactatatctatttcgctgacactaccagcttcttgatagggaggcaaaagattgatggcacagaacgggagaccattcttaaagatgacttggacaacgttgaaggcattgcagtggattggattgggaacaacttatactggacaaacgacggccataggaaaacaattaatgttgcgagactggaaaaggcaagccagagtcgcaagaccctcctggagggcgaaatgtcccacccccggggaatcgtcgtggatcccgtgaatggatggatgtattggacggattgggaggaagatgaaattgacgactctgtgggaagaattgagaaggcgtggatggacggatttaaccgtcagattttcgtcacttctaaaatgctgtggccgaacgggttaaccctagactttcatacaaatactctgtactggtgtgatgcctattatgatcacatagagaaggtcttcttgaatggcactcaccggaaaatcgtttatagtggccgcgagctaaatcatccttttggcctgagccatcatggcaattatgtattctggacagactacatgaacggcagtatttttcagctggatctgataactagtgaggtcacgctactgaggcacgaaagacctcccttgtttggcctccaaatttatgacccccgtaaacagcagggtgacaatatgtgcagggtgaacaacgggggttgtagcacgctgtgtctggcaatcccaggaggaagggtctgcgcatgtgcggataaccagctcctggatgaaaacgggaccacatgtacttttaaccccggggaggcactacctcacatatgcaaggctggcgagttcaggtgcaaaaatcggcactgcattcaagctcgatggaagtgcgatggcgacgacgattgtctggacggctccgatgaagacagcgttaactgcttcaaccattcctgcccagacgaccaattcaaatgccagaataatcgctgcattccaaagaggtggctgtgtgatggcgccaatgattgtgggtccaacgaagatgagagtaaccaaacatgcacggcacgaacttgtcaagtggaccagttcagctgcggcaatggaagatgcataccacgggcatggctttgtgacagggaggacgactgcggcgaccaaaccgacgaaatggcttcttgcgaattcccaacatgcgagcctctgacgcagtttgtgtgtaagagtgggagatgcatcagttcaaagtggcactgcgactcggacgatgactgcggggacggctctgatgaggtgggctgcgtgcattcttgcttcgataaccagtttcgctgtagctctggacgttgcatccccgggcactgggcgtgcgacggcgataatgactgtggcgatttttcggacgaagctcagatcaattgtaccaaggaagaaattcacagcccagctggctgtaacgggaacgaattccagtgtcacccggacggaaactgtgtccctgacctttggaggtgtgacggtgagaaagactgcgaagatggctctgatgaaaagggatgcaacggcacgattcggctgtgcgaccacaagacaaaattttcatgttggtccaccggaaggtgcatcaataaggcttgggtgtgcgacggcgatattgattgtgaagaccaaagcgatgaggacgattgcgatagcttcttgtgtggaccgcctaagcatccgtgcgcgaacgacacttccgtgtgcctgcagcctgagaagttatgcaatggaaagaaggactgccccgatggctctgacgaggggtacttgtgtgatgaatgctcactaaataacggcggctgcagcaatcactgtagtgtcgtccctggcagagggatcgtatgctcttgccctgaggggttgcagctgaacaaggataacaaaacttgtgagatagtggattattgctcaaaccatcttaaatgttcacaggtgtgtgaacaacacaagcataccgttaaatgtagctgctacgagggatggaagctggacgttgacggagagtcctgcacttccgttgacccttttgaagcgttcataatcttctcaatccggcatgagatccgacgcatcgacctgcacaaaagggactactccctcctggtccctgggctgagaaataccatagcgctcgacttccatttcaatcagtcgctgctgtactggacagacgtggtagaggaccgtatttatcgggggaagttgtccgagagtggcggcgtcagcgcaatagaggttgttgtggagcatgggctggcaactcccgaaggccttacagtagactggatcgccggcaatatatattggattgattccaatctcgatcagatcgaagtagcaaaattagatggatccctgcgcaccactctgattgcaggcgccatggaacatcccagggccattgctctcgatcccagatatggtattttattttggaccgattgggacgccaactttccacgcattgagtcagcctcaatgtccggcgcaggcaggaaaactatttataaagacatgaagacaggcgcatggccaaacgggctcacggttgaccattttgaaaaacggatagtgtggaccgacgctaggagcgatgccatctattcggccctgtatgacggtacaaacatgatcgagattattaggggccatgaatatttgtcccacccctttgcagtatctctgtacggcagcgaagtgtactggacggattggcggaccaacactctatccaaagctaacaaatggacaggtcagaacgtgtcggtgatccaaaagactagtgcccaaccgttcgaccttcagatatatcatccaagcagacaacctcaggcacccaacccctgtgcggctaatgatggtaaaggtccatgttctcacatgtgcctgatcaaccacaatagatctgctgcctgtgcctgcccccacctcatgaagctgagcagtgataagaagacttgctatgaaatgaagaaattcctgctgtacgctcgccggagtgagatccggggggtcgacattgacaacccctatttcaatttcatcacagcattcactgtacccgacatcgacgacgtgaccgttattgattttgacgcttcagaggagcgcctttattggacagatatcaaaactcagactatcaaaagggcgtttatcaatggcacaggactggaaaccgtgatcagcagagatatccagagcataagaggattagccgtggattgggtttccaggaatctttactggatttcatccgagttcgacgagacccagatcaacgtagctaggctggacggcagcctcaaaacctccatcatacacggaatcgataaacctcagtgtctggcagcacacccggtaagaggcaaactgtattggaccgatggaaacaccattaacatggccaatatggatggctctaactcaaagattctctttcagaaccagaaggagcccgtggggctgtccattgactatgtcgagaataagctgtactggattagctcaggcaatggcacgattaaccgctgtaatctcgatggtggtaacttggaagtgattgaatcaatgaaggaagagctgacaaaagctacagcgttgacaatcatggacaagaagctctggtgggcggaccagaacttggcacaattgggaacctgtagtaaacgagacgggagaaatccaaccatcctgcgcaataaaacttcgggggtcgtgcatatgaaggtctacgacaaagaggcgcagcagggctccaattcctgtcagctcaacaacggaggttgtagtcagctatgcttgccaacttcagaaacaacccgcacctgtatgtgcactgtgggctactacttgcagaagaatcggatgagctgccaaggcatcgagtcattccttatgtatagcgtgcacgaaggtataagaggcatacctctagaaccttctgacaagatggatgcactgatgcctataagcgggacctcgtttgccgtcggcattgattttcatgccgagaacgatacaatctactggacagatatggggttcaacaaaatcagcagggccaaaagagaccagacatggaaagaggacattatcactaacggactgggccgggttgagggaatagcagtggattggatcgccgggaatatttactggacagatcatggatttaatctcattgaagtcgccaggttgaacgggtcattcaggtacgtcatcatctcccagggcctcgatcagcctagaagcattgcagtacacccggaaaagggcttgttgttctggactgaatggggccaaatgccatgcataggaaaggccagattagacgggtcagagaaggtcgtgttggtttccatgggaatcgcatggccaaatggaatctcaattgactacgaggagaacaagctgtactggtgcgatgcccgaacagacaaaatcgagcgcattgatcttgagaccggtggcaaccgagagatggtcctaagtggatctaacgtcgatatgttttcagtggctgtgttcggggcctacatttattggtcggatcgcgctcatgccaacggctctgttcggaggggacacaagaacgatgctacagagactatcacgatgaggactggactcggagtgaacctgaaagaggtaaagatctttaacagggtacgcgaaaaaggcacaaacgtttgcgctcgcgataacggaggatgtaaacagctctgtttgtatcgaggaaactctcgccgtacatgtgcttgtgcccacggatatctggccgaagacggcgtcacttgtctgaggcacgaagggtatctcctgtacagcggtagaactattctaaagtctatacatttgtcagacgagaccaatcttaacagtcctatacggccatatgagaatcccaggtacttcaagaacgtcattgcgctggcatttgattacaaccaacgacggaaagggaccaacaggattttttattcagatgcacactttgggaacattcagctgattaaagacaactgggaagaccgtcaggtgatagtcgaaaacgtgggatccgtggagggtctggcttatcacagagcttgggacactctgtactggaccagctccacaactagttctattacacggcataccgtggatcagactcgccccggggcattcgaccgcgaagccgtcataacaatgtccgaagacgatcatccccacgtgctagccttggacgagtgccagaacctaatgttctggaccaattggaatgagcagcacccttcaatcatgcgctctacccttaccggaaagaacgcacaggtggtcgtctctactgacatcctaactcctaacgggctcacaatagactacagggcagagaagctgtacttctcggacgggtctctcgggaagattgaacgctgtgaatatgacggctcccagcgccacgtgattgtgaaaagcggtccgggaacatttttgtccctggccgtgtacgataactacattttttggagcgattgggggcggcgtgctatacttaggagtaacaagtacaccgggggagacactaagatcctgaggagcgatatccctcatcagccaatgggcattattgctgtggctaatgatactaattcctgcgaactttccccttgcgctctcctaaacggtggatgtcatgacctgtgcctactcacccctaacggcagggtcaattgctcttgccgcggggatcgtatcctcctggaagataatagatgcgtaacgaagaactcctcttgtaacgcgtactctgaatttgagtgcggaaacggcgaatgcatagactatcaactcacctgcgatggaatccctcactgtaaggataagtcggatgagaagttgctatactgcgagaatcggagctgtaggagaggattcaagccgtgctataatcgacgatgcattcctcacgggaagctttgcgatggggaaaacgactgtggagataattcggacgagcttgactgcaaagtgtccacctgtgcaacggtcgaatttcgctgcgctgatgggacctgtataccgcgatcagcacgatgcaaccagaatattgactgcgccgacgcctctgacgaaaagaactgtaacaacactgattgcactcatttctacaagttaggggtcaagaccacgggtttcattcggtgcaactctacgagcttatgcgtactcccaacatggatctgtgacggctctaacgactgcggagactattcagatgagctgaagtgtcccgtacagaataaacacaaatgtgaggaaaactatttttcctgccccagcggccggtgtattcttaacacttggatatgtgatggtcagaaagattgtgaagatggtagagacgaattccattgcgattcgagctgcagctggaatcaattcgcgtgttctgcccagaaatgtataagcaaacattggatttgcgatggcgaggacgattgtggcgacggcttagatgagagtgatagcatttgcggcgccatcacttgcgccgccgacatgtttagctgccaaggatcacgagcatgcgtgccccggcattggctttgtgacggggaaagggattgtccggacggcagcgacgaattgtcgacagccggctgtgcaccaaacaacacgtgcgacgagaacgcctttatgtgccacaacaaggtctgtatccccaagcagttcgtgtgcgaccatgacgacgattgcggagatggcagcgacgaatctcctcagtgcggctacaggcagtgcggaaccgaggagttttcatgtgccgatggcagatgtctgctaaacacccagtggcaatgcgacggggacttcgattgcccagatcattccgatgaggccccccttaacccgaagtgtaagtcagccgagcagtcctgcaattcatcatttttcatgtgtaagaatgggcgatgcatcccgtctggcggtctgtgcgacaataaggatgactgcggagacggatcagatgagaggaattgccatattaatgagtgtctttcaaaaaaagtctccggttgctcccaggactgccaggacctgcctgtctcttataaatgcaaatgttggcccgggttccaactcaaagatgacggtaagacatgcgtcgatatcgatgagtgtagtagcggttttccgtgtagccagcaatgtatcaacacctatgggacttataagtgtctttgtaccgacggctatgagattcagcctgacaatccaaatggatgtaaatctctgagcgatgaagagcccttccttattctcgctgatcatcacgagattcggaagatttcaacggacggcagtaactacacgctactgaagcaggggctgaacaacgtaatagcaattgatttcgactaccgtgaggagttcatatactggatcgatagctctcgtcccaatgggagcagaattaaccgtatgtgccttaacggttcagacataaaggtggtgcataatacggctgtgccaaatgcgctcgcagttgattggatcggtaagaacctatactggagcgatacagagaagcgaattattgaagtttccaagctcaatgggctctatccgacaatactggtctccaagaggttaaagttccctagagacttgagcctggacccacaggccggctacctgtattggatcgactgttgtgaatatccccacatcggcagagtcggaatggatggcacaaaccagtccgtggtgattgaaacaaagatctcgcggcccatggctcttacaatcgattatgtgaatcggagactctactgggccgacgagaatcacattgagtttagtaatatggacggatctcaccgccataaggttcctaaccaggacatcccaggggtcattgctctcaccctctttgaggactatatttattggacagatggtaagaccaagagcctgtcacgggcacacaagacctctggcgcagatcgcttgtcactgatctatagttggcacgccatcactgacatccaagtatatcacagctaccgtcagcctgatgtgtccaagcacctgtgcatgattaacaacggagggtgtagccatctctgtttgctggccccgggaaagactcacacgtgtgcctgtccaacaaatttctacctggcagcagacaaccggacttgcctgagcaactgcaccgcttctcagtttaggtgcaaaactgataaatgcatcccattctggtggaagtgcgatacagtcgatgattgtggcgacggaagcgacgaacctgacgattgtcccgagttcaggtgtcaacctgggcggtttcagtgtgggactggtttgtgcgctttgcccgccttcatctgtgacggagagaacgattgtggagataactctgacgaactgaattgtgacacacatgtttgcctcagcggacagtttaaatgtactaagaaccagaagtgtatccctgtcaaccttcggtgcaatggccaggatgattgcggcgatgaggaggatgagagagattgccccgagaattcctgttcccctgattattttcagtgtaagacaaccaagcactgcatctcaaagttgtgggtgtgcgacgaagaccctgattgtgcagatgccagcgatgaggccaattgcgacaaaaaaacctgcggcccccacgagttccagtgtaagaataataactgcataccagaccactggcgttgtgatagccagaacgattgctccgacaattccgatgaggagaattgcaagccacagacctgtactctaaaggatttcctgtgcgccaatggcgactgtgtctcttcacgcttctggtgcgatggcgatttcgactgtgcagatggttccgacgaacgaaattgtgagacctcgtgctcaaaagatcaattccgctgcagcaacggtcagtgcattcctgccaagtggaagtgtgatgggcacgaagactgcaaatatggggaggacgaaaaatcctgtgaacctgccagcccaacatgttccagccgagagtatatctgcgccagtgatgggtgtattagcgcttctttgaagtgtaacggggaatatgattgcgctgacgggagtgacgagatggactgcgtgaccgaatgtaaggaagatcagtttagatgtaaaaacaaggcccactgtattcctatccgttggttgtgtgacggaatacatgattgcgttgatggctcagacgaagagaactgtgaacgtggcggcaacatttgtagagccgatgagttcctttgtaacaattctctctgtaagttgcacttctgggtctgtgatggcgaggacgattgcggggataattcagacgaagcgcccgatatgtgtgttaaattcttatgtcccagtaccaggccacaccgatgtcgtaacaaccggatctgtctccagagtgagcaaatgtgcaatgggatcgatgagtgtggcgataattcagacgaagatcactgcggagggaaactcacctacaaggcacgaccctgtaagaaggacgagttcgcttgctctaacaagaaatgcatcccgatggacctgcagtgtgatagactggacgactgtggggatggttccgacgaacaaggctgtcgtattgcccctactgagtatacttgtgaagataatgtgaatccttgtggagacgatgcgtactgtaaccagataaagactagcgtcttctgcagatgcaaacctggcttccagcgaaacatgaaaaaccggcaatgtgaggaccttaacgagtgcctggtgttcggcacatgctcccaccagtgcatcaatgtcgagggttcttacaagtgtgtgtgcgatcagaacttccaggagaggaataacacctgcatcgcagagggctccgaagatcaagtgctgtacatcgctaacgatacagacatcctgggattcatctatcccttcaattatagcggcgaccaccagcagatcagccacatcgagcacaattctcgaataaccggaatggacgtctactatcagagagacatgattatttggtcaacgcagttcaaccctggcggcattttttacaagagaatccatggccgggaaaaaagacaggctaattctggattgatctgccctgagtttaagcggccgcgggatatcgcagttgattgggttgccggcaatatctactggacggatcactcacgcatgcactggttttcatactatacaacccactggacctccctcagatattccatcaacgtgggccaactgaacggaccgaattgtacccgcctgctgacgaatatggctggcgaaccatacgctatagccgtgaaccccaagagaggaatgatgtattggaccgtggtgggagatcacagccatattgaggaagccgctatggatggaacccttaggcgcattctagtccagaaaaatctccagagacccaccgggctggccgtggactacttctccgagagaatctactgggcggatttcgagctatcaataatcggatctgtgctgtatgatggatccaacagcgtggtttccgtgtcatccaagcaggggctgcttcatcctcacagaatcgatatcttcgaggattacatctatggggccggccccaaaaacggagtctttcgcgtacaaaaattcggtcacgggagtgtggagtatctggccctgaatatagataagacaaagggagtactgatcagccacaggtataaacagctcgacctgccaaatccttgccttgatctcgcgtgcgaatttttgtgcctacttaatcctagcggggccacgtgcgtctgcccagagggcaaatatctgatcaacggcacctgtaatgatgactccctactggacgactcttgcaagcttacatgcgagaatggcggaagatgcatcctcaacgagaaaggcgatctccgatgccattgctggcccagctactctggggaaaggtgtgaagtcaaccattgcagcaattattgccagaacggcggcacttgcgtgcctagcgtgctggggcgtcctacgtgtagctgtgccctaggttttaccggacctaattgcggaaagacagtgtgcgaggatttctgtcaaaatggaggtacctgcatcgtgacggccggcaaccagccctactgtcattgtcagcccgagtacactggagatcgttgccagtattacgtgtgccaccactactgcgtgaattctgagtcttgcacaataggtgatgacggatccgtcgaatgcgtctgccccacccggtacgaaggccctaagtgtgaggttgataagtgcgtcagatgccacggcggtcactgcataattaacaaggactctgaagatatattttgcaattgtaccaatggtaagatcgcgtctagttgccagctgtgcgacggctactgttataacggaggcacgtgccaacttgaccccgagaccaacgtgcctgtgtgcctgtgttccaccaattggtcgggtacacagtgtgagcgccctgcgccaaaatctagcaaatctgatcatattagcacacgaagcatcgcaattatcgtgcccctggtgctgctggtcaccttgattaccacactggtcattggtctcgtgctttgcaagcgcaaacgcaggacaaagaccatcaggcggcagccaattatcaacgggggcattaacgtcgaaattggtaatccttcctacaatatgtatgaggtcgaccacgatcataacgacggtggactcctggacccagggtttatgattgatcctactaaagccaggtacattggcggtgggccctccgcattcaaactgccacatactgctcctcccatctaccttaatagtgacctcaaagggccactgaccgcagggccaacgaattacagcaacccagtgtatgcgaaactgtatatggacgggcagaactgtagaaactcactgggtagcgtcgacgaaaggaaagagcttctccccaagaaaatagaaatcggtatccgtgagacagtggcatag

SEQ ID NO: 15824 - DNA, 843 bp, Artificial Sequence
  Description of Artificial Sequence: Synthetic coding sequence
atgtgccccccccaggcccaggcggaggtgggcccaactatgaccgagaaggctgaaatggtttgcgccccaagtcctgctcccgctcctcctccaaagcctgctagcccaggcccaccacaggtagaggaggtcggtcacagaggcggttcctctccccctaggttacctccaggggttcccgtgattagcctgggccacagccgcccccctggcgtggcgatgcccaccactgaactgggtaccttacggccaccattgctgcaactgagcacccttggtacagcaccaccgaccctcgccctccactatcaccctcacccattcctcaactcagtgtacatcgggcctgcagggcccttttcgatcttcccctcgagccggcttaagagacgaccctctcattgtgagctggacctggctgagggccaccagccacagaaggtggcacggagagtgtttactaattccagagaaagatggcgccagcagaatgttaacggtgccttcgccgagctgagaaagttgctccctacccaccccccagatcggaagctgtcaaagaacgaggtgctacgccttgcaatgaaatatatcggttttctggtcaggctgttaagagaccaggcggctgccctggccgccggtcctactccacccggaccaaggaagcgtcccgtccatcgggtgcctgacgacggcgcccgacgcggatccggcagaagagctgaggcggccgcgcgctcccaacccgcaccacctgcagacccggacggaagcccgggcggcgctgctcggcccattaagatggaacagaccgcactgtctcccgaagtgcgatag

SEQ ID NO: 15825 - DNA, 1620 bp, Artificial Sequence
  Description of Artificial Sequence: Synthetic coding sequence
atgggttgtgggtgctctagccacccggaggatgattggatggagaatatcgatgtctgtgaaaactgccattatcctatcgtgccactcgacggaaaaggcactttgttaattagaaacgggtccgaagtaagagacccattggtgacatatgagggatctaatccaccagcctctccccttcaagataatctcgttatagctctgcactcatacgaaccctctcacgatggcgatctcggttttgagaagggcgaacagttgcggatactggaacaatcaggagaatggtggaaagcgcaatccctgactaccgggcaagagggattcataccctttaattttgtggctaaagctaatagtctggaaccggagccatggttttttaaaaatctgagccggaaagatgcagaaagacagctgcttgcgcctggcaacacacatggatcatttttgatcagagaaagtgaatccaccgctgggtcattctccttgtcggtgagagattttgatcagaaccagggagaggtggtgaagcattacaaaataaggaacttggacaatggtgggttttacatcagccctcgcataacattccctggtttgcatgagttggtgcgtcattacaccaacgcctctgacggcctgtgtactagactgtcccgcccttgtcagacacagaagccgcaaaagccatggtgggaggacgaatgggaagtgcctagggagacccttaagcttgtggaacgccttggagccggtcagtttggggaggtatggatggggtattacaacggtcacaccaaagtggccgttaaaagtctgaagcaggggtcaatgtccccagatgccttcctggccgaagccaaccttatgaagcagcttcaacaccagcgtctggttaggctgtacgcggtagtgacccaggaacccatttacatcatcacagaatacatggagaatgacaccttactggactcccagttggaggaaaaggggttgggcgcgagcccgtggggcaacttgggccagcaactgctgctgcttccaactggtagcctggtggatttcctgaagaccccttctggcataaagctcactatcaacaaacttcttgacatggctgctcaaatcgccgaaggcatggctttcattgaggagagaaattacatacacagggatctccgcgccgccaatattctggtatctgacacattatcctgtaagattgctgacttcgggcttgcccggctaatcgaagataacgaatacacagcacgggaaggggcaaagtttccgattaaatggactgcccctgaggctatcaactatggcacgtttacaataaagtctgatgtctggtcattcgggattttacttacggagatcgtgacccacggtagaatcccatatccaggtatgacaaacccggaggtgattcagaacttggaaagaggttataggatggtaaggcccgataactgcccagaagagctttatcagctaatgcggctgtgttggaaagaacgacctgaagatcggcccacattcgattatcttcgcagcgtgctcgaggacttttttacggcaacggaagggcagtatcagccgcagccgtag

SEQ ID NO: 15826 - DNA, 1530 bp, Artificial Sequence
  Description of Artificial Sequence: Synthetic coding sequence
atggggtgcggttgttcctcacaccctgaagacgactggatggaaaacatcgacgtgtgcgaaaattgccactatcccattgtgccgttggacggcaagggtactctcctcatccgaaatggcagcgaggtccgagacccgctcgttacctatgagggctccaatccaccagccagcccacttcaggataatctggttattgcccttcattcgtatgaaccgtcacatgacggggatctgggcttcgagaaaggcgaacaattgaggattctggagcaatctggagaatggtggaaagctcagagccttaccaccggccaggaagggtttatcccctttaattttgtagctaaagcaaattccctggaaccggagccttggttttttaaaaacctaagcagaaaagatgctgaacgccagttattagcccctgggaacacccacggaagcttcttaattagagaaagtgagagtaccgcaggcagtttttcactctccgttcgggattttgatcagaatcagggcgaagtggtcaaacactacaagattcggaatttagataatggcggcttctacatcagcccacgaattactttccctggcttgcacgagctagtgagacactacactaatgccagcgacggtttgtgcactaggctgtcgagaccctgtcaaactcagaaacctcagaagccctggtgggaggacgaatgggaggtgcctagagagactctcaaattggtagagcgcctgggggctggccaattcggtgaggtgtggatgggttattacaacggtcataccaaagtagccgtgaagagcttgaaacaaggttcaatgagtccagatgcctttctcgctgaggccaatctaatgaaacaactgcagcaccagagactggtgagactttacgccgtggtaacccaagagcctatctatatcattaccgaatacatggagaatggctcactggtcgactttctgaagacgccttctggaatcaaactgaccataaacaagctcctcgatatggccgcacaaattgcagaagggatggcattcatcgaagagaggaattacatacaccgggaccttcgcgcagctaacatcttagtgagcgataccctctcttgcaagatagcagacttcggcctggctaggctgattgaggacaatgagtatacagcccgtgagggagccaagtttccaatcaagtggaccgctcctgaagcaatcaattacgggacctttacaattaagtctgacgtgtggagttttggcatccttctcaccgaaatcgtcacacacggacgtataccctacccaggaatgaccaatccagaggtaatacagaatctcgagcggggttacagaatggtcaggcccgacaattgtccagaagagctgtaccagctgatgcggctttgttggaaggaacggccagaagacagacctacattcgattacttgcgttctgtgctggaggacttctttacagccactgaggggcagtatcagccacagccgtag

SEQ ID NO: 15827 - DNA, 1551 bp, Artificial Sequence
  Description of Artificial Sequence: Synthetic coding sequence
atgggctgtggttgttcctcccatccagaagatgattggatggagaatattgatgtgtgtgagaattgccactaccccattgtgcccctcgatggtaagggtaccctccttattagaaatggctctgaggtgagagaccctctcgtcacctacgagggctccaatccccccgcctcaccactgcagggggaccccaggcagcaagggctgaaagataaagcctgcggcagcctcgcggtcggctttcatctttcccccacctatttcctcccagggttggcctttctggtcccgcaccctgtgacccccggcttccttcccattcccgccagattcagccttatgcccttggtcttcaccgacaatctggtaatcgccctgcattcctacgaaccctcccacgatggcgacctcggtttcgagaagggagagcagcttcggatcctggaacaaagcggggagtggtggaaggcccagagtctgactacaggacaggagggctttataccatttaacttcgtcgcaaaagctaattccctagagccggaaccatggttctttaagaacctgtctcgcaaggatgccgagcgtcagctgctggcacccggtaatacacacgggagtttcttgattcgagagtcagaatccactgctggctctttctccctgtcagtaagggactttgaccagaatcagggtgaagtggtcaaacattacaagattcggaacttggacaatggcggattctacatttctccgcggattacgtttccaggtcttcacgaactggttcggcattacacacgctattacaatgggcacaccaaggtcgcggtcaaatcgttgaaacaagggtccatgtcccccgacgcctttctcgcagaggcgaatctgatgaaacagttacagcaccaaaggctggttcgtttatacgcagtggttacccaggaaccaatctatatcattacagagtatatggagaacggtagtctagtggacttcctcaaaactcccagcgggatcaaactgacaattaacaaacttttggacatggccgcccagattgccgagggcatggcgttcatcgaagagcgcaactacattcacagagatctgcgtgcagctaatatccttgtgagtgacactctgtcgtgtaaaatcgctgacttcggccttgcccgactgatagaagataacgagtacactgccagggagggcgcaaagttccctatcaagtggacagcgcctgaggccattaactatggcaccttcactatcaagtcagacgtgtggagctttggaattttgcttacagagattgtcactcatggaaggataccttacccaggaatgaccaacccggaggtaatccagaatttggagcggggatataggatggtccgtccagacaattgcccagaggagctttatcagttaatgagactgtgttggaaggagagaccggaggaccgccccacatttgactatctaaggtcagtacttgaagacttttttaccgctacagagggccagtaccagccacaaccttag

SEQ ID NO: 15828 - DNA, 750 bp, Artificial Sequence
  Description of Artificial Sequence: Synthetic coding sequence
atgggttactacaacggccatacgaaggtggccgtaaaatcactgaagcaaggctcaatgagtccagacgccttcctggccgaggctaatctgatgaagcagcttcagcatcaacggctcgtaagactttacgctgttgtgacacaagaaccgatctacattatcaccgaatacatggaaaacgggtccctggtggactttctgaaaacacccagcggcattaaactgacaatcaacaagctgctggatatggctgcccagatagccgaggggatggcgtttattgaggaacgaaactacatccatagagacttgagggccgccaatatccttgtgtccgacacactgagctgtaagatcgccgactttgggctggcgagactgatcgaagacaacgaatacacagcgcgtgagggagccaaatttccaataaagtggaccgcacctgaggctattaattatgggacctttacaatcaaatccgatgtctggtctttcggaatcttactaaccgagatcgttacccatggtagaattccttaccccggcatgacaaaccccgaagtaatacaaaacctggaaagaggatacaggatggtgaggcctgacaattgtccggaggaactgtatcagttaatgcgcctgtgttggaaagaacgccctgaggaccgccccacctttgactacctccggtccgttcttgaagatttcttcaccgctaccgagggacagtaccagccacaaccctag

SEQ ID NO: 15829 - DNA, 1611 bp, Artificial Sequence
  Description of Artificial Sequence: Synthetic coding sequence
atggggatcccaggctcccataatttaagatacttttggaactttccaggccagggaccaattatctccgatgtggggggcgccgatctgggcggtgcgccctccgcccctagcagcattccctccgggaccatggggtgcgggtgtagctctcatccagaggatgactggatggaaaacatcgacgtctgcgagaattgtcattaccctattgtgcctctggatgggaaagggactctcttgattcgcaatgggagcgaggtgagggacccgctggtcacatacgagggttcaaatcccccagccagccctctgcaggataacttggttattgccttacactcttatgagccgtctcatgatggagatctaggatttgagaagggggaacagctacggatccttgagcagtctggtgaatggtggaaagcacaaagcttgacgactgggcaggaaggcttcatccccttcaactttgttgcaaaggcaaacagtctggaacctgaaccttggttctttaagaatttgagcagaaaggatgccgagaggcagctgctcgctcccggcaatacgcacggctctttcctgatacgggagtctgagtccactgccgggtcattctctcttagcgtgcgcgacttcgaccaaaaccaaggcgaggtggttaaacattacaagatacgaaatctggacaatggaggcttctatattagtccgagaattacctttcccggtctgcacgagcttgtcagacactataccaatgctagtgacggcctctgcacgcggctaagcaggccctgccagactcaaaagccccagaagccttggtgggaagatgagtgggaagtgcctcgagagaccctaaagcttgtggaacggctgggggcaggtcaattcggtgaggtttggatgggttactacaatggacacaccaaggtggcggttaaatcgctcaagcagggcagtatgtctccagacgctttcttggcagaagccaacctgatgaagcaattgcagcaccaaagactggtaagactgtacgctgtcgtgactcaggagcctatctacataataactgaatatatggaaaatggtagtctggtggattttctcaaaacaccctcaggcatcaaattaactataaacaagctgctggacatggctgctcagatagcagagggaatggcctttattgaggaacgcaattacatacatcgggatctccgagctgctaatatactggtctctgatactctcagctgcaagattgcagatttcggactagcaaggttgattgaggataatgaatacacagcgcgggaaggcgctaagttccctataaagtggacagcacctgaggcgattaattatggcacctttacacacgggcgaataccatacccaggcatgaccaatcccgaggtcatccagaacctggagagaggctaccgcatggttcggccagacaattgtcccgaggagctctatcagctcatgcggctgtgttggaaagagcgcccagaagaccgacctacctttgactatctccggtctgtactggaggattttttcaccgcaaccgagggccagtatcagccccagccttag

SEQ ID NO: 15830 - DNA, 1200 bp, Artificial Sequence
  Description of Artificial Sequence: Synthetic coding sequence
atgcctcagctgtctggaggcgggggaggagggggcggcgaccccgaattgtgtgcaacggatgaaatgatcccgttcaaagacgaaggggatccacagaaggagaaaatcttcgcagaaatctcacacccagaagaagaaggcgacttagcagacatcaaaagctccctggtaaacgaatcagaaataatcccagccagtaacggacacgaggtggccaggcaagcccagacatctcaggagccataccacgataaagccagggaacatcctgacgatggcaaacatcccgacgggggtctgtacaacaaaggaccttcctacagctcctactctggctacatcatgatgccgaatatgaataatgacccttacatgtccaatggctctctgtccccccccatcccaaggacaagcaacaaagtgcccgttgttcagccttcacatgccgtgcatcctcttacacctctcataacatacagtgatgagcatttcagtccgggcagtcatccatcccacataccttcagacgtgaacagcaaacagggaatgtcgcgccacccacctgctcctgacatccccacattctatcctctgtctcctggcggtgtgggacaaatcactcctcccttgggttggcaaggccaaccggtttatcccatcacggggggatttaggcagccataccctagctccctgtccgtggataccagtatgagtaggtttagtcaccacatgattccaggtcctcccgggcctcataccacgggtattccccatccagccattgttaccccgcaggtgaagcaggaacatccccataccgatagcgacctgatgcatgtaaagcctcagcacgaacagcggaaggaacaggaaccgaaaaggccccatattaaaaaaccactgaacgcctttatgttatatatgaaagagatgagggccaacgttgtggctgagtgcacccttaaggaaagtgccgccatcaaccagatcctggggcgccggtggcacgcattgagtcgcgaggagcaggccaagtattacgagcttgctaggaaggaaagacaactgcacatgcagttataccctgggtggtcagctagggacaactacgggaagaaaaagaagcggaagagagaaaagttgcaagagagcgcttctggaacaggcccacggatgacagctgcatacatttag

SEQ ID NO: 15831 - DNA, 1161 bp, Artificial Sequence
  Description of Artificial Sequence: Synthetic coding sequence
atgccccagctgtctggcggaggggggggcggagggggggaccctgaactgtgcgctaccgatgaaatgatcccctttaaggacgaaggggacccgcagaaagaaaagatctttgcagagatcagccacccggaggaggaaggggacctagcggacataaaatcctcccttgttaatgaaagtgagatcatccctgcctcaaatgggcacgaggtggcgagacaggctcagaccagtcaggagccataccacgacaaagctagagagcaccctgatgatggaaagcacccagacggcggcctgtataacaaaggaccctcttactctagttacagcggctatattatgatgcccaatatgaataacgacccctatatgagcaatgggagcctgagcccacccatcccgaggaccagcaacaaagtccctgtggtgcaaccgagccatgccgtgcaccccctcacccccctgattacttacagcgatgagcacttcagtcctggaagtcacccatctcatataccgagcgatgttaattctaaacaaggcatgtcaaggcatccccccgctcccgacatcccgacgttctaccccctgtctcccggtggcgtcgggcagatcacaccacctctggggtggttcagtcatcatatgattccaggcccgccagggcctcacaccaccggcattcctcatccagccattgtcacccctcaggtcaaacaagagcacccccacactgatagtgacctgatgcacgtgaagcctcagcatgaacagcggaaggagcaagagcccaagaggcctcatatcaagaaacctctgaatgcatttatgctttatatgaaagagatgagagctaatgtcgttgcagaatgcaccttaaaggagtccgccgctatcaaccagatactgggtcgcagatggcacgctctttcccgggaagagcaagccaaatattacgagctggcacgaaaagagcgacagctgcatatgcagctgtaccccgggtggagtgccagggacaattatggaaagaaaaaaaagagaaagagagaaaagttgcaggaaagcgcctctgggggcaaacggtcatctttccccacttgcaaagctaaagctgctacgcctggcccacttctggagatggaggcttgctag

SEQ ID NO: 15832 - DNA, 1116 bp, Artificial Sequence
  Description of Artificial Sequence: Synthetic coding sequence
atgccacagctaagtggtgggggtggtggcggagggggtgaccccgaactgtgcgccaccgatgaaatgatcccgtttaaggatgagggggatccacagaaggagaagattttcgccgagatttcccatccggaggaggaaggcgatctcgctgatataaaatcctctcttgtgaacgagtctgaaatcattccggcctccaatggacacgaagtggcacgtcaggcccagacctcccaagaaccttatcacgacaaagcccgggagcacccggacgacggcaagcatccagacggcggactttataataagggcccttcctactcatcatacagtgggtatataatgatgccgaatatgaacaatgacccatacatgtctaatggctcccttagcccccccatacctaggacatccaacaaagtcccggtcgtgcaaccgtctcacgctgtgcacccattgacgcccctgattacttactctgacgaacatttttctcccggtagtcaccccagccacatcccatctgacgtaaacagtaaacagggcatgagcaggcatccccccgccccagacatccccacgttctaccccttgtcaccgggcggtgtgggacaaatcaccccccctctggggtggttcagtcaccatatgattccaggcccgccaggcccccacacaactgggatccctcaccctgcaatcgtgactccacaggttaaacaagaacacccccacacggattccgatctcatgcatgttaaaccccagcatgagcagcggaaggagcaggaacccaagcgtccccatattaagaaacctcttaatgcctttatgctgtacatgaaagagatgagggctaacgttgtcgctgagtgtacattaaaggagtccgccgctattaatcagatactcggtagacgatggcacgctctctccagggaagagcaggcaaagtattatgaactggcgagaaaggaacggcagctccacatgcaactgtacccagggtggtctgcacgcgacaactatggcaaaaagaaaaagaggaagcgtgaaaaactgcaagagagtgcctctgggacaggcccaagaatgaccgcagcatatatatag

SEQ ID NO: 15833 - DNA, 912 bp, Artificial Sequence
  Description of Artificial Sequence: Synthetic coding sequence
atggcagaggtggcccgacaggctcagacatctcaggaaccgtaccacgataaggcacgagaacacccagatgacgggaaacaccccgacgggggcctgtacaacaagggaccctcatacagttcctacagcggctatatcatgatgcccaacatgaataatgacccatatatgagcaacggctccttgtctcccccaatacctcgcaccagtaataaagtaccggtagtgcagcctagccacgctgtacatcctctgaccccactgataacttattcggacgagcatttcagccctggatctcatccctcacacattccaagcgatgtcaatagcaagcagggcatgagtcgacacccgcctgcacccgacataccaactttttaccctctgagccccggtggggtcggacagattaccccccccctgggttggttctcccatcacatgattccgggaccaccggggccacacaccactggaatcccccatcctgctatcgtgactccccaggtaaagcaggaacaccctcacaccgattcggatctgatgcacgtgaaaccccaacatgagcagaggaaagaacaggaaccaaaacgcccccatatcaagaaacccctcaacgctttcatgctgtacatgaaggagatgcgggcaaacgttgtggcagaatgcaccctaaaagagagcgcagccatcaaccagattttgggccggcgctggcacgctctcagcagggaagagcaggccaaatattacgagttagcccggaaggagcgccagctgcatatgcagttatacccaggatggagcgccagagacaattatggtaaaaaaaagaaaaggaaaagggaaaaactgcaggaaagcgcctctggcacaggtcccagaatgaccgctgcctacatatag

SEQ ID NO: 15834 - DNA, 1500 bp, Artificial Sequence
  Description of Artificial Sequence: Synthetic coding sequence
atgaatgacgaccccagcatggaggagaacggggtggagcgagtttgtcctgagagtttgctacagtccagagaatactcctcgttgcctctacctagacacacctctagtacagatggaacgattacttcatccgatcccgggttagagatccttaatatggcgagttgcgatctggaccgaaatagtctctgcaagaaggaagaggataccaggtccgccagccccactatcgaagcacagggcacttcaccagctcacgataacattgcattccaggactctacaagcaaggacaaaacaatacttaacttagaggctaaggaagaacccgagaccatcgaggagcacaaaaaggagcacgcttctggggacagtgtggtttcccccctgccggttaccactgtaaagtcagtgaacctgcgccagagtgaaaatacctccgccaacgaaaaggaggtggaagccgaattccttagactgagtcttgggtttaaatgcgattggtttacgctggagaagcgtgtgaagctggaggagagaagcagagacttagccgaggagaatctgaaaaaagagatcactaactgcctgaaattgctggaaagtctgacccccttgtgcgaggatgacaaccaagcacaggagatcatcaagaaactcgagaagagcatcaaattcctaagtcagtgcgccgccagggtggccagcagggcggagatgttaggagctattaatcaggagtctagagtcagcaaagcagttgaggtgatgatccagcatgtggaaaatctcaaaagaatgtacgccaaggaacacgccgagctagaggagctcaaacaggtgctgcttcagaatgagcggagctttaatcccctggaggacgatgacgattgtcagatcaaaaagcggtctgctagcctcaactccaaaccttcgagcttgcgtcgggtgacaattgctagcctccctcgtaacattggtaatgcagggatggttgcgggtatggaaaataacgacaggttctcaaggcggtctagcagctggcgaattctaggcagcaagcagagcgagcatagaccctctctcccccggttcatttcaacatacagttgggctgatgccgaagaggagaaatgtgaactgaaaacaaaagacgactcagagcctagtggtgaggagaccgtcgaaagaacccgaaaaccttccttgagcgaaaagaaaaacaacccctccaagtgggatgtgagttctgtgtatgacacgatcgcttcttgggctacgaatctgaaaagttctattagaaaggcaaataaagctctttggttatctattgcctttatcgtgctatttgccgcactgatgtcttttctgaccgggcagctcttccaaaagtcggtcgatgcagctccaacccaacaagaggatagctggaccagtctcgaacatatcctgtggccgtttacaaggctgaggcataacgggccaccacccgtttag

SEQ ID NO: 15835 - DNA, 1500 bp, Artificial Sequence
  Description of Artificial Sequence: Synthetic coding sequence
atgaacgatgaccccagcatggaagagaatggcgtggagagggtgtgccctgaatctttactccagagccgggagtactcaagcctgccccttcctcgccatacttccagtaccgacggcaccattacttccagcgatcctggcctcgagatcctcaacatggcgagctgcgatttggaccgcaattctctctgcaagaaggaggaagatactcgctccgcatccccaactatcgaggcacagggtaccagcccagctcacgacaatattgcattccaggacagcacttcaaaggataaaacaattctgaatctggaggctaaggaagagcccgagactattgaagagcacaagaaggagcacgctagcggagactccgtcgtcagtccactacctgtcactaccgtgaagagcgtcaatcttcgacagagcgaaaataccagtgcaaacgagaaagaggtggaggccgaattcctccgactgtccttagggttcaagtgtgactggttcaccctggagaagcgggtcaaactcgaagaaagatctagagatttggcagaggagaatctgaagaaagagattacaaattgtcttaagctattggagagcctcaccccactatgtgaagatgacaaccaagctcaggagattatcaaaaagctggaaaagtccataaaattcctgtcccagtgtgccgcaagggtggcttcccgggccgagatgctgggagctattaatcaggaaagccgtgttagcaaggccgtggaggtgatgatccagcatgtggaaaacctcaaacgcatgtacgccaaagagcacgcagaactggaagaattgaagcaggttttacttcaaaatgagagaagttttaatcccttggaggacgatgatgactgccagataaagaagcgcagcgcctctctgaactctaaacctagttccctgcgaagagttaccatcgccagtttacccagaaatataggcaatgcaggaatggttgctggaatggagaacaatgatcggttctcccggagatcatcttcatggagaatcttgggaagcaaacaaagtgaacataggccatctcttccacgattcatatcgacctattcttgggccgatgctgaagaggagaaatgcgagctgaaaactaaggatgatagtgagccgagcggagaggagaccgtcgagcgtacgcgaaaaccaagtctcagcgagaaaaagaataatccttcaaaatgggacgtgtcttctgtatacgacactattgcttcctgggccacgaacctaaagagcagtatacgaaaagccaacaaggccctatggctgagtattgcattcatcgtgctgttcgccgcactcatgtcatttctgacggggcaattgttccagaaatctgtggacgccgctccaactcagcaagaagattcgtggactagtctcgaacacatactctggccatttactaggttgcgccataatggaccaccccccgtatag

SEQ ID NO: 15836 - DNA, 1500 bp, Artificial Sequence
  Description of Artificial Sequence: Synthetic coding sequence
atgaacgatgatcctagtatggaagagaacggggtggagcgggtgtgtccagagagtctgctacagagcagggagtacagcagcctgccattgcctagacacacatcaagcactgacgggaccataacaagttcggacccaggccttgaaattttgaatatggcctcgtgcgatttggacagaaatagcctgtgcaaaaaggaggaggatactcggagcgcctcgcccacaatcgaagctcagggaaccagcccggcccacgataatatcgcattccaggactccacttcgaaggacaaaacaatccttaacctggaggcgaaagaagagcctgaaacaatcgaggagcacaaaaaagagcatgcgtcaggagacagtgtggtcagtccactaccagtgacgactgtcaaatccgtcaacctgcgccagagcgagaacacaagtgccaacgaaaaggaagtggaggctgagtttctgaggctgtccctgggattcaaatgcgactggttcaccctagagaagcgggttaagctggaggagcgatcacgagacctggcggaagaaaaccttaagaaggagatcactaattgtctaaaattattggaatcactgacccccctgtgtgaggacgacaatcaggctcaggagataataaagaaactcgaaaagtcaatcaagttcttgagccaatgcgccgcacgtgtggccagtagggcagaaatgttgggcgccattaatcaggagtcacgcgtatcaaaagcagtcgaagtcatgatccagcacgtcgagaaccttaagcgcatgtatgcaaaggaacacgctgagctcgaagagttgaagcaggtgctgctccagaacgaacgcagcttcaatccgctggaggatgacgatgactgtcagatcaaaaaacgctccgctagcttaaattcaaagccttcctccttaagacgtgtgaccatcgcctccctcccgcggaacatcggaaacgcaggaatggtggcagggatggaaaataatgataggttctcacgcagatctagctcttggcgcatcctgggaagcaaacaaagtgagcaccggccttcactgccccgcttcatcagtacttattcatgggcagacgcggaggaagaaaaatgcgagctgaagacaaaagatgatagtgagcccagcggggaggaaaccgttgaaagaacccgtaagcccagtttgagtgagaagaagaataatccctctaagtgggacgtaagctcagtttacgacacaatcgcaagctgggcgacgaacctgaagtcaagcattcgtaaagctaataaagccctctggttgagcatcgcctttatagtgctgtttgccgcactaatgtccttcttaaccgggcaattgttccaaaagtctgtggacgcagctcccacccagcaggaggactcatggacaagcctcgagcatatcctgtggccttttacccggctgaggcataacggacctcccccagtgtag

SEQ ID NO: 15837 - DNA, 234 bp, Artificial Sequence
  Description of Artificial Sequence: Synthetic coding sequence
atgaacgatgacccctccatggaggagaatggcgtggagagagtgtgccctgaatctctcctgcagtccagggaatactcttcactgccactgcccaggcataccagctccacagacggcacaatcacctcttctgatccgggactcgagatcctcaacatggccagttgtgatctggataggaatagcctatgtaagaaagaagaggacactagatccgcctcacccacatag

SEQ ID NO: 15838 - DNA, 27 bp, Artificial Sequence
  Description of Artificial Sequence: Synthetic coding sequence
atgaacgatgaccctagtatggagtag

SEQ ID NO: 15839 - DNA, 618 bp, Artificial Sequence
  Description of Artificial Sequence: Synthetic coding sequence
atgacccccccagaacgcctgttcctgccaagggttcggggaactaccttgcacttgctgctgttgggcctgcttctagtactgctgcccggagcccagggtctgccaggggtgggtctaaccccctcggcagcacagactgcaagacaacatccaaagatgcaccttgcacacagcaccctgaaacctgctgcacacctcataggagacccctctaagcagaactccctgctatggagggcaaacacagatcgcgcctttcttcaggacggattttcactgtcaaataattctcttctggtgccaaccagcggcatatacttcgtgtacagccaggtggtgtttagcggcaaggcatacagtcctaaagctactagttctcctttatatctcgcccatgaggtccagctgttttccagccagtatccttttcacgttccattgctgagcagtcagaagatggtgtaccccggactccaggagccttggctccactcgatgtatcacggggctgcattccagttgactcagggcgatcagctgtctacacatacagacggaattccacacttagttctgagtccatcgacagtattttttggggcttttgcgctctag

SEQ ID NO: 15840 - DNA, 618 bp, Artificial Sequence
  Description of Artificial Sequence: Synthetic coding sequence
atgaccccacccgagcggctattcctgcccagagtgcgcgggaccacattgcacctcctgctgctgggcttactgctcgttcttctgcccggcgcccaggggctgcccggagtgggcctgaccccctctgccgcacagaccgcacggcagcaccccaagatgcacctggctcatagtacgcttaaacctgcggcacatctcattggcgatcctagtaagcagaattccttgctttggagagccaatacagaccgagccttcctgcaggatggcttttcattgtcaaataattccctcctggtgcctacctccggcatttatttcgtgtatagccaggttgtgttttccggaaaagcctattctcccaaagccacgtctagcccgctctatttagcccatgaggtgcaattgttctcctctcaatatccctttcatgtgcctcttctgtcatctcagaagatggtctacccaggtttgcaggagccatggctgcattcaatgtatcacggcgccgctttccagttaactcaaggagaccagctgagtacacatactgatggcataccccatctggttctgtcaccatccacagtgttctttggcgctttcgcgctatag

SEQ ID NO: 15841 - DNA, 417 bp, Artificial Sequence
  Description of Artificial Sequence: Synthetic coding sequence
atgactcctccagaaaggctgtttctccccagagtgcgaggcactacactgcacctgttactcctcggcctgctactggtcctactgccaggtgcccagggattgccaggagttggacttactccctctgccgctcagaccgctcgccaacatcccaagatgcacctggcccattccaccctgaaacctgctgctcatctgattggggatccctctaagcagaactcgctgctatggcgggcgaacactgatcgcgcctttctgcaggacggcttctctctttccaacaattccctgcttgtacctacctctgggatctattttgtgtattcgcaagggtccagtccacctctattgtggccttttcagcagctgaaatctagtttgattaagtccccagaactgagcaagaagtag

SEQ ID NO: 15842 - DNA, 2010 bp, Artificial Sequence
  Description of Artificial Sequence: Synthetic coding sequence
atggagggtaacaagttagaggaacaggattctagcccaccgcagagtaccccaggccttatgaaagggaataaaagagaggaacagggactgggcccagaaccagccgctcctcagcaaccgactgcagaggaagaggccttaattgagttccatagatcgtatagggagttattcgaatttttttgtaacaacactactattcacggggccatacgcttagtttgtagccaacacaacagaatgaagaccgcgttttgggctgttctgtggctttgcaccttcggaatgatgtattggcaatttggtctgctgtttggagaatacttttcttatccagtgtccctaaatattaatctgaactccgacaagctggtttttcccgccgtcactatttgcaccctgaatccataccggtaccctgaaattaaagaagagctagaagagctggacaggatcactgagcaaacactttttgatctgtacaagtatagctccttcactacattagtggctggttctaggtcccggcgagatcttcggggcacgttgcctcacccactccagagattaagagtgcccccccccccccacggtgcgcgaagagctaggagcgttgctagcagtctccgtgacaacaatccgcaggttgactggaaagattggaaaatcggatttcagttgtgcaaccagaacaagtccgactgtttctaccagacttattctagtggcgttgacgcagtgagagaatggtaccgcttccattacataaatatactctctcggttacctgaaaccctgccttctctcgaggaagacactcttgggaattttatcttcgcctgccggttcaaccaggtctcctgcaaccaggctaattactcacactttcatcatcctatgtacggcaactgttacaccttcaacgacaagaataattcaaacttatggatgagctcaatgcctggaatcaacaatggcctttctctgatgctcagagctgagcaaaacgacttcatccccttactttctacggtcacaggggctagggtgatggtgcacggtcaagatgagcccgcatttatggacgatgggggtttcaacctacgtccgggcgtggagacgagtattagtatgaggaaggagaccctggatcggctgggtggagactacggagactgtaccaagaacgggagtgatgtgccagtggagaatctgtacccttctaaatatacccagcaggtctgtatccacagctgttttcaggagtctatgattaaagagtgcggttgtgcttacatcttctatccgaggccacagaacgtcgagtactgtgactaccgcaagcactcgtcgtggggctattgctattacaaactgcaggtcgatttcagttccgaccatttgggatgttttactaaatgcaggaaaccttgctctgttacaagttatcagctctctgctggatactcaagatggccctcagtcacttctcaggagtgggtgttccagatgttgtcccgacagaacaactatacagtgaacaataagaggaatggagtggccaaggtgaatattttcttcaaggaactcaactacaaaacaaactctgagtctccttccgtaacaatggtgactctgctaagtaatttgggctcccagtggagcctttggttcggcagctccgtgttaagcgtagtggaaatggcggagctggtcttcgatttactggttataatgttccttatgctcttgagaaggtttagatctcggtactggtctccagggagaggggggcgcggcgcgcaggaggtcgcttccaccctggccagtagcccccctagccatttttgtcctcatccaatgtcgctatcactgtcacaaccaggaccagccccctctcctgccctcaccgctcccccccccgcttacgcgaccctggggcctaggccctccccaggcggatccgctggcgcctcatcaagtacttgcccccttggggggccatag

SEQ ID NO: 15843 - DNA, 987 bp, Artificial Sequence
  Description of Artificial Sequence: Synthetic coding sequence
atgggccttgaggagatagcaccttgtacttccaaacgcaaaacgcagtgtagatgtcagcctgggatgttctgcgccgcgtgggcgctggagtgtacccattgcgagcttctatccgattgtcctcctgggacagaagccgaattgaaggacgaggtgggcaagggaaataatcattgcgtcccctgcaaggccggccacttccaaaacacatcctcccctagtgctcgttgccaacctcataccagatgtgagaatcaggggcttgtcgaggcagcccctggaacagcacaatcggacaccacctgcaaaaatccgctcgagccccttccacccgagatgtcagggactatgctgatgctcgcagtgcttctgcctctagcgttcttcctcctgctggcaacggtgttttcatgtatctggaaatcacacccctctttatgcaggaagcttggaagtctgctgaaaagaaggccccaaggggaggggcctaacccagtggccgggagctgggagccccccaaagcccacccttatttccctgacctagtgcagccactgctgcccatctccggcgacgtgagtcctgtcagcaccggtcttccggccgcaccggtcctggaagctggggtgccccagcaacaaagccctctcgacttaacgcgagaacctcagcttgaacccggggaacaatctcaagtggcccatgggaccaatgggatccacgtcacaggcgggtcgatgacaattaccggcaacatatacatatacaacggaccagtgctgggtgggccgcctggtcccggagacctccccgccacaccggaaccaccgtaccctataccggaagagggcgacccagggccaccagggctctccacgccccatcaggaagacggcaaggcctggcacctggccgaaactgaacactgtggggcgactcccagcaatcgcggacctcgcaatcaattcattacacatgactag

SEQ ID NO: 15844 - DNA, 1725 bp, Artificial Sequence
  Description of Artificial Sequence: Synthetic coding sequence
atggcgctggcaagaggcagtcggcaactgggagccctggtttggggtgcttgtctgtgtgtgttagtgcacggccaacaagcacaacccggccaaggctccgatcccgcgcgatggcgacagctgatccagtgggaaaacaacggacaggtgtatagtttactgaattctggatccgagtatgtgcccgctggcccccagcggtcagaatctagttcccgcgtactgttggccggggctccacaagctcaacagaggcgatcacatgggagtccccgcaggagacaggcaccatccctacccctgcccggtcgggtcggcagcgatacagtaaggggacaagccagacaccccttcggatttgggcaagtacctgacaattggcgcgaagttgccgtcggagacagcaccggcatggcccgcgcccgtacaagtgtgtcacaacagagacacggcggctctgcttcatccgtgtctgcgtcggccttcgcaagtacctaccggcagcagccatcatacccccagcagtttccatatccccaggcacctttcgttagccagtatgagaattatgacccagcttcccggacatacgaccagggcttcgtttactatcggcccgccggcggaggggttggagcaggggccgccgccgtagcctctgctggagttatatacccctaccagcctagagcccggtacgaagagtacggaggtggcgaggagctccccgaataccccccccaggggttttatcctgcgcctgaaagaccgtatgtaccgccgcccccacctccgcctgacgggttggataggagatactcccattctctctatagcgagggaacccccgggtttgagcaggcatatcctgatccagggccagaagccgcccaggctcacggaggtgatccgagattgggatggtacccaccatacgccaacccaccacctgaggcttacgggccgccaagagccctggagccaccttacctgcctgttcgcagcagcgacacccctccacctgggggagaacggaacggggctcagcaaggccgccttagtgttgggagtgtttacaggccaaaccaaaacgggaggggtctccctgatctggttcctgatccaaattatgtgcaggcctctacgtatgtgcagagagctcacctatactctctccgatgcgcggctgaggagaagtgcctagccagcaccgcctatgctccggaagcaactgactacgacgtgcgggtactgctgagatttcctcagagagtgaagaatcagggtacagccgattttctgccaaacagaccacgtcacacatgggagtggcatagctgtcaccagcattatcacagtatggacgagttcagccattacgacctccttgatgccgctactggaaaaaaggtcgccgaaggccacaaagcaagcttttgtcttgaagacagtacatgtgacttcggcaacctaaaacggtatgcttgcacctctcatacacagggccttagtcccggatgctacgacacctataacgccgacattgattgccagtggatagatatcaccgacgtccagcccggaaattacatcctgaaggtccatgtgaatcctaagtatatcgtcctcgaatcagattttacaaacaacgtcgtgcgttgtaacatccattacactgggcggtatgtcagcgccaccaactgtaagattgtgcaatcctag

SEQ ID NO: 15845 - DNA, 1311 bp, Artificial Sequence
  Description of Artificial Sequence: Synthetic coding sequence
atggctagggctcgaacatcagtctcccagcagcggcacggcggaagcgcttcatccgtctctgcctcagcattcgcttccacctataggcagcagccatcttaccctcagcagttcccatacccacaagccccctttgtgagccagtatgaaaattacgaccctgcaagccgcacatatgaccagggttttgtgtattatcgccccgccgggggaggggtgggcgcaggagcagctgcagttgcctctgccggagtgatctacccatatcaaccacgcgcccgttacgaggaatatgggggaggcgaagaattacccgagtatcccccgcagggcttctaccccgctcccgaacggccctacgtacccccaccacctcccccacctgatggcctcgataggcggtacagccattccctgtacagtgaagggacacccgggttcgaacaggcctatccagaccccgggcctgaggccgcacaggcccacggcggtgacccgcgcttaggctggtatcctccatacgcaaacccacctcccgaggcttacgggccccctagagcgcttgagcctccctacctcccggtgcggagctccgataccccaccccccgggggggaacgtaacggggcgcagcagggcaggctctctgtgggcagtgtttaccgcccaaaccagaatgggcgcgggctccccgacctggtcccggatccgaactatgtgcaagcctccacctacgtgcagagagcgcacctgtactcactgagatgtgccgcggaggagaagtgcctcgcatccaccgcttatgctcctgaggctactgactatgatgtgcgggtgctcctccgcttcccgcagagggtgaagaatcaaggcactgctgattttctgccaaatcgaccacgacatacctgggagtggcactcatgtcaccagcactatcatagtatggacgagttctctcactatgacctgctggacgctgctactgggaaaaaagtggcagagggccacaaggcctcattttgccttgaagattccacctgcgacttcgggaatctgaaacgctacgcatgtacatcccatacccagggcctttcgcctggttgctatgacacatataacgcggacattgattgtcagtggatcgatatcaccgatgtccagcccggaaactacattctgaaggtgcatgtgaaccccaaatacattgttctggagtcggattttacaaacaacgtggtgcggtgcaatatccactataccggacggtacgtgagtgcaacaaattgcaagattgtgcagtcatag

SEQ ID NO: 15846 - DNA, 636 bp, Artificial Sequence
  Description of Artificial Sequence: Synthetic coding sequence
atgaccacattaacacggcaggacctgaactttgggcaagtagtggccgacgtcctgtgtgaattcctggaagtggcagtgcacctgattctgtacgttcgcgaagtttacccggttggaatcttccaaaagcggaagaagtataatgttcctgtccagatgtcttgccatcccgaactcaatcagtatatacaagacactctccactgcgtcaagcctctcctggagaaaaacgacgtagagaaggtggttgtggtgattcttgacaaggagcatagacctgtagagaaattcgtgtttgagatcacccagcctcccctgttatctattagctccgacagcctgctgtcccatgtggagcaactcttgagggccttcatccttaaaatctctgtttgtgatgctgtgctagatcacaacccacccggttgtacattcacagttctggtccacaccagagaagccgccacccggaacatggagaaaatccaggttattaaagactttccttggatcttggccgatgagcaggatgtgcacatgcatgacccgcggctgatacccctcaagactatgaccagtgatatcttgaagatgcagctgtacgtcgaggaacgggctcataagggctcttag

SEQ ID NO: 15847 - DNA, 318 bp, Artificial Sequence
  Description of Artificial Sequence: Synthetic coding sequence
atgactacgctgaccaggcaggacctgaattttgggcaggtcgttgccgacgtactgtgtgaatttctggaggttgctgtgcatcttattctttacgtcagggaggtctatccagtgggaattttccagaagcgcaagaagtataacgtcccagtccagatgagctgtcatcctgagcttaaccagtacatccaggacacgctgcactgcgtgaagcctttgttagagaaggttcgcgtccattgggctccgcaacctagtcaccccatgctaaccccggtccctgtatgcagccagagcaactccgggatgggatag

SEQ ID NO: 15848 - DNA, 531 bp, Artificial Sequence
  Description of Artificial Sequence: Synthetic coding sequence
atgacaacccttacaaggcaggaccttaatttcggacaggttgtggctgatgtcctgtgcgagtttctagaagtagccgtgcaccttattctgtacgtccgcgaggtataccctgtggggatatttcagaagcggaaaaagtacaatgtgcctgttcagaacgatgtcgaaaaggtcgtagtcgtcatactagacaaggaacacagacctgtcgagaaattcgtattcgaaatcacacagcctccactgctttcaatcagctcagatagccttcttagccatgtagagcagctgcttagagctttcatactgaaaatttccgtgtgtgatgcagtcctggatcacaacccccctggtgtgagcaccccacaccccctcttcccctggcacttccatgggtatctgggcttagtgtgcgttccacgcagcatgttcggctgttcagaaactcacctgtttctgacactccgggtgcatctcctgtgggaagcatccctgatcgatagcacatggctcccttctccctactag

SEQ ID NO: 15849 - DNA, 636 bp, Artificial Sequence
  Description of Artificial Sequence: Synthetic coding sequence
atgactactctaactcggcaggatcttaatttcggccaggtggtcgccgacgtcttgtgtgaattccttgaagtagcagtacacctgatactgtatgtgcgtgaggtctaccctgtcgggattttccagaaacgcaagaagtataatgtgcccgtacaaatgtcatgccaccctgagctgaatcagtatatacaggacacactccattgtgtgaaaccccttctggagaaaaacgatgtggagaaagtggtggttgtgattctagataaggagcaccgccccgtggagaaatttgtgttcgaaattacccagccgcctctgctgtccataagcagcgactccctcctatcacacgtggaacagctacttagagctttcattctcaagattagtgtttgcgacgcagtactagatcacaatcctcccggctgcacctttacagtcttagtccatacccgggaggctgccacaagaaatatggagaagatccaggtcattaaggatttcccatggatactggccgacgagcaggatgtgcacatgcatgatcctaggttgattcccctcaagacgatgaccagcgacatcctgaagatgcagctgtacgtcgaagaacgggcgcacaagggctcttag

SEQ ID NO: 15850 - DNA, 675 bp, Artificial Sequence
  Description of Artificial Sequence: Synthetic coding sequence
atgacgacactcacacgccaggatctgaattttgggcaggtggtcgcggatgttttatgcgaatttctggaagtggccgtgcacctaatcctgtacgtcagagaagtgtaccccgtggggattttccagaagcgcaagaagtacaatgtgcccgtacaaatgagctgtcacccagaactgaatcaatatatccaagatactctgcactgcgtgaagcctctcctggagaaaaatgatgtagaaaaagtggtcgtggtaatcctggataaggagcacagaccggttgagaagttcgtcttcgagattacccagccgccgctgttgtccatacgatgggcagcccctgcacctcgtccgcttgcggggataagctcagacagcctcctaagccacgttgagcaactgctgagagcattcatcctgaaaatcagtgtctgtgatgccgtcctggaccataatccaccaggatgcaccttcacagtactggttcacacgcgcgaggccgccacacggaatatggagaaaattcaggtgattaaagatttcccgtggatcctcgccgatgagcaggacgttcatatgcacgatcctcggttgatacccctcaagacaatgacctctgacatcctaaaaatgcagttgtacgtggaggagagggcccataaagggtcctag

SEQ ID NO: 15851 - DNA, 675 bp, Artificial Sequence
  Description of Artificial Sequence: Synthetic coding sequence
atgaccaccctcaccaggcaggaccttaactttgggcaggtggttgcagacgtgctatgcgagttcctggaagtggctgtccacctgatcctctacgtgagggaggtgtaccccgttggcatctttcagaaacgcaagaagtacaacgtgccggtgcagatgtcatgtcaccctgagctgaatcagtatatccaggacaccttacactgtgtgaagcccctactggaaaagaatgacgtcgaaaaggtggtggtcgtgatactagacaaagaacatcgcccggttgagaaatttgtctttgagataactcagcctccactgctcagcatcaggtgggcagcccctgccccaaggcccctcgctggcatatcctcagattcgctgctctcacacgtcgagcagctgcttagggcctttattctgaaaatctccgtgtgcgatgcagtactggatcacaatccaccgggctgcacatttaccgtcctggtccacactcgggaggccgccactagaaacatggaaaagatccaggtcataaaggacttcccctggatactggcagacgagcaggacgtgcacatgcatgacccacggctaattccactgaaaacaatgacaagcgacattcttaagatgcagctgtacgtggaggagcgggcacacaagggaagttag

SEQ ID NO: 15852 - DNA, 636 bp, Artificial Sequence
  Description of Artificial Sequence: Synthetic coding sequence
atgacaacgctgacccgtcaggacctgaacttcgggcaggttgtcgctgacgtgttgtgtgagtttctggaggtggcagtccacttgattctgtatgtaagagaagtgtatccagtcgggattttccaaaagcgaaagaagtacaacgtcccagtacaaatgagctgccaccccgaactaaatcagtacattcaggacacactccattgcgtgaagcctctgctggagaagaacgatgtagaaaaagttgtcgtagtcattctcgacaaagagcaccggccagtggagaaatttgtgtttgaaatcactcagccccctcttttaagcatctcttccgattctctgctctcccacgtggaacaactactgcgggcctttatccttaagatttctgtgtgcgacgcggtactcgatcacaatccaccgggttgcacctttactgtactcgtgcataccagagaagctgctacccgcaacatggagaagatccaggtaatcaaagattttccttggatccttgctgacgaacaagatgtccacatgcatgaccctcgattaatcccgcttaaaaccatgacttccgacatcctgaagatgcaactgtatgtcgaggaacgcgcccacaagggtagttag

SEQ ID NO: 15853 - DNA, 597 bp, Artificial Sequence
  Description of Artificial Sequence: Synthetic coding sequence
atgaccaccctgacaagacaagatttaaatttcggtcaagggcgcgaagccggtcctgccggcccaggggccggggctagcggaccagccggcttcttagagcgcgcaaccgggctgtgtccccccgccgtggtggccgacgtactctgtgaatttctggaggtagccgtgcacttgatcctatacgttcgagaagtgtatcccgtgggtatttttcagaaacggaaaaagtataatgtgcccgtccaaatgtcttgtcatccagaactgaaccaatatatccaagatacactgcactgcgtcaagcccctccttgagaagaacgacgtcgagaaggtggtggttgtgattctggacaaagaacaccgtcctgttgagaagttcgtctttgaaatcacccagccacccctgttgtcaattagctctgactcactgctgtctcacgtggagcagcttctgcgagcctttattctcaagatctccgtttgtgatgccgtcctggaccacaatcctcccggctgcacgttcaccgtgcttgttcacacaagagaggccgctacgcgcaacatggagaaaatccaggtaatcaaagtttag

SEQ ID NO: 15854 - DNA, 504 bp, Artificial Sequence
  Description of Artificial Sequence: Synthetic coding sequence
atgacaacattaacccgtcaagatctgaacttcggccaggtggtggctgatgtgttatgcgaatttctggaggtcgctgtccacctgattttatatgtcagagaggtatatcccgtggggatattccagaagagaaagaagtacaacgtgccagtgcaaatgtcctgccatcctgaacttaaccagtatattcaggatactctgcactgcgtgaagccgctgttagagaagaacgatgtggagaaagtcgtggttgtgattttggataaggaacatcgacccgtcgaaaagttcgtgttcgagatcacacagccacccctactcagcatttcaagtgattccctgttatcacatgtggaacagctgcttcgtgcattcatcctgaaaatttcagtgtgcgatgctgttctggatcataacccacctggttgcacttttactgtgctggtacatactagggaggccgccacaaggaacatggagaagatacaggtaatcaaatag

SEQ ID NO: 15855 - DNA, 3159 bp, Artificial Sequence
  Description of Artificial Sequence: Synthetic coding sequence
atggcaggaatggactctggcaatctaaagaccgcccggctgtggcgggatgccgctcttcgggctcgcaagctgcggagcaatctccgccaactgacgttgacagcagccggagcttgtcccggggccggagccgatgcgctggaatccccagcttctccacagcttgtacttccagccaatttaggagacatcgaggccctgaacctgggaaacaatgggctggaggaggtgcccgaaggcctggggtccgctctagggagcttaagggtcctggtgctcagacgcaatcgcttcgcgaggctcccccccgccgtagcagagctcgggcaccacctgacagagctagatgtgtctcacaacaggctgaccgccctgggtgccgaggtagtctctgctctgagagagttgcgtaaactcaatctcagccataatcaactgccagccctccctgcccagctaggggctctcgcccatcttgaggagctggatgtcagctttaaccggttggcacacttgccagatagcctctcttgcctctctcgtctcagaactctagacgtggaccataaccagctgactgctttcccccgccagttgttacagctcgtggcactggaagagctggacgtatcttctaatagactgcgggggcttccagaagatatctctgcgctgcgtgcacttaaaatcctatggctgagcggagccgagctgggcacactgccagctgggttctgcgagctcgccagccttgagtcactgatgctggacaataatgggcttcaggcactgccagctcagttctcttgcctgcagcggttgaaaatgttgaatctcagttctaacctgttcgaggaatttcctgctgcactactcccactggccggcctggaagaactgtacctaagtagaaaccagctgacttccgtcccctctctgattagtggcctcggcaggctgctgaccctgtggctagacaacaacaggattagatatcttcccgattccattgtggaactgacgggtctggaagagctggtcctccagggcaatcagatcgctgtcctccccgaccatttcgggcagctaagccgggtagggctgtggaagatcaaagacaatcctctgattcagcccccctatgaggtttgtatgaagggcatcccatacatcgctgcctaccagaaagagttggcgcacagccagcctgcagtgcaacctagactgaaattgctcctcatgggacataaggcagctgggaaaactctactgagacattgtctgaccgaggagagagtagaaggatgccctggaggaggggataaagagaaatgttatcccccttcaccaccccccgtttcaaagggaattgaggtgacctcgtggacagcagacgcaagcagaggtctgcgcttcattgtgtacgatctggccggtgacgagagctatgaagtaattcagcctttcttcctctccccaggagcattgtatgtgttagtcgtgaatttggcgacgtacgagccaaggcatttcccaacgacagtcggctccttcttacaccgagtgggggcccgcgtccctcatgctgtggtgtgcattgtaggcacccatgctgatttatgcggggagcgggaactagaagagaagtgcctcgacatccacaggcagatagctttgcaggaaaaacacgacgcagaaggcctctcacggctagccaaggtagttgatgaagccctggcccgcgactttgagctgcgctccgcttcgccccatgcagcctattacggagtgtccgataagaatcttcgcagacgaaaggcccattttcaatacctgctcaatcataggctacagatcctgtcaccagtcctgcccgtgagctgccgcgatcctcgacacttgcgacggcttagggacaaactgttaagcgtggcagagcatagagagattttcccaaatctccatcgcgtattgccacgatcctggcaggtgctggaagagttacattttcagcccccccaggcacagagattatggctgagctggtgggacagcgcaaggcttggcctgcaagctggactgaccgaggatcgactgcagagtgcccttagttatttgcatgaaagtggaaaactgctctacttcgaagattctccagccctgaaagagcacgtattccataatctcacccgcttgatcgatatcttaaatgtttttttccaacgtgatccgagccttctcctgcataagttgctcttgggcacaagcggggaaggcaaggccgagggcgaaagctccccaccaatggctcgctccaccccatcgcaagagctactgcgagcgacgcagctgcatcaatacgtcgagggcttcctgttgcacggactcctaccggcgcacgtaattcgactgctgctgaaacctcacgtgcaggctcaacaggatctgcagcttttgctcgaactcctggagaaaatgggactgtgctactgcctcaataaacccaaggggaagccgctaaatggctctacagcctggtacaagttcccctgctatgtacaaaatgaggtgccgcatgcagaggcatggattaacggcacgaacctggccggccagagctttgtcgccgaacaactccaaatcgagtactcattcccattcacctttcctctgggattgtttgccagatattccgtgcagatcaactcccatgtcgtccaccggagtgacgggaaatttcagatattcgcttatagggggaaggtgcctgtggtagtgagctaccggccagctagaggcgtacttcagcccgacacactctccatcgcaagccacgcaagtctacccaacatctggactgcttggcaggccatcaccccattagtagaggagcttaatgtgcttcttcaagaatggccagggctgcattacaccgtgcacatcttatgcagcaaatgtctgaagagaggttcccccaacccgcacgccttccccggcgagctgctgtcacagccccgccccgagggcgtggccgagattatctgtccaaaaaatgggtcagagcgagtgaatgtcgcacttgtgtatccaccaacccccactgtgatctctccctgttccaagaaaaacgtgggtgaaaagcaccggaaccagtag

SEQ ID NO: 15856 - DNA, 549 bp, Artificial Sequence
  Description of Artificial Sequence: Synthetic coding sequence
atgggtaaagggcgcttcgacgaaaaggagaatgttagcaactgtattcaattgaaaacttcagtgatcaagggaatcaaaaaccaactgatcgaacagtttcccggtattgagccttggctgaaccaaattatgccgaaaaaagatcctgttaaaatcgtgcgctgtcacgaacacatcgaaattttaaccgtgaacggcgagcttctgtttttccggcaacgggagggaccattttaccctacacttcgtctacttcacaaatatcctttcattctgccacaccagcaagtagataagggagctatcaagttcgtgttatcgggagccaatatcatgtgtcctggtttaaccagtccaggcgccaagctgtacccagcagctgtggacactattgtggcaatcatggcggaaggaaagcaacatgcattgtgcgtgggggttatgaaaatgagtgcggaggacatcgagaaggttaataagggcattgggatcgagaatattcactacctaaatgacgggttatggcatatgaaaacatacaaatag

SEQ ID NO: 15857 - DNA, 546 bp, Artificial Sequence
  Description of Artificial Sequence: Synthetic coding sequence
atgttcaaaaaatttgatgaaaaggaaaatgtgtctaattgtatacaactgaaaaccagtgtgataaagggcatcaagaaccagttaatcgagcagtttcccggaattgagccctggcttaaccagattatgcctaaaaaggatcccgtgaaaatagtccgctgccatgaacatattgagattttgactgtgaatggagagcttctcttcttcaggcagagagaggggcccttctacccaaccctgcgactcttgcacaagtacccgttcattttgccacatcagcaggttgacaaaggcgccatcaaattcgtgctgtcaggggcgaatattatgtgcccggggctcacatcgcctggggctaagctctatcctgctgccgtggacacgatcgtcgccattatggccgaaggcaaacagcatgccttgtgcgtcggtgtgatgaagatgtcagctgaggacattgaaaaggttaataaagggatcgggatcgagaatatccactatctcaacgatggactgtggcacatgaaaacatataagtag

SEQ ID NO: 15858 - DNA, 2226 bp, Artificial Sequence
  Description of Artificial Sequence: Synthetic coding sequence
atggcactctttaccccttggaaattatcaagtcagaaattaggctttttcctcgtgacattcggatttatctgggggatgatgttactgcatttcactattcaacagaggacacagccagagtccagctccatgttgagagagcagattctagacttgtctaagcggtacataaaggccctcgccgaggagaaccgaaacgtggtcgacggcccttatgcaggcgtcatgacagcctacgacctcaaaaaaacactggcggttctcttggataatatcctccagagaattgggaagttagagtcaaaagtagataatctggtggtcaatggtacaggtacaaactccaccaactccaccacagcagtaccttcactggtggcacttgagaaaattaacgtggcagacattatcaacggtgcacaggagaagtgtgtccttcctccgatggatggttatccccactgcgaggggaagatcaagtggatgaaggatatgtggcgcagcgacccctgctacgccgactatggggtagacggctccacttgctctttctttatttacctgtcagaggtcgagaattggtgtcctcatctcccttggagagccaagaacccctatgaagaagctgatcataattcgctcgccgaaattaggactgatttcaacattctgtacagtatgatgaagaagcatgaggaattcaggtggatgagactgagaataagacgaatggccgacgcttggattcaggcaatcaaatcactggccgagaaacagaacttggaaaaacggaaaaggaaaaaggtgctggtgcatctcgggctgctgaccaaggaatcaggatttaagatcgccgagaccgcattctctggaggaccactaggggagcttgtgcaatggtccgaccttatcacatccctctacttgcttggccacgacatcagaattagcgccagtctggccgagttgaaggagatcatgaagaaggttgtgggaaacagaagtggctgcccaacggtcggcgaccggattgtagaactgatctacatcgatattgtgggcttagcccagtttaaaaagacattaggaccttcctgggtccattatcagtgtatgctgcgagttctggatagcttcggcaccgaaccagaattcaatcatgccaactacgcccaaagcaaaggacacaagacaccatggggcaagtggaatctgaaccctcagcagttttacactatgttccctcatacacctgataacagctttctggggttcgtcgttgagcagcatttgaactcatccgacatccaccacattaatgagatcaaacgtcaaaaccagtctttggtgtatgggaaggtggatagcttttggaagaataagaagatctacctggatataatccacacctacatggaagtgcacgctacggtgtacgggagcagcacaaaaaacatcccatcttacgtgaagaatcatggcatcctaagtggcagggatcttcagtttcttctgcgcgagacaaagctgttcgttggtcttggatttccctatgaaggaccagctccccttgaggccattgccaacggatgtgcttttctgaatccaaaatttaatcccccgaaaagcagtaagaatacagactttttcatcgggaagcccactctgcgggaactgacaagccagcatccatatgcagaggtgtttatagggcgcccgcacgtgtggaccgtggatctgaacaaccaggaagaagtggaagatgcagtgaaggcaattttgaatcaaaagatcgaaccctacatgccttatgaattcacatgtgagggcatgttgcagcggattaacgcgtttatagagaaacaggatttctgtcatggacaagtgatgtggccacccctcagcgctctgcaggttaaactggcggagcccggccagagctgcaagcaagtctgccaggagtctcagcttatctgtgagccatctttcttccagcacttgaataaagacaaggatatgttgaagtacaaagtaacatgtcagtccagcgagcttgctaaggacatcctggtgccatcattcgaccctaaaaataaacactgtgttttccagggagatctgctactgttttcctgcgcgggagcccatcctcgccatcagcgtgtctgcccctgccgagattttattaaaggccaggtcgcactgtgtaaagattgcttgtag

SEQ ID NO: 15859 - DNA, 2226 bp, Artificial Sequence
  Description of Artificial Sequence: Synthetic coding sequence
atggctctgttcacaccatggaagttatcgagtcagaaactgggattcttcctagtcactttcggcttcatatggggtatgatgctgctccattttaccattcaacagcgtacacagcctgaaagctcttctatgctgagggaacaaattcttgatctgagtaagcggtacattaaggcgctcgccgaagagaaccgcaacgttgtcgacggaccctacgcgggcgtgatgactgcctacgacctgaaaaaaacccttgcggttctactcgacaacatcctgcaaagaatcgggaagctcgagagtaaagtggataatttggtggtgaacggaaccgggaccaatagtaccaattccacaaccgccgttccatctttggttgctctggagaagataaatgttgctgatataattaacggcgcccaagagaaatgcgtcctccccccaatggatgggtacccacactgtgaaggaaaaattaaatggatgaaggacatgtggcggtcggatccgtgttacgctgattacggcgtggatgggagcacctgcagcttctttatctacctctcagaggtggagaactggtgcccacacctgccttggagagcgaaaaatccttatgaggaggctgatcataacagtctggctgagataaggaccgattttaacatcctgtatagcatgatgaagaagcacgaagagttcaggtggatgagattaaggataaggaggatggcagatgcttggattcaggctatcaagtccttggccgaaaagcagaatttagagaagaggaaaaggaagaaagttcttgtccacctggggctactgacaaaagaatcaggatttaaaatagccgaaactgctttctcagggggcccattgggcgagctggttcagtggtccgatctgatcacatccctctatttgctggggcatgatatccgtatcagcgccagcctcgcagaactcaaagagattatgaagaaggtggttggaaacaggagtggctgccccaccgtcggggacaggatcgtggagctgatttatattgacatcgtcggtctcgcgcagtttaagaaaacattaggaccatcctgggtgcactaccagtgcatgctcagagttctagacagctttggtactgagccggagttcaatcatgccaattatgctcaaagtaagggccacaagaccccctgggggaagtggaacttaaatcctcaacagttctataccatgttcccacatacccctgacaattccttcctaggcttcgtggtggagcagcacttaaatagtagtgatatccaccacataaatgagattaaacggcagaatcaatctctcgtgtacggtaaggtggactcgttctggaagaacaagaaaatctatctggacataattcacacgtacatggaagtgcatgctacagtttacggcagctcgaccaaaaatatccccagctacgtgaagaatcatgggatcctgtcaggccgcgatctccagttccttctgcgggaaacaaagcttttcgtgggcttaggctttccttatgaaggccccgctccacttgaagctatcgccaatggctgtgctttcttgaaccctaaattcaacccaccaaaaagctccaaaaataccgacttttttataggtaagccaaccctgcgcgaactgactagccagcacccttacgctgaggttttcataggacgccctcacgtgtggaccgttgacctcaataatcaggaggaagtagaagacgctgtgaaagcgattttgaatcagaagatcgagccatatatgccgtacgagtttacttgcgaagggatgttgcagcgaataaacgcatttattgagaaacaggatttctgtcacggccaggttatgtggcctccactgtccgcccttcaagtcaagcttgcagagcccggccaaagttgcaaacaggtgtgccaggaatctcagctgatctgcgaaccctcattcttccagcacctgaacaaagataaagacatgctaaaatacaaagtaacctgtcagtcctcagaactcgctaaagatattcttgttccatcctttgacccaaaaaataagcattgcgtgttccaaggcgatctgttgctgttcagctgtgctggcgctcatccacggcaccagcgggtgtgcccatgccgagacttcatcaaaggccaggtcgccctgtgcaaggattgtctgtag

SEQ ID NO: 15860 - DNA, 1410 bp, Artificial Sequence
  Description of Artificial Sequence: Synthetic coding sequence
atgcatagctttccgcccctcctcctccttctgttttggggggtggttagtcatagcttccccgccactttagaaactcaagaacaagatgttgacctagttcaaaagtacctcgagaagtactacaatctcaagaacgatggcagacaagtggagaaacgtagaaatagtggccccgtggtagaaaagctcaaacagatgcaggaattctttggacttaaggtgaccggcaaaccagacgccgagaccctcaaagttatgaagcagcctaggtgcggcgtgccagacgtcgcacagtttgtcctgactgaaggcaatcctaggtgggagcaaacacatctaacctaccgcattgagaattacacccccgatctgcccagggcagatgttgatcacgctatcgagaaggcattccaactctggagtaatgtcaccccgttgaccttcacgaaggttagcgaggggcaggcggatattatgatctcttttgtacgcggggatcaccgagacaacagtcccttcgatggaccaggaggcaacctagctcacgcatttcagccgggaccaggcatcggcggagacgcccactttgatgaggatgaacgttggaccaataattttcgggaatataacctgcaccgcgtggccgcacatgagctgggccactccctgggcctctcgcacagtactgatatcggtgcgctgatgtacccaagctatacgttctctggtgacgtccagctggctcaagatgacatcgacggcatccaggccatctatggacgctcccagaaccccgtgcaacccattgggccacagactcccaaggcttgtgactcgaagcttaccttcgatgccattactacaatcagaggagaggtcatgttctttaaggacaggttctatatgcgcaccaaccccttttatccagaagtcgagttgaatttcatcagcgttttctggcctcagctcccaaatgggttagaggccgcctatgaatttgctgacagggatgaggtgcgcttttttaagggtaataagtactgggcagtgcaaggtcagaatgtgctgcatggctaccctaaggatatctattccagcttcggcttccctaggaccgtcaaacatatcgatgccgctctgagcgaggaaaatactggcaaaacatatttctttgtcgcgaataagtactggcggtacgacgaatataagcgtagcatggaccctggctatcccaaaatgattgcgcacgacttccccggaattggtcacaaagttgacgccgtgttcatgaaggatgggttcttctatttcttccacggcacacgccagtacaaatttgacccaaagaccaagcgtatactgactctgcaaaaagccaattcatggttcaattgtcggaagaattag

SEQ ID NO: 15861 - DNA, 1431 bp, Artificial Sequence
  Description of Artificial Sequence: Synthetic coding sequence
atgatgcacctggcattcctcgttctcctctgtctcccagtctgcagcgcttatcccttatctggtgctgcaaaagaggaggactctaacaaggacctcgcgcagcagtatctcgagaagtactataacctggaaaaagatgttaagcagtttcggcgcaaagacagcaaccttatcgtcaagaagatacagggaatgcagaagttcttaggattagaagtgaccggtaagctggacaccgacactctggaagtaatgcggaagccgagatgcggggtgcccgacgtgggacatttcagctcctttccaggtatgcccaaatggaggaagacgcatcttacataccgtatcgtcaactacacacccgatcttccccgcgatgccgttgactccgccattgagaaggcactgaaggtatgggaagaggtgacgcctctgacatttagtcgactctacgagggagaggcagatatcatgattagttttgccgtgaaagaacatggggatttttattcatttgacggtcctgggcactctctcgcccatgcctatccccccggacctggcctctatggcgatatccacttcgatgacgacgagaagtggacagaggacgcatccggaacgaatctgttcctggtcgcagcccatgagctgggacacagcctgggcctattccattctgcgaacactgaggcactgatgtaccctctgtataacagcttcacagaactggcccagttccgattgtcccaggacgacgtgaacggcatccagtcattatacgggcccccccccgcttctaccgaggagccattggtccctacgaaatctgtacccagcggatcagagatgccagcgaagtgcgaccccgcccttagcttcgatgccatcagtactcttagaggagagtatctattctttaaggatcgatacttctggcggaggtctcactggaaccctgaacctgaatttcacttaatctcagcgttctggccctcactgcctagttatctggacgcagcctatgaggttaattcccgagacacagtttttatatttaagggaaatgagttctgggccattagaggcaacgaggtacaggccggctacccgcgcggcattcacactctgggatttcctccgactatcaggaagatcgatgccgcagtgagcgataaggagaagaaaaagacttacttctttgccgccgataagtattggcgcttcgacgaaaatagccagagtatggagcaggggttccccaggctcatcgctgacgattttcccggagtagaacctaaggtagacgcagttctacaggcctttggcttcttttatttcttctcaggatcttcgcagttcgagttcgatcctaatgccaggatggtaactcatatcctgaaatccaactcatggctgcattgctag

SEQ ID NO: 15862 - DNA, 930 bp, Artificial Sequence
  Description of Artificial Sequence: Synthetic coding sequence
atgccgcgtcactgttcggcagctggctgctgcacaagagatacgcgcgagacacgcaatcgcggaatcagttttcaccgtctcccgaagaaggacaatccacggagaggtttatggctggctaactgtcaacgcctcgaccctagtgggcagggactgtgggaccccgctagcgagtatatctacttctgtagtaagcacttcgaggaggactgttttgagctcgtgggcattagcggctatcaccgcctgaaggaaggagctgtgcccaccattttcgagtctttctctaaactgagacggacgaccaagaccaagggtcatagttatcccccaggccccgcggaggtgtcaaggctccggcggtgtcgcaagcgctgctccgagggcaggggacccactacacccttcagtccccctcctcctgccgacgtcacgtgctttcctgtggaggaggcctctgcccctgcaactctcccagcaagcccggctggacgactggagccaggcttgagtagtccgttctcggacctcttaggacccctgggggcccaggcagacgaggctggttgtagcgcccagccatccccagagagacagccaagccctttggagccccgccccgtgagtcctagtgcatatatgctgagactgccgccacccgctggcgcttatatccagaatgagcattcttaccaggtgggcagcgctctgctgtggaaacgccgggccgaggcagcacttgatgccctggataaagcccaacggcagctgcaggcctgcaagagaagagaacaacgactccgattgcgtctcaccaagctccagcaagaacgggctagggagaaaagagcacaggcggatgcaagacagacactaaaggagcatgtacaggacttcgcaatgcagctgagtagtagtatggcttag

SEQ ID NO: 15863 - DNA, 1416 bp, Artificial Sequence
  Description of Artificial Sequence: Synthetic coding sequence
atgcatcccggcgtgttggccgcctttttgtttctgtcttggacacactgcagggccctaccactgcccagcggcggggatgaagacgatctcagcgaagaggatctacagtttgccgagagataccttcggagctactatcacccaactaatcttgcaggcatcctgaaggagaacgcagcctcaagcatgacagaaagactacgcgaaatgcagagtttttttggcttggaggttaccggcaagcttgatgacaacaccctggatgtgatgaagaaacccaggtgcggagtgcccgatgtcggtgaatataacgtcttccctaggaccttaaaatggagtaagatgaatctgacctaccgcatcgtcaactataccccggacatgacccattccgaggtagagaaggcattcaaaaaagcttttaaagtatggtctgacgtaactccactcaatttcacaagactgcatgatggcattgccgacatcatgataagctttggaatcaaggagcatggtgacttttaccccttcgatggtccctcaggtctcttggcacatgcgtttcccccggggccaaactatggtggagatgcacatttcgatgacgatgagacgtggaccagcagcagtaaaggttacaaccttttccttgtggccgcccatgaattcggacattctttgggcctggatcactctaaagaccctggagcccttatgtttcctatctacacctacaccgggaaatcgcacttcatgctacctgacgacgacgtgcaggggattcagagcctctatggtcctggggatgaggaccccaatcccaaacacccaaaaacacccgacaagtgtgaccctagtctgtcgctagacgccataacctccctgcgcggcgagaccatgattttcaaagataggtttttctggcggctacaccctcagcaggtagacgcagaactgtttttaaccaagtccttctggcccgagttgcctaaccgtatagacgctgcctacgaacacccctcacatgatctcattttcatctttcgagggcgcaagttttgggccctcaacggttatgacatactcgagggatatccgaaaaagatttcagaactcggccttccaaaggaggtcaagaaaatatccgccgccgtgcactttgaagatacaggtaagactctgctattctcgggcaaccaagtttggaggtacgatgatacgaaccacattatggacaaggattaccccaggctgatcgaggaagacttccctggtatcggcgataaagtggacgccgtctacgagaagaacgggtacatctattttttcaacggacctatccagtttgaatattctatctggtccaatcgcatcgtgcgtgtgatgcctgctaattcgattctttggtgttag

SEQ ID NO: 15864 - DNA, 1470 bp, Artificial Sequence
  Description of Artificial Sequence: Synthetic coding sequence
atgcaccctggtgtgttggctgcattcctgtttctgtcctggacacattgccgggctttgcccctgccatctggtggcgacgaagacgacctaagcgaagaggacctccaattcgcagagcgctacctacgatcatactaccatcccactaatctggcggggattttgaaggaaaacgctgcaagtagtatgacggaacgcctgcgtgaaatgcagtccttttttggtcttgaagtcaccggaaagcttgacgacaacacactggatgtcatgaagaaaccaagatgcggagtcccagatgtgggggagtataatgtgttccctaggacactgaaatggtcaaagatgaacctgacataccgaatcgttaactatacgccggacatgacccattccgaggtcgagaaagccttcaagaaggccttcaaagtctggagcgacgttactccacttaactttactaggttgcacgacggcatcgccgacatcatgatctctttcggcatcaaggagcacggcgacttttatccctttgacggccctagtggccttctggcgcacgcttttcctcctggtcccaactacggcggagacgcacattttgacgacgatgaaacatggacatcctcgagtaaagggtacaacctgtttctggtggcagcacacgaattcggccacagcttgggacttgaccattctaaggatcctggtgccctgatgttcccaatctacacctataccgggaaatcccactttatgctgcctgatgatgatgtacagggcatccagagcctatacggcccaggtgatgaagacccaaatccgaagcaccccaagacccccgacaagtgcgacccttcactgtcgctggatgctatcacatctctgcggggtgagaccatgatattcaaagatcggttcttctggaggctgcatccccagcaagtagacgcagagttgttccttaccaaatccttctggcccgagttgccaaatcgcatcgacgccgcctatgagcatccgtcacacgacctgatttttatatttagggggcgcaagttttgggccttgaacgggtacgacatcctggaaggctaccctaaaaagatctcagagctgggcctgcccaaagaggttaagaagatctccgccgccgttcacttcgaagacacagggaagacactcctcttttctggcaaccaagtatggcggtacgatgataccaatcacattatggataaagactatcctcgtctgatcgaggaagattttccaggaataggcgacaaggtggatgcggtctacgagaagaacgagtctcattctgtcacccaagccggggtacactgtcggaatctgtccagtctccaaccacccccacccgggttcaaacggttttcttgcctgagcctttggtcctcatgggattacagactatatttgtttttccaacggacacatacggtctag

SEQ ID NO: 15865 - DNA, 1152 bp, Artificial Sequence
  Description of Artificial Sequence: Synthetic coding sequence
atgcatccgggcgttctcgccgcctttttgtttctttcctggacccactgtagggcactgccactgccatctgggggtgacgaggatgacctgtcagaagaggatttgcaatttgcggaacgatatctgaggagttactatcaccctacaaacctcgccgggatactgaaggaaaatgcagcatctagtatgaccgagcggttgagagagatgcagtctttctttgggctggaggtgacaggaaagcttgacgacaacactctcgatgtgatgaagaaaccaagatgcggggtgccagacgtgggggagtacaacgtgtttccaagaacgctcaagtggagtaaaatgaatctgacatacaggatagtgaactacaccccagatatgactcacagtgaggtagagaaggcctttaagaaagctttcaaggtgtggtcggacgttacccccctcaacttcacaaggctacacgatggcatcgccgatatcatgatctcatttggcataaaagaacacggcgacttttatccgttcgacggcccgtccggtttgttggcccacgcgttcccccctggacctaattacggcggcgatgcccatttcgatgacgatgaaacctggacgagctcctcgaaaggatataatctgtttcttgtagccgcccatgagttcggccactcattgggcctggaccactccaaggatcccggcgccctgatgttccccatttacacctataccggaaagtcccattttatgctccccgacgacgacgtccagggaattcagtctctgtatggacctggggatgaagaccctaacccaaaacacccaaagacccctgacaagtgtgatccaagtttatctcttgatgcgatcacatctctgcggggggaaacaatgatttttaaggacaggttcttctggcggttgcatcctcagcaagtagatgcagagctgtttttaacaaagtctttctggccggagcttcctaaccgtatcgacgcagcctacgagcatccttctcatgacttgattttcatttttcggggccggaaattttgggccttaaacggctatgatattttagaaggctatcccaagaaaattagtgagcttgggctacccaaggaggtgaacaagcttcagtag

SEQ ID NO: 15866 - DNA, 1749 bp, Artificial Sequence
  Description of Artificial Sequence: Synthetic coding sequence
atgtcgcccgccccaagaccaccccgctgtttacttctgcctctgcttactttgggaaccgccctggcctctcttggatcggcgcagtcaagttccttctctcccgaagcttggctgcaacagtatggatacttaccacccggagaccttagaacacacactcaacggagtccacaaagcctgagcgcagccattgccgcaatgcagaagttctatggcctgcaggtgacgggcaaggctgatgctgataccatgaaagctatgaggcgccctaggtgtggcgttcccgataagtttggagcagagattaaggcgaatgtgcgccggaagcgatatgcgatccaaggcttaaagtggcagcacaatgaaattacgttctgtattcagaattatactcctaaggttggggagtatgccacttatgaggccatccgtaaagcctttcgggtctgggagtcggccacccccctgaggttccgagaggtcccgtacgcctacatcagggaaggtcacgagaaacaagccgatattatgatattctttgctgagggcttccacggagattcgacaccctttgacggggagggagggttcttagcgcatgcttactttcccggccccaacatcggcggggatacccacttcgattctgccgaaccttggaccgtgagaaacgaggatctcaatgggaacgacatctttcttgtggcggttcatgagttggggcacgctctgggactggagcactcctctgatccgagcgccatcatggcaccgttttaccaatggatggatactgaaaattttgtgttgcctgatgatgacagacggggtattcagcagttgtacggtggagaatctggttttcccaccaagatgcccccccaaccccgtactacctcgcgccccagcgtccctgacaaaccaaaaaatccgacctacggaccaaacatttgcgatggcaattttgataccgtagctatgttgcggggcgagatgttcgtcttcaaagagagatggttctggagagtcagaaacaaccaagtgatggatggctacccgatgcccatcggccagttctggcgggggctcccggcgtccattaacacagcgtatgagaggaaagatggtaaattcgtgttttttaaaggcgacaaacattgggtgttcgacgaagcaagtctggagcccggctaccctaagcacatcaaggaactggggcgaggcctcccgacagataagatagatgccgccctgttttggatgcctaatgggaagacgtacttcttccgcggcaataaatactacaggtttaatgaggaactgcgggcagtggattcagagtatcccaaaaatatcaaggtctgggaaggcatccccgaatctccacgcggctcattcatgggctcagacgaggtcttcacttatttttacaaggggaacaagtactggaagttcaacaaccaaaagttgaaggtcgagccgggatatcctaaatctgccctccgggattggatggggtgccccagcggtggccggccagatgaggggaccgaggaggaaaccgaggttataattatagaggtggacgaagaaggaggtggggctgtgtcagcagccgccgtggtgcttcccgttctccttctgctgctggtgctcgccgttggacttgctgtgtttttcttccgcaggcacggaacgcctagacgcctcttgtactgccagcgaagtctgctcgataaagtgtag

SEQ ID NO: 15867 - DNA, 2052 bp, Artificial Sequence
  Description of Artificial Sequence: Synthetic coding sequence
atggcgtcggggcctgggtcgcaggagagagaagggctcttaattgtgaagttagaggaagactgtgcatggagccaagagctaccgcctcctgacccaggccccagtcccgaggcttctcacctgaggttccgccgtttccgcttccaggaagcagcgggaccaagagaagctctgagccggctccaagagctatgccacgggtggcttagacccgaaatgcgaacaaaagaacagattttggaattgctggtccttgagcaattcctgacgattctaccccaagaaatccaatccagggttcaggagttgcacccagagagcggagaagaggcggtgacattggtcgaggatatgcaacgagagcttggtagactgcgccagcaagtgaccaatcatggcaggggaactgaagtccttctggaggaaccactcccactggagaccgcccgggagtccccctcatttaagctggagccaatggaaacagagaggtcccctggtccaagactgcaggagctcctcggcccctctccccagcgcgatccgcaagccgttaaggagcgagcactttccgcgccctggttgagcctgtttcccccagagggcaacatggaggataaggagatgacaggaccacagcttccagaaagtctcgaagatgtcgctatgtatatctcacaggaagaatggggtcatcaagatccgtccaaacgggctctcagtagagatacagtgcaggaatcttacgagaatgtggacagcctcgaatcccacattcccagccaggaagttccaggcacacaggtgggtcaaggcggtaaactttgggatccttccgtgcaatcctgtaaagaaggcctgagcccacgtggcccagcccccggtgaggaaaagttcgaaaacctggagggggtcccatccgtgtgctccgagaacattcatccgcaggttttgctgccggatcaggcccgtggcgaagtgccttggagtcctgagctggggcgacctcatgatagatctcagggagattgggcgccaccacctgagggaggcatggagcaggctctggcaggcgccagctccgggcgagagctcgggaggccgaaggagcttcagcccaaaaagttgcatctttgtccactctgtggcaagaacttctcgaacaactccaatctgattcgacatcagaggatccatgctgcggagcgtctctgtatgggcgtggactgtacggaaattttcggtgggaaccctcgcttcctctctttgcatcgggcacacctgggagaagaggctcacaagtgtctcgaatgtggtaagtgcttttcccagaacacacacctcacgcggcaccaacgcacacacaccggcgagaaaccctaccagtgtaatatctgcggcaaatgtttctcgtgcaattcaaatctccatcgacatcaacggacccacactggagaaaagccctataagtgccccgagtgtggcgagatctttgcccattcctcaaacctactcagacatcagagaattcacaccggggaaagaccttataaatgcccggagtgtggcaagtccttctccaggtcaagccatcttgtgatacacgaacgaacgcacgaaagggaaagactctacccgttctcagagtgtggagaggctgtgagcgatagcactccgttcctcacgaaccacggagctcataaagccgagaagaagttgttcgagtgccttacatgcggaaaaagcttcagacaggggatgcaccttacacggcaccaacgtacacatacgggggagaagccttataaatgcaccctgtgtggcgagaatttctcacacagatctaatctgattcggcaccaaagaattcatactggtgagaagccatacacatgtcacgagtgtggggatagttttagccactcgtcaaaccgaattaggcatctgcgaacgcacaccggagagcgtccgtacaagtgctccgaatgcggcgaatcgttctcaagaagcagcagactcatgagtcaccaaagaacacacactggctag

SEQ ID NO: 15868 - DNA, 1755 bp, Artificial Sequence
  Description of Artificial Sequence: Synthetic coding sequence
atgcagaaatttttcggcctgccacagaccggcgaccttgatcagaatactatagagaccatgaggaagccgcggtgcgggaatcccgacgtcgctaactataatttctttcctcggaagccaaaatgggacaaaaatcagataacatatcggatcatcgggtatactccagacttggacccagaaaccgtggacgatgctttcgctcgtgcctttcaagtctggagcgacgtgaccccactgagattctccaggatccacgacggggaggctgatatcatgattaactttggacgctgggaacatggcgatgggtacccctttgacgggaaggatgggctcctcgcgcatgcattcgcccccggcactggggtcggcggagacagccacttcgatgatgacgaactctggaccctcggtgaggggcaggtggtacgcgtcaagtacggaaatgccgacggcgagtactgcaagttcccatttctgtttaacggtaaagagtataattcctgcacggacaccgggagatccgacggctttctatggtgctccaccacctacaattttgaaaaagatggaaagtacggcttctgccctcatgaagctctctttacaatgggtggaaatgctgaggggcagccatgtaagtttccatttcgattccagggcacatcatatgacagctgtacaactgagggaaggactgacggctataggtggtgtggaaccacggaagactatgatagagataagaaatacggattttgcccagaaaccgccatgagcaccgtgggtggaaacagcgagggggcaccgtgcgtgttccccttcacctttctgggaaacaaatatgaatcttgcaccagtgcagggaggtcagatggcaagatgtggtgtgctaccacggcaaactacgacgatgatagaaagtggggattctgccctgatcagggttactctttattcttggttgcggcacacgaattcggccatgccatggggctggaacactcccaggacccaggtgctctgatggcaccaatctacacgtacactaaaaacttccggctgtcccaggatgatattaagggaatccaggaactgtatggggcttctcctgatatcgacttgggcacagggcccactcctacactgggtccagtgactcccgagatttgtaagcaggacatcgtctttgatggaattgcgcagataagaggggagattttcttctttaaggacagattcatctggaggacagtgactccacgagataagcccatgggcccactccttgtggctaccttttggcccgagttgccagaaaaaattgacgctgtgtacgaggcaccacaggaagagaaagcagtgttttttgctgggaacgagtattggatttattctgcgtctactcttgagaggggttaccccaagcccctgacaagtctgggcctacccccagacgttcagcgggtagatgccgcctttaactggagcaagaataagaaaacatacattttcgccggtgataagttttggagatataacgaggtaaagaagaaaatggatccaggcttcccaaagctgatcgccgatgcatggaacgcaattcccgataatctggatgctgtggtggacttgcaagggggaggacacagctatttttttaagggcgcatattacctgaagttagagaaccagagcctgaaatctgtcaaattcggaagcattaagtccgattggctcgggtgctag

SEQ ID NO: 15869 - DNA, 1434 bp, Artificial Sequence
  Description of Artificial Sequence: Synthetic coding sequence
atgaagagccttcctatcttactcttgctatgtgtagcggtttgcagtgcctacccactggacggcgctgcccggggggaagacacctctatgaaccttgtgcaaaagtacctcgagaattactacgatttaaaaaaggatgtgaagcagttcgtgaggcgtaaagatagcggaccggtggtcaagaagatccgtgaaatgcagaaattcctcgggctggaagtaactggaaagctcgattcggacactctcgaagtgatgaggaagccacgctgcggggtgcccgatgttgggcactttagaacctttccgggtatcccaaaatggaggaagacacatctcacctatcggattgttaattacacacctgacctgcccaaagatgccgtggactccgcagttgaaaaggccctgaaggtgtgggaggaggttactcctttaaccttctcgcggctgtacgagggtgaggctgatattatgatcagtttcgctgtgagggagcacggagatttttatcctttcgacggccccggtaacgttctggcgcacgcatacgccccaggtcctgggatcaatggagacgcccacttcgatgatgacgaacagtggaccaaagacactacagggaccaatctgttcctggtcgcagctcacgaaatagggcactcactgggcttgtttcacagcgctaatacagaggcactgatgtacccgctttaccattcactgacagatctgacgagatttagactcagtcaggatgacataaacgggatacagtctctttatggtcccccacccgacagccctgagaccccgctcgtaccaacagagcccgtaccaccagagcctggaacacccgcaaactgcgatcctgcgctgtctttcgatgctgtgtctactctacgcggcgagatactaatttttaaagatagacacttctggcggaagtctttgaggaaattagaaccagagctccacctcatttctagcttttggccttcacttccctcgggcgtagacgctgcctatgaggtcacatcaaaagatctcgtgttcattttcaagggaaaccagttttgggccatcagaggaaatgaggtaagggctggttaccctcgcgggattcacacactcggttttcccccgaccgtaagaaagatagatgcagctatcagtgacaaggaaaaaaataaaacctacttctttgtggaggataagtactggaggttcgatgaaaagcggaatagtatggaacctgggttcccaaagcagattgccgaggattttccaggcattgactctaagattgacgcagtcttcgaagagtttggattcttttacttttttactgggtcttcccaactggagttcgaccctaacgcaaagaaggtcacacacactttaaagagcaactcttggttgaactgttag

SEQ ID NO: 15870 - DNA, 804 bp, Artificial Sequence
  Description of Artificial Sequence: Synthetic coding sequence
atgcgcctcactgttctttgtgcagtatgcctgctcccgggctccctggcattacccctccctcaggaggccggtggcatgagtgagcttcaatgggagcaagcccaggactaccttaaaagattttatctatatgactcagagaccaagaatgctaattctcttgaagctaaacttaaggagatgcagaaatttttcgggctgccgattaccggcatgctgaactcccgggtgatcgagatcatgcaaaagccacgatgtggagtgccggacgttgccgagtactccttattccccaatagcccaaagtggacatctaaggtggtgacttatcgcattgtctcatacacacgcgatctccctcacatcaccgtggataggttggtctctaaagcactgaacatgtgggggaaggagattccattacatttccgcaaggtggtgtgggggaccgctgatatcatgatcggcttcgcacgaggagcgcatggagattcttatccctttgacgggccagggaacacactggctcatgccttcgcacccggaacaggcctggggggcgacgctcactttgacgaagatgagcgatggacggacggcagcagcctcgggataaattttctgtacgcagccactcatgagttgggtcatagcctgggcatgggccacagctcggaccccaatgccgtgatgtaccccacttacggcaacggagacccccagaacttcaagctgtcccaggatgatataaagggaatccagaagctttacggcaaaaggtccaactctcgtaagaagtag

SEQ ID NO: 15871 - DNA, 2124 bp, Artificial Sequence
  Description of Artificial Sequence: Synthetic coding sequence
atgagtctgtggcagccccttgtgttagtgctgctcgttctcggctgttgcttcgccgcccctaggcagcgccagtctaccctcgtgctgttcccaggggacctacggactaacctgaccgaccgacagctcgccgaggagtacctgtatcgctatgggtatacaagagtggcagaaatgagaggcgagagcaagagcctgggtccggccctgcttctcctccaaaagcagctgtccttgccggagaccggcgagttggactccgccacgttaaaagccatgaggacccccaggtgcggcgtgccggacctggggcggttccagaccttcgaaggagaccttaagtggcatcaccacaacattacttactggattcagaactatagtgaagaccttccacgagccgtgattgacgatgcgttcgctagagctttcgcactatggtccgccgtgactccactgacattcacacgcgtgtacagcagggatgcggacattgtgattcaattcggcgttgctgagcatggggacggctacccctttgacggcaaagacgggctcctcgcccacgcttttccaccaggaccaggcatccagggagatgcccattttgacgatgatgagctctggtcactgggaaagggcgtcgtcgtgccaacccgattcggcaacgccgatggcgcagcgtgtcactttccatttattttcgagggacggtcttactccgcatgtacgactgacgggaggagcgatggcctcccttggtgcagcacaacagccaattacgacactgacgacaggttcggcttttgcccctcagaacggctatatacacaggatgggaacgctgatggcaagccgtgtcagtttcccttcatctttcagggccagagttacagcgcctgtacgacagacggtaggagtgacggatataggtggtgcgctaccactgctaattatgacagggacaaactcttcggattttgtcctacgcgcgccgattcaactgtcatgggtggaaatagcgcgggggagctttgtgttttcccttttacatttctgggcaaggaatattctacctgcacaagcgagggtaggggggatggccgcttatggtgcgcgacaacttctaactttgacagcgacaagaagtggggattttgccccgatcaaggttactctctctttttggtcgcggctcatgagtttggccatgccctcgggctcgatcactcgtccgtccctgaggccctcatgtaccctatgtataggttcactgaggggccccctctgcacaaggatgacgttaatggcatcagacacctgtacggaccccgccctgagcccgagccgcggcctcctacaaccaccacacctcaacctacagcccctcctactgtctgcccgacagggcccccaaccgtgcacccatcagaaaggccaaccgctggaccaaccggccccccctccgccggacccacaggaccccccacagcgggacctagtaccgccactaccgttcctttgtcacccgttgacgacgcctgtaatgtaaacattttcgacgctatcgccgaaatcggcaatcagctgtatcttttcaaagatggtaagtactggcggttctctgaaggaagaggttcgaggccacaaggacccttcctgattgctgataaatggccagctttgccgcggaagttggacagtgtgtttgaagagcggctgagcaagaagttgttttttttcagcggccgccaggtctgggtttacactggcgccagtgtgctgggtccgcgccgtttagacaagctcggcctgggcgcggatgtggcccaggtcacaggagcgctccgatcaggcagaggcaagatgctcctcttttcagggaggagattgtggcgcttcgatgtgaaagcccagatggtggatccgagatccgcaagtgaggtggaccgaatgttccccggagttcccctcgacacccacgacgtgtttcaatatcgggagaaagcatacttttgtcaagaccggttctattggcgggtatcctcacgttcagagctgaaccaggttgatcaggttggttacgtaacatacgacatactgcaatgtcccgaggattag

SEQ ID NO: 15872 - DNA, 834 bp, Artificial Sequence
  Description of Artificial Sequence: Synthetic coding sequence
atgggaggcaattccgcaggggagctctgtgtcttccccttcacattcctcggtaaagagtactctaattttgactccgataaaaagtggggtttctgccccgatcagggctactccctgttcctggtggccgcacatgaattcggtcatgccctaggtcttgaccattcaagcgtgccagaggccctgatgtacccaatgtatcggtttactgagggtcctcctctgcacaaagacgacgttaatgggatccgtcatctttatggcccacgtcccgagcctgaaccccgcccacccacaacaactacaccccagcctacggcccccccaacggtttgcccaaccggcccgcccacagtacatccacccttcctcatagccgacaaatggcccgcactgccacgcaaattagactcagtgtttgaagagaggttatccaagaaactgtttttcttctctgggcgccaagtgtgggtctatacaggcgcttcagttctcggacccagaagactcgacaagctaggactgggtgctgacgtagcccaagtgacaggtgccctgcggtcagggaggggaaaaatgctgctcttttctggaagaagactttggcggttcgatgtgaaggcccagatggttgaccccaggtccgcatctgaagtggatcgcatgtttccgggtgtgcctttggacacacacgatgtctttcagtatcgagaaaaagcttacttttgtcaggatagattttattggcgcgtgagcagtcggagtgagttgaaccaagtggatcaggtgggctacgtcacttacgacatcctgcagtgtcccgaggattag

SEQ ID NO: 15873 - DNA, 324 bp, Artificial Sequence
  Description of Artificial Sequence: Synthetic coding sequence
atggctggggaggatgtgggagctccgcccgaccacctctgggtgcaccaggaggggatctatagagatgaataccagagaacatgggttgctgtggtggaagaggaaacaagcttcctccgggctcgagtgcaacagattcaggtgcctctgggggacgccgctcgcccgtctcacctgcttacgtcccagttgccactaatgtggcagctgtaccccgaagagcgctacatggacaataattctagactttggcaaatccagcatcatttaatggttaggggagtccaggagctgcttctgaagctgttaccagatgattag

SEQ ID NO: 15874 - DNA, 324 bp, Artificial Sequence
  Description of Artificial Sequence: Synthetic coding sequence
atggccggcgaggacgtgggagcgcctccggaccacttgtgggtgcaccaggaaggcatttacagagacgagtaccagaggacatgggtcgcggtggtcgaggaggagacttcattcctacgcgccagggtgcagcagatacaggtgcctctgggcgacgctgccagacccagccatttgctgaccagccagttgccacttatgtggcagctatacccggaagaaagatacatggataacaattctaggctgtggcagatccagcatcaccttatggtgaggggggtgcaagagctgttgctcaagctgctgccggacgattag

SEQ ID NO: 15875 - DNA, 1329 bp, Artificial Sequence
  Description of Artificial Sequence: Synthetic coding sequence
atggtccgatctcgacagatgtgtaacaccaacatgagcgttcccacagacggagcggtgaccactagccagatcccagcatcagagcaagagaccctggtacgccccaagccgctcttgctcaaactccttaagagcgtcggcgcccaaaaggacacctacactatgaaggaggtgctcttttacttagggcagtacatcatgacaaagcgactctatgacgaaaagcagcaacatatcgtatactgttctaatgatctgcttggcgatttattcggcgtgccctccttctccgtcaaggaacatcgaaagatttatacaatgatttaccgcaaccttgttgtggtgaaccagcaggaggagaacagcgacgaattgtctggagaacgccaaaggaagcgccataagagcgatagtatttctctgtccttcgacgaaagtcttgccctatgtgttattcgcgagatttgctgtgaaagatcgtccagcagcgagtcaactggtacccccagcaaccccgacctggacgccggagtctctgaacactcgggtgattggcttgaccaggactcagtgagcgatcagttctctgttgagttcgaggtggagtccctggattccgaggactatagtctgtccgaagagggccaggaactgtccgatgaagatgacgaggtctatcaagtaaccgtttatcaggcgggcgaaagcgatactgacagctttgaggaggatcccgaaatcagtctggctgactattggaagtgtacatcatgcaacgaaatgaaccctcctctcccttctcactgcaacaggtgttgggctctcagagaaaactggctacccgaagataagggcaaagataaaggggagatctctgagaaagcaaaactcgaaaacagtacccaagctgaggagggattcgatgtccctgactgcaagaaaacaattgtcaacgacagtcgagaaagctgcgtggaagaaaacgatgacaaaatcacacaggcctcacaaagccaggagtccgaggattatagccagccgtctaccagttcctctataatctacagtagccaagaggacgtgaaggaattcgagagggaggagactcaggacaaagaggaatccgtcgagagctccttgcctctcaacgcaatcgaaccatgtgtcatttgtcaggggcggcctaaaaatgggtgcatcgtccacggtaaaacaggacatcttatggcatgcttcacatgtgctaaaaagctgaagaagcgcaacaagccatgccccgtctgccggcagccaatccagatgattgtcttgacttactttccttag

SEQ ID NO: 15876 - DNA, 1311 bp, Artificial Sequence
  Description of Artificial Sequence: Synthetic coding sequence
atgtgtaatacaaacatgtccgtaccgacagacggcgcagttaccacctctcaaatccctgcgagtgagcaagaaacactggttagacccaagccccttctactgaagctcctaaagtccgttggagctcagaaggacacgtataccatgaaggaagtgctcttttacctcggccagtacattatgacaaagagactgtacgatgaaaagcagcagcacatcgtttactgttccaacgatctactgggcgaccttttcggtgtgcccagctttagcgtgaaagagcaccgtaagatctatactatgatatatcgtaatttagtggtcgtgaaccaacaggaagagaactccgatgagttatcgggagaacggcaaagaaaacggcacaagagtgacagcattagcctgagcttcgacgaatccctcgccctatgtgtgatccgcgagatctgttgcgaaaggtccagttcctccgagtccacgggcacacccagtaaccctgacctcgatgctggagtttcagagcacagcggcgactggctcgaccaggactccgtgtccgatcagttcagcgtggaattcgaggttgaatctctagatagtgaagattacagtctgtctgaagaaggtcaggaactttccgacgaggatgacgaggtttaccaggtgaccgtgtatcaagccggcgagagtgacactgattctttcgaggaggaccctgagatatctctcgcggactattggaaatgcacttcctgtaacgaaatgaacccccccctgccttcccactgtaataggtgctgggcactgagagaaaactggctgccagaggacaagggcaaggacaagggggaaatcagtgagaaggccaaactggaaaacagcacccaggccgaagaaggatttgatgtgccagattgtaagaaaacgatcgtgaacgattcaagggaaagttgtgtggaggaaaatgacgacaaaatcacacaggcttctcagagccaggagagcgaagattatagccagccatccaccagctcttctattatctacagctcgcaggaggatgtgaaggaattcgaacgcgaagagacacaggataaggaggagtcggtggaaagcagcctgccactgaacgctatcgagccatgcgtcatctgtcaaggaagaccgaagaatggatgcatagtgcacggaaagacaggccacctcatggcatgttttacatgcgctaagaagctgaagaaacgaaataaaccatgcccagtttgccgacagcctattcaaatgattgttctcacctactttccctag

SEQ ID NO: 15877 - DNA, 966 bp, Artificial Sequence
  Description of Artificial Sequence: Synthetic coding sequence
atgtgtaacactaatatgtcagtgcccactgacggtgctgtcactacctcccagatcccagcatcagaacaggagacattggtacggcccaagcccctgctgcttaagttgttgaaaagcgttggtgcacagaaggacacttacaccatgaaggaggatctcgatgctggtgtgagcgaacatagcggagattggctggatcaggattcagtctcagaccagttttcggtggaatttgaagtagagagtctggacagcgaagattatagcctctccgaggaaggtcaggagctgtcagatgaggacgacgaagtttaccaggtaaccgtctaccaagctggtgagagcgatacagatagtttcgaagaagaccctgagatctcactggccgattactggaagtgtacatcttgcaacgagatgaatcctcctttaccgtcgcattgcaatagatgctgggctctgcgggaaaattggctgccggaagataagggtaaagacaagggagaaatttctgagaaagcgaaacttgagaatagcactcaggccgaagagggattcgatgttcctgactgtaaaaaaaccattgttaacgactcacgggagagttgtgtggaagaaaatgacgacaaaattacacaggccagtcagagccaggagagtgaagactacagtcaaccttcgacctcttccagcattatttactcatcccaggaggacgtcaaggaattcgaacgagaggaaactcaggacaaagaggagtccgttgagtcgagcctgccactgaacgcaattgagccttgcgtaatatgccaggggcgacccaagaatggatgcattgtccatggcaagacagggcacctcatggcctgctttacttgtgccaaaaagctgaagaaaagaaacaaaccctgtcccgtgtgtaggcagcctatccagatgattgtcctcacgtattttccctag

SEQ ID NO: 15878 - DNA, 1359 bp, Artificial Sequence
  Description of Artificial Sequence: Synthetic coding sequence
atggttcgaagtagacagatgtgcaataccaatatgtctgtcccgactgatggggcagtaactacgtcccagatacccgctagtgagcaggagactctggttcggccgaaacccctgttgttgaagctgttgaaatcagtcggagcccaaaaggacacatatacaatgaaggaaaaaatctataccatgatttataggaatttggtggttgttaatcagcaagaatcttccgactccggtacttccgtgagtgagaaccggtgccacctcgaggggggctccgatcagaaggatttggtccaagagctacaagaggaaaaaccctcctcctcccacctcgtttcgcgaccttctacctcgagccgaagaagagctatctcggagactgaggagaactcagatgaactgtccggtgagagacagcggaagaggcacaaatcggattcaatttctctcagtttcgacgagtcactagctctgtgcgtcattcgggaaatatgttgtgaaagatcttcttctagtgagtctaccggcacgccttccaacccagaccttgatgctggagtgtccgaacacagtggggactggctggaccaggattcagtaagcgaccagtttagtgtggagtttgaagtcgaatcactggattctgaagattattctttaagcgaagaaggtcaggagctctctgatgaagacgatgaagtgtatcaggtcactgtgtaccaggctggtgaaagtgatacagacagctttgaagaggaccccgagatcagtctggccgactattggaaatgtacaagctgcaacgagatgaatccccctttaccttcgcactgtaatcggtgctgggcactgcgcgaaaattggctcccagaggataaagggaaggacaaaggagagatctcagagaaggctaagcttgagaacagcacacaagctgaagagggctttgatgtgcctgactgcaagaagaccatagtgaacgattcgcgcgagtcatgcgtcgaagagaacgacgacaaaatcacccaggcgtcacaaagccaggaatctgaggattacagccagcccagcacatctagtagcattatctattcctcccaggaagatgtgaaagagtttgagagggaagaaacccaggacaaggaagagagtgtcgagtctagcctccctctgaatgccatcgagccatgcgtgatctgtcagggcaggcctaaaaatggatgtattgtgcatggtaaaactggccaccttatggcctgtttcacctgtgctaagaagctgaagaaaagaaataagccttgccctgtgtgtcgccagccaattcagatgatagtgttaacatactttccttag

SEQ ID NO: 15879 - DNA, 771 bp, Artificial Sequence
  Description of Artificial Sequence: Synthetic coding sequence
atgtgtaataccaacatgtcagtgccaacagacggggcggtgaccaccagtcaaatccccgcttcagagcaagagactctcgtgaggccaaaacccctcctactgaagctgctaaagagcgtcggtgcccagaaagatacatacactatgaaagaggtgctgttctatctgggccagtacattatgaccaaacgactttacgacgagaaacagcagcatatcgtatactgttcaaacgatctgttgggagatctctttggagttccgagcttctctgtgaaggaacaccgcaaaatctatactatgatttaccgaaatctcgtagtggtaaatcagcaggagagttccgatagtggcacctccgtttcggagaataggtgtcatctcgaaggtggaagcgatcagaaggacctggtgcaagagctccaggaggaaaagccctcctccagccatcttgtgtctcgcccttccaccagtagcaggaggcgggctatatccgagaccgaagagaactctgatgagctcagtggcgagcgacaaagaaagcgacataagagcgatagcatttctctttccttcgacgagagtctcgcgctctgtgtgattcgggaaatatgctgcgagcgatcttcgagttctgaaagcaccggaactccctcgaaccccgatttgttgcttggggtgtaccaagtaactgtgtaccaagccggagagtcagacacggacagtttcgaggaggatcccgaaattagcttggcacattacctctag

SEQ ID NO: 15880 - DNA, 798 bp, Artificial Sequence
  Description of Artificial Sequence: Synthetic coding sequence
atgtcggttccaacagacggtgctgtgaccacttcacagattcccgcctctgagcaagaaaccctcgacctagatgcaggtgttagcgagcattcaggcgattggctggatcaggatagtgtgtcggatcagttctccgtggaatttgaagttgagtccttggatagcgaagattacagtttgtccgaagaggggcaagagttaagcgatgaagatgacgaagactactggaaatgcacaagctgcaacgagatgaacccccccctgccttctcattgtaatcgatgctgggcactaagagaaaactggcttccagaggataaaggcaaggataaaggggaaattagcgaaaaagctaaattggaaaattcgacgcaagcggaggaagggtttgatgttccagactgcaagaagacgatcgtgaacgattcaagagagagttgcgttgaggagaatgacgacaagatcacccaagcctctcagagccaggagagtgaagactactcccagccttctactagcagtagtatcatatactcttctcaggaggatgtaaaggagtttgagcgcgaggaaactcaagataaagaagagtctgttgaatcctcactgccactgaatgctatcgaaccatgtgtgatttgccaggggcggccaaagaacggatgcatagtgcatggcaagactggtcacttgatggcctgctttacgtgtgccaaaaaattgaagaaacgaaacaaaccctgtccggtttgtcggcagccgattcagatgatcgtcctgacatattttccctag

SEQ ID NO: 15881 - DNA, 1401 bp, Artificial Sequence
  Description of Artificial Sequence: Synthetic coding sequence
atgtgcaatacaaatatgtccgtaccgacggacggagcagtcaccacaagccagattcctgcatctgagcaggaaaccctggtgttgttttatctgggccaatacattatgacaaagcgactgtatgatgagaagcaacagcatattgtttattgttctaatgaccttctaggggatctatttggagtgccctcattctccgtcaaagagcacagaaaaatctataccatgatttataggaatttggttgtcgttaaccagcaggaaagctcagacagtgggacctcagtgagcgaaaaccgttgtcacctcgaaggcggttctgaccagaaggatctggtgcaggagctgcaggaggaaaagccaagctcaagccatctagtctcacgtccttcaacttctagcaggcgtagggcgattagtgagactgaggaaaatagcgatgagctatcaggagagcgccagagaaaaagacacaaatccgattcaatatcactgtcttttgatgagtctctggcactgtgtgtcatccgggaaatatgctgcgagcggtcatcctcgagtgagagcacagggaccccttccaacccagatctcgatgccggcgtgagcgaacactccggcgattggctggaccaggatagcgtgagcgaccagttcagtgttgaattcgaggtagagtccctcgatagcgaggattactccctgtcagaagagggacaggagctgagtgacgaggacgacgaagtgtatcaagttactgtctatcaggcaggcgagtccgataccgactcctttgaggaggacccggagatttccttggccgactactggaagtgtactagctgcaatgagatgaacccgcctctgcctagccattgtaacagatgttgggctcttagagaaaactggctgcctgaggataagggaaaggacaagggagaaatttccgagaaagcaaagcttgaaaactctactcaggccgaggaaggattcgacgttcccgattgtaaaaagacaatagtgaacgactcacgagaaagttgcgtggaggagaacgacgataaaatcacacaggccagccagagtcaggagagcgaagattattctcagccttctactagttcttctatcatctactcctcacaggaagacgtgaaagagttcgaaagagaggagacgcaagataaggaagagagcgtagaaagctcactgcccctgaatgctatcgagccttgtgtcatttgtcagggaagacctaagaacggatgcatcgtgcacgggaagacagggcatctgatggcttgctttacatgcgccaagaaactgaagaaacgtaataagccttgcccagtctgccgccagccaattcaaatgattgtccttacatacttcccctag

SEQ ID NO: 15882 - DNA, 966 bp, Artificial Sequence
  Description of Artificial Sequence: Synthetic coding sequence
atgtgcaatacaaatatgtccgtgcccaccgacggcgccgttaccacgtcacagatccctgcctccgaacaggaaaccctggttcgaccaaagccattactcttgaaactgcttaaatccgttggtgcacagaaagacacctacaccatgaaggaagacctggatgctggtgttagtgaacactctggggattggttagatcaggattccgtctccgaccagtttagcgtcgagtttgaagtcgagagcttggactccgaggactactctctgtcagaagagggacaggaactctcagacgaagatgatgaggtttaccaggtcactgtgtatcaggccggtgaatcagataccgatagcttcgaggaggacccagagatcagtttggccgattattggaaatgtactagctgcaatgagatgaacccacctttaccctcacactgcaatcggtgttgggcgctgcgggagaattggcttcccgaagataaaggtaaggacaaaggcgagatcagcgagaaggcaaagctggagaactctacccaggctgaggaggggttcgacgtccccgactgcaagaagaccattgtaaacgactccagagagtcctgcgtcgaagagaatgatgacaagataacacaagcttctcagtctcaggaatccgaagactactcccagccttcaacgtcctcttccatcatctactcatctcaggaggacgtaaaagagttcgagcgtgaggagacacaggacaaggaggagagcgtggagtccagcctgccccttaacgccatcgaaccatgtgtgatctgccaaggccgaccaaagaatggctgcatcgtgcatgggaaaacgggtcacctgatggcctgctttacttgtgctaagaagctgaagaaaaggaacaagccctgtcccgtttgcaggcagcctatccagatgatagtgcttacctactttccatag

SEQ ID NO: 15883 - DNA, 480 bp, Artificial Sequence
  Description of Artificial Sequence: Synthetic coding sequence
atgtgcaacactaatatgtccgtgcctacagacggagctgtaactacctcccaaatcccagcctcagaacaggagacgttggtcaggcctaaacccctgctcctgaagttgctaaagtccgtgggtgctcagaaggacacctatacgatgaaagaagatcttgacgccggcgtgtccgagcacagcggcgactggctggatcaagattcagtgtccgatcagttcagtgtagaatttgaagtcgagagcttagattcagaggattactccctttccgaagagggccaggagctgagcgacgaagatgacgaagtttatcaggtcactgtgtaccaggcaggggagtctgacacagatagcttcgaggaggatccagaaatttctctggcagattattggaaatgcctgaaaaaacgcaacaagccatgcccagtctgcagacagcccatacaaatgatcgtgctcacttacttcccctag

SEQ ID NO: 15884 - DNA, 891 bp, Artificial Sequence
  Description of Artificial Sequence: Synthetic coding sequence
atgtgcaataccaatatgagtgtgcctactgacggagctgtgacaaccagccagatcccagccagcgagcaggaaacattagacttagatgcaggagtgagcgagcacagcggtgactggctggaccaggactccgtgagtgaccagttctctgttgaatttgaggtggagtccctggatagcgaagattatagtctaagtgaggagggacaggagctgtctgatgaagacgacgaggtgtaccaggtgaccgtttatcaggcgggcgagagtgatacggattctttcgaggaagaccctgaaataagtctggcggactattggaaatgcacctcatgtaacgaaatgaatccgcccctgccaagtcactgcaatcgatgttgggccttgcgtgagaactggcttccagaggataaaggtaaggacaaaggcgagatctctgagaaagctaagctggaaaactcaacgcaggccgaggaaggatttgatgtgcctgactgcaaaaagactatcgtcaacgattcaagggaaagctgcgtagaggagaacgacgataagataacccaggcctcccaaagtcaagaatcagaggattacagccaacccagcacaagttcgtcaatcatttactcatcccaggaggatgtgaaggagttcgagcgagaagagacccaagataaagaggagagtgtggaaagctctctgccactgaatgcaattgaaccctgcgttatttgccagggaaggccaaaaaatgggtgcatcgtccacggcaagactggccacctgatggcctgtttcacttgcgcgaagaagttgaaaaaaaggaacaagccatgcccagtgtgtaggcagcccatccagatgatcgtactgacttatttcccttag

SEQ ID NO: 15885 - DNA, 732 bp, Artificial Sequence
  Description of Artificial Sequence: Synthetic coding sequence
atgtgcaacaccaatatgagtgttccaacagacggcgccgtaacgacaagccagattccggctagtgagcaggaaacattggttcgacccaagccccttttgctgaagctgcttaaaagcgtcggggctcagaaagatacatataccatgaaagaagactactggaaatgtacctcctgtaatgagatgaatcctcccttgccaagccactgcaaccgatgttgggctcttcgcgagaactggctcccagaggacaagggtaaagataagggcgagatcagcgagaaggccaagctcgagaactcaactcaggctgaagaggggtttgacgttcctgactgcaagaagacgattgtgaacgattccagggaatcatgcgtagaggagaatgatgacaagattacccaggcttctcagagccaggagtctgaagattactctcaaccgagtacgagtagctcaataatttactcatcacaggaggacgttaaggagtttgagagggaggagactcaggataaagaggagagcgtggagtccagccttcccttgaacgccatagagccttgcgtcatctgtcagggcagaccaaaaaatggttgtattgtacatggcaaaacggggcatctcatggcttgcttcacctgcgcaaagaagcttaagaaacgcaataaaccctgcccagtgtgtcgccagcctattcagatgatagtgctgacctacttcccttag

SEQ ID NO: 15886 - DNA, 657 bp, Artificial Sequence
  Description of Artificial Sequence: Synthetic coding sequence
atgtgtaacactaacatgtcagttccaaccgatggcgccgtgactactagccaaattccagcttcagagcaggaaacactcgactactggaagtgcacgagctgtaatgagatgaatcccccactgccttctcactgcaaccgctgctgggctctgagagagaactggctccctgaggacaagggtaaggacaagggtgaaatctctgagaaggccaagctggagaacagtacacaggcagaagaaggctttgacgttccagactgtaagaaaactatagtcaacgactctcgggagtcctgtgttgaagagaatgacgataagataacacaggcaagccagtcgcaggagagtgaggactactcacagccaagtactagctcaagcattatctatagcagtcaggaggatgtcaaggaattcgaaagggaggaaacacaggataaggaggaaagcgtggaaagttcactccccttgaatgctatagaaccttgtgtgatctgtcagggcaggcccaaaaatggatgcattgtgcacgggaaaaccgggcacttgatggcctgttttacttgcgccaaaaagctgaagaaacgcaataaaccctgcccagtgtgccggcagcctatccagatgattgtgctaacgtatttcccctag

SEQ ID NO: 15887 - DNA, 657 bp, Artificial Sequence
  Description of Artificial Sequence: Synthetic coding sequence
atgtgtaacactaacatgagtgtccctacagatggcgcggttaccacatctcagatacccgcctccgaacaagaaacacttgactactggaaatgcacatcatgtaacgaaatgaacccacctttaccaagtcactgcaaccgatgctgggccctgagagagaactggcttcccgaggataaaggcaaggataagggcgaaatctccgaaaaagctaagctggagaattctactcaagccgaagagggcttcgacgtgccagattgcaagaagaccatcgtgaatgacagtcgagagtcatgtgttgaggaaaacgacgacaagattacacaagcgtctcagtcacaggagtctgaagattatagtcagccctccacctcgagttccataatttactcaagccaggaggatgtgaaggagttcgagcgcgaggagactcaggacaaggaggaaagcgtggagtctagcctgccactgaatgcaatcgagccttgcgtcatatgtcagggaagacctaagaacgggtgcattgtgcacggaaaaaccggacacttgatggcctgctttacctgcgccaagaaactgaagaaaaggaataagccttgtccagtgtgcaggcagccgattcagatgatagtgctcacatatttcccctag

SEQ ID NO: 15888 - DNA, 771 bp, Artificial Sequence
  Description of Artificial Sequence: Synthetic coding sequence
atgtgcaatactaacatgtcagtgcccaccgacggggccgtaaccacctctcagataccagctagtgaacaggagacgctggtgcgcccaaaaccactgttactgaaactgttaaaatctgtcggtgctcagaaggacacttacaccatgaaggaagtgttattctatctgggtcagtacataatgacaaagagactctacgacgagaagcagcaacatatcgtctattgcagcaacgacctgttaggagacctgttcggcgtgcccagtttttctgtgaaggagcatcgaaaaatctacactatgatctaccgcaatcttgtcgtggtgaatcaacaggagtcttccgactctgggacatcagttagcgagaaccgttgccacctcgagggcggttctgaccaaaaagacctcgtgcaggagctgcaggaggagaagccgagctcttctcatttagtgtcacgcccctctacatcatcaagaagacgtgccatcagtgaaaccgaagaaaattcggatgagctatccggggaacgccagaggaaaagacataaatccgatagcatctcactctcctttgacgagtctctggctctatgcgtaattcgtgaaatctgctgtgagagaagctccagttccgagagcacaggaacaccatctaaccctgatctggacgctggcgtgtatcaagtgacggtttaccaagccggcgaatctgacacagacagcttcgaagaggaccctgagattagtttagccgattattggtag

SEQ ID NO: 15889 - DNA, 813 bp, Artificial Sequence
  Description of Artificial Sequence: Synthetic coding sequence
atgtgcaacacaaatatgtctgtgccaaccgacggggccgttacaacttcccagatccccgcgagcgaacaggaaactctagacctcgatgcaggggtctccgagcacagcggggactggctagaccaggactccgtgtccgatcagttcagcgttgagtttgaggtggagtctcttgattccgaagactactccctgtctgaagagggacaagagctgagcgacgaagacgacgaggactactggaagtgtacctcttgtaacgaaatgaacccaccactgccttctcattgcaataggtgttgggcactgagggagaactggctgccggaagacaaggggaaagacaagggcgagataagcgagaaagccaaactggagaactccacccaagctgaggagggcttcgacgtcccagattgcaaaaagacaatcgttaatgacagccgagagtcttgtgttgaggaaaatgacgacaagattacacaagcctcacagagccaggaatcggaagattactcgcagccgagcacgtccagtagcatcatatacagctctcaggaggacgtgaaagaattcgagcgcgaagagacgcaggacaaagaagagtcggtcgaatccagcctacccctgaatgcgattgagccctgtgtcatatgccaaggacggccaaagaacgggtgtattgtgcacggtaaaacgggccatctgatggcctgctttacatgcgctaagaagctcaaaaaacgaaataaaccttgccctgtatgccgtcagccgatacagatgatcgtgctgacctacttcccttag

SEQ ID NO: 15890 - DNA, 1494 bp, Artificial Sequence
  Description of Artificial Sequence: Synthetic coding sequence
atggtgaggtcccggcagatgtgcaacacaaatatgtctgtccctacagacggagccgttaccacatctcaaatccccgccagtgagcaagagacgctggtccgtccaaagccactgttgctcaagctcctgaagagtgtgggagctcaaaaggatacctataccatgaaagaggttttattttacctcggacaatacattatgaccaaacgtctgtatgacgagaagcagcagcacatagtctattgcagcaacgatttattgggcgacctgttcggagtgccctctttttcagttaaggagcaccgaaaaatatacacaatgatttacagaaacctggtggttgttaaccagcaggagagttctgactccggaacaagcgtgtccgagaaccgctgtcacctggaggggggaagcgatcagaaggaccttgtccaagagctccaggaagaaaaacccagcagttcccatctggtgagtaggccgtcgacatcctctcgaagacgagccatctcagaaacagaagagaatagtgatgaactgtccggcgagcgccagaggaagcgccacaaatcagacagtatttcactcagttttgatgaatccctggcactgtgcgttattagagagatctgctgtgaacggagttcatcgtccgagtccacagggaccccaagcaaccctgacctggacgcgggcgtgtccgagcacagcggggattggttggatcaagattccgtgagcgaccagttctccgtagaatttgaggtcgagtcccttgactccgaggattattcgctgtctgaggagggccaggaactgtctgatgaggacgacgaagtttatcaggtcaccgtgtaccaggcaggggaaagtgataccgacagctttgaggaggaccccgagataagcctggccgattattggaagtgcacaagctgcaacgagatgaatccaccgctaccatcacactgcaacaggtgctgggctcttcgcgagaactggttacccgaagacaagggcaaagacaagggcgagatttcagagaaggctaagctggagaactccacccaggcagaggaaggatttgatgtgccagactgcaagaagacaatcgtaaacgactctagggagtcatgcgttgaggaaaatgacgacaagataacccaagcctcacagtctcaggagtcagaggattacagccagccatcaactagtagctcaatcatatatagcagccaggaagacgtcaaagagttcgagcgggaagaaacccaagataaagaggagtctgttgaaagttctctccctctcaacgcgattgaaccctgcgtgatttgccaggggagaccaaaaaatggatgtattgtccacggtaagaccgggcatctaatggcctgctttacctgtgctaagaaactcaagaaacggaataagccatgccccgtatgtcggcagcctatacagatgattgtgctgacatatttcccttag

SEQ ID NO: 15891 - DNA, 393 bp, Artificial Sequence
  Description of Artificial Sequence: Synthetic coding sequence
atgtgcaatactaacatgtccgtacccacggatggcgccgtaacaacaagccagataccagccagcgaacaggagaccctggtgcgacccaagcctttactcctgaaattattgaaatcggttggagcccagaaggacacatataccatgaaggagttcgagagggaggaaacacaagacaaggaggagtccgtggagtcatctcttccccttaacgcaattgagccatgtgtgatttgccaggggagacctaagaacggctgcatagtgcacggtaagactggacacctgatggcctgctttacctgtgctaaaaagttaaagaagcgcaataagccatgccctgtttgccgccagccaatacagatgatagttcttacttactttccatag

SEQ ID NO: 15892 - DNA, 774 bp, Artificial Sequence
  Description of Artificial Sequence: Synthetic coding sequence
atgtgcaacacgaatatgagtgtgcccactgacggcgccgtgactacatcacagatcccggcatcagaacaggaaaccctggttaggccgaaacccttgcttcttaaactgctcaaatcagttggcgcacagaaagacacttatactatgaaggaggtgctattctatttgggccagtacattatgaccaaacgactctatgacgaaaagcagcaacatattgtctattgtagcaacgatcttttgggggacctgttcggagtgccctcattttccgtaaaggagcaccgcaaaatatataccatgatttacagaaatctggtcgtcgtgaaccagcaggaatcttctgactcggggacctccgtgagcgagaatagatgccacctcgagggggggagcgaccagaaggatcttgtgcaggaactgcaggaggaaaagccgagctcttctcacctcgtctcaaggccatcaacaagctcacgccgccgagcaatcagcgagacagaagagaattccgatgaactgagcggcgagcgtcagagaaaacgtcacaaaagcgattccatttcattgagctttgacgaatcactggcattgtgtgttataagggagatctgttgcgagcgctcctccagcagcgagtcaacaggcacccctagcaacccagacctggatgccggtgtcagcgagcactccggagattggctggaccaggatagtgtttctgaccagttctcagttgagttcgaggtcgagagtctcgattccgaatag

SEQ ID NO: 15893 - DNA, 891 bp, Artificial Sequence
  Description of Artificial Sequence: Synthetic coding sequence
atgtgcaacacgaacatgtcagtgcccacagatggggctgtgactaccagccaaatccccgcttctgagcaggaaactctggatttggacgccggggtgtcagagcattccggtgattggcttgatcaggattccgtgtccgaccagttttcagtagaattcgaggtggagtcgctggacagcgaggattacagtctgtcagaggagggacaggagctgtccgatgaagacgacgaggtgtaccaggtgacagtttatcaggccggcgagagcgatacagattcattcgaggaggatcccgaaattagtctcgccgattactggaagtgtacgagctgcaacgaaatgaaccctcccctgccatcccactgcaatcggtgctgggctttgagggaaaattggctgccggaggataaaggcaaggataagggggaaataagcgaaaaggcaaaactggaaaattctactcaggccgaagagggatttgatgtgcctgattgcaaaaagacaattgttaacgactctcgtgagtcctgcgtggaagaaaacgacgataaaatcacacaagcaagccagtctcaggagtcagaagattactcacagcccagcacatctagcagcataatttatagctcacaggaggacgtgaaagaatttgagcgggaggagacacaggataaagaggaatcagttgagtcaagtctcccgctgaacgccattgagccatgcgtcatatgccagggtcgcccaaaaaacgggtgtatcgtacacggcaaaactggccaccttatggcctgtttcacctgtgcaaaaaaattgaagaaacggaataagccctgtcctgtgtgccggcaacctatacaaatgatagtgctgacttattttccatag

SEQ ID NO: 15894 - DNA, 1341 bp, Artificial Sequence
  Description of Artificial Sequence: Synthetic coding sequence
atgtgtaacactaacatgtccgtccctaccgatggggcagtaacaactagtcagatcccagcctccgagcaggagacactcgtgagacctaaaccactcttactcaaactgcttaagagtgtgggtgcccagaaggatacctacaccatgaaggagaaaatctacactatgatctacagaaatctggtcgtggtaaaccagcaagagagctcagacagtggcactagtgtgagtgagaatcgatgccacctggagggtggcagtgaccagaaagacctggtgcaagagcttcaagaggaaaaacctagcagctcacatctagtctccaggccatcaacctcatcgcgccggagagctatttccgagaccgaagagaactccgatgagctgtcgggggagcgccaacgcaaaagacacaagtctgacagcatatcactgagcttcgacgagagcctcgccttgtgcgtgatcagggaaatttgttgcgaacgcagttcgtcatccgagtcaaccggaactccttctaaccccgatctggatgctggagtctcagagcatagtggtgattggctcgatcaggactcggtcagtgaccagttctccgtcgagtttgaagttgagtccctggattcagaggactacagcctgagcgaagagggccaggagctctcagacgaggacgacgaggtgtatcaggtgactgtctatcaggccggagagtcggatactgattcattcgaggaagatcccgagattagcctagccgattactggaagtgtacctcctgcaacgagatgaacccccctctgccatctcactgcaatagatgctgggcactcagggaaaattggctgcccgaggataaggggaaagacaagggcgagatctctgagaaagcaaagcttgagaatagtactcaggctgaagagggctttgacgtgcccgactgcaagaagacgatcgtgaacgacagcagggaatcttgcgtcgaggaaaatgatgacaaaattacgcaagcttcacagagtcaagagtctgaggattattcccagccgtctactagtagttcaatcatctactcaagccaggaggacgtgaaggagtttgagcgagaggagacgcaggacaaagaagaatccgtcgagagttcactccccctgaatgctatcgagccttgcgtcatatgccagggccggcccaagaacggttgcattgtgcacggtaaaacaggacacctcatggcatgcttcacatgcgccaaaaaactcaagaaaagaaacaagccttgtccggtctgtaggcagcctatccagatgatagtcctgacttatttcccctag

SEQ ID NO: 15895 - DNA, 642 bp, Artificial Sequence
  Description of Artificial Sequence: Synthetic coding sequence
atgcctaatttcgtggtagattggagagtttatacagattcactctttctgacggtcgacttcggcctctgcgcagaagagagttccacatctaggaagcgcacgacagaggatgacatcccaaccctcccaacgtcagaacacaaatgtatacactccagagaagatgaggatctcattgagaatctggcacaggacgaaacctctcgtctagatctcggatttgaggagtgggatgtggcaggtctgccatggtggttcctaggcaacctgcgctccaattacacacctcgcagcaacggcagcacggaccttcagaccaaccaagacgttgggacagcaatcgtctcagatacaaccgacgatttatggttccttaatgaatctgtcagcgagcagctgggagtcgggataaaagtagaggctgcagacacagagcagacgagtgaagaagttgggaaggtgtccgacaaaaaagtgatcgaggtaggcaaaaatgacgacttggaggatagtaagagcttgtccgatgatacagacgtggaggtcacctctgaggacgagtggcaatgtacggaatgtaagaaatttaatagcccatccaaacgctattgctttaggtgctgggccctgcgaaaatag

SEQ ID NO: 15896 - DNA, 396 bp, Artificial Sequence
  Description of Artificial Sequence: Synthetic coding sequence
atgacctccttctcaacatccgcgcagtgcagcacttccgacagcgcgtgtcgtatctcccccggccagataaaccaggtgcggcctaaactgccactgctcaaaatcttgcacgctgcaggagctcaaggcgaaatgttcactgttaaggaggtcatgcactatttgggtcagtacattatggttaaacaactttacgaccagcaagaacagcacatggtctactgtggcggtgatctgctcggagagctgctaggcagacaatcatttagtgttaaagatccttcacccctctacgacatgctgcgcaagaatcttgtgaccctggctaccgcgacgaccgaaatgggccacttattctgtcgcataagccacgccttggaattggccgactag

SEQ ID NO: 15897 - DNA, 1473 bp, Artificial Sequence
  Description of Artificial Sequence: Synthetic coding sequence
atgacgtcatttagcacctccgctcagtgtagtacctcagactcagcttgccggatttcacccggccaaattaatcaagtgcgacccaagctgcccttgctgaagattttgcacgccgccggcgcccagggagagatgtttacagtcaaggaagttatgcactatttgggtcagtatatcatggtaaaacaactttacgatcagcaagaacagcacatggtgtattgcggtggggacctgctgggtgaattactgggtaggcagagtttcagcgtgaaggacccgtcccccctctatgatatgctccggaagaacctggtgacgctggcgaccgccacgacggatgctgcgcagactctggccctggctcaggatcattccatggacatccccagccaggaccagctgaaacagagcgcggaggaatcatcaacatccagaaagcggaccacagaagacgacattccaaccctccctacgtctgaacacaagtgcatccatagtcgcgaggacgaagacctaatcgaaaacctggcgcaggacgaaacgtcccggctggacctcgggttcgaggagtgggacgttgctgggctaccctggtggttcctgggtaacctacgcagcaattatactccacgttctaatggatccacagacctccaaacaaatcaagacgtgggcactgctattgtgtcggataccacagatgatctgtggtttctaaatgaatctgtatcagagcagctgggagtgggaatcaaggtggaagccgcggacacagagcagacgagcgaagaggtgggtaaagtaagcgataagaaagttatcgaagtgggcaagaacgacgacttggaagactcaaagagcttgtccgatgataccgacgtggaggttacgagcgaggatgaatggcagtgtaccgagtgcaagaaatttaacagcccttctaaacgctattgcttccggtgttgggctctccgcaaggactggtatagcgattgcagcaagctgacccactcactgagcacctccgacattaccgcaatacccgagaaagagaatgaaggcaatgacgtgcctgattgcaggaggacaatttccgctccagtggtcagacccaaagacgcttatataaaaaaggagaactctaagctatttgatccttgcaactctgtggagttcctagacttggcccattcttctgagtcccaggaaactatttcctccatgggtgagcagttggataacttgtcggagcagagaaccgataccgaaaatatggaggattgtcaaaatctactgaagccctgtagcctctgcgaaaagcgcccacgcgatggaaatattattcatggcaggacgggacacctggtgacttgttttcattgcgcgaggaggctgaagaaggctggcgcctcatgtcccatttgcaagaaggagattcagttagtaattaaggtgtttatagcttag

SEQ ID NO: 15898 - DNA, 495 bp, Artificial Sequence
  Description of Artificial Sequence: Synthetic coding sequence
atgacatccttctctacttcagcacagtgctcaacgtcagacagcgcctgtaggatatctcccggacaaatcaatcaggagaatgaggggaatgacgtgcccgattgtaggaggacaatttcagctccagtggtgcgacccaaagatgcatacattaaaaaagagaactctaaactgttcgacccgtgcaacagcgtggaattcctggatctggcccacagctcagaatcccaagaaaccatcagttcgatgggagagcaactagacaacctgtccgagcaaaggactgacactgagaatatggaggactgtcaaaaccttttgaaaccatgttccctgtgtgagaagcgcccccgagatgggaacatcatacacggaaggacaggccacctcgtgacatgctttcattgcgcccggagacttaagaaggcgggtgcgagctgtccgatctgcaagaaagaaatacaactcgttattaaagtctttattgcctag

SEQ ID NO: 15899 - DNA, 423 bp, Artificial Sequence
  Description of Artificial Sequence: Synthetic coding sequence
atgacctcattttctactagtgcccagtgttccacttcagattctgcttgtagaatcagccctggacaaatcaaccaggtgcgtcctaaattgcccctcctgaagatcctccacgcagctggggctcagggcgaaatgtttaccgttaaggaggtaatgcactacttaggccagtatataatggtaaagcagctttatgatcagcaggaacagcacatggtatactgcggcggagacttactaggggagctattggggcgccagtcattcagcgtgaaagacccttccccgctatacgatatgcttcggaagaacctggtcaccctggccactgcaactactgccaagtgccgaggaaaatttcattttcagaagaaaaattatcgcagaaggtaccctcatacggcttatttacgtgcatag

SEQ ID NO: 15900 - DNA, 516 bp, Artificial Sequence
  Description of Artificial Sequence: Synthetic coding sequence
gacttaattgagaatctcgctcaggacgagacgtccaggctggacttaggatttgaagaatgggacgtggccggcctgccctggtggtttcttggtaacctgagatctaattacactccgcgctctaacggctcaacagatctgcaaaccaaccaggtgattgaggtcggaaaaaacgatgaccttgaggactccaaaagcctatccgatgacacggacgtggaggtgacaagcgaggacgaatggcagtgcacagagtgcaagaaatttaacagcccgagcaagaggtattgctttagatgctgggcgcttagaaaagattggtattccgactgtagcaaacttacacacagcttgagcacatccgatataactgccataccagagaaagaaaacgagggaaacgacgtcccggactgtcggaggacgatctctgcccctgtggtacgacctaaagatgcttatatcaaaaaggaaaattctaagctattcgatccatgtaattcagttgagtag

SEQ ID NO: 15901 - DNA, 1323 bp, Artificial Sequence
  Description of Artificial Sequence: Synthetic coding sequence
atgacaagcttctccacttccgcgcagtgttctacctctgattcagcttgcagaatctcacccggccagataaatcaggtgcgacctaaactacccctgctaaagatcctccacgcggccggcgctcagggagaaatgttcacagtcaaagaagttatgcattatctcggccaatacatcatggtgaagcaactctacgaccagcaggagcaacacatggtctactgcgggggcgatctgctcggtgaactcctcggccgccagtccttctcagtgaaagacccttctcccctgtatgacatgctccgtaaaaacttagttactcttgctaccgcaaccactgacgctgctcagactttggccctggcccaagatcactccatggacatccctagtcaagaccaactgaaacaatcagccgaggaatccagtacttctagaaaaagaactactgaagacgatattcccaccctgcctacctcagagcacaagtgcatccactctcgagaggatgaggatctgatcgagaatctggctcaggatgagacatcgaggctggatttgggctttgaagagtgggatgttgcgggacttccgtggtggttcttgggaaacctgcgaagcaactacactccacgaagcaatggctccacagatcttcagacaaaccaggtgatcgaggttggaaagaacgacgatctggaagacagtaagtccctgtccgacgacactgacgttgaggtcacttccgaagatgagtggcagtgcacagagtgtaagaaatttaactcccctagcaagcgctattgtttcagatgttgggcccttcgtaaggattggtatagcgactgttccaaactgactcacagtctgtcgaccagcgacatcaccgcaatccccgaaaaagaaaatgaaggaaacgacgttccagactgcaggaggactattagtgcaccggtggtaagaccaaaagacgcatacatcaagaaggaaaactctaaactttttgacccatgcaatagcgttgagtttctagacctcgcccattcaagcgagagtcaggagactattagctccatgggagagcaactcgacaatctgtcagagcagcgaactgacactgaaaatatggaggattgccagaacctgctgaaaccctgctccctgtgtgaaaagcgtccaagagatggaaatataattcatgggcgcactggccacctcgtgacgtgctttcactgtgcgaggagactgaagaaagcgggggcctcctgtcctatttgcaagaaggaaatccagctggtgatcaaagtattcatcgcctag

SEQ ID NO: 15902 - DNA, 384 bp, Artificial Sequence
  Description of Artificial Sequence: Synthetic coding sequence
atgacctcattctccaccagcgcacagtgtagtacgtctgatagtgcttgcagaatttcccccggtcagattaaccaggtccgaccaaagcttccactgcttaagatccttcatgcagcgggagcccagggtgagatgtttaccgtgaaagaagtcatgcactatctggggcagtacattatggtgaaacagttatacgatcagcaggaacagcatatggtttactgcgggggcgacctcctgggagagttgctcggtcggcaaagtttctcggtgaaggatccgagccccctgtatgacatgctgcggaaaaatttggttacgctcgcgacagcgaccacagggtgtcagagacgagtcaatggaccgcagagggcatggtag

SEQ ID NO: 15903 - DNA, 462 bp, Artificial Sequence
  Description of Artificial Sequence: Synthetic coding sequence
atgaccagctttagtacctcagcccaatgttccaccagcgattcagcgtgtcgcatttcccccggccaaatcaatcaagtgcgacctaagctgcctttgctcaagatcctccatgcagcaggggcacagggcgagatgttcacggtgaaggaggtcatgcattacctggggcaatatattatggttaaacagctttacgaccagcaggaacaacatatggtttactgtggaggagacctccttggtgaactgcttggccgacagtcgttctctgtgaaagatccttcccctctgtacgatatgctcaggaagaatcttgtcactttggctacggcaactacaggctcccagtacggctattcgaagtcaagacctacagaggcaaaatgcagaggaaaattccactttcagaaaaaaaattataggcgccggtacccccacaccgcttacctgcgggcatag

SEQ ID NO: 15904 - DNA, 7650 bp, Artificial Sequence
  Description of Artificial Sequence: Synthetic coding sequence
atgctggggacggggccggctgccgctacaaccgctgctaccacctcttccaacgtgagtgtgcttcagcagtttgcttcggggttgaagagccgaaatgaggaaacccgagcaaaagcagctaaggaactgcaacactatgtcacgatggagcttagggagatgagtcaggaggagagcaccaggttttatgaccagcttaaccatcacatattcgagctagttagttcctcggacgcaaatgaacggaagggaggtattcttgctattgcatcgcttataggagtggaggggggaaacgctaccagaatcgggcggttcgcgaactatttacggaacctgcttccatctaacgatccggtggtcatggaaatggcttctaaagccattggacggctggcaatggcgggagacacatttactgcggaatatgtggagttcgaggtcaaacgcgcactggagtggctgggggccgatcgaaacgaagggcggcggcacgctgccgtcctcgttctgagagagttagcaatctctgtccccacgtttttctttcagcaggtgcagccattctttgacaatatcttcgtcgcagtctgggaccccaagcaggccatccgagagggcgcggtggccgcgctccgggcctgcctaatcttaacgactcaacgggagcccaaagagatgcagaagccccaatggtacagacatacctttgaggaagcagagaagggctttgacgaaaccctggccaaggaaaaaggaatgaatcgcgatgacaggatccacggcgccttgcttatcctcaacgaattggtacgcatctcctcaatggagggtgagaggctccgcgaggaaatggaagaaatcacacagcagcagctggttcacgacaagtactgtaaagacctgatggggtttggcaccaaaccccggcacatcacaccatttacttcatttcaggcggtgcagccccaacagagtaacgccctcgtcggcttactgggttattctagtcaccaaggtcttatgggcttcggcacaagcccctctccagcaaagagcactctcgtagaatcaagatgttgcagagaccttatggaggagaaatttgaccaggtgtgccaatgggtattgaagtgcagaaattccaagaactcacttatccaaatgaccatccttaatctgctcccccgcctggcagcctttcgtccctcagcgtttacggacactcagtatctgcaagatacaatgaatcatgtgctgtcatgcgtaaaaaaggagaaagaaaggaccgctgcgttccaggccctcggactcctatctgtcgcagtgagatccgagtttaaggtgtatctgcccagagtcctggatattatacgagcggcactgcctccaaaggacttcgcacataaaaggcagaaggcaatgcaggtggacgctaccgtcttcacctgtataagcatgttagctcgggctatgggccccggcatccagcaggacattaaggaactcctggagccgatgcttgcagtaggtctgagccctgccttgacagcagttctctacgacctctcccggcaaatcccacaactcaagaaggacatacaagatggactcctgaagatgctaagtctggtcctgatgcataaaccgttgcgccatcctgggatgcctaagggcctggcccatcagctggcaagtcctgggctcaccacactgcctgaagcctctgacgtggggagcattacgctcgctctccgcacactggggtccttcgagtttgaagggcactcactgacccagttcgtgcgtcactgtgcagaccactttctaaatagcgagcacaaagaaattcgcatggaagccgctaggacctgctccagacttctcactccttctattcacttaatttcaggccatgctcatgtggtcagccagactgcagtgcaagtggtggctgacgtgctctccaagttattggttgtcgggattactgatcctgatcctgatattcggtactgtgtccttgcctccctggatgaacgcttcgatgcccacttggctcaggccgagaacttgcaagccctgttcgttgccctgaacgaccaggtgtttgagatccgtgaactggctatttgcaccgtcggacgactgtcaagcatgaatcctgcctttgtcatgccctttctgcgtaaaatgttgattcagatacttaccgaactggaacacagcggaatagggcggatcaaagaacaaagcgccagaatgttaggtcatctcgtgtccaacgctcctcgattgatccgaccctatatggagcctattctgaaagccctgatattaaagctgaaggacccagaccctgacccaaacccaggcgtgataaataacgttcttgcgacaattggagagctggcgcaggtcagcggtcttgagatgcgcaaatgggttgatgagctgttcattatcattatggacatgctccaggactccagtctgctggccaagcgccaggtggccctgtggacattagggcagctggtggctagcactggctacgttgtcgagccttatcggaaatatccaacactgctggaggtgttgctgaattttctgaagactgaacaaaatcaaggaaccaggagggaggctatccgagtgctgggactgctgggcgctctggatccttacaagcacaaagtgaacatagggatgatagatcagtcacgggatgccagtgccgtgtctctatcagagtcaaagtctagccaagactcctctgattattcaaccagtgaaatgctggttaacatgggcaatctgcccctggatgaattttaccccgccgttagcatggtggccctcatgcgcattttccgtgaccagagcctgtcccaccatcacaccatggtcgtccaggccatcacttttatctttaagagcctcggcctcaagtgcgttcaatttttgccccaggtaatgcctacatttctgaacgtgattagggtctgtgacggcgctatccgggagttcctattccagcagctgggcatgctggtctcatttgttaagtctcatattcgaccatatatggatgaaatagtgacccttatgcgtgagttttgggttatgaacacgtcaattcaaagcacaattatcttgctgatagagcagatagtagtggcactggggggggaatttaaactgtaccttcctcagctaattccccatatgttaagggtgttcatgcacgataacagtccaggcagaatcgtctcaatcaagctccttgccgccattcagctgttcggagccaacctggacgattacctgcatctcctactccctcctatcgtgaaactctttgacgcgcccgaggcgcccctgccgagtcggaaggctgcgctggaaacagtggatcggctgacagaaagtttggactttacagactatgcatctcgcattatccacccgatcgtgcgcacactcgaccagtctcccgagcttcgtagtactgctatggacactctcagtagccttgtgttccagctgggtaagaagtaccagatttttattcccatggtcaataaggtactggtccgccaccgcatcaaccatcagagatacgatgtgctgatctgccgcatcgtgaagggttacacacttgccgatgaagaagaagacccactaatataccagcacaggatgttaagatctggacaaggagatgccctcgcatccggacccgttgaaacaggtccaatgaagaaactccacgtgtcgaccatcaatctgcaaaaagcctggggcgcagccagacgcgtgtcgaaagacgactggctggagtggcttaggaggctgtctctggaattactaaaggattcgtccagtcctagcctgaggtcttgttgggccctggcacaggcttataaccccatggccagagacctgttcaacgccgcattcgtgtcttgttggtccgaactcaacgaagatcagcaagacgaattaataagatccattgaacttgcactgacctcacaggacattgcagaagttacccagacactgctaaatctggccgaatttatggaacacagtgataagggacccttgcccttgcgtgacgacaacggtatcgtgctgttgggagagcgagccgccaagtgccgagcctatgctaaagcactgcactacaaggaactggaatttcagaaaggcccaacccccgcaattctggaaagcttgatttccattaacaataaactgcagcagcctgaagcggctgccggcgtgctcgagtatgctatgaaacattttggcgaacttgaaatacaagctacatggtatgagaagcttcatgaatgggaagatgccctggtggcctacgataaaaaaatggatactaataaggacgacccggaactgatgctggggagaatgaggtgtctcgaagcattaggcgagtggggccaactgcaccaacaatgctgcgagaagtggaccttggttaatgacgagactcaggctaagatggcccggatggccgcagctgccgcatgggggcttggacagtgggatagtatggaagagtatacttgcatgattcctagggacacccacgatggagctttctatagagccgtgctcgcgttgcaccaggatttgttctcactagctcaacagtgtatagacaaagctcgggatctgctcgacgctgagttgaccgccatggccggtgagtcttattcacgtgcgtacggcgctatggtctcatgccacatgctctcagagctcgaagaagtcatacagtacaagctggttccagagcgccgggagatcattcgtcagatttggtgggagaggttgcaaggttgtcagcgaatcgtggaagactggcaaaagatcttaatggtaagatcacttgtggttagcccccatgaagacatgcgcacctggttgaagtatgcctccctgtgtggaaagtcgggtagattggccttagcacacaaaaccctggtgcttcttcttggcgtggatccatcccgccagctggatcaccctcttcccacagtgcatccgcaggttacatatgcgtacatgaaaaacatgtggaagtccgcccgaaagatcgacgcctttcagcacatgcaacactttgtccagacaatgcagcagcaggcccagcacgccatcgccaccgaagatcagcagcataaacaggagctccataagctgatggcacgttgtttccttaagctgggggaatggcaattaaacctgcagggcattaacgaatccaccatccctaaggtcctccagtactattcggccgctaccgaacacgacaggtcctggtataaagcatggcatgcctgggccgttatgaattttgaggccgtcttacactacaagcaccagaatcaagcccgtgacgagaagaaaaaattgcggcacgcgagtggagctaatatcactaacgctaccacggccgcaactaccgcagctacagccactaccactgcctccaccgaaggctccaactcggaatctgaagctgagtccactgagaacagccccacgccatcaccactccagaaaaaggtgacagaagatcttagtaagacactcttgatgtataccgtgccagccgtgcagggtttttttaggtctatctccctcagcaggggaaataatctgcaggacacactgcgcgtccttactctgtggtttgactatgggcactggcccgacgtgaatgaggctcttgtggagggagtgaaggcgatacagatagatacttggctacaggtaattccccagctgatagcgcgaatcgacacccctaggccgcttgtcgggcgtctgattcaccagctcctgaccgacattgggagataccacccgcaggcccttatttaccctctgacggtggcatccaaatccactacaaccgcacggcacaatgcagcgaacaagattctgaagaacatgtgtgagcatagcaatacattggtccagcaggccatgatggtctccgaggaactaattcgcgtggcaattctttggcacgaaatgtggcatgaaggcctggaagaagcctccaggttgtactttggcgagcgaaacgtgaagggcatgtttgaggtattggaaccattgcacgccatgatggagcgaggtccccagacccttaaagagacatcgtttaaccaggcttacgggagggatctgatggaagcccaggaatggtgtcgtaaatatatgaaatctgggaacgtcaaagacctcacacaagcatgggacctctactaccatgttttccggcgcatcagtaaacagctcccccagttgacgagccttgagctgcagtatgtgagccccaagttgctcatgtgtcgcgacctggagctggccgtcccaggaacctacgatcctaaccagccaatcatacgcattcagagtattgcgcctagtttacaggtgatcacaagcaaacaaaggcccagaaaactcaccctcatgggcagcaatggccacgagtttgtgtttttattaaagggccatgaggacctccgacaggatgagagagtcatgcagctgtttggcttggtgaacaccctgttagccaatgaccccaccagtttaaggaaaaatttgagtatccagcgctacgccgtaattccgctttcgacaaattccggcctgattggatgggtaccccactgtgatacactacacgctctcattagagattacagagagaagaaaaaaattctccttaacatcgagcacagaatcatgctgagaatggcgcccgactacgaccatctgaccctgatgcaaaaggtggaggttttcgagcacgcagttaataatacagccggagatgatttggctaagctcctgtggctgaaatcacctagctcggaggtctggttcgacaggcgaaccaattacactcgatcccttgccgtcatgtccatggttgggtatatcttagggctgggcgaccgtcatccttccaatttgatgttggaccgattgtctgggaagatactgcacattgacttcggcgactgcttcgaggtggctatgacccgtgagaagttccccgagaaaattccatttagactgacgagaatgcttacaaacgccatggaagtgacaggattggatggcaactaccggatcacctgtcacactgtcatggaggttttgagggagcataaggactccgtcatggccgtgctcgaggcattcgtctatgacccactcctgaattggcggcttatggacaccaacaccaagggcaacaagcgctccagaacaaggacggattcctattccgcaggtcaaagtgttgaaattttggatggggtcgagctgggtgagcctgcccataaaaagaccggtactacagtgccagagagcatccactcgtttattggcgacggactggttaaaccagaagcgctgaacaaaaaggccatacagattattaatcgcgtgcgggacaaactgacaggccgcgacttctctcacgatgataccctggacgttcctacacaggtggagttgctcatcaaacaggctacatcacacgaaaacctgtgccagtgttatattggatggtgccccttctggtag

SEQ ID NO: 15905 - DNA, 2265 bp, Artificial Sequence
  Description of Artificial Sequence: Synthetic coding sequence
atgaattttgaggctgtcctgcactataagcaccagaaccaggccagggacgagaagaagaagttaagacacgcttccggtgccaatatcaccaatgctactacggcagcgactactgcggccaccgccaccacaaccgctagtactgagggatctaactcagaatcagaggcagagtccaccgagaactccccaactccatcccctttgcagaaaaaggttactgaagacctgtctaaaactttgttgatgtataccgttccggcagttcaggggtttttccggtcaatctcactttcccggggcaataaccttcaggacaccctccgcgtgttgaccctgtggtttgactacgggcattggcccgacgtcaatgaagccctcgtagagggggtcaaggccatccagatcgatacatggctgcaggtgataccccagttgatcgccagaattgacactcctcgcccactggtcggaaggctgatccatcagcttctcactgatattggaagataccatccccaagccctcatctatccattgactgtggccagtaagagcacaacaactgccaggcacaacgccgcaaacaagatcctcaaaaacatgtgcgaacactccaatacactggtgcagcaggccatgatggtctccgaggagctgattagagtggccatcctatggcacgaaatgtggcatgaaggcctcgaagaggccagcagactgtactttggagagaggaacgtgaaaggtatgtttgaagtgctagagccactgcatgcaatgatggagcgggggccacagaccctgaaggaaacttccttcaatcaggcatatggtcgagacctgatggaggcccaggaatggtgcaggaagtacatgaagagtggtaacgtcaaggacctcacccaagcttgggatctctattaccacgtgttcagacgtatcagtaagcagctgccacaactcacctcgcttgagctgcagtacgtgtctccgaagttgctgatgtgccgtgatctggaattagctgtgccaggcacttacgatccaaaccagcccattataagaatccagtctatagccccttccctgcaggttatcacctctaagcagaggccccgcaagctgacattgatgggcagtaatggccacgagttcgtctttctgctcaagggccacgaggatctccgccaggacgaacgtgtcatgcagctctttggactcgtgaacactctcctagccaacgaccccacctctctacggaagaatctctccattcagagatatgccgtaatacctctttcaacaaacagtggtctaatcgggtgggtcccacactgcgacacacttcatgcgttaatccgggactacagggaaaaaaagaagattctgctgaatatcgaacacaggattatgttgagaatggctcccgattacgatcacctaacactgatgcaaaaggtcgaagtgttcgaacacgccgtgaataacacggcaggtgacgacctcgctaagcttctctggctgaaaagcccctccagtgaggtttggttcgacaggaggaccaactatactcggagtttagccgtcatgtccatggtgggctacatcctgggattgggggaccgccatcctagtaatctgatgctggatcggttgtccggaaaaatcctgcacattgattttggagattgctttgaggtggcgatgacccgggaaaaattccccgagaaaatcccattccgtctcacacggatgctgaccaacgcgatggaggtcactgggctggatggtaactatcggatcacatgccacaccgtgatggaggtgttaagggaacacaaagattcagtgatggccgttctggaggccttcgtctatgatccacttctcaactggcgactcatggatactaacacaaaggggaataagcgtagtaggacgcgcactgactcatatagcgccggtcagagtgtggagatcctcgatggggtcgagctgggagagccggcccacaaaaaaactggtacgacggttcctgagtcgattcactctttcattggtgacggcctggtgaagcctgaggcactgaacaaaaaagctatccaaatcataaacagagtgagggataaactgaccggaagagacttttcacatgatgatacactggacgtccctactcaggtagagctactcatcaagcaggcgacatctcatgagaacctgtgccaatgttacattgggtggtgccctttttggtag

SEQ ID NO: 15906 - DNA, 486 bp, Artificial Sequence
  Description of Artificial Sequence: Synthetic coding sequence
atgcttgaccgactctctggaaaaattctccatatcgacttcggggactgcttcgaggttgccatgactcgagagaagttcccagagaaaatcccattccgcttaacccggatgctgactaatgcgatggaggtaactgggctggatgggaactaccgcattacctgccatactgtaatggaagtgctgcgagaacacaaagacagcgtcatggccgtgctggaagccttcgtctacgacccactgctcaattggagactgatggacacaaataccaagggaaacaaacgtagccgaactcgcactgactcatacagtgccggacagagcgttgaaatcctggatggtgtggagttgggtgaaccagctcacaagaagaccggaaccactgttcctgagtctatccattcctttattggcgacggtctcgtgaagcctgaagccctcaataaaaaggccatacagatcatcaatagagttaggtag

SEQ ID NO: 15907 - DNA, 5187 bp, Artificial Sequence
  Description of Artificial Sequence: Synthetic coding sequence
atgctgggaaccggacccgccgccgccaccaccgcagctactacaagcagtaacgtgagcgtcctgcagcaatttgcatcaggcctcaaatccagaaacgaagagactcgcgccaaggccgccaaggagctgcagcactatgtgacaatggaactccgcgaaatgtctcaggaagaatccacgcgtttctacgaccagttgaaccaccatatcttcgagctggtgtccagtagcgacgccaacgaacggaaaggtgggattctggctattgcgagcttaattggcgtggagggagggaacgccacccgaatcggacggttcgctaactacctgcggaatctgttgccttccaatgaccctgtggtcatggagatggcctccaaggcgataggaaggcttgcaatggcaggcgacacatttacagctgagtacgtggagtttgaggtgaagcgcgctctcgaatggctgggtgcagatagaaatgagggtcggcggcatgcagctgtgctggtgctccgtgagctggctatttcggtaccgacctttttctttcagcaggttcagccgtttttcgacaacatctttgttgctgtgtgggaccccaaacaggcaatccgggagggtgcagtcgcagccttgagagcctgcctgatactcacaacccaaagagaacctaaggagatgcagaagccacaatggtaccgtcataccttcgaggaagcagagaaggggttcgatgaaactctggccaaagaaaagggtatgaacagagacgaccggattcatggagcattgttgattctcaatgagctggtgcgtatctcgtctatggagggcgagagattgcgcgaagagatggaggaaattactcagcagcaattggtccacgataagtattgcaaagatctgatggggttcgggacgaagcctcgccacataacgccgttcacatcatttcaagctgttcagccgcagcagagcaacgcactcgtgggcctgctcggttactcaagtcaccaggggcttatgggattcggtaccagtccaagccctgcgaaaagcacactagtggagtctcggtgttgccgggatctcatggaagagaaattcgatcaagtttgccaatgggtgctcaagtgtaggaactccaaaaactcccttatacagatgactatcctgaacctgctcccacggctggccgcatttagaccaagcgcgttcaccgatacccaatatcttcaagataccatgaaccacgtcctgagctgcgtgaagaaagagaaggagcgaactgcagcattccaggcgctcggactgctgtcagttgcagtccggtccgaatttaaggtctatctgcctagagttctggacattattagagcagctctgcctcccaaagacttcgcccataagagacagaaagccatgcaggtcgacgccactgtgtttacttgcattagtatgttagcccgcgcaatgggacccggcattcagcaagacatcaaggagttgctggagcccatgctggccgtgggtcttagccctgcactgactgctgtcctgtatgacctgtcccgccagatcccacagttgaaaaaagacatacaggacggactcctgaaaatgctttcccttgtcctaatgcacaagccattaaggcaccccggaatgccgaagggcctggctcaccaactggcatcacccggattaaccactctccctgaagctagtgacgtagggtctataacacttgctctgcgaacacttggcagttttgaatttgagggacatagcctcacccagttcgtgaggcactgtgccgaccactttctgaacagcgagcataaagagattagaatggaggctgctcgcacctgttctaggctcctgactccaagcatacaccttatttccggccacgcccatgtagtgtcccagaccgccgtccaggtggtcgcagatgtgttaagtaagttgctggtggtaggtattactgatcctgacccggacataagatactgcgtgttggcgagcctagatgagcgctttgatgcccaccttgcgcaggcagaaaacctacaggccctgtttgtcgccctgaatgaccaagtgttcgagattagagagcttgcaatttgcaccgtcgggaggctctcttccatgaaccctgctttcgtgatgcctttcctgagaaaaatgctgatccagattctcaccgaactggagcactccgggatcggaagaatcaaggagcaaagcgcaaggatgctaggacatctcgtgtctaacgccccacgcctgattcggccgtatatggagcctattctgaaggccctgattttaaagcttaaagaccctgaccctgacccaaatcctggagtcataaataatgtcctggctacaatcggagagctggctcaagtatcaggtctcgagatgcggaaatgggtcgacgagctctttatcatcataatggacatgctacaggatagctctttgctggccaagcgccaggtagctctctggactctgggccaacttgtggcatctactggatatgtagttgagccctacagaaagtacccgacattgcttgaggtgctcctcaattttcttaagaccgagcagaatcagggtactcgccgcgaggcaatccgcgtgctgggccttctgggggcccttgacccctacaaacataaggtgaatatcggtatgatcgatcagagccgggatgcgtccgccgtttccctgtctgagtcgaagagcagccaggactcgtccgattattccacatctgagatgctggttaatatggggaatcttcccctggacgagttctatcctgctgtgtctatggtggctctgatgaggatttttcgcgaccaatctttgtctcatcatcatacaatggtcgtccaggccattaccttcatctttaaatccctggggctgaaatgcgtgcagtttctgccccaggtaatgcctacatttctgaatgtgattagagtgtgcgacggcgctattagggaattcctctttcaacagctgggcatgctggtgtcgttcgtaaaaagccacatacggccatacatggatgaaatcgttactctcatgagagagttctgggtgatgaacacatccatccagagcaccatcatattgttgatcgagcagatagtggtcgcactgggcggggagttcaagttatacctgcctcagctcatcccgcacatgcttcgcgtattcatgcatgataacagtccgggaaggattgtaagcattaaattgctggctgccattcagctgtttggtgcaaacctggacgattacctccaccttcttctaccgcccattgtgaagctgtttgatgcacccgaggctcctctgccatcccggaaggcggccctggagaccgttgatcgcctgaccgaatccctcgactttacagactacgctagtaggattattcacccaattgttcgaactctggaccaatctcctgagttgcgttccaccgcaatggacacgctatcctctttggtattccagttgggaaagaagtaccagatatttatccccatggtgaataaagtgctggtcaggcacaggatcaatcatcagcgatacgatgtgctgatatgccggattgtcaaaggttatacattggctgatgaggaggaggatccacttatttatcagcatcgaatgctgaggtccggccagggagacgccctggcctccggacctgtcgagactgggcctatgaaaaaactccatgtgtctacaatcaatttgcagaaggcatggggtgccgctcgacgggtttcaaaggacgattggttggagtggcttcgtagactaagcctggagctgctcaaagactcctcttccccttcactgcggtcttgttgggccttggcacaggcttacaatccgatggcacgcgacctgtttaatgcggcgtttgtgagctgctggtctgagctgaatgaagatcagcaagacgaacttatccggagtatagagttagccctgactagccaggatatagcagaggtgacccagactctcttaaatcttgccgaattcatggaacacagtgacaaggggcctctcccgctgagagacgataacggtattgtcctcttgggagagcgcgccgctaaatgtcgagcgtacgcgaaagcactgcactataaggagctcgaatttcaaaaaggacccacccccgctatcctggagtctttgatttccattaataacaagctgcagcaacccgaggcggctgccggcgtactggagtatgccatgaaacacttcggagagctcgaaattcaggctacatggtatgagaagctgcatgaatgggaggatgcactagtggcgtacgacaagaaaatggatactaataaagatgaccctgaactgatgctgggcaggatgcgttgtctggaagccctcggggagtggggacagctgcatcagcagtgctgcgagaaatggacactggtcaacgatgagacacaggccaaaatggctcggatggctgccgcggcggcgtggggacttggtcagtgggactccatggaagagtacacatgcatgatccctagagatacccacgatggcgctttctatcgagctgtgctggccctgcaccaagacctgttctctctggcacagcagtgcatcgataaggcgcgcgatcttttggatgccgaattgactgccatggctggggagtcatactctagagcctacggtgccatggtgagttgtcatatgctttccgagctagaggaagtgatacagtacaagctggtgcccgagcgtagagaaattataaggcagatctggtgggaacgactgcagggctgccagcgcattgtcgaggactggcagaaaattctgatggtccggtccctggtcgtgtccccacatgaagacatgcgaacttggctgaaatatgcatcattatgcgggaagtccggacggcttgccatcgcaccactgaatatgggtacagctaattcagctcagccccgctccttgcgctcgtggcgaacttggatcagaatcctggactgtaaagacaccgaggacgccgatctcacccctgccacctacccaaagacgtctctggtctgtgggcagcaacagaaatgtctgcaggaccggccgaaatag

SEQ ID NO: 15908 - DNA, 6270 bp, Artificial Sequence
  Description of Artificial Sequence: Synthetic coding sequence
atggaagacactcaagccattgactgggacgtagaagaagaagaagagactgagcagtcatccgagtccctgaggtgcaacgtggagccggtagggcgcctacacatcttcagcggggctcacggacctgagaaagacttccccctgcacctcgggaagaatgtagtgggccgtatgccagattgctccgtcgcccttccatttcccagcatatcaaaacagcacgccgaaatcgagatcctagcatgggataaagcccctatcttgcgagattgcggtagcttgaacgggacccagatattgcgacccccaaaagtgttaagccctggcgtgagccataggttgcgtgatcaggagctgatcctgtttgccgacctgctttgccagtaccacagactggacgtatccctgccatttgtgtctcgtggaccactgaccgtcgaagagacgccgagagtccagggggaaacccagcctcagcgtctgctcttggcagaggattctgaggaggaggttgactttttatccgaacgaaggatggtgaaaaagagcaggactacttcaagctcagtgatcgtacctgagtctgatgaagagggccatagcccagtactcggcgggttgggcccaccctttgccttcaatctgaatagcgataccgatgtcgaggaggggcaacagccggcaacagaggaagcttcctcagcagccagacgcggagctactgtcgaagcgaaacagtctgaggcggaggtggtgacagagatccagctggagaaggaccaaccccttgtgaaggagaaggataacgacactaaagtcaaaagaggggccggaaatggagtggttccagcaggagtcatcctggagcgctcccaaccacccggcgaggattcagatactgatgtggacgacgacagcaggcctcctgggcggcctgctgaggtccacctcgagagggcacagccattcggtttcattgatagcgataccgatgcagaggaagagagaattcctgcaactcccgtggttatccctatgaagaaacgcaagatctttcatggcgtgggaactcgtggtccaggtgcccccgggctcgcacacttacaagaatcccaggcagggtccgatacggacgttgaggaggggaaagcgcctcaagccgttcctcttgagaaaagccaggcttcaatggtcattaactctgataccgacgacgaagaagaagtttcagccgccctgacactggcgcatctgaaagagtctcagcctgcaatttggaacagggacgcagaagaagatatgccacagagggtcgtcctactgcagagatcccagactacaactgaaagggatagtgatacagatgtggaggaggaagagctgccagtggaaaaccgggaagcagtgctgaaggaccatactaagattcgtgctttggtgagagcacactcagagaaggatcaaccgccattcggcgatagcgatgactcggttgaggccgacaaaagcagccccgggatacacctagaacgaagtcaagcgagtaccacggtggacatcaacactcaggtcgaaaaagaagtccccccaggcagtgccattatccacattaagaaacaccaggtcagcgtagaggggaccaaccaaacagatgttaaagccgttggaggccccgctaaattgcttgtggttagtctcgaggaagcttggcccctgcacggggattgtgaaacagatgcagaggagggaacatccctgaccgccagcgtcgttgcagacgtccggaaaagtcagctgcctgctgagggcgacgcaggtgccgaatgggcagcagctgtattgaagcaagaacgagcccatgaagtgggcgcacagggtggaccacctgtggcccaggtggagcaggacctgcccatttccagagaaaatctaaccgacctcgtggtggatacagacacgctaggagagagtacgcaaccccaacgcgaaggggcacaggtacccaccggacgcgaaagggagcaacacgtggggggaacaaaagacagcgaggataactatggtgacagcgaagacctggacctccaagccacacagtgctttcttgaaaaccaaggactcgaggccgtccaaagtatggaagacgaacccacacaggcatttatgcttacccccccccaggagctgggtccatcccattgtagtttccagactactgggacacttgatgagccatgggaagtgctcgccacccagccgttctgcctcagggagtctgaggattcggaaacacagcccttcgacactcatctcgaagcctatggtccatgcctctctcctcctcgagctatcccaggcgatcagcatcctgagagccccgttcatacagaacctatggggatacaaggtaggggcaggcagaccgtcgataaagtgatgggtatccccaaggagaccgccgagcgcgtggggccagagcgaggcccactagaacgtgagacagaaaagttgcttcccgaacgccagacagacgtgaccggtgaagaggagttgacaaagggcaagcaggatcgggaacaaaagcagctcctagcaagggatacccagcgacaggaatctgataaaaatggtgagagcgcttcccccgaacgcgatagagagagcctcaaagtggaaatagaaacatccgaggagatccaggaaaaacaggtgcaaaaacagacactcccatcgaaagccttcgagcgcgaagttgagcgacctgtggccaatagggagtgtgaccctgccgagctggaggagaaggtcccaaaggtcatcctggagagagacactcagagaggcgagccggagggcggatcacaagaccagaagggccaggcatcttctcccactcctgagcccggtgtcggcgcgggagatctgccaggtcccactagcgccccagttccctccggttctcagagcgggggccgcgggagcccagtttctccccgacggcaccagaagggactgctcaactgcaaaatgccacctgccgagaaggcctcccgaatcagggccgccgagaaggtgtcacgcggggatcaggagtcaccagacgcctgcctacccccaaccgtcccagaggcacccgcccctccgcaaaagccattgaacagtcaatcgcagaagcatcttgctccacctcctctgctcagtccgcttctgccatccattaagccaacggtcaggaagactaggcaggatgggtcccaagaagcccctgaagcccccctctcttctgaacttgaacccttccatcctaagccgaagatcagaacacgcaagagtagcagaatgactccatttcctgctacatctgctgcccccgagcctcacccaagtacgtctacagcacagccggtgacacctaaaccaacttctcaggccacgcgttcaagaaccaataggtcatctgttaaaacgccagaaccagttgtaccaaccgcgcctgagttgcagcctagcaccagtaccgatcagccagtaacgtccgagccaacaagtcaggtcacgcggggcaggaaatcaagatcttcggtgaaaacccctgagacagtcgtgcccaccgccctggagctgcaaccatccaccagtactgatcgtcccgtgactagtgaaccaacctcccaggcgactagaggaagaaagaaccgatcttcggtaaagactcccgaacccgttgtgcccactgcacctgagctgcagcccagtacatctaccgaccaacccgttacctcagaaccgacctatcaagccacaagaggtcggaagaacagatcctcagtcaagacaccggagcctgtggtccccacggcgcccgaacttcggccctctacctcaaccgaccgaccagtcacccccaagcctacatctcgtaccacacgaagtagaacaaacatgtcatctgtgaaaactcccgagacagtcgtgcccactgcaccagagctgcagatcagcactagcacagatcagccagtgacccccaagccgacaagtcggacaacccggtcgcgtacaaatatgtcctccgtgaaaaaccccgagtccacggtgccaatcgcccccgagctgcctccttcgacttccactgagcagcccgtcaccccagagcccacatctcgcgctacccggggcaggaaaaaccgctcctctggaaaaaccccagagaccctggtccccactgctcctaaactggagccttccacctctacggaccaacctgtgaccccagagcccacttcgcaagcaacaaggggcagaacaaaccgctcctctgtcaagacgccagagacggtagttcctactgcacctgaattacaaccaagcacaagcactgaccaacccgtgacgccagagcccacctcacaagccactcgagggaggactgatagatcatctgtgaagacgcctgagaccgtcgtcccaactgctcccgagctgcaggcctcagcctccaccgaccagccggtaacttctgaaccgactagtcggactactcggggaaggaaaaaccgcagcagcgttaagacgccggagacagtggtgccagcagcccctgaattgcagccttctacttccaccgaccagccagtgaccccggaaccaacctccagggccacgcgcgggcggactaacagaagcagtgtcaaaacccccgagtccattgtgcctatcgctccggaactgcagccatccacatcacggaaccagcttgtgaccccagagccgacttcccgagcaacgaggtgccgaactaatcggagtagtgtgaagacccctgagccagtcgtgcccaccgctcctgaacctcaccccactacctctaccgatcagccagtaacaccgaagctgacctctagggccaccaggaggaaaacaaacagaagttccgttaaaactccgaaacctgttgaaccagccgccagtgatctggagccgttcacccctactgatcagagcgtaacgccagaggcaatcgcacagggcgggcaaagcaaaacactgaggtcatccacggtaagggctatgccagtgcccaccaccccagaatttcagtccccagtgactaccgatcaaccgatctctcccgagcccatcactcagccaagttgcattaagcgacagcgagccgctggtaacccgggttccctggccgctcctatagatcataagccctgctccgctcccctggaaccaaagtcacaggcaagccgaaaccagcgctggggggcagtccgggctgcagagagcctaactgcaatcccagaaccggccagcccgcagctgctagagacccccatccatgcctcgcaaattcagaaagttgagcctgccggtaggtcccggttcacaccggagctgcagccgaaggcttcgcagtctagaaaacgctctctagctaccatggatagtcccccacaccagaaacagccacaacggggtgaggtgagccagaaaacagtgattatcaaggaggaagaggaagatacagcagagaagccaggaaaagaagaagatgtggttactcccaagcccgggaaaaggaagcgggatcaagccgaggaggagcctaaccgcattccctcccgatctctgcgacgtacgaagctaaatcaggagagcacagcgccaaaagtcttgtttacaggggtggtggatgccagaggagagagggctgtcctcgctcttggcggatcactggccggcagcgccgccgaggcctctcacctggtaacagatcgaatacgcagaaccgtgaagtttctgtgcgccctcgggcgcggaattccaatcttatcccttgattggctgcaccagtctcggaaggctggattcttcttgccgcctgacgaatatgtggtcaccgaccccgagcaagagaagaacttcggctttagcctccaggatgcactgtccagggctagggagagacgattgctggaaggttacgaaatttacgtcacccccggagtgcagccaccaccccctcagatgggagaaattatcagctgttgcggcggtacgtacctaccaagcatgcccagaagctacaaaccgcagcgcgtcgtgatcacctgtccacaggactttccccactgcagtattcccctcagggtgggattgcccctcctctccccagagtttctgctgactggcgtcctcaaacaagaggccaaaccggaggctttcgtcttgtcccctctcgaaatgtcaagcacctag

SEQ ID NO: 15909 - DNA, 489 bp, Artificial Sequence
  Description of Artificial Sequence: Synthetic coding sequence
atggaagacactcaggctatcgattgggatgtggaggaagaggaagagactgaacagtcatctgaatccctgagatgtaatgtggagcccgtggggcgccttcacatcttttcgggtgctcatggccccgagaaggacttcccattacaccttggcaaaaacgttgtgggcagaatgccagattgttccgtcgcgctgccattcccttcaattagtaagcagcacgccgagatcgaaattttggcttgggataaagcccctatcctgcgtgactgtgggtctctcaatggaactcagatactccggcctccgaaagtcctcagccccggggtgtcccatagactgagagatcaggagctgattctgtttgctgatctgctgtgtcaataccatcgactcgacgtttcactccctttcgtttcacggggaccgctgaccgtggaagaaacccctcgcgtccaaggggagacacaaccacagaggctttag

SEQ ID NO: 15910 - DNA, 384 bp, Artificial Sequence
  Description of Artificial Sequence: Synthetic coding sequence
atggaggacacccaggcaattgactgggacgtggaggaggaggaggaaactgaacagtcaagtgagtccctgaggtgcaatgtcgagcccgttggccgtctccatatcttctctggcgctcatgggcccgagaaagacttccctttgcatttaggaaagaacgtcgtgggccgcatgcccgactgctcagtggccctgcccttccctagtatttcaaaacagcacgccgaaatcgagattctcgcgtgggacaaggccccgatactaagggattgcggcagtttgaatggaacgcagatactcagaccacccaaggtgctttccccaggggtgagccaccgcctgcgggaccaggagctaatcttgttcgccgaccttctgtag

SEQ ID NO: 15911 - DNA, 921 bp, Artificial Sequence
  Description of Artificial Sequence: Synthetic coding sequence
taacatgttggaggtaccaaagacagtgaggacaactacggtgactctgaagacctggacctgcaggctacacagtgctttctggagaatcagggactggaagcagttcaatctatggaggatgagcctacacaggccttcatgttgacgccaccccaggagctgggcccatctcactgttccttccagaccactggtttgctgaattgtaaaatgccccctgccgagaaagcgtcccgcatccgcgcagctgaaaaagtcagccgtggagaccaggagtctccagatgcatgcttaccccctacagtgcctgaggcccccgctccgccccagaaaccacttaactcccaatctcagaaacatcttgctcctcccccgttattgtcaccgctgctgccttcgataaagcctaccgtgcgaaaaacccggcaggatgggagtcaggaggctccagaagcacctttatcctccgagctggagcctttccatccgaaaccaaaaattcggactcggaaaagctcccgtatgacccccttcccagccacgagcgccgccccagagccgcatccgagcacttccacggctcaacccgtgaccccaaagccaacaagccaagcgacccgctcgcgcaccaatcgcagctcagttaaaacccccgagccggtcgttccgactgctcccgaattacagcccagcaccagcacagaccagcccgttacctctgagccaacaagccaggttacacgtggcaggaagagcaggagcagcgttaagacacccgaaaccgtggttccaaccgccctcgagctccaaccctccaccagcacagaccgacctgtgacatcggagccgacttctcaggctacccggggcagaaagaatcggtcctctgtgaagacaccggaacctgttgtgccctag

SEQ ID NO: 15912 - DNA, 342 bp, Artificial Sequence
  Description of Artificial Sequence: Synthetic coding sequence
atggaggatactcaagcgatagattgggatgttgaggaagaagaggagacagaacaatcatccgagtcactgcggtgcaatgtggagcctgtaggacggctgcacattttctccggtgcccatggacctgagaaagactttcccctgcacctcgggaaaaacgtggtgggcaggatgccagactgttcagtggctctgccatttccatccataagtaagcagcacgcagagatcgagattttggcctgggacaaagcaccaattctgagggattgcggctctttaaacggtacgcaaatactccgacctcctaaggttctgtctcctggcgtcagccattag

SEQ ID NO: 15913 - DNA, 5409 bp, Artificial Sequence
  Description of Artificial Sequence: Synthetic coding sequence
atggaggacactcaagccatcgattgggacgtggaggaagaggaggagacagagcagtcgtccgaatccttgcgctgcaatgtcgaaccagtaggacggttgcatatcttctccggcgcacatggccctgaaaaagattttcctctccatctgggcaagaacgtggttggccggatgccagattgtagcgttgctctgccctttcctagtatctcaaagcagcacgctgagatcgaaatcctggcctgggataaagcgcctatactgagagactgtggatcccttaacggtacgcaaattctgcgtccacccaaggtactaagtccaggcgtctctcatagacttagagaccaggaactaatcttgttcgcagacctgctctgtcagtatcacaggctggatgtttcattacctttcgtgagccgcgggccgctcacagttgaagagacaccacgggttcagggtgagacccaaccacaacgactcctgcttgcggaagactcggaagaagaggttgatttcctgtctgagagaagaatggtgaaaaagtctcggactacttcaagctccgtgatagttcctgaatccgatgaagaggggcattcccccgtactgggcggtttagggcctcctttcgccttcaacctcaactctgataccgacgtggaagaaggccagcagccggcaacagaagaggccagcagcgctgccagaagaggggccacagtggaggccaagcaaagcgaggccgaggtggttaccgagatccaattggaaaaggaccaaccattggtgaaagagaaagataacgacacgaaagtgaagagaggtgccggaaatggcgtcgtgcccgccggcgtgattctggaacgttcccaacctccaggcgaggatagtgacaccgacgttgatgatgactcaagacctccgggaagacccgccgaagtgcatctggaaagggcccaaccgtttggtttcattgattcagacacagatgccgaggaggaacggatccctgctactcccgttgtgattccaatgaaaaaacgtaaaatctttcacggggtggggacccgcggacccggcgctcccggcctcgcccacctccaggaaagtcaggctggctctgacactgacgtggaggaaggaaaggcccctcaggctgtgccgttagaaaagtcccaggcctcaatggtgattaacagcgacaccgacgacgaagaggaagttagcgccgctctcacgctcgcccacctgaaggaaagtcagccagctatctggaatcgggacgccgaggaggatatgccacagcgagtggtgctacttcagagatctcagactactaccgagcgcgactccgataccgatgttgaggaggaagaactgcctgtagaaaatcgtgaagccgttttgaaggatcatacgaagattcgtgcgctcgtgagggcccacagcgagaaggaccagcctccttttggcgactccgacgacagcgtggaagctgacaagtccagtcccggaattcacctggagagatctcaggcatctaccaccgtcgatatcaacacacaagtcgagaaggaagttcctccaggatcagctattatacatatcaagaaacaccaagtgtcagtggagggcacaaaccaaacagacgtaaaagctgtgggtggtccagctaagctgttggtagttagccttgaagaggcgtggccactccatggcgactgcgagactgacgcagaagaaggcactagcctgaccgcatctgttgtcgcggacgtgcggaagagccagctgccagctgagggagacgcaggggccgagtgggccgccgccgttctgaagcaggagagggcccacgaagttggggcccagggaggacccccagtggctcaggtggaacaagatttgcccatatctagggaaaatcttactgacctggtagtcgacaccgacacgctcggagagtcaactcagcctcaacgcgagggtgcacaggtgcctactggtcgtgaacgagagcagcacgtcggggggacgaaggattcagaggataattacggggactcagaagatctcgacctccaggcgacccagtgtttcctggaaaatcagggactggaggccgtgcagtcaatggaggacgagcccactcaagcctttatgctgacacccccacaggaactgggtccctcccactgtagctttcagaccaccggcactctcgatgagccatgggaggtgctggctactcaacctttctgtttgcgcgagtcagaggacagtgaaacccagccattcgacactcacctcgaggcttatggtccttgcttaagcccgccacgcgccatacctggggaccaacacccggaaagcccagtccatactgaacccatggggattcaaggtcgcggcaggcaaactgtggataaggtcatggggatacccaaagagacggccgaacgggtcggacccgaacgggggccattggagcgggaaacagagaagctgctgccagaacggcaaacagatgttaccggggaggaggagctgactaaaggcaagcaggaccgggagcagaagcaattgctggcaagggacacacagcggcaagaatcagacaagaacggcgaatccgccagcccagagagagaccgagaatctctcaaggtcgaaattgagacgagcgaggagatccaagagaaacaggtccaaaaacagacactacccagtaaagcctttgagcgtgaggtagagcggcctgtggccaaccgtgagtgtgacccggctgagctggaagagaaggtcccaaaggtcattctggaaagagacacccagagaggggaacccgagggggggtcacaggatcagaagggccaagcctcctcccccacccctgaaccaggcgtgggggcgggcgatttaccaggcccaacctcggcgcctgtaccttcggggagtcagtcaggcggacgcgggtctcctgttagtccccggcggcaccagaagggccttctgaattgcaagatgcccccagccgaaaaagcctcccgaatccgcgcggcggagaaggtgagccggggcgatcaagagtctcccgatgcgtgtctgcccccgacagtgccggaggcaccagctccaccacaaaagcctctgaacagtcagtcacagaagcacctcgccccgccccccctactgagtcccctgctgccaagcatcaagccaacagtgaggaagacacgtcaggacggctctcaggaggcgcctgaggcccccctgagttcagagttagaaccctttcatcccaagcctaaaatccgtaccagaaaatcttctcggatgaccccttttcccgccacctcagccgcgcctaaactggagccatccacttcaactgaccaacccgtgacgccagaacccacaagtcaggcaacacgcggcaggacaaacaggtcatcagtgaaaacaccagagacggtcgttccaaccgcccctgagctccaaccttcgacttctaccgatcagcccgtgaccccagagcccacttctcaggcaactcgagggcgcaccgatcgctcatctgtgaaaacacccgagacagtggttcccacggcaccggagctgcaggctagcgcatcgaccgaccagccagttaccagcgagcccacttccaggactaccagggggagaaaaaatcgctctagcgtgaaaacacccgaaaccgtggttcctgcagctccagagctccagccgtccacaagtacagatcagcctgtgacccccgaacctacctctcgggctacacgaggaaggacaaatagatcctccgtcaaaactcctgaatctatcgtccctattgcccccgagttacagccaagtacctctaggaaccagctcgtaacacccgagccaacctcacgcgctacgaggtgcagaacaaatcggtctagcgtgaagacccccgagccagtcgtacctacggcaccagaaccacaccccacaacaagcaccgaccagcccgttactcctaagctcacatctcgtgccacgcgtagaaaaacaaaccggtcctccgttaaaacccctaagccagtggaacctgctgcaagtgacctcgagccatttactccaacggatcagtctgtcacgcccgaggctatcgcccaaggcggtcagagcaagacgctgcgttcttcaacggtgagagctatgccagttcccactactccggagttccagagtccggtgactacggaccagcccattagccccgaacccatcacccagccatcttgcatcaagcgccagagggcagcagggaatcccggcagccttgcagcacccattgaccacaagccgtgttccgccccattagaaccgaagtcacaggccagtcgaaatcagcgttggggcgccgtccgggccgccgaatcgcttactgcaattcccgagcctgccagtccccagcttctggaaacccccattcacgcgagccagatacaaaaagtggagccagccggaagatcacgcttcactccggaacttcaaccaaaagccagccagtctcgtaaacggagtctcgcaactatggacagcccgcctcaccaaaagcaacctcagaggggagaagtatcccagaagaccgtcataatcaaggaggaggaggaagacacagctgagaagccaggtaaagaagaagatgtggtaacgccgaaacccggaaagcggaagagagaccaggctgaggaagagcccaacaggatcccaagccgcagcttgagaagaactaaactgaaccaagagtccaccgcacccaaggtgttatttacaggcgttgtggacgcgcggggggaaagagccgttctcgcgttgggagggtcattggctggcagcgccgctgaggcatctcacctggttactgatcggatccggcgtacggtgaaattcctttgcgccctggggagaggcatccccatcctgtccctagactggttgcaccagtcccggaaggctggcttctttttgccgccagacgaatacgtggtcactgaccctgagcaagagaaaaactttggatttagtttgcaggacgctctctcccgcgccagggagagacgactcctggagggatatgagatttacgttaccccaggagtgcagcctcctccccctcaaatgggggaaatcatctcctgctgtgggggcacgtacctcccaagcatgcctcgcagctacaaacctcagagagtcgtgatcacttgccctcaggacttcccccattgcagcatccctctcagagtgggcctgccactcctgtcccctgaattcctgctgacaggagtgttgaagcaggaagccaaaccagaggctttcgtactaagcccgcttgagatgagttccacttag

SEQ ID NO: 15914 - DNA, 666 bp, Artificial Sequence
  Description of Artificial Sequence: Synthetic coding sequence
atggaggatacgcaggccatagattgggatgttgaggaggaggaagagaccgagcagagctcggagtctttacgatgcaatgtggagccagtaggcaggctgcatattttctctggcgcacacggtccggaaaaagacttccctctgcatctgggaaaaaatgttgtggggcgaatgccagattgtagcgtagccctgccttttccttctataagcaagcaacacgcggagattgagattttggcttgggacaaagctccgatcctgcgagactgtgggagcctgaacgggactcagatattgagctcatccttgccccccccccaaacttctttgttacctctgagtctcaggcttcgactgctgggggaagagcagatcgaccctctcagtcggctgcttaagcagctgagcccacagcctctctcctaccggctcccccccccccaaacctccctgtctccactctcaccccacctgggccccctgggcgaggagaaaattggcccactgagcagaccactgaaacagctctgcccgcaacccttgagctcctccctgccacctccccagaccaaccttagcccactgagcccacacctggggcctctcggcgccgggcagattggaccactcagccgtcccttgaaccaattatccctgtag

SEQ ID NO: 15915 - DNA, 738 bp, Artificial Sequence
  Description of Artificial Sequence: Synthetic coding sequence
atggaggacacacaggctatcgattgggacgtggaagaggaggaggaaacagaacagagttctgagtccctgagatgcaatgtggaacccgtgggacgtcttcatattttttccggcgctcacggacctgagaaggactttcccctccacctgggcaagaatgtggttggtcggatgccagactgctctgtggccctgccctttccctcgataagtaagcagcacgcagagatagagattctcgcttgggacaaagcacctatcttgcgcgactgcgggtccttgaatggcactcagatactgagaccccctaaggtcctctctcccggggtaagccaccggttgcgggatcaggagttaatcctttttgctgacctgctttgtcagtatcaccggttggacgttagccttcccttcgtaagtagggggcctcttacagtggaagagacgcctagggtccagggagagacccagccccaaagactgctgctggccgaagactcagaggaagaggtagatttcctaagcgaacgccgtatggtgaagaaaagcaggaccacatctagtagtgtgattgtgccggaaagcgatgaggagggtcactctcctgttctgggcgggttgggaccaccttttgcctttaatctgaacagcgacacagacgtggaagagggccagcagcctgcgaccgaggaggcaagcagtgcggctcggagaggggctacagttgaggcttag

SEQ ID NO: 15916 - DNA, 735 bp, Artificial Sequence
  Description of Artificial Sequence: Synthetic coding sequence
atggaggacacccaagctatcgactgggatgtcgaggaggaagaagagaccgaacagtcctcggaaagcctccgttgcaacgtagaaccagtaggcaggctgcacattttctccggggcccacggtcctgagaaggatttccctctacacctgggaaaaaacgtggtcggtcggatgccagactgcagtgtggcattgcctttcccatctatttcaaagcagcacgccgagatagaaatcctggcatgggacaaggccccaatcttaagggattgtggatcccttaatgggacacagattctccgtccccccaaggttttatctcccggggtgtcacaccggcttagagaccaagagctgatcctgtttgccgacctcctctgccagtaccaccgcttggacgtcagtctgcctttcgtcagtaggggcccccttacagtggaggagacgcctcgggtccagggggagacgcagcctcagcgactgctgttggcagaggacagcgaagaagaagtagacttcctgagcgaacgacggatggttaaaaagtccagaacaacatcgtcttcggtcatcgtgcccgaatcagacgaagagggccactcacctgtcctcggtgggctgggccccccgtttgcttttaatctcaactccgatacagatgtagaggaaggtcagcagcctcatcgcggcggcctgctgtcttgtcaaaaacgctgccactgtagaggttag

SEQ ID NO: 15917 - DNA, 5478 bp, Artificial Sequence
  Description of Artificial Sequence: Synthetic coding sequence
atggaggacactcaggcaatcgactgggatgtcgaggaggaggaggaaaccgaacagagttcagagagtctccgctgcaatgtggagccagtaggacgcctgcatatatttagcggagcccacggccctgagaaagacttccccctgcatctcgggaaaaatgtcgtcggtagaatgccagactgctcagtggcattgccctttccatctatatccaagcagcatgcggagatcgaaattttagcctgggacaaagcacccatactgagagactgtgggagtctgaatggcactcagatccttaggccacctaaggttttgagcccgggagtaagccatagactgagagaccaggagctgatcttgttcgctgacctattatgccaataccaccggcttgacgtttcactgccttttgttagccgagggcctctgactgtggaggaaactcccagagtccagggcgaaacccagccgcagagactactgctggctgaagatagtgaagaagaggtggatttcctgagcgagcgccgcatggtgaaaaagtcccggaccacctctagttcggtgattgtcccagaatctgatgaggagggacattcgccggtactcggtgggttaggacctccatttgcttttaacctcaacagtgacactgacgtggaggaaggacaacagcccgccacggaagaagcaagctcagccgcgcgccggggggcgactgtagaagcaaagcaaagtgaggccgaggttgtaacagagatacagttagagaaagaccagccactggtgaaggagaaggacaatgacacgaaggtgaagcggggggccgggaatggggttgtacccgccggggttattctagagaggtcacagcctccgggagaagattctgacaccgatgtggatgacgactcaagaccccctggacggcccgccgaagtccatctagaacgcgcacagcctttcggttttatagattccgataccgacgccgaagaggagcggatcccagccacaccagtggtcattccaatgaagaagcgaaaaatctttcatggtgtggggacccgcggacctggagctcctggcctcgcccatctccaggaaagccaggcaggctcagacaccgatgtggaggaagggaaagcgccacaggccgtgccgctagaaaaaagccaggcatctatggtgatcaattccgacactgacgatgaggaggaggtatctgcagcacttacccttgcacaccttaaggagtcgcagccagccatttggaaccgggatgccgaagaagatatgccccaacgtgttgtgctattgcagaggtctcagaccacaacagagagagactcagatacagacgtcgaggaagaagagttgcccgtggaaaaccgcgaggccgttctgaaggaccacacaaaaatccgggcgctggtgcgcgctcacagtgagaaagatcaaccccctttcggggatagcgacgattccgtggaagctgataaatctagccctggtatccacctggaacgcagccaggcatccacaactgttgacatcaacactcaggtggaaaaagaggtgcctcccgggtctgccatcatccacatcaagaagcaccaggtgagcgtagagggtaccaaccagacagatgtaaaggccgtggggggacctgcaaaactactcgtcgtgagtctggaggaggcttggcccctgcacggcgactgcgagacggacgccgaagagggcacatcgctgacagcatcagtggtggcagacgtgagaaagagccagctgcctgccgagggcgatgcaggggcagagtgggccgctgctgtcttaaagcaggagagagctcacgaggttggcgctcagggtggacccccagtcgcacaggtggagcaggatttgcccattagcagggagaatttgaccgaccttgtggtcgacactgatacgctcggagaaagcacccagccccagcgcgagggagcgcaggtcccaacagggagggagagagagcagcatgttggcgggactaaagattctgaagacaactacggcgacagtgaggatctggacttacaggccacccagtgctttctggagaaccaggggctggaggcagttcaaagtatggaggacgagcctactcaggcgttcatgctgaccccaccgcaggaattaggtccgagccattgctcctttcagactactgggctcctgaactgcaaaatgcctccggccgagaaagcatcccggatacgcgctgcagaaaaggtgagtaggggggatcaagaatcacccgacgcatgcctgccccctaccgtccctgaagcaccagctcctcctcagaaacctctaaattctcagtcacaaaaacacttagccccccctccactcttgtcccctttgcttcctagcattaaacccacagtgcgaaagaccaggcaggacggcagccaagaagcccccgaggctcctctgtcaagcgaattggagcccttccacccaaaaccaaagatacggaccagaaagagcagcagaatgaccccatttccggcaacctcagccgccccagaacctcacccctccacatccacagcacaacctgtaactcccaaacctactagtcaggcaactcgttcgaggacaaatcggtcatctgttaaaaccccagagccagtggttcccactgcccctgagctccagcctagcacgtccacggatcagcctgtaacatccgagccgaccagtcaggtcacccgcggaagaaagagccgctcctcagtcaaaactcctgagacagtcgtgccaaccgctttggagctgcaaccaagcacctccactgatcggccagtgacctctgaaccaacaagccaagcaacacggggaaggaagaataggagctctgtgaagacgccagaacctgtggtgccaaccgcgcccgagctacagccttccacctctactgaccaacctgtgaccagcgagcctacatatcaggccactagagggagaaagaacaggtccagcgttaagacgccagaaccagtggtgcccaccgcgcccgagctgcgccccagcacatctaccgatcgacccgtgactcctaagcctaccagtagaaccacaagatcccgcaccaacatgtctagtgttaagacccctgagacagttgtgccaactgccccagagcttcagatctcgacctctacagatcaaccagtaacaccaaagccaacatctcggaccaccagatctcgcaccaatatgtctagcgtgaagaaccccgagtccaccgtcccaatcgcgccagagctgcctcccagcacctccacagaacagccggtgactccagagcctacctccagggcaacccgtggtcggaagaatcgctctagtgggaaaacccctgagactctggttcctactgcccctaagctggaaccaagcaccagtacagatcagccagtgacgccggagcccacaagccaggctacccgggggcgaaccaaccggagctcggtcaaaacacctgaaacggtggtacccactgcgcctgagctgcagccttccacatctacagaccaaccggtgacaccagagcctacttctcaggcaacccgggggaggactgaccgcagcagcgtcaaaacgccggaaacagtggtccccactgccccagaactgcaggccagcgcatccactgatcagcctgttacaagtgagcctacatcacgcaccaccagaggacggaagaaccgcagctctgtgaaaaccccagaaactgtggttcctgcagctcccgagctacagccctccactagcacagaccagccagtgacaccggagcccacctccagggcaaccagagggcggaccaatcgctcttctgtgaaaaccccagaaagcatcgtccccatcgccccggaacttcagcctagcacttctcggaatcaactggtcacgccagagcctacatcccgggctacccggtgcaggacaaatagaagctcagtgaaaactccagagccagttgtccccaccgctccagagccccatccgacaacatctacagaccagcccgtgacacccaagttgacctcccgtgctacacgccgcaagacaaatcggagctccgtcaaaacgcccaaacctgtggagcccgccgcctccgatttggagcccttcaccccaacggaccaatctgtgactccagaggcgattgctcagggaggtcagagcaagactctcagatcctccactgtgagagctatgccagtccctaccacaccagagttccagtctcccgtgactactgatcagcctataagcccggaacccatcacccagccctcatgcatcaaaagacaacgcgccgccggtaatcccggcagtcttgctgcccctattgatcacaaaccatgttccgctcctctggagcctaagagtcaagcttcccgaaaccaaaggtggggggccgtcagagctgccgagtctctgaccgccattcctgagccagcgtcacctcaactgctcgaaacccccattcacgctagccaaatacagaaggttgaacccgccgggagaagtagatttaccccagagttgcagccaaaggcctctcagtcacggaaacgcagccttgcaaccatggacagccctccccaccagaaacagccacagcggggcgaggtctcccagaagactgtgattattaaagaagaagaagaggacactgctgaaaagcccggcaaggaagaggatgttgtgactccaaagccaggaaaaagaaagagagaccaggccgaagaggaaccaaaccgtattccttcacgaagcttaaggcggactaagttgaatcaggaatcaactgctcccaaggtgcttttcactggcgttgtcgacgctagaggggaacgtgctgtccttgctctggggggatccctagccgggagcgcggccgaggccagccacctcgtgaccgaccggatcaggcgtaccgtcaagtttttatgcgcgctaggtcgaggcattcctattctcagcctggattggttgcaccagagcaggaaagccggattcttcctcccgccagatgagtacgtggtgacggaccctgaacaggagaagaatttcggcttttcactgcaagatgcactgagtcgggcccgggagagacgcctacttgagggttacgagatctacgttactcctggagtgcaacctccacctccacaaatgggagagatcatttcctgctgcggcgggacatacttaccttcaatgccacggtcctacaaacctcagagggtggttatcacctgtccgcaggatttccctcactgttccatcccacttcgcgtcggtctgcccctgctttctccggagttcctgcttacgggcgtgttaaagcaggaggccaaacctgaagccttcgtactgagcccactagaaatgagcagtacctag

SEQ ID NO: 15918 - DNA, 4968 bp, Artificial Sequence
  Description of Artificial Sequence: Synthetic coding sequence
atgtaccaccgccttgacgtcagtctgcctttcgtctccagaggccccctaacggtcgaagagacaccacgggtgcagggagaaactcaaccccaaaggcttcttttggctgaagatagtgaggaggaggtcgatttcctgtctgagaggcgaatggtgaagaagtctcgcaccacgtcctcatcagtcatagtgcctgaaagtgatgaggagggacatagccctgtgttgggggggctcggtccaccttttgctttcaacttgaattccgatactgacgtggaggaaggtcagcaaccagctaccgaggaggcttcatccgccgcacgacggggggccacagttgaagcaaaacagtccgaggccgaggttgtcaccgagatccagctggaaaaggatcagcctctcgtgaaggagaaagataatgacaccaaagtcaagcgtggggctggaaatggagtcgtccccgccggagtgattcttgagcgatctcaacctccaggtgaagattctgatacagatgtggacgatgattcccggcccccaggtcgaccagccgaagtccatctggaaagggcacagcccttcggcttcattgatagcgacaccgatgcagaagaagaacggattccagccacccctgtggtcatcccaatgaaaaagcgcaaaatctttcacggggtgggaacccggggccccggcgcacccggtctggcccatctccaggagtcgcaggctggctctgatactgatgtggaggagggcaaagctcctcaggctgttcctctggagaaatcccaggccagtatggttataaatagcgatactgacgatgaggaggaagtcagtgcagcactgactttggcccatctgaaagaatctcagcctgctatttggaatcgggacgcggaggaggacatgcctcagcgcgtggtgcttttgcagcgctcacagacaaccaccgagcgtgatagtgacactgatgtggaggaagaagagctgccagtcgagaaccgcgaggcagtgctgaaggatcacaccaaaattcgggcgcttgtccgagcccattccgagaaagaccaaccacctttcggggattccgatgattccgtggaggccgataagtccagtcccggcattcatttagaaagaagtcaggcaagcaccaccgttgacatcaatacacaggttgaaaaggaagtgcctcccgggagcgccattattcacattaaaaaacaccaggtatctgtggaagggacaaatcaaactgatgtgaaagccgtgggtggcccagctaaactgctcgtagtgagcctagaagaagcttggccactccacggggattgcgaaacggacgcagaggaagggacatctctcacagcatctgtcgtggctgatgtgagaaagtcacagcttcccgcggagggagacgctggtgccgagtgggccgccgctgttctcaaacaggagcgggctcacgaggtgggcgcccagggaggccctccagtcgcccaggtggagcaggatctccctattagccgtgagaatctcaccgacctcgtggtcgataccgatacactaggcgaaagcacacagccacaacgggagggggctcaggtgccaacaggacgtgagagagagcagcacgtaggggggaccaaagacagcgaggacaactacggcgattccgaggacctggacttgcaggctacccagtgttttcttgagaatcaaggtttggaagtacagagtatggaagatgagcctacacaggctttcatgctgacaccaccccaagaattgggcccctcccattgttccttccagactacaggcctgctgaactgcaagatgcccccagcagagaaggcaagcaggatccgagcagctgaaaaggtctcccgtggtgaccaggagtctccagacgcctgcctccctcccacggtgccagaggcccccgcgccaccgcagaaaccacttaacagccagtcacagaagcacctggcaccacctcctctgctttctccactccttccatccatcaagcctaccgtgcgtaagacccgccaggacggatcacaggaagcacccgaggctccgctcagttccgagctggaaccctttcatccgaaaccaaagattcgaacccggaaatcttctcgaatgactccgttcccggcaacgtcagctgcgccggagcctcatccttcaaccagcaccgcacaacctgtgacccccaaaccaactagccaagcaaccaggtcaaggaccaatcggagctctgtgaagactcccgagcccgtcgtcccaacggcccccgaattgcagccctctacctcaacagaccagcctgtgacgtctgaacctacctctcaggtgacccgcggcaggaaatccagatcaagtgtgaagactcccgaaactgtcgttcccaccgccctagagctgcagccgagcacctcaacagacagaccggtgaccagtgagccgacatcgcaggctactagaggccggaaaaacagaagcagtgttaaaaccccggaacctgtcgttcctacagctccggagcttcagccaagtacttctaccgatcaaccggtcacctccgagccaacctaccaggccacccgcggcagaaagaacaggtcttccgttaaaactcctgagcccgtggttcccaccgctccagaactgagaccttcaacttccactgataggccagtcacccctaaaccaacaagtagaaccaccagaagccgaactaatatgagctccgttaagaacccggagtccactgttcccatcgctcccgaactgcctcctagcacttccacggagcagcctgtgactcccgaacccaccagcagggccacacgtggtcgcaaaaacagatcaagtgggaaaaccccagagactcttgttcctaccgccccgaagttggagccgagcactagcacggaccagccagttacacctgagcctacaagccaggctacacgggggcggaccaaccgtagctccgtcaagaccccagagactgtcgtccccaccgcacccgagctccagcccagcaccagcaccgaccaacccgtcactcctgaacctacctcacaagctactagggggcgcaccgatcgttcttcggtgaagacacccgagacggtagtgcccaccgcccccgagctccaggcatccgcctctactgatcagcctgttacttctgagccgacatcacggaccaccaggggcaggaaaaatcgctcttcagtgaaaactcctgagaccgtcgttcctgctgctccggaactccagccttccacttccactgaccagccagtgacccccgagcctacaagcagggcgacccgtggccggactaatcgtagttctgtgaagacccctgagtcaatcgtgcctattgctcccgaactgcagccttccacttccagaaaccaactggtgactccagagcccacatcccgtgctacgcggtgtagaacaaaccgctccagtgtgaagactcctgagccagttgtcccaacagctcccgagccccaccctactacctccactgatcagccagtgactcctaagctaaccagccgggcaactagacgaaagaccaatcggtcttctgtcaaaactcccaagccagtggagccagccgcatcagaccttgagcccttcactccgactgaccagtctgtgacacctgaggcgatagctcagggaggtcagtctaagaccttgcggtcaagtaccgttcgcgctatgccagtccctacgacgcccgagtttcaaagccctgtcaccacggaccaaccaatttcccccgaacccattactcagccaagctgcatcaagcgccagagagctgctggtaaccctggatcccttgccgcccccatcgaccataaaccttgctctgcacccctggagccaaagtcacaggcgtcccgaaaccagaggtggggggccgtgcgtgccgccgaatccctgacggccataccggagccggcgtctccccagttgctggagacacccatccacgcttcacagattcagaaggtagagccagcaggcagaagtcgtttcactccagagttacagccaaaggccagtcagtctcgaaaaagaagcctggccacaatggactctccgcctcaccagaagcagccccagcgcggcgaagtgtcacagaaaaccgtcatcataaaagaagaagaagaggacaccgccgaaaaacctgggaaggaggaggacgtggtaaccccaaaacctggcaagagaaaaagagaccaggccgaagaggagccaaaccgcatccccagccggagcttgcgaaggaccaagctcaaccaagaatccaccgctcctaaggttctgtttacaggcgttgttgatgctcggggtgagagggcagtgcttgcactaggagggagtctggcaggatccgccgcggaggcttcccacctcgtgacggacaggatccgacgcactgtgaagttcctttgcgctcttggccgtggcattccgatattgtccctcgattggttgcatcagagtcggaaagccgggttttttctcccgcctgacgagtacgtggtcactgacccagagcaggagaaaaattttggattttcattgcaggacgccctgtccagagctagagaacgacggttgttagaaggttatgagatatacgtgactcctggggtacagccccctcccccccagatgggtgaaatcatcagttgctgtggcggtacctacctgccatcaatgccacgctcttacaaacctcagagggttgtgatcacctgcccgcaggactttccccactgcagcattcccttacgggttggactccctctccttagcccagagttcttactgacgggcgtcctcaaacaggaggccaaacctgaggccttcgttttgagcccattggaaatgtcatcaacatag

SEQ ID NO: 15919 - DNA, 1941 bp, Artificial Sequence
  Description of Artificial Sequence: Synthetic coding sequence
atgggtctgcctaggctcgtgtgcgctttcttgcttgccgcgtgctgctgctgcccccgcgttgctggggtccctggcgaggcggaacagccagcaccggagcttgtggaggtggaggtgggcagcacagccctgcttaagtgcggactgtctcaatctcagggcaacttatcccacgtcgactggttttccgtgcataaggaaaagcgaacgctcatctttagggtgcgtcagggtcaaggtcagtccgagcccggtgagtatgaacagcgcctcagtctgcaggacaggggcgccacccttgcgttgacacaagtgacacctcaagatgagcggatctttctatgccagggcaagaggccaagatcacaagaatatagaatccagctccgagtctacaaagctcccgaagaacccaatattcaggtgaaccccttgggaatccccgtgaactccaaagagcctgaggaggtggctacttgtgtgggcaggaacggatatcccataccacaagtcatctggtacaagaatggaagacccctgaaggaagaaaagaacagagtgcatatccaaagcagccagacggtcgaatcaagtggtctatataccctgcagagcattctcaaagcacagcttgtcaaggaggataaggacgcccagttttattgcgagctaaattaccgactgcctagcggcaatcatatgaaggaaagcagagaggttacggttccagtcttctatcctacagagaaggtttggctggaggtggaaccagttggaatgctgaaagaaggagaccgcgtcgaaattcggtgcctggctgacggaaatcctccgccacatttctccatttcaaaacagaaccctagcacccgggaggccgaggaggaaacaacaaacgacaatggcgttctggtgctggaaccagcccgcaaggagcactctgggcgatatgaatgtcagggtctcgatctggacactatgatctccctgctcagcgagccccaggaactgctggtcaactacgtttctgatgtcagggtgtctcctgctgctcccgaaaggcaggaaggatcaagtctgactctgacgtgtgaggcggagtcatcccaggacctggagttccagtggctgcgtgaagagacaggtcaggttcttgagaggggcccggtcctgcagttgcatgacctgaaaagagaggccggaggcggttacagatgcgtggcctcagtcccttccatacctgggctgaatcggacacaactggtgaatgtagccatctttggaccaccctggatggccttcaaggagcgcaaggtctgggttaaggaaaacatggtgctgaacctttcttgcgaggccagcggacatccaaggccgacgatctcatggaacgttaatggcaccgcctctgaacaggatcaagacccgcagagggtcttatcaactctgaacgttttggtgacacctgaactgctggagactggcgtcgaatgtaccgcctcaaatgacctgggcaagaacacaagtatcttgttcctcgaactggtcaatctcaccacactgacacccgatagcaacactacaaccggattatctacctccacagcgtcaccacacacccgtgcgaattccacttcaacagagcggaagctgcctgaaccggagagccgaggcgttgtcattgtggccgttattgtttgtatcttggtcctcgccgtcctgggggcggttctgtatttcctgtacaagaaaggcaaactgccatgtagacgcagtggaaagcaagaaatcactctgcccccatctagaaaatccgagctcgtcgttgaggtcaagtcggacaagctgcctgaggagatgggcctgctgcagggtagttcgggggataaaagagctcccggtgatcagggcgagaagtacatcgacttgcggcactag

SEQ ID NO: 15920 - DNA, 1584 bp, Artificial Sequence
  Description of Artificial Sequence: Synthetic coding sequence
atggtgtacatcgtgcgccagtttctgctttacaatgtaagcgggagtgtgtatctggatcaactgatcgtgcttctgaccgcaaagttttctatcctgagaattgcaggaagccgagtgcatcacagccctttttcaggtcacctggatgggtgttcctttctgtccttgcagcatagtctgcacacctccctcgacatgtctagacatgagaacgtctttctgggactgacattaagctctaaatctgctggcctaaagggattccaacttgctttcgtccctggcttgctacagggcaccggtggctatcttgatgggccacttcccaccccagtcgacaatcccagggtgggattggaagttggcttacgcctgagcctgcccccgttgcccccttgtcctggtgtgcacattcagagtagtcaaacagttgagtctagcggactatacacgttacagagcattctgaaggctcagctcgtgaaggaggacaaagatgcccaattttactgcgaattaaattacaggctcccgtctggcaatcacatgaaggaaagccgcgaagtgactgttcccgttttctaccctaccgaaaaggtgtggctggaagttgagcccgtaggcatgctgaaggagggtgatagagtagagataagatgcttggccgatggaaacccacctccccatttcagcatctctaagcagaatccttctacccgcgaagcagaggaggaaaccaccaatgacaacggagtcctggttcttgagcccgcccgtaaggagcactcaggcagatacgagtgccaaggtctggaccttgacacaatgatcagccttctttctgaaccccaggagctgctcgtgaattatgtttctgacgtgagagtgagtcccgcggctccggaaagacaggagggttcctctctgaccctgacctgtgaggcagaatcttcacaggatctggaattccagtggcttcgggaagaaaccggccaggtgctagagcgcgggccggtgctccagctgcatgatctgaagcgcgaggccggcggtggctatagatgtgtggcctccgttccttctattcctggtcttaatcgtacccagctggtgaatgtggctatattcggacccccctggatggcattcaaagagcgtaaggtgtgggtgaaagagaatatggtgctgaacctgagctgtgaggcttccggtcacccgcgcccaacaatatcctggaatgtgaacgggacagcgtcagagcaggaccaagacccgcaaagggtgctctccactttaaacgtgctggtgacaccagagctccttgaaactggggtggagtgcaccgcttcgaatgaccttggtaagaatacaagcattctattcctggaactcgtaaacttaactacgctgacgcccgactcaaatactactacaggattgtctacatcaaccgcctctccacatactcgcgccaacagcacaagcacaggcaagcccggactggctagggagcagggctgcgccagggccagttttctgccttgcccctctcccgagtcgcccgttcagaagggtgaatag

SEQ ID NO: 15921 - DNA, 141 bp, Artificial Sequence
  Description of Artificial Sequence: Synthetic coding sequence
ggagtggtcatcgtggccgtcatcgtttgcattctggtgctcgcagtgctgggcgctgtactgtatttcctctataagaagggcaaactcccttgtaggagatctggaaagcaggaaatggagcgtaatacctccatctag

SEQ ID NO: 15922 - DNA, 2253 bp, Artificial Sequence
  Description of Artificial Sequence: Synthetic coding sequence
atgggcaaatccgaatcacagatggacattacggacattaatactccaaaacccaagaagaagcagcgctggactcctctggaaatatctctcagcgtgctcgtgctgcttctcacaataatcgccgtgactatgatcgctctctacgcaacatatgatgacgggatttgcaaatcgtccgattgcattaagtccgcagcacgcctgattcaaaacatggacgcaacaacggagccatgcaccgacttcttcaagtatgcctgtggaggttggcttaaacgaaatgtgataccggaaacaagctctcgctacggaaatttcgatatcttgcgcgacgaacttgaggtggtgttgaaggacgtcctccaagaacctaaaacagaggatattgtggctgttcagaaggctaaagccctctatcgtagctgcataaatgagtccgccatcgactcccggggcggtgagccacttctgaaacttttacctgacatctatgggtggccggttgccacagagaactgggagcaaaagtacggcgcatcctggacagcagaaaaagccatcgcgcagttgaattctaaatacggaaaaaaagtgctgatcaacttatttgtcggaactgacgataagaattctgttaatcatgtcattcacatagaccagccacggctgggtctgccatctagagactactatgaatgcacaggcatttataaggaggcctgtactgcctatgtggatttcatgatctccgttgccagactgattcgtcaggaggaacgtttgccgatcgacgaaaaccaactggccctcgagatgaacaaggtaatggaactcgagaaagaaatagcaaacgcaacagctaagcccgaggatagaaatgacccaatgctcctatataacaaaatgacactggcccagatccagaataacttctcactcgagatcaatggcaaacccttttcatggcttaacttcacaaacgaaatcatgtccaccgtgaatatctctatcactaatgaggaggacgtagtcgtctacgcacccgagtatttgacgaagctgaaaccaattttgacgaaatactcagccagagatctgcaaaatttgatgagttggcggtttattatggatctggtgagcagtctctcccgcacatataaagagtcgcggaatgcattcaggaaggctttatatgggacaacctcggaaaccgctacttggaggcggtgcgcaaactacgtgaacggtaacatggagaatgccgtggggaggctttatgtcgaggccgcattcgctggtgagagcaaacacgtggtggaggatctcattgcccaaattagggaggtgtttatccaaacgttggatgacctgacctggatggacgccgaaactaaaaaacgggcagaggaaaaggccctcgccattaaagagagaatcggatacccggacgacatcgtgtccaatgacaacaagctgaacaacgagtatctcgagctgaactataaagaggacgaatattttgaaaatattatccagaatctcaagttcagtcagtccaagcagttgaaaaaactgcgcgagaaagtcgataaagatgaatggatttccggcgctgcagtcgtgaatgctttttacagttccggccggaatcagatagtatttccggccggtattcttcagcctccattcttctcagctcagcaatccaacagccttaattacgggggcatcgggatggttataggtcatgagatcacccacggcttcgacgacaatggtagaaacttcaacaaagatggggaccttgtggactggtggacccagcagtctgcctccaacttcaaggagcagtcccagtgcatggtataccagtacggaaacttttcatgggacctcgcaggtggacaacatcttaacggaatcaacactctcggcgaaaacatcgccgacaatggggggctgggacaagcctacagggcataccagaactacatcaaaaaaaatggcgaggagaagttgctgccagggctagacctgaatcataagcagctgtttttcttaaattttgctcaagtttggtgcggcacataccgccctgaatatgcggtgaactcaatcaagaccgatgtgcattcaccaggtaattttaggattatcgggaccttgcagaattccgctgaattttcagaggctttccactgcagaaagaactcatatatgaacccagaaaagaagtgtagggtttggtag

SEQ ID NO: 15923 - DNA, 2253 bp, Artificial Sequence
  Description of Artificial Sequence: Synthetic coding sequence
atggggaaaagcgagtcccagatggacatcaccgatattaatactccgaaaccaaagaaaaagcagcgatggacacccttagaaatctctttgagtgtgctggtgctcttgctgaccataatcgccgtgacaatgatcgctctctacgctacttatgacgatgggatctgcaagagttccgactgtattaaaagcgccgcacgcctcatccagaacatggacgccaccacagagccctgtacagatttctttaaatacgcttgcggggggtggcttaaaaggaacgttatccccgagacgagtagtcgatacggtaattttgacatccttcgggacgagctggaggtagtgctcaaggacgtgctacaggagcccaaaactgaggatattgtcgcggtccagaaagccaaggccctgtacaggtcatgcatcaacgaatcagctatagattctagaggcggtgagcctcttctaaaacttctgccggacatctatggatggcctgtggccaccgaaaactgggaacaaaagtatggcgccagctggacagcagagaaggctatcgcccagttgaacagtaagtatggcaaaaaggttctgattaatctgtttgtcggaacagacgataaaaatagcgtgaaccacgttattcacatcgatcagccgcgcctgggcctcccgagtcgtgactattacgagtgtacaggtatctacaaagaggcctgtaccgcttatgtggacttcatgatatcagtggccaggctcattcggcaggaagagaggcttcctatcgatgagaatcagcttgccctggaaatgaacaaggtcatggaacttgaaaaggaaatagccaacgcgactgccaaaccggaggatagaaatgaccctatgctgctatacaacaaaatgaccttggcccagatacaaaacaacttctcattggaaattaacgggaagccgtttagctggctgaatttcacgaacgagatcatgtcaacagtgaatatttcaataaccaacgaggaggatgtagttgtgtacgctccagagtaccttaccaagctgaagccgattctgacaaagtactctgcacgggacctccagaatttaatgtcttggcggtttatcatggatttagtttcttccctgtcacgaacctataaggagtccaggaatgcatttcggaaggccctatacgggactacgtcggagaccgccacgtggcgacgctgcgctaactacgttaatgggaatatggaaaatgctgtaggtcgactttatgttgaagctgccttcgctggcgaatcaaagcatgtagtggaagacttaattgcccagatccgcgaagtgttcatacaaacgcttgacgatctaacatggatggatgctgaaaccaagaaaagggcggaggaaaaggcactggccataaaggagcgcatcgggtatcctgacgacattgtctctaatgacaacaaactcaacaacgaatacctggaactgaactataaggaggacgaatattttgagaacattatacagaatctgaagttctcgcagtcaaaacagctgaaaaagctgagagagaaagtggacaaagacgaatggatcagtggcgctgcagtggtgaatgccttctattctagcggccgaaatcagattgtcttcccggctgggatcctgcagccacccttctttagcgcacagcagtccaattcacttaattatggaggaatcggcatggttattggacatgagataacccatggattcgacgacaatgggcgtaactttaacaaggacggtgacctggtcgactggtggactcagcagagtgcgtccaattttaaggagcagtcccaatgcatggtgtatcagtacggaaactttagctgggacttagctggcggacagcacctcaacggaattaacactcttggtgaaaacatagcagataacggtggattgggacaagcatatcgagcctatcagaactacatcaaaaagaacggtgaggagaaactcctgccggggctggatcttaatcataagcagctgttctttctgaactttgcccaggtgtggtgtggaacctacaggcccgagtacgccgtgaacagcatcaaaaccgacgtgcactctccaggaaactttaggattataggcacattacagaacagtgcagagttctctgaggcctttcactgccggaaaaacagctacatgaatcccgaaaaaaagtgtagagtttggtag

SEQ ID NO: 15924 - DNA, 2253 bp, Artificial Sequence
  Description of Artificial Sequence: Synthetic coding sequence
atgggaaagagtgagtctcagatggatataaccgatatcaacacccctaaaccaaaaaaaaaacagcgatggacaccactggagatttcattaagtgtgttggtgctcctgctgactatcattgctgttacaatgatagcactgtacgctacttatgacgatggcatctgcaaaagtagcgattgtattaagagcgctgcgaggttgatacagaatatggatgcaactacggagccctgcactgatttctttaagtacgcgtgtgggggatggctgaagcggaacgttatcccagaaactagctcaagatatggcaactttgacattttacgagatgagctcgaagtcgtgctgaaggatgtgctgcaggaacccaagactgaggatatagtggccgtccagaaagccaaagccctgtatcgctcctgcatcaatgaatcagccattgactcccgcgggggggagccactgttgaagctactgccggacatttacggctggccagtggcgacagaaaattgggaacagaagtacggggcatcttggacagcggaaaaagccatcgcccagttgaactctaaatacgggaaaaaagtgctgatcaacttgttcgtcggcaccgacgataagaattccgtcaaccacgttatacacatcgatcaaccgaggcttggcctgcccagcagagattattatgagtgcaccggtatatataaagaagcatgtactgcctacgtggattttatgattagcgtagcccgcttgatcagacaagaagagcgcttacccatcgatgagaaccagctggccctggagatgaacaaggtcatggagctcgaaaaagagatagccaacgccacggccaagcctgaggaccggaatgatcccatgctgctttataataagatgaccttggctcaaattcaaaacaatttctccctggaaatcaatggcaaacccttctcatggcttaactttactaacgagatcatgagcactgtcaatataagcataactaacgaggaagatgtagtggtctacgcccccgagtacctgactaagctgaaaccaattttaacaaagtacagtgctagagacttacagaatctgatgagctggcgcttcattatggacctagtttcttctctttcaaggacttacaaagagagcagaaacgcattcaggaaggctctctatgggacaacatctgagactgcaacctggagacgctgcgccaattatgtgaacgggaatatggaaaacgccgtggggagattgtatgttgaggcggcttttgcgggcgagagcaaacatgttgtggaggacctgatcgcccaaattcgagaggtctttattcagacgttagacgacttgacttggatggacgcagaaactaagaaacgagctgaggagaaggcactggccatcaaagaacgcataggataccccgatgacatcgtgtccaacgataataagctaaataatgaatatcttgagctgaattataaagaggacgagtacttcgagaacataatccagaacctcaagtttagtcagtccaaacagctgaaaaaactgcgagagaaagtagataaagacgagtggattagcggagccgccgtggtcaacgcgttctattccagtggaaggaatcagattgtcttcccagctggcattcttcaaccaccattcttctcggcccagcagtccaatagtctcaattacggcggaatcggaatggtgattggccatgaaataactcacggtttcgacgataacggcaggaatttcaataaagacggcgatctggttgattggtggacccaacagtctgcaagcaactttaaagaacagtcgcagtgtatggtgtatcaatatggaaattttagttgggacctggcaggcggtcaacacctgaacggaatcaatactctgggcgagaacatcgccgacaacggcggcctggggcaagcttaccgtgcttatcagaactacattaagaagaacggtgaagagaagctgttgccggggttggaccttaatcataagcagctgttctttctgaactttgcccaggtgtggtgcggaacttatcgcccagagtacgcagtgaattctattaaaacagatgtgcactctcccggaaacttcagaataattggtaccctacagaatagcgctgaattttctgaagcgttccattgtaggaagaacagttacatgaaccccgaaaagaagtgtcgagtgtggtag

SEQ ID NO: 15925 - DNA, 486 bp, Artificial Sequence
  Description of Artificial Sequence: Synthetic coding sequence
atggggaaaagcgagtctcagatggacattactgatataaatacaccgaaacctaagaagaagcagcgctggactcctttggagatctccctctctgtgctggtcctacttctaactataatcgccgttaccatgattgctctctacgctacctacgatgatgggatctgcaaatcatcagactgcatcaagtctgccgcgcgcctcattcaaaatatggacgcaaccaccgagccctgtacagatttttttaagtacgcatgtggagggtggctgaaaagaaatgttattcctgaaacaagcagccgttatggaaacttcgatatcctgagggatgagcttgaggtcgtcctgaaggatgttctgcaagaacccaagacagaggacatcgttgccgtccagaaagccaaagccctgtaccgatcttgcattaatgaatctgctatagacagcagggggggagaacctttactgaaactgctgtag

SEQ ID NO: 15926 - DNA, 282 bp, Artificial Sequence
  Description of Artificial Sequence: Synthetic coding sequence
atggggaaatctgagagccagatggatataactgatattaatacccccaagcctaagaaaaaacagcgctggactcctctggagatcagtctctccgtacttgtccttttgctgaccatcatagctgtgaccatgatcgctctatacgccacttacgacgatgggatctgtaagtcctcagactgtatcaaatccgcagctaggctcatccaaaatatggatgccaccacagagccttgtacagacttttttaagtatgcatgtggaggctggctaaaatag

SEQ ID NO: 15927 - DNA, 702 bp, Artificial Sequence
  Description of Artificial Sequence: Synthetic coding sequence
atgggcaagtcagaatcccagatggacattaccgacatcaacacaccaaagcctaagaaaaagcagaggtggactcctctggagatttccctgagcgtgcttgtgctgctgcttactatcatcgctgtgaccatgatcgctctttacgccacctacgatgatggcatttgtaaatcctccgactgcattaagagcgccgctagactgatacaaaatatggacgcaaccaccgagccgtgcacagacttttttaagtacgcttgtgggggttggttgaagaggaatgtaatccctgaaaccagctcacgttatggtaatttcgatatcctaagggacgagctcgaggttgtattgaaagatgtcctgcaagagccgaagaccgaggatattgtagctgttcagaaggctaaagcactctataggtcttgcatcaatgaatcggccatcgactcgcgcgggggggagcctctgctcaaattactccccgacatttacggttggcctgtcgcaacagagaactgggagcaaaagtatggagcaagctggaccgccgaaaaggccatcgcacagctcaactccaaatatgggaagaaggtattgattaacttattcgtaggcactgacgacaagaacagcgtgaaccatgtgatacacattgatcaacctagattggggttgccttccagggactactacgagtag

SEQ ID NO: 15928 - DNA, 360 bp, Artificial Sequence
  Description of Artificial Sequence: Synthetic coding sequence
atggggaagagcgagtcccaaatggacattaccgatataaacaccccaaagccaaagaagaagcagcgctggaccccgctggaaatttcattgtccgttctcgtgctgctcctaaccattatcgccgttacaatgattgccctttatgctacatacgacgacggcatctgtaagagctctgactgcattaaaagtgccgccaggctgattcagaacatggacgccaccactgagccgtgcacagatttttttaagtatgcttgcggcggatggctgaaacgcaatgtgattcccgaaacatcgtctcggtacggcaactttgacattctgcgggacgagctggaggttgtactcaaatag

SEQ ID NO: 15929 - DNA, 2253 bp, Artificial Sequence
  Description of Artificial Sequence: Synthetic coding sequence
atgggaaagtctgaatcacagatggatatcacggacataaatacacccaagcccaaaaaaaagcaacgctggaccccactcgaaatctctttatccgtgctcgtcctgctgctcaccatcattgctgtcacaatgattgccctgtacgctacttatgatgacggcatctgcaagagctctgattgtatcaaatccgccgccaggttgatccagaatatggacgccactaccgagccatgcaccgatttctttaagtacgcttgtggcggctggctaaagcgaaatgtgatcccagagaccagttctagatatggcaattttgacatcctccgggatgaacttgaggtggttcttaaagacgttctgcaggaacccaaaacggaggacatcgtcgccgtgcagaaagctaaagctctctaccgttcatgcattaatgagtctgctattgacagccgcggcggggagcccctcctaaagcttttgccagacatctacggttggcctgttgcgactgaaaattgggagcaaaagtatggagcaagttggacagcggagaaagcaattgctcagctcaactcaaagtacggtaagaaggtcctcatcaacctcttcgtcggcaccgacgacaaaaatagcgtcaaccatgtgattcacatcgaccagccccgcttgggcctgccctccagagattactacgagtgtacggggatctataaggaggcttgtaccgcctacgtggactttatgatcagcgtagctcgcctgatcagacaggaagagaggctccccattgacgagaaccaattggcactggaaatgaacaaggtgatggaactcgagaaagagattgctaatgccaccgcaaagccagaggaccggaacgaccctatgctgctgtacaataaaatgaccctcgctcagattcaaaataatttctccctcgagatcaatggcaagccattctcctggttgaattttaccaatgagatcatgtccacagtgaacattagtatcactaacgaagaggacgtggtcgtgtatgcgccagagtatctgacaaaacttaaacctatcctaaccaagtactcggcacgggacctgcagaatcttatgtcttggaggttcattatggatcttgttagctccctgtctcgcacatacaaggaaagccgcaatgcgttcagaaaggccctgtacggaactacctccgagacagccacttggcgtagatgcgcaaactacgtaaatggtaatatggagaatgccgtgggacgattgtacgttgaagccgccttcgccggagaaagcaaacacgtggtggaagatttgattgcccagatacgcgaggtgtttatccaaactctggatgacctgacctggatggacgccgagacgaagaagcgagccgaggagaaggccctggccattaaggagcggatcggatatccggatgatatcgtaagtaacgacaacaaactgaacaacgagtacctagaattaaattataaggaggacgaatacttcgaaaatatcattcagaatctcaagttctctcagagcaagcagctgaaaaagttgcgggaaaaggttgacaaggatgagtggatatcgggcgcagccgtcgtgaacgcattctattccagcggcaggaaccaaatcgtgtttcccgcagggattctccagccccccttcttctctgcccagcagtccaattccctaaactacgggggaattgggatggtgattggccacgagattacccacggcttcgatgataacggcagaaattttaataaagatggcgacctagtcgactggtggactcagcagtcagcctctaactttaaggagcagtcccaatgcatggtgtaccagtacgggaacttcagctgggacttagccggaggccagcatctgaatggcatcaacaccctgggagagaacatagccgacaacggtggcctgggccaggcctatagagcctatcagaactacatcaagaagaacggtgaagagaagctactaccgggactggacctcaatcataagcaattgtttttcctgaacttcgctcaggtctggtgcgggacttaccgtcctgagtatgccgtgaattcaattaaaaccgacgtgcactcacccggaaatttccgcatcatcgggactctgcaaaattccgctgagttttccgaagctttccattgccgcaaaaattcatacatgaatccagagaagaagtgtagggtgtggtag

SEQ ID NO: 15930 - DNA, 2253 bp, Artificial Sequence
  Description of Artificial Sequence: Synthetic coding sequence
atgggaaagtccgaaagccagatggacattacggacatcaatacacccaagcctaagaaaaagcagaggtggaccccgcttgagattagcttaagcgtgctcgtgctgttgttaaccatcatcgccgtgaccatgatcgcgctgtacgcaacatacgacgacgggatttgcaaatctagcgattgtattaaatccgcagccagactcattcagaacatggacgctacaactgagccatgcacggactttttcaaatacgcttgtggggggtggctgaaacgaaatgtcatacctgagacttccagccgatatggaaactttgatatcctccgagacgagctcgaagtggtgctaaaagacgttctgcaggaacctaagactgaagacattgtggccgtccaaaaggcaaaggccctgtacaggtcttgtatcaacgaatcggcaattgattcaaggggtggcgagcctctcttaaagctgttgcccgacatctacggctggcctgttgctacagaaaattgggagcagaagtacggagcttcttggacagccgagaaggcaatcgctcagctcaacagcaaatatgggaaaaaagtgctgattaatctgtttgtgggaaccgacgacaaaaatagtgttaaccatgtgattcacattgatcagccaaggctggggctgcctagtcgggactattacgagtgcacaggcatctataaagaagcatgcacagcgtatgtggacttcatgatcagcgtagcaagacttatacgccaggaggagaggctgccaatcgatgagaaccaactggccctagagatgaataaggtgatggagctcgagaaggagatagccaacgcgactgcaaagcccgaagaccggaatgaccctatgctattatacaacaaaatgacgctggcccagatccagaataacttcagccttgagatcaatggtaagcccttctcctggctgaacttcaccaacgagattatgtctacggtgaacatcagtatcactaatgaagaggatgttgttgtctacgctccagaatacctgaccaagctaaagccaatactcacgaaatattctgctcgcgacctgcagaacctcatgtcttggcgattcataatggacctggttagctcgttgtcccggacctacaaagagtcccggaatgcttttaggaaagcactgtatggaaccaccagcgaaacagctacctggaggaggtgcgccaattacgttaatgggaacatggaaaacgcggtcggtcggctgtacgtcgaggccgcattcgcaggtgaaagcaaacacgtcgttgaggacctgatcgctcaaattcgcgaggtcttcatccagaccctggacgatctgacctggatggacgccgagaccaaaaagcgggcagaggagaaggccctcgctattaaagaacggatcggatatcccgatgatattgtgagcaatgacaacaagctcaacaatgaataccttgagcttaactataaggaagacgagtattttgagaatataatccagaacttgaaattcagtcagagtaagcagttaaagaaattacgcgaaaaggttgataaggacgagtggatctctggggctgcggtggtcaacgccttttatagcagcggcaggaatcagattgtgttccccgcagggatcctccagcctcccttcttctccgcccaacaaagcaatagtctaaattacggggggattgggatggtcatcggacatgagatcacacatgggtttgatgacaacggcagaaactttaacaaggatggggatcttgtggattggtggacacagcagtccgcgtccaactttaaggagcaaagccaatgtatggtataccagtacgggaacttttcctgggatctggccggcggacaacacttgaacggaataaacacccttggcgagaacatcgccgacaatggcggtcttggtcaagcataccgggcatatcagaattacatcaagaagaacggggaggagaaactccttccaggtctggacctgaaccacaagcagctgttctttctcaacttcgcacaggtgtggtgcggcacttaccggccagagtacgccgtgaatagtataaagactgatgtgcactccccgggcaactttagaattattggcactctgcagaatagcgctgagttctctgaggcctttcactgcaggaaaaattcctatatgaacccggaaaaaaagtgtcgcgtctggtag

SEQ ID NO: 15931 - DNA, 48 bp, Artificial Sequence
  Description of Artificial Sequence: Synthetic coding sequence
atggggaagagcgaaagccaaatggatattactgacataaatacatag

SEQ ID NO: 15932 - DNA, 894 bp, Artificial Sequence
  Description of Artificial Sequence: Synthetic coding sequence
atgactacgccgaggaattcagtcaatggcactttccccgcggaacccatgaaagggcctattgcgatgcagagcggtcccaaaccattgttccgccggatgtcgagcctagtcggcccaacacagagctttttcatgcgcgagagcaaaactctcggcgcagtgcagatcatgaacggactgttccatatagctctggggggcctgttgatgatccccgcggggatttacgcccctatctgtgtgacggtctggtaccctctatggggtggcataatgtacatcatatcaggcagcctcctggccgcaactgaaaaaaattcccgcaagtgtttggtcaagggcaagatgatcatgaattccctgtctctgtttgccgcaatatctggaatgatcctgtccatcatggacattctcaacattaagatttcccatttcttgaagatggagtcccttaacttcattcgcgctcatactccctacatcaatatctacaactgcgagccggcaaatccttccgaaaagaattcacccagcacccagtactgctattctatacagtctttgtttctcggaattctgtctgtgatgttaatctttgcctttttccaagaactggtgatcgccggtatagttgagaacgagtggaagagaacatgctcacgaccgaagtcgaacatcgtgcttctatcggcagaggagaagaaagagcaaacaattgagatcaaagaggaagtggtcggactcaccgaaaccagttctcagcccaagaatgaggaggatattgagataatcccaatacaagaggaagaggaagaagaaactgaaacaaattttccggaacctcctcaggaccaagaatcaagcccaatcgaaaatgatagtagtccttag

SEQ ID NO: 15933 - DNA, 894 bp, Artificial Sequence
  Description of Artificial Sequence: Synthetic coding sequence
atgacaactccacgcaactcggttaatggaacttttcccgccgaacccatgaaaggccccatcgccatgcagtcagggcctaagcccctgtttcgccgtatgtcatctctggtgggtccaactcaatctttcttcatgagggaatcaaaaacgctgggcgccgttcagatcatgaacggcctgttccacattgctctgggtggactccttatgattccggctggcatctatgccccaatatgcgttaccgtttggtatcctctgtggggtggcatcatgtacatcatctcaggaagcctgctggccgccaccgaaaaaaactccaggaagtgtctggtcaagggtaagatgatcatgaattcgctgtctctgttcgccgctatttctgggatgatcttatctatcatggatattctgaatatcaaaataagccacttcctgaagatggagtcccttaacttcattcgtgcacatacaccgtatatcaatatctataattgcgagccagctaacccaagcgagaagaattccccttcgacacaatattgttatagcattcagtcattgtttctgggaatcctttctgttatgctcattttcgccttcttccaagagctggtgattgccggcatcgttgagaacgagtggaagaggacatgtagccggcctaagtctaacatcgtgctcctgtccgctgaagaaaaaaaagagcagaccatagagatcaaggaggaagtggtggggttaacagaaaccagctctcagcccaagaacgaagaggacatcgaaattattccaattcaggaagaagaggaggaagagactgaaacaaacttcccggagccacctcaggatcaggagtcttccccgattgagaatgattcttccccatag

SEQ ID NO: 15934 - DNA, 24 bp, Artificial Sequence
  Description of Artificial Sequence: Synthetic coding sequence
atgacaacccctcgcaattcttag

SEQ ID NO: 15935 - DNA, 855 bp, Artificial Sequence
  Description of Artificial Sequence: Synthetic coding sequence
atgacaacacccagaaactccgttaatgggacattcccagcagagcctatgaaggggcccattgccatgcagagcgggcccaaaccattgtttcggagaatgtccagcctcgtgggcccaacacagagttttttcatgcgtgagtctaagacactcggagccgttcagattatgaacggacttttccatattgccctaggaggtctcctgatgattcccgcgggcatctatgcccctatatgcgtcaccgtatggtaccctctatggggaggcatcatgtatataatctccggtagcctgttagctgcgaccgaaaagaatagcagaaagtgcctggtgaaggggaaaatgatcatgaattctctgtccctgttcgcggctataagtggaatgatcttaagtataatggacatcctgaatataaaaattagccatttcctgaagatggagagtctgaactttattagagcccacacaccctacattaacatctacaactgtgaaccggccaatccatctgagaaaaactcccctagtacgcaatattgttactccatacagtccctgttcctcgagctggtgatcgccggcatagtggagaatgagtggaaaaggacctgctcgcgccccaagtccaacatcgtgttactatccgctgaggaaaagaaagagcaaacaatcgagattaaagaggaagtggtgggcttgacagagactagctcacaacctaaaaatgaagaggacatagagataataccaattcaagaagaggaggaggaagaaaccgagacaaactttcccgagccgccacaggatcaagagagttctcccatcgagaatgacagctccccatag

SEQ ID NO: 15936 - DNA, 21 bp, Artificial Sequence
  Description of Artificial Sequence: Synthetic coding sequence
atgacaacgccccgtaactag

SEQ ID NO: 15937 - DNA, 894 bp, Artificial Sequence
  Description of Artificial Sequence: Synthetic coding sequence
atgaccactccccggaactccgtcaacgggacttttcccgccgaaccaatgaaaggacccatcgcaatgcagtctgggcccaaacctctgtttagacgaatgagctccctcgtggggccaacccagagcttctttatgagagaatccaagactttgggggccgtgcaaattatgaacggactttttcatatcgcacttggaggtctccttatgattcccgccggtatctacgctcccatttgtgttacggtttggtacccactttggggcgggatcatgtatatcatcagcgggtccttattagccgcgactgagaaaaactcccgcaagtgcttggtgaagggcaaaatgattatgaattctctctccctcttcgcggctatctcaggcatgattctgagcatcatggacatcctcaatattaagatctcccattttctcaaaatggagtcactaaacttcattcgagctcataccccttatattaacatctacaattgtgaacccgccaacccctccgagaagaactctcctagtacgcagtactgctactctatccagagcttattccttggaattctcagtgtaatgcttatcttcgcctttttccaagagctggtaatcgccggtattgtggagaatgagtggaagcgtacttgctcccggccaaaatctaatatcgtcttactctcagccgaggagaaaaaggagcagacgatcgaaattaaggaggaagtggttgggttaactgagacctctagccaaccaaaaaacgaggaagatatcgaaattatcccaatacaggaagaggaggaggaggaaactgagacaaattttccagaacctcctcaggatcaggaatcttccccaattgagaacgattcttccccttag

SEQ ID NO: 15938 - DNA, 930 bp, Artificial Sequence
  Description of Artificial Sequence: Synthetic coding sequence
atggatgatcaagggtgtccgcgttgcaaaaccacaaagtaccgaaacccatcgctcaagcttatggttaacgtgtgcgggcatacactctgcgagtcctgcgtagatctgctcttcgtgagaggggccggcaattgtcctgaatgtgggactcctcttcgcaagagcaactttcgcgtacaactcttcgaagatccaaccgttgacaaagaagtcgagattcgaaagaaggtgttaaaaatctataacaagcgcgaggaagatttcccctctttacgggaatacaacgactttctggaggaggtggaggagattgtttttaacctgactaataacgtggacctagataacaccaagaaaaaaatggagatctaccagaaagaaaataaagacgtaattcagaagaacaaactcaagctgaccagggagcaggaggagctggaggaggcactggaagtggagcggcaggaaaatgagcagaggaggttgttcattcaaaaggaggagcaactgcagcagattctcaaacgaaaaaataaacaagcgttcctcgatgagctagagtcctccgacttgcctgtggcccttctcttggcccagcataaggaccggagtactcaactggagatgcagcttgagaaaccaaagccagttaaaccagtcaccttcagcactgggatcaagatggggcaacacataagtctagcacctatccacaaactcgaggaggccctgtacgagtatcagccacttcagatcgagacatacggcccacacgtgcccgaacttgagatgttggggcggcttggatatttgaatcacgtccgtgctgcatccccgcaggatcttgccggcggctacacttcttcactagcctgtcatcgggccctacaggatgctttttccgggctgttctggcagcccagctag

SEQ ID NO: 15939 - DNA, 804 bp, Artificial Sequence
  Description of Artificial Sequence: Synthetic coding sequence
atggatgatcaggggtgcccccggtgcaaaacaaccaaataccggaaccctagcctgaaattgatggtgaacgtctgcggtcacaccctatgcgagtcttgtgtagacctgttgtttgtaagaggtgccggcaattgccccgaatgcggaacccccttgcgcaagagcaattttagagttcagttgttcgaggacccaacagtggacaaagaggtggagatccgcaaaaaagtactgaagatttataacaaacgcgaagaagacttcccgtccttgcgggaatacaatgatttcctagaagaagttgaggagattgtgtttaatctgacgaacaacgttgacttggataataccaagaagaaaatggagatctatcagaaagagaacaaagatgttatccagaagaacaaattgaagttgacgagggaacaggaagaactcgaggaggctctggaggtcgagcgtcaagaaaatgaacagaggcgactctttattcagaaagaggaacagctgcagcaaatcctgaagcgtaagaataaacaagctttcctcgatgaactcggtcagcatatcagcctggctccaatccacaaattagaggaagcgctgtacgaatatcaaccactacagatcgagacatatggaccacatgttccagaactggagatgctgggccgcttgggctacttaaaccatgtgcgggccgcatctccccaggacctcgctggcggatacactagctctctcgcgtgtcacagagcattgcaagatgccttctcaggcctgttctggcagccttcctag

SEQ ID NO: 15940 - DNA, 510 bp, Artificial Sequence
  Description of Artificial Sequence: Synthetic coding sequence
acaagagagcaggaggaactggaagaggccttggaggtcgaaagacaggagaacgagcagaggcgtctctttatccagaaggaggaacagctccaacaaattctcaaaagaaagaataaacaagcctttttggatgagctggagtcaagtgatctccccgtcgccctgctcctagctcagcacaaggacagaagcacacagttggagatgcagctggagaagccaaagcccgtgaaacccgtgacattctctaccggcatcaaaatgggtcagcatatcagtttagctccaattcataagctggaggaagctctgtacgaatatcagcctcttcagatcgagacatacggcccacacgttcccgaactagagatgttgggacggctggggtacctgaatcacgtgcgggctgccagcccgcaggacctggccggtggctataccagttccctggcgtgccatagggccctacaggatgccttcagtggtctgttttggcagccttcctag

SEQ ID NO: 15941 - DNA, 3963 bp, Artificial Sequence
  Description of Artificial Sequence: Synthetic coding sequence
atgttcggccttgatcaatttgagcctcaggtcaattctaggaatgccggacaaggtgagagaaactttaacgagacaggcctgtctatgaatactcatttcaaggctccggccttccacaccgggggtcctcccggacccgttgatcccgccatgtcagcattaggagaaccaccaatactaggaatgaatatggaaccctacggattccacgctcgcgggcattctgaattacatgccggtgggttgcaggctcagcctgtccacggctttttcggggggcaacagccccaccacggccaccccggtagccatcacccgcaccaacatcatccgcattttggcggcaattttggagggcccgaccccggtgcatcatgccttcatgggggccgtctcctcggctacgggggagccgctggcggactcggaagccagcccccttttgcagaggggtacgaacacatggccgagagccagggacccgagagttttgggccccaacgccccgggaatctgccagattttcattcgagcggtgcaagtagtcacgccgtacctgccccttgtttgcctctggaccaaagccccaatcgagctgcctccttccacggtctgccaagctccagtgggtcggattcccactcactcgagccaagaagagtgactaaccagggcgctgtggattcattggagtacaattatccaggcgaagcaccaagcggccatttcgacatgttttcaccaagcgacagtgaaggccagcttcctcactacgccgccggccgacaggttcctggcggagcttttcccggtgcctctgctatgccacgggcggctggaatggttggattgtctaagatgcatgctcagccccctcagcagcagccccagcagcagcagcagccacagcagcagcagcagcagcacggtgtgttcttcgaaaggtttagcggagccagaaagatgccagtggggctcgaaccgagcgttggatcccggcacccgctaatgcagccacctcagcaggcaccaccacccccccagcagcagccgcctcaacagccccctcagcagcagcctcccccgcctcccgggttattggtgcggcaaaactcttgtcctcctgccctgcctcgtccacagcagggtgaagctgggaccccaagcggagggctccaggacggtggtccaatgcttcctagtcaacatgcccaattcgaatatcctatccatcgcttggaaaacaggagcatgcacccgtattctgaaccggtgtttagcatgcagcacccacctccccagcaggctcccaatcagcggctccagcacttcgatgcccctccgtacatgaatgtggccaagcgacccagattcgatttccctggctcagctggtgtggaccggtgtgcatcctggaatggcagtatgcataatggggccctagacaatcacctgtctccttctgcatacccaggcctgcccggggaattcaccccccccgtcccggactccttcccaagcgggcctcctctgcagcacccggccccggatcaccaatcacttcagcagcagcagcaacaacagcagcagcagcagcaacagcagcagcaacagcaacaacagcagcagcagcaacaacagcaacaaaggcaaaatgccgcccttatgatcaagcagatggccagccgcaatcagcagcagagattacgacaacctaatctggcccagctggggcaccccggtgacgtcgggcagggtggcctggtacacggcggtcctgttggaggcctcgcgcaaccaaatttcgaaagagaggggggaagcactggtgcggggcgcctaggaacatttgaacagcaggctcctcacctagcccaggagagtgcatggtttagtgggccacacccccctccgggggacttgctcccaaggcgaatgggaggttccggtctccccgcagattgtgggccacatgatccctcactggctcctcccccgccaccggggggttccggagtactcttccgaggcccactgcaagaacctatgaggatgcccggggagggtcacgtgcccgcgcttccaagtcctgggttgcagttcggggggtctctaggcggactggggcaactgcagagtcccggcgctggagtaggcctgccaagcgcggcatcagaaaggcgccccccaccaccggactttgccacttcggccctcggcggtcaacctggatttcccttcggagccgccggcagacaatccacacctcattctgggccaggagtgaatagccccccatctgctgggggcggcggtgggagtagtggaggaggtggggggggcggagcctaccccccccagccggatttccagccctcccagcgcaccagcgcctcgaaattgggggccctctccctgggaagttttaacaaaccctctagcaaggataacctattcggacaatcctgtctcgccgcactttcaaccgcatgtcagaatatgattgccagtctgggggcacctaatctcaacgtcactttcaataagaaaaacccaccggaaggtaagagaaaactgtctcaaaatgagaccgatggcgccgcggtagctgggaatcccgggagcgactacttcccgggagggacagctcctggggcccccggaccagggggcccatcagggaccagcagctccgggtcgaaagccagcggtccccctaatcctccggcccagggggacgggacttccctctcgccaaactatactttggagtccactagcgggaatgatggcaaacctgtctctggtggcggcgggcgaggacggggccgaagaaagcgggacagcggtcatgtgtcacctgggaccttctttgacaaatactccgcggccccagatagtggcggcgctcccggtgtcagccccggtcagcagcaggcaagcggagcagcagtcggtggctcttctgcaggggaaacaaggggtgcgcccacgccacacgaaaaggcacttactagcccatcttggggcaagggcgcggagctgctgctgggcgatcagcccgatctcattggcagcctcgacgggggcgccaagagcgattcaagctcacctaatgtcggtgaattcgcgagtgacgaggtgagcactagttacgctaatgaggatgaggtaagctcatccagcgataatccacaggccttggtcaaggcctcccgaagcccattagtcaccggcagtcccaagctacctccccgtggagtgggagccggagaacatggacccaaggccccccccccagcattgggactgggcatcatgagcaacagcacatcaacgcccgattcatacggaggcggtggaggtcctgggcaccctggaacacccggtcttgagcaggtcaggaccccgacaagttctagcggtgctccccccccagacgagatccatccactggaaattctgcaggcacaaattcaactgcagcggcaacagttctccattagcgaggaccaacctctcggcttgaaaggcgggaaaaaaggcgaatgtgccgtaggtgcttctggtgcacagaatggggattctgaacttggatcatgctgtagcgaggctgtgaagagcgctatgagtacaattgatctggattcactcatggctgaacatagcgcagcttggtacatgcctgctgacaaggccctggtggatagtgcagacgacgacaagacgttggctccatgggagaaagctaaaccacaaaaccccaactctaaggaggctcacgacctgcctgccaataaagcttcggcgtcccaacccggcagccatctccagtgtctgagtgtgcactgcacggacgatgtcggcgacgcgaaagcacgcgcttctgtgcctacatggcggagtcttcactccgatatctctaatcgcttcggcactttcgtggccgctttgacttag

SEQ ID NO: 15942 - DNA, 4227 bp, Artificial Sequence
  Description of Artificial Sequence: Synthetic coding sequence
atgaaggcaccagcagtccttgcacccggaattctggttctactctttaccttagtgcagcgttcaaatggagaatgtaaagaggcgcttgccaaaagcgaaatgaatgtgaatatgaagtaccagctacctaatttcacggccgagacccccattcagaatgtgattcttcatgaacaccatatctttctaggagccactaattacatttacgttctgaatgaagaggacctccagaaagtcgctgagtacaagaccggccctgttctcgagcatccagactgctttccttgccaggattgtagtagcaaggctaacctgtccgggggtgtttggaaagacaacattaacatggctctcgtggtggacacgtattacgacgaccagctgattagctgcggcagcgtgaacaggggaacatgtcagcgacacgtgtttccacataatcacaccgccgacattcagtccgaggtacactgcatcttttctccgcagatcgaagagccctcccagtgtcctgactgcgtggtctcagcgttgggagcgaaggtgttgagctcagttaaagataggtttattaatttcttcgttgggaatactattaactcctcctactttccagaccaccccctgcattctataagcgtcaggcggctgaaggaaacaaaagatggcttcatgtttctgacggatcagtcgtacattgacgtgctgcccgaatttcgtgatagttaccctatcaaatacgttcacgcgtttgaatcgaacaacttcatctatttcctcaccgtccagagggaaacgttggatgcccaaacctttcatacacgcattatcaggttctgttccattaattcagggctgcactcgtacatggagatgccgctggagtgcattcttactgaaaagcgcaaaaaacgaagtactaaaaaggaagtcttcaatattcttcaggccgcctatgtaagcaagcccggcgcccagctggcccgtcagattggggcttcgcttaacgacgacatcctttttggagtgtttgcacagtcaaaacccgattcagcagaaccgatggaccgctctgctatgtgcgcattcccgattaaatatgtgaatgacttttttaataaaattgtgaacaagaacaatgtgagatgtctgcagcatttctacggccctaatcacgagcactgtttcaacagaaccctgctgcgcaattccagtggctgtgaggcccgcagagatgagtatcggaccgagttcactacagctttgcaaagggtagatcttttcatgggccagttttcagaagtgcttctgacctcgatcagtactttcattaaaggagatctcaccattgctaacttaggaacaagcgaggggaggtttatgcaagtcgtagtgagccggagcggaccctcaacaccccatgttaactttctgctggatagccatccagtgtcacccgaggtgatcgtagagcatactctgaatcagaacgggtacaccctggttataaccggcaagaaaattaccaaaataccattaaatggtctgggctgtagacatttccaaagctgctcccagtgtctttctgctccccccttcgtgcagtgcgggtggtgccatgacaagtgtgtcagatccgaagaatgtctgtcaggaacttggacgcagcagatctgtcttcccgccatttacaaggtgtttcccaactctgcgcccttggagggtggcactcgactaactatctgcgggtgggattttggtttccggagaaacaataaattcgacctgaaaaaaacaagagtgcttcttggcaatgaaagttgtactctcacactatccgagtcgacaatgaacacactgaaatgcacggtcgggccagccatgaataaacatttcaatatgagtataattatatcaaatgggcatggcactacacaatattccacattttcatatgtggacccagtgatcacaagcatctcccctaaatatgggccaatggccggcggtaccctgctaactctgacaggaaactacctgaatagtgggaatagtaggcacatttctatcggcgggaagacttgtactctgaaaagcgtcagcaactctattctagagtgctacacgcccgcgcagactatcagcacagagtttgccgtgaagctcaagatagatctggcaaacagagaaacgagtatcttttcctatagagaagacccgattgtatacgaaatacacccaaccaaatcttttatttctacttggtggaaagagcctctcaacattgtttcttttttgttttgctttgcctcaggggggtctaccattaccggcgtggggaagaatctcaactccgtgtcagtgccaagaatggtgatcaatgttcatgaagctgggcgtaacttcaccgtcgcctgccagcatagaagcaacagtgagatcatatgctgcaccactcccagtctgcagcaactgaatttgcagctccctctgaagacaaaagctttttttatgctagatgggatactgtcgaaatactttgatctaatctacgtgcacaatcctgtttttaagcctttcgagaagccagtgatgattagtatggggaatgagaatgttttagagatcaaaggaaacgacatcgatcccgaagccgttaaaggcgaagttctcaaagtgggcaacaagtcttgtgagaatattcaccttcacagtgaagctgtgctgtgcacggttccaaacgacttattgaagttgaactcggagttgaacattgaatggaaacaagctatatcctctaccgtgttaggaaaggtcattgtgcagcccgaccaaaacttcacaggattgatcgctggcgttgtgagtattagtacagcgctacttctactcctaggcttctttctgtggctgaagaagcgcaaacagatcaaggatctggggtccgagctcgtgcggtatgacgcaagggtccatacacctcatttagatagattggtgtccgccagatccgtttccccaacgactgaaatggtttccaatgaaagcgtggattacagagctacattccccgaagaccagttcccaaattcaagccagaatggatcctgccgccaggtgcagtacccgctaacggacatgtccccaatcctgactagcggcgacagcgacatctccagccccttgctccagaacacagtgcacatcgacctttctgcacttaaccctgagttagtccaggcagttcagcatgtggtcataggtccaagcagtttgatcgtccatttcaacgaggttattgggaggggacactttggatgcgtgtaccacggtacactgctggataacgatggcaagaagatccattgtgccgttaagagcttgaaccggatcaccgatattggtgaagtctcccagttcctgaccgagggaatcatcatgaaggacttctctcacccaaacgttctctcactcctcggaatctgtcttcgcagcgaggggtcgcccctcgtggtgctcccatatatgaaacatggcgacctcagaaatttcatccgaaacgagacacataaccctaccgtaaaagacctgattggcttcggcctgcaggttgccaaaggaatgaagtatcttgcttctaagaagttcgtacatcgtgatctagccgcccgcaattgcatgctggacgagaagttcactgtgaaagtagctgacttcgggttggcccgagacatgtatgataaggagtattatagcgtgcacaataagacaggggccaagttgcctgtgaaatggatggccctggaatccctccagacacaaaagttcactaccaaatcagatgtatggagttttggagttctgctgtgggagctcatgacgagaggagcaccaccatacccggacgtgaacacattcgatatcacagtgtatctacttcagggacgcagactcttacagccagagtactgccctgatcccctctacgaggtgatgctgaagtgttggcatcctaaggcggaaatgaggccaagcttctccgaactcgttagccggattagcgctatcttttctacctttattggcgaacactatgtgcatgtgaatgctacgtacgttaacgtgaagtgcgtggccccatacccatcattgctgtcctcagaggacaacgccgatgatgaggtggatacaagacctgcaagcttttgggaaacctcttag

SEQ ID NO: 15943 - DNA, 4173 bp, Artificial Sequence
  Description of Artificial Sequence: Synthetic coding sequence
atgaaggcccccgccgttctcgcccctggtatcttggtcctcctattcacgctggtccagcgaagcaacggagagtgcaaggaggcactcgcaaaatctgagatgaacgtgaacatgaagtaccagctgcctaatttcaccgccgaaactcctatccaaaacgtgattctgcatgagcaccatatttttctgggtgcaacaaactacatttacgtgctgaacgaggaagacctccagaaagtggctgagtataagaccggccctgtgctcgaacaccctgactgtttcccatgtcaggactgtagcagcaaggcgaacctctcggggggcgtgtggaaagacaatattaacatggcgttagtggtcgacacatattatgacgatcaactgattagctgcggctccgtcaaccgaggaacatgtcagcgccacgtgttccctcacaatcacacagctgacatccagagcgaggtgcactgcatcttctctccgcagatcgaggaaccttctcagtgccctgattgcgttgtttccgccctgggagccaaggtgctatcttcagtcaaagaccgcttcatcaatttctttgtaggaaataccattaattcttcttatttccccgaccaccctctccatagtatttctgtcagaagattgaaggagacaaaggacggattcatgttcttaacagaccagtcctatatcgatgtgttgcccgaattcagagattcataccccatcaagtatgtgcacgcgtttgagagtaacaacttcatttacttcctgacagtgcagcgcgaaaccctcgacgcccagacgtttcatacacggatcattaggttttgtagcatcaacagcggcttacacagctacatggaaatgccactagagtgtatcttgacagaaaaaagaaagaaacgctctacgaagaaagaagtatttaatatcttgcaggccgcctacgtgtccaagcctggggcccaacttgcgaggcagatcggcgcctcactgaacgatgatatcctctttggtgtgttcgcccagtctaaacccgattctgccgaaccaatggacagaagtgcaatgtgcgcttttccaattaaatacgtaaatgacttctttaataaaattgtcaataagaataatgtacgatgtctgcagcacttctatggaccaaatcacgagcactgctttaaccggacactgttgcgaaattcttccggctgcgaggcaaggagagacgagtatagaaccgagttcacaacggccctccagagagtggatttgttcatgggacagttttccgaggtgctcctaacatcgatatcaactttcatcaaaggggacctgaccatcgcaaacctgggaacatccgagggcagattcatgcaagtcgtagtctcacggagtggaccatcgacccctcacgtgaactttctgcttgacagccacccggtgtcaccggaggtgatagtcgaacacacactgaatcagaacggttacacactggtgattacgggcaagaaaattaccaaaattccactgaatggcctgggatgccggcactttcagtcgtgttctcagtgcttgtcagcacccccctttgttcagtgcgggtggtgccacgataaatgtgtcaggtcagaggagtgtctttcaggcacatggacccagcaaatctgtttgcccgctatttacaaagtctttccaaacagcgctccccttgaaggaggcacccggcttaccatctgtgggtgggatttcggctttcggcggaataacaagttcgacctgaagaagacccgggtgctgctgggaaacgaaagttgcacgctcaccctttcagagtcaacaatgaatacactgaagtgcactgtaggccctgctatgaacaagcactttaacatgtctattatcatttccaacggacacggaactacccagtactccaccttcagctacgttgatccggtaattactagcatatcaccgaagtacgggcccatggctggtggcacactgctcactttaactgggaattacttgaatagtgggaatagccggcatataagcataggcgggaagacatgtacactgaagtccgtgtcaaatagtattttggaatgctacactccggcacagacaatttctacagagttcgcagtaaaactcaagattgaccttgccaaccgagaaacttcaattttctcgtaccgggaagatcccattgtctatgagatccacccgacaaaaagcttcatcagtggcgggagtaccataacaggagtggggaagaacctgaactccgtgtccgtaccgcggatggtcatcaacgtccatgaagctggccgaaactttacagtcgcatgtcagcacaggtccaacagtgagatcatatgctgtacaacacccagcctgcagcaattaaacctgcagctgcccctcaaaacaaaggctttttttatgctagatggcatcctatcaaagtatttcgaccttatctatgtccacaacccagtgtttaagcctttcgagaagcccgtaatgataagcatggggaacgaaaatgtgctagaaattaagggtaacgatatcgaccccgaagccgtgaagggagaagtgctcaaagtggggaataagtcttgcgagaatatccaccttcactccgaagccgtactctgtacagtaccgaatgatctgctgaagctgaactccgagctcaatatagagtggaagcaggccataagttcaactgtgctgggaaaagtaatcgtacaaccagaccagaatttcaccgggctgattgccggggtagtctcaatttctacagcccttcttcttctactgggattcttcctgtggctaaagaagcgcaagcagatcaaggacttgggaagtgaactggtgaggtacgacgctcgggtgcacactcctcaccttgaccgcttagtgtcagcgcgctccgtttcgcccacaaccgaaatggtatcaaatgagagtgttgattaccgggctactttccccgaggaccagttccccaactcctctcagaatggcagctgtcgtcaagtacagtatccgctcacagatatgagtcccatcctgacatctggagacagcgacatatcatcacccctgctgcagaataccgtgcacattgatctgtcagctctaaatccagagttggtgcaggccgtgcagcacgtcgtgatcggccctagctcgctcatcgtacactttaacgaggtaatcggacgtggtcactttggctgtgtctatcatgggaccttgctcgataacgatggaaagaaaatccattgtgctgtgaagagtctgaaccgcatcactgacatcggagaggttagccagttcctcacggaggggataatcatgaaggacttctcccaccctaatgtgctgtccttgctgggcatttgtctccggtctgagggcagcccactggtagtcctgccttacatgaagcacggcgacctaaggaactttattagaaatgagacccacaatcccaccgtgaaagacctcatcggttttgggctgcaggtagcaaaagggatgaagtatttggcctctaagaagtttgtgcatcgcgacttagcggcccgaaactgtatgcttgacgagaaatttactgtgaaagttgctgacttcggccttgcccgcgatatgtacgacaaagaatactacagcgtacacaacaaaaccggtgctaagctgcctgtcaagtggatggcactcgagtctttacagacccagaaatttacaacaaagagcgatgtttggtctttcggcgtgttactctgggaactgatgacacggggagccccaccgtacccagacgtgaacaccttcgatatcactgtttacctcctgcagggcaggaggctgctgcagccagagtattgccccgatcccctctacgaagtgatgcttaagtgctggcatccaaaagctgagatgcgaccctcctttagtgaattggtgagcaggatttcggctattttttccacctttatcggagaacactacgtccacgtaaacgcgacatatgttaacgtcaagtgcgtcgccccctatccgtccctattgtcgagcgaagacaacgccgacgacgaggtcgatacgcgacccgcaagtttctgggaaacttcctag

SEQ ID NO: 15944 - DNA, 2295 bp, Artificial Sequence
  Description of Artificial Sequence: Synthetic coding sequence
atgaaagctcccgctgttctggctcctgggatactggtgttgttatttacacttgtgcagcgctccaacggcgagtgcaaggaggcattggccaagagcgagatgaatgtgaatatgaaataccagctccctaattttacggccgaaacccccattcagaatgtgattctgcacgagcatcatatcttcttgggagctactaattacatatatgttctgaacgaggaggatctgcagaaggtggccgaatacaaaaccgggccggtcctggaacacccggattgcttcccgtgccaggactgcagtagtaaagccaacctgtcagggggggtctggaaggataacattaacatggccttggtggtcgacacctactatgatgaccagctcattagttgcggtagtgttaaccggggcacctgccaaagacacgtcttcccccataatcacaccgccgatatccagtcggaggtgcactgcatttttagcccccagatcgaggaaccaagccagtgccccgattgtgtcgtttccgccttgggcgcaaaggttctttcctcagtcaaggacagattcatcaatttcttcgtcggtaacaccatcaacagttcatacttcccagatcaccctttacatagcatcagcgtgcgcagactgaaggagaccaaggacggttttatgtttttgaccgaccagagctacattgacgtgttgccagaattccgcgattcttaccctataaaatacgtccacgcctttgagtccaacaactttatctatttcttgacagtccagagagagacgttggacgctcagacgtttcatactaggattattaggttttgcagtataaacagtgggctccatagctatatggagatgcctctggagtgcattctgactgagaagagaaagaagcggtcgactaaaaaagaggtgttcaacatcctgcaggccgcctatgtgtctaaaccaggggcgcagctagccagacagattggggcatccctgaacgacgatatactcttcggcgtcttcgctcagtctaaacccgactccgccgaacccatggaccgctccgcgatgtgcgccttccccataaaatacgttaacgatttcttcaataagatcgtcaataaaaataacgtgagatgcctgcagcatttttatgggcctaaccacgagcactgtttcaaccgcactctactgcgcaactcttcaggctgtgaggcaaggcgcgacgagtaccgcaccgagttcaccacagcgctccaaagggtcgacctattcatgggacagttttcagaggtgctgctgacaagtatctctaccttcatcaagggcgacttgaccattgcgaacctgggcaccagtgagggccgcttcatgcaggttgtagtgtccaggtcagggccctcgaccccccacgtgaatttcctcttagattcacaccctgtgagccccgaggttatcgtggagcacaccctcaaccagaacggctacaccctcgtgattacaggcaagaaaataacaaagatcccgctaaacgggctcggctgcaggcattttcagtcatgctcgcagtgcctgtccgcacctccctttgttcagtgtggctggtgccatgataaatgcgtgaggagtgaggagtgtcttagtggaacctggacacagcaaatatgcttgccagcgatctacaaagtttttcccaacagcgccccactagagggcggcactcgactcacaatttgcggctgggattttggctttcgaagaaacaacaagttcgatcttaaaaagactcgtgtgctcttgggtaatgagagctgcactctgacactgtcagaaagtacaatgaacaccctgaagtgcaccgtaggccccgctatgaacaaacacttcaatatgtcaatcatcataagcaacggtcatggaactacccagtattcaactttcagctacgtagatcccgtgatcacttcaatttccccgaaatatggaccgatggctggcggcaccctgctgaccctgactgggaactacttgaattcaggaaatagcagacatatctctatcggcggcaagacatgcactctcaagagtgtgagcaattccatcctcgagtgctacactcccgcgcaaaccatttctactgagtttgcagtcaaactgaagattgatctggctaacagagagacctcaatcttctcatatagagaagatcctatcgtctacgagatccaccctacaaagagcttcattcgccacgtgaatatcgctttgatccagagatag

SEQ ID NO: 15945 - DNA, 783 bp, Artificial Sequence
  Description of Artificial Sequence: Synthetic coding sequence
atgaaagacttttcccaccccaacgtattatccctgctgggcatctgcctccggtctgaggggtctccgctcgtggtgttgccttatatgaagcacggtgacctgagaaacttcatccggaacgaaacacataatcccacagtcaaggatctgatcggttttggtctgcaggtggccaaaggcatgaagtatctggctagcaaaaagtttgtccaccgtgacctggcagcgaggaactgcatgctagacgagaagtttaccgtcaaagtggctgactttggattggcaagagacatgtacgacaaggaatactacagtgttcataataagacaggcgccaaattgccagttaaatggatggccctggaatctttacagacccagaaattcactaccaagagcgatgtgtggagctttggcgtgctcctgtgggaactgatgacgcggggagcacctccataccctgacgttaatacttttgacatcactgtgtacttacttcagggaagaagactgttgcaaccagagtattgtcctgaccctctctatgaagtcatgttaaagtgttggcaccctaaggcagaaatgcggccttccttttcagagttggtgagtagaatttcggccatattttctacctttataggggaacattacgtccacgtgaatgccacatacgtgaacgtgaagtgtgtggcgccatatccctcactgttatcatccgaggataatgctgacgacgaagtagatacgcgccctgcctctttttgggagacaagctag

SEQ ID NO: 15946 - DNA, 1749 bp, Artificial Sequence
  Description of Artificial Sequence: Synthetic coding sequence
atggccgcaagatcgtggcaggacgagttggcgcagcaggcagaagaagggtccgccagactcagagagatgctctctgtcggactggggtttctgcgcaccgagctgggtctcgaccttgggctggagccgaaacgctatcctggatgggtaatcctggtgggaaccggtgctctcgggctgctgctgcttttcctgctgggctatggctgggcggccgcatgcgctggagccaggaagaagcggcggtcccctccaagaaaaagagaggaggcggctgccgtccccgccgccgcaccagacgacctggccctcctcaaaaacctgagatctgaggagcagaagaagaaaaacaggaaaaagctttcagaaaagcccaagccaaatggacgcacagttgaagtggctgaaggtgaggccgtccgaaccccccagtcagttacagccaagcaacctcccgaaattgacaaaaagaacgaaaagtctaagaagaataagaagaaaagtaagagcgatgccaaggccgtgcaaaacagcagtaggcacgatggaaaggaagtggacgagggggcatgggagactaaaatctcacatcgagagaaacggcaacagaggaagagagataaggtcctcacggacagcggatcactcgactctacaatccccgggatcgagaatactatcaccgttacaaccgagcaattaacaactgcgtcttttcccgtcggctcaaagaaaaataagggcgattcacatctgaacgtacaggtgtccaacttcaaatccggaaagggagacagtaccttgcaggtgtcaagtggcctaaacgagaacttgacagtgaacgggggaggatggaatgagaagtcggtcaagctgtcgtcccaaatctcagcaggggaggaaaagtggaattctgtgtctcccgcgtccgccgggaagcggaaaactgagcccagcgcctggagccaggacacgggcgacgcaaacactaacgggaaagactggggccggtcttggtccgatagaagtatatttagcggtatcgggtcgacggccgaacctgtctctcagtctaccacttctgactaccagtgggatgttagcagaaaccagccttatatcgacgatgagtggtctggtctcaacggcctgtcaagcgccgacccaaattcagattggaatgcgcctgccgaggaatgggggaactgggtggacgaagaaagagctagcctccttaaaagtcaggagccgattcccgacgatcagaaagtgtccgacgatgataaagaaaaaggcgaaggtgcacttcctaccggaaaaagtaaaaaaaagaaaaaaaagaagaagaagcagggcgaagataatagcacagctcaggacacagaagagcttgaaaaagaaatcagggaggacctgcccgtaaacacctccaagacgcgccctaagcaagaaaaagcgttctctctgaagaccatcagcacttccgatccagccgaggtgcttgtgaaaaacagccagcccatcaagaccctgccaccagccacgtctaccgagccatctgtgattctcagcaagtctgatagcgacaagtccagttcccaagtgccaccaatcctgcaggagacagacaaatcaaaatctaacacaaaacagaattcagtgccgccgtcacagaccaaaagtgaaacctcatgggaatctccaaaacagattaagaagaagaagaaggctcggagggaaacttag

SEQ ID NO: 15947 - DNA, 2148 bp, Artificial Sequence
  Description of Artificial Sequence: Synthetic coding sequence
atggcggccaacatgtaccgagtgggtgattatgtttactttgagaacagcagttctaatccttacctgatcagacggatagaggaactgaataagaccgccaacgggaatgtggaggcaaaagtcgtctgcttctatcgccgacgcgatatatcctccacactcatcgctttggcagataaacacgccactctcagcgtgtgctataaggcgggtcctggtgctgataatggggaggaaggggagatcgaagaggagatggaaaatcctgagatggtggatctgcctgaaaaactcaagcaccagttgcggcacagagaactttttctaagccgtcagctggagagtctcccagcaactcacatccgtggtaaatgtagcgtgactctcctgaacgagacagaatccctcaagtcatatctcgaaagagaagatttttttttttattcactcgtttatgacccccagcaaaagaccctcctcgctgataaaggagagataagagtggggaaccgatatcaggccgatatcacagacttgctcaaagaaggggaagaagatggacgcgatcaatcaagactggaaacccaggtgtgggaagcccacaatcctctaacagataagcagatagatcagttcctggtggtcgctaggagtgtcgggacctttgccagggcactcgactgcagtagctctgttcggcaaccctcgctccacatgagtgccgcagccgcttctcgtgacatcactctcttccacgcaatggacaccctacacaagaacatttatgacattagtaaggctattagcgccctggtcccacaggggggacccgtcctatgtcgggacgagatggaggagtggtctgctagtgaagccaacctgtttgaagaggcactcgaaaaatatggcaaagacttcaccgacattcagcaagattttttaccctggaagagtctgacctcaattatcgaatattactacatgtggaaaaccactgacaggtatgtgcaacagaagaggctcaaggctgcagaggcagaaagcaaacttaagcaggtgtacatccccaattacaataagccaaaccccaatcagatctcagtcaacaatgttaaggctggagtggtgaatgggacaggagcacctggccagtccccaggagccggcagagcttgcgaaagttgttacaccacacagagctatcaatggtatagttggggccctcccaacatgcagtgtaggctttgcgcatcttgttggacttactggaagaagtatggggggctgaagatgcccacaagattggacggcgagcggcctggtccaaaccggagtaatatgtctccacacgggttacctgcccggtcaagcggcagcccgaaattcgcaatgaaaactcggcaggctttctatttacacaccaccaaattgactcgcatcgctcgcagattgtgccgggagatcctgaggccttggcacgcggctcgccatccgtatcttcctattaattctgcagcaattaaagctgagtgtactgcaagactgcctgaagcctcacagagccctctcgtgcttaagcaagcagttcgaaagccccttgaggccgtgcttaggtatttggagacacatccaaggccaccaaagcccgatcccgtgaaatcagtcagcagcgtactgagctcccttactcctgcgaaggtcgcccctgtgatcaacaacgggtcacccactatcctggggaagagaagctatgaacagcacaatggagtggacggcaatatgaagaagcgcttgttaatgccctccaggggactggctaatcatgggcaggccaggcacatgggtccttctagaaacttactcctcaatgggaaaagctacccaaccaaggttcgcttgattaggggtggctcccttcctccagtgaagagacggcggatgaactggatcgacgcacccgacgatgttttctacatggccacagaggagaccagaaaaatccgaaaactgcttagctcttcggagactaaaagagcagcacgccgaccttacaaacccatcgcacttagacagtcccaggcattacctcccaggccacccccgcccgctccagtgaatgatgaaccgatcgtgattgaggactag

SEQ ID NO: 15948 - DNA, 1887 bp, Artificial Sequence
  Description of Artificial Sequence: Synthetic coding sequence
atggtggacctgcccgagaaactcaaacaccaactgcggcatcgggagctgttcctaagccggcagcttgaaagtctcccagcgacacatattagaggaaaatgttcagtgactctcctcaacgaaactgaatcacttaaaagctatctggagcgcgaagacttctttttctacagcctggtctacgacccccagcagaaaaccttgctcgccgataagggtgagattcgggtgggaaatagatatcaggccgatatcacggatctactgaaggagggagaggaggatgggagagatcaatctcgcctggaaacccaggtttgggaagctcacaatccattgaccgacaaacagattgatcagtttttagtcgttgcacgatccgtggggacattcgccagggctttggactgttcttcctctgtccggcaaccaagtctccacatgtccgcggcagcagcatcaagggatataacactgtttcacgcgatggacactctgcataagaatatttacgatatctccaaagccatcagcgccctggttccgcaaggagggcctgtgctgtgcagagacgaaatggaggagtggagtgcctccgaagcgaatctattcgaagaagcactggagaaatatggcaaagatttcaccgatatccagcaggatttcctcccctggaaatccctgaccagcatcatcgaatactactacatgtggaagaccacagatcgctacgtgcagcaaaaaagattaaaagctgcagaagctgaaagtaaacttaaacaggtgtatattccaaattataataaacccaacccgaatcagatttctgtgaataacgtgaaggcaggcgtcgtaaacggaacgggcgcgccaggccagtcacctggcgctgggcgcgcctgcgaaagctgttatactactcagtcctaccagtggtattcctgggggccccctaatatgcagtgcagactgtgcgcttcctgttggacttactggaaaaagtacggaggtctcaagatgccaaccagactcgacggcgaacgcccgggccctaaccgaagcaatatgtcacctcacgggttacccgccaggtcctctggtagccctaaatttgctatgaagactagacaggccttttatcttcacacgacgaagttgacgcgcattgcaaggcgcttgtgcagagagatcctgaggccctggcatgcagcgcgccatccctatctgcccatcaacagtgcagctatcaaagcggagtgtacggcaagattaccagaggcaagccagtccccactcgtgctgaaacaggcagttagaaagccattagaagctgtcttacgctacctggagactcacccccgtcccccaaagcctgatccagtaaaatccgtcagtagcgtattatccagcctcaccccggccaaggtcgcgccagtgattaacaacggctccccaaccattctcggtaaaaggagttatgaacagcacaatggcgtggacggcaacatgaagaaaaggctgcttatgccatctcggggaacttcatcgggcttagcaaaccacggccaagctagacatatgggaccttccagaaacctcctcctgaacggaaaatcttatcccaccaaggtgagattgattcgtggcggctctctgccaccagttaaacgaagaagaatgaactggatcgatgctccggacgacgtgttctacatggctaccgaggagacgaggaaaattaggaagttgctgtcctcttccgagactaagagggctgcaagaaggccttacaagcctattgcattgcgccaatcccaggctcttccgccacgtccacctccgcctgcacctgtgaacgatgagccaatagtgattgaagactag

SEQ ID NO: 15949 - DNA, 768 bp, Artificial Sequence
  Description of Artificial Sequence: Synthetic coding sequence
atgaagacacgccaagcgttttatttgcacactaccaagctgacgcgaatagcgcggcgcctctgcagggagattctgcgcccctggcacgctgctcgccatccttacctgcctattaacagcgctgctatcaaagccgagtgcaccgcacgtcttcctgaggcttcacaaagtcccctggtactcaaacaggctgtacgtaaacctctggaagcggtcctgaggtacctggagacacacccaaggccgcctaaaccagatccagttaagtctgtgtcttccgtgttgagctcacttacaccggccaaggttgcacccgtgattaataatggctctcccaccattctgggaaagaggtcctacgaacagcataacggggtggatggtaatatgaaaaagaggttgctcatgccgtcacgcggaacctacctgggattggctaaccatgggcaggctcgccacatggggcctagccgtaacctcctgctgaacggcaaatcatatccaacaaaggtccgcttgatccgcggcggatcactcccgccagtaaaaaggagacgaatgaactggatagacgcgccagatgacgtgttctatatggccacagaagaaacccgaaagatcaggaagcttctcagttcaagtgagaccaaacgggcggcccggcggccctacaagcctattgcccttcgccagagccaggccttgccaccccggcccccccccccagccccggtcaacgatgaacccatcgtgatagaggattag

SEQ ID NO: 15950 - DNA, 1293 bp, Artificial Sequence
  Description of Artificial Sequence: Synthetic coding sequence
atggccgctaacatgtaccgggtgggggattatgtgtacttcgaaaactcgagtagcaatccttacttaatcagaaggattgaggaactgaataaaaccgctaacggcaacgttgaggcaaaagtcgtgtgcttttatcgcaggagggacatttccagcacattaattgctttagctgataaacacgccactctgagcgtctgttacaaggctgggccaggcgctgacaatggagaggagggagagattgaggaggagatggagaatccagaaatggtggatctccctgaaaaactgaagcaccagctgaggcaccgagagctgtttctttcgcgacaacttgaaagtctaccagcgactcacatacgcggcaagtgctctgtaaccttactgaatgaaacagagagcctcaagagctacctcgaacgggaagatttcttcttctactccttagtctatgacccacagcagaagacactcctcgccgataagggtgagatcagggtcggtaacagatatcaggccgatatcacagacttgttgaaagagggagaagaggatggccgcgatcagtcacgcctcgagacacaggtgtgggaggcccataacccattgaccgataagcagatagaccaatttttagttgtggctcggtctgtggggaccttcgctagagctctggactgttctagcagcgttagacaacccagcctacacatgtcagctgcagctgccagtcgcgacatcaccctctttcacgccatggacactcttcacaagaacatatacgatattagcaaggctatctccgccctcgttccgcaaggagggcctgttttatgccgtgacgagatggaggagtggagcgccagtgaggccaacctttttgaggaagctctcgagaagtatggcaaggactttactgacatccaacaagactttctcccttggaaatctctcacgagcattatcgagtactattatatgtggaagacaacagatcggtatgtccagcaaaaacggctcaaggccgcggaagcagaaagcaagcttaagcaggtgtatatcccgaactacaacaagcctaatcctaatcaaattagtgtgaacaatgtgaaagctggtgttgttaacgggactggcgcgccgggccagtcccctggcgcggggagagcctgcgagtcttgttatatgtcaagcctccgcatcctcttagacattctagaggagatttggtggctggagaatgccaacccagtgcgctggcgcgaggctcgaacgaaaccccagtag

SEQ ID NO: 15951 - DNA, 1422 bp, Artificial Sequence
  Description of Artificial Sequence: Synthetic coding sequence
atgttaagaccagtgatagaggaagagatcagtatgcttggtgagataacacacctgcagacaatcagtgaggacttgaaatctctgacaatggacccccataaattgccatcaagttcagagcaggtgatcctcgatctgaagggctccgactactcatggtcgtatcaaacgccgccgtcatccccatctaccaccatgagccgtaaatctagtgtgtgtagcagcctgaacagtgtgaatagttccgacagcagatccagtggatcccattcccacagccccagcagtcattatagatatagaagtagcaaccttgcccagcaggcacctgtccggctttcttccgtttcatcacacgattcgggcttcatctcccaggatgctttccagtccaaatcaccctcacccatgcctcccgaggcgccaaaccaacggcggaaggagaagcgcgagcccgaccctaatggaggcggccccacaacagcctccggtcctccagcagcagccgaggaagcccagagaccccgcagtatgacagttagtgctgccacgaggcctggtgaggagatggaagcctgtgaagagttggcacttgccctgtctcgggggctacagctggacacacaaaggtcaagcagggactccctacagtgcagtagcggctacagcacccaaactacgacaccttgttgcagcgaagatacgatacccagccaggtctccgattacgattacttttctgtatcaggagaccaggaggcggatcagcaagaatttgacaagagctctacgattccaaggaatagcgatatttcccaatcgtaccggcgaatgtttcaggccaaacgccctgcatctacggccggactccccacaaccctggggcccgcgatggttaccccaggcgttgcgacaataagaagaacaccgtctaccaaaccgagcgttcgtcggggcaccatcggagccggtcccattccgatcaaaaccccagtgatcccggtgaagacacctacagtccccgatctgccaggagtgctgcccgctccccccgatgggcctgaggagcggggagagcatagcccagaaagcccctcagtgggggagggacctcagggggtgacttccatgccatccagcatgtggagtgggcaggcaagtgtcaaccctccactcccaggtcctaaacccagcattccggaggagcatcgacaagccattcccgagagtgaggcagaggatcaagaaagagagccaccctctgcaaccgtgtcccccggacagatcccagaaagcgatccagcagatctgtcccctagggacaccccccagggggaagacatgctgaatgctatcagacgcggggtaaagctcaaaaaaacgaccactaacgatagatcagcaccgcgcttcagctag

SEQ ID NO: 15952 - DNA, 2193 bp, Artificial Sequence
  Description of Artificial Sequence: Synthetic coding sequence
atggaagccgttattgagaaggagtgcagcgctttaggcgggctattccagacaataattagcgacatgaaaggttcctaccctgtttgggaagattttatcaataaggccggcaaactccaatcccagctccggaccacggtggtggctgccgccgcctttctggatgcctttcagaaggtggccgatatggcaaccaatacacgaggcggcaccagagagatcggttcagccctcaccaggatgtgtatgcgccaccgttctatcgaggcaaagctgagacaattctccagcgcacttatcgactgcctgatcaaccccctgcaggagcagatggaggagtggaaaaaagttgctaatcaactggataaggaccatgctaaagagtataaaaaggcccgccaggaaatcaagaaaaagagcagcgacaccctgaagctccaaaagaaagccaaaaaggggagaggggatatccagcctcagctcgatagtgctctgcaggatgtcaacgataaatacttactgctagaggaaacagaaaaacaggccgttcgcaaagccctcatagaggagagagggcgcttctgtacatttatcagcatgttgcgtcctgttatagaagaggagatatccatgttgggcgaaattacccacctacagactatcagcgaagatctgaagtcattaaccatggatccccataaactgccctcatcctcagaacaggtgattttggatttgaaagggtccgattatagttggtcttaccagacaccccccagctctccaagtaccacaatgagcagaaaatctagtgtatgcagctcccttaacagtgtcaacagcagcgatagcagatcttcagggtcgcacagccactctcccagcagccactaccggtacagaagtagcaacctggctcagcaagcaccggtgagactgtcctctgtgtcttcccacgatagtggtttcatttctcaggatgccttccagtcaaagagcccatcgccgatgccgccagaggcgcctaatcaaaacagttcaagttccgccagctccgaagcaagcgagacatgccagagcgtgtctgaatgtagttcgcctacttctgtttcaagcggctccaccatgggcgcttgggtcagcaccgaaaaggactgggcaaagcctgggccctacgaccagcctctggtcaatacacttcagcgccgaaaagagaaaagagagcccgaccctaacggggggggacccacaacggcttccggcccaccggccgccgcagaggaggcacagcggcctagaagcatgaccgtttccgctgccacacgaccaggcgaggagatggaagcgtgcgaggaactggcactcgcattgtcccgaggtttacagctcgacacccagcgatcaagccgggattcattacagtgtagctccgggtactcaacacagaccaccacaccgtgttgttctgaggacacaatcccctctcaagtatccgactacgattacttctcagtgagtggcgatcaggaggctgatcagcaggaattcgacaaatcatccacaattccaaggaactcagacatttctcagagctatcggagaatgtttcaggccaagcgtcccgcctccacagcaggcttgcccacgacgctcggaccagccatggttacacctggcgtggctacgatacgccggacaccatcaacaaagccatccgtacggaggggtactataggcgccgggcccatacctatcaagacccccgttattccagtgaaaacaccaactgttccggatttgcccggggtgttgcccgctccccctgacggacccgaggagaggggggagcacagcccagagagcccgtctgtgggcgagggccctcagggagttacgagcatgccatcctctatgtggagcggtcaggcatccgtgaacccccctctgccaggccccaaaccaagtatacctgaggagcaccggcaggcaatccctgaatctgaggcagaggatcaggaaagggaaccgccgtccgctacggtgagcccgggacaaataccggaaagcgaccctgcagatctgagccccagagacactccccagggagaggacatgcttaacgccataagaagaggggtgaaattgaaaaagacaacaacgaatgataggtcagcacctcgcttcagttag

SEQ ID NO: 15953 - DNA, 1590 bp, Artificial Sequence
  Description of Artificial Sequence: Synthetic coding sequence
atgagcagaaaaagctcagtgtgttcatctctgaattctgttaattcatccgactctcggagcagcggatctcatagccacagccctagctcccattaccgatacagaagcagtaacctggcacagcaggcaccagtcagactcagctcggtgagttcacacgactccggcttcatctcgcaggatgcatttcaatcaaagagcccatctccgatgccaccagaggcacctaatcaaaacagtagttcctccgccagcagtgaagcgtccgaaacttgccagtccgtgtcagagtgcagtagccctacctctgtgtcaagtggcagtacaatgggtgcgtgggtatctactgagaagctgagtaatggcttcagccactactctctatcctccgagtctcacgtggggccaacaggagcagggctgtttcctcattgtctgcccgccagtcgcctgctcccccgcgtgacctccgtgcatctcccggactatgcccactattacaccatcggtccaggcatgtttccttcaagccagataccaagttggaaagactgggcaaaaccagggccctatgaccagcctctggtgaatacattgcagcgaagaaaagaaaaaagagagcctgatccaaatgggggaggacctaccacggcaagtgggcctcccgccgccgcggaagaagctcagcgccctcggtccatgaccgtttctgctgcgactcgtcctggagaggaaatggaggcatgcgaggagctcgcattggctttaagccgcgggctacagctcgatactcagcgcagtagcagagactcccttcagtgctcatccgggtattcaacacaaaccacaacaccatgttgtagtgaagatacgatcccctcacaggtaagcgattacgactacttcagtgtgtctggcgatcaagaagccgaccagcaggaattcgacaaatccagcaccatcccaagaaacagcgatatcagccaaagttaccggaggatgttccaggcgaagagacccgcctccacagctggattgccaactacccttggacctgctatggttaccccaggcgtggctaccattaggcgcaccccctctaccaagccgagcgtgaggcgagggactatcggtgctggtcccattccaatcaaaactcccgtgatacctgtgaagaccccgacagtgcccgatctgcccggcgttctaccagcacccccggatggtcctgaggagaggggcgagcattctcccgagagtccttcggtgggcgagggtccccagggggtgactagtatgcctagctctatgtggtcgggccaggcatctgtaaacccccccctcccagggcccaaaccaagcatcccggaagagcaccgccaggcaattcccgaatcagaggcggaagatcaggagagagaacctccatccgctactgtgagtccgggccagatacctgaatcggatccagcagacctgtcccctagagatactccacaaggggaggatatgctgaacgccatcagaagaggtgtgaaactgaagaagactacaaccaacgaccggtccgcaccacgattcagctag

SEQ ID NO: 15954 - DNA, 2268 bp, Artificial Sequence
  Description of Artificial Sequence: Synthetic coding sequence
atggaagcagtcattgagaaggagtgctcagccctggggggtttgtttcagactattatttccgatatgaaaggctcctatccagtgtgggaagactttatcaataaagcaggtaagctccagtcccagctccgcacgaccgtagttgctgctgcagcgttcctggacgcgttccagaaagtcgccgacatggctaccaacacaagaggcggtactcgcgagatcggatctgcccttacacgaatgtgtatgaggcaccgaagcatagaggccaagctgcggcagttctcatctgctcttatcgactgcctgatcaatcctctgcaggaacaaatggaggaatggaaaaaggtcgctaatcagttggataaagaccacgccaaagaatataagaaggcacggcaggagattaaaaaaaagtcttcagacacactgaagctacagaagaaggcaaaaaaagggaggggagacatccagccgcagctggattccgctctgcaggacgtgaatgataaatacttgctcctcgaagagacagagaagcaggccgtgcgcaaggctctcattgaggagagaggaaggttctgcacatttataagcatgttgagaccggttatcgaagaggaaatcagcatgctgggcgaaattactcatcttcagacaatctccgaagatctgaagtcattgactatggatccccataaactgccatcatctagtgagcaggtcatcctcgatctgaaaggctctgattactcatggtcttaccagacaccaccctcatcacccagcacaactatgagccgtaagtcatctgtgtgcagcagtctcaatagtgttaacagtagcgattccaggtcctccgggagtcactcacattctccttctagccattatcgctaccgcagttccaatctggcccagcaggcccccgtcagattgtcctccgtctcctcccacgactcagggttcatctcccaagacgcattccagtctaaaagcccaagtccaatgcctcctgaagctccaaaccagcttagtaatggattcagccactacagcctctcgtcggagagccacgttggacccacaggcgccggactgtttccgcattgccttcccgccagcaggttattaccccgggtaactagtgtgcatctgccggattacgctcactattatacgatcggtccaggcatgtttccgtcctcccagattccttcttggaaagattgggcgaagcctggaccttacgaccagcctctggtcaatacgttgcagcggcgtaaagagaagcgagagcctgaccctaatggtgggggtccgaccaccgcctccggcccccctgccgccgctgaagaagctcaacgcccccgtagtatgaccgtgagcgcagcgactaggcccggggaggaaatggaggcttgtgaagagctagctttagctctgagtaggggactccagttggatacccagaggtcttctcgggacagtctccagtgcagttcagggtatagcacacagaccactactccttgctgttccgaagacaccatcccctcacaggtctccgactatgattattttagcgtgtctggtgatcaggaggctgaccagcaagaattcgataagagctctacaatcccccgaaatagcgatattagccagagttatagacggatgttccaggcaaagcggcccgcatcaacagcaggactcccgaccacactgggcccagctatggtgacccccggagtggctacaatcaggcgcaccccatccaccaaaccttcagtacgtagggggaccatcggcgcgggccccatcccgataaagacgcccgtaattcccgttaaaacaccgaccgtcccagatctgccaggcgttcttcctgccccaccggacggccctgaagaacgaggagagcactcacccgagtctccatctgtgggcgaaggaccccagggggtaactagcatgccatcatctatgtggagcgggcaggcgtccgtaaatccacctcttccaggtccgaagccatctatcccagaagaacaccgacaggctattcccgagtcagaggccgaagatcaggaacgtgaacctccatctgccaccgtatccccaggtcagattcccgagagcgatccagccgatctgtccccccgggatactccccagggcgaagacatgctgaacgcaatcaggcgtggtgtcaaattaaaaaaaaccactactaacgataggagtgcgcctcgtttttcttag

SEQ ID NO: 15955 - DNA, 1437 bp, Artificial Sequence
  Description of Artificial Sequence: Synthetic coding sequence
atggcaggggtagaggaggtggcagcgagtggcagccaccttaatggtgacctggacccagatgatcgagaggagggagccgcctccaccgccgaggaagccgcaaaaaagaagcgccgcaagaagaaaaagagtaaaggcccctctgccgctggagaacaggaacccgacaaagaatcaggagcttccgtggatgaggtcgcaagacagctggagcgatcagcgctggaggataaggaacgagacgaagacgatgaagacggagatggagatggcgatggtgccactggtaagaaaaagaagaagaaaaaaaaaaagcgcggtccaaaagtgcagactgacccccccagcgtcccaatttgcgacctttaccccaatggggtgttccccaagggacaagagtgcgagtatccacctactcaggacggccgcacagcagcctggcgcacgaccagcgaggagaagaaggccctggaccaggcctcagaggagatctggaatgatttccgtgaagcagctgaagcacacagacaggtgcgaaagtatgtcatgtcctggataaagccagggatgaccatgatcgagatctgcgagaaactggaagactgcagccgtaaactcatcaaggagaacgggctgaacgccggcctggcttttcccacaggatgctcccttaataattgtgccgcacactacacccccaacgcaggagatacgacggtgctgcagtatgatgacatttgcaaaatcgactttgggacccacatcagcggaaggatcatcgactgcgcgtttaccgttaccttcaacccgaaatatgataccttgttgaaagccgtaaaagatgccacaaatactggcatcaagtgcgccggcattgacgtgcggctttgtgacgtgggagaagcaatccaagaagtgatggaatcatatgaagtcgaaatcgacggcaaaacctatcaagtgaagcccatcaggaacttgaacggccatagcatcgggcagtaccggatccacgccgggaagacagtgcccatagtgaaagggggcgaagctacccgtatggaagagggcgaggtgtacgccattgagacctttggctctaccggcaagggcgtcgtgcatgacgacatggagtgctcccattatatgaagaactttgatgtaggccatgtgccaatcaggttgccgaggaccaagcacctgcttaatgtcatcaatgagaatttcggcaccttggccttctgcagacggtggctggatagactgggcgagtccaaatatcttatggctttgaaaaatctgtgcgatctgggcatcgtggatccatacccccccctgtgcgatatcaagggctcctacactgcacagttcgagcatactattctcctccgcccaacctgcaaagaggtagtcagccgaggcgacgattattag

SEQ ID NO: 15956 - DNA, 1743 bp, Artificial Sequence
  Description of Artificial Sequence: Synthetic coding sequence
atgggaactacgggcctcgaatccttgagtcttggtgatcggggtgccgcccctaccgtcacctccagcgagcggctggtgcctgacccaccgaatgatctgaggaaggaggacgtggctatggaactggaaagagttggggaggatgaggagcagatgatgataaaacgaagcagcgaatgcaacccactgctgcaggagcctattgctagcgctcagtttggagcgactgcaggtaccgagtgcagaaaatctgtgccatgtggttgggagagggtcgtgaaacagagactttttggaaagacagccgggcgcttcgatgtctactttatcagcccgcaaggactgaagttcagatcaaagtcttcccttgccaactatctgcacaagaatggagaaaccagcctgaaaccggaggactttgacttcactgtgctctccaagcgaggcatcaaaagtaggtacaaggattgttccatggctgcactcacttcccacttgcagaaccaaagtaacaacagcaactggaacctgcgcacgcgatctaaatgcaagaaagatgtgttcatgccaccaagctcttcctcagagctgcaagaatcccgcgggttatcaaattttacttctacccacctcctgctcaaagaggacgagggagtggatgatgtcaatttccgcaaggtgaggaagccaaaggggaaggtcaccattctgaaaggaattccgattaaaaagaccaagaaagggtgccgaaagagttgctctgggttcgtccagagcgactctaagcgcgaatccgtttgtaacaaggcggatgctgaatcagagccagttgcacagaagtcccaattagaccggacagtctgtatctccgatgcgggcgcctgtggggaaacactgagtgtgactagcgaagagaattctctggtgaaaaagaaagaacgatctctttcatccggtagcaatttctgcagtgagcaaaaaacatccggaattatcaacaagttctgtagcgcaaaggactccgagcacaatgaaaagtacgaagatacattcttagagagcgaggagatcggtaccaaggtcgaagtggtagagcggaaagagcaccttcatactgatattctgaagcgtgggagcgaaatggataacaattgctcaccaacccgaaaagactttaccggagagaagatctttcaggaggacaccatcccacgtacacaaatagaaaggcgcaaaaccagtctctatttctcctccaagtataataaagaggcactttccccccccagaaggaaggcgtttaaaaagtggactccacctcgtagtcccttcaatctggtgcaggaaacgcttttccatgacccatggaagttgctaatcgcgactatatttctcaatcgcactagtggtaaaatggcaattccggtgctgtggaagtttctcgaaaagtatccgagcgccgaagtggccaggacggcagactggcgggacgtgagcgagcttctcaagcctctcggcctatacgatctgcgggcaaagacaatcgtgaagttctccgacgagtatctaacaaagcaatggaagtaccctattgagctgcatggaataggaaaatacggtaatgattcatatcggatattctgcgtgaatgagtggaaacaggtccatccagaggatcataaattaaacaaatatcatgattggttatgggagaaccacgaaaagctatcactgagctag

SEQ ID NO: 15957 - DNA, 789 bp, Artificial Sequence
  Description of Artificial Sequence: Synthetic coding sequence
atgggcaccacgggtctcgagagtctatcacttggcgaccgcggggcggcccccaccgtgacaagttctgagcgactggtgcctgatccaccaaatgatctgcgaaaagaggacgtggccatggaactcgaaagggtcggagaagacgaggagcagatgatgattaaaagatccagcgagtgcaaccccctgctccaggagccaatcgcttcagcacaatttggcgccacagccgggactgagtgccaggacaccattccgcggacacagatcgaacgcagaaaaacctccctatacttctcatctaagtataacaaagaggctctctctccccctaggcggaaggcctttaagaagtggacccccccaaggtctcccttcaaccttgtccaagaaacattatttcacgacccctggaaattgctaattgcaaccatctttctgaatcgcaccagtgggaaaatggccatcccagtcctgtggaagttcttagaaaaatacccgagcgccgaagtcgccagaacagctgactggagggatgtgtctgaactcctgaaaccactcgggctgtatgacctgcgtgcaaagacgattgtaaaattttccgacgaatatctgaccaaacagtggaagtaccctatcgagctccatggaatcgggaagtatgggaacgacagctatcgcatcttttgtgtcaacgagtggaagcaggtgcaccctgaagatcataaactcaacaaataccatgattggctgtgggaaaaccacgagaagctttcactttcttag

SEQ ID NO: 15958 - DNA, 1725 bp, Artificial Sequence
  Description of Artificial Sequence: Synthetic coding sequence
atggggactactggattagagtctctgtcattgggcgaccgcggagccgctcccaccgtgacctccagcgagaggctggtcccagaccccccaaatgacttgaggaaggaggatgtggccatggagttggaaagggtgggagaggacgaggagcagatgatgatcaagcggtcctctgagtgcaatccactgctccaagagcctattgccagtgctcaattcggagcaacagctggtaccgaatgcaggaagtcagtgccctgcgggtgggagcgagttgtgaagcagcgcctgttcggaaaaactgctggccggttcgatgtctattttattagccctcaagggttgaaattcaggagtaaaagctcactcgctaattatctgcacaagaacggagaaacttctctgaagccagaagatttcgacttcactgtcctcagtaagagggggattaaaagcagatacaaagattgttccatggctgccttaacatcgcacctgcagaaccagtctaacaacagcaactggaatctcaggacccgatccaaatgtaagaaagatgtttttatgcccccgtcttcatcctccgaactccaggaatctcggggactgagtaactttacaagcacgcaccttctgttgaaagaagacgagggcgtggacgacgtgaactttcgcaaggtacggaagccaaaaggtaaggtgacgatcctcaaggggatccccatcaaaaaaacaaaaaagggctgtaggaaaagctgctcgggctttgtccagtcggactcgaaacgggaatctgtgtgcaacaaggcagacgccgagtctgagcctgtggcccagaaatcccagctcgatcgcactgtttgtatctctgacgcgggggcctgcggcgaaactttgtcggtgactagcgaagaaaatagcctggtcaaaaagaaggaaaggagtctttcatctggatctaacttctgctctgagcaaaaaacgagtggaatcatcaacaagttctgttctgcaaaggacagcgagcataatgaaaaatatgaggatacgtttcttgaatcagaagaaatcggtaccaaggtagaagtcgtagaacgtaaagagcatctgcacacagacatcctgaaaagaggctctgaaatggacaataattgttcgcctacacgtaaggactttacagaggacacaatacctcgcacacagattgaacggcgaaaaacttctctttatttcagctcaaagtataacaaagaggctttatctccccctagaagaaaagcctttaagaaatggacaccgccacgtagtccattcaacctggtgcaggagactttgttccatgacccttggaaactgcttattgcaacgattttcctgaatcgcactagcggaaagatggctattcctgtgctgtggaagttcctggaaaaatatccctcagccgaggtcgcccgaactgccgactggagggacgtatctgaactgcttaaacctctgggcctctacgacctgcgggcaaagacaatagtaaaattttctgatgagtatttaaccaaacagtggaaataccccatcgagcttcacggcatcggcaaatatggcaatgactcgtaccgaatcttctgtgtgaacgaatggaagcaagtgcatccagaagaccacaaattaaacaagtaccacgactggctttgggagaatcacgaaaaattgagcttgagttag

SEQ ID NO: 15959 - DNA, 93 bp, Artificial Sequence
  Description of Artificial Sequence: Synthetic coding sequence
atggtaaacgaggcaagggggaactcctccctgaacccttgtttagaaggcagcgcctcttctgggagcgagagtagcaaggactcctcctag

SEQ ID NO: 15960 - DNA, 2094 bp, Artificial Sequence
  Description of Artificial Sequence: Synthetic coding sequence
atggatcaccggaaagccagggtgctgcctgccggccactactgcccctctcttggtatctgggcaagtcaggttggatcagtgcgaagctcagtgcccccttccatttcacggaatcccgcaatggtgaacgaggcccggggaaatagcagcctgaacccatgccttgagggatcagccagctctggatccgaatcttctaaggacagtagtcggtgtagcactcctggcctcgatcccgagcgccacgaacgcctccgggagaagatgaggcggcggctcgagtctggagataagtggttctcactggaattttttccccccagaaccgccgagggtgcggtcaatttaattagtagattcgaccgcatggcggcaggcggccccttgtacatcgatgtcacttggcaccccgccggtgatcctgggagtgacaaggagacctcaagtatgatgattgcctccactgccgtgaattactgtggcttggaaaccattctacatatgacctgttgccgacagcgtcttgaggagattaccggacacctgcacaaagcaaagcagctgggcctcaaaaatatcatggccttgagaggcgaccccataggagaccagtgggaggaggaagagggcggatttaactacgccgtcgacctggttaaacacatccgatccgagttcggggactactttgacatttgtgtcgccggttatccaaaaggccatccggaagccggaagtttcgaggccgatttaaagcacctgaaagaaaaagtctctgctggggccgattttattatcacgcagctgtttttcgaggccgatacctttttcaggttcgttaaggcttgcacggacatgggcataacatgtcccattgtcccaggcatatttcccattcagggctaccacagtctcagacagctggtgaaactctctaagcttgaggtgcctcaggagatcaaggacgttattgagccaatcaaagacaacgacgcggctatccgcaattacggcatcgagctcgcagtctcattatgtcaggaactgctggcttctggccttgtgcctggactccacttttatactctcaaccgggaaatggcaaccactgaggtcctgaagcggcttggcatgtggacggaagatcctagaagacctctcccttgggccctcagcgctcatcctaaacggcgggaggaagatgtgcgaccaatcttttgggcgagccgacccaaaagttacatatacaggacgcaagaatgggacgagttccctaacggccgatggggaaattcttcctcaccagcgtttggggagctcaaggattattacctcttctatctaaagagtaaatccccaaaagaagagctactcaagatgtggggggaggaacttaccagcgaagagtccgtgtttgaggtatttgtgttatatctgagtggcgaacccaaccgcaatgggcataaggtgacctgcctgccctggaacgacgaaccacttgccgccgagaccagcctcctcaaggaggagctgctcagagtcaataggcagggaattctgacaataaatagccaacctaacatcaatggtaagccgtcctccgatccgattgtcgggtgggggccctcgggcggatatgtattccagaaggcctatctcgagttctttactagccgggagaccgctgaagccctacttcaggtcttaaagaagtatgaattgagagtcaattaccatttggtcaatgtcaaaggggaaaacatcactaacgcaccagagcttcagccaaatgccgtaacgtggggaatattcccaggccgcgagatcatccagcctacagtcgtggacccagtgtcatttatgttttggaaggatgaggcatttgccctgtggatcgaacggtgggggaaactgtacgaagaagagtctccttctcggaccataatccagtacatccatgacaattactttctcgtgaacctagtcgataatgacttccctcttgacaactgcctttggcaagtcgtcgaggacacattggaactgctcaatcggccgactcagaacgctagggagaccgaggctccgtag

SEQ ID NO: 15961 - DNA, 2094 bp, Artificial Sequence
  Description of Artificial Sequence: Synthetic coding sequence
atggatcaccggaaggctcgggtgctccccgcaggtcactactgcccttccctgggtatctgggcctcccaagtgggcagtgtgcggagtagtgttcccccatccatctcccgaaacccagcaatggtgaacgaggcaagagggaactcctccctgaacccctgcttagagggctctgcctcgagcgggagcgagtcctctaaagattcgagcagatgctcaactccaggcctcgaccccgagaggcacgaaagactgagagagaagatgcgacgaaggctggagtctggcgataagtggttcagtctggagttttttccccctaggacagcagaaggcgctgtgaatttgatctctagatttgatagaatggctgccgggggtcccctctatatagacgtaacttggcatcctgccggcgatcccgggtccgacaaggagacctcgtccatgatgatcgcctctaccgctgtcaattactgcggtctcgagaccatactgcatatgacatgctgtaggcaacggcttgaagagatcacaggccacttgcacaaggcaaagcagttgggcctcaagaacatcatggcattgcgcggtgatccgataggtgatcagtgggaggaagaggagggcgggttcaactatgccgtggacctggttaagcatatccggtcagagttcggggactattttgacatctgcgtagccggatatccaaaaggacatccagaagcgggtagctttgaggccgacttaaagcatctcaaagagaaagtttctgccggcgccgactttatcattacccaactctttttcgaagctgacaccttttttaggttcgtaaaggcgtgtactgacatgggcattacatgccctattgtacccgggatctttccaatccagggctaccactcgctgcgccagctggttaagttgtctaagctggaggttccacaggagatcaaagacgtcatagaacccatcaaggataatgacgcagccatccggaattacggcatcgagctggctgtgagtttgtgtcaagaactattagcgtccggactagtgcccggtctgcatttttacacactcaacagggaaatggcaacaactgaggtcttaaagaggcttgggatgtggactgaagatcctcggcgccccttgccttgggccctttccgcgcaccctaaaaggagagaggaggatgtgagacctatcttttgggcaagtcgacctaagagctacatctaccggacccaagagtgggatgagtttcccaacggcagatggggcaactcttcctcccccgcttttggcgagttgaaagactactacctcttttatctcaaaagcaaaagtcctaaggaagagcttctgaagatgtggggagaagagcttacaagcgaggaatctgtctttgaagttttcgtgctctacttgagcggagagcccaaccgaaatgggcataaagtaacgtgcctgccctggaacgacgaaccactggctgccgaaaccagcctgctgaaagaggagctacttagggtaaaccgacaggggatcctaacgatcaacagccagccaaacataaatggcaagccctcgtccgatcctatcgtagggtggggccccagtgggggatacgtcttccaaaaggcgtacttagaattcttcacctctcgagagacggccgaggctctgctgcaagtgctgaaaaaatacgagttgcgggtgaactatcacctcgtgaacgtgaaaggagagaatatcacaaatgccccagaactgcagcctaacgctgtgacttgggggatctttcctgggcgtgagattatccagcccactgttgtcgaccctgtgagcttcatgttttggaaggacgaggcctttgctctgtggattgaacggtggggtaaactatacgaggaggagtctccttcccggacaattatacaatatatccatgacaattacttccttgttaatctggttgacaatgacttccctttggacaattgtctgtggcaggtggtcgaagacacattggaacttctcaatcggcccacccagaacgcacgggagactgaagcaccttag

SEQ ID NO: 15962 - DNA, 1971 bp, Artificial Sequence
  Description of Artificial Sequence: Synthetic coding sequence
atggtgaatgaggcaagaggaaacagctctttgaacccttgtttggagggctcagcgtcctccggcagtgaaagcagtaaagattcgtccaggtgttccacccccggtcttgatccggagcgacacgaaaggcttcgagaaaaaatgcggcggcgccttgagtcaggggataagtggttctccctggagttctttccacctcgaaccgccgagggggcagtgaatctgatcagcagattcgaccgcatggccgccggcggccctctgtatatcgacgtaacttggcacccggctggcgatcccgggtccgacaaggagacctcatccatgatgatcgcttcaacggcggtgaactattgcggcctagaaactatacttcacatgacttgttgtaggcagagactggaggagatcacaggtcatttgcataaagctaaacagctgggactgaaaaatatcatggccctacggggcgatccaattggagaccaatgggaggaggaagaggggggcttcaattacgcagtggatttagtaaaacatatcaggagtgagtttggtgactattttgacatttgcgtcgcagggtatccaaaagggcatcctgaggctggtagttttgaagctgacctgaagcatctgaaagagaaggtgagcgctggcgcagacttcatcatcacgcaattgtttttcgaggccgacaccttcttccggttcgtgaaggcctgcaccgacatgggaatcacatgccccatcgtcccaggcatttttcccatacaaggctaccatagccttcgacagcttgtgaagcttagcaaactggaggtcccacaagagattaaagatgtcattgagcccataaaagataacgatgcggcgattcgtaactatggtatcgagttggccgtgtccctctgtcaggagttgctggcttcagggctggtcccggggctccatttctataccctcaacagagaaatggcaaccacagaggttctgaagcgtttaggcatgtggaccgaggacccacggaggcccctgccctgggctctttcagcacatcccaagcgaagggaagaggacgtacgccccatcttctgggcatccaggccaaaatcctacatctaccggactcaagaatgggacgagttccctaacggacgatggggcaacagctcatcacccgcctttggcgagcttaaggattactacctattttacctgaaatcaaagagccctaaggaggagctgctaaagatgtggggcgaagaactcacgtctgaagagagcgtattcgaggtgtttgtcctgtacctgtcaggggaaccaaatcgcaacggccacaaagtgacttgcctaccatggaatgacgagcccctggccgccgaaaccagcctactcaaagaagagctccttcgcgttaacagacagggcatattgacgatcaattcgcagcccaatattaatggcaagcctagctcagatcccattgtggggtggggtccctccggggggtacgtgttccagaaagcttatttggaattctttacaagcagggagacggcggaggcactactgcaagtgctgaagaagtatgagctgcgtgttaactaccatctggtcaacgtcaaaggtgagaacataaccaacgcccctgagttgcagccaaacgctgtgacctgggggatctttcctgggagggagattattcagccgactgtagtagatcccgtgagtttcatgttctggaaggatgaagcctttgccctctggatcgaacgttggggcaagttatatgaagaagaaagcccttctcgtacaataattcaatacattcacgacaactattttctggttaatctggtcgataatgactttcctctggacaattgcctctggcaggtggtggaagataccctggagttactcaaccggccgacccagaacgcaagagagaccgaggccccctag

SEQ ID NO: 15963 - DNA, 1971 bp, Artificial Sequence
  Description of Artificial Sequence: Synthetic coding sequence
atggtcaacgaggcccgcggaaattcgtcactgaacccctgtctcgaaggatccgccagctccggatccgagagcagcaaggactctagccgatgctctacaccagggctggaccctgaaaggcatgagaggttacgggaaaagatgcgacgtcggctggaaagcggggataaatggtttagtttagagttttttccccctagaacagccgaaggagctgtgaacctcataagcagattcgaccgcatggcagcgggtggccctctgtacattgatgtcacgtggcaccccgcaggcgacccaggtagcgacaaagagacctcttccatgatgatcgcaagcacagctgtcaactattgtggtctcgagaccatactacatatgacctgctgtcgacaaaggctggaagaaataacaggtcatttacacaaggctaagcagctggggctgaagaacattatggctctgcgaggggatccgataggcgaccagtgggaagaggaggagggagggtttaattacgctgtggatctggtgaagcacatccggtcagagttcggagattatttcgacatttgtgtggctggttatcctaagggccaccccgaagcaggcagcttcgaggcagatcttaaacatctgaaggagaaggtctccgccggggcagactttattattactcagttgttctttgaagccgacactttttttagattcgtcaaagcctgcacagacatggggattacatgcccgatcgtgccgggcatattccccatacagggataccactctttgcggcagctggtgaaactgagtaaactagaggtacctcaggaaataaaagacgtgatcgagccaatcaaagacaacgatgctgcaatacgcaactacggaatcgaactcgcagtgagcctgtgccaagagctgctcgccagcgggctcgttcctggactccacttctacaccttgaacagggagatggccacaactgaggtactcaagcgcctcggcatgtggactgaagatccaaggcggcccctgccttgggccctgtcagctcaccccaaacggagggaggaggatgttcgcccaatcttttgggcttctcgcccaaagtcatatatctatagaactcaagagtgggatgagttccctaatgggcgctgggggaactctagttcccctgcctttggcgaattaaaggattactacctgttttatctgaaaagtaagtctccaaaggaagaacttctcaagatgtggggagaggaactcactagtgaggagagtgtgtttgaagtgttcgtgctttacctaagcggggagccaaatagaaacggtcataaagtgacttgtttaccttggaacgacgaaccactggccgccgagacttcactgctgaaagaggagctcctccgcgtgaatcggcagggtatattgacaatcaacagtcaacctaatatcaacggtaagccatctagcgaccctatcgtgggctggggcccaagcggaggatacgtcttccagaaggcctacctggagtttttcaccagccgagaaaccgctgaggctctactgcaagtgttgaagaagtatgaattgcgagtgaattatcacctggtcaatgttaaaggcgagaacatcaccaacgcgcctgagttacaacccaatgccgtcacatggggaatctttcccgggcgggagataatccaaccaactgtggtagaccccgtttcttttatgttttggaaagacgaagcatttgccctctggattgagcgctgggggaaactatacgaagaggaaagccctagccggactattattcagtatatccacgataattacttcctggtaaatcttgtggacaatgacttcccactcgacaattgtctgtggcaggttgtggaagatacactcgagctgctgaaccggccaactcagaatgccagagagactgaggccccctag

SEQ ID NO: 15964 - DNA, 93 bp, Artificial Sequence
  Description of Artificial Sequence: Synthetic coding sequence
atggtgaacgaggcaagaggaaactcctcgctgaacccgtgcctggaaggctctgcatcgtcagggtccgaatccagcaaagacagcagttag

SEQ ID NO: 15965 - DNA, 432 bp, Artificial Sequence
  Description of Artificial Sequence: Synthetic coding sequence
atggtgaatgaagccagaggcaactcgtcattgaacccctgtctggaaggtagcgcatctagcggcagtgagtctagtaaggattcgtcacgctgtagcaccccaggcttggaccctgagaggcatgaaagactgagggagaagatgcggcgacgtctggagagcggagacaaatggttctccctcgaattcttcccccccagaacagcagagggagccgtcaacttgatcagccggtttgatcgcatggcagccgggggccctctatatattgacgtgacctggcaccctgccggagacccaggatcagacaaggaaactagctccatgatgattgcctctaccgctgtgaattactgcggactggagactattctccacatgacctgttgtagacagcgcctggaagagattactggccacctacattag

SEQ ID NO: 15966 - DNA, 162 bp, Artificial Sequence
  Description of Artificial Sequence: Synthetic coding sequence
atgtgtcgcggttgtgggtgtttgccaccggacgccccgtgcccaacactgtgtagtcggaatcctgctatggtaaacgaggccagaggtaattctagtcttaatccctgcttggagggttccgcttcttccgggtccgaatctagcaaggatagttcttag

SEQ ID NO: 15967 - DNA, 93 bp, Artificial Sequence
  Description of Artificial Sequence: Synthetic coding sequence
atggtcaacgaggcaagaggcaatagctcacttaacccctgcctggaggggagtgcaagcagcggaagtgaaagcagcaaggactctagttag

SEQ ID NO: 15968 - DNA, 2508 bp, Artificial Sequence
  Description of Artificial Sequence: Synthetic coding sequence
atggccgcacccattctcaaagatgttgttgcctacgttgaggtctggagctctaatggaactgaaaactacagtaagacattcacaacccagctggtcgacatgggcgccaaggtttccaaaacctttaacaagcaggttacacacgtgatcttcaaagatggttaccagtccacttgggataaggcccagaagagaggcgtaaaactggtttctgtcctgtgggtagaaaagtgccgcaccgctggggcccatattgacgagtcactatttcccgccgccaacatgaatgaacacctcagctccctaataaagaaaaagcgaaagtgtatgcagcctaaggactttaactttaagactcctgaaaatgacaagcggttccagaagaaattcgagaaaatggccaaggaactgcagcgccagaaaacaaatcttgatgacgatgtgccaatcctgctcttcgaatccaacggtagcttgatctatacaccaactatcgagatcaacagcagacaccatagcgccatggagaaaagactacaggagatgaaggagaaaagggagaacttgagcccaactagttcccagatgatccaacagtcccatgacaatccaagcaattcgctctgtgaggctcccctaaatattagccgggacaccctctgctcagatgaatactttgctggaggcctgcactcaagctttgacgacctgtgcggcaacagtggatgcgggaatcaggagaggaagttggagggtagtatcaacgacattaagtctgatgtgtgcattagctcgctggttctcaaggccaataacatccactccagcccatctttcacacacttggataaaagcagccctcagaagtttctgtcaaacctttcgaaagaggagattaaccttcaacgtaacatcgccggcaaagtggtgacgcccgaccagaaacaggccgccggcatgtcccaggagacattcgaggaaaaatataggctatcccctactcttagcagtacaaaggggcatcttctcattcactctcgtccacgcagctctagtgttaaacgcaagcgtgtgagtcatggctcccactctcctccaaaggaaaagtgtaaacggaaaagaagcaccagacgatccattatgccaaggctgcagctgtgccgctcggaggataggctccagcatgtggcgggtccagctttggaagccctgtcttgtggagagtcaagctacgacgactatttttcccccgacaacctgaaggagcggtacagcgaaaacctaccacctgagtcacaactacccagctctccggcacagctgtcctgtcgaagtttgtccaaaaaagaacgcacatcaattttcgaaatgagtgacttcagttgcgtcggaaagaagacccgcaccgtcgacattacgaattttaccgctaaaaccataagctccccacgaaagacaggcaacggcgagggaagagccacatccagctgtgtcaccagcgctccagaggaagccttgaggtgctgccgtcaggctggtaaagaggatgcttgtcctgaggggaacgggttcagctacacgatagaggatccagcactcccgaaggggcacgatgatgatctgacaccgcttgaggggtctctggaagaaatgaaagaagccgtaggcctcaaatctacacagaataaaggcacgacatccaaaatctcaaacagctctgagggggaggcccagtcagagcacgagccgtgttttatcgtggattgcaatatggaaactagcaccgaggaaaaagaaaatctgcctggtggctactccgggagcgttaagaacagacctacgcgccatgacgtcctggatgatagctgtgacgggtttaaagatcttattaagcctcacgaggagctcaaaaagagcggcagaggaaaaaaaccaacaagaacactggtgatgactagcatgccctccgagaagcaaaatgttgtgattcaggtggtggacaagttgaaaggcttttccatcgccccagacgtctgcgaaacaacgacacatgttctgtcaggcaaacccctccgcacactcaacgtgttactgggcattgctagaggatgctgggtcttgagctatgattgggtgctttggtctctggaactgggacactggattagtgaggaacccttcgagctcagccatcactttcccgcggccccactttgcagaagcgagtgtcacctttccgccggcccttatagaggcaccttgttcgccgatcagccagcgatgttcgtgtcccccgcctccagtccacctgtggccaagctctgtgagcttgtgcatctttgtggcggtagagtatcgcaggttcctaggcaggccagcattgtgattggcccatacagcggtaaaaagaaagccacagtcaaatatctgtcagagaaatgggtgttagattccatcactcagcacaaagtgtgtgcccctgaaaactacctgctgagtcagtag

SEQ ID NO: 15969 - DNA, 1833 bp, Artificial Sequence
  Description of Artificial Sequence: Synthetic coding sequence
atggctgccccgatcctgaaggacgtggtagcatacgtggaggtgtggtcatctaatggtacagagaattacagcaagacttttactacccagctcgtcgatatgggagccaaggttagcaagacgttcaacaagcaagtgacccacgtaatttttaaggacgggtatcagtccacctgggataaagctcaaaagcggggagtcaagctagtgagtgttctgtgggtagaaaaatgccgtaccgccggagcgcatatcgacgagtccctgttcccggccgccaacatgaacgagcatttgtcctcattgattaaaaagaagagaaaatgtatgcagcctaaagactttaattttaaaactcctgaaaatgataagcgttttcagaaaaagttcgagaagatggcaaaagaactacagcggcagaagaccaatctagacgatgatgtgcctattctgttgttcgagtccaacggatcactgatatacacacccacaattgagattaatagccgacatcattccgctatggaaaagcggctccaggaaatgaaagaaaagagagaaaacctctcacctacatcttcacagatgattcagcagagccatgacaacccatccaatagcttgtgcgaagctcctctgaacatctcccgtgataccctttgtagtgacgagtactttgcaggaggactacatagctcctttgacgatctgtgcggaaacagcggctgcggcaatcaagagaggaagctggagggtagtattaatgacattaagtcagatgtatgcatctctagcctcgtgctgaaagccaacaacattcattctagtccttccttcacccaccttgacaagtcctctccacagaagttcttgtccaacttgtctaaggaggagatcaacctgcaacgaaacattgcaggtaaggtggtcacacctgaccaaaagcaggctgcaggcatgagccaggagacttttgaagagaaatacaggcttagccccaccctgagttcgaccaaggggcacctgttaatccacagcagaccacgttcttccagcgttaagcgcaagagagtctctcacggatcacactctccacctaaggaaaagtgcaagcggaagcggagtacacgtagaagcattatgccaaggctccaactgtgtaggtctgaggaccggctgcaacatgtggcagggccagcactggaggcgctcagctgcggggaaagctcgtacgatgattatttctcaccagataatctcaaagaaagatattctgagaatttacctcccgagagtcaactgccgtccagccctgctcagctcagttgccgttcgttaagcaagaaggagaggacgagcattttcgagatgtcagacttttcctgtgtcggcaagaagacaaggacagtagatatcaccaactttactgctaaaactatttcctctcctcggaagaccggaaatggggagggaagggcgacatcaagctgcgttacttccgctcctgaagaagcactccggtgctgccggcaggccgggaaagaagacgcctgccctgaagggaatgggttttcctacaccattgaggatcccgcactgccgaaggggcacgacgatgatctgactcctctcgagggatctttagaagaaatgaaagaggcagttggattgaaaagtacccagaataagggaaccacctctaaaatcagcaactcctctgaaggcgaggctcagtccgaacacgaaccgtgctttattgtggactgtaacatggaaacgtcaaccgaggaaaaggagaatctcccgggcggctactcaggctctatgtag

SEQ ID NO: 15970 - DNA, 1689 bp, Artificial Sequence
  Description of Artificial Sequence: Synthetic coding sequence
atggcagcaccaattctaaaagatgttgttgcctacgtggaagtctggtcttccaacgggacagagaactacagcaaaacttttactacccagctggtcgacatgggcgctaaagtgtctaagactttcaacaaacaagttacccatgtgatattcaaggacggataccagtccacttgggacaaggctcaaaagcgaggagtaaagcttgtctctgtcctgtgggtcgagaagtgccgcacagccggcgctcatattgatgaatctctttttcccgccgccaacatgaacgagcacctctcctcattaatcaaaaagaagaggaagtgtatgcagccaaaagactttaacttcaaaacgcctgagaacgacaagcgtttccagaagaaatttgagaaaatggcaaaagaacttcagagacagaagactaatctagccagtcagatgatccagcaaagccatgataatccctcgaactctctctgcgaggctccactgaacatcagcagagatacactctgttccgatgaatactttgccggaggcctgcatagttcttttgatgacctttgtggcaattcgggatgcgggaaccaggaacgcaagttggaggggtccatcaacgatattaagtctgacgtgtgcatttcctcactggttcttaaagccaataacatccacagtagcccctccttcactcacctcgacaagtccagcccacagaagtttctctccaacctgtccaaagaagagatcaatctccagagaaacattgctgggaaggtggtgacccctgatcagaagcaagcagccgggatgtcccaggaaacatttgaggaaaaatacagactctcccctactcttagctccaccaaggggcacctcttgatccacagcaggcccagatcaagcagtgtgaaaagaaagcgtgtgtcacatggatcacactccccccctaaggaaaagtgtaagagaaaaaggtctacccgcaggtcaatcatgcccaggttgcagctctgtaggagcgaggacagactgcagcacgtcgccggaccagctcttgaagctctgtcttgcggggagtcgtcatatgacgactactttagccccgacaaccttaaagagcgctacagcgagaacttacccccggagagccagctcccttccagccccgctcaattgagctgtcgcagcctgagcaaaaaagagaggaccagcatcttcgagatgtcggatttcagctgcgtgggaaagaaaacaagaacggtggacattacaaatttcactgccaaaacaatcagttccccgcgtaaaaccggcaacggggaaggacgggctacgtcttcctgtgtgaccagtgcccccgaggaggcactccggtgctgcagacaggcagggaaggaggacgcctgtcccgagggcaacgggttctcttatacaatcgaggatccggcactgccaaagggacatgacgatgacctaacaccattggagggtagcctggaggaaatgaaagaggcagttgggctcaaatcgacccagaataaagggacaaccagcaaaattagcaacagctccgaaggagaggctcagagcgagcacgaaccatgtttcatcgtggactgcaatatggaaacaagtaccgaggagaaggagaacctgcccggcggctactctggatctatgtag

SEQ ID NO: 15971 - DNA, 234 bp, Artificial Sequence
  Description of Artificial Sequence: Synthetic coding sequence
atgaacgtattgctgggcagtgtggtgatctttgcaactttcgttacactttgtaacgcttcctgctatttcattcccaacgagggtgttccaggggatagcacacggatgtttctgcacctgtgggtgatgaccaaaaccacagcaaaggaatcgtcccgcaggaggaccgcctcaatctcatggtggcgccggcgcacgcagaagagaccggtgctctcggtgaatgggtag

SEQ ID NO: 15972 - DNA, 345 bp, Artificial Sequence
  Description of Artificial Sequence: Synthetic coding sequence
atgaatgtgctcttaggaagcgttgtgatctttgcgactttcgtgaccctctgcaatgccagttgctatttcatcccaaacgaaggagtgcccggtgactccacccgcaagtgcatggatttgaaaggcaacaaacatcccattaacagcgaatggcagaccgataattgtgagacatgtacatgttacgagactgaaattagctgctgtaccctggtgagtacaccagtggggtatgataaagataactgccaaaggatctttaaaaaggaggattgcaaatatattgtggttgagaagaaggatccaaagaagacctgtagcgtctctgagtggattatatag

SEQ ID NO: 15973 - DNA, 3813 bp, Artificial Sequence
  Description of Artificial Sequence: Synthetic coding sequence
atgacagacgacaactcagatgataagatcgaggacgaattgcagactttttttacatctgacaaggacggaaacacccatgcgtataacccaaagagtcctcctacccagaacagctccgcaagctctgtgaactggaattctgccaatcccgatgacatggtggtggactacgagactgaccccgcagtggtcaccggtgagaacatctccctgtccctacagggcgtggaagtgttcggccatgagaaatctagcagtgatttcatatctaagcaagtcctcgatatgcataaagattcaatctgtcagtgccccgctttggttggcaccgaaaagcccaaatacctgcagcactcttgccactccttggaggctgtggagggccagagcgttgagcctagcttacccttcgtctggaaaccgaacgacaacttgaattgtgctgggtattgtgacgccctcgagcttaatcaaacatttgacatgactgtggacaaggtgaactgtaccttcatcagccatcacgcaattggtaagtcccagagtttccacactgccggctccttaccaccaactgggcggagaagtggaagcacatcttccctctcctactcaacatggacctctagtcatagcgataagactcatgcccgggagaccacatatgaccgggagagtttcgaaaaccctcaggtaactccgtcggaggcccaagacatgacttacaccgcctttagtgatgtggtcatgcagagcgaagtgttcgttagtgatatcggtaatcaatgcgcatgttcatccggcaaggtcacttcagaatacactgacggttcacagcaaagattggtcggcgagaaggaaacgcaagcccttactcccgtatcagatggcatggaagtgcccaatgatagcgccctccaagaatttttctgcctctctcatgatgaatctaactccgaaccccacagtcaatccagctatcgccacaaggagatgggtcagaatctgcgggagacagtgagctactgcctgattgatgacgagtgccccctgatggtgcccgcatttgataaaagtgaggcccaggtccttaacccggagcacaaagtgaccgaaactgaggatactcaaatggtttccaaaggaaaggacctaggaacccagaatcacacctcagaattgatcctctcatctccgccaggtcagaaagttgggagctccttcggcttgacatgggatgcaaatgacatggtgatttcgactgacaaaaccatgtgcatgagtaccccagtcctggaaccgaccaaggttacattctcagtctctcctatagaggcgacagagaaatgtaagaaggtggagaaaggtaacagagggctgaagaacattcctgacagcaaagaagcaccagtaaatctatgcaagccctcacttggcaaaagcacgatcaaaacgaacactccaataggttgtaaggtgcggaaaacagaaattatttcttatcctaggcccaacttcaaaaatgtcaaggccaaggtgatgtctcgtgctgtgctacagcctaaagacgccgctttgtcaaaagtgactccacgccctcagcaaacatccgcctcatccccatcatccgtgaattccaggcagcagacagtcctgtcacgcactcctcggagtgaccttaacgcagataaaaaggccgaaatcctgatcaataagacccacaagcagcagttcaacaaactgatcaccagtcaggccgtgcacgtcacgactcacagcaagaatgcctcccaccgcgtgccaaggaccactagtgcagtaaagtcaaatcaggaagacgtggacaaggcgtcaagctccaattccgcttgcgaaaccgggagcgtcagtgcattgtttcaaaaaatcaaaggcatcctgccagtcaaaatggagagtgcagaatgtctggaaatgacttacgtgcctaatattgacagaataagccctgaaaagaagggcgagaaggagaatggaacatctatggaaaagcaggaacttaaacaggaaatcatgaatgaaacatttgagtatggcagcctgttccttggcagcgcctccaagaccacgaccactagcggaagaaacatcagtaaacctgattcttgcgggctgcggcagatcgctgcccctaaggccaaggtcggaccacccgtgagctgtctgcgtaggaatagtgataatcgaaatccttctgctgatagagctgtgtccccacagaggatccgtcgcgtgagctcgtccgggaaaccgactagccttaagacagcccaaagctcatgggtcaatcttcctaggccgctgcctaagtccaaagctagcctcaagtctcctgcccttcgtcgcaccggctccacgcctagtatagcctctacccatagtgaattaagcacttattccaataatagcgggaacgccgctgtcataaagtacgaagaaaagcctccaaaaccagccttccagaatggatcctccggcagcttctatcttaagccgctcgtaagtcgggcgcacgtacatttaatgaagacaccaccaaagggtccatcaagaaaaaatctcttcactgccttgaatgccgtggagaagagccgtcagaaaaacccaagatccctttgcatccagcctcagacagctcctgacgctcttccgcccgagaagacactcgaactgacccagtacaagacgaagtgcgaaaatcagtccgggtttatcctgcagctgaaacagctgctcgcctgcggcaatacgaagttcgaagcactgaccgtagtcattcagcacctgttatctgaaagggaggaggcactcaagcaacataaaaccctgtctcaggagctggtcaacctgcgaggagagctggtgacagctagcacaacatgtgaaaaattggagaaggcgcggaacgaactgcaaactgtgtacgaagcctttgtgcagcaacatcaggccgagaaaaccgagagagagaatcggctgaaggagttttataccagagaatacgagaaactgagagacacttatatagaggaggccgagaagtataagatgcagctacaggagcagttcgataatctcaatgcggcccatgagacatctaagctcgaaatcgaggctagtcactcagagaaattagagctgctcaaaaaagcatacgaagccagcttgtccgagataaaaaaggggcatgagatagagaagaagtcactggaagatcttctttccgaaaaacaagagtctctagagaaacaaatcaacgacctgaaaagcgaaaacgatgccttaaacgagaagttaaaatctgaggaacagaaacggcgtgctagggagaaagccaacctgaaaaatcctcagatcatgtacctcgagcaggagttagagtcccttaaggccgtccttgaaatcaaaaacgagaagctgcatcagcaagatattaagctgatgaaaatggagaagctggtcgataataatactgccctggtggataagctgaaacgtttccagcaggagaacgaggaactgaaggcacgcatggacaaacacatggccatctcccggcagttgtcgacagagcaggccgtgctgcaggagtccctggagaaagaaagtaaagtgaataaaagactgagtatggaaaatgaagagttgctgtggaagctacacaacggtgacctctgtagtcctaagagaagtccaacctccagcgctatccccctccagtcccccagaaactctggatcgttcccctctccctccatatccccaaggtag

SEQ ID NO: 15974 - DNA, 1311 bp, Artificial Sequence
  Description of Artificial Sequence: Synthetic coding sequence
atgctcctctcacctaaattcagtctgtcaaccatacacattagacttactgcgaagggcttattgcgtaatttgcgactgccttccggctttagacgctctactgtggttttccatacggtggaaaaaagtcgacagaagaatccgcggtcactgtgtatccagcctcagactgctcccgatgcactccccccagaaaaaactctggagcttactcagtacaaaaccaagtgcgaaaatcagtctggcttcattctgcagctgaaacaactgctggcatgtggcaacactaagtttgaagccctgacggttgttatacagcatctcctttccgaacgggaggaagcattgaagcagcacaaaactctgtctcaggagctggtaaatctaaggggcgagctggttactgcctcaacgacatgtgagaagcttgagaaagctcgaaatgagcttcaaacggtgtatgaggcattcgtccaacaacaccaggctgagaaaaccgaacgggagaatcggcttaaggagttttataccagagaatatgaaaagttgagggatacatacattgaggaagctgagaagtataagatgcagcttcaggaacagttcgacaacctgaacgcagcgcacgagacgtccaaattggaaatagaggccagtcatagcgaaaagctggagttacttaagaaagcctatgaggcctcactgagcgaaattaagaaaggacacgaaatagagaagaagtccctggaggacttgctgagcgagaaacaggaaagtcttgagaagcagattaatgatctcaaaagcgaaaatgacgctttgaatgagaaactcaaaagcgaggaacaaaagcggcgagcgcgcgagaaggccaatctgaaaaatccccagattatgtatctcgagcaggagctcgaatccctgaaggctgtcttggagatcaagaacgagaagctccatcaacaggatataaaacttatgaaaatggaaaagttggtcgacaataacacagcactggtagacaaattaaaacgattccaacaggagaacgaggagctgaaagccaggatggacaaacatatggccatctctcgacagctgtcaaccgaacaggcggttctccaggaatccttagagaaggaatccaaagtaaacaagcgcctctcaatggagaacgaggaactgctctggaagttgcataatggtgacctctgtagccctaaacgttccccaacttcctctgccattcccctgcagtccccccggaactcggggagtttcccgtcgccatctatatctccacgatag

SEQ ID NO: 15975 - DNA, 1554 bp, Artificial Sequence
  Description of Artificial Sequence: Synthetic coding sequence
atgacagtgcctggaggcttccgctcttgtaccgagacagatatctcaagtaagatcttcatcaactcaacactcaccccacctgcaggtagcgaaagacactacgacgcgacattgctgaccctgctggttgtggggtcttactctctctgcataattcctctgctggcaaccttcaccggcaagaaaaccgggaacgctgccgtcatcaaatacgaggagaaaccccctaaaccagcgtttcaaaatgggagcagtgggagcttctacctgaagccactcgtatcaagagcgcacgtgcacctcatgaagacccccccaaagggaccttcccggaagaatttatttaccgccctgaacgcggtggagaagagtcgccagaagaaccccagatccctctgtattcaaccccagacagcccctgatgcccttccccctgaaaagacactcgagctgacccaatataagaccaaatgcgaaaaccagtcaggatttattttgcagttgaaacagttactcgcatgcggcaacactaagttcgaggcactgacagtggtgatacagcatttgctcagcgaaagagaagaagcgttaaagcagcacaagaccttaagtcaggaattagtgaatctcaggggcgagcttgtcacagcatccaccacgtgtgagaagctggaaaaggcacggaatgaacttcagaccgtctacgaagcttttgttcagcagcaccaagccgaaaagaccgagcgggagaatcggctcaaagagttttatacccgcgaatatgaaaaactacgtgatacctacatcgaggaggcagagaagtacaaaatgcaactgcaggaacagtttgataacctgaacgccgctcacgaaacatctaagttggagatcgaggctagccacagcgagaagctggagctgctgaagaaggcctacgaggcatctttgtcagagattaagaagggacacgagattgaaaaaaagtctctggaggacttgttaagcgaaaagcaggagtccctcgaaaagcaaattaatgatctgaagagcgagaatgacgccctgaacgagaaattaaaaagtgaggaacagaaacggcgcgctagggaaaaggccaatctgaagaacccgcaaatcatgtatctcgagcaggaactggaaagtctgaaagctgtcctggagatcaagaacgaaaagctccatcagcaggacattaagctcatgaaaatggaaaagctagtggacaacaatacggctctggtagacaagttgaagagatttcagcaggagaacgaagaattaaaggcaagaatggacaagcatatggctattagccgccagctctcaacagaacaagccgtgctgcaggagagtcttgagaaagagtctaaagtcaataagcggctctccatggagaatgaagagctgctgtggaaactgcataatggggatctttgtagcccgaagcgttctcccactagttctgccatccctctgcagtctcctcgtaactcaggcagtttccccagcccaagcatctccccacgatag

SEQ ID NO: 15976 - DNA, 2313 bp, Artificial Sequence
  Description of Artificial Sequence: Synthetic coding sequence
atgaccgacgacaacagcgacgacaaaattgaggacgagttgcaaacgttctttactagtgacaaggatggtaatactcatgcatacaatcccaagagtccccctacccagaacagtagcgcttccagtgtcaactggaacagtgccaacccagacgacatggtcgtcgattacgaaaccgatcctgccgtggttaccggagagaatattagcctgtcattgcagggggtggaagtttttgggcacgagaagtccagttctgattttatttccaaacaggtgctggatatgcacaaggatagcatttgtcagtgccctgcactggtaggaaccgaaaaaccaaagtaccttcagcacagttgccactcactggaagcagtagagggccaatctgtggaaccatcattaccctttgtgtggaaacctaacgacaacctgaattgtgcaggctactgtgatgccctagagttgaaccagactttcgacatgacagtcgacaaggtcaactgcacattcatttcacaccacgccatcgggaagtcacagagctttcacaccgcaggaagcctcccacctaccgggcgacggagtggctccacctcaagtctgagctactccacgtggacttccagtcacagtgacaagactcacgcccgggagactacatacgatagggaatccttcgagaacccacaggtcacaccatcggaagcacaggacatgacgtatactgccttcagtgacgtggtgatgcaatccgaggtgttcgtatccgacattggcaatcaatgtgcctgcagctctggaaaggtcacatccgagtataccgacggaagccagcagcggctcgtaggggagaaggagacacaagccttgacaccagtctccgacggtatggaagtcccgaatgactccgccctgcaagagtttttttgtctctctcacgacgagtccaattctgagcctcactcacaatcctcttataggcataaggaaatggggcagaacctgcgagaaacggtatcttactgtctcatagatgatgaatgtccactaatggttccggccttcgataagtcagaagctcaggtgctaaatcctgagcacaaggtcacagaaaccgaagacacacaaatggtctcaaagggaaaggacctggggacacaaaatcatacgagcgagttgattttgtccagcccacccggccagaaggtggggtcaagcttcgggctaacttgggatgcaaacgacatggtgattagtacagacaaaacaatgtgcatgtccacaccagtgctcgaacccacgaaggtcacctttagcgtctctccaattgaggcaactgaaaagtgcaagaaagtggagaagggaaaccgcggcctgaagaacatcccggactctaaggaggctcccgttaacctgtgtaagcccagcctcgggaaaagtactataaagaccaacaccccaattggttgtaaagtgagaaaaactgagatcattagctaccccaggcccaattttaaaaacgttaaggctaaagtgatgtcaagggccgtgttacaacccaaggacgccgcattgtcgaaggtgacaccccgcccgcagcagacttctgcatcaagtcctagttcagtgaatagcagacagcagacagtgcttagtcgcacaccccggtccgacctgaacgctgataagaaggctgagattttgatcaacaaaactcacaaacagcagttcaacaaactcatcacaagccaggccgtacacgtgaccacacactctaaaaacgctagtcaccgggttcccagaactacttctgcggtgaagagcaaccaggaggatgtggataaagccagtagctccaattccgcatgcgagaccggatctgtttccgcgctgttccagaagataaaggggatcctgcctgtgaaaatggagtctgctgagtgcctcgagatgacatacgttccgaatatcgacagaatcagccctgagaagaagggggagaaagaaaacgggaccagcatggaaaaacaggagttaaagcaggagattatgaatgagaccttcgagtacggttccctatttttgggtagcgcatccaagactacaaccacgtcaggaagaaacatttctaaacccgattcctgcggcctgcggcagatcgccgcccctaaggccaaggttggacccccggtatcatgcttgcgcaggaattccgataaccggaacccttcagcagacagggcggtcagtccccagagaatccgtagggtgagtagctctgtactgccaaaggcagcattttcttag

SEQ ID NO: 15977 - DNA, 3651 bp, Artificial Sequence
  Description of Artificial Sequence: Synthetic coding sequence
atgacagacgacaattccgacgataaaattgaggatgagctacaaactttcttcacatctgacaaggacggcaacactcacgcctataatcctaaatctccccccacacaaaactcctcagcttcctcagttaactggaattccgccaaccctgacgacatggtcgtggactatgaaaccgaccctgcagtagtgaccggagagaacataagcttgtccctccagggcgtggaagtgttcggacatgagaagtcatctagtgattttatcagcaaacaggtgctggacatgcataaggacagcatctgccagtgtccagcactcgtcggtaccgaaaagcctaagtaccttcagcactcttgtcattcactggaggcagtggaggggcaaagtgtggaaccctccctgcctttcgtgtggaagcctaatgataacttaaattgtgccggatattgtgatgcccttgaactaaatcaaaccttcgacatgactgtcgataaagtgaactgcacctttatctctcaccacgcaatcgggaagagtcaaagctttcacaccgccgggagcttgccgccaaccggtagacgctcggggagtaccagctcactctcttacagtacgtggacgagttcacatagcgataagacacatgctcgcgagactacttacgacagggagtctttcgagaacccccaggtcactccttcggaagcccaagacatgacttacaccgctttctctgatgttgtgatgcagagtgaggtgtttgtctctgacattggcaaccaatgcgcctgtagctccgggaaggttacctcagaatacaccgatggatctcagcagcgcctcgtaggtgaaaaggaaacccaagccctgactccagtatccgacggtatggaagtcccaaacgactcggctttgcaggaatttttctgcctctcccatgatgaatccaactctgaacctcattcccaatccagctaccgccacaaagaaatgggacaaaatctgcgagagaccgtgagttattgcctcattgatgacgagtgccccctcatggtccctgcgttcgacaaatctgaggcgcaggttttgaatcccgagcacaaggtgaccgagactgaggacacccagatggtgtccaaaggaaaagatctcggaacccaaaaccacactagcgaattgatcttgtctagtccccctggccagaaagtgggttcctcttttggcttaacgtgggatgcgaatgatatggttatttcgaccgacaaaacgatgtgcatgtccaccccagtgctcgagccgaccaaggtgaccttttcagtgagtcctattgaggccacggagaaatgcaaaaaggtggaaaagggcaaccgaggactgaaaaacatcccagacagcaaagaagctcctgtaaatctctgcaaaccttccctcgggaagagtactattaagacaaatactcccataggctgtaaggtgcgcaagacagagatcatctcttatcccagaccaaatttcaaaaatgtaaaggccaaagtcatgtctcgtgccgtgttgcagccgaaagatgccgccctctctaaagtgacaccacgcccacaacagacttcagcctcttcccctagctctgtgaatagccgtcagcagaccgtgctctcaaggacacctaggagcgatctcaacgcggacaagaaggccgagattctgattaacaagactcacaagcaacagttcaacaagctcattaccagccaggcggtgcatgtgaccacgcactcaaagaacgcatcgcatcgggtccccagaactacgtctgctgtcaagtctaatcaagaggatgttgataaagcgtcctctagtaattccgcatgtgaaaccgggagcgtgtcagctctgtttcaaaagattaaagggattctcccagtgaagatggagtccgctgagtgccttgaaatgacatatgtaccaaacatcgatcggatttctcctgagaagaagggcgagaaggaaaatggcacatccatggagaagcaagaacttaaacaggagatcatgaacgaaacattcgaatacggttctctgtttcttggaagcgcctcgaaaaccacaactacaagcggccggaacatttcaaaacctgattcatgtggtctgcgtcagatcgccgccccaaaggccaaagtgggtccccccgtgagttgcctccggaggaacagcgataaccgcaacccctcagctgacagggctgtgtcaccgcagaggattaggagagtttctagcagtgcaggcaacgctgcagtcatcaaatacgaggagaagccacccaagcctgcgttccagaatggctcttccgggtctttttatctgaagccactggtgtccagggcccacgttcacctcatgaagactccacctaaggggcccagccggaaaaacctcttcaccgctctgaacgctgttgagaagagccgccagaaaaatcctcgcagtctgtgtatacagcctcagacagcccctgatgctctgcctccggagaagacacttgaattgacccagtataagactaagtgtgagaaccagagtggctttattctgcagctgaagcagctgctggcttgcggtaataccaagttcgaggccctgaccgtagtgatccagcacctgttatccgaacgggaggaggcattaaaacagcacaagacactcagccaggaattggtaaacttgcggggagaactcgtgacggcatcaaccacatgtgaaaagctggagaaagccaggaatgagctccagacagtgtacgaggcgttcgtccagcaacatcaagctgagaagacagaacgggaaaacagactgaaggaattctatactcgtgaatatgagaaactgcgtgacacctacattgaggaggccgaaaagtacaagatgcagctccaggagcaattcgacaatcttaacgctgcacacgagacctccaaactcgagattgaagctagccacagcgaaaagcttgaactgctcaaaaaggcctatgaggcatcactctctgagatcaagaagggacacgagattgagaaaaaaagccttgaagacctgctgtccgagaagcaggagtcactggaaaaacagataaacgacctaaaatctgagaacgacgcactgaacgagaagctgaaatccgaggagcaaaaaagaagagcccgcgagaaagcgaatttgaagaacccccagattatgtaccttgaacaggaattggagagtttgaaggccgttttggagataaagaatgaaaagttacaccagcaagatatcaagctgatgaaaatggagaagctagtggataacaacacagcactcgttgataagctgaagaggttccagcaggagaacgaggagttgaaagctaggatggacaagcatatggccatcagccgccagttaagcacagaacaagccgtgctgcaggagtcactagagaaggaatccaaggtcaacaagcgcctttccatggaaaacgaagaactcctttggaaattgcacaatggggatttatgtagccccaagaggtctcccacttcctcggcaatacctctgcagtccccccggaattcaggtagctttccttccccaagcatttccccccggtag

SEQ ID NO: 15978 - DNA, 1029 bp, Artificial Sequence
  Description of Artificial Sequence: Synthetic coding sequence
atgggttgtccgtccagtaagctgtgcttgtactccccatgcgcagctactcgcagagaagaggcgctgaaacagcacaaaaccctctctcaggagctagtaaatctgcgcggagagctggtcactgctagcaccacctgtgagaaactggagaaggccaggaatgaattacagactgtctatgaagctttcgtgcagcaacaccaggctgagaagactgagagggagaatcggctcaaggaattctatacacgagagtatgagaagcttcgcgacacctatatagaagaggctgaaaaatacaagatgcagttgcaggagcagttcgacaatctcaacgccgcacatgaaaccagcaagctcgagatcgaggcgtctcattctgaaaaattagaactgttgaaaaaagcttatgaggctagtctctccgaaatcaaaaaggggcatgaaattgagaaaaagagtttggaggatctgctatctgagaagcaagagtccttggagaaacagatcaacgaccttaaaagcgagaatgatgcactaaatgaaaaactgaagtcagaggagcagaagagacgagcacgtgagaaagccaacttgaaaaaccctcaaattatgtacctcgaacaggagctcgagtctctgaaggcagtgctggagatcaaaaatgaaaagctgcaccagcaggacatcaaactgatgaagatggagaaactggttgataataacaccgccttagttgacaaactgaaacgctttcagcaagaaaacgaggaactcaaagctcgcatggacaagcatatggctatcagccgacagctgtctacagagcaggcggtccttcaggagtcactcgaaaaagaatcaaaggtgaataaacgcttgagcatggagaatgaggaactcctgtggaaactgcataacggcgacctctgcagtcctaaaaggtctccgaccagttccgctatcccattgcagtcacccagaaatagcggctcatttccatcacccagcattagcccaaggtag

SEQ ID NO: 15979 - DNA, 3651 bp, Artificial Sequence
  Description of Artificial Sequence: Synthetic coding sequence
atgaccgacgataattcagacgataaaattgaggacgagttgcagaccttcttcaccagtgataaggacggcaatacccacgcatacaacccaaaatccccccccacacagaactcttctgcatcttcagtcaattggaatagtgccaatcccgatgacatggtcgttgactacgagacagatccagctgtagtcaccggcgaaaacatctcgttaagcttacagggcgtcgaagtgtttggccacgaaaaaagtagcagtgactttatctccaaacaggttttggatatgcataaagatagtatatgccagtgtccagctctggtgggcaccgagaagccgaagtacctccagcatagctgccactcgttggaagcggtggaggggcaaagtgtggaaccttccctgcctttcgtgtggaagcccaacgacaacctaaattgcgccggatattgcgatgcgttggagctaaatcagacatttgatatgacagtggacaaagtcaattgcactttcatatcccatcacgcaattggaaagagtcagagttttcacacagcaggcagccttccccccaccgggagacggagtggctctacctcaagccttagctacagtacatggacctctagccattcagataagacccacgcccgcgaaactacatacgatagggaatcattcgagaacccccaggttaccccatcggaggcccaggacatgacctacacagctttctcagacgtggtgatgcagtccgaggtgtttgtaagtgacatcgggaaccagtgtgcttgctcaagcgggaaagtgacttcagaatacactgatggttcacaacagcgtctggtcggcgaaaaggagacccaagccctgactccagtgtctgacgggatggaggtccctaatgattcagcgctccaggagtttttttgccttagtcacgacgagagcaattcagaaccccactcccagtcaagttacaggcacaaagagatggggcagaatcttagagagacagtgagctattgcctcatcgatgacgagtgcccactgatggtcccagcctttgacaagtccgaagcccaggtgctcaatccagagcataaggttactgaaacagaagatacccagatggtgagtaaagggaaggaccttggcactcagaatcacacgtctgagctgattctctcgtcaccccctggacagaaggtgggctcctccttcggactcacttgggacgctaatgacatggtcatttctaccgacaaaacaatgtgtatgagtacccctgttctagagccgactaaagtgacatttagcgtaagccctatagaggctaccgaaaagtgcaagaaagtggaaaagggtaaccgcggattaaaaaatattcctgattccaaagaggccccggtcaatctgtgtaaacccagtctgggaaaatctacaattaaaacaaacactccaattggttgcaaagtgcgcaagacggagatcatctcgtaccccagacctaatttcaagaacgttaaggccaaggtgatgtcacgtgccgtcctgcagccaaaggatgcggccctctctaaggtcacaccaagaccacagcaaacatcggcttctagcccatccagcgtcaacagccgccaacagacggttctgtcacggacaccgcgtagtgatttaaatgctgataagaaggccgagatactcatcaataaaacacacaagcaacagtttaacaaactgatcacatctcaggccgttcatgtaacaacacattctaagaatgcaagccatcgagttcccaggacgacaagcgcagtcaagagcaaccaggaggacgtggataaagccagctcttctaactccgcctgtgaaacggggtccgtgtctgccttgttccagaaaataaaggggatcttaccggtcaagatggaatccgccgagtgcctggagatgacttacgtgcctaacattgacaggatctcgccagaaaagaaaggagaaaaggagaacggtacgagcatggagaaacaggaattgaaacaagaaattatgaacgagacgttcgagtacggcagcctatttttagggagcgctagcaagacgaccactacgtccgggagaaacattagtaaaccagacagctgcgggcttagacagatcgctgctcctaaggccaaagtggggcctcctgtgagctgtctcaggcgaaatagcgataatagaaaccctagtgcagacagggcggtgtccccccagcgcattagacgggtgagtagctctgctggtaatgccgccgtgattaaatatgaggagaaaccgccgaagcctgcattccaaaacggatcttccggctcgttctaccttaaaccattggtctctcgcgcccacgttcatttaatgaagacccctcccaagggccccagtcggaaaaatctcttcaccgctctgaatgccgtggagaaatcaagacagaaaaatccgcgttcactttgcatccaaccccagacagctccagatgctctgccccctgaaaagactttggagcttacacagtacaaaactaaatgtgaaaatcaatcaggctttattctgcagttgaagcaactgttggcttgtggcaacacaaaattcgaggcactaactgtggtaatccagcatctcctcagcgagcgcgaggaagctctgaagcaacataaaaccctctctcaggaattggtaaatttacgcggcgagctcgttacggccagcaccacatgcgagaagctcgagaaggctcggaacgagctccagactgtgtatgaggctttcgtgcagcagcaccaagccgagaagacggagcgggaaaaccgactgaaggaattttatacacgggagtacgagaagctgcgagacacatatattgaggaagctgagaaatacaagatgcagctgcaggagcaattcgacaacctgaacgccgcgcacgagacttctaaacttgaaattgaggccagtcattcggagaaactcgaactgttgaaaaaagcttatgaagcttccctctccgaaattaagaaagggcatgagatcgagaagaagtctctggaggatttactgagcgaaaaacaagagagcctcgagaagcaaattaatgatctgaagagcgagaacgacgctttgaacgaaaaacttaagtccgaggaacaaaaacggagagccagggaaaaagcaaacctgaagaatcctcagatcatgtacctcgaacaagaacttgaatctcttaaggcagtccttgagattaagaatgagaagcttcaccaacaggacattaagctgatgaagatggaaaagttagtagacaacaataccgcactggtggataagttgaaaaggttccagcaagaaaacgaggaacttaaagcaaggatggataagcacatggccatctcccggcagctttcaactgagcaggctgttctacaggagagcctggagaaagaaagtaaagttaacaagaggctcagcatggaaaacgaagaattactctggaagctacataacggagacctgtgtagccccaaacggtccccaacatcaagtgcaattccacttcaaagccctcggaactccggctcattcccaagcccctcaatcagcccaaggtag

SEQ ID NO: 15980 - DNA, 1248 bp, Artificial Sequence
  Description of Artificial Sequence: Synthetic coding sequence
atgaagactccacctaagggaccgagcagaaaaaatttgtttaccgccctcaacgccgtcgagaaatccaggcagaagaacccgcgttctctctgcatccagccccagaccgcaccagacgccctgcctccagagaagactctggagttgacacaatataagaccaagtgcgaaaatcagtctgggttcatactgcagcttaagcagttattggcctgcggcaataccaaattcgaggcgcttacagtcgtgatccagcatcttttatccgagcgtgaggaggccctcaaacagcacaaaaccctttcgcaggagctggtaaaccttaggggtgagcttgtgacagcatccacaacgtgtgagaagttggaaaaggcaagaaatgagctgcagacggtgtacgaagcttttgtccagcaacaccaggctgaaaaaactgaacgagagaaccgactcaaagaattctacactcgagaatatgaaaagttgcgcgacacatacatcgaggaggcagagaagtacaaaatgcaattgcaggagcagttcgacaatctaaacgccgcccacgagacctccaaactcgagatcgaagcttcacatagcgaaaaattagaattgcttaaaaaagcctacgaggctagcctaagcgagatcaagaaggggcacgagatagaaaagaagtctttggaagacttactcagtgagaaacaggagagtctcgagaagcagattaacgacctcaagtccgagaacgatgccctgaacgagaagctaaagagcgaggaacaaaaaagacgcgcacgtgagaaagcgaacctgaagaatcctcagattatgtatttggagcaggagctggagtctctgaaggctgtcctagaaatcaagaatgaaaaactccatcagcaggacatcaagctgatgaagatggagaaactggtggacaataatacggccctagtggacaaattgaagcgcttccagcaggagaacgaggagttgaaggctcgtatggacaagcacatggcgattagccggcagctttctaccgagcaggccgtgctgcaagagtcattggaaaaagagagtaaggtgaacaaaagactgtctatggagaacgaggagctgctttggaagctgcacaatggggacctctgttctcctaagcgatcccccacgagctctgcaataccactccaatcaccgagaaattccggctcattcccttcccctagcatttccccccgctag

SEQ ID NO: 15981 - DNA, 7407 bp, Artificial Sequence
  Description of Artificial Sequence: Synthetic coding sequence
atggctacagttgtggtcgaggctacagagccagagccgtcaggatctattgcaaacccagccgccagcacttccccgagtctgtctcaccggttcttagatagtaagttttacctactggtggtggtgggagagattgtgaccgaggaacacctgcgtcgtgcgattgggaatattgaattgggcatccgcagctgggacactaacttgatcgaatgcaacctggaccaggagttaaagctgttcgtgtccagacactcggctcgctttagtccagaggtgcctggccagaagattctgcatcaccgctccgacgtcttggagacagtagtcctcattaaccctagcgatgaggccgtctccaccgaggtcaggctaatgattacagacgcggctaggcataagctgctcgtccttacaggacaatgtttcgagaacaccggcgaactaatcttgcagtccggttctttctcctttcagaattttattgaaatcttcaccgaccaggagattggggagctgcttagcacaacgcatcctgccaacaaggccagtttaactcttttctgccccgaagagggagattggaagaattccaatttagatcggcataatctacaggattttattaacattaaacttaactctgcctccatcctgccggaaatggaggggttgagcgaatttactgagtacctctccgaatctgttgaggttccgtcacctttcgacattttagagcccccaactagcggcgggttcctcaagcttagcaaaccctgctgctatatcttcccggggggccgaggggactcggccctttttgcagttaacggcttcaatatgttaatcaatggaggctctgaacgaaagtcttgtttttggaaactcatccgccaccttgaccgtgtcgacagcatcctcctgacacacattggcgatgacaatctgccgggaataaattcaatgttgcagcggaaaatcgccgagctcgaggaggagcagagccagggaagcactactaatagcgactggatgaagaacttgatttcaccagacttgggggtggtatttctgaacgtgccggaaaacctgaaaaatcctgagccaaacatcaaaatgaagcgctccatagaagaggcatgctttacacttcagtatctcaacaagctgtccatgaagcccgaacctttattcagatccgtcgggaatacaatcgatcccgtgattctctttcagaagatgggcgtcggtaagctggaaatgtacgtcctgaaccctgtcaagtcctccaaggagatgcagtacttcatgcagcagtggacgggaacgaataaggataaggcggaatttattctccccaacggtcaggaggtggacctgcctatttcttatttgacctccgtaagctctctgattgtttggcacccagccaatcctgccgagaagattattagagtcctgtttccgggcaactccacacagtataacatactggaaggtttggaaaagctcaaacatctggacttcttaaagcaacctctagccacccaaaaagatctgaccggtcaagtgcccacccccgtggtaaagcagaccaagttaaagcagcgggccgatagccgagaaagtttgaagcctgcagctaaacccctaccaagcaaatctgtgagaaaggaatctaaggaggaaacccccgaggtaacaaaggtcaatcacgtggaaaagcccccaaaagtggaatccaaagaaaaagtgatggtcaagaaagataagcctattaagaccgagactaagccctctgtgaccgaaaaggaggtgcccagtaaggaagagccttctccagtcaaagcggaagtggctgagaaacaagctaccgatgtgaagcccaaggccgccaaagaaaaaaccgtcaagaaagagactaaagtgaaaccagaagataaaaaggaggagaaagagaagcccaagaaggaggtcgccaagaaagaagataagaccccaattaagaaagaggaaaaaccaaagaaagaggaggttaagaaggaagtgaagaaagagattaagaaggaagagaaaaaggagcccaaaaaggaggtgaagaaagagaccccacccaaggaggtgaaaaaggaggtgaagaaggaagagaaaaaagaagtgaaaaaagaggagaaggaacccaaaaaggagatcaaaaagctgcccaaagacgcaaaaaagtctagcacccccctctcagaggccaagaaacccgccgcactaaaacccaaggtgcctaagaaggaggaatcagtcaagaaagatagcgttgctgcaggaaaaccaaaggaaaagggcaagatcaaagtgatcaaaaaagagggtaaagcggccgaggctgtggctgcagcggtaggtacaggggcgactacagctgcagtgatggctgccgccgggattgcagccatcggaccagcgaaagagctcgaggccgaaagaagtcttatgagctcaccagaggacctcaccaaggacttcgaggagctaaaggccgaggaggtcgatgtcaccaaggatatcaaaccacaactcgaactgatcgaagatgaggaaaaactgaaagagaccgagcccgttgaagcatacgtgatccagaaagaacgcgaggttacaaagggccctgcagagtcccccgatgagggtattaccaccactgaaggcgagggcgaatgcgaacagacacctgaagaactggagcctgttgaaaaacagggagtggacgacattgaaaagttcgaggacgagggagcaggcttcgaagaaagctcggaaaccggggactatgaagagaaggcggagacagaggaagctgaggagccagaagaggatggtgaggagcacgtatgcgttagtgcatcaaaacactctcccactgaagacgaggaatccgccaaagcagaggctgacgcctacattagagaaaaacgggaatctgtggcttcaggcgacgatagggctgaggaggatatggatgaagcaatcgaaaaaggggaggctgagcaatccgaagaggaggctgacgaggaagacaaagctgaggacgctcgcgaggaggagtatgagccagaaaagatggaggccgaggactatgtcatggccgtcgtggataaggcagccgaggcaggcggcgctgaggaacaatatggatttctgacaactcccaccaaacagttaggcgcccagtcaccaggacgagaacctgcgagctctatacacgacgaaaccctccccggagggagtgagtccgaagcgactgcctctgacgaggagaaccgagaggaccagcctgaggagttcaccgccacctccggctacactcagtccactattgagatttcaagcgaacctactccaatggatgagatgtctacaccacgcgatgtcatgtcagacgagaccaacaatgaagagacggaaagccccagtcaggagtttgttaacatcacaaagtacgaaagctctctgtacagtcaggagtattctaagcctgccgacgtgacgccgctgaacggtttcagtgaaggttccaagactgatgctaccgacggaaaagattacaacgcgtctgccagtacgatctcacctccgagcagcatggaggaagataaatttagtaggagcgccctgcgggacgcctattgtagtgaggtaaaggctagcacgaccctcgacatcaaggattctatatccgcagtttcctccgagaaggtttctcccagcaagtcaccttccctgtcccctagccctccatcacctttggagaaaaccccactcggagagcggagcgttaacttctccttgacacctaacgagatcaaggtgagtgctgaagctgaagtcgccccagttagccccgaggtaacacaggaagtcgtcgaggaacattgcgcctcaccagaggataagacactagaagtggtgtccccgtctcagtccgttacaggaagcgcagggcataccccttactatcagtctcccactgatgagaagagcagccacctgccaacggaagttatagagaagccccccgcagtgccagtctctttcgaattttcagacgccaaagatgagaatgagagggccagcgtgtctccaatggatgagcctgtccccgatagtgaatcgccaatcgagaaagtactgtctcccttgcgctccccacccttgattggaagcgagtctgcgtacgagtcctttctatcggcagatgataaagcatcaggacgcggtgcagagagcccattcgaggagaaaagcggtaaacaaggttcgccagaccaggtgagcccagtaagcgaaatgacatccacttccctttaccaggacaagcaggaaggaaagagcaccgacttcgcccccatcaaagaggatttcgggcaagagaaaaagaccgacgacgtggaggcaatgtcatcacagccagctctggccctcgatgaacgcaagctgggggacgtgtcccctacccagattgacgtatcgcagtttgggtccttcaaggaggacaccaagatgagcatcagtgaaggtacagtgtcagacaagtcagctaccccagtggatgagggcgtagccgaggatacctacagccatatggaaggggtggctagcgtgtcaacagcatctgtggcaaccagcagctttcccgagcccacgacagatgatgtatctcccagcctccatgcagaggttggatccccccactctaccgaagttgacgacagtctgagtgtgagtgtcgtccagacacctacaaccttccaggagacagaaatgtcaccttcgaaggaggagtgtcccaggcctatgagtatcagtcctcctgacttttctcccaaaaccgctaaaagcaggaccccggtgcaagaccaccggagcgagcagtcgtccatgagcattgaattcggccaggaaagtcccgagcagtccctggccatggatttctctcgacagtctcccgaccatcctacagtaggcgcaggcgtcctacacatcactgagaacggccccaccgaggtcgattacagtccctctgatatgcaggattcgtctctctcccataaaatccctcccatggaagaaccttcctatacccaggataacgatctaagtgagctgattagtgtctctcaggtggaagcaagcccttcgacatctagcgcacatacacctagccagatcgcaagtccccttcaggaggacaccctgtccgatgtggcaccccctagggacatgtccctttacgccagtttgacatcagagaaagtacagtctttagagggagagaaactgagtcccaaatctgacatatcaccactgacaccaagggagtcatctcccctttacagcccaacctttagcgatagcacctctgctgtgaaggagaaaacagcaacttgccactcatcatctagccccccgatcgacgccgcctccgctgagccctacggatttagggctagcgtgctgttcgacacaatgcagcaccacttggcactgaatcgggatctctctacccctggcctagagaaggatagtggcgggaagaccccaggcgattttagttatgcgtatcaaaaacctgaagaaaccactagatccccagatgaggaggactatgattacgagagctatgaaaaaactacgcgtacctctgacgtggggggctactactacgaaaagatcgaacggacgacaaagtctccaagcgattctggctactcgtacgagactatagggaagacgaccaagaccccagaagatggcgactatagttatgagatcatagagaagacaacaaggaccccggaggaaggaggatactcgtacgatattagcgagaaaaccacgtctccgcctgaggtttccggctattcgtacgagaagacggaaagatcacgacgtctactggacgacatcagcaatgggtacgatgactctgaagatgggggtcacacacttggagacccttcttactcttatgaaacaacggaaaaaataacttccttcccggagtcagagggttattcatacgagacaagcacaaagaccactagaacgcccgatacaagcacttactgctacgagacggctgagaaaattacacgtacaccgcaggcctctacctattcctatgagaccagtgacctgtgctataccgctgagaaaaagagtccgtccgaagcccggcaggatgttgatctctgtttagtctcttcttgtgaatataaacaccctaaaacggagcttagccctagtttcattaaccccaaccccctcgagtggttcgcctctgaagaaccgactgaggaaagcgaaaagcctcttacacagagcgggggcgcgccacctccacccggtggcaagcaacagggccgccagtgcgatgagacccctcctacgagcgtctccgagtcagctcccagtcagacagatagcgacgttcctcctgagactgaagagtgtccttcaatcaccgccgatgctaacatcgatagtgaggacgaatctgagaccattcccacagacaaaaccgtgacatacaaacatatggacccaccacctgcacccgtgcaggaccgtagcccgtcaccacggcatccagatgtatctatggtggaccccgaggcccttgcgattgaacaaaaccttggaaaggcactgaaaaaagacctgaaggagaaaaccaagactaaaaagccaggaactaaaaccaagtcctccagcccggtgaaaaagtcagatggtaagtctaagcccctggcggcaagtcccaagcctgctggtcttaaggaaagttctgataaggtctctcgggtggcgtccccgaaaaaaaaagaatccgttgagaaagcggcaaagcctaccactacaccggaggttaaagccgcacggggggaagagaaggataaggaaacgaagaatgccgcgaatgcatcagccagtaaatccgcgaagactgccacagccggaccaggaacgacaaagaccacaaaatcgtcagcagttcccccaggtctaccggtatacctggatctatgctatattccaaatcacagcaactcaaaaaatgtcgatgtggaattcttcaaaagagttaggagctcctactacgtggtctctggcaatgatcccgctgcagaagaacccagtagggctgtccttgatgccctgcttgaaggaaaagcgcaatggggcagcaatatgcaggtgacattaatcccgacccacgattccgaagttatgcgtgagtggtatcaagagacgcacgagaagcagcaggatctgaatatcatggttctcgccagcagttcaactgtggtgatgcaggatgagtctttcccagcttgcaagattgagttgtag

SEQ ID NO: 15982 - DNA, 432 bp, Artificial Sequence
  Description of Artificial Sequence: Synthetic coding sequence
atgcagcatcggggtttccttcttctgacccttctggctctccttgcactaacctctgcggtggcgaaaaaaaaagacaaggttaagaaggggggtccaggttcggaatgtgctgagtgggcctggggcccctgcaccccatctagcaaggattgtggcgtgggatttagagagggcacatgcggcgcacagacccagcgcattcgctgtagggtcccttgcaactggaagaaggagttcggggcagactgtaaatacaagtttgagaactggggggcatgtgatggtggcaccgggactaaggtgagacagggaactttgaagaaggctcgctacaatgcccagtgccaggagaccattcgggtaacaaagccttgcactcccaagaccaaggcaaaggccaaagccaagaagggaaaaggcaaggactag

SEQ ID NO: 15983 - DNA, 432 bp, Artificial Sequence
  Description of Artificial Sequence: Synthetic coding sequence
atgcagcatcggggcttccttctacttaccttactggccctgctggctttaactagtgctgtggctaaaaagaaggataaggtgaagaagggcggtcccggttccgagtgtgctgaatgggcatgggggccctgcactcccagctccaaagattgcggggtcgggtttcgggaaggtacatgtggagctcagactcagcgcattcgttgcagggtcccctgcaattggaagaaagagtttggtgcagattgcaagtataaatttgagaattggggtgcctgcgatggaggcacaggaacaaaagtacgtcagggcactctgaagaaggctcggtacaatgcacaatgccaggagacaatcagggtaaccaaaccgtgcaccccaaagaccaaggccaaggcaaaagcgaagaagggaaaaggaaaagactag

SEQ ID NO: 15984 - DNA, 432 bp, Artificial Sequence
  Description of Artificial Sequence: Synthetic coding sequence
atgcaacacaggggttttctactgctgacactactcgccctgctcgcactgacaagcgctgtggctaaaaagaaggacaaggttaagaagggcggtcctggtagcgaatgtgctgaatgggcttgggggccatgtacccctagttcgaaggactgtggcgttggtttcagggaaggcacctgtggtgcacagacccagcggattcgctgccgtgtgccttgtaactggaaaaaagagttcggggctgactgcaagtacaagttcgagaattggggtgcatgtgacggcggtactggaacaaaggttcgccagggcaccctgaaaaaagcccggtacaacgcccagtgccaggagacaattcgggtcacaaagccatgcacaccaaaaactaaagccaaagccaaggcaaagaagggaaagggaaaggattag

SEQ ID NO: 15985 - DNA, 459 bp, Artificial Sequence
  Description of Artificial Sequence: Synthetic coding sequence
atgcaacatcgcgggtttcttctcctgaccctcttagcactcctggccttaacaagtgccgtcgctaaaaaaaaagaggagggtgccctgcaatgctcagtgccaggagatcatcccagacaccaggccctacaccctcaagatcaatcaaaagggcagtcacaggagcgcgaagggaagggattagatgccaagcccgggtgccagggagctcccggcgtgacctggggcctggcccacgctctccccctacctgggcccagatgcgatcctccagtgccatctgtgtgcagcctcgctctgattaaccacgccctcccttgtccttcacactctcccgcacctccactgtcagcacaaagtggggaggggcagggaatattagggagcctgagccttccacaatcaaacgtctcccctcgagcgagattctgctcgagccctcagtttcactactag

SEQ ID NO: 15986 - DNA, 432 bp, Artificial Sequence
  Description of Artificial Sequence: Synthetic coding sequence
atgcaacatagaggctttttgctgttgacactgcttgcattgctcgcactgacttcagccgttgccaagaaaaaggacaaagttaaaaaaggtggccctggttcagagtgcgctgaatgggcctggggcccctgtaccccatcgtcaaaagactgtggtgtgggctttagggagggaacatgcggggcgcagactcagcggattcgatgtcgggtcccctgtaactggaagaaagaattcggcgctgactgcaaatataaatttgagaattggggtgcctgcgatggagggacgggaaccaaggtgcgacagggaacccttaagaaagctcggtataatgcgcaatgccaggagaccattagagtcacaaagccctgtacccctaagactaaagcaaaggccaaggccaagaaagggaagggtaaagactag

SEQ ID NO: 15987 - DNA, 432 bp, Artificial Sequence
  Description of Artificial Sequence: Synthetic coding sequence
atgcagcaccgtggatttctcctactgaccctccttgccctccttgcattgactagcgctgtcgcaaaaaaaaaggataaagtaaaaaaagggggaccaggttccgaatgtgctgagtgggcttggggtccctgtaccccatcaagtaaggattgtggggtaggttttagagagggtacctgtggggcccagacgcagagaatcagatgtcgtgtcccatgtaactggaagaaagaatttggtgccgactgcaagtataaatttgagaactggggcgcttgcgatggcggcaccggtaccaaggtgcgacaggggacgctgaagaaagctaggtacaatgcgcagtgccaggagactatacgggtgaccaagccttgcacaccaaagactaaagccaaagcgaaagccaagaaaggaaaaggcaaggattag

SEQ ID NO: 15988 - DNA, 432 bp, Artificial Sequence
  Description of Artificial Sequence: Synthetic coding sequence
atgcagcatagaggttttctcctgctgacgcttttggcacttcttgctcttaccagtgccgtagccaaaaagaaagacaaggtaaaaaaggggggtcccgggagtgaatgcgccgaatgggcttggggaccctgcacaccttcatctaaagactgcggagtgggatttcgagagggcacttgcggcgcccagacccagaggatcaggtgccgtgtaccatgcaactggaaaaaggagtttggcgctgactgtaaatataagttcgaaaattggggcgcctgcgatggaggtaccggtacaaaggttcggcagggcaccctgaagaaggcccgctataatgcccagtgccaggagaccatccgcgtgaccaaaccatgcactccaaaaactaaagcaaaggcaaaggcaaagaagggcaaaggcaaagactag

SEQ ID NO: 15989 - DNA, 150 bp, Artificial Sequence
  Description of Artificial Sequence: Synthetic coding sequence
atgcaacatcgcggattcctgctgttaacccttttggcgttgctggcactgaccagcgcagtggcaaaaaagaaggataaagttaagaagggcggcccaggaagcgagtgcgcggagtgggcgtgggggccttgtactccaagtagctag

SEQ ID NO: 15990 - DNA, 396 bp, Artificial Sequence
  Description of Artificial Sequence: Synthetic coding sequence
atgcagcaccgagggtttctgttgcttacccttctcgcccttcttgcgctcacctcggctgtggccaaaaaaaaggacaaagtcaagaagggcggtccaggcagtgagtgcgccgagtgggcatgggggccttgtaccccttcatccaaggactgtggcgttggatttcgtgaagggacctgtggggcccagactcagcgaattcgctgcagggtcccttgtaattggaagaaagagtttggcgccgactgcaaatataagtttgagaactggggggcatgcgacggcggaactgggaccaaggtgcgacaggggactttgaaaaaggctcgatataatgcccagtgtcaggaaacgatccgggttactaagccatgcactcccaagaccaagtag

SEQ ID NO: 15991 - DNA, 264 bp, Artificial Sequence
  Description of Artificial Sequence: Synthetic coding sequence
atgcaacataggggatttctattgcttactttgttagctttactcgcactgaccagtgcagtggctaagaagaaagcagattgcaaatacaaatttgaaaactggggggcttgcgatggcggtacagggacaaaagtgaggcagggcaccttgaaaaaggcccggtataacgcccagtgtcaggaaactatacgtgtcaccaaaccctgtacccccaagacgaaggccaaagcaaaggctaagaagggcaagggcaaagattag

SEQ ID NO: 15992 - DNA, 2715 bp, Artificial Sequence
  Description of Artificial Sequence: Synthetic coding sequence
atggccgaatcttccgagagtttcaccatggcaagctccccggcacagcgtcgccggggcaacgacccgttgacgagttcgccaggtcggtctagccgaagaactgacgctctcacctctagtccaggcagagatttaccaccctttgaagatgagtctgaaggcttactcgggactgaggggccgctcgaagaagaggaggatggcgaggaacttatcggggacggcatggaaagggactaccgagctatacccgagctcgacgcttacgaggccgagggcttggcactggacgatgaggatgtggaggagctcactgcatctcagagagaggctgccgagagggccatgcggcagcgtgaccgggaggctggaagaggattgggtcgcatgcggcgcggcctgctctacgattcggatgaggaagacgaggagcgtccggcacgaaaacggcggcaggtggagcgggccacagaggacggagaggaggatgaggaaatgatcgagagtatagagaacctcgaggacctaaagggccattccgttagagaatgggtttccatggcggggcctcgtctggaaattcaccatcgatttaaaaatttcttacggactcacgttgacagccatggacataacgtgttcaaagagagaattagtgatatgtgtaaagaaaatagggaatccttggtggtcaattatgaagatctcgcagccagggaacacgtactcgcatattttctacccgaggctcccgccgagttactgcagatctttgacgaagctgccctcgaagtggtcctggccatgtaccctaagtacgataggattaccaaccacatacatgttagaatatctcacctacctctcgtcgaagagctgaggtctctccgccagctacacctcaaccaattgatccgcacttcaggggttgtgacttcctgcactggtgtcctgccacaactttcaatggtgaaatataactgcaataaatgtaacttcgtgcttggccctttctgccagtcccaaaatcaggaagtgaagcctggttcctgtcccgagtgccaaagcgctggacccttcgaggtcaacatggaagaaaccatctaccagaactatcaacgaatacgtattcaggaaagccctggtaaggtcgctgccgggcgtctgccgcgtagcaaggatgctattctgctggccgacctcgtggattcatgcaagccaggagatgagatcgaactaactgggatctaccataacaattatgatggcagcctaaatacagccaacggctttcctgtctttgcaactgttattttagctaatcacgtagctaaaaaggacaacaaggtcgctgttggggagttaaccgacgaggatgttaagatgatcacatcactgtccaaggaccaacagatcggagagaagatctttgcatcaattgcacccagcatctacggccacgaggacattaaacgcggactggccctcgcactgtttggaggcgagcctaagaatccaggtggtaaacacaaggtcagaggcgatatcaatgtcttgctctgtggagatcctggcacagctaaaagccaatttctaaaatacatcgaaaaagtttcatccagggcaatttttacaaccggacagggcgcatcggcagtcgggctcactgcttatgtgcagagacacccagttagtagagaatggacattggaagcgggcgctctggtgctggcggatcgaggcgtgtgcttgatagatgagttcgataagatgaatgaccaagacagaacaagcatccacgaggccatggaacaacagagtatttctatctcgaaagccggaatagtaacctcgctgcaagctcgatgtactgtaattgcagcggctaaccctatcgggggccgatatgatccatctttgacgtttagcgaaaatgtggatctgacagagcctattatttctcggtttgacatcctttgcgtagtgcgtgatactgtcgatccagtacaggacgaaatgctggcccgatttgtggtggggtctcatgtgcgccaccatccatcaaataaggaggaagaaggtttggcaaacggatcggctgcagagccagccatgccgaacacttacggggtggagccgctcccacaagaggtgctaaagaagtacataatttatgccaaggaaagggttcatcccaagttaaaccagatggatcaagataaggtcgccaagatgtacagtgacttaagaaaggagtccatggcaaccggctcgatccccattaccgttcgtcacattgagagcatgattcgcatggccgaggctcatgctcggatccatctgagagattacgtaatagaggatgacgtcaatatggccatacgggtaatgcttgagagttttatagatacgcagaaattctctgtaatgcgttctatgaggaagaccttcgcgaggtacctctcatttagacgtgataataacgaactgctactttttatcctcaagcagttggtcgcagagcaggtgacatatcaaaggaataggttcggagctcaacaggatactatagaggttccagagaaggatctcgttgataaggcccggcaaatcaacattcataatttgtctgcattttacgactcggagctattcagaatgaacaaattcagccacgacctgaagcgtaaaatgattcttcagcagttctag

SEQ ID NO: 15993 - DNA, 2427 bp, Artificial Sequence
  Description of Artificial Sequence: Synthetic coding sequence
atggccgaatcgagcgagagctttactatggcaagctcgcctgcgcagcgccggagaggcaacgacccactgacctccagcccaggctggggcctgggcagaatgcggaggggtttactctatgattctgacgaggaggatgaggagcggccagccagaaaaagacggcaagtggaacgcgcaacagaggacggggaggaggacgaagagatgatcgagtcaatcgagaacctggaagacttaaagggccattcagtccgagagtgggtcagtatggccggcccgcgcctcgagattcaccaccgctttaaaaattttcttcgcacacatgttgactctcatggacacaacgtgtttaaagagaggatttccgacatgtgcaaagaaaaccgcgagagcttggtcgtgaactacgaagatctggctgctagggagcatgtgctggcttatttcctccctgaggcccctgctgagctactccagatttttgacgaagctgcgttggaggtcgtcctggctatgtaccccaaatatgatcggatcaccaatcatatccatgttaggatctctcatttaccactcgtcgaggagctccggtccctcagacagttgcaccttaaccagctcatacggaccagcggggtggtgacctcctgtaccggagtgttgccacagctgtcgatggtgaaatacaactgcaataagtgtaactttgtcttggggcccttctgccagagtcagaaccaagaagtcaagcctgggagttgcccagaatgccagagcgccggaccatttgaagttaacatggaagaaacgatctatcagaactaccaaagaattagaatccaggaatcccccgggaaagtggcggcaggccggttgccccgctcaaaggatgccatactgctggccgacttggtggacagctgcaaaccgggtgacgagatcgaattgaccggaatttaccacaataattacgatggtagcctcaacactgcaaatggctttcccgtgttcgccacagtcatcctggctaatcacgtcgcgaagaaagataataaagtggccgtgggcgagttaactgatgaggacgtaaagatgatcaccagcttgtctaaggaccaacagatcggcgagaaaatcttcgcctccatcgccccttcaatctatggccacgaagatatcaagcgtggcctggcactcgctttgttcggaggggagccgaaaaaccctggaggaaagcacaaagtcagaggagatattaacgtgctactctgcggagaccctggcaccgccaaaagccagttcctgaaatatattgaaaaagtgtcttcccgggcgattttcacaacaggccagggcgccagcgctgtcggactgaccgcctatgtgcagcgccatccagtgtctagggagtggacactcgaggccggggcacttgtactcgccgaccggggggtgtgcttgatcgacgagtttgataagatgaatgaccaggacaggacctccatccacgaagctatggagcagcagagtatcagcatctccaaagccgggatcgtcacctctctgcaagccagatgcacagtcattgccgccgcaaaccccatcggcggcaggtatgatccaagcttgaccttcagtgagaacgttgatttgactgagcctattatttctcgctttgacattttgtgtgttgtgcgagatactgtggaccctgtgcaagacgaaatgctggcccggttcgtcgtgggcagtcacgttaggcatcaccccagtaacaaagaagaagagggcctcgcgaatggcagcgctgccgagccagctatgcccaacacatatggtgtagagccattaccccaagaagtgctgaagaaatacattatctacgcaaaagaaagggtgcaccctaaattgaaccagatggaccaggacaaggtggccaagatgtactcagaccttaggaaggaaagcatggccacggggtctatccctatcacagtgagacacatcgagtcaatgatccgcatggctgaggcccacgccaggattcatttgagagattacgtgatcgaggacgatgtgaacatggcgattagggtcatgctggagagtttcattgatacacagaagtttagtgtcatgcgctcgatgcggaaaacgtttgctcggtacttgtcctttcggcgggacaacaacgaattattgctctttattctaaagcagctggtcgccgagcaggtgacgtaccagcgcaatcgattcggtgcacaacaggatacaatcgaagtcccagagaaggacctagtcgacaaggcccggcagataaatatccataatctttcagccttctacgactccgaactattcaggatgaataagttctctcacgatctgaaacgaaagatgatcttgcaacagttctag

SEQ ID NO: 15994 - DNA, 2865 bp, Artificial Sequence
  Description of Artificial Sequence: Synthetic coding sequence
atggcagagagttccgaatcattcaccatggcatccagtcccgcacagcgacgtagagggaatgaccctttgacatcatctcccggaagatccagcagacggactgatgccttgacctccagccctggtcgggacttgcctcccttcgaagatgaaagcgaggggcttttggggaccgaaggaccgcttgaagaggaggaggatggcgaagagcttatcggcgacggtatggagcgcgactatagggccataccggaactcgacgcttacgaggctgaggggctcgccctggacgacgaggatgtggaggagctgacagctagccagcgggaagccggaagggggctgctgtacgattctgacgaagaggacgaggaaagacctgcccggaaaagaaggcaggttgaaagagcaaccgaagatggcgaagaggatgaagaaatgattgaatccattgagaacctggaagacctgaagggacatagcgtcagggagtgggtgagtatggctggtccgaggttagaaatccaccatcgatttaaaaacttcctcaggactcacgtagattcccacgggcataacgtgtttaaggagaggatttcagatatgtgcaaggaaaacagggagtccctcgtcgtcaactacgaagacctcgccgcaagggaacacgttctcgcgtacttcctacccgaagcgcccgctgagctgttgcagatctttgatgaagctgcattggaggtggtcctggccatgtacccaaagtatgatcgaatcactaaccacattcacgtccgcatatctcatcttccattagtggaagaactgaggtcactgaggcagctccacctgaatcagctgatacgcacctcaggagtagtaacctcttgcactggcgtattgccacagttgtcaatggtgaagtacaattgtaacaagtgcaacttcgtgctgggccccttttgccagtcccagaatcaagaggtcaaaccgggcagctgtcccgagtgtcagagcgccgggccctttgaagttaacatggaagagacaatctatcagaattaccagcggattagaatccaggaatcaccaggaaaagtggcggccggccggctaccacgcagcaaggacgctatcttactcgcggacctggtcgattcctgcaagcctggggacgaaatagagttaactgggatctaccacaataactacgatggcagcctcaacacagccaacggctttccagtttttgccaccgttatccttgccaaccatgtggcaaaaaaggacaataaggttgccgtcggtgagcttacggatgaggatgtgaaaatgatcacaagcctctctaaagatcagcagataggcgaaaaggaatcctctcgcaatgcaagtctcgccgaggctggtattggagctattcctagtcagctcttggctatcgagccatcgctccgacgatccggggtacccatcggcgaagtgggagtctcccagagacaggaggcacgttccttcagctcagcaaacactcattggtttttggaggacctgctgggccccagttgccgcgacaccatgattttcgccagtatcgcaccgtctatatacgggcatgaagacatcaagcgagggctcgcattggcccttttcggcggggagcctaagaatcccgggggaaagcacaaggttcgaggcgacatcaacgtgttgctttgtggggatccaggcaccgcaaagagccagttcctgaagtacattgagaaggtcagcagcagggccatatttaccactggtcagggcgctagcgcagtgggcctgacagcttacgtgcagcgacacccagtaagcagagagtggacgctcgaggccggggctctcgtactggccgacagaggagtatgtctcatagacgagtttgataaaatgaacgatcaggatcgaacgtcgatacatgaggccatggagcaacagtccatcagcataagcaaggccgggatcgtcacaagtctccaggctcggtgcacagtcatcgcggccgctaatcccatcggggggcggtacgatccaagtctgacattctctgagaatgttgacctcactgaacctataatttcccgtttcgacatcctttgtgtcgtgcgggatactgtcgatccagtccaggacgaaatgctcgccagatttgtggttggaagtcacgttagacaccatccttccaacaaggaggaggagggacttgctaacggaagtgcggccgagcctgccatgccgaacacttatggcgtggagcctcttccacaagaagttcttaagaagtacatcatctatgcaaaagagcgcgttcatcctaaactaaaccagatggatcaggataaggttgctaagatgtactccgacctcaggaaagaatccatggctaccggtagcataccaatcaccgtacggcacattgagtccatgataaggatggccgaggcgcatgctaggatacatctgagagactacgtgatcgaagacgatgtgaacatggcaattagggtgatgcttgagtccttcatcgacacgcagaaattctccgtaatgagaagtatgaggaaaacttttgcacggtacctgagtttcaggcgggataataacgagctgctcttgtttatcctgaagcagctggtggccgaacaggttacttaccaacgaaataggttcggagcccagcaagataccattgaagtgcctgagaaagacctggttgacaaggctcgtcaaatcaatattcataatctttctgcgttctacgacagcgaactgtttcgcatgaacaaattttctcacgacctgaaaagaaagatgatcctgcagcaattctag

SEQ ID NO: 15995 - DNA, 753 bp, Artificial Sequence
  Description of Artificial Sequence: Synthetic coding sequence
atggctttaagggctggccttgtgttgggatttcacacacttatgacgctgttgagcccacaagaggccggggctactaaagctgaccatatggggtcatacggcccagccttttatcaaagctatggagcaagtggccagtttactcacgagttcgacgaagagcagctgttttccgtggacttaaagaaaagcgaggctgtgtggcgattgccagagttcggagacttcgcccgatttgacccccaggggggtctggccggtatcgcagccattaaagcccatttagacatcctggttgagcgctctaaccggagcagagcaataaatgtccctcccagagtcacggtcctcccaaaatcacgtgtcgagcttggtcagcccaacattctcatttgtattgtcgacaacatatttcctccagtcatcaacatcacatggttaaggaacggccagactgtcacggagggcgtcgcccagaccagcttttactcacagccagatcatctgtttaggaagtttcattacctgcccttcgttcctagcgccgaagacgtatacgactgtcaggtggagcattggggccttgacgcccccctgttgaggcattgggaacttcaagtccctatcccccctcctgacgctatggagacactggtttgtgccttagggctggccatcggcctggtcggcttcctggttggcacagtgcttataatcatgggcacttacgtaagcagtgtgccccgctag

SEQ ID NO: 15996 - DNA, 993 bp, Artificial Sequence
  Description of Artificial Sequence: Synthetic coding sequence
atgcatcgttatcgtgcgcccggggagcaagacggtgatgccatgcccctaggctctgcggttgatatccttgcaacggacgatcccaacttcagccaagaagaccagcaggatacacagatctatgaaaaacatgacaatctactgcacggaaccaagaagaaaaaggagaagatggttagcgccgcatttatgaagaagtatatacacgtggccaagattattaagcctgtgctcactcaggaaagcgccacatatatagccgaggagtactcaagactgcgaagccaagattctatgtcttctgacactgccaggacttctcccgtgaccgcacgaaccctggagacactcattagactggcgaccgcgcatgccaaggcccgtatgagcaagactgtggacctgcaggatgcagaggaggccgtcgaacttgtacagtacgcctacttcaagaaggtcctggagaaagagaaaaaacgtaaaaaacgatccgaggacgagagtgagactgaggacgaagaggagaagagccaggaagaccaggagcaaaaacgtaagcgaaggaaaacacgacaaccagatgcgaaggacggggacagctatgacccatatgacttctcagacactgaagaggagatgcctcaagtccacaccccaaagaccgccgacagccaagagacgaaagaatcccagaaggttgaattaagcgagagccgtgacgggattagcccttgctgtcccggatggtcgtggaccccagggctcaagcagtctttctacttaagtctgcccaagggatgggattatagacacaagcccctctgtctctttgatctgattctgtttaacgactgtcgcgtttccatggttgagggaatccagggcggcccactgggatgtgttcccggaagcagctgtgccgttaaccgccacgagtctccccatcgcatacaccagcctgggcagagaagggccctcctcttctcatag

SEQ ID NO: 15997 - DNA, 2289 bp, Artificial Sequence
  Description of Artificial Sequence: Synthetic coding sequence
atgtggtcatgcggtcggctgcgggaaatcacttggacttcatggaccacccgtctcctcaacaatgccttcgaggaactggttgcttttcagcgcgctctgaaagattttgtggccagcatcgacgctacatatgctaagcagtacgaggaattttacgtggggcttgagggatccttcggctccaaacacgtgagtcctcgcaccttaacatcctgtttccttagttgcgttgtttgtgttgagggaattgttacgaagtgcagcctggtgcgcccaaaagtggtaagatcggtacattattgcccagcaaccaagaagaccatcgagcgacggtacagtgatctcaccaccctggtcgcctttcccagttcatcagtctatcctactaaggatgaagaaaacaatcctctggaaactgagtacggcctgtccgtttacaaggaccaccaaacaataaccatacaggaaatgcccgaaaaggctcccgcagggcagctaccacgatctgtggatgtcattcttgacgacgacctcgtggacaaggctaagcccggcgatcgggtgcaggtcgtggggacatatcgctgtcttcctggaaaaaaaggcggatacactagtggcacattcaggacagtgctgattgcttgcaatgtgaagcagatgagcaaggacgcccagccatctttttccgcggaggatatagcgaagatcaaaaagttttcaaaaaccagaagcaaggacatattcgatcagctagctaaatccctggccccatctatacacggacacgattatgtcaagaaagccatactgtgcctacttctgggcggagtggaaagggatttggagaatgggtcacacattcggggggatatcaacatcctgctgattggagaccccagcgtggcaaagagccaactgttgaggtatgtgctttgcaccgcacctcgcgctatccctacaaccggacggggcagcagcggcgtcggtcttacagctgccgtcacaaccgaccaggaaacgggcgagagacgtctggaggctggggccatggtgctcgctgaccggggggtcgtgtgtatagacgaatttgacaaaatgtctgatatggacagaactgccatccatgaagtcatggaacaggggagagtgacaatcgcaaaggcgggtatacatgcccggctcaacgcacggtgttctgtgttagctgccgcaaaccccgtttacggacgctacgatcagtacaagacgcccatggaaaacatcgggttgcaggatagcctgctgagccgcttcgatcttttgtttattatgttggaccagatggatccagagcaggaccgggaaatctcagaccacgtgcttcgaatgcacagataccgagcacctggggagcaggacggagacgctatgccgctagggagtgccgtggacatcttggcgaccgatgatccaaacttttcgcaggaggatcagcaggatacccagatttatgagaaacacgacaacttactgcacggcaccaagaagaagaaagaaaaaatggttagtgccgcattcatgaagaaatacatccatgtggccaagatcattaaaccagtccttacccaagagagcgctacgtacatcgctgaagagtattcccggctgagaagccaagattccatgagctcagacaccgctagaacaagcccggtcaccgcacgcacactggagaccctcatcagattggctactgcacacgcaaaagctaggatgtccaagactgtggacttacaggatgccgaggaagccgtggagcttgtccaatacgcctacttcaagaaggttctagagaaagaaaaaaagcggaagaaacggtccgaggacgagtctgagactgaggacgaggaggagaaatcgcaggaagatcaggaacaaaagcggaaaaggcggaagacgcggcagcctgatgctaaggacggcgacagctatgacccatacgacttttccgatacggaggaggaaatgccacaggtacacacccctaagacagccgatagtcaggagactaaggaatctcaaaaagtggaactctccgagtctagactgaaggctttcaaggtcgcattgctggacgttttccgggaagcgcacgcccagtccattgggatgaatcgccttaccgaaagtatcaaccgggattctgaagaaccttttagtagtgtggagatacaagctgccctatccaaaatgcaggatgacaaccaggtgatggtctcagaaggcattattttcttaatttag

SEQ ID NO: 15998 - DNA, 987 bp, Artificial Sequence
  Description of Artificial Sequence: Synthetic coding sequence
cggtaccgggcccctggcgagcaagacggggatgccatgcctttaggctccgctgttgatattctggccactgacgatccaaatttcagccaggaggatcagcaagatacacagatctatgaaaaacacgataatcttctacacggcaccaaaaaaaaaaaggagaagatggtgtctgctgcctttatgaagaagtatattcatgtggccaagattatcaagccagtgcttacgcaggaatctgcaacttacatcgccgaagagtattcacgactaagatcccaggattccatgagcagtgatacagcccgaacctcccccgttacagcacggaccttagagacgctgatcagattagccacggcacatgccaaggctcgaatgagtaagacagtggatctgcaggacgctgaggaagccgtggagctggtacagtacgcatacttcaagaaagtgcttgagaaggagaagaagcggaagaagcggagcgaggacgagagcgagacagaagatgaggaagagaagtcccaggaagaccaggagcagaaacggaaacggaggaagaccagacagcccgacgctaaggatggtgactcgtacgacccatacgatttctccgataccgaagaggagatgccccaggtgcacacccctaagacggccgattctcaggagaccaaagaaagccagaaggtggaactgtcagaaagccgtgatggcattagcccctgctgcccaggctggtcctggactcccgggttaaagcagtccttttatttatctctcccgaaaggctgggactaccgccataaacctctgtgtctgttcgacttgatacttttcaacgattgcagagtttccatggtggaaggcattcagggaggacctttgggatgcgtacctggatccagttgtgctgttaataggcatgaaagccctcatcgtatacaccagcctggtcagcggcgcgctcttctcttctcatag

SEQ ID NO: 15999 - DNA, 2562 bp, Artificial Sequence
  Description of Artificial Sequence: Synthetic coding sequence
atgctgccaagaagccctccgttgcccagaggtaatctgtggtggcgcgaagaattcggttcattcagggccggagtggaatcgtcatgggaaccacctcgggactttggagggggtagtagtttagctgctggaatggccggcaccgtagtgcttgacgatgtggaactgagagaagcgcagcgcgactacctggactttctcgatgacgaagaagatcagggtatttatcagtcaaaggttagagaactgatttcagataatcagtacaggctgattgtcaatgtcaatgacctccggaggaaaaatgagaaaagggcgaacaggctgctgaacaacgctttcgaggagcttgtcgccttccagcgtgctctaaaagattttgtggcttccattgatgcaacatatgcaaagcaatacgaggaattctatgtaggtcttgaaggctcctttggaagcaagcacgtgagcccccgcacccttacctcttgcttcctgtcctgcgtcgtgtgtgtggagggcatagtgaccaagtgctcgctcgttcgtcctaaggttgtgagatcagtgcactactgtccagccactaagaagactatcgagcggcggtactcagatctcaccactcttgttgcctttccttcctcttcagtataccccaccaaagacgaggagaacaatccactggaaacagaatacggtttgtccgtgtataaggaccatcagaccattacaatccaagagatgcccgagaaggccccggccgggcagctgcctcgctcagtggacgtcatcctggatgacgatctggtggacaaggcgaagccaggcgatcgcgtccaggttgtggggacgtatcgatgtttgccgggaaaaaaaggggggtatacaagtggcaccttccgaactgtcctgatagcatgcaacgtgaagcagatgagtaaagacgctcaaccgtccttttcagctgaagatatagccaagataaaaaagttttctaagacccgctctaaagacatcttcgaccagctggccaagagcttagcccctagcatccacggacacgattacgttaaaaaggcaatcctgtgtctgctgctgggcggggtggagagagacctcgaaaacgggtcacatatacgtggtgacataaacatattgttgataggcgacccctcagtcgccaaatctcagttattgcgctacgtcttatgcacagctccccgggctattcccactaccgggcgcgggagttcgggggtggggctcacagccgctgttacaaccgatcaggagaccggagaaagacgcctcgaagccggagctatggtcctggccgacaggggcgtggtgtgcatcgacgagtttgataaaatgagcgatatggatcgcaccgccatacatgaggtaatggagcagggacgcgtgaccatcgctaaagccggcatccacgcccgattgaacgcacgttgcagcgtattggctgctgccaaccctgtgtacggccgctacgatcagtacaaaacacccatggaaaatatcggtctgcaggacagccttctcagcagattcgatctccttttcattatgctggaccagatggaccccgagcaggaccgggaaatatctgatcacgttttaaggatgcatcgttaccgggccccaggtgaacaggatggagatgctatgcccctgggatctgctgttgacattttagctacagatgatccaaatttctctcaggaggatcaacaggacacgcagatctacgaaaagcacgacaacctgttacacggaacaaagaagaagaaagaaaagatggttagtgccgcatttatgaaaaagtatattcacgtagccaaaatcataaagcctgtactgactcaagagtccgcaacctacatcgccgaagaatattcacggctgcggagccaggacagcatgtcgtcggacactgctcgcactagtcccgtaacggctagaaccctcgaaaccctgataaggttggcaactgctcacgccaaggcacggatgtctaaaactgtggatctgcaagacgccgaagaagcagtcgagctagtccagtacgcttattttaaaaaagtcctggaaaaagagaaaaagagaaagaaacggtccgaagatgagtccgagacagaagacgaagaggagaaatcgcaggaggatcaggagcaaaaacgcaagagacggaagacgaggcagccagatgctaaggatggagattcttacgacccgtatgatttctctgacacggaagaggagatgcctcaggtgcacactcccaaaaccgccgattcccaagagaccaaggagtcccaaaaagtcgagctgagtgagtctaggcttaaagcgttcaaagtcgccttgcttgacgtgtttcgcgaggcccacgctcagtcaatcggcatgaatcgcctgacagaatctattaaccgagactcagaagagcccttctcaagcgtagagatccaggccgccctgtcaaaaatgcaggacgataaccaagtcatggtgagcgagggtataattttcctgatctag

SEQ ID NO: 16000 - DNA, 2592 bp, Artificial Sequence
  Description of Artificial Sequence: Synthetic coding sequence
atgtccagtcctgcgtctactccttcaaggcgcggctcaaggcggggtagagcaactccagctcagactccgagatctgaagacgccagatccagtcctagtcagaggcgacgtggagaagacagcacctctacaggcgaactacagcccatgcccacttccccaggagtcgatcttcaatctccggccgcccaggatgtactgttttccagccctcctcaaatgcactctagcgctattcccctagacttcgatgtatcctcgcctcttacgtatgggacgcccagttcccgggtggaaggaactccccggagtggggtgcggggaacacccgtccgccagcgtcctgatctcggatccgcccaaaaaggcctccaggtggatttacagagcgatggcgccgctgccgaggatattgttgcttcagaacagtcactggggcagaaactcgtcatctgggggaccgatgtaaacgttgcagcatgcaaagaaaactttcaacgttttctacagcgttttatagaccctctagccaaggaggaggaaaatgtcggcatagatatcactgagcctctgtacatgcaaagattgggcgaaatcaatgtaattggagaaccttttctcaacgtgaattgtgagcatattaagagcttcgacaagaatctgtaccggcagctcataagctatccccaagaggtaatccccaccttcgatatggccgtcaatgaaattttcttcgataggtaccctgactccatcctggagcaccagattcaggtcaggccctttaacgccctgaaaacgaagaacatgcgcaatttaaatcctgaggacatagaccaactgattacaatttcgggaatggtgattaggactagtcagctaattccggagatgcaggaagccttcttccaatgccaggtatgcgcccacaccaccagggtggagatggaccgcggacgaatcgccgagcctagcgtgtgtggccggtgtcacaccactcacagcatggcactcattcataataggtccctgttttcagacaagcaaatgattaagctgcaagagagccctgaggatatgcccgcaggtcagacccctcataccgtgattttgttcgctcacaatgatcttgttgataaagtccaacctggagacagagtcaacgtgaccggcatctatcgagccgtccctatccgagtcaatccccgggtgagtaacgttaaatcagtgtataagacccatatcgacgtcatccattacaggaagactgacgcgaaacgacttcatggactcgacgaagaagctgagcagaagctgttctccgagaaaagggtggagttgctgaaagagctgtccagaaaacctgatatctacgaacgtctagctagcgctttagcccccagcatttatgaacacgaggatatcaagaaggggatattgctgcaactatttggcggaacacgcaaggacttcagccacacgggcaggggcaaattcagagccgagataaacattctgttgtgcggcgaccccggaaccagcaagtcacagttactccagtatgtttataacctggtgccccgcggacagtatacgagtggaaagggaagcagtgccgtcggtcttactgcatatgtaatgaaggaccccgaaacaaggcagctggtacttcaaactggggctctagttctctcagataatggtatttgctgcatcgacgaatttgataagatgaacgagtctactcggtcagtcctccacgaggtcatggagcagcagacactgtccatcgccaaagcaggtatcatctgccagctgaacgccaggactagcgtgttagccgcggctaatccgatagagagccagtggaatcctaagaagaccaccatcgagaacatccaactaccccatacccttctcagcagatttgacctcatctttctgctgcttgacccacaagacgaggcttacgatcgcaggctcgcacaccaccttgtggccctgtattaccagtcagaggagcaggccgaagaggagttactcgacatggctgtactcaaagactacatcgcctacgctcactccacaataatgccgagattaagcgaggaagcatctcaggccctgattgaagcatacgtggatatgcgaaagatcggatctagcagaggaatggtctcggcttaccctcggcagctcgagtctctgattcgcctggcagaggctcacgcaaaggtcaggctgtccaacaaagtggaagctattgatgtcgaggaagcaaaaagactccatcgagaggctctgaagcaatccgccaccgatccacggactggtattgtcgacatctccatattgacaaccggaatgagcgccacgtcccgcaagagaaaggaggagttagccgaggctctgaaaaagctaatactgtccaaaggaaagacaccggcattgaagtaccagcagctctttgaagacataagagggcagagcgatatcgctattaccaaggacatgtttgaggaagctctgagagctctggcagacgatgattttctcactgttactggcaagaccgtgaggctcctgtag

SEQ ID NO: 16001 - DNA, 2472 bp, Artificial Sequence
  Description of Artificial Sequence: Synthetic coding sequence
atgcctggccacctgcctctgcgcgatgtcgaggcacgtattccccccccacgtgggagttgttcgaggtgccagcccagactggaatggacctgtagggccctgttaaggagaacatgttgcttccccgcactcccgaagtgcatactgcagttatctctcctgaccctcatgctagaaggtacgcctcgatctggcgtaagggggacccctgtaagacagcgtcctgacctgggcagcgcccagaagggtctgcaagtggacctccagtctgacggagccgcagcagaagacatcgtggcttcggaacagtctctgggacagaagttagtcatatggggtaccgatgtcaacgtcgcggcttgtaaagaaaactttcaacgcttcctccagcggtttatcgatcccctggctaaagaggaggaaaacgtgggcatcgatatcacagaaccactgtacatgcagaggctaggcgagattaacgttattggcgaacctttcctgaatgtgaactgtgagcacatcaagagtttcgacaagaacctttatcggcaattgatctcatacccccaggaggtgatccctactttcgatatggccgtcaacgaaatcttcttcgatcgctacccagacagtatcttggagcaccaaatccaggtgcgccctttcaatgcattgaaaacaaagaacatgagaaatctcaaccctgaagacattgaccagctgatcactatatccggcatggttatccgaacttcgcaacttatcccggagatgcaggaggcgttctttcagtgccaagtatgcgcgcacactaccagagtggaaatggatcgaggacggattgcagaaccatcagtttgcgggaggtgccacaccacccactcaatggccctgattcataaccgatcactattcagcgacaagcaaatgattaaattgcaagagtctcccgaagacatgccagctggccagactccacataccgtgatcttgttcgcccataacgacctagtggataaagttcagccaggcgaccgcgtcaacgtcactggcatttacagagctgtgcctattagggtgaacccgagagtatccaacgtgaagtctgtgtacaagacgcacattgacgttatacattatagaaagacagacgccaaacggctgcatggcctcgatgaggaagccgagcaaaagctgtttagtgaaaaacgtgttgagctcttaaaagagctcagtcgcaagccagacatctatgagagattagcgtccgcactggctccctccatttacgagcatgaggatattaaaaagggcatcctgttgcaactgttcggtgggacacgcaaggatttctcccacactgggcgaggtaaattcagagcagagattaacattctgctttgtggagacccaggaacgtccaagtcacagctgctgcagtatgtttacaacctcgtgccacgtggtcaatatacttccggtaaaggtagtagtgcagtgggcctaactgcctatgtcatgaaagaccccgagacgcgccagctcgtgctacagactggggcccttgtcctctcagacaatggcatatgttgcatagatgaattcgacaaaatgaacgaatctactcgatccgtgctccacgaagttatggagcagcaaacattaagcattgccaaagctggaattatttgtcagctcaatgctcggacatccgtcctggctgccgctaatccgatcgagtcgcagtggaaccccaagaaaacgaccattgaaaatatccagttgccacacacattgctgtcgagattcgacctgatcttcctgctccttgatccccaggatgaagcatatgacagaaggctggcccaccaccttgtggctctgtattaccagagcgaagagcaggcagaggaggaactcttggacatggctgtcctgaaggactacattgcctacgcacacagcactattatgcctaggctgagcgaggaggcctcccaggccctcattgaagcctacgtcgacatgcgtaagattgggtcctcacgcggcatggtttcagcgtatcctcgtcagctcgaatctctgattcggctggcagaggctcacgcgaaggtgagactctcgaacaaagttgaggcgattgatgtcgaggaggcgaagcgccttcacagggaagccctgaaacaatccgctaccgacccaagaactggcatagtggatatatccatcctaaccacaggcatgtctgcaacttccaggaagcggaaagaagagctggccgaggccctcaagaaactgatcttgtccaagggcaaaactcccgcactgaagtaccaacagttattcgaggatattcgtggccaatctgacatcgccattaccaaggatatgttcgaggaggcacttcgggctcttgcagatgacgacttcctgactgttaccgggaaaacagttcgtttactttag

SEQ ID NO: 16002 - DNA, 2592 bp, Artificial Sequence
  Description of Artificial Sequence: Synthetic coding sequence
atgagctcaccagcctctacgccgagcaggcggggcagcagacgagggagagcgactccagcacaaactcctcgcagtgaggacgccagatcatccccatctcagcgacgtcggggcgaagatagcaccagcacgggagagttgcagccaatgccgacaagtcccggcgtagacctacaaagcccagctgcacaggacgtgttgttcagctccccaccgcagatgcactcttctgctatcccactggacttcgacgtgagttcgcctttgacctacggcaccccatcatcgcgagtggagggcacgccccgaagcggcgtgcggggaactccagtgcgccagcggccagacctggggtcggctcagaaggggctccaggtcgatctccagtccgacggcgctgcggcagaggatattgtggcttcggagcagtctttgggtcagaaactcgtgatctggggaacagatgtcaacgttgcagcgtgtaaggagaacttccagcgatttctgcaaagatttattgatcctctggcaaaggaagaggagaatgtcggcattgatattaccgaaccattgtacatgcaaagactgggcgaaattaatgtgattggtgaaccgtttttgaatgtcaattgtgaacacattaagtcctttgataagaatctgtataggcaattgatcagctacccgcaggaagtgataccaactttcgatatggcagtgaatgagatcttttttgatcgttatcccgactccatcttggagcaccagattcaggtgcgcccattcaacgccctgaagacaaagaacatgcgcaacttgaatcccgaggacattgatcaactgattacgataagtggcatggtgatcaggaccagccaactcattcccgagatgcaagaggcattcttccaatgtcaggtatgcgcccacaccactcgcgtggagatggatcggggtaggatcgcagaaccatcggtctgtggccggtgtcataccacacattcaatggcactgattcataaccggtctctgttcagtgacaagcaaatgatcaaactacaagagtcccccgaggatatgccagccgggcagacacctcacactgttattttattcgcccataatgacctggtcgacaaagtacagcctggcgaccgtgtgaacgtgaccggcatctaccgcgccgtgcctattcgcgtaaacccaagagtgtccaacgtaaagtccgtgtacaaaacacacatcgatgtcatccactaccgaaagaccgacgccaaacggttacatgggctcgatgaggaggccgaacagaaactgttctcggaaaaacgggtggagctgctgaaagagctgagtcgaaaacctgacatttacgaacgtctcgcttccgccctggcacccagcatttatgagcatgaagatataaagaaaggaatactccttcagctgtttggaggaaccagaaaagacttttcacacaccggacgtgggaaatttcgggccgaaataaatatcctgctgtgcggggacccaggaactagcaaatctcagctgctccaatatgtgtataatctggtaccccgaggccagtatacctccggtaaagggagtagcgcggtaggactgactgcttacgtcatgaaggacccggagacaaggcaactggtgttacagaccggcgctttggtcctctcagataatggaatctgctgcatagacgagttcgacaaaatgaacgagagtacaaggagcgtcctacatgaagtaatggagcagcaaacactttccattgccaaagccggcattatctgccaacttaacgccagaacctctgtgctggctgccgcaaacccaattgaaagtcagtggaatccaaaaaaaacaacaattgagaatattcaactgcctcacacgctgttaagccgtttcgatctgatctttctccttttagacccccaagatgaagcgtacgaccgccggctggcccaccacctcgtggccctatattaccagtcagaggagcaagccgaagaggaactcctcgacatggccgtacttaaggactacatcgcatacgctcatagcactataatgcctcggctgagtgaagaggccagtcaagcactgatcgaggcgtatgtggacatgagaaagatcggctcgagtagaggcatggtgtccgcgtatcctcgtcaactggaaagtttaatcaggctcgcagaagctcatgcaaaagtgcggctcagcaataaagttgaggccatcgacgtcgaggaagccaaacgccttcacagggaggctctgaagcagagcgccacagatcctaggacagggatcgtggacatttccatactgaccacaggcatgtctgccacttcaaggaagagaaaggaggaactggctgaagccttgaaaaaactcattctgtcgaaaggtaaaactcccgctctgaaataccagcaactcttcgaggatatcagaggacagtcagatatcgctatcactaaggacatgtttgaggaagctctacgtgctctcgccgacgacgacttcctgacagtgacaggaaaaactgtgagactcttgtag

SEQ ID NO: 16003 - DNA, 855 bp, Artificial Sequence
  Description of Artificial Sequence: Synthetic coding sequence
atggcaccacgtctgtgctcgatctcagtcacagcgcgtagactcctggggggccctggacccagagcaggcgacgtggcgagtgcagctgctgctagattttactcgaaggacaatgaaggcagttggttccgaagcctgttcgtgcacaaggtggacccaagaaaggacgcccattctacactcctcagtaaaaaagagacgtcgaacctatataagatacagttccacaacgtgaagccggaatatctggatgcatacaacagtcttaccgaagctgtcctgcccaagctgcatctggacgaggattacccatgctcactggtgggcaactggaacacgtggtatggagaacaggaccaggcggtgcacctgtggagattttccgggggttatccagcactgatggactgcatgaataaactgaaaaacaataaggaatatctggagttcagacgtgagcggagccagatgctcttgagcagaagaaatcagctgttgttagagtttagcttttggaatgaaccgcagccgcggatgggtccaaacatttacgaactgcgcacatataagttgaaacccggtacgatgattgagtgggggaacaactgggctagggccatcaagtatcgacaagaaaatcaggaggccgtaggcggatttttttctcagatcggcgaattgtatgtagtccatcatttgtgggcctacaaggacttgcagtcccgtgaagaaaccaggaatgcggcatggcgaaaacggggctgggatgagaatgtgtattacacagtcccgctggtcaggcacatggagagtcgcatcatgattcccctcaagatctcccctcttcagtag

SEQ ID NO: 16004 - DNA, 2076 bp, Artificial Sequence
  Description of Artificial Sequence: Synthetic coding sequence
atgagtgggtttgatgaccctggaatcttctactctgacagcttcggaggagatgcccaggctgatgaagggcaggcaagaaaatcccaactgcagcgccggttcaaggagttcctccggcaataccgcgtgggaacggatcggaccgggttcacatttaagtacagggatgaattaaaacggcactataacctcggagaatactggattgaagtggaaatggaggatttggccagcttcgacgaggatctggcagattacctctacaaacagcctgcggagcatttacagctctccgacatgatgtcccaccttgtgaagatccccgggataatcatcgctgccagcgctgtaagggccaaggctactagaattagcatccagtgcaggtcatgtcggaatacacttactaacattgccatgaggcccggactcgaaggctacgccctgccccgcaaatgtaatacagatcaagccggccgacccaaatgtcctctggatccctactttatcatgcccgataagtgtaaatgtgtggattttcaaaccctcaaactacaggaactgcctgacgcagtcccccacggggagatgccccggcacatgcaactgtactgtgatcgttacctttgcgataaagtggtgcccggtaaccgcgtgacaattatggggatatacagtattaagaaatttggcttgactactagtagagggcgggacagagtcggcgtgggaatccgcagtagctatattcgcgtactcggaatccaggtcgatacagacggcagcggcagaagttttgctggcgccgtgagccctcaggaggaagaagagttccgccgtcttgcagccctccccaatgtgtacgaagtaataagcaagagcatcgcaccctccattttcggcgggaccgatatgaagaaagcaatagcctgtctgctctttggtggctcccggaagcgcctgccagacggactgactaggcggggcgatattaatctgctgatgctgggtgacccgggaaccgccaaatcccagttgttgaaatttgtggaaaaatgtagtccaatcggagtctacacgtcaggtaaaggctcatctgctgccgggctgacagcgagcgtcatgcgcgatccatccagccgaaactttataatggaaggaggcgccatggtactggctgatggaggggttgtttgcatcgacgaatttgataaaatgcgggaagatgacagggttgcgatccacgaggccatggagcagcagactattagcatcgccaaggccggcataacgaccaccctgaactcccggtgcagcgtcctcgccgcagccaatagcgtatttggacgatgggacgaaaccaagggagaagataacatcgactttatgcctacaattttatctcggttcgatatgatattcatcgtcaaggacgagcacaacgaggaacgtgacgtaatgctggcaaagcatgtaattacattacacgtttcagccctgactcaaacgcaggccgttgagggagagattgatttagcaaagctgaaaaaattcatcgcgtactgtcgcgtcaagtgtgggccccggctgagcgcagaggccgccgagaaattgaagaacaggtacatcattatgcgctctggcgctcgtcaacacgaacgagattccgacagacgatcatccatccccatcacggtccggcagctggaggccatcgtacgtatcgcagaggccctgagtaagatgaaactgcagccttttgccaccgaagccgacgtggaggaggccctgcgtttatttcaagtgagtacgttagacgctgcattatctggaacactttcaggagtggaggggttcacttcccaggaggaccaagagatgttatcgcgcattgaaaagcagctcaagagacgttttgctatcggcagtcaggtctcagaacactcaattataaaggactttacaaaacaaaaatacccggaacacgctattcataaggtgctccagctcatgctgaggaggggagaaatccagcacagaatgcagagaaaagtactctatcgacttaaatag

SEQ ID NO: 16005 - DNA, 696 bp, Artificial Sequence
  Description of Artificial Sequence: Synthetic coding sequence
atgagtgggttcgacgatcccggaattttttatagcgactccttcggtggcgatgcacaggccgacgagggccaggcaaggaagagccagctgcagcgtaggtttaaggagttcctgagacaataccgggttggcaccgaccgcacgggctttactttcaaatattcactcgcccctagtctgatcgagcatcttctgcccgcccggtattgcagcggctgctgggcagcagctctgaaactggacctggccccagcatcccgggacgaattgaaacggcactacaacctaggggaatattggatagaagttgaaatggaagatctggcttcctttgacgaagacctggcggactatctctataagcaacccgcggagcacctgcagctcctggaagaggcagccaaggaggtggccgatgaggtcacacgaccacggccttcgggcgaagaggtcctgcaggatattcaagtaatgctcaaaagcgatgcgtcaccgagttccatccgctccttgaagtccgatatgatgtcacatctggtgaagatacccggaattattatcgctgcttcggctgtgcgagcgaaagctacccgaatcagtatccagtgtagaagttgccggaatacgttaacgaacattgccatgcgtcctgggctggagggatatgccttaccccgtaagtgtaacacatag

SEQ ID NO: 16006 - DNA, 1125 bp, Artificial Sequence
  Description of Artificial Sequence: Synthetic coding sequence
atgaattccagtggaatcacaacatggggaagtacaggacttcggtggcgctggaggacaaggcccagaccctctggcgaggaggttttacaggatattcaggtcatgctgaaatcagacgctagcccatctagcattaggtctctgaagagcgatatgatgtctcacttggtgaagattcctgggattataatcgccgcctccgccgtaagggctaaggcaacacgaattagtattcagtgccgctcgtgtcgcaacacactcactaatattgctatgagacccggactcgaaggctacgcgctgcctcgaaagtgtaacacagatcaggctggaagaccaaagtgcccgttagacccctatttcatcatgcccgacaagtgtaagtgcgtagatttccagaccctgaaactgcaggagctgcctgatgctgttccacacggggagatgccccgccacatgcagttatactgcgacaggtacttatgcgataaagtcgtcccaggaaatagggtcactataatgggcatttactccatcaaaaaattcgggctcacaacgagtcgtgggcgggatagggtgggtgtcgggatcaggagcagctatatccgggttttaggcatccaggtcgacacagacggcagtggccgaagcttcgctggggcagtttccccccaggaagaggaggagttccggaggcttgccgctctgccaaatgtctacgaagttatctctaaaagtattgccccttcaatcttcggtggcaccgacatgaaaaaggcaatagcatgtctgctgttcggggggagccgaaaacgccttccagatggcctcactagaagaggagatatcaatctgctaatgttgggtgaccctggcacagccaaatcccaactgttgaaattcgtggagaagtgtagtcctatcggggtctacacatcagggaagggctcatctgctgctggtcttactgcctccgttatgcgagacccatcgagtagaaattttatcatggagggaggtgccatggtccttgcagatggcggagttgtctgtatcgatgagttcgacaagcaccgggaggctgcacaagcacccttgtgccattggctgcctggagtgtag

SEQ ID NO: 16007 - DNA, 1788 bp, Artificial Sequence
  Description of Artificial Sequence: Synthetic coding sequence
atgttctatttccgcggctgcgggcgctgggttgcggtttcctttacaaagcaacagttccctctggctcggctgagctcagacagtgcagctccacggacaccacattttgatgttatcgttataggtggtgggcatgctggtacagaggccgcgacagcagcagccaggtgtggaagcagaactttgcttctaactcaccgggtggacactataggacagatgagctgcaacccaagcttcggagggattggcaagggacacttgatgcgggaagtagacgcccttgatggcctgtgctctaggatttgtgaccagtccggcgtccattataaggtgctcaatcgcaggaaaggtccggccgtctggggcctgagggctcagattgatcggaaactttacaaacagaacatgcagaaggagatcttaaatacccctctgcttactgtgcaggaaggagccgtggaggacctgattctaactgagccagagcccgagcacactggtaagtgcagggtctcgggtgtggtgcttccagaggaccaactaccatgttatctcactcataccaatccccgagttgatgaaattgttctgaagaacttgcacctcaactctcatgtgaaggaaacgaccaggggacctcggtactgcccctcaatcgagagcaaggtgctgaggtttccgaacaggctgcaccaggtgtggctagaaccggaggggatggactctgatctgatttacccacagggattaagtatgacgcttcctgccgagctgcaggaaaaaatgattacctgcatacgtgggctcgagaaggccaaggtaatccaaccaggatatggtgtccagtacgattatctggatccgagacagattactcctagcctagaaacccacttagtccagcgattattcttcgctggccagattaatggaactactggctacgaggaggccgcggcccaaggcgtgatcgctggcatcaatgctagtctgcgagtgtctaggaagccgccttttgtggtcagccggactgagggctacatcggtgttctgatagatgacctcactaccttaggtacctctgagccttacaggatgttcacgtcgcgcgtggaattccggctgtcgctgaggccagacaacgccgactctcgactgactttgagaggctataaagatgcgggctgtgtgtcacaacagcgttatgagcgggcctgctggatgaaatcatctctcgaagaggggatttccgttttaaaatccatcgaatttctcagttccaaatggaaaaaactaattcccgaggcaagtatttcaacttctcgctcactgcctgtccgggccttagatgtgttgaagtatgaggaagtggacatggacagcctcgctaaagctgtcccagaacccctgaaaaaatacaccaaatgccgcgaactggcagagagattaaaaattgaggccacatacgagagcgttctttttcatcagctgcaggaaattaaaggcgtgcaacaggatgaggcgctgcagcttcccaaggaccttgactacctaacaattagggacgtgtctctgagccacgaagtccgggagaagctccacttctcccgccctcagacaataggcgccgcttcgagaattcccggagtcacccctgccgcgataatcaacttgctacgttttgtgaagacaactcaacgtagacaatctgccatgaacgagagttctaagaccgaccaatacctgtgtgatgccgatagactccaggagagagagttgtag

SEQ ID NO: 16008 - DNA, 2154 bp, Artificial Sequence
  Description of Artificial Sequence: Synthetic coding sequence
atgttctatttcagaggatgtggaaggtgggttgcggtgagctttaccaagcagcagttccctcttgcccgcctgtcttccgactctgcagctccgcgcacccctcattttgatgtgattgtgattggcggagggcacgccggcacagaggctgccactgctgccgcccgttgtggaagcagaacgcttttgttaacccacagggtggacaccattggtcaaatgagttgcaatccatcattcggtgggattgggaaaggccacttaatgcgtgaagtcgacgctctcgatggcctctgctccaggatttgcgatcagagcggcgttcactacaaagtactgaatcgacggaagggccctgcggtgtggggacttcgcgctcagatagatcgaaagctgtacaaacaaaatatgcagaaagaaatccttaacacaccgctactaacagtgcaagaaggtgctgtggaagatttgattctaactgagccagaacccgaacacaccggaaagtgcagggtgtctggcgtggtgctggtggatggctcaacagtgtatgcggaatctgtcatcctgaccacaggaactttcctgaggggcatgattgtgatcggcctggaaacccaccccgcaggcagactaggcgatcagccttccattggcctggcacaaacgctcgaaaagctgggatttgtagtcggccggctgaagacgggaacaccacctcgaatagcaaaggaatcaatcaattttagcatcctgaacaagcatattcccgacaatccgagcatccccttttcctttactaatgaaacagtgtggatcaaacctgaggatcaactgccatgttatttgacccacactaatccgagagtcgacgagatcgtgttgaaaaatctgcaccttaactctcacgtgaaagagaccactcgcggccccagatattgcccaagcatcgaatccaaagtgttgcgattccccaataggctgcatcaggtgtggctggaacctgagggtatggactctgatctgatttacccacaaggactgagtatgacactgcccgccgaattacaggaaaagatgatcacatgtatccgcggattggagaaggccaaggtaatccagcccgacggtgtcttgctcctgctgccgcgcatggagtgtaacggagccatatctgcacaccacaacctgcccttacctgggtatggcgtgcagtacgactacctcgatccaaggcagataaccccatctctagagacccacctcgtgcaaagattgttctttgcaggtcagattaatggcaccactggctacgaagaggctgcggcgcagggggtgattgccggcatcaatgcgtccctgagagtctctaggaagccaccgttcgtggtgagcagaacggaaggatacataggtgttttaatcgacgacttgacaacactcggaacttcggagccctataggatgtttaccagtcgggttgaattccggttaagtctacggccagataatgcagattctcgcctgaccctcaggggatacaaggatgctggctgtgtttctcagcagagatatgaaagggcctgttggatgaaatcgagtctggaagagggcatctccgtgctgaaatctattgagttcctatcatcgaaatggaagaagctgatccctgaagcttccatatccacatctaggagtttaccggttagagctctggatgttctaaagtatgaggaagtagatatggatagcttggcaaaggcagttccagagcccctcaagaagtacacaaaatgtcgagaactggctgaaagactcaaaatcgaggctacgtatgagtcagtgctctttcatcagctgcaggagataaagggggtgcagcaagacgaagccttgcaactgcctaaggaccttgattacctcaccatacgcgacgtatccctcagccacgaggttagagaaaagctgcacttttcccggccccaaaccatcggagcagcttcccggattcccggcgtcacacctgcggccatcataaacttactgaggtttgtgaagacaacacagcggagacaatctgcaatgaacgagagctcaaaaaccgatcagtacctctgtgacgccgataggctgcaggagcgggaattgtag

SEQ ID NO: 16009 - DNA, 1932 bp, Artificial Sequence
  Description of Artificial Sequence: Synthetic coding sequence
atgtcctgtaatccttctttcggggggattggcaaaggccacctgatgagggaagtggatgcactcgacggcctgtgttcgcgcatatgtgatcaaagtggagtccactataaagtcctgaacaggaggaaaggccccgccgtttggggactcagagcccaaattgatcgaaagctctacaagcagaatatgcaaaaggaaattctgaatactcccctccttaccgtgcaagagggagctgtcgaggacctgatactcaccgagccggagcccgagcatacaggcaaatgccgggtatcaggcgttgtcctggttgacggtagcaccgtgtacgccgagtccgtcatccttactaccggaacttttctcagaggaatgattgtgatcggccttgaaactcaccccgcggggcgcctcggcgatcagcccagcattggacttgctcagacgcttgagaaacttgggttcgttgttgggcgcctaaagactggaacacctccccgcatagctaaagagtcgatcaacttctctattctgaacaagcacattccggataatccatccattcccttcagctttacaaacgaaacagtttggataaaacctgaggatcagctcccttgctacctcacacataccaacccaagagttgatgaaatagtgctaaaaaacctccacctgaatagtcatgtcaaagagacaacccggggtccgcggtattgtccatccatcgagagtaaagtgctgcgttttcctaatcgacttcaccaggtgtggctggagcctgaagggatggactccgatctgatttaccctcaaggactgagtatgacactccctgctgaactgcaggaaaagatgatcacgtgcattagaggtttggaaaaggcaaaggtcatacagccagatggcgtgctgcttctgttgcctaggatggaatgtaacggcgcaatcagcgcacatcacaatctgccactcccagggtatggtgtgcagtatgattatctggatccccgccagatcactccttcactggagactcacctggtgcagaggctgtttttcgccggccaaatcaacggcacaactgggtatgaggaagctgcagcacagggcgtaatagcgggaataaacgcgtccctgcgcgtctcccgaaagcctcctttcgtcgtgagccggacagagggatacatcggcgttctgatagacgatttgacgacactcggcacatccgagccttataggatgttcacctctagggtggagtttagactgagcctgagaccggacaatgctgactctcgactgaccctgagagggtataaggacgcagggtgcgtgagccagcagcggtatgaaagggcatgttggatgaaatcatcactggaagaggggatcagcgttctgaagtctattgaatttttaagttcaaagtggaagaaactgattcccgaggcctcaatctccactagcaggagtctcccagtgcgagcacttgatgtgctgaaatatgaggaggtcgacatggacagtcttgctaaagccgtcccagagcccctcaagaagtataccaagtgtcgagaattggccgaaagactcaagattgaggccacatacgaaagcgtactgtttcatcagctacaagagataaaaggggtgcaacaggacgaagctttgcagttgccgaaggatcttgactacctcaccatacgggatgtatcactttctcacgaggtccgcgaaaagctgcactttagtcggcctcagacgattggagcagccagccgaatcccaggtgtcactccagccgcaattataaatctgctgcggttcgtgaaaacaacccaaagaagacaaagcgctatgaacgaaagctccaaaaccgatcagtacctatgcgacgcagaccggcttcaggaacgcgaactgtag

SEQ ID NO: 16010 - DNA, 2199 bp, Artificial Sequence
  Description of Artificial Sequence: Synthetic coding sequence
atgttttacttcaggggatgcggcagatgggttgcagtgagcttcactaaacagcagtttcctttagcacgactgagcagcgattctgccgctccccggacgcctcactttgatgtgatcgtgattggggggggacacgcaggaacggaagcagccaccgctgcagccaggtgtggctcaaggaccctattattaacccaccgagtcgatactataggccaaatgagctgtaacccctctttcggtgggattggcaaaggtcacctgatgagagaggtggacgcactggatggcctttgttcccgcatctgcgatcaaagcggagtgcattacaaagttctgaacagacgcaaaggcccggctgtttggggcctcagggcacaaatagatcggaaactctataaacagaacatgcaaaaagaaatattgaacacgcctctgctcactgtccaagagggggctgtggaagatctgattctgacagagcccgagccagaacacaccggaaagtgtagagtgtccggcgtggtcttagtggatggatcaacagtgtatgccgagtcagtaatactaaccacaggcacgttcctccgcggcatgattgtcatcgggcttgagactcaccctgctggacgtctgggagatcaacccagtattggactcgcccagactctggaaaagctcggttttgtcgtcggcagactgaaaaccggaacacccccccgtattgcgaaggagtcaatcaatttctccatactaaataaacatatcccggataatccgagcattcccttttcgttcacaaatgagacagtgtggattaagcccgaggaccagctgccttgttatcttactcacaccaatccccgagtcgacgagatcgtcctgaaaaatctgcacctaaacagccatgtgaaggagaccacacgaggaccccggtactgtccgagtatcgagtccaaggtcttaaggttcccaaatcggctgcaccaagtgtggctggaacctgaaggtatggactccgacctcatttatccccagggtctctcgatgactctcccggctgaactccaggaaaagatgatcacctgcatcaggggattggagaaggctaaagtgattcagcccgggtatggggtgcaatatgattatcttgacccacgtcagatcacccctagcctcgaaacccacctggtccagaggctgttcttcgctggccaaataaatggtactacaggctatgaggaggctgccgcacagactgagtgttgttcggtggcccgattggagtgttccgatatgatctcccagctgcaagcaatcttactccctcaaccatccctggtagccggcactgccggaatgcatcacaatacccagggagtcatcgctgggattaacgcttcactgcgcgttagccgcaagcccccgtttgtggtctcacgaacagaagggtatatcggtgtgctcatcgacgatctgactacactcgggacatccgagccataccggatgttcacatcccgggtggagtttcgattaagtctgagaccagataatgctgactccaggttgaccctgagaggctacaaggatgccggctgcgtttcccagcagagatatgaacgcgcttgctggatgaagagctcgttggaagaggggattagtgttctgaaatccatagagttcctgagtagtaaatggaaaaagcttatccctgaagcctccatatcaacatccagaagtctgcctgtcagagctctggatgttcttaaatatgaggaagtcgacatggacagtttggccaaggctgtaccagagcccctgaagaagtataccaagtgtcgagaattggccgaacggctgaagatcgaggctacttacgaatccgtcctatttcatcagctacaagaaatcaagggcgtgcagcaggacgaggcactgcagttgccgaaagatttggattacctgacaatcagagacgtatctctgagtcacgaagtgcgagagaaactgcatttttcccgcccccaaactataggtgccgccagccgcatcccaggtgtgacacccgctgctataatcaatctgctgaggtttgtcaagactactcagaggcgccagtctgctatgaacgagagttctaagacagaccagtacctgtgtgacgcagatagattacaggagagggagctttag

SEQ ID NO: 16011 - DNA, 2079 bp, Artificial Sequence
  Description of Artificial Sequence: Synthetic coding sequence
atgttttattttagaggctgcggcaggtgggtagctgtgagtttcacaaagcagcagttcccgttggcccggctttcaagcgattccgccgcacctaggaccccgcactttgacgttatcgtgattggagggggtcacgcaggcactgaggctgcgaccgcggcagcaaggtgtggaagccgtaccctcctcctgactcatagggtcgacaccatcggccagatgtcatgtaatcctagcttcggcggaatcggcaaaggccatcttatgcgggaggtggatgcattggatggattgtgttctagaatctgcgaccagagcggagtgcattacaaagtcttgaaccgtagaaagggccctgccgtgtggggtctgcgcgctcagatcgaccgcaaattgtacaaacagaacatgcaaaaagagatcttaaatacccccttgctgaccgtccaggagggggccgtggaggatctgatcctcacagagcccgagccagagcatacagggaagtgcagagtctcaggcgtcgtgctcgtggacggcagcacagtgtacgccgaaagcgtgattttaaccactggtacatttctgcgtgggatgattgtgattggcctagaaactcaccctgcaggacgactgggtgatcagccttcaataggactcgcacagactttggagaaactaggattcgtcgtgggcaggcttaagactgggaccccaccccgaattgccaaggagagcattaatttctccatactcaacaagcatatccctgacaacccatccattccgttttcctttacaaatgaaacagtctggattaagcctgaggaccagttgccatgctacttgacacacaccaatccccgagtggacgaaatcgtgttaaaaaatctccacctgaacagtcacgtgaaggagacgacccgtggcccgaggtactgtccaagcattgagagcaaggtactgagattcccgaatcggttgcaccaggtttggctagagcccgaggggatggattcggacctcatataccctcaaggcctctccatgactttgcccgccgagctccaggaaaaaatgatcacctgtatacggggtctggaaaaggcaaaggtgatacaacccggttacggcgtacagtatgactacctggatccaaggcagattactccctctctggagacacatctggtgcagaggctcttctttgccggtcagatcaacggcactacaggatacgaagaggccgccgcccagggtgtgattgccggcataaatgcctctctgagggtcagtcgaaaaccgccctttgtagtttcccgcaccgaagggtacatcggcgtgctgatagacgaccttactaccctgggcaccagtgagccatacaggatgttcacttctagggtggagttcagacttagcctgcggcccgacaacgccgactcaagacttactctgagggggtataaagacgcaggatgcgtaagccaacagcggtacgaaagagcttgctggatgaagagcagtctggaagagggcatctcagtgttgaagtccatcgagtttctcagttccaaatggaagaagctgatccctgaagcaagcattagcacctctcgatcattgccggtccgcgcccttgatgttctgaagtacgaagaggttgatatggacagtctggccaaagctgttcccgagccattgaaaaagtacaccaagtgtcgggagttggccgaaagactcaaaatagaggctacctatgaatcggtgcttttccaccagctgcaggaaataaaaggagtacaacaggatgaagcgctgcagctccctaaggatctagactatctaaccatccgagatgtgagcctgtctcacgaggtcagggagaaactacacttttctaggccgcagaccattggcgccgcctccaggatcccaggtgttactcccgccgctataatcaaccttctgcggttcgtgaagacaacacaaagacggcagagtgctatgaacgaatcgtcaaaaacagaccagtacctgtgtgacgcagaccgcttgcaggagcgggaactgtag

SEQ ID NO: 16012 - DNA, 381 bp, Artificial Sequence
  Description of Artificial Sequence: Synthetic coding sequence
atgtcaatcggggttcctatcaaagtacttcacgaggccgagggccacattgtgacttgtgagaccaatacaggggaagtgtatcgaggcaagctgattgaggcggaggataatatgaattgccagatgagtaatatcactgttacgtaccgcgacggtagggtggcccaactggagcaggtctatattcggggatctaaaattcgattccttatactgcccgacatgctcaagaatgcccccatgctcaagtctatgaaaaacaagaaccagggctcaggggccggcaggggtaaagccgctatactaaaggctcaggtggcggctcggggcagaggacgaggtatgggtagaggcaatatcttccagaagagacggtag

SEQ ID NO: 16013 - DNA, 1083 bp, Artificial Sequence
  Description of Artificial Sequence: Synthetic coding sequence
atggccgctgccgcagcagccggcgctggtcccgaaatggttcgcgggcaggtgtttgatgttggaccaaggtacactaatctctcatatataggagagggagcttacgggatggtctgttcagcatacgacaacgtgaacaaggtgagagtcgccataaagaaaatctctccctttgagcaccagacatactgccagcgcaccctgagggagataaagatactcctccggttccggcacgagaacattatcggtattaacgacataataagggctcctaccattgaacagatgaaggatgtgtacatcgtgcaggatctcatggagactgatctttacaagctactaaaaacacagcatctcagtaacgatcacatctgctacttcctgtatcagatactgagggggctgaagtacattcactctgccaacgtgttacatcgagacctgaaaccaagtaatctacttctcaacaccacctgcgatttaaaaatttgtgactttgggctcgcccgagtggccgatcctgaccacgatcacacaggattcctgacagagtatgtggctactaggtggtacagggcgccagagatcatgctgaatagtaagggttacaccaagtcaatagatatatggtccgttgggtgtatcttggcagaaatgctctcaaacaggcctatcttccccggcaagcactatctggaccagttaaatcatatcctcggcatcctggggagccccagccaagaggatctgaattgtattatcaacctgaaagcgagaaactacctgctctctctaccccacaagaacaaagtaccctggaaccgcttatttcccaacgcagacagcaaggctctggacctactggataaaatgctgacatttaacccccataaacgaattgaagtcgagcaagctctggcccacccctatctcgagcagtattatgatccttctgacgaacctatagctgaggccccctttaaattcgatatggaattagacgatctgcccaaagagaaactaaaagagcttatctttgaagagaccgcccgattccagcctgggtatagaagctag

SEQ ID NO: 16014 - DNA, 1047 bp, Artificial Sequence
  Description of Artificial Sequence: Synthetic coding sequence
atggttcgaggacaggtctttgacgtggggcctaggtacaccaacttgtcctacattggtgagggcgcctacggaatggtatgctccgcttacgacaatgtgaataaagtcagggtagctataaagaagattagcccgtttgagcaccagacgtactgccaacgcacattgagagagataaagatacttctgagatttagacacgagaacatcattggaataaacgatatcatcagggcccccaccatagagcagatgaaggatgtatatattgtccaagatttgatggaaaccgatttatataagttgctaaagactcagcacctctcgaatgaccacatctgctacttcctctatcaaatcctccgcggattaaagtatatacactccgccaatgtgctacacagggacctcaagccctccaacttgttactcaatacgacatgtgaccttaagatctgtgacttcggactggctcgcgtggctgatccagaccatgaccacaccggcttcctgactgagtacgtggcaacacgatggtacagggctcctgaaataatgttaaacagcaaagggtacacgaaatcaatcgacatctggtctgtcggttgtattctggctgagatgctcagtaatagaccaatttttcccggaaagcattaccttgaccagcttaaccatattctcggcattctaggatcaccatcgcaggaggacctcaactgcatcattaaccttaaagctaggaactacctactctctttaccccacaagaataaagtgccctggaaccggttgttccccaatgccgattccaaggcactcgacttattagataagatgctaacattcaatccacacaagaggatcgaagtcgagcaggctctcgcgcacccctaccttgaacaatattacgacccctccgatgagccaatagccgaagctccgttcaagtttgacatggagctagacgatctccctaaagaaaagctcaaagagctgatctttgaggagaccgcgcggtttcagcccggttatcgtagttag

SEQ ID NO: 16015 - DNA, 951 bp, Artificial Sequence
  Description of Artificial Sequence: Synthetic coding sequence
atggcagccgctgcagcggcgggagcagggcccgagatggtgcgcggacaggtctttgatgtgggcccccgatacacaaatcttagctacattggagagggcgcgtacggcatggtgtgctctgcctacgacaacgtgaataaagtaagagtggccataaagaagatcagtcccttcgaacaccaaacctactgtcagagaacacttagggagataaagatactcctcaggttccggcacgagaatatcattggcatcaacgatattatcagggcgcccacaattgagcagatgaaagatgtgtatattgtccaggatcttatggagacagatctgtacaaactcctgaagacgcagcaccttagtaacgaccatatttgctactttctttaccaaatcttacggggactgaagtacattcattccgctaacgttctgcacagagatctgaagccatcgaatctcctgctgaataccacctgcgatctaaaaatttgcgattttggcctggcccgtgtcgctgaccccgaccacgaccacaccggattcctgaccgagtatgtagctaccagatggtatcgcgcacccgaaattatgctcaatagcaagggatatactaaatcaattgacatttggagtgtgggctgcatacttgcggagatgctgtcaaatcggcccatcttcccagggaagcattatctcgatcaactcaatcacatcctggccctggatctgttggacaagatgctcacgttcaacccacacaaaaggattgaggttgaacaagctctcgcccacccatatttagaacagtattatgacccttccgacgaaccaatcgccgaagcaccattcaagttcgacatggaacttgatgatctgccgaaagaaaagctcaaggaactgatatttgaggaaaccgctcgcttccagcctggctatcgcagctag

SEQ ID NO: 16016 - DNA, 1095 bp, Artificial Sequence
  Description of Artificial Sequence: Synthetic coding sequence
atgagcggaccaagggcgggattttacagacaggaactgaacaagacagtgtgggaggtgccccagcgtctgcaaggtctcaggccggtagggtctggagcatatggctctgtgtgttcagcttacgacgctcggctcaggcaaaaggtagccgtgaagaagctgagcagaccatttcagagtctgatacacgctagacgtacttatcgcgaactgcgtctcctgaagcacctcaagcacgagaatgttatcggcctcctagacgtgtttaccccagcgacctccattgaagacttctccgaggtttacttagtcacaacactgatgggcgcggatctaaacaacattgttaaatgtcaggcactgtctgatgaacacgtacagttcctggtttatcagcttctgcgtggtttgaaatatatccatagtgccggcatcattcatagagacctgaagccgagcaacgttgcagttaatgaggactgcgagttacgcatcctggactttggcctcgctcggcaggcggacgaggaaatgactggctacgttgccacacggtggtatcgcgccccagagatcatgctgaactggatgcactataaccaaacagtggatatttggagcgttggttgtatcatggccgaattactgcaagggaaggccctgtttccaggatccgactatatcgaccagctgaagagaattatggaagtcgtcggtaccccttcccccgaagtgctggccaaaatatcttctgaacacgcccgcacttatattcaatctctgccgccgatgccccagaaggacctgtccagtattttcaggggggcaaatccacttgcaatagacttgctcgggcgtatgctagtgttggactcagatcagagggtttctgccgcagaagcccttgcccatgcctatttctcccagtaccatgatcccgaagatgaaccagaggcagaaccgtatgatgaatcagtggaagccaaggagcgcacactggaggaatggaaggagctaacatatcaagaagtacttagctttaagccacccgagccacccaaaccacccggctctttagaaatcgaacagtag

SEQ ID NO: 16017 - DNA, 1095 bp, Artificial Sequence
  Description of Artificial Sequence: Synthetic coding sequence
atgagcggtccacgcgctggcttctacaggcaggagctaaataagactgtgtgggaagtgccgcaacgcctgcagggtctcaggccagtgggcagcggggcttacggcagcgtttgtagcgcctatgacgcacggcttagacagaaagttgcggtgaagaagctgtctcgaccattccagtccctcatccacgcacggcggacataccgggaattgaggctgctgaaacatctgaaacacgagaatgttattggattgctggacgtgtttacacctgcaacttcaatcgaggacttcagcgaagtgtatcttgtgaccacactgatgggagcagacctgaacaatatcgtgaagtgtcaggcccttagtgacgagcatgtgcagtttctggtgtatcagcttcttcggggactgaaatacatccattctgctggaatcattcaccgtgacctaaagccctctaatgtcgcagtgaacgaagattgcgagcttagaattttggatttcggtcttgccaggcaagccgacgaggaaatgactggttatgtagctactaggtggtatagggcccctgagatcatgctgaactggatgcactacaatcaaaccgtggacatttggtccgtgggatgtattatggccgagctgctgcaaggcaaagctctgtttccaggctccgactatattgaccagctgaaacgcattatggaagtagtgggaacacctagccctgaggtgctggcgaaaatatccagcgaacacgcacgcacctatatccagtctttaccacctatgccacagaaggatctttctagtatttttcggggtgccaacccccttgccatagacctcctgggcaggatgctcgtcttggattctgaccagagggtgtccgccgcggaggccctggcacacgcctatttctcacagtaccatgatccagaggacgagcctgaagccgagccctatgatgagtctgtcgaggccaaagagaggaccttagaggagtggaaagaactgacctatcaggaagttctgtcctttaaaccgcctgagccccctaaaccaccaggaagcctggagattgagcaatag

SEQ ID NO: 16018 - DNA, 642 bp, Artificial Sequence
  Description of Artificial Sequence: Synthetic coding sequence
atgggggccgacctcaacaacattgttaagtgccaagccctgtcagacgagcatgtccagttcctcgtttaccaactgctgagaggattgaagtacatccattcggcaggaattatccacagagatctgaagccatccaatgtggcagtgaacgaggattgcgaactccgtatcctggatttcggtctggcgcgccaagcagacgaggaaatgacaggctatgtggccacccggtggtatagggccccggagatcatgcttaattggatgcactacaatcaaaccggcgccggcggcaggccgtggggggatgaagggcaaggcccccgattagctctggattggctttgcatgcctgggctgagaggccaggctcgatctccgcgaatgtgggatccccactccaaagtagcactgcagcgccccctagagcacgacgggtgttggccgcctttagcggttcagctttggacaagtccttgtctgggtgggctcgggatggcagaggagggagtgtgtccttcatgggggttagacgtgactgtcggccttctggaggagggtagaggagtgggaaccctaatggaagtgcctagcccttctcatagcggctacctggttagaggcttacaccatggttag

SEQ ID NO: 16019 - DNA, 1149 bp, Artificial Sequence
  Description of Artificial Sequence: Synthetic coding sequence
atggactttgggttagcccttttattggctggattattaggcctgcttctgggccagtcactgcaagtgaagccgctgcaggtagagcctcccgaacctgtagttgcagtcgcactcggcgcctcacgtcaactgacatgccggctggcctgcgcagaccggggagcaagtgtccagtggcgcggactggacaccagcctgggtgcagtccagtccgatacaggccgaagcgtgctaacagtgaggaatgcatcacttagcgcggctgggaccagagtatgcgtgggctcttgcgggggccggactttccaacacaccgtccaattacttgtgtatgccttcccagaccagctaacggtgtccccagcggccttggtccccggggatcccgaggtcgcatgcacagcccacaaagtgactcccgtcgaccctaacgctttatctttttcattgctggtcggcggacaggaactcgagggcgcacaggccctgggaccggaagtgcaagaagaggaggaagaaccacagggggacgaagatgtgcttttcagagtgacagaacgttggagacttcccccactagggacaccagtcccgcccgccctctattgtcaggccacgatgagactgccgggattggagctctcccacaggcaagctataccggtgctgcacagcccaacctcccctgagccccccgacacaacctcacccgaatcccccgacaccacctctcccgagtctcctgatacgacatcccaagaaccccctgataccaccagtccagagccaccagataagacatccccagaacctgccccacagcaagggagcacacacaccccgcgctctccaggcagcacgaggactcggcgccctgagattagccaggcagggccaacccagggtgaagtcattccaaccggaagctccaaaccagcaggggatcaactgcctgctgccctctggacctctagtgccgtactgggtttactgctgctcgcactgccaacatatcacctttggaagcgctgtaggcatttagccgaggacgatacccatccacctgctagcctacgactgctgccacaggtgtctgcctgggctggcttgcgggggactggacaggttgggattagtccatcatag

SEQ ID NO: 16020 - DNA, 1074 bp, Artificial Sequence
  Description of Artificial Sequence: Synthetic coding sequence
atgtcttcccccccccccgctagatccggcttttatcgacaggaagtgacaaagacagcctgggaggttcgggctgtgtatagagatctgcagcctgtaggctccggggcctacggcgcagtgtgctccgcggtggatggacggaccggggccaaggtggccattaagaagctgtatcggccattccagagcgagctgttcgccaagcgggcgtatcgggagctgaggttgttgaagcacatgaggcatgaaaacgtcatcgggctgctcgacgtgtttacaccagatgagactctcgacgatttcaccgacttttatctggtgatgcctttcatgggcacagacttgggcaagctgatgaagcatgagaagctcggcgaggaccggatccagtttcttgtgtatcagatgctaaaagggttacgtgatttgaaaccgggcaacctggcggtcaatgaggactgcgagttaaagatcttggattttggtttggcccggcaggccgatagtgagatgaccggctatgtagttactaggtggtacagagccccagaggtgatcctgaactggatgaggtacacacaaaccgtggacatctggagcgtcggctgcatcatggctgagatgatcaccgggaaaacactgttcaaggggtctgatcatctagaccagttaaaggagatcatgaaggttactggtaccccccccgccgagtttgtgcaacgcctccagtctgacgaggccaagaattatatgaaaggcctcccagaactcgaaaagaaagacttcgccagcatcctaaccaacgcttcccctttggctgtcaacctgttggaaaagatgctggtactggacgcggagcaacgtgtaaccgccggcgaagcgttggctcacccgtatttcgagtccttgcatgacacagaggatgaacctcaagtccagaagtatgacgactcttttgatgatgtcgatagaactctcgacgagtggaagcgagtaacgtacaaggaagtcttatctttcaagcccccaagacaactgggagcccgtgtgtctaaggaaacaccactgtag

SEQ ID NO: 16021 - DNA, 837 bp, Artificial Sequence
  Description of Artificial Sequence: Synthetic coding sequence
atggccctgctgcctgtgctgtttctggtgactgttctactgcccagtctccccgcagaaggaaaggaccctgctttcacagcccttctcactacccagctgcaagtccagcgggagatagtgaacaagcacaacgagctcaggaaggccgtgagtccaccagcctccaatatgctcaagatggaatggagtcgcgaagtcacaacgaatgcacaacggtgggccaataaatgtaccctgcagcactccgaccccgaggacaggaaaacatcaacccgatgtggcgaaaatctctacatgtcgagcgaccccacttcatggagtagtgctatacagtcatggtacgatgagattctggatttcgtgtacggcgtgggcccgaagtcacctaatgccgtggtcgggcattatacccagctagtgtggtatagtacataccaggtcggttgtggcatagcctactgtccaaatcaggattccttgaagtactactacgtgtgccaatactgccccgcaatgaaaacctatctcaataaacgagagggcattaacgtgtggaaatgtttcctccggttgcgacatttccaactgctacgcggggagcagttattaacattttccggaaataacatgaacaggaagaacaccccgtaccagcaaggtactccttgcgcaggatgtcctgacgactgtgacaaaggactctgtaccaactcctgccagtatcaggacctgctttccaactgcgactcactgaaaaatactgctggatgtgagcatgagttactgaaggaaaaatgcaaggccacttgcttgtgcgaaaacaagatctactag

SEQ ID NO: 16022 - DNA, 459 bp, Artificial Sequence
  Description of Artificial Sequence: Synthetic coding sequence
atgcagcacgaaaacgtgatcgggctgctggacgtgtttacacctgccagttcactccgcaacttctacgacttctacctggtgatgccttttatgcaaactgatctccagaagatcatgggaatggaatttagtgaggaaaaaatacagtacttggtttatcagatgttgaaaggattgaaatatatacattctgccggagtggtccaccgggacttgaaacctggcaatctggcagtgaatgaggattgcgagctgaagatcctggatttcggattagcaaggcacgctgacgccgagatgaccggctatgtggtgactagatggtatcgggcccccgaggtcatcctgagttggatgcactacaatcagacgggacagatcttacaccccgtacctgccaccgacccacaggaagggttccatagcgccgtcccaaccggccagccacccggctag

SEQ ID NO: 16023 - DNA, 1068 bp, Artificial Sequence
  Description of Artificial Sequence: Synthetic coding sequence
atgtccctcattcggaaaaagggcttctataagcaggacgtgaataaaactgcatgggaactacctaagacgtatgtgagcccaactcatgtaggctctggggcctatgggagcgtttgttccgccattgataagcgaagtggcgagaaggtggccatcaagaagcttagtaggccctttcagagtgaaattttcgcaaagagagcttacagggaactgctattactgaagcacatgcagcacgagaacgtcataggcctgctggatgttttcacacctgcgtcatcactaaggaacttttacgatttctacctagtgatgcccttcatgcaaaccgacctccagaaaatcatgggtatggagttcagtgaagaaaagatacaatatctagtgtatcaaatgctgaagggtctgaaggacctgaagcctggcaacctggctgtaaatgaggattgcgaactcaaaatccttgattttggtctggcacgacacgcagacgccgagatgacaggatacgtggttacaagatggtaccgcgccccagaagtgatcttgtcatggatgcactacaaccaaaccgtggatatatggagcgtcggatgcatcatggccgagatgcttacagggaaaacactgtttaaaggtaaggattatctggatcagcttactcagatcctgaaagttaccggcgttcccggtaccgaattcgtgcagaagctgaacgataaagcggcaaagagctatattcaatcccttccgcagacaccccggaaggattttactcagctgtttccacgcgctagcccccaggctgccgacctgcttgagaagatgctcgagctggacgttgacaagagactcaccgccgcccaagcgcttacccacccatttttcgaaccctttagggatcccgaagaggagacagaagcccaacagcccttcgatgactccctggaacacgaaaagctgaccgtggatgagtggaagcagcacatctataaggagattgtcaatttttctcctatcgcaaggaaggactctaggcggcgcagcgggatgaagttgtag

SEQ ID NO: 16024 - DNA, 774 bp, Artificial Sequence
  Description of Artificial Sequence: Synthetic coding sequence
atgtcactgatcaggaagaaaggcttctacaaacaggatgtcaataagacagcatgggaattgcctaaaacctatgtaagtcctactcacgtgggctccggagcctatggaagcgtatgttccgcaatcgacaaaagatccggcgagaaagttgccatcaagaagctgtccagaccttttcaatctgagatctttgccaagagagcgtatcgagagctcctgcttctgaaacacatgcagcacgagaatgtgatcgggctcctagacgtattcacgcccgcttcatcgctgcgaaacttttacgatttttatttagtaatgccttttatgcagacagatctgcaaaagatcatgggcatggaattttccgaggagaagattcagtatcttgtgtaccagatgctgaagggactcaaatatattcacagcgctggggtggtgcatcgagacctgaagccaggcaacctggccgtgaatgaagattgtgagctgaagatattggactttggactggcccggcatgccgacgccgagatgactggatatgtagtcaccagatggtaccgagctcctgaggttatcctgagttggatgcactataatcagacaggccagattctacaccccgtcccggccactgatccccaggaaggctttcattcagccgtccctacgggtcaaccgccagggtgtgggcctgcgggcgaggatgcgggcgctcggcgaggacaggcccccgacggccgggctggccctcacccctccttgctgtag

SEQ ID NO: 16025 - DNA, 933 bp, Artificial Sequence
  Description of Artificial Sequence: Synthetic coding sequence
atgtctctaatacggaaaaaggggttttacaagcaggacgtgaacaagactgcttgggagctgccaaaaacatacgtctcccctacacacgtagggtccggggcttacggctctgtgtgctcagccatcgataagaggtcaggcgagaaagttgcaataaagaagctgtccagaccctttcaaagcgaaatatttgctaagagggcctacagagaactcctgcttctgaagcatatgcagcatgaaaatgtgatcggcctattggatgtattcacacccgcctctagtcttcgtaatttttatgacttctatttagtgatgccttttatgcaaactgacctccaaaaaatcatgggtatggagttttcggaggagaagattcagtatcttgtataccagatgctgaagggtctgaaatacattcactccgcgggagtggtccaccgcgatcttaaaccgggaaatcttgcagtcaatgaagactgtgagctaaagattctcgacttcggccttgctcggcacgccgacgcagagatgaccggatatgtcgtgacccgctggtatcgagcccctgaggttatcctgagctggatgcattacaaccaaaccgtggatatttggagcgtaggctgtataatggcagaaatgctgactgggaagactcttttcaaaggaaaagattatcttttggaaaagatgttggagctggacgtggataagcggctaactgctgcgcaagcactgactcatccctttttcgagcccttcagagaccctgaggaagaaactgaagcgcagcagccattcgatgattctctggagcatgagaagctcactgtggacgaatggaaacagcatatttataaagaaatagtcaatttctcccctatcgcgcgcaaggattccaggcgcaggtctgggatgaaactttag

SEQ ID NO: 16026 - DNA, 1629 bp, Artificial Sequence
  Description of Artificial Sequence: Synthetic coding sequence
atgccactgcgggatgaaaccctgagggaggtgtgggcgtccgatagcggacatgaagaagaaagcttatcaccagaagcccccagacgccccaagcagaggcccgctccagcgcagcgcttgagaaaaaagcggacagaagcacccgagtccccctgtccaacaggcagcaaaccgagaaaacccggggcgggtagaacaggcaggccgcgagaggaaccctccccagatccggcccaagcccgtgccccacaaactgtctacgcaaggttcctcagggatccagaggccaaaaagagagaccccagggagacatttctggtggcccgggcacctgatgcggaggacgaggaggaggaagaggaggaggatgaggaggacgaggaagaggaggccgaggagaaaaaggaaaaaatactgctgccacctaagaaaccactgcgagagaagtcatcagccgatctgaaggagaggagggccaaagcccaaggacccagaggggatctaggctctcctgatcctccaccaaaaccacttcgcgtccgtaacaaagaggcgcctgccggggaagggacaaagatgagaaagacaaagaagaagggcagtggcgaagcagacaaggatcctagcggctcccccgcctccgctagaaaatcacctgctgccatgtttctggtcggcgaaggctctccagataagaaagctctgaaaaaaaagggaacccccaagggagcacgcaaagaggaagaagaagaggaggaagctgcgacagtcattaagaaatcgaaccagaaaggcaaagccaagggaaaaggcaaaaaaaaggctaaagaggagagagcacccagtcctcctgtggaggtcgacgagcccagagaatttgtcctgagacccgctccccagggtcgcaccgtccgctgtagactgactcgcgataaaaagggcatggaccgcggcatgtacccatcttacttcctgcacttggacactgaaaagaaagtatttctgcttgctggtcgtaagagaaaaaggtcaaaaactgcaaactatctgatctccatcgacccaacaaacctctctagggggggcgaaaacttcatcggaaagctgcgttcgaatcttctgggtaaccgcttcacagtatttgacaacgggcagaatcctcagaggggatactctaccaatgttgcgagcctgcggcaagagctcgctgccgttatttacgaaaccaacgttctggggttccggggtccaaggagaatgactgtgatcattccaggtatgtcggctgagaatgagagggtgccaatcagacctagaaacgcatccgacggactcttagttagatggcagaataaaacattggagtctcttattgagctgcataacaaaccccccgtatggaacgatgacagtggtagttataccctgaacttccaagggcgtgtcactcaggcctccgtgaagaactttcagatagtccatgccgacgaccctgactacattgtactgcagtttggtcgagtcgcagaagacgcctttacattggactacaggtacccgctctgtgccctccaggcgttcgcaattgccctgagctcatttgatgggaagttagcatgtgagtag

SEQ ID NO: 16027 - DNA, 1083 bp, Artificial Sequence
  Description of Artificial Sequence: Synthetic coding sequence
atgtcacaggaacggccaactttttatcgccaggagctgaataagacaatctgggaagtaccggagagataccagaatttatcaccagttggctccggtgcttacgggtcagtgtgtgctgctttcgacactaagactggcttgcgtgttgccgtcaagaaactcagtaggccgttccagagcattatccacgctaagcggacataccgagagctgaggctgctgaaacacatgaagcatgaaaatgtgattggcctattagacgtgtttacgccggcccgcagcctggaggagttcaacgatgtttaccttgttacccacctgatgggagccgacttgaataacatcgtgaagtgccagaaactcacagacgaccatgtgcaattcctgatctaccagatactgaggggcttaaaatatattcattctgctgatatcatccaccgggatttaaagccatcaaacctggctgtcaacgaagactgcgaactcaagatcctcgatttcggactggcacgacatactgatgatgaaatgaccggctatgtggcgacgcgttggtaccgggctcctgagattatgctcaattggatgcattacaaccagactgtcgatatttggagcgtcggttgtatcatggccgaacttctgacaggaagaacactcttcccgggcaccgatcatattgaccagctgaaattgattcttcgcctggttggtaccccaggcgctgaactattgaagaaaatctcttctgagagcgcgagaaattatattcagtccctcacacagatgccgaagatgaacttcgctaacgtgttcatcggcgcgaaccccctagccgtggacttactggaaaaaatgctagtacttgactcagacaagagaatcacagccgctcaagctctggcacatgcctactttgcgcagtaccatgatcccgacgacgagcccgtggcagatccttatgatcagtcattcgaatctagggacttgcttattgatgaatggaagagcctcacttacgacgaagtcatttcttttgttcctcctccactggaccaggaggaaatggaaagctag

SEQ ID NO: 16028 - DNA, 924 bp, Artificial Sequence
  Description of Artificial Sequence: Synthetic coding sequence
atgtctcaggagaggcccaccttttaccggcaagaactgaacaagacgatctgggaagtcccagagcgttaccagaacttgagtcctgtgggatcgggcgcctatggcagcgtgtgcgctgcctttgacactaagacggggttaagggtagcagtcaagaaactgtcaagaccgttccagtccatcattcatgccaagagaacctacagagagctccgcctcctgaagcacatgaagcatgagaacgttatcggcctcctggatgtgttcacgccagcccgatccttagaggagtttaacgatgtgtacttggtaacacacctgatgggagccgatttgaacaatatcgtaaagtgccagaaactcactgacgatcatgtgcagtttttgatttatcaaatcttacgaggccttaagtatatccacagtgctgatatcatccatagagatctgaagcctagcaatctcgccgtaaatgaggactgtgaacttaaaattctggatttcggactggcacgtcatactgatgatgaaatgacggggtacgtggctacacgctggtaccgtgctcccgagatcatgcttaactggatgcactataaccaaacggtggacatctggtctgtggggtgtattatggctgagttactaacaggccggacccttttccccggcactgatcatatcgaccaacttaagctgatcctgaggctcgtgggaacccctggagcggaactgctcaagaaaataagttctgagtcacttagcacctgctggcggcggtgcctctattggacgcagatccgcgagctgcagcggccaaagcccctgcatatgccgacactgctgtcaacaaccatccttatgatgaaccagtggcctatcttaatgatcagccccctgaaggctgggacatccctctag

SEQ ID NO: 16029 - DNA, 852 bp, Artificial Sequence
  Description of Artificial Sequence: Synthetic coding sequence
atgaagcacgagaacgtgattggactgttagacgttttcactccagctcgctcgttagaggaattcaacgacgtttatctggttacgcatctgatgggcgcggaccttaataacatcgttaagtgccagaaactgaccgacgatcatgtgcagttcctgatttaccaaatactccgtggactgaaatatattcattctgccgatataattcatcgtgatcttaagccaagcaatctagccgtcaacgaggattgcgaactgaagatcctggattttggcctcgcgagacataccgatgatgaaatgacggggtatgtagctactcggtggtaccgcgcacccgaaattatgctgaattggatgcattataaccagacggtggatatctggtccgtcgggtgtatcatggccgagctgctcaccgggagaactctgttcccggggacagatcacattgatcagttgaagttgattttaaggctggtcggaactcccggcgccgaactcttgaagaagatcagcagtgagtcagcccgcaattacattcaaagcttaacccagatgccgaagatgaattttgcaaacgtttttattggtgcaaatcccttagccgtggacctgcttgaaaagatgctcgtgctggattccgacaagcgcattactgcagcgcaggctcttgcacacgcttacttcgcccagtaccacgacccagatgacgagcccgtggcagatccgtatgaccaaagttttgagtctagagatttgttaatcgacgagtggaagagtctgacatatgacgaggttatcagctttgtccccccccccctcgaccaggaagagatggaatcttag

SEQ ID NO: 16030 - DNA, 1140 bp, Artificial Sequence
  Description of Artificial Sequence: Synthetic coding sequence
atggccgccgccgccgcacagggaggtggcggaggagaaccaaggcggacagagggagtggggccaggtgtgcccggggaagtggagatggtcaaaggacagcctttcgatgtcggacctcggtacacacaactacaatatataggtgagggcgcttatggaatggtgtccagcgcatatgaccacgtacggaagactagagtggcgataaagaaaatcagtcccttcgagcaccagacctattgtcagcggactttgcgcgagatccagatcctcctgcggttccgccacgagaacgttattgggatcagggacatcctgcgggccagtaccctggaggccatgcgcgatgtctatatcgtccaggatttaatggagacagacttgtacaagctgctgaaaagccagcagctctccaacgatcatatctgttactttttgtatcaaattctgcgcggattgaagtacattcacagcgctaatgttctgcacagggacctcaagcccagtaacctgctcataaacaccacttgtgacctgaagatctgcgactttggactggctcggatcgctgatccagaacacgaccacactgggttcctcacagagtatgtggctacgagatggtaccgagcccctgaaattatgctaaatagtaagggctacaccaagtcaatcgatatatggagtgtcggatgtattcttgcggagatgctctcaaacaggcccattttcccaggcaagcactatcttgaccaactgaaccacattcttgggattctggggtccccatctcaagaagaccttaattgtattatcaatatgaaggctcgaaactacctgcaatccctgccaagcaagactaaggtggcctgggcaaagctcttccccaagtcagatagtaaggctctggatctgcttgaccgaatgctcacatttaaccccaataagagaattaccgtggaagaagcgctggcccatccatatcttgagcagtactatgatcccactgacgagcccgttgccgaagagccatttactttcgctatggagttagatgatttacctaaagagagactcaaggaattaatttttcaagagactgctcggtttcaaccaggcgtactggaggccccttag

SEQ ID NO: 16031 - DNA, 1008 bp, Artificial Sequence
  Description of Artificial Sequence: Synthetic coding sequence
atggctgcagctgccgctcagggcggaggaggcggcgaaccgcgccggacagagggcgtgggtccgggagttccaggcgaagttgagatggtgaagggtcagccattcgacgtgggtccgagatatacccaacttcagtatatcggagagggagcctacggcatggtaagtagtgcctacgatcacgtgaggaaaacgcgcgtggccatcaagaagattagccctttcgagcatcagacttactgccagcgaacattgagagaaattcagatcttactgcggttccgccatgagaacgtgatcggcatcagagatattcttagggcctctaccctggaggcgatgcgagatgtttatatcgttcaggatttgatggagaccgacctttataaattgctcaagtcacagcagctgagtaacgatcatatctgctactttttataccagatcttgagaggcttgaagtacatccatagcgcaaatgtcctccaccgagatctcaaaccttctaatctgctcattaataccacgtgcgatctgaaaatctgcgattttgggttggccaggattgctgatcctgaacacgaccacacgggcttcttaactgaatacgtggcaacgcgatggtacagggcccccgagattatgctcaacagcaaggggtataccaaaagtatagatatctggtccgttgggtgcattttggccgaaatgctgtcaaataggccaatttttcccggtaagcactacctggatcagctgaatcacatcctcgctttagacctgcttgaccggatgctgactttcaatccaaacaagcgtatcactgtggaggaagcccttgcacacccgtaccttgagcagtactacgaccctacagatgagccagtggcagaggagcctttcacattcgcaatggaattggacgacctgccaaaagaacgcttgaaagagctgatatttcaggagactgcacggtttcagccgggtgtgctggaggccccctag

SEQ ID NO: 16032 - DNA, 936 bp, Artificial Sequence
  Description of Artificial Sequence: Synthetic coding sequence
atggtgaaggggcagcccttcgatgtcggacccaggtacacccaactgcagtatattggcgaaggagcttatggaatggtcagttccgcatatgatcacgtcaggaaaacccgcgtcgctataaagaagatttcccccttcgagcatcagacatattgccagagaaccttaagagagattcaaatcctgctcaggtttcgacacgagaatgtgattggaatcagagacattctcagagcctcgaccctcgaagccatgagggatgtgtatatcgtgcaggatctgatggagaccgatctctataagctgctgaagagccaacagctgagtaacgaccacatctgctacttcctgtatcagatcctgcgaggcctgaaatacatccatagcgccaatgtactccaccgagatctgaagcctagcaatctgctgatcaacacaacttgtgatcttaaaggatacacaaagtccatcgacatttggagcgtgggatgtatactcgctgaaatgctttccaataggccaatcttccctggcaaacactatttggatcagctcaaccacatactcggcattctgggaagtccctctcaagaagatctaaactgtattataaatatgaaggccaggaactacctgcaatctctgccatccaagactaaagttgcctgggccaaattgttcccaaagagtgatagcaaagcactcgatctgctggaccgcatgctcacgtttaaccccaacaaacggatcacggttgaagaggctttggctcatccatacctggaacagtactatgaccctacagacgaaccagtggcagaggaaccttttacattcgccatggaactggacgatctgccaaaggaacgacttaaggaactgatattccaagagaccgcaagattccaacccggtgtcctcgaggctccctag

SEQ ID NO: 16033 - DNA, 1008 bp, Artificial Sequence
  Description of Artificial Sequence: Synthetic coding sequence
atggctgcagcagcggcccagggtggtggcgggggagagcctcgaagaaccgaaggtgtgggccctggggttcctggcgaggtggagatggtaaaggggcagccttttgatgtaggacccaggtatacacagctgcagtacataggcgaaggcgcttatgggatggtgagttccgcttatgaccacgttcgaaaaacccgcgtcgcaatcaagaagattagcccttttgagcaccagacatactgtcaaaggaccctcagagaaatccagattttgctgcgattcaggcatgagaatgttatcggcatccgggacatcctgcgggcctctactttggaggctatgcgggacgtctatatcgtccaggacctgatggaaaccgacctctacaagctgctgaaatctcaacaactgtccaacgaccacatctgttacttcctataccagattctccgcggcctcaagtatatacatagcgcaaatgtactccacagggaccttaaacctagtaacctgcttatcaacaccacatgcgacctaaaaatttgcgacttcgggctggcccggattgcagatcctgagcacgaccatacaggattcctgactgaatatgtggctaccaggtggtatcgtgcccctgaaattatgttaaacagcaaagggtacaccaaaagtatcgacatctggtcagtggggtgcatcctggcagaaatgctgtctaaccggccgatctttccagggaagcactacctcgaccagctcaaccacattttagccctcgatttgctggaccgaatgctgacatttaaccctaacaagcgaattactgtggaggaagccttggcacacccttacctggaacagtattatgatcctactgacgagcccgtcgcggaggaacccttcacctttgccatggagctcgatgacctgcctaaagagagactgaaggagttgattttccaggaaacagctcgcttccagcctggcgtgctggaggctccctag

SEQ ID NO: 16034 - DNA, 1074 bp, Artificial Sequence
  Description of Artificial Sequence: Synthetic coding sequence
atggccgccgccgctgctcagggaggtggaggaggagaaccccgccgtacagagggggtcgggcctggagtgccaggagaagtggagatggttaaaggacagccgttcgacgtcggcccccggtacacccagctccagtacatcggtgagggcgcatatggaatggtgagctcagcttatgaccatgtgcgaaagacaagagtggcaattaagaagatctcacccttcgagcatcagacatattgtcagcggacactgagagagattcaaatccttttgcgcttcagacatgagaacgtgattgggattcgagatattctgcgggctagcactctagaggcgatgcgggatgtctacatagtacaggatctcatggaaactgacttatacaagctacttaagagccagcagctgtccaatgatcacatctgttattttctgtatcagatactccgcggactaaaatacatccattctgccaatgttctccatcgcgacctgaagccatctaatttgctcatcaatactacatgcgatctgaagatctgcgacttcggactggctcgtatcgctgaccctgagcacgaccacacaggcttccttacagagtatgtcgctacgcgctggtatcgcgccccggagattatgctgaactctaaaggatataccaaatctatcgacatctggtccgtcgggtgtattctcgcagagatgctgagcaataggcccatttttcctggaaaacactacttggatcagctgaaccatattctgggtatcttgggcagcccctctcaggaggatttaaactgtattattaatatgaaggcacgcaattacttgcagtcgttgccatctaagacgaaagtggcttgggctaagttattcccaaagagcgatagtaaggctctagacttgctggacaggatgctcacttttaatcccaacaagagaattactgtggaagaggctctggcccacccctacttagagcagtattacgatccaaccgatgaggtgggccaaagtcccgctgccgtagggctgggagccggtgagcagggtggtacctag

SEQ ID NO: 16035 - DNA, 798 bp, Artificial Sequence
  Description of Artificial Sequence: Synthetic coding sequence
atgcgtgatgtgtacatcgtgcaggatctgatggagacggacctgtataagttgcttaagagtcagcagctaagcaacgatcatatctgctacttcctttaccagattctgagaggcctgaaatatattcattcagccaatgtcctgcaccgggatctgaaaccatctaatctcctgatcaatacaacatgcgacctgaaaatctgtgattttggcctggctaggatcgccgaccccgaacatgaccataccggctttctgacagaatacgtcgcaacccgctggtatagagccccagaaattatgctcaatagtaaggggtatacaaaatcaatagatatttggtctgtggggtgcatcctggctgagatgcttagcaacagacccatattccctggcaaacactacctggaccaactgaaccacatactgggaatattaggctcaccttctcaagaagatctgaactgcattatcaatatgaaagcaaggaactacctccaatcattaccgtctaaaacaaaagttgcatgggcgaaactgttccccaaatctgactctaaagccctggatttgctcgaccgaatgctcacatttaatcccaacaagcgaatcacagtggaggaggccttggctcatccgtacctggaacaatactatgacccaactgatgagcctgtcgccgaggagccttttacattcgcgatggagctggacgatctgcctaaggagaggctgaaagaactcatcttccaggagacagctagattccaacccggtgttctggaggctccctag

SEQ ID NO: 16036 - DNA, 1284 bp, Artificial Sequence
  Description of Artificial Sequence: Synthetic coding sequence
atgtcccgttccaaacgcgacaataacttctattccgtagaaatcggagacagcacctttaccgtactgaagcgctatcaaaacctgaagcctatcggatccggcgcccagggcatcgtgtgcgcagcatacgatgccattctcgaacgcaatgtggcaataaaaaagctgtctagacctttccagaaccagactcatgcaaagcgtgcctaccgagagctcgtattaatgaaatgcgtgaaccacaagaacattattgggctgctgaacgtgtttacaccacagaagtctctggaagaattccaggacgtttatatcgttatggagttaatggacgccaacctgtgccaggtgatccagatggaactggatcatgagcgcatgagctacttactctatcaaatgctttgcggtattaagcaccttcactctgcaggtatcatacaccgggatttaaagccctcaaacattgtggtaaagtcagactgtaccctaaaaatcctcgacttcggattagcccgaacagccgggacttcatttatgatgaccccatacgtcgtgaccagatactacagagctccagaggtgatcctcggaatgggatacaaggaaaatgtagacctctggtctgttggatgtataatgggtgagatggtttgccataagatcctgttcccaggacgagactacatagatcagtggaacaaagtgatcgagcaactcggcacaccatgccccgaatttatgaagaagctacaacccactgttagaacatacgttgagaatcggcctaaatatgccgggtattcatttgagaaattgtttccggatgtcctattccccgctgattcagagcacaacaaactgaaagcctctcaggctcgggatctcctgtcgaagatgctggtcattgacgccagcaaaagaatctcggtggacgaggcactccaacatccctatatcaacgtctggtatgacccctccgaagcggaggcaccaccacctaagattccagataaacagctggatgagagggaacatacaatagaagagtggaaagagttgatttataaagaggtgatggaccttgaggaacggactaagaatggcgtgatccgcggccaaccctcaccactgggcgcagcagtaatcaacggttcccagcacccttcaagcagttctagcgtcaacgatgtatccagtatgagtacagaccccaccctggcttccgacacggatagcagtttggaggcggccgccggacctctcggctgttgtcggtag

SEQ ID NO: 16037 - DNA, 657 bp, Artificial Sequence
  Description of Artificial Sequence: Synthetic coding sequence
atgtcgagaagcaaacgcgataacaatttctactcggtcgagatcggtgacagcacatttacagtgctgaaaagataccagaacttgaagcccatcggatctggagcccagggcattgtgtgtgctgcttacgatgctattctggaacgtaacgtggcaattaagaagctgagccggccattccaaaaccagacacacgcgaagcgcgcataccgggaacttgttctcatgaagtgcgtgaatcacaagaacatcattggtcttcttaatgtcttcacacctcagaaatcactcgaagaattccaggatgtgtatatcgtcatggagctcatggacgccaatctgtgtcaagtcatccagatggaactggatcacgaacgcatgagctacctgctttatcagatgctgtgtggcattaaacacctgcatagtgcagggattatccacagggatctgaagcccagcaatatcgttgtgaagtctgactgtactctcaaaattctggattttgggctagccaggaccgccgggacctcttttatgatgacaccttacgttgtcacccggtattatcgtgcaccggaggtgatcctcggaatgggatacaaggaaaatggaggtcgtatgggtaaaggcattttcactagactccaatag

SEQ ID NO: 16038 - DNA, 1284 bp, Artificial Sequence
  Description of Artificial Sequence: Synthetic coding sequence
atgtcccggtctaagcgggataacaacttctactccgtcgagatcggagatagcactttcaccgtgcttaaacggtaccagaacctgaaacccataggctctggtgcccaaggcatagtgtgcgccgcctacgatgccatcctggagaggaacgttgccattaaaaaattatctcgccccttccagaaccaaacccacgccaagcgagcctatcgggaactggtgttaatgaaatgcgtgaaccacaaaaacattatcggcctgctcaatgtgttcacaccacagaaatcactggaagaatttcaggacgtgtacattgtgatggagcttatggacgcaaatctctgtcaggtaattcagatggagctcgatcacgagcgtatgtcgtatctgctgtaccagatgttatgtggaataaagcacctccatagcgctgggataatccatcgtgatctgaaaccttcaaacatagtggttaagtctgattgtacattgaaaattcttgattttggtctggcccggaccgctggcacaagcttcatgatgactccttacgttgtgaccaggtactatagagcccctgaagtcatcctcggcatgggctacaaggagaatgtagacatttggtccgtggggtgcattatgggggaaatgatcaagggcggggttcttttccctggtactgatcacattgatcagtggaataaggtcatcgaacaactgggtactccttgccccgaattcatgaaaaagcttcagcctacagtgagaacttatgtggagaaccggccaaaatatgcggggtactctttcgagaagttgttccctgatgtcttgttcccagccgattccgagcacaacaaactcaaagcgtcgcaagcgcgggatctcctttcaaagatgctcgtaatcgacgcgagcaaacgcattagcgtggacgaggctcttcagcacccctacatcaacgtgtggtacgacccgtctgaagccgaggcccctcctccaaagattccagataagcagctcgacgagagggagcacacgattgaagaatggaaggaactgatatacaaggaggtcatggacctggaggagcggacaaaaaacggagtgattagggggcaaccctctccactgggggccgcagtgatcaatggaagccaacacccttcctcatcttctagcgtcaacgacgtttccagtatgtctactgacccaactctggcctctgatactgacagttcattggaggcagcagccgggcccctgggctgttgtaggtag

SEQ ID NO: 16039 - DNA, 1155 bp, Artificial Sequence
  Description of Artificial Sequence: Synthetic coding sequence
atgtcacgctccaagcgagacaacaacttttactccgtagaaattggggattctacatttacagtcctaaaaagataccaaaacctaaagcctatcgggagcggggcacagggcatcgtatgtgcggcctatgatgccatcctggaaaggaacgtcgctattaaaaaactcagcagaccattccagaaccagacacatgcgaaacgtgcctatcgcgaactggtcctcatgaaatgcgtaaatcataagaacatcatcggactgttaaatgtttttacaccacagaaatcactggaggagttccaggatgtgtacatcgtgatggaactaatggatgctaacctctgccaggtgatccagatggagttggaccatgaaaggatgtcatatctgctctaccaaatgctttgtggcattaaacacttacactcagccggcatcattcaccgggatttgaagccttccaatatcgtggttaaaagcgactgtaccctgaagatactcgactttgggttggcccgtactgcaggaacctccttcatgatgacgccctatgtggtgacaaggtactaccgggcgcccgaggtgatcctcggcatgggatacaaggagaatgttgatatatggtctgtgggatgcataatgggtgagatgataaaggggggagtgttgtttccagggaccgatcacatcgatcagtggaacaaagtgattgagcagctggggacaccgtgccccgaattcatgaaaaagctgcaaccaacagtgaggacgtacgtggaaaatcggccaaaatatgctggctacagtttcgagaagctgtttcctgacgtcttgttccccgccgatagcgagcataataaactcaaggcatcccaggcacgcgacctgctgagcaagatgctggtgatcgacgcaagcaaaagaatctcagtcgacgaggccttgcaacacccctacatcaacgtttggtatgacccttcagaggccgaggcacctcccccgaaaatcccggataagcagctcgatgaaagagaacacaccattgaagaatggaaggagctcatatacaaagaggtcatggacctagaagaaaggacgaagaatggagtcatccggggccagccctcacccctggcccaggtgcagcagtag

SEQ ID NO: 16040 - DNA, 1155 bp, Artificial Sequence
  Description of Artificial Sequence: Synthetic coding sequence
atgtcccggtccaaaagagacaataacttctactccgttgagatcggcgactcaacatttaccgttctcaaacgatatcagaacctaaagcccattggaagcggcgctcaaggaatcgtctgtgctgcctacgacgccatcctggagcggaacgtcgcaattaagaagttgagccgcccttttcagaatcagacacatgcaaagcgagcatatcgagagctcgtgttaatgaagtgtgttaaccataagaatatcatagggcttttaaacgtctttactcctcagaaatccttggaggaattccaagatgtttacatcgttatggagctgatggacgcgaatttgtgccaagttatacagatggaactggaccacgaacggatgagctacctcctgtatcaaatgctgtgcggtataaagcatctgcactcagcgggaattatccaccgagatcttaagccaagtaacattgtcgtaaaatctgactgcacactaaaaatactcgacttcgggctggcgcgaaccgccgggacatctttcatgatgaccccgtatgtggttaccaggtattaccgagcacctgaagtgattttggggatgggttataaggaaaacgtagatttgtggagcgtaggatgtattatgggcgaaatggtgtgtcataagatcctgtttccagggagggattacatcgatcaatggaacaaggtgatagagcagcttggcaccccctgtcccgaattcatgaaaaagctccagcctaccgtacgaacttatgtggagaatcggccaaagtacgccggttacagctttgagaagctgtttcccgatgtcctgtttcctgccgactcagaacacaataagctaaaggccagtcaagcaagagatctcttgagcaagatgctagtcatcgacgcctcaaaacgcatctcggtggatgaggcgcttcagcacccctacattaatgtgtggtatgacccctccgaagctgaagcaccccctcctaagatccctgataagcagctggacgagcgggagcatacgattgaggagtggaaggagctgatctacaaggaggtgatggacctggaagagcgcacaaagaatggcgtaattagaggccaaccctctccgctagcccaggttcagcagtag

SEQ ID NO: 16041 - DNA, 1284 bp, Artificial Sequence
  Description of Artificial Sequence: Synthetic coding sequence
atgtcccgaagcaagcgcgataataatttttatagcgtagagattggcgacagcactttcactgtgctgaaaaggtatcagaatctgaagcccattggaagcggagctcagggaattgtttgtgctgcctacgacgcaattctggaacgcaacgtggccattaaaaaattaagtcgaccattccagaaccagacccacgccaaaagagcctatcgggaactagtgttgatgaagtgcgtcaaccataaaaatatcatcggactgctcaacgtgttcaccccccagaagagtcttgaggagtttcaggatgtttatatcgtcatggagcttatggacgccaatctgtgtcaggtgattcaaatggagcttgaccacgaaagaatgagctacctcttatatcagatgctgtgtggaattaagcatctgcatagcgcggggattattcaccgcgacctgaaaccaagtaacattgtggtgaagtccgactgcaccctaaagattctggactttggccttgcacgcactgcgggcacctcctttatgatgacgccttacgtggtgactcggtactaccgagcgcccgaggttattctgggaatgggctataaggaaaacgtggatctctggtccgtggggtgtatcatgggcgaaatggtctgtcacaagatcttatttcctggcagagactacatcgatcagtggaataaggtgattgagcagctgggtaccccatgccctgagttcatgaaaaaattacaaccaacagtgaggacctatgttgaaaaccggcccaagtatgcaggctactcatttgaaaaattgttccccgatgttctgtttcccgcagattcagaacacaataaactgaaggcctcccaggccagagacttactgtccaagatgctcgtcattgacgcatctaagcgcatttctgtcgacgaggccctgcagcacccctatattaatgtttggtacgacccgtccgaagccgaggcgccccccccgaagattccagataaacagctggacgagcgggaacataccattgaggaatggaaggagttaatctataaggaggttatggacctcgaagagagaaccaaaaacggcgtgatccgcgggcagcccagtcctctcggggccgccgtgatcaacgggtcccaacacccttcatcttcaagtagcgtgaacgacgttagttctatgtcaaccgaccctacattggctagtgatactgacagtagtctcgaggcagccgcgggacccctgggatgttgtcgctag

SEQ ID NO: 16042 - DNA, 927 bp, Artificial Sequence
  Description of Artificial Sequence: Synthetic coding sequence
atgagccgaagcaagcgagacaacaatttttactcagtggagattggtgactctaccttcacagtcctgaagaggtaccagaatctcaagccaatcggaagtggcgcccaggggatcgtctgtgctgcctatgatgcgattctggaacgcaacgttgcaataaagaagctgtccaggccattccagaaccaaacccatgcgaaacgggcataccgcgagcttgtgctgatgaagtgtgtgaaccataagaacattattgggctcttgaacgttttcacaccacaaaaaagtcttgaagaatttcaggatgtttacatcgtaatggagcttatggatgccaatctctgccaggtgatccagatggagctggaccatgaacgcatgtcctacttgctgtaccaaatgctgtgcggaatcaagcatctccactccgctggaatcatccacagggatttgaagccctccaacatcgtggtgaagagcgactgcacactcaaaatcctggattttggtctggccaggacagccggaacctcgtttatgatgaccccctacgtggtgacccgttattatcgcgcacccgaggtgatcctgggcatggggtataaggagaatgccgatagcgagcataacaagttaaaggcgtcacaggcacgcgacctcctgagtaagatgctcgttatcgacgcctccaaaaggattagcgtcgacgaggccctgcagcacccctatatcaatgtgtggtacgatccttcagaggcagaggctccccctcctaagattccagataagcagcttgacgaacgcgaacacacaattgaggagtggaaggaactcatctacaaggaggtcatggacctggaggagaggacaaagaacggagtgattaggggccaaccatcgcccctggcccaggtgcaacagtag

SEQ ID NO: 16043 - DNA, 429 bp, Artificial Sequence
  Description of Artificial Sequence: Synthetic coding sequence
atgtcccgttcaaaaagggataataatttctacagtgtggagattggtgattctacgtttacagttttaaagcggtaccagaacctgaagcccatcgggagtggagctcagggcattgtatgcgctgcctatgacgctatcttggaaagaaatgtggctattaaaaagctgtcgaggccgtttcagaatcagacccacgccaagcgggcttacagggagctggtgctcatgaaatgtgttaatcacaagaatattataggactgctgaatgtattcaccccccagaagagcctcgaggagttccaggatgtatatattgtcatggagctgatggacgctaatctatgccaggttattcagatggagctcgaccacgaaagaatgagttatctgctgtaccaaatgctgtgtggaattaagcatctgtag

SEQ ID NO: 16044 - DNA, 294 bp, Artificial Sequence
  Description of Artificial Sequence: Synthetic coding sequence
atgatcatcggccttttaaatgtgtttacaccccaaaagtcgctggaggagtttcaggatgtgtacatagtgatggaacttatggatgcaaatctgtgtcaagtgatccagatggagcttgatcacgaacggatgtcatatctcctctatcaaatgctctgtgggattaaacacctgcactccgcggggatcatccacagagatctgaagccaagcaatatcgtcgtgaaaagtgactgcacgctgaagatcctggatttcggcctggctcgcaccgccgggacttcattctag

SEQ ID NO: 16045 - DNA, 429 bp, Artificial Sequence
  Description of Artificial Sequence: Synthetic coding sequence
atgtccagatcaaagagagataacaatttctattccgtggagataggggatagcacctttaccgtcctgaaacggtaccagaacctaaagcctatcggtagtggggcccagggaattgtctgtgcagcatatgacgcaatacttgaacgcaatgtggccataaagaaactgagtcggccgtttcaaaaccagacccatgctaagcgggcgtacagagaactggtgctgatgaagtgtgtgaatcacaagaatatcattggactccttaacgtcttcaccccacagaagtctctggaagagttccaagacgtgtatattgtcatggaactcatggacgccaatctttgtcaggttatccaaatggagctggaccacgaacgcatgtcctatctgctatatcaaatgttgtgcggaataaagcacctgtag

SEQ ID NO: 16046 - DNA, 1182 bp, Artificial Sequence
  Description of Artificial Sequence: Synthetic coding sequence
atgcctaaaaagaagcccacacctatccagctgaacccagctccagatggaagtgctgtgaacggtactagttccgcagaaactaacctagaagccctgcagaagaagctggaagagcttgagctggacgagcagcaacggaaacgcctggaggcattcttgacccagaaacaaaaagtgggggaacttaaagatgatgacttcgagaagatctctgagctcggggcggggaacggcggcgtcgtattcaaagttagtcacaagcccagcggactggtcatggcgcgtaaattgatacacctggaaatcaagcccgccatacggaatcagatcatccgagaattgcaggttcttcacgaatgtaatagtccctatattgtgggattttatggagctttttacagcgatggcgaaatttccatctgcatggaacacatggacggtggttctctggatcaggtgcttaagaaagccgggagaattcccgagcagatactgggcaaagtgtcaattgcagtgataaaggggcttacgtatctcagggagaaacataagattatgcaccgcgatgttaagcctagcaacatcctggtaaactcccggggcgaaattaaactttgcgatttcggcgtgtccggtcaacttatcgattctatggccaactcatttgtcgggacccgctcatatatgtcgcctgagagactccaggggacccactacagcgtccagtctgacatttggtccatgggcctgagtctggtcgaaatggcggttggaagataccccatccctccaccggatgccaaggaactggagctgatgtttgggtgtcaagtggaaggggatgcagcagagactcctcctagaccaagaacccccggacgacctttgagtagttacggcatggactctaggcctcccatggcgattttcgagctccttgactatatcgtcaatgagcctccacctaaactgccgagtggggtgttctccctggagttccaagactttgtgaataagtgccttattaagaatccagctgagcgggccgacctgaaacagctcatggtgcatgcattcatcaagagatctgatgcggaagaggtggactttgccggatggctgtgtagcacaataggcctgaaccaaccttccaccccgacacacgccgctggggtgtag

SEQ ID NO: 16047 - DNA, 1203 bp, Artificial Sequence
  Description of Artificial Sequence: Synthetic coding sequence
atgctcgcaagacgtaagcccgtacttccagccttaactattaaccctacaatagctgaggggccctcccctacttctgagggagcgtccgaggccaatttggttgatttacaaaagaagctggaagagctggagctggatgagcagcaaaaaaaaagattagaggcattcctgactcagaaggccaaagtaggtgaactgaaagatgacgactttgagcggatctcagagcttggggctggcaacggcggtgttgtgaccaaggtgcagcataggccatcaggactgatcatggcacgaaagttaattcacctggaaatcaaaccagcaatcaggaaccagataattcgcgagctccaggtgttacacgaatgcaacagcccatacattgttggtttttacggcgccttctattccgacggagaaatctccatttgtatggaacacatggacggtggtagcctcgatcaagtgctgaaagaggccaagcgtattcctgaagagattctgggaaaggtctccatcgctgtcctaagaggccttgcttatttaagagagaagcaccagattatgcacagggatgtgaagcctagtaatattttggtgaatagcaggggagagatcaaactctgtgattttggagtttcgggacagctaattgattctatggccaactcctttgtaggaacgaggagctatatggctcccgaacggctccagggaacacactatagtgtgcaatccgacatctggagcatggggttgagcctggtggagctggcagtgggccggtaccccattccacccccggacgctaaagagcttgaagccatcttcggacgacccgtggtcgatggcgaggaaggcgagccccacagcatcagtccaaggccaaggccacctggcaggccagtgagtggacatggcatggactcacgaccagccatggcaatcttcgagctgctggattacatcgtcaatgagccaccccccaagctgccgaatggggttttcactccagatttccaagagttcgtaaacaagtgtctgatcaaaaaccctgccgaacgcgcggacctgaaaatgctgactaatcataccttcatcaagcgctccgaggtggaagaggtagattttgcaggctggttatgcaaaacccttcgtttaaaccagcccggtacgcccacacggacagcagtttag

SEQ ID NO: 16048 - DNA, 1056 bp, Artificial Sequence
  Description of Artificial Sequence: Synthetic coding sequence
atgggagttcaggggacactgatgagccgagatcagaccccgcacctgctgtccatccttggaaagtcaaaaaggaagaaagacctgagaatcagttgtatgtctaagccccccgctcccaacccaacaccgcctcgcaatttggatagccgcacattcattacgattggagatcgtaactttgaggtggaggcagacgatctggtgacaatttcagaactaggccgaggcgcatatggggttgtcgagaaggtgagacacgctcaatcaggaacaattatggccgtgaagaggatccgcgcaactgtaaactcgcaggagcagaaacgtcttttaatggacctcgacatcaacatgagaacggtggattgcttttacactgtcactttctatggggcgctttttagggagggagacgtttggatatgcatggagctgatggacacttctctggacaaattctaccggaaagtactggacaaaaacatgaccattccagaggacatcctaggggagatagcggtgtccatcgttagagcacttgagcatttgcattctaagctcagtgtcatccaccgtgacgttaagccctctaacgtgcttatcaacaaagaaggtcatgtgaagatgtgtgattttggcatctccggctacctggtggactccgttgccaaaaccatggacgctgggtgcaaaccatacatggcgcctgagaggatcaatcccgagctcaaccaaaaggggtataatgttaaatccgacgtctggtcattgggaatcactatgattgaaatggctattctgcgttttccatacgagtcctggggcaccccttttcagcaacttaaacaggttgttgaagaaccctcaccccagctccccgccgaccggttctcccctgagttcgttgattttacagcgcagtgcctgagaaagaacccagccgagcgtatgtcttatctggagctgatggaacatccctttttcactctccataagaccaaaaagacagacatagctgcctttgtgaaggaaatcctgggagaggattcttag

SEQ ID NO: 16049 - DNA, 1044 bp, Artificial Sequence
  Description of Artificial Sequence: Synthetic coding sequence
atggaatcacctgcaagctctcaacctgcctccatgccacagagcaaaggcaagtctaagcggaagaaagatttgaggatatcttgtatgtctaagcccccagcgcccaatcccactcctccaagaaacctggatagcaggaccttcatcaccattggagataggaactttgaagtggaagcagatgatctggtgacgatctctgagctcggacgaggagcctacggagtggtcgagaaggtaagacatgcccagtccggaactatcatggccgtgaagcgcatcagagctaccgtaaacagccaggaacagaaacgcctgctcatggacctcgatattaatatgcgcaccgtggactgcttttacacagtcaccttctacggggcgcttttccgtgagggtgacgtgtggatctgtatggagctcatggatacgagcttggataagttctaccgcaaagtgctggacaagaacatgaccatccctgaagacatactgggcgagattgcggtgagcattgtgcgagcacttgaacacctgcacagcaagctgagcgtaatccatcgagacgtgaagcctagtaatgtgctcataaacaaggaaggacacgtcaagatgtgtgatttcggcatctcaggctatctggtggattccgtcgcaaagacaatggacgcggggtgcaagccctatatggccccagagagaatcaaccccgaactaaaccagaaagggtataatgtcaaaagcgatgtgtggagcttagggatcacaatgattgagatggctattctgcgatttccctatgagtcttgggggacgcctttccagcaattaaagcaggtggtggaggagccttctcctcagctgcctgcagacaggttcagcccggaatttgttgactttacggcacaatgtctgagaaagaaccccgctgagagaatgtcttacctggagctgatggagcatcctttctttacactccacaaaacaaaaaagactgacatagccgcatttgtgaaggagattctgggcgaggattcttag

SEQ ID NO: 16050 - DNA, 957 bp, Artificial Sequence
  Description of Artificial Sequence: Synthetic coding sequence
atgtcaaagccacccgcccccaacccaaccccaccacgtaacctggactcacggacatttattaccataggagacaggaacttcgaggtggaggctgatgaccttgtcaccatctccgaacttggcagaggtgcttacggggtcgtggagaaggtgcgccacgctcagtctgggacgatcatggcagttaaaaggattcgggccactgtcaattcccaggagcagaaacgcctactgatggaccttgacattaacatgagaaccgttgactgcttttataccgtaacattttacggtgctcttttccgggagggcgatgtctggatttgtatggagctgatggatacctcactggataaattctacagaaaggtgcttgacaagaacatgacgatccccgaggacattctcggagagattgccgtgagcatcgtcagagcactcgagcatcttcactctaaactctccgtaattcatcgcgacgtgaagccctccaacgtgctgattaataaggagggacacgtgaaaatgtgtgacttcgggatttccggatacctggtggacagtgtcgctaagactatggacgctggctgcaagccctatatggccccagaacggatcaatcctgagctaaaccaaaaagggtataacgtgaagagcgatgtgtggtcattggggataacaatgattgaaatggccatcctgcgatttccctacgagtcatggggaacacctttccagcagctgaagcaggtggtggaggagcccagcccccagctccccgctgatcggttctcccctgagttcgtggacttcacagcccagtgcctacgtaaaaaccctgcagagaggatgtcttaccttgaattaatggagcatccctttttcactctacacaaaacaaagaagacagatatcgctgccttcgtgaaagagatacttggcgaggattcctag

SEQ ID NO: 16051 - DNA, 1113 bp, Artificial Sequence
  Description of Artificial Sequence: Synthetic coding sequence
atgctgtcaaacagccagggccagtctccgccagtcccgttccctgcccccgccccccctccgcaacccccgaccccagcattaccccacccaccggctcaaccccctcccccccccccacagcaatttcctcaatttcacgttaagtccgggttgcagattaaaaaaaacgcaatcattgacgactacaaagtgacatcccaggtgttgggactgggcattaatggtaaggtactacagatttttaataaaagaacccaagaaaagttcgcattaaaaatgctgcaggactgccctaaagccaggagggaggtagaactgcattggcgggcctcacaatgtccgcacatagtgcgcatcgtcgatgtgtacgagaatctctacgcaggtagaaaatgtctgctgatcgttatggagtgcctcgacgggggagaactctttagccgaatacaggacagaggagatcaggcatttaccgaaagggaggcctcagaaattatgaagtccattggggaggccatacagtacctgcactctattaacatcgcacatagagacgttaagcctgagaatttgctctacacctccaagcgcccaaacgccattcttaaactgactgactttggattcgccaaggaaacgacctcccacaactcacttactacaccttgttacacgccttattacgtggcaccagaggtgctcgggcctgaaaagtacgataagtcttgtgatatgtggtccttgggagtcattatgtacattctcctgtgtggatacccccctttttattctaatcacgggctggctatttcaccagggatgaagacgcgcatccgcatgggccaatacgaatttccaaatccggagtggagtgaggtgtcagaggaagttaagatgttaataaggaacttgcttaagactgaacctacgcagcgaatgacgatcacagagttcatgaaccacccctggattatgcaaagtaccaaggtgccacagactcctttacacactagtcgagtgctgaaggaggataaagaacgatgggaagatgttaaaggttgtcttcatgataaaaatagcgatcaggctacttggctcactcggctctag

SEQ ID NO: 16052 - DNA, 1203 bp, Artificial Sequence
  Description of Artificial Sequence: Synthetic coding sequence
atgttgagcaactctcagggtcagtcacccccggtgccattcccagcccctgcaccacctccccaaccgcccacaccggcactgcctcaccctcccgctcagcctccgcctccaccaccccagcagtttccccagtttcacgtgaaatcagggctgcaaatcaaaaaaaatgctatcattgacgactataaagtgacatcccaagtgctaggcctaggaataaacggaaaggtgcttcaaatttttaataagcgcacccaggaaaagttcgccctgaaaatgctccaggattgccccaaagctcggagagaagtggagttgcattggagggcctcacagtgccctcacattgtaaggatagtggacgtatacgagaatctgtatgctggtcgcaagtgccttctgatagtcatggagtgtttggatggtggggagttgtttagccgaatacaagatagaggcgatcaggccttcactgagagggaggcaagtgagatcatgaagagcatcggtgaggccatccagtatctccattcaattaacatcgcccatcgggacgtcaagccggagaatcttctgtacactagcaaacgacccaatgccatcctgaaattgactgatttcgggtttgctaaggagacaactagtcacaattccctgactacgccctgttatactccatactatgttgcgcccgaggtactcggtccagaaaagtacgataagtcatgcgatatgtggagcctaggcgtaataatgtacatcttgttgtgcgggtatccgcctttttactcaaaccatggcctggccatcagtcctggcatgaagaccaggatccgaatggggcagtatgagttcccaaaccctgagtggtctgaagtctcggaggaggtcaaaatgctaattaggaaccttcttaagaccgaaccgactcaaaggatgacaattactgagttcatgaaccacccgtggatcatgcaatctaccaaggtccctcagactccattacacacaagcagagtcctgaaggaagacaaagaaagatgggaggacgtgaaggaagaaatgacaagcgccctggcgacgatgcgcgtcgattacgagcagatcaaaatcaaaaaaatcgaggatgcctctaatccactgctcttgaagcggcgcaaaaaagctcgggccctggaggccgccgccctggcccactag

SEQ ID NO: 16053 - DNA, 1149 bp, Artificial Sequence
  Description of Artificial Sequence: Synthetic coding sequence
atggatggagaaactgccgaagagcagggtggacctgtgcctccacccgtggcaccaggcggtccaggcctgggcggagcccctgggggcaggagagagcctaaaaaatacgccgtgaccgacgattaccaactaagcaagcaggttttgggcttgggagtgaatggaaaagtgcttgagtgctttcaccggcgaaccggtcagaagtgcgccctgaagcttctgtatgacagcccaaaggctcgtcaggaggtggatcatcattggcaggcatcaggggggccccacatagtctgcatcctcgacgtgtatgagaacatgcaccatggcaagaggtgcttgttgatcattatggaatgcatggaggggggggagctgttctcacggatccaagagcgaggcgaccaggctttcactgaaagggaagccgcggagatcatgagagacataggaactgctatacaatttctgcacagtcacaatatagcccaccgcgacgtgaaaccagagaacctcctttacacctctaaagaaaaggacgccgtcctgaaactgaccgacttcggatttgcgaaagaaaccacccagaacgcactacagacaccatgctacactccatactacgtagcacctgaggtgctgggccccgaaaaatatgataaatcatgcgacatgtggagcctgggcgtgatcatgtacatcctgctgtgcgggttccctcccttctattcgaacacaggtcaggcaattagccccggaatgaaaaggaggatccgtctgggccagtatggcttcccgaatcctgaatggagcgaggtctctgaggatgctaagcaactcattcgtctgctgctgaaaactgatccgacagagcgcttgaccatcacacaatttatgaatcatccttggatcaaccaatccatggtggtgccccagactccacttcatacagcacgggtgctacaagaggacaaggaccactgggacgaggtgaaagaggagatgacttctgctctcgccaccatgcgggtcgactacgaccaggtgaaaattaaggatctaaagacaagtaataatcgactccttaacaagcggcgcaaaaaacaagctgggtcttcaagtgcttcccagggttgcaacaaccagtag

SEQ ID NO: 16054 - DNA, 999 bp, Artificial Sequence
  Description of Artificial Sequence: Synthetic coding sequence
atggatggcgagactgccgaggagcagggggggcccgtgcccccacccgtggcgccaggaggtccaggcctgggtggggcgccaggcggaagaagggaaccgaaaaagtatgccgtgacagatgactatcaattatctaagcaggttcttggactgggcgttaatggcaaggtcctggaatgttttcacagaagaaccggacagaaatgtgccctgaagctactgtacgatagcccaaaggctcgccaagaagtcgatcatcactggcaagccagcggagggcctcacattgtgtgtattctcgatgtgtacgaaaatatgcaccatgggaagaggtgtctgcttatcatcatggaatgcatggaggggggagaactgttcagccgcatccaagaaagaggtgaccaagccttcacagaaagggaggccgcagagataatgagggacataggtacagcaattcagttcctgcatagccacaatattgcccatagggacgtgaaacccgaaaatctgctgtacactagtaaggagaaggacgctgtcctcaagctgacagatttcggcttcgccaaggagacgacgcagaatgccctgcaaacaccttgttataccccttattacgtggccccagaggtcttaggcccagagaaatatgataagtcgtgcgacatgtggtctttaggtgtgattatgtatattttattatgtgggtttccgcctttttactcaaatactggacaggccattagtcccggcatgaaaagaagaattagactgggccagtatggttttcctaatccagagtggtccgaggtgtctgaggacgccaaacagctcattaggctactgctcaagacagatccgaccgagcggctgactatcacacagttcatgaatcacccctggatcaatcaatcaatggtagtcccccagaccccactacacactgcgcgcgtcctccaggaggataaggatcattgggacgaagtcaaatag

SEQ ID NO: 16055 - DNA, 1149 bp, Artificial Sequence
  Description of Artificial Sequence: Synthetic coding sequence
atggacggggagacagccgaggagcaaggaggtcctgtgccgcccccagtcgcccccggcggaccagggctgggaggcgccccgggtgggcgacgcgaaccaaaaaagtacgcagtgacagacgattatcagttgagcaagcaggtcctcggtcttggagtcaacggcaaggtgctggaatgctttcatcgacgcaccggacagaaatgcgcactgaagcttctttatgatagcccaaaggccagacaggaagtcgaccaccactggcaggcctcaggtggtcctcatatcgtttgcatccttgatgtgtacgagaatatgcatcatggaaagagatgtctgctcataatcatggagtgcatggaagggggagagctgttctcccgtatacaggagcgaggagaccaggcatttactgagcgggaggcagcggagataatgcgcgatattggaacagctatacagtttcttcactcacataacatcgcccaccgggatgtgaaacccgagaacctgctttatacaagcaaggagaaagacgcggtcctgaagttgactgacttcgggtttgccaaagagaccactcagaacgcactgcagacaccttgctacacaccttactatgtggctcctgaagtcctgggccctgaaaaatacgataagagctgcgatatgtggtctctcggagtgatcatgtatatcttgctctgcggcttcccgcctttttattccaataccggacaggctatttcaccaggcatgaagaggcggatccgccttggccagtatgggtttccaaaccccgagtggtctgaggtttcagaggacgcgaaacaactgatccgtttgttattaaagacggacccaaccgaaagactcaccataacacaatttatgaaccatccttggatcaaccagtcaatggtcgtgccacagactcccctgcataccgcccgcgtgctacaggaggacaaggatcattgggatgaggttaaagaggagatgaccagcgcattggccaccatgcgcgtcgactatgatcaggtgaaaatcaaagatcttaaaacgagcaacaaccggctgctaaacaaaagacggaagaagcaggcagggtcaagctctgcctcgcagggatgcaacaatcaatag

SEQ ID NO: 16056 - DNA, 360 bp, Artificial Sequence
  Description of Artificial Sequence: Synthetic coding sequence
atggatggtgaaacagccgaagagcaaggaggacctgtccctccccctgttgccccaggaggcccaggcctcggcggtgcccctggaggacgaagagaacccaaaaagtacgctgttactgatgactaccagctgtccaagcaggtgttgggcctcggggtgaatggtaaggtgcttgagtgtttccatcgtcgcaccggacagaaatgcgctctgaagcttctctatgacagccccaaagcacggcaggaggtggaccatcactggcaggcctccggcgggccccatatcgtctgcatcctggacgtctacgagaacatgcaccacggaaaacgttgcctgctaattataatggagtag

SEQ ID NO: 16057 - DNA, 1422 bp, Artificial Sequence
  Description of Artificial Sequence: Synthetic coding sequence
atgagcgaggagtccgatatggacaaagcaatcaaggaaacttctattcttgaagagtactctattaactggactcagaagctgggtgccggcatttctggacctgtccgagtgtgcgttaaaaaatctacacaggaaaggttcgctctcaagatcctgctggacaggccgaaggcacggaacgaagtgaggcttcatatgatgtgtgccactcatcctaatattgtgcagatcattgaggtgttcgccaattctgttcaatttccacatgagagtagccctcgcgcccgactgctgatcgttatggagatgatggaggggggcgaactattccatagaatttctcagcacaggcattttacagagaaacaggccagccaggtcaccaagcagatagcactggccttacggcattgccacttgctgaatatcgctcaccgcgatctgaaacctgagaacctcctgtttaaggacaatagtttggatgctcctgttaagctttgtgacttcgggttcgcaaaaatagaccagggggatctcatgaccccacagttcaccccctactatgttgcgccccaagtactggaagcacaacgtagacaccagaaggagaagagcggcatcatccccacaagcccaaccccttacacatataataagtcttgtgatctctggagtctgggagtcattatctatgtcatgctgtgtggctacccccccttttactctaaacaccattcacgaaccatccctaaggacatgcgcaggaagatcatgactggctctttcgagttcccagaggaggaatggtcacagatctcggaaatggctaaggacgtcgttcggaagttgctaaaagttaaacctgaagagcgcctgacgatcgagggggttcttgaccatccctggcttaacagcactgaggctctggataatgtgttaccttccgcacagctgatgatggataaggccgtggtggcgggcattcaacaggcacatgctgaacagctcgcgaatatgcgaatccaggatctgaaggtatcgttaaagccactgcactcagtaaataaccccattttgcggaagaggaaactcctgggcaccaagcccaaggattctgtgtatatacacgaccatgaaaatggcgcagaagattctaatgttgcgctggagaagctaagagacgtcatcgcacagtgtattctcccccaggcgggcaagggcgagaacgaggatgaaaagttaaacgaagttatgcaggaggcttggaaatataatagagagtgtaaactgcttcgcgatactctccagtccttttcatggaacggcagaggcttcacagataaagtggacagactcaagcttgcggagattgtgaagcaggtgatcgaggagcagaccacctctcatgagtcgcagtag

SEQ ID NO: 16058 - DNA, 1416 bp, Artificial Sequence
  Description of Artificial Sequence: Synthetic coding sequence
atgagtgaggagagcgatatggataaagcgattaaggaaacatcaatcctcgaagaatactctattaactggacacaaaaattgggggccggcatctccggccccgtgagggtgtgtgtgaaaaagagtactcaggagagattcgctcttaaaattttgctggatcgccccaaggcacgaaacgaagtgaggctgcacatgatgtgcgccacacaccccaatatcgtgcagattatcgaagtttttgctaactctgtccagtttccgcacgaatcctctcctcgcgcacgactcttgatcgtgatggagatgatggaaggtggcgaactgttccataggatcagtcagcatcgtcacttcacagagaaacaagcctcccaagtcactaaacaaatcgcactggcactgcgacattgccacctgctgaatatcgctcatcgtgatttaaagcctgaaaacctcctcttcaaggataatagccttgatgcaccagtgaagctctgcgactttggtttcgcgaaaatagaccaaggcgatctgatgaccccacagttcacaccctattacgtggcccctcaagtactggaagcacagcgacgtcaccagaaagagaagtctgggataattcccactagccctactccatacacttataacaaatcatgcgatctgtggagtctaggcgtgattatctacgttatgctgtgcggctacccacccttttactccaaacatcattcccgtactatccctaaggatatgaggagaaagatcatgaccggatccttcgaatttcccgaggaggagtggtctcaaatcagcgaaatggctaaagacgtcgttaggaagttgctcaaagtgaaaccggaggagcgcttgacaatcgaaggcgtcctcgaccacccttggctgaattcgacagaggccctggataatgtactgccctcagctcagctcatgatggacaaagccgtggtggccggcatccagcaggcacacgccgagcagctggcgaacatgcgaatccaggatctgaaagtaagcctgaaaccactgcactctgtaaacaatccgattctcaggaagcggaagctcctggggacaaaacccaaggattctgtgtatattcatgaccacgagaacggggccgaggactcaaacgtcgccctggagaagctccgtgacgttattgcccagtgtatactccctcaggcaggggagaacgaggacgagaagctcaacgaggttatgcaggaggcttggaaatacaaccgggagtgtaagctgctgagggatacattacagtccttttcttggaacgggcgagggttcactgacaaggtggacagacttaagctggccgaaattgtgaaacaagtcattgaggagcaaacaacatctcacgagagtcaatag

SEQ ID NO: 16059 - DNA, 1416 bp, Artificial Sequence
  Description of Artificial Sequence: Synthetic coding sequence
atgtccgaagaatctgatatggacaaggcaataaaagaaacaagtatcctggaggagtattccattaattggacccagaagctgggagccggaatttctggaccagttagggtgtgtgtcaaaaaatctacccaggagaggtttgctctgaagattctcctggatcggcctaaagcccggaacgaggtgcgtctccatatgatgtgtgctactcacccaaacattgtgcagatcatcgaggtgttcgcaaacagcgtacagttcccccacgagagcagtccaagggccagactgctgatcgtgatggagatgatggagggcggtgaactgtttcataggatctcccagcatagacacttcaccgagaaacaagctagccaagtgacaaagcaggctacactggcccttcgtcattgtcacctgctgaacatagctcacagagatttaaagccggagaatctgcttttcaaagacaactcactggatgcaccggtgaaattgtgtgatttcggcttcgccaagatcgatcaaggggacctgatgacacctcagtttaccccatactacgtagccccacaagttctggaagctcagcgacggcaccaaaaagagaagtcaggcatcattccaacctcaccaactccatacacctacaacaaatcttgcgatctctggagcctaggcgtcattatctatgttatgttgtgtggatatcctccattctatagcaaacaccacagtaggacaataccgaaagacatgcgccgtaaaatcatgacggggtctttcgagttccctgaggaggagtggagccagatatcagaaatggcgaaagatgtggtgcggaaactactcaaggtgaaacccgaggagagacttactattgaaggggtcctagatcacccttggctcaattctacggaagcactcgacaatgtcctgccgagcgcccagctcatgatggacaaggctgtcgttgctggaatccagcaggcccatgccgagcaactggcgaatatgcgcatccaagatttaaaggtgtctctgaagcccctccattctgtaaacaacccaatccttcgaaagcgtaaattgctggggacaaaacctaaagattctgtttatattcacgaccatgagaacggagcagaagattccaatgtggcacttgagaaactcagagacgtgattgcacagtgtatactgcctcaggcaggagagaatgaagatgagaagttgaatgaggttatgcaggaggcctggaagtataaccgcgagtgcaagctgttaagagacacactgcagtccttttcttggaacggaagggggttcaccgataaggtggatcggctgaagttagcggaaattgtgaagcaggtgattgaggaacagacaacctcccacgaaagtcagtag

SEQ ID NO: 16060 - DNA, 1422 bp, Artificial Sequence
  Description of Artificial Sequence: Synthetic coding sequence
atgtcagaggaatctgacatggataaggctatcaaagagacctcaattctggaggaatactccataaattggactcaaaagctgggagccgggataagcggtccggtacgcgtgtgcgtgaagaagtctacccaggagcggttcgctctgaagatcttgctggaccggccaaaggcccggaacgaagtcagactccacatgatgtgcgccacacatccaaacatcgtgcaaattattgaagtgtttgccaacagtgttcaattcccacacgaatcaagccctcgggctaggctcctcatagtcatggagatgatggaagggggggagctgttccatcgaatcagtcaacacaggcatttcactgagaaacaggcctcccaggtaaccaagcaagccactttagccctccggcactgtcatctcctgaacatagcccacagagacttgaagccggaaaatctcctgtttaaggataattccctcgacgcccccgtcaagctgtgcgatttcggtttcgccaagattgaccaaggcgatcttatgaccccgcagtttaccccatactatgtcgctccccaggtacttgaggcacaacggcggcaccagaaagaaaaatctggaatcatcccaacgtcccccaccccctatacttacaataagagttgtgatctgtggagcctcggggtaatcatatatgtcatgttgtgcggctatccaccattctattcaaagcaccactcccgcacaatcccaaaagacatgcgccgaaaaatcatgaccggcagtttcgagtttcctgaagaggaatggagtcagatctcagaaatggccaaggacgtggtccgaaagcttctaaaggtgaagccagaggagagattgactattgagggtgtgctggaccatccgtggctgaactccaccgaagccctcgacaatgtcctcccaagcgctcagctcatgatggataaagcagttgttgccgggatccagcaggcacacgctgagcagcttgcgaatatgcgcatacaagacctgaaggtgagcctgaaaccgctgcatagcgttaacaacccaatcctcagaaagcgcaagctactgggcacgaagcctaaagatagtgtctatatccatgatcacgaaaatggagccgaagactccaatgttgcccttgaaaaactgcgggacgtgatcgcccaatgtattttaccccaggcaggcaagggcgagaacgaggacgagaaattgaacgaagtcatgcaagaagcatggaaatacaacagggaatgtaagctgctcagggacaccctgcaatccttttcctggaacggtcgcggcttcacagacaaggtggataggctgaaattggccgaaattgtcaagcaggtcatcgaggagcagactacttcgcacgaatcacagtag

SEQ ID NO: 16061 - DNA, 2799 bp, Artificial Sequence
  Description of Artificial Sequence: Synthetic coding sequence
atggccgcagctgccgccgtcgaggccgctgcccccatgggcgccttgtggggactagtacacgacttcgtagtcgggcagcaggagggtcctgcagaccaggtggcagccgacgtcaagtccggcaattacacagtgctgcaggttgtagaggctctagggagctctctggagaacccagagcctcgcaccagggctcgcgcaatacagctgttatcacaggtactcctccactgccacactctgctgttggaaaaagaggtcgtacatctcattcttttttacgaaaaccggttgaaagaccaccacctagtcatcccctcagtcctacaaggcttaaaggccctgtcactgtgtgtggccttgccaccaggactggctgtctccgtccttaaggcgattttccaggaggtgcacgtccagtcgttgccacaggttgacaggcacactgtctacaacatcattacaaattttatgagaacacgagaggaggagctcaagagtctcggggccgactttaccttcggctttattcaggtcatggatggcgagaaagacccacggaatttgctggttgcattccgtattgtgcacgatctgatctcccgcgactacagtcttggccctttcgtggaggagctttttgaggttacctcctgttatttcccaattgatttcacgccaccccctaacgatccccacggtattcagcgtgaggatctcatcctcagcctgagggcagtcctggctagcacacctcggtttgccgaatttctgctcccactcctcatcgagaaggtggactctgaggtgttaagtgccaagttggacagcctgcaaacactcaatgcctgttgtgccgtctacggtcaaaaggagctcaaagattttctgccaagcctctgggccagcataagaagggaaagctctcagagacgcaccatactggagatgctgctcggtttcctgaagttacagcagaaatggagttacgaggacaaagaccaaaggcccttaaatggttttaaagaccagctgtgttctctagtgtttatggctctcacagacccttccacccagttacaattggtcggaattcggactctgacagttctgggagcccagcctgacctccttagctatgaggatctggaactggcagtaggccatttgtatcgactatcgtttttgaaggaagacagccagagctgtcgggtggccgctttggaggcgtctggaactcttgcggccctttacccagtggccttctcaagccatttggtccctaagctggccgaggagttgcgcgttggagaatctaatctcactaatggggacgagcctacacagtgttcacgccacctatgctgcctacaagccctttccgccgtgtccacccatccttccatagtaaaagaaaccttacctctcctcttgcaacacctttggcaggttaaccgcggaaacatggttgctcagagcagcgatgtcatcgccgtgtgtcaaagcctgcggcagatggcggagaagtgccaacaggaccccgagtcttgctggtattttcaccaaactgccatcccttgtctcctggctctggcagtgcaagcctcgatgccagagaaggaaccttctgttctgcgcaaagtgttattggaggatgaagtccttgcagccatggtctcagtgattgggactgctaccacccacctgtcaccagagttagcagctcagtccgtcacgcatattgttcctctgtttctggacggcaacgtgtcatttcttcctgagaatagctttccttctcgtttccagccttttcaggatggatcttcaggtcagcgcaggcttattgccctcctgatggcctttgtatgttcattgccccgaaacgttgaaatccctcagctcaatcagctgatgcgggagttattggagttatcatgttgtcacagctgccccttttcatccacagctgccgctaaatgctttgcaggcctgctgaataagcaccccgctggacaacagctagacgagttcctgcagttagccgtcgataaagttgaggccggccttggcagcggaccctgtaggagtcaggcattcacactgctactgtgggtgacaaaagcactagtcttacgttatcatccgctgtcaagctgcctgactgctcgattgatgggattacttagcgatccagagttgggccccgcagctgcagatgggttctcactgcttatgtcagattgcaccgacgtgctcacgcgagcgggccatgcagaggtccgaattatgttccgccagaggtttttcaccgataatgtccccgccttggtgcaaggcttccatgccgccccccaggacgtcaagccaaactatctgaaagggcttagccacgtattaaaccgtctgcctaaacccgttctgctgcccgaactgccaactctgctgtcactgctgctagaagccctgagctgcccggactgtgtggttcagctgagcaccttgtcttgcctccagccgttactgctggaggctccacaagttatgtcattacatgtcgacactctggtgacaaagtttctaaacctgtcctctagtccatccatggcagttcgcatagcggctctgcagtgtatgcacgcactgactagactcccaacacctgtgttgttgccatataagccacaggttattcgcgctctggccaaaccccttgacgacaagaaaagacttgtcagaaaagaggcagtgtctgctcgaggtgagtggtttctgctgggatcaccgggatcctag

SEQ ID NO: 16062 - DNA, 1092 bp, Artificial Sequence
  Description of Artificial Sequence: Synthetic coding sequence
atgctgctgggttttctgaagctccagcagaaatggagttacgaggataaagaccagcgtcctctaaatggctttaaggatcagctgtgctccctggtcttcatggctttgacagatccgtccacacaactgcaacttgtgggtatacgcacattgaccgttttgggggcccagcccgacttgcttagttatgaagatctggagctggcagtgggccacctctatcggctctccttcttaaaagaggatagccagtcgtgtcgtgtcgcagccctagaggctagcggaaccctggctgccctgtatcctgtcgcgttctcgtcccatcttgtgccaaagctcgccgaagaactccgcgtcggggagagtaatcttacaaacggagatgagcctacccaatgtagcaggcacctttgctgtttgcaggctctatcagctgtgagcacacacccatccattgtgaaggaaaccctccctctgctgctacagcacctctggcaggtcaatagaggtaatatggtggcccagtctagcgacgtgattgccgtatgtcaaagcctgcgccagatggccgagaagtgccagcaggaccccgagagttgctggtacttccatcagactgctattccctgtctgctagctctagctgtgcaggcgtcgatgcctgaaaaggagccctctgtcctgaggaaagtgctgttggaggatgaggtcctggcggccatggtatcagtgatcggcaccgcaacgactcatctcagtcctgagttggctgcgcaatcggtaacccacatcgtgcctctgttcctggacggaaacgtgtctttcctgccagagaattcattcccgtcccgatttcagcctttccaagatgggtcatcaggtcaaagacggttgattgccctcctgatggctttcgtctgctccctcccaagaaacgtcgagatcccccagctcaaccagctcatgagggagctgcttgaattgagttgtactgctgcaccgttccttcccccgctcctgccatccgctctacaggattcgtctacttcaactcttcaaggttcatcgtggatgaatagttacagctag

SEQ ID NO: 16063 - DNA, 1128 bp, Artificial Sequence
  Description of Artificial Sequence: Synthetic coding sequence
atgaaacttgtgtggccatcagccaagcttctgcaggctgccgctggggcatctgccagagcctgcgattccgttacttccaacgtgctgccacttcttctggaacagttccataagcacagccagtcatctcagcgtcgcactatcctcgagatgctgctgggttttctcaagctgcagcagaaatggtcctatgaagataaggatcagagacccctgaacggttttaaggaccagctttgtagcctggttttcatggccctgacagacccatcaactcagttgcagctggtcggaatccggaccctcactgtgctcggtgcacagcctgatctcctctcctacgaagatttggaactcgccgtcggccatttgtaccggctttcattcctgaaggaggactcccagtcctgcagggttgctgcgctggaagcctcaggaactctagcagccctgtaccctgtggccttcagctcccaccttgtgcccaagctggccgaagagcttcgggtgggggagtctaaccttaccaacggtgatgagcctacccagtgctccagacacctgtgctgtctacaagcactcagcgctgtatcgacacacccgagcatcgtgaaggagactctcccactcctgcttcagcacctgtggcaggtgaatcggggcaacatggtcgcccaatcatcagacgtgatcgctgtgtgccagagcctccgccaaatggcagagaaatgtcaacaagatcctgagtcctgctggtatttccaccagactgcgattccatgcctgttagctttggccgtacaagcttctatgcctgagaaagagccaagtgtgcttcggaaagttctgcttgaggatgaagtgcttgccgccatggtgtctgttattggcacagctacaacccatttgtctcctgaattggccgcccagagtgtgacgcatattgtccctctttttctagacggcaatgtcagttttctgcccgagaatagcttcccaagcagatttcagccatttcaggtaactgacgggagtagtgggcagcgccggctcattgctctgctcatggcatttgtttgcagcttgccccggaacggctcatcctggatgaactcctattcatag

SEQ ID NO: 16064 - DNA, 1128 bp, Artificial Sequence
  Description of Artificial Sequence: Synthetic coding sequence
atgaagctggtgtggccctcagcaaaattgctgcaagctgccgccggcgccagcgcaagggcttgtgactctgtgacgtccaatgtgctccccctgctgctcgaacagtttcacaaacactctcagtcaagtcagaggcgcactatcttggaaatgctgctggggtttcttaaactgcagcagaagtggagttatgaagacaaggatcagcgccccctgaatggattcaaggaccagctgtgcagcttagtgtttatggccctgaccgacccttccacgcagctgcagctggtgggcattcgcacacttaccgtcctcggcgctcagccggatctgctgtcttacgaggatctagagctcgcagtggggcatctgtaccgactcagttttctcaaggaggattctcaaagttgtcgcgtcgctgctctggaagctagtgggaccctggccgcattgtacccagtggcgttctctagtcacttggtcccaaagctcgctgaagagttgagagtgggcgaatctaatctgacaaatggcgacgaaccgacccagtgttcacgtcacttatgttgtctgcaggcactgtccgcggtctctacacacccatccatcgttaaggagacgctccccctgctccttcagcatctttggcaggttaaccgcggcaacatggtggcccagtcttcagacgtgattgctgtgtgccagtctcttcggcagatggctgaaaagtgccagcaggaccccgaatcctgctggtactttcaccagactgccataccatgtctgcttgcattggctgttcaggcctcgatgccagagaaagagccatcagtgttgagaaaagtcctgctggaagacgaagtccttgccgcaatggtgagcgtgattggtaccgctacgacacacctctcacccgaactggctgcacagtcagtcacccatatagtgcctctgttcttagacggaaatgtgtcttttctgccggagaattctttccccagcaggttccagcccttccaggtcaccgacggcagcagcggccagcgacggctgatcgcgttgctgatggcatttgtgtgcagtctcccgcgaaacggatcgagctggatgaattcctatagttag

SEQ ID NO: 16065 - DNA, 2964 bp, Artificial Sequence
  Description of Artificial Sequence: Synthetic coding sequence
atggcagccgcggctgccgtggaagcagcggcccctatgggagccctttggggattagtgcacgattttgtggtcggtcaacaggaagggcctgctgatcaggtagctgctgacgtgaagagcggcaactatactgtgctccaggtcgtggaagcattaggtagctctttagaaaacccggagccccggactcgggcccgcgccattcaactactgtcccaagtgctcttgcactgtcacaccctgctcctcgaaaaagaagttgtccacctcatcttattttatgagaatcgcctcaaagatcaccatctcgtaatcccaagtgtcctacagggtcttaaggccctgtctctgtgcgtcgcactgcccccgggtctggcagtgtccgtgctcaaagccattttccaagaggtgcacgtgcagagcttgccccaggtggacagacatacagtgtacaacatcatcaccaatttcatgcgcacacgggaagaaggtcccttcgtggaggaactctttgaggtaacatcttgctattttcccattgactttacacccccgccgaatgatccacacggtatccaaagagaagatctgatactgagtctgcgggctgtgctcgcctccacccctcgatttgccgagttcctgctgccattactgattgagaaagtggattccgaagttctgtctgctaagctggatagcctgcagacactgaatgcgtgctgcgcggtctatggccaaaaagagcttaaggattttcttccatcgctatgggcatccatccggcgggaggtttttcagaccgccagtgaaagggtagaggctgagggactcgcagcacttcacagtttgaccgcctgtctgtcaaggagtgtcctgcgagcagacgcggaagatctgctggactccttccttagtaacattctgcaagactgtaggcaccacctgtgtgagcctgacatgaaattagtttggccaagtgctaaattacttcaggctgctgccggggctagtgcccgcgcttgcgactccgtcacctcaaacgttctccctctgctgctggaacagttccacaaacattcccagtcttcccagcgccgcacgattttggaaatgctgctcggatttctcaagttacagcagaagtggagctacgaggataaagaccagcgtcccttgaatggcttcaaggaccagttatgttctctggtcttcatggcactgacagacccctccactcagttacagctggtggggattcgcaccctgaccgtgttgggcgcgcagcctgacctcctgtcttatgaagatctggagctggcagtaggacatctctatcgtctttcatttctgaaggaggattcccagagttgtagagtggcagccctcgaggcgagtggaactctggcggctctttaccccgtagcattctctagccacctcgtgcccaaactggccgaagaactcagggttggtgaaagcaatttgacaaacggagacgagcctactcagtgctcgaggcacttatgctgtcttcaggccctaagcgcagtgagcactcatccgtccatcgtgaaggagacactaccgctgctgttgcagcatttgtggcaagtcaataggggcaacatggtcgcacagagttcagatgtgattgcagtgtgccaaagtctgcgccagatggcagaaaagtgccagcaggaccctgagtcctgttggtatttccatcagactgcgattccatgtttgctggcgctggcagtccaggctagtatgccagagaaggagccaagcgtgctccgcaaggttctgctggaagacgaggttctcgccgcgatggtgtccgtcatcggaacagcaacaacacatctgagccctgagctagccgcccagtccgtgacccacattgtgccgctcttcctggacggtaacgtgtcgtttctgccagaaaactcttttcctagtagatttcagcctttccaggacggttctagcggccagcgcaggctcatcgcgcttctgatggcttttgtgtgttcgcttccccgaaacgtagagatcccccagttaaaccagttaatgcgagaattactcgaactgtcttgttgccactcctgcccgttctcttcaacagccgccgctaagtgcttcgctggtcttttaaacaaacacccggcgggccagcagctggacgaattcctgcagctggcagtggacaaagtggaggctggcctgggatccgggccatgccgatcccaagccttcactctgctcttgtgggtgacgaaagctctcgttctacgctaccatcccctgtctagctgcctaactgcaaggctaatgggcctactgtctgacccagagctgggccccgccgcggcggatggcttttcccttcttatgtctgactgcacagatgtcttaaccagggccggccacgcagaagttaggataatgttcagacaaaggttcttcacggacaatgtccccgccttggtgcagggcttccatgctgcaccacaggacgtgaaaccaaactatcttaaaggtctttcccacgttctaaataggttgcccaagcccgtcttgctgccagaactgccaacactgcttagcttgctgctcgaggccctgtcttgtcccgattgtgtcgtgcaattaagtaccctcagttgtttgcagcccttactcttagaggccccccaggtgatgtctttgcatgtggacactttggtgaccaaatttctgaatctgagttcctctccctctatggccgtaaggattgctgcgctgcagtgtatgcatgctctgaccaggttgcctaccccagtcttactgccgtacaaaccacaagtgattcgggcactggcaaagccactcgatgataagaagcggttagtacgcaaggaggctgtttccgcaaggggcgaatggtttctcctgggatcaccaggcagctag

SEQ ID NO: 16066 - DNA, 3093 bp, Artificial Sequence
  Description of Artificial Sequence: Synthetic coding sequence
atggccgctgcagccgccgtcgaggccgccgcacccatgggcgccctttggggcctcgtgcacgacttcgtcgtcggtcagcaggagggccccgcggaccaggtggcagctgatgtcaagtctggtaactatacggtattgcaggtggttgaagcgcttgggtcgagtttggaaaatcccgagccccggacccgggcacgagccatccagcttttatcgcaggtcctgctgcattgtcacacactgttgctcgagaaagaggttgtccacctgattcttttctatgagaataggctgaaggatcaccatctggtgatccccagcgttctgcagggtttgaaggcactgtcactctgcgtcgcactgcctcctggcctggctgtgtctgtactcaaagctatcttccaagaggtgcatgtgcaatctctgcctcaggtcgatcgccatactgtgtacaatatcatcactaactttatgcgcacaagggaggaagagctgaaaagtttgggcgctgatttcacctttggcttcatccaggtcatggatggggaaaaggacccccgtaacctactcgtcgctttccggatcgtccacgatctcatatctagagactatagcctgggcccatttgtggaggagctcttcgaagtgacatcttgttatttccccatcgattttaccccaccccccaatgatccacacggcattcaaagggaggacctgatcctttcgctgagggccgttctggctagcactccacgtttcgccgaattcctgttacccctgctgatagagaaggtggactccgaagtgctctcagccaagctggattccttgcaaactctgaacgcgtgctgcgctgtgtatggccagaaagagctcaaggatttcctcccctccctgtgggccagcatccgaagggaggtgtttcaaacagcatcagagagagttgaggcagagggactggctgccctgcactctctcactgcctgcctgtctcgctccgtgctgcgggcagatgcggaggatttactggacagcttcctgtccaacatccttcaagactgccggcatcatctgtgcgaacctgatatgaagcttgtgtggccctcagcaaagctcttacaggcagctgccggcgcgtccgccagagcatgtgactccgtgacaagcaatgtcctgcccctgttgttggaacagttccacaaacactcccagtcgagtcagagaaggacaatcttagaaatgctgctcggattcctcaaactgcaacagaagtggagctatgaggacaaagatcagaggcccttaaacggttttaaggaccagctttgctctctggtgtttatggctctaactgatccctccacacagctgcagttagtgggcataaggacactgactgtcttgggagcccagcccgaccttttgtcttacgaggaccttgagctggctgtgggccatctgtatcgactatcttttttaaaggaagactcccaatcatgtcgagttgccgccttagaagcttctggtaccctggcagccctttatcctgtcgcgttttcgtctcatctggttccaaaactcgccgaggaactgcgggttggagagtctaacctaacaaatggtgacgagcccacacaatgttcacgtcacttgtgctgtctgcaggcgctgtctgccgtgagcacccacccttcaatcgtgaaagagacacttccacttctgttgcaacatctgtggcaggtgaacaggggaaacatggtcgcacagtctagcgacgttatcgcagtgtgccagtccctgcgccagatggccgagaagtgtcagcaggaccctgaatcttgctggtactttcaccagaccgctatcccgtgtctcctggctctggccgtccaggcgtcaatgcccgagaaggagccgtcggtcttgcgaaaggtgttattggaggacgaagttttagcggccatggtgtctgtcattggtacggctacaacccacctgtcgcctgaactggccgcacagagcgtcacccacatagtccccttgttcctcgacggcaatgtgagcttcctgcctgagaactcttttccatcccggttccagcccttccaggacggctcctccggacaacgcagattaatcgcactgctgatggcttttgtctgctccttgccgaggaatgtggaaatcccccagctaaaccaattgatgagggaactcttggagctgtcatgctgtcacagttgcccgtttagctccacagcagcagctaagtgtttcgccggtctgctgaacaagcatcccgcgggtcagcagctggacgagttcctgcaactggcggtggataaagtcgaagccggcctcggttccgggccgtgcagatcacaagcttttaccctgttattatgggttacaaaagcactggtgctgaggtaccaccctctatcgtcttgcctgactgcccggcttatgggtctcctgagtgatcccgagttagggccagccgcagccgatggtttcagcctgttgatgagcgactgtacagatgtgctgactagagctgggcacgccgaggtgaggataatgttccggcagagattcttcactgacaacgtaccagcactggtgcagggcttccatgctgctccccaagacgtgaaacccaattaccttaaaggtctgagccatgtgctcaatagactgccaaaacccgtactcctcccagagctacccactctgctgagtctgctgctcgaagccctcagctgccctgattgcgtagtgcagctgagcactctctcctgccttcagcctctactgctagaggcgcctcaggttatgtccctccacgtggatacactggtgacgaagttcctgaatctgtcttccagccccagcatggccgtgagaatagctgcgctccagtgcatgcatgcccttacccggctccctacacctgtgttgttgccgtacaagcctcaggtgattcgggcgctcgctaaacctttggacgataagaaacgcctagtgcgaaaggaggccgtctcagcccgaggcgagtggttcctgctggggtcgccaggctcatag

SEQ ID NO: 16067 - DNA, 3030 bp, Artificial Sequence
  Description of Artificial Sequence: Synthetic coding sequence
atggccgccgcagccgctgttgaggcagctgccccaatgggagctctgtgggggctggtccatgactttgtggtgggtcagcaggagggacctgcggaccaggtggcagcttcctccttagaaaaccccgaacccaggactagggcccgtgctattcagctcttgagtcaggtactgcttcactgtcacacactactgcttgaaaaggaagtggtgcatctgatcctgttttatgaaaacaggctgaaggatcaccatctggttatcccctcagtgctgcaaggactgaaggcactctcgttgtgtgtggctcttcctcctgggttagccgtgagcgtgttgaaggctatcttccaggaggtgcacgtccaggtcgacagacatacggtctacaatattatcaccaactttatgaggactcgcgaggaagagctgaagtcactgggtgccgacttcaccttcggcttcatccaggtgatggatggcgagaaagatcctagaaatcttctggttgctttccgaatagtgcacgatctcatctcgagagattactccctcggaccatttgtggaggagttatttgaggtgacctcctgttacttccctattgacttcacaccacccccgaatgatccccacggtatacagcgcgaagatctcattttgtccttgagggccgtactcgcctcaaccccccgattcgcggaattcctgctcccactgctgatcgagaaagtggatagcgaagtgctcagcgcaaaattagactccttgcagaccttaaacgcctgttgtgcagtttatggacagaaagagctcaaagattttcttccaagcctctgggcttccatcagacgcgaagtgttccagacagcttctgagcgcgtggaagccgaagggctggccgccctgcactccctgactgcctgtctgagccgtagcgtgcttagggccgatgctgaggatctgctggattcattcctcagtaacatccttcaggactgcaggcaccacctgtgcgaacctgacatgaagctcgtgtggccatccgctaagctactgcaagctgctgctggggccagcgccagagcgtgcgacagcgtcacctccaatgtcttaccactactcctggaacagttccataagcatagtcagtcttctcaaagaaggacgatacttgaaatgctgttgggcttcttgaagttgcagcagaagtggagctacgaggacaaggaccagcggccccttaatgggtttaaggaccagctgtgcagcctggtttttatggcgctgactgaccccagcacacagttgcagctcgtgggcatacggacacttacggtgctgggggcccagcctgacctcctcagctacgaggatcttgagctggctgtcgggcatctctaccgcctctctttcttaaaagaagattcccagagttgtagggttgcagctctggaggcgagcggcacgctggcggctctctatccagtggccttcagctcccatctagtccccaagttggccgaagagctgagagtcggggaatcaaacttgaccaatggagacgagcccacccagtgcagccggcatttgtgttgtctgcaggctctgagtgctgtgagcacccatccatctatcgtgaaggagacactgcctctgttattgcagcacttatggcaggtcaatagaggtaatatggtggctcagtcatcagacgtaatcgctgtctgccagtcgctgagacaaatggctgagaagtgccagcaagatcccgaatcttgctggtactttcatcagaccgctatcccctgcttactcgcactggcagtccaagctagcatgcccgaaaaagagccgagtgtgttgcgcaaagtgctgctcgaggatgaagtgttagctgccatggtgagtgttataggaactgccaccacccacctgagtcctgaactcgccgcacagtctgtcacacatatcgtgcccctgttcctggacggcaacgtgtctttcctgcccgaaaacagcttcccgtcgagatttcagccattccaggacggatcctccggacaacgacggctaatagcccttcttatggccttcgtatgcagtctccctcggaacgtggagattccccagctgaaccaactcatgagggaactactggagctctcatgctgtcattcttgtcctttctcttccaccgccgccgcaaaatgcttcgcagggcttttaaacaaacatcccgctggccagcagctggacgagttcctgcaactcgccgtcgacaaagtggaggcaggcctgggttctggtccctgcagatcacaagcgtttactctgttgctctgggtgacaaaggccttggtgctgagataccacccattgagcagttgtctcacagccaggttgatgggcttgctctctgatcccgagttggggcctgccgccgccgatggcttcagtcttctgatgtccgattgtacggacgttctgacaagggctggacatgcggaggtcagaattatgttcagacagcgtttcttcactgataatgtgccagctttagttcagggttttcacgccgctccccaagatgtgaagcctaactacttgaagggattaagtcacgtccttaatcgcctgcccaaaccggtcctactgcccgaattgcccacccttctgtcgctgttactagaagctttgagttgtccggattgtgtggtgcaactgagcaccctgtcctgtctccagcccctgctgctggaggcaccacaggttatgtctctgcacgtggacacactggttacaaaattcctgaatctgtcaagcagtccaagtatggcagtgcgaatcgcggcactacagtgcatgcacgctcttacaagactccctacgcctgtgctcttgccttacaaacctcaagtgattcgggcactcgccaaacctcttgacgacaaaaaacggttagttcggaaggaagccgtgtccgcccgcggagagtggttcctgctgggctccccaggatcatag

SEQ ID NO: 16068 - DNA, 3093 bp, Artificial Sequence
  Description of Artificial Sequence: Synthetic coding sequence
atggccgcagctgcagcagtggaagccgctgcccctatgggcgcattatggggcctagtacatgacttcgtggtaggacaacaggagggtcctgccgatcaggtagcggcagacgttaagagcgggaattacaccgttcttcaagtggttgaagccctaggaagtagcctagaaaaccctgagccccgcacccgtgctcgagccatacaactgctgagtcaggtccttctgcactgtcatacactgcttctagagaaagaggtggtgcatctgatcctgttctacgagaacagactgaaggaccaccatctggtgattccttccgtcctgcagggactgaaggcattgtccttatgtgtcgcgctcccgcccggtctggcagtgtcagttctgaaggcgatctttcaggaagtgcacgtgcagagtttacctcaagtcgacaggcacaccgtgtacaacattatcactaattttatgcggacaagggaggaagagctgaagagtttgggggctgacttcacctttggctttatacaggttatggatggggaaaaagatcctcggaacctccttgtagcctttcgtattgttcacgatttgatctcccgcgattatagtttgggcccctttgtggaggaactgtttgaagtcaccagttgctattttcccatcgatttcacaccgccccctaacgacccccatgggatccagagagaagacttgatcttatcactaagagccgtgctcgcgtcgacacctcggtttgcggaatttctcctccctcttctgattgaaaaggttgactcggaagtgctgagtgccaagctggactccctgcagaccctcaacgcctgttgtgcggtctacggacagaaagaactgaaggactttctgccgtctctgtgggcgtccatcagaagagaggtttttcagacagcttctgagagggtggaagccgaagggttggccgccctgcactcccttacagcgtgcctgagcaggtcggtcctaagggctgacgccgaagatcttctggactcttttctttccaatatccttcaggattgccgccatcacttatgtgagcccgatatgaaacttgtgtggccctctgccaaactgcttcaggctgcagctggggcttcagccagagcctgtgattcggtcacctccaatgtcctgccactgctcctggagcagttccataaacactctcagtcgagccagcgacgaaccatactcgagatgctcttgggtttcctgaagcttcagcagaaatggagctacgaggacaaggaccaaaggcccctgaacggatttaaggatcagttgtgctcgctcgtgtttatggccctgaccgatcctagtacccagctccagttggtaggtatacggacactaacggttctgggggctcaacctgacctcctcagctatgaggatctggagctggctgtgggccatctgtatcggctgtccttcctgaaggaggacagtcaaagttgtcgcgtcgcagctctcgaggcctccgggacactggccgcgctttaccctgttgctttctcttcacacctggtacccaagcttgccgaggaactcagggtcggtgagagtaacctcacaaatggcgatgagccaactcaatgcagtcggcacctgtgttgtcttcaagcattaagtgcggtgtcgacacacccttccatcgtgaaagagaccctacccttactcctccagcatttgtggcaggtcaacagagggaatatggtggcacaaagctctgacgtgattgcagtgtgccagtcactacggcagatggccgaaaagtgtcaacaagatccagagagttgctggtattttcaccagactgcgattccgtgtctactggcgctggcggttcaagcatctatgcctgaaaaagagcccagcgtgcttaggaaggttctgctcgaggatgaagtgcttgcagccatggtgtccgttatcggcacagcgacgactcatctgtcccccgaattggccgcccagtctgtgactcatatagtgcctctttttctcgatggtaatgtgagctttctcccagagaactctttcccaagcagatttcagccatttcaggacggctcgtcaggccagcgccgattaatcgcactgttgatggcctttgtatgtagcctgccaaggaacgtcgagatcccacagctaaatcagctgatgagggagttactggaacttagttgctgccacagttgtccttttagcagtaccgcggccgcaaagtgcttcgccggactgcttaacaaacacccggccggtcagcagcttgatgaattcttgcaactggctgtcgataaggtggaagcaggcctggggtctgggccctgtcgcagtcaggccttcaccttactcctctgggttactaaagccctggtcctgaggtatcaccccttgtcctcatgtctgaccgcccgactgatgggcttactttctgacccagaattgggacccgcagccgccgatggctttagtttgctgatgtcagactgtactgatgtgctgacaagggccgggcatgcggaggttcgcattatgtttaggcagagattctttaccgataatgtgccagccctggttcagggcttccacgccgcaccgcaggacgtcaagccaaactatttaaaaggtctgtcccacgtgttgaatcggctacccaagcctgtgctcctgccggaacttcctacacttctgtcacttctgttggaggctctgagttgtcccgattgcgtcgtgcaactgtcaaccttatcctgcctgcagccattattgctggaagcgcctcaggtaatgtccctccatgtggatacactagtgaccaaattcttgaacctgagttcctcacccagtatggcagtgagaattgccgccctgcagtgcatgcatgctctgacacggctgccaacccccgtgcttttgccatataagccacaggttatccgggcactggcgaagccactggacgacaagaagcgtctggtcaggaaagaggctgtttccgccagaggcgagtggttcctcctcggaagcccgggcagctag

SEQ ID NO: 16069 - DNA, 1734 bp, Artificial Sequence
  Description of Artificial Sequence: Synthetic coding sequence
atgcctaaaacaattagtgttagagtgactactatggatgccgaactagaatttgctatacaacccaacacaacaggaaaacagctctttgaccaggtggttaaaaccatcggcttaagggaagtctggttcttcggtttgcaataccaggacacaaaaggcttttctacctggctgaaactcaacaagaaagtgacagctcaggacgttcgcaaggagtcaccgctgctgtttaagtttcgggccaagttctatcccgaagatgtgtccgaagagcttatccaagacatcacccagcggctgtttttcctccaagtgaaagagggtatcctgaacgacgacatctattgtccccctgagacagccgtgctgctggcctcctacgccgtccagtcgaagtatggagattttaataaagaggtgcacaaatcgggataccttgccggcgataagctcctacctcagagggtgctcgaacagcataaactgaacaaggaccagtgggaagagcggatacaggtgtggcacgaagaacacagaggcatgctccgggaggatgctgttctggagtatctgaaaatcgcccaagacctcgagatgtatggggtgaattatttctcaatcaagaataagaagggatcagagctgtggttaggagtcgacgcactcggattgaacatatacgagcagaacgaccgacttacgcccaagattgggttcccttggagtgaaatcagaaatatctcgttcaacgataagaaattcgtgatcaagcccattgacaagaaagccccggatttcgtattttatgccccccgcctgcgaatcaataagaggattcttgccctatgcatgggaaatcacgaattatacatgcggagaaggaaacccgataccattgaggtacagcaaatgaaggcccaagcgagagaggaaaaacaccagaagcaaatggagagagcaatgttggagaatgaaaagaaaaaaagggaaatggcggagaaagagaaagagaagatcgagcgggagaaagaagagctgatggagcgtttgaaacagatcgaagaacagacaaaaaaggcacagcaggaactggaggagcagacccgccgagccttggagctcgagcaggagagaaagagggcccaaagtgaggctgagaaattggcaaaggaacgtcaggaggcagaggaagcgaaggaggctctgctacaggcatcacgcgaccagaagaagacccaggagcaactggctctggagatggctgagctgacagcccggatctctcagctggaaatggcccgacaaaaaaaagagtccgaggcagtcgaatggcagcagaaagcacaaatggtacaggaggatctggagaaaacccgcgcagagttgaaaaccgcaatgtctactccccacgttgctgagccagccgagaatgaacaggatgaacaggacgagaatggggcagaggcaagcgctgacctgcgagccgatgccatggccaaggataggtctgaagaggaacgcacaaccgaagctgaaaagaatgagagagtgcagaagcatctgaaagccctcacctcagagctggctaatgccagggacgagtctaagaagaccgctaatgacatgatccatgccgagaacatgcgtctcggacgcgataaatacaagactcttcgtcagatcagacagggtaatactaaacaacgcatcgacgagttcgagtctatgtag

SEQ ID NO: 16070 - DNA, 717 bp, Artificial Sequence
  Description of Artificial Sequence: Synthetic coding sequence
atgcgctttaaaaaccgatttcagaggttcatgaatcacagggcaccagcaaacggccgctataagccaacttgctacgagcacgccgctaattgttacacacatgcatttcttatcgtccctgccatagttgggtccgccctgctgcaccggctctctgacgattgttgggaaaaaatcactgcctggatttacggaatgggactgtgcgccctttttatcgtctctaccgtgttccatatagtgagctggaagaagtcccatttacgcacagtggaacattgtttccacatgtgtgatcgcatggtaatatacttcttcatcgccgcttcatatgccccttggctgaatctgcgcgaattgggccctctcgcttcacacatgagatggtttatatggctgatggcagccggtggcacgatctacgtcttcttgtaccacgagaaatataaggtggtggaactgttcttttatctcacaatgggattctccccggccctggtggtgacctccatgaataatacagatgggctgcaggaactggcctgcggaggcttaatctactgcctcggtgtggttttctttaaaagtgatggcattattcccttcgcccatgccatctggcaccttttcgtggccacggcagctgcggtgcactactacgcgatttggaagtacctgtacaggagtcccacagacttcatgcggcacttatag

SEQ ID NO: 16071 - DNA, 2127 bp, Artificial Sequence
  Description of Artificial Sequence: Synthetic coding sequence
atgtctacagccgacgcccttgacgatgagaacaccttcaagatcttggttgcaaccgatattcacctaggattcatggaaaaagacgccgtcagaggtaatgatacctttgtcacgctggatgagattctccgccttgcccaagaaaatgaagtggattttattttgttgggaggtgatttatttcacgaaaataagcctagtcggaagactctccacacctgccttgagttactacgaaagtattgcatgggagaccggcctgttcagtttgaaatactgtccgaccaaagtgttaacttcgggttctccaaattcccttgggtcaactatcaggacggaaatctcaacatttccatcccagtttttagtattcatggcaaccatgacgaccccaccggcgccgatgcactgtgtgctttggatattctctcctgcgccgggttcgtgaatcacttcggaagatcaatgtctgttgaaaaaatcgacatctctccagtcctccttcagaaagggtcaactaagatcgccttgtacggtctgggctcaattcccgacgaaagactctatagaatgtttgtgaacaagaaggttaccatgctgagacccaaggaagacgagaattcctggttcaacctgttcgtgatacatcagaaccggagtaaacatgggtccactaacttcatccctgaacagttcttagacgactttattgacctggtgatatggggacatgagcacgaatgcaagatcgcccctactaagaacgagcagcagctcttttacatctcacagccaggttcgagcgtcgtgacatctctgagtcctggcgaagctgttaaaaaacatgttgggctgctgcgtattaagggacggaagatgaacatgcacaaaatccctctgcacactgtccggcagttctttatggaggacattgttctcgccaatcatccggatattttcaaccctgacaatcccaaggtgacccaggctatccaatccttttgcctggaaaagatcgaagagatgctcgagaatgccgagcgcgagaggcttggaaactcacaccagcccgagaaaccgcttgtgcgcttgagagtggattacagtggcggatttgaacccttcagcgtgctccgattttcccagaagttcgtcgaccgcgtggctaaccccaaggatattattcacttctttcgacaccgagagcaaaaggaaaagactggtgaagagattaatttcggcaagctcatcaccaagccctccgaagggactacactgcgggtggaagacttggtcaagcaatactttcaaaccgccgaaaagaacgtgcagctgtccttgctcaccgaacgcggcatgggggaggctgtacaggagttcgtggacaaagaagaaaaagatgccatcgaggagttggtaaagtatcaactggagaagacgcagcggtttctgaaagagcgacacatcgatgctctcgaagacaagatcgacgaagaggttagacgcttcagagaaacccggcagaaaaacacaaatgaagaggatgacgaggttcgggaggctatgactagagcgcgcgccctgagatctcagtctgaggagagcgcttctgcctttagcgccgacgacctgatgtctattgatctagcggagcagatggcaaacgactcggacgatagtatttctgccgccaccaacaaaggaagaggtcgcggccggggcagacgcgggggaagggggcagaactccgcatctcgtggcggcagccagagaggaagagccgacacaggacttgagacatctacaagatcacgcaactcgaagaccgcagtttctgcctcgcgtaacatgtccattatagacgcttttaaaagtacaagacaacagcctagccggaacgtcaccactaagaactactctgaggtcatcgaggtagatgagagtgacgtggaggaagatatattcccaaccacatccaaaaccgaccagcgctggtcaagcacttcctctagtaagatcatgtcacagtcgcaagtcagcaaaggtgtagattttgagagctccgaagatgacgacgatgaccccttcatgaatacatccagcttgagacggaataggcggtag

SEQ ID NO: 16072 - DNA, 2043 bp, Artificial Sequence
  Description of Artificial Sequence: Synthetic coding sequence
atgtcgaccgccgatgcactggacgacgagaacacatttaaaatacttgtagctactgacatccatctgggatttatggagaaagacgcagttaggggaaatgatacgttcgtcaccttggacgaaatcctgagactggcccaggaaaatgaagttgatttcatccttctggggggagaccttttccatgaaaataagccttcccgcaagaccttgcacacttgcttagagttgttgagaaaatactgtatgggcgaccgacccgtacagttcgagattctatccgatcagagcgtcaattttgggttttctaaatttccttgggttaactatcaggatggaaatttaaacatttctatcccagtgttctctatccacgggaatcacgacgaccccactggagcagacgctctgtgcgctcttgatattctgagctgcgcaggcttcgttaaccactttggccgatccatgagtgtggaaaagattgatatatcgcccgtccttcttcagaagggatccaccaagattgctctctatggcctaggcagcatacctgacgagagactgtaccgaatgtttgtgaataagaaggttaccatgctgaggcccaaggaagatgagaacagctggttcaacctatttgttatccaccagaatagatctaagcatggtagcactaacttcatcccagagcagtttctcgacgattttattgatctggtaatctggggtcacgagcatgaatgtaagatcgcaccgactaagaatgaacaacagctcttttatattagccagcctggatcttctgtggtgacttcactcagccccggggaagccgtcaaaaagcatgtcgggctattacggatcaaaggtcgcaagatgaacatgcataaaattcctctgcacactgtgagacagttctttatggaggacatcgtacttgccaatcacccagacatcttcaacccggataatcctaaagttacacaggctatccaatccttttgtctggagaagatagaagaaatgctcgagaatgctgagcgcgaaagactcggaaattcccaccagccagagaaaccactggtgcgcctacgggtggactacagcggcggcttcgaaccgtttagtgtacttcgcttttcgcagaagtttgttgatagagtagccaaccctaaggacattatccatttctttaggcatagagaacagaaagaaaagacgggcgaggagatcaattttggaaagctcatcacaaaaccgagtgaaggcaccactttgagggtggaggacctcgtgaaacaatactttcaaactgccgagaagaatgtccagctttcacttctgacagaaagagggatgggcgaggcagtgcaggagttcgtcgacaaggaagagaaggatgctattgaagagctggtgaaatatcagctcgagaaaacacagcggtttctgaaagagcgtcatatagatgccctggaggacaagatcgatgaggaggttcggcgtttccgtgagactaggcagaagaacaccaatgaagaagatgatgaggtgcgagaagcgatgactcgcgcccgggcattgcgctctcagagtgaggaatccgccagtgccttcagcgcagatgacctaatgagcatcgatttggccgagcagatggcaaacgacagcgacgattccattagcgccgccacaaataaaggaaggggcagaggtagaggccgtaggggcgggaggggccagaattccgcctcccggggggggtcacagcgaggtcgcgctttcaaaagcacccgacagcaaccaagccggaacgttacaaccaaaaactactccgaggtaattgaggttgacgaatctgatgtagaggaggacatttttccaaccacgagtaagacagaccaaaggtggagtagcacttcctccagtaagataatgagtcagagtcaggttagtaagggcgtggattttgagagtagcgaggatgatgatgacgacccatttatgaatacctcttctctccggcgcaaccgccgctag

SEQ ID NO: 16073 - DNA, 2124 bp, Artificial Sequence
  Description of Artificial Sequence: Synthetic coding sequence
atgtccacagccgacgctttggatgatgaaaatacctttaaaattcttgtggccaccgatatccacctagggtttatggaaaaagacgctgtgaggggaaatgacacctttgttactctggatgaaatccttagattggctcaggaaaacgaggtggatttcattctacttggaggggatctgttccacgagaataaaccctctaggaagacgctgcatacctgtctggagctgctcagaaaatattgtatgggggaccggcccgtgcaattcgagattttatctgatcagagtgttaacttcggatttagcaagtttccttgggttaactaccaggacggcaatctgaatatcagtattccggtttttagcatacatggcaaccatgatgatcctaccggagccgacgcactgtgcgccttggacatcttgtcctgtgcaggctttgtaaaccatttcggccgaagtatgtccgtcgagaaaattgacataagtccagtgctactccagaaggggtcaacgaagatcgccttatacggcttggggtccatccctgacgaacggctctacaggatgtttgtgaacaaaaaggtcacaatgctccgacctaaagaagatgagaattcctggtttaatctcttcgtaatacaccagaataggagcaagcatggttcaactaatttcatccctgagcagttcttggatgactttattgacctcgtcatctggggacatgaacatgagtgtaaaatcgcaccgaccaaaaatgaacaacagctcttctacatttcccagcccgggtcaagcgtggtaacaagtctgtccccaggagaggcagtgaagaagcatgttgggctgctgaggataaagggccggaaaatgaacatgcacaagattccactgcacacggttcgccagttcttcatggaagacatcgtcctggccaatcacccagacatctttaaccccgacaatcccaaagttacgcaagctattcagagtttctgtctcgagaagattgaagagatgctcgagaacgcagagagggaacgcctcggaaattcacatcagccagaaaaaccactggtgagattgagagtggactactcaggtggatttgagccattctcagtgcttagattttcgcaaaagttcgtggatagagtcgccaatccaaaggacatcattcacttctttcgccatcgggagcaaaaggaaaagactggagaagagataaactttgggaaacttataaccaagccctcagaaggcacgacccttcgcgtggaagatctcgtgaagcagtacttccagacagcagagaagaatgtgcagctgagtctgctcaccgaaagggggatgggcgaggccgtccaggaattcgtggataaagaggaaaaggatgcgattgaggagttagtgaagtaccagctggagaagacgcaacggtttctgaaagagcgtcatatcgacgcccttgaggataagattgatgaggaagtgcggcgttttagagaaactaggcaaaagaataccaacgaagaggatgacgaagttcgggaagcaatgacaagggcccgcgccctgagaagccagtctgaggaatccgcatcagcattttccgctgatgacctcatgagtatcgatctggctgagcagatggcgaacgactccgatgactccatttctgccgccactaataagggtcgcggcagaggcaggggtagaaggggaggaagaggacagaactctgcttcacgaggcggctcacagcgggggcgagacacaggcctggagaccagtaccagatcccgtaacagtaagaccgccgtgtcagccagccgaaatatgtccatcattgatgcctttaaatccacaagacagcaaccttctcgcaatgtaaccactaaaaactactccgaggtgatagaggtcgatgagagcgatgtcgaagaagatatatttcccactacctccaagacagatcagcgctggtctagcacgtcttcaagcaagatcatgtcgcaatcccaggttagtaagggggtcgactttgaatcctcggaagacgacgacgatgacccattcatgaatacatcgtcactgagacgaaatcgtcgttag

SEQ ID NO: 16074 - DNA, 2136 bp, Artificial Sequence
  Description of Artificial Sequence: Synthetic coding sequence
atgaatcgcaacatcagtcatcaaaaaggcgacgatgaaaatacttttaaaattctggtcgccaccgatatccacttaggttttatggagaaggatgcagtaaggggtaatgacaccttcgtcacactggacgagatcttaagactggcgcaggaaaatgaagttgattttattcttctgggtggggacctctttcatgaaaacaagccctcgagaaaaactctccatacctgtctcgaattgttgaggaagtactgcatgggtgacagaccagtccagttcgagattctgtccgaccagagcgtcaatttcggatttagcaaattcccgtgggtcaactatcaggacggcaacctgaacatctcaatccccgtgttctccattcatggcaaccacgacgaccctaccggagctgacgccctctgcgctttggatatactgtcatgtgcgggtttcgtgaaccacttcggacgttccatgtccgtggagaagatcgatatttctccggtactcctgcagaagggatccaccaaaattgctctctatggtctcgggagcatcccggatgaaaggctttaccgaatgtttgttaacaagaaggtcacaatgctacggccaaaggaggacgagaattcatggtttaacctcttcgtgattcaccagaatagaagcaaacacgggtctactaatttcattcctgaacagtttctggacgacttcatcgatttggtgatctgggggcacgaacacgaatgtaagatagcgcccacaaaaaacgaacaacagctgttttatattagtcagccgggcagcagtgtggttacatccctgtcaccaggtgaggctgtgaaaaaacacgtggggctgctccgtataaaggggcgcaaaatgaacatgcacaaaattcccctgcacaccgtgcggcagtttttcatggaggatatcgtgctcgcaaaccatcctgacatattcaacccagacaatcctaaggtgacacaggcgattcaatccttctgtctggagaagatagaggagatgctggagaacgccgaaagagagcgccttggcaattcacatcaacccgaaaagccactggtgaggctgagggtcgactactcgggagggtttgaaccgttctctgtgctgaggttcagccagaagttcgtcgaccgggtggctaaccccaaggacattatccatttttttaggcatcgggagcagaaagaaaaaacaggtgaagaaatcaactttggcaagctgattacaaaaccaagcgagggtaccaccttacgggttgaagaccttgtgaagcaatacttccagactgccgaaaagaacgtacagctatcactgttaacagaaagaggaatgggggaggccgtgcaggaattcgttgacaaagaggagaaagacgcaattgaggagctcgtgaagtaccagttagagaagactcagaggttcctgaaggagcgtcatattgacgccttagaagacaagatagacgaagaggtgaggagatttcgcgagaccagacaaaaaaatactaacgaagaggatgatgaagtacgcgaggcaatgacaagagcccgtgccctaaggtctcagtctgaggaatcagccagtgcattctcagcggacgaccttatgagtattgatctcgcagaacagatggcaaatgattcagatgattcaatttctgctgcaactaacaaggggcggggtagaggtagaggacgccgcggtggtcgagggcagaactccgccagccgcggcgggtcacaacgcgggagggctgataccgggctggaaactagtaccaggagccgcaattccaagacagccgtctctgcctctcgaaacatgagtataatcgacgcttttaagagcacccggcaacagccctcccggaatgtgacgactaaaaactactcggaagtgatagaagtggatgaatccgatgtggaagaggatatctttcctactacatcgaaaactgaccagcgttggtcatccacctcttctagcaagattatgtctcagtcccaagtttccaaaggagttgacttcgaatcaagtgaggacgatgacgacgacccattcatgaataccagctcccttaggcgtaataggaggtag

SEQ ID NO: 16075 - DNA, 384 bp, Artificial Sequence
  Description of Artificial Sequence: Synthetic coding sequence
atgtcaaccgctgacgccctggatgatgagaacaccttcaagatcctagtagcgaccgatatacacctaggcttcatggaaaaggacgccgtgagaggtaacgataccttcgtgaccttggacgagattctacggcttgctcaggagaacgaggtggatttcatcctcttaggcggtgacctgtttcatgaaaacaaacccagtaggaaaactctccatacatgcttggaactattacggaaatactgtatgggcgaccggccagtccagttcgagattctgtccgatcaatccgtgaacttcgggttctctaaatttccctgggttaactaccaggacgggaatctgaacattagcatccccgtttttagcatccatggttag

SEQ ID NO: 16076 - DNA, 336 bp, Artificial Sequence
  Description of Artificial Sequence: Synthetic coding sequence
atgtccaccgcagatgctttagatgatgaaaacaccttcaagattcttgtggcaaccgatatccatctgggtttcatggagaaagacgcagtcaggggaaatgataccttcgtgacactggatgagatcctccggctagcgcaggagaacgaagttgattttattcttcttggaggtgacctgtttcacgagaataagccatcacgcaaaacactgcatacttgtttagaattgctgaggaagtactgcatgggcgatcgcccagtgcaatttgaaattctctctgatcaaagcgtgaattttgggttctcaaaattcccctgggtcaattactag

SEQ ID NO: 16077 - DNA, 666 bp, Artificial Sequence
  Description of Artificial Sequence: Synthetic coding sequence
atgtctaccgcagatgctctagatgatgagaacaccttcaaaattctggtggccaccgacatccacttgggcttcatggaaaaagacgcggttagaggaaacgacaccttcgtgaccttagacgagattctgcgcctagcacaggaaaacgaggtggatttcatactccttggcggcgacctgttccacgagaacaagccctcacgcaagaccctgcatacgtgcttggaactcctgcgtaagtattgcatgggagatcgccctgtccaattcgagatcctgtcagaccaatccgtgaattttggtttcagtaaattcccatgggtgaattatcaggacggcaatctgaatatttctattcctgtcttctccatccatggtaaccacgacgaccccactggggccgatgcgctatgtgccttagatatccttagctgtgccggcttcgtcaaccacttcggtcgaagcatgtccgtagaaaagatagacattagtcccgttctgctgcagaaagggtctacgaagatcgcactgtacgggcttggatccatcccagacgagcgcctgtatagaatgtttgtcaataagaaggttacgatgctcagacctaaagaggatgaaaactcgtggtttaacctattcgtcattcaccagaacagggtgtag

SEQ ID NO: 16078 - DNA, 822 bp, Artificial Sequence
  Description of Artificial Sequence: Synthetic coding sequence
atgacaccaggcactcaatctccgttcttcttattgctgctgttgacagtcttgaccgttgtgacagggtccggccatgcaagctcaactcctgggggggaaaaagaaaccagcgctactcagcgcagcagcgtcccctcctccaccgaaaagaatgccctgtctactggcgtgtctttctttttcctgagtttccacataagcaatttacaattcaattcaagcttagaggacccatccacagattattatcaggaattgcagcgcgacatctctgagatgtttctccagatatataagcaggggggctttttaggtctctcaaacatcaagttccgaccagggagtgtagtggtacaactcaccctggcatttcgtgaaggcacaatcaacgtgcacgacgttgaaacacagttcaaccagtataagaccgaggctgcttcacgctacaatctcacaatctctgacgtgtcggtgagcgacgttccattccccttcagcgctcaaagcggagccggtgttcctggctggggcattgcactgctagtcctagtctgtgtgcttgtggctctggccatcgtgtacctgatcgcgctcgctgtttgtcagtgcaggcgaaagaactacgggcagcttgatatattccctgcaagggatacataccatcccatgagcgagtatccaacttatcacacccacggcagatacgttcccccttcttccacagaccggtccccatatgaaaaggtgagcgccgggaatggaggctccagcctttcctataccaatcctgctgtggcagcaacttctgccaacctgtag

SEQ ID NO: 16079 - DNA, 675 bp, Artificial Sequence
  Description of Artificial Sequence: Synthetic coding sequence
atgacacccggcacacagagtccattctttctgctgctcctactaacagtgcttaccgccaccacagctcctaaaccggctactgtggtgaccggtagtgggcacgcgtcaagtacaccaggcggagagaaagagacctccgcaacacaacgatcaagtgtgccgtccagtaccgagaagaacgcctttcggcctggaagcgttgtagtccagctcaccctggctttcagggagggcacaattaacgttcacgacgtggaaacacaattcaatcagtataaaacagaggccgcctcaagatacaacctcactatatctgatgtctcagtgagtgacgtaccctttccttttagcgcccagagtggagctggagttccgggctggggaatagccttacttgtgctcgtatgtgtgctcgttgccctggccatagtctacctgatagccttagctgtttgtcaatgccgaaggaagaattatgggcagctagacatttttcccgcgagggatacataccacccaatgtctgagtatcccacttatcatactcatggaagatatgtgccccccagttctaccgataggagcccatacgagaaagtcagtgcggggaatggcggttctagcttaagttatacgaaccccgcagtggccgccacctcagccaacctgtag

SEQ ID NO: 16080 - DNA, 501 bp, Artificial Sequence
  Description of Artificial Sequence: Synthetic coding sequence
atgactcctggaactcagtcaccttttttccttttgttgctgctcactgtccttacagcgaccacagcaccgaagccagccacagtggtgacaggctccggccatgcatcttctacaccagggggagaaaaagagacgtccgcaacccaacggtcaagcgtgcccagttccactgaaaagaatgcaagcggagcgggtgttcccggatggggaatcgccttactggtgcttgtgtgcgtgctggtcgcactagctatcgtgtatctcatagctctggcagtgtgtcagtgcagaaggaagaattatggccagctggacatctttcccgccagagacacctaccaccccatgtctgagtaccccacctaccacactcatggtcgttatgtcccgccatctagcaccgaccgcagtccatacgaaaaagtgtctgctggcaatgggggtagctccctctcgtatacaaaccccgccgtggccgccacttctgctaacctgtag

SEQ ID NO: 16081 - DNA, 612 bp, Artificial Sequence
  Description of Artificial Sequence: Synthetic coding sequence
atgactccaggaactcagagcccttttttcctgctgctgttgttgacagtgttgacagttgttactggttccggtcatgcttccagcacccccggcggcgaaaaggaaaccagcgcaacccagagatccagtgtaccctcatccactgagaagaacgctatccccgcgcctaccactactaagagctgcagagagacctttcttaaatgcttctgtagattcattaataaaggagttttctgggcatcacctatactttcatcagtatccgacgtgccttttcctttctcagcgcagagcggcgccggagtgcccggttggggtattgcccttctcgttctggtgtgcgtgcttgtggcgctcgccattgtgtatctcattgcgctcgccgtctgccagtgtagaaggaagaattatgggcaactggatatcttcccagccagggacacttaccaccctatgtcagagtatcctacatatcacacgcacgggagatatgtccccccatcctcaacagatcgctccccttacgaaaaagtcagtgcgggcaatgggggatcttcgctgagctacactaacccggccgtggcggccacaagcgccaatctgtag

SEQ ID NO: 16082 - DNA, 507 bp, Artificial Sequence
  Description of Artificial Sequence: Synthetic coding sequence
atgacacccggcactcagagcccattcttcctccttctcctcttgaccgtactgacagtagtgacagggagtggacacgctagcagcacacccggcggagagaaggagacttccgcaacccagcgcagctcagtgccttccagcacagagaaaaacgcactgagcacaggggtgtctttctttttcctgagcttccacatttcaaacctgcaatttaactcatctctcgaagatccctcaacagattattatcaggagttgcagcgggacatttccgaaatggctgtgtgccaatgccggaggaagaactacggacagctggacattttccctgccagggacacctatcaccccatgtcagagtacccaacttaccatacccatggcaggtacgtacctccttcttccacagacaggtccccttacgagaaggtttcagctggcaacggagggagcagcctgtcttacacaaatccagctgtcgccgcgacttcagcaaacctgtag

SEQ ID NO: 16083 - DNA, 768 bp, Artificial Sequence
  Description of Artificial Sequence: Synthetic coding sequence
atgacgccaggcactcagagccccttttttttgctgcttctcttgactgttctgactgtcgtcactgggtccggtcacgcctcctctacgccaggtggtgagaaggagactagtgccactcagcgcagctctgtgccctcatccacagaaaaaaacgcgttcaattcctccctcgaagaccctagtacggactattaccaagagcttcagcgtgatattagcgaaatgtttctgcagatttacaaacaggggggcttccttggactgtctaatatcaagttccgcccaggatcggtggtggtgcagctcacactcgccttccgagagggaacaatcaacgtgcatgacgtcgaaactcagtttaatcaatataaaacggaagctgcctccagatataatttgacaatctccgacgtgagcgtcagtgacgtgccctttcctttttcggcccagtccggcgctggggtgcccggatggggcatcgctctgttggtgctggtttgcgttctggtggccctggccatcgtctatcttatcgcactggcggtgtgccagtgtcgccgcaaaaattacggtcagctggatatcttcccagccagggatacatatcacccaatgagtgaatatccaacgtatcacacgcatggaagatatgtacctccctctagcacagacaggagtccctatgaaaaagtgtccgctggtaacggcggtagcagcctttcctatacaaatcctgcagtagcggcaacctctgccaatctgtag

SEQ ID NO: 16084 - DNA, 795 bp, Artificial Sequence
  Description of Artificial Sequence: Synthetic coding sequence
atgacacccggaacacagagccccttttttctgctgttgctccttaccgtcttgaccgctaccaccgcccctaagcctgcaacagtagtgaccggaagtggccatgcgtcctcaaccccaggcggcgagaaggagacaagcgcgacacagagatcatccgtgccctcttcgactgagaagaacgcttttaatagctctttagaggatcctagcaccgattactaccaagagttgcagcgagacatctcggagatgttcctgcagatatacaaacaaggaggcttcctgggcttgtctaacattaaattccgccctgggtctgttgtggtgcaactgactctagcattcagagaggggaccattaacgtgcatgacgtcgaaacccagtttaaccaatataagacagaagcagcatcccggtataacctgaccataagtgatgtctcggtgtccgacgtgccgtttccctttagtgcccaaagcggagccggagtgcctgggtggggcatagctctgttggtgctggtatgtgttcttgtggcactcgctattgtgtacctcattgccttggcagtttgtcagtgccgccgaaagaactatgggcagcttgacatcttccccgcacgcgatacataccatcccatgagtgagtatccaacttatcacacacatggaaggtatgtccctcctagcagtaccgatcgatcaccctacgagaaggtcagtgccggaaatggcgggtcgagcctctcctacacaaacccagctgtcgctgccactagtgccaatttgtag

SEQ ID NO: 16085 - DNA, 597 bp, Artificial Sequence
  Description of Artificial Sequence: Synthetic coding sequence
atgacccctggtactcagtccccatttttcttactccttctgctgaccgtgttgacagtggtcaccggcagcggccacgcaagttccacgcccggcggcgaaaaggaaacgagtgcgacccaaaggagttctgttccaagctctacggaaaagaacgctttgagcactggcgtcagttttttcttcctgtcttttcacatcagcaacctgcagtttaattcctctctggaagatcccagtactgattactatcaggaacttcaaagggatatttctgagatgttccttcaaatttataagcagggcggctttctggggctcagtaatatcaagtttagacccggctccgttgtggtacagttgactctcgccttcagagaagggacgattaatgtgcatgatgttgagacgcagttcaatcaatacaagacagaggcagctagtagatacaacttaacgatttcggatgtgagcggttgcctgtctgtcccaccgaaagagctgcgggccgctggccatctgtcctccccgggctacttgccctcctacgaaagggtcccgcacctgccccatccctgggctctgtgtgcgccctag

SEQ ID NO: 16086 - DNA, 1428 bp, Artificial Sequence
  Description of Artificial Sequence: Synthetic coding sequence
atgaccccgggcacccaatctccctttttccttctgttgctcctgaccgtgttgaccgtggtgacgggctctggacatgcgagttccacaccgggaggcgaaaaggagaccagcgcgactcagagaagcagcgtcccttctagtacagagaagaatgccgtgtccatgacttcctcagttctgtcgagccactccccagggtccggctcctctacgacccaggggcaagatgtgactctcgcgcccgcaactgagcctgccagcggaagtgcagccacatggggtcaggacgttaccagtgttcccgttactaggcctgcattgggatcaaccactccacctgcccacgatgtcacctctgcgccagacaataaaccggctccaggatctactgcccctccggctcatggggtaacctctgcccccgacacccggcccgcacctggaagcacagccccccctgcacacggtgttacatccgccccggataatagaccggccctgggctccactgctcccccggtacataatgtcacatcagcatcaggtagtgcttccggctcagcctcgacactggtgcacaatggaacatctgctagggccactaccacacctgcttctaaatcaacaccattttctattccatctcatcattccgacaccccgacaacactcgcctcgcactccaccaagaccgacgcctcttcaacgcaccactcaactgtgcccccacttaccagttctaaccatagcactagccctcagctctccaccggtgtgtcgttcttttttctctcattccacatttctaacctgcaatttaacagttctctggaagatccgtccacggactattaccaagaactgcaacgggacatcagcgaaatgtttctccaaatctataagcagggtggttttttgggcctcagcaatattaaattccggccgggctctgttgttgtgcagttaacactcgcatttcgggaaggaactattaacgtgcatgacgtggaaacacaatttaaccagtacaaaacagaggcggcttcccgttataatctgaccatctctgatgtgagtgtctctgatgtgccattcccttttagcgcacaatctggtgctggggttccaggttgggggattgccttactggtcttggtctgcgtgcttgtggccctggctatagtatacctcatcgcactcgcagtttgccagtgtcgccggaaaaattatggtcaactggacattttcccggcccgcgacacttatcacccgatgagtgagtacccgacttaccacacacacgggagatacgtgcccccatcctctacagacagaagtccttatgagaaagtgtccgctggtaatggcggttccagtctcagttatacgaatcctgccgtcgctgctaccagcgcaaatctatag

SEQ ID NO: 16087 - DNA, 480 bp, Artificial Sequence
  Description of Artificial Sequence: Synthetic coding sequence
atgacgcctgggacccaatcccctttcttcttattactgctgcttacagtgctgactgcaaccacggcacccaagcctgccactgtggtgaccggctctggccatgcgtcaagtactccgggcggggagaaagagacatccgccacacaaagatcttcagtgccgtcctccacggagaagaatgcctttaactcaagcctcgaggacccatctactgattattatcaagaattacagcgcgacatttccgaaatggctgtctgccaatgtagacgcaagaattacggccagctggacatctttccggccagagatacatatcatccaatgtccgaataccccacctatcacactcatggccgctatgtcccccctagctccacggaccggtctccttatgaaaaggtgtctgcaggaaacggcgggtcttctttgtcctacacgaaccctgcagtggccgctacaagcgcgaacctttag

SEQ ID NO: 16088 - DNA, 693 bp, Artificial Sequence
  Description of Artificial Sequence: Synthetic coding sequence
atgactccgggtactcaaagcccatttttcctcctcctcctgcttacggttttgacagtcgtgactggcagcggccatgcctcctccactcctggtggcgagaaggaaacctcagctacccagcggtccagcgttcctagttcaaccgaaaaaaatgccattccagcacctacgactacaaaaagttgccgagaaacatttctcaagtggcccggcagcgtggtggtgcagttgactctagctttccgcgagggcacaattaacgtgcatgacgtagagacgcagttcaatcagtacaagaccgaggccgcatcccgctacaatctgactatatcagatgtgagcgtgagtgacgttccgttcccctttagcgcgcagagcggggccggcgtgcctgggtggggaatagcattacttgtacttgtatgcgtgcttgtcgctctggcaatcgtctacctgatcgcgctggcagtatgccagtgcaggcgaaagaattacggtcaactggatatcttccccgccagagatacttaccacccgatgtcggaataccccacttatcacacacacggacgctatgtcccaccttcatctactgaccgatccccgtatgagaaggtgtctgcaggaaacggtggttcttcactctcctatacaaaccctgccgtggccgcgactagcgccaacctatag

SEQ ID NO: 16089 - DNA, 1686 bp, Artificial Sequence
  Description of Artificial Sequence: Synthetic coding sequence
atgaccccgggaacgcagagtcctttcttccttctcctgcttctgacggtgctgacagtagttaccgggagtggccatgctagcagcacacctggcggcgagaaagagacaagtgcaacacagcggagctctgtacccagcagcaccgaaaaaaatgccgtgtccatgaccagtagcgtgctgagctctcacagccctggcagcggatctagcactactcaagggcaggatgttaccctggctcccgcgaccgagcccgcctctggtagcgccgctacctggggacaggacgtcacgtccgtcccagtgacgcgacccgccctgggcagcacaactcctcccgctcatgatgtaacgagtgcccctgatacacggcctgcgccggggagtaccgcccccccagcccatggggtcacctctgcacctgatacgcgccctgcgcccgggtccactgcccctcctgcacacggagtgacgtctgccccagatacacgaccagctcccggatccactgccccacctgcccatggcgttacatctgcaccagatacccggccagctccgggaagcactgcccctcccgcacacggggttacatcagcaccagataccaggcgcgctccaggttcaactcccgcccctgggagcactgccccgccagcccatggggttacctctgcaccggacacccgccccgccccagggtctacagctccccccgcgcatggggtgacgtcggccccagacaacagaccagccctgggatcgacggcaccgcccgtgcataatgtgaccagtgcaagcggctcggcctccggttctgcctctacactggtgcataacggcacctccgcacgcgctaccacgactcccgcgtcaaaaagcacaccattctcgatcccctcccatcactcggacacccccaccactctggcctcacacagcactaagaccgacgcctcctcaacacaccatagcaccgtgcctcctcttactagttctaatcattcaacctccccgcaactctccaccggggtgagctttttcttcctaagctttcacatctccaacttgcagtttaacagctctttggaggatccctcaacagattactaccaggaacttcagagagatattagtgaaatgttcctccagatctataaacaggggggcttcttgggcctctctaacattaagtttaggcccgggtccgtggtggtacagctgacattggctttcagggagggtactattaatgtgcatgatgtcgagactcaatttaaccagtacaaaaccgaggccgccagtcggtataatttgaccatctcagacgtgtcagtaagcgatgtgccgtttcccttttctgcacagagtggcgcaggagttcccggctggggcattgctctgcttgtgcttgtttgcgtcctggtcgcgcttgctattgtgtatctcattgcgctggctgtgtgtcagtgcaggagaaagaattatgggcagctcgatatattccctgctagagatacgtaccaccccatgtcagaatatccaacctatcatacccacgggcgatacgtgcctccaagttccaccgaccggagcccgtatgagaaggtgagcgctgggaacgggggctcatcgctcagctacacgaaccctgcagtagcagccacctccgccaatttatag

SEQ ID NO: 16090 - DNA, 690 bp, Artificial Sequence
  Description of Artificial Sequence: Synthetic coding sequence
atgacacctggaactcagtcccctttcttccttttgctattactcaccgtcctgaccgtggttaccgggtccgggcatgcgagcagcaccccaggtggggagaaggagacgagcgcgactcaaaggtctagtgttcctagtagcactgagaaaaacgctatttacaaacagggaggatttctgggtctcagtaacatcaaattcagacccggcagtgtggtagtgcagctgaccttagccttcagggaggggacaatcaacgtgcacgacgtggagacacaattcaatcagtacaagacagaggcagctagtagatacaatctaactatctccgatgtgtcagtgagtgatgtgccctttccctttagcgcccaaagcggagcgggcgtacccggttggggaatcgccctgctggtcctggtgtgcgtcctcgtggctcttgcgattgtgtatttaattgcactcgccgtctgccagtgccggcggaaaaattatggccagcttgacatcttcccagcaagggacacgtaccaccctatgagcgagtacccaacgtaccatacgcacggccggtacgtgcccccatccagcaccgaccgtagcccatacgagaaggtgagcgccggcaacgggggcagtagtctcagctacacgaaccccgccgtggccgcaacctcggcgaacctgtag

SEQ ID NO: 16091 - DNA, 780 bp, Artificial Sequence
  Description of Artificial Sequence: Synthetic coding sequence
atgacgcctggcactcagagtccttttttcctcctgctccttcttacagtcctgaccgccacgactgccccaaaacctgctactgtagtgaccggaagcggccacgcaagcagtacacccgggggtgaaaaggaaacctccgcaacacagaggagttccgtgccaagctcaaccgagaagaatgccttcaatagctccttggaagacccgagcacggattactatcaggaacttcaaagagacattagtgaaatgttcctgcagatatacaaacagggaggcttcttaggcctatctaacattaagtttaggcccggcagcgttgtggtacaactcacactggcgtttcgggaggggacaatcaatgtgcatgacgttgagacacagttcaatcagtataagacagaggcagcctccagatataatttgaccatcagcgacgttagcgtttcagacgtaccctttccttttagcgctcagtccggtgcaggggtacccgggtggggcattgccctgctggtgttagtatgtgtcctggtggccctggcaattgtttatttgattgctctagccgtgtgccaatgtcggcgcaagaactacgggcaattagacatcttcccagcgcgggacacttaccaccccatgagcgaataccctacctaccacacacacggcaggtacgttcccccctcatccactgatcgatccccgtacgagaagagacagaatggatggagtactatgccccggggggcgctccctgaggaatctcagggatag

SEQ ID NO: 16092 - DNA, 1833 bp, Artificial Sequence
  Description of Artificial Sequence: Synthetic coding sequence
atggggctgaaagctgcacaaaaaacgctatttccactgcggagcatcgacgacgtggtgagactctttgcagcggaactggggagggaagaacctgacctggtattgttgagccttgtattggggttcgttgagcatttcctggctgtaaatagagtaatccccacgaacgtccctgagctcacctttcagccaagtcccgctccagatcctcctggcggcctgacttactttcccgtggcggatctctccatcatcgccgcactctacgcgagatttaccgcacagatcaggggagccgtcgacctgtcactctacccccgggaggggggggtctcatcgcgtgaattggttaaaaaagtgagcgacgtcatctggaacagcttaagcaggtcttattttaaggatcgtgctcacatccaatccctgttctcgttcatcactggcaccaagctcgattctagtggagtagcgtttgcagtcgtgggggcctgtcaggcactgggactccgtgatgtgcatcttgccctgtctgaggatcacgcctgggtggtcttcggtcccaatggggaacaaaccgccgaggtgacctggcacggtaaaggaaacgaagaccgtcggggccagaccgtgaacgctggtgtcgcagagagaagttggctatacttaaagggctcttatatgaggtgtgatagaaagatggaggttgctttcatggtctgcgctataaacccttccattgacttgcacaccgatagcctggaactgctgcaactgcaacaaaagctgctctggctcctttacgacttgggccatctcgagcggtatcctatggcccttggcaacctggctgacctggaggaactggaaccaacccccgggagacctgacccactcaccctttaccataagggaatcgctagcgctaagacatactaccgggatgagcacatttacccatatatgtaccttgctggataccactgtagaaaccgcaatgttcgagaagcgcttcaagcttgggcagacactgctaccgtgattcaggactataactactgccgggaggacgaagaaatatataaagagttctttgaagtggccaacgacgtgattcccaatttgttaaaagaggccgcaagcttattggaagcaggggaggaacgcccaggagaacaaagccagggaactcaaagccaaggttcagccctgcaggaccctgagtgcttcgctcacctgctaagattctacgatggtatatgcaaatgggaagaggggagcccaactccggtcctgcatgttggttgggcaaccttcctggtgcagagtctgggtcggttcgaaggccaggtgaggcagaaggtccggatcgtctccagagaagcagaggccgctgaggctgaggagccttggggagaggaagccagggagggcagaaggcggggacctagaagggagtccaaaccagaggaacctccaccacccaaaaaacccgctctggataaaggtctaggcaccggacagggcgccgtgtcagggcctccgcgaaagccaccgggcacagttgccggaacggccagaggccctgagggaggcagcactgcccaggtcccggcccctacggcttctcctcccccggaagggccagtgctgaccttccagtccgaaaagatgaagggcatgaaggagctgttggtggctactaagatcaactccagcgctatcaaactgcagctcaccgcccagtcacaggttcagatgaaaaagcaaaaggtaagcacaccttctgattataccctgtcgtttctcaaaagacagcggaagggtctttag

SEQ ID NO: 16093 - DNA, 1833 bp, Artificial Sequence
  Description of Artificial Sequence: Synthetic coding sequence
atggggctaaaggccgcccaaaagaccctgtttcccctaagaagcatagatgatgtcgttcggctgttcgccgccgaacttggccgagaagaaccagacctagtactcctctcgttagttttgggatttgtggaacacttcctcgctgtgaatcgcgtgattcctacaaacgtccccgagttgaccttccagcccagcccagccccagacccgccaggcggcctgacatattttccagtagctgacctgtccattattgccgcactctatgctaggttcactgctcaaatacgaggggccgtggatctgtcactgtacccgagagaagggggagtgtcatcgcgcgagctcgtcaagaaggtgagcgacgttatctggaacagcttgtcaagatcatacttcaaagatcgcgcccacatccagagcctgtttagctttattaccggaacaaaactggacagtagcggcgtggctttcgctgtggttggcgcctgtcaggcgctggggctcagagacgtgcacttggcattaagcgaggaccacgcctgggtcgtttttgggcccaatggggagcagaccgcagaggttacgtggcatggcaagggcaacgaagaccggaggggtcagactgtcaatgccggcgtcgctgagcgcagctggctttatctcaagggtagttatatgcgatgcgacaggaaaatggaggtggcatttatggtttgcgctatcaacccatctatcgatctccatactgatagcctggagctcctccaacttcagcagaagcttctgtggttattgtacgatctcgggcacctagagaggtatccaatggcgctcgggaacctggctgatctggaggaattggagccaacaccaggtagacccgacccacttaccctgtaccacaagggaatcgcatctgcgaaaacctattatcgggacgaacacatatacccctatatgtatctggcaggctaccactgccgcaacaggaacgtccgcgaggctctgcaggcctgggcggacaccgcaacagtgatccaggactacaattattgtcgggaggacgaggagatctacaaagaatttttcgaggtcgcaaacgatgtaataccaaacctgctcaaggaagcggcttcacttctcgaagcgggtgaagagaggccaggagaacagtcccagggtacgcaatcacaaggaagcgcattacaagatccagagtgtttcgctcacttacttaggttttatgacggcatctgcaaatgggaagaaggaagtccgacaccagtgttacatgtgggatgggctacctttttagttcaatctctgggccgctttgagggtcaggtgcgacaaaaggtgagaatagtgtcccgggaggcagaagcagctgaggccgaggagccttggggcgaggaggcccgcgaaggccgccgccgaggcccccggcgagagtccaagccagaagagccaccacctcctaagaaaccggctctggacaagggtcttggaacagggcaaggcgcagtttccgggccacccagaaagccgccaggcactgtagcgggaactgcacgcggaccagagggaggctctaccgcacaggtccctgcccctaccgcctcacccccaccagaaggaccggtcctcaccttccagtccgagaagatgaaagggatgaaggaacttctggtcgccactaaaattaactcgtccgctataaaactgcaactgacagctcagtcccaagtccagatgaaaaagcagaaagtgtcaacacctagcgattacacgctcagcttcctcaagcgacaacgcaaaggcctgtag

SEQ ID NO: 16094 - DNA, 1848 bp, Artificial Sequence
  Description of Artificial Sequence: Synthetic coding sequence
atgggtctcaaagcggcccagaaaacacttttccccttaaggagcatagacgacgtggtgcggctgtttgcggctgaattgggccgggaagaacccgaccttgtcttactgtcgctggtgttgggcttcgttgaacactttctggctgtaaaccgtgtgatccctaccaacgtaccagagcttacattccagccttcccccgcccccgatcctcctggcgggctaacctatttccccgtcgcagatctgtcaatcatagcggccctgtatgcaagattcaccgcccaaattcggggtgctgtggacctgagcctatatccaagagaaggaggtgtaagttcccgagagctagtcaagaaagtgagcgatgttatctggaatagcctaagcaggtcctacttcaaggaccgtgcacatatacaaagtcttttttccttcattaccggctggtcacccgtgggtactaaactcgattcctcgggcgtcgcctttgccgttgttggcgcatgtcaagcgctcggactgcgtgatgtgcacctggctctaagcgaggatcatgcttgggtcgtcttcggccccaatggtgagcagacagctgaagtgacctggcatggaaagggcaatgaagaccgcaggggtcagaccgtgaatgcaggcgtggcagaaagaagttggctatatttgaagggctcctacatgaggtgcgatcgaaaaatggaagtagctttcatggtttgtgctataaacccttctatcgatttacatacagattccttggaacttctgcaacttcagcagaaactgctgtggctgctgtatgatctcggacacctggaaagataccccatggcgctgggcaatctcgcagatttggaagagctggaacctacacccggccgccctgatcccctgaccctgtatcacaaaggaatcgcctcagccaagacctattatagagatgaacatatctatccctacatgtacctcgccggatatcactgtcgtaatcggaatgtgagggaggcactgcaggcctgggcggacactgccaccgtgattcaagactacaactattgtagagaggacgaagagatctataaggaattttttgaggtcgcaaacgacgtaattcccaacctgctgaaggaagcagcatctctccttgaagctggtgaagagcgcccaggcgagcagagccagggcacccagtcacaaggcagtgcactgcaggatcccgaatgtttcgcccacctcctccgcttctacgacggaatctgcaagtgggaggagggcagccctacacccgtcttacatgtgggttgggctacctttctggttcagagcctaggcaggtttgagggacaggtgagacagaaagtgaggattgtgagccgtgaggccgaggcagctgaggccgaagaaccatggggcgaggaggcccgcgaggggagacgtcggggtcctaggcgtgagtcaaaacctgaggagcctcccccacctaagaagccggcacttgacaagggactggggaccggacagggagccgtaagcgggcccccacggaaacctccaggcaccgttgccgggacggcgcgaggccccgaaggtggctccaccgcccaagtgccagcccccactgcgagccctccacctgagggaccagtgctgacttttcagagtgaaaagatgaaaggtatgaaagaattgctggtcgcaacgaagattaactccagtgccataaagctgcagttaacagcacagagtcaggtccagatgaagaagcagaaggtcagcaccccatcagattacacccttagctttttgaagaggcaaaggaaggggctctag

SEQ ID NO: 16095 - DNA, 1848 bp, Artificial Sequence
  Description of Artificial Sequence: Synthetic coding sequence
atggggttgaaggcagcccagaagaccctcttccctctgcggagcatcgatgacgtggtacggctctttgctgccgaactggggagggaagaaccggatctggtgttgctgtctctggtgttggggttcgtcgagcacttcctagccgttaacagagttattccaaccaatgttcccgaattgaccttccagccgtcacccgccccggatccaccaggcggcctgacatacttccccgtcgccgatttatcaatcatcgcagctctgtacgccagatttacagctcagatacggggagccgtagacctttccctctatccgcgagagggcggcgttagtagtcgggaacttgtgaagaaagtatcggacgttatttggaacagcttatcaagatcatatttcaaggatcgggcccatattcagtctctgttcagctttatcactggctggtcccccgtgggcaccaagcttgacagttccggtgtagcctttgccgtggtgggagcatgccaagcactggggctgagggacgtccacttagctttgagcgaagaccacgcttgggtggtgttcggcccaaacggcgaacagacggccgaggttacctggcacgggaaaggaaatgaagatcgaagaggtcagactgtgaatgccggagtagccgaacgaagctggctgtaccttaaaggcagctatatgcggtgcgatcgaaaaatggaggtagcctttatggtgtgtgccatcaatccctcaattgatcttcacactgatagtctagagctgctccaactccagcagaaactgctatggttactgtatgacctggggcacctggagcgctatccgatggctctgggcaacctggccgatctagaagagctggaacctacccctggaagacctgatcccctgactctgtaccataagggcattgctagcgcgaaaacttactacagggatgaacatatctacccttacatgtatctagcgggatatcactgcagaaacagaaatgtgcgggaagcgctgcaagcctgggctgacaccgccacagtgatacaggattacaattattgccgggaagatgaggagatctacaaagagtttttcgaggtggccaacgacgttattccaaacttactgaaagaggctgcctccctactcgaggccggtgaggaacgtcctggcgaacagtcccagggtacacagagtcagggctctgccctgcaagatccagaatgctttgcccatctgctcagattttacgacggaatctgcaagtgggaagagggctcccctacaccagtcctgcacgtcgggtgggcgacgtttcttgttcagtctctgggtcgctttgaggggcaggtgaggcagaaagtgcgcattgtcagcagagaagcagaggctgccgaagcggaggagccctggggtgaggaagcccgggagggccgccgccgcgggccccgtagagaaagcaagcctgaagagcctccacctccgaagaagcccgctctggacaaaggcctggggactgggcaaggggcagtttcaggccccccccgcaaacccccgggtactgtggccggaactgcccggggtccggaaggaggaagtacggcccaggtcccagcacccaccgcgtccccaccccctgagggtccagttctgactttccaaagtgagaaaatgaaaggcatgaaggagttgctggtggcaacaaagattaattcatccgcaattaaactccagctcacggcccagtcccaagttcaaatgaagaaacaaaaggtgtcaaccccttccgattacactctgagttttttaaagcgtcagagaaagggactctag

SEQ ID NO: 16096 - DNA, 1668 bp, Artificial Sequence
  Description of Artificial Sequence: Synthetic coding sequence
atggggttgaaagcagctcaaaagactctctttccactccgcagcatagacgacgtggtgcgcctcttcgccgctgagcttggtagagaagagcctgacttggttctcttatccctcgtgctgggattcgtggaacatttcctcgctgtgaatagggtcataccaaccaatgtgccggagctgacttttcaaccttcacccgcgcctgaccctccagggggtctcacatatttcccagtagcagacctcagcatcattgcagcactctatgctcggtttacggcccagatcagaggcgcagtcgacctcagtctatatcccagggaagggggcgtctctagtcgggagctagtcaagaaggtgagcgatgtgatttggaactctttgagccggagctatttcaaggatagagcacatatacagtcactgttctccttcatcaccgggaccaaactggacagttctggtgtggcatttgcagtggtcggggcttgccaggccctcggcctgcgggatgtacacttggcattaagtgaggatcacgcctgggttgtctttgggccaaatggcgaacagactgccgaagtgacttggcacggcaaaggcaacgaagatcgcaggggccagaccgtgaacgccggcgttgccgaaaggagctggctctatctgaaggggtcatacatgcggtgtgatcgaaaaatggaggtggcattcatggtgtgcgccattaacccaagcatcgacctgcacacagacagtcttgagctgctgcagctgcagcagaaattgttatggctgctgtacgacttgggacacttggagaggtatcctatggcattggggaatttggctgatctggaagagctggaacccacccctggtcggccagacccccttactctttaccacaaaggtatcgcgtccgcaaagacttactaccgggatgagcacatctacccttatatgtacctcgctggctaccactgtagaaatagaaatgtccgcgaagccctccaagcttgggctgatacagccacagtgattcaagattataactactgccgcgaagatgaggaaatctacaaagagttcttcgaagtggctaacgatgtgattccgaatctgctgaaagaggcagcaagcctgctggaggcgggtgaggaaaggcccggagagcagtctcaggtgcgccagaaggtcaggattgtttcaagggaagcagaggctgcggaggcagaggagccttggggtgaagaagcccgtgagggaaggcggagaggcccgcgaagggagtccaaaccggaggaaccaccacctcccaaaaaaccggccctggacaaaggcctcgggactggacagggcgccgtgtctggacccccacgaaaaccaccaggcaccgtcgccggcactgctagaggacccgagggtgggagtactgcacaggttccggcccccacagcctcaccaccccccgagggaccagtactgacgttccaatctgagaaaatgaaaggaatgaaagaactgcttgttgccaccaaaatcaattcatcggctatcaaattacaattaactgctcagtctcaggtccagatgaagaaacagaaggttagcacaccaagcgattacaccctgtccttcctcaaaaggcaacgcaaaggactctag

SEQ ID NO: 16097 - DNA, 1728 bp, Artificial Sequence
  Description of Artificial Sequence: Synthetic coding sequence
atggggctgaaagcagcccaaaagactctatttcccctgcggagcatcgacgatgtggtccgactattcgccgcagaactgggccgcgaggaacccgatctggtgcttctatctctggttcttggttttgttgagcatttcctcgccgtaaatagagtcatcccgaccaacgtcccggagctgacctttcagccctctcccgcccctgatccacctggcggcctgacctacttcccagtggcagacctgagtatcattgccgcactgtatgcacgctttactgctcagatacggggcgccgtggatctgtcactgtatccccgtgagggaggcgtgagttcaagagaactggtgaaaaaggttagcgacgtcatttggaatagtctttcacggagttacttcaaggatagagcccacattcaaagcctcttttcattcatcaccggcacaaaactggactcttctggagtggctttcgctgtggtgggtgcctgccaagccctgggcctgcgggacgttcatctcgctctcagcgaagatcatgcctggtcctggctgtatttgaaagggtcatacatgagatgtgatcgtaaaatggaggttgcgttcatggtctgcgctataaaccccagcatagacttgcatacagattctctggagctgctgcagctgcaacaaaaactcctttggctcctgtatgacctgggacacctcgagcgataccccatggccctggggaacctggccgacctagaagaactcgagccaacgcctgggcggccagatccgttgaccctttaccacaaagggatcgcaagtgccaaaacatactacagagacgaacatatttatccctacatgtacttggccgggtatcactgtcgtaaccgcaacgtgcgagaggccctgcaggcctgggccgatactgccaccgtgattcaagactacaactactgccgggaagatgaagaaatctataaagagttctttgaagtcgctaacgatgtcatacccaaccttttgaaggaggccgcctccctgttagaagccggggaggaacggcctggagaacagtcacagggtacccagtctcagggaagtgccctgcaggaccccgagtgttttgcacacctgctccgcttttatgatggaatatgcaagtgggaagaaggatcgcctactccagtcctgcacgtgggatgggcaacatttctcgtacagtctctcggaaggttcgaagggcaagtgcggcaaaaggtgaggatcgttagcagggaagccgaggcggcggaggccgaggaaccgtggggagaggaggcaagggagggtcggaggagaggcccacgccgagagtcaaagcccgaggaacctcccccacccaagaaacctgctctggataaaggtttagggactggtcagggcgccgtgagtggtcccccccgcaagccacccggaacagtcgcaggtaccgcaagggggcctgagggtggatctactgcccaagtgccagctccgactgccagcccgccccctgaagggccagtgcttacctttcagtccgagaagatgaaagggatgaaggaactcctcgttgccactaagatcaactcatccgcaattaaactgcagctgaccgcacagtctcaagtgcagatgaaaaaacaaaaagtgtctaccccgtccgattacacactgtctttcttgaagcgacagcgtaagggtctctag

SEQ ID NO: 16098 - DNA, 1833 bp, Artificial Sequence
  Description of Artificial Sequence: Synthetic coding sequence
atgggccttaaggctgcacagaagactctgttcccgctcagaagcatcgatgatgtggtgagactttttgcggcagaactcggcagggaggagcctgatctggtgttgctgagtctcgtactggggtttgtcgaacacttcctggccgtgaatcgagtcatcccaacaaacgtaccagaactgacatttcagccttctcccgcacccgatccaccgggaggcctaacctacttccctgttgcagatttgagcatcattgccgcactctatgctagatttacggcgcagatccgcggagccgtggacctctcgctgtatcctcgggagggtggggtgtccagtcgcgaactagtcaaaaaggttagcgatgtcatatggaattccctgtcgcgtagctatttcaaggatcgcgctcacatccaaagcctgttctcattcataacaggtaccaagttggattccagcggcgtcgcctttgcagtggtaggggcttgccaagcattaggcctgcgcgacgttcatttggcgctgagtgaggaccatgcgtgggtggtctttggcccaaacggcgaacaaaccgccgaggtgacgtggcacggcaagggcaacgaggaccgccggggtcagaccgtgaatgccggcgtggcagagagatcctggctttatctcaaaggaagctacatgcgttgtgaccggaagatggaagtcgctttcatggtgtgcgcaatcaaccccagtattgacctgcacacagattcactcgaactgctgcagctgcagcagaaactgctgtggctgctgtacgacctcggacacctcgaaagatacccgatggctctgggaaacctcgcggacctggaggagctggagcccaccccgggacgcccagaccctctgacactgtatcataaaggaattgcaagtgccaaaacatactatagagatgagcacatttacccgtatatgtacctggccggctaccattgccggaaccgaaacgttcgagaggccttgcaggcatgggctgataccgccaccgtgatccaggattataactattgccgggaggacgaggagatctacaaggagtttttcgaggtagcaaacgatgtaatccccaatctgcttaaagaagcggccagtctgctggaggccggagaggagagaccgggcgaacagagccaaggcacccagagtcaaggctccgcgctgcaggatccagagtgtttcgcgcatttactgaggttttacgacggcatctgtaaatgggaagaggggagtcctacgcctgtcctgcacgtgggatgggccactttccttgtccagagccttggtcgctttgaagggcaggtgcgacaaaaggtgaggatagtgagccgcgaagcagaggctgcagaagccgaagaaccctggggcgaggaggctagggagggacgtcggcgtggacccaggagggaatccaaacctgaagagccccccccgcccaagaagcccgctctggacaagggactcgggactggccaaggagctgttagcggcccccctaggaaaccccccggcaccgtggctggaacagcccggggtcccgagggtggttccacagcccaagttcccgcacccacagcgtcccccccgccggaaggtcctgtcttgaccttccagtccgagaaaatgaagggaatgaaagaattgctggtggcaaccaagatcaactccagcgctatcaaactgcagctgaccgctcaatcccaggtccagatgaagaagcagaaggtgagcacacctagtgattacacccttagcttcctgaaacggcagaggaaggggctttag

SEQ ID NO: 16099 - DNA, 1848 bp, Artificial Sequence
  Description of Artificial Sequence: Synthetic coding sequence
atggggcttaaagctgcccagaaaacactcttccctttgaggagtatagatgacgttgtccgtctgtttgccgcggaacttggacgggaagaacccgacctcgtgcttctgtctttggtgttagggttcgttgaacatttcttggcagtgaatcgcgtcatacctaccaatgtgccagagctgacctttcagcctagccccgctccagaccccccaggcggcttgacatacttcccagtggccgatctgtccataatcgccgccctttacgccaggttcactgcacaaatcaggggggccgtggacctctcactgtatccacgggaaggtggagtatcctctcgggaactggtgaaaaaagtctctgacgttatctggaattccttatcacgttcatattttaaggatagagctcacatacagtccctgtttagcttcatcacaggctggtccccagtggggactaaactcgacagttcgggtgttgcatttgccgttgttggagcgtgtcaagctctgggcctgagggacgtccatctggctcttagcgaagaccatgcatgggtagtgtttgggcccaacggcgaacagacggcagaagtgacttggcacggaaaggggaatgaggatagacgggggcaaaccgtgaacgccggggtggccgagaggagctggctttatctcaagggttcctacatgagatgtgacagaaagatggaggtggcctttatggtgtgtgcaattaatcctagcatcgatttacacaccgatagtttagaattgctgcaactgcagcagaaactgctgtggctcctctacgacctgggccatctcgaacggtacccaatggcccttggaaacctggccgacctcgaggagctggagcccacacctgggaggccagatcccctcactctctatcacaagggcatagcgtcggccaaaacctactatagggacgagcacatttacccatacatgtacctagccggataccattgccgaaaccgaaacgtgcgcgaggccctgcaagcctgggccgacactgccacggtcatacaagattacaattattgtcgggaggatgaggaaatctacaaggaattcttcgaggtggccaatgacgtcatcccaaatctactgaaagaagcggctagtcttctagaagcgggggaggagaggccaggcgaacagagccagggaacccagtcacagggctctgccctccaggatcctgagtgtttcgctcacctgctcaggttctatgacgggatctgcaagtgggaggagggaagtcccacccccgtcttacatgtgggctgggctaccttcctcgtgcagagtctgggtcggttcgagggccaggtgaggcagaaggttagaattgtgagtcgtgaagccgaggccgctgaggctgaggagccatggggagaggaagcgcgagagggccgacgcaggggtcccagacgcgagtcgaaacctgaggaaccccctcctcctaagaagccagctctggacaagggcctcggcacagggcagggagccgtcagcgggccacctaggaagcctcccggcaccgtagccggcacggcaaggggccccgaaggtgggtcaacagctcaggtccccgcaccaaccgcctcgccccctccagaaggtccagtgttaacgttccaatctgagaagatgaaaggcatgaaagaactccttgtcgccaccaagatcaatagttccgccatcaaattgcagctgaccgctcagagccaggttcaaatgaagaaacaaaaggtcagtactccttccgactatactctgagttttctgaaacgccagaggaagggcctgtag

SEQ ID NO: 16100 - DNA, 1848 bp, Artificial Sequence
  Description of Artificial Sequence: Synthetic coding sequence
atgggtttgaaggcggctcagaaaaccctgtttcccctgcgatcgattgatgatgtggtccggttatttgcagctgagttgggccgagaggaacctgatctggtattgctgtccctggtgctcggcttcgtcgaacacttcttggcagtgaatcgcgtcatacctacgaatgtccctgagcttactttccagccatctcccgcccctgacccccccggcgggctgacttactttccagtggcagatcttagtattatcgccgcactttatgcgaggtttacagcccagattcgcggtgccgtggatctctctctttaccctcgggagggaggcgtgtcctctcgagagctggtgaagaaagtttcagatgtgatctggaacagtctatctagaagttattttaaagatcgcgcccacattcagtcgctcttttcctttatcacgggatggagcccagtggggacaaaactcgattcttcgggtgtcgcttttgccgtcgtgggcgcatgccaggccctgggtcttcgtgacgtccatctagcactgagcgaagatcacgcctgggtggtattcgggccaaacggagaacagaccgccgaggttacctggcatgggaaaggtaacgaggatcggcggggtcagaccgtcaacgctggagtagctgagcgctcttggctgtatctgaaagggtcttatatgcggtgcgatcgcaagatggaggtggccttcatggtgtgcgctattaatccgagcatcgatctgcacaccgattcgctggagctcctgcaactgcaacagaaactcttgtggctgctctatgatctgggacatttggaaagatacccaatggccctggggaacctagccgacctcgaggagttggagcccaccccaggtcggcctgatccactcaccctgtatcacaaggggattgcgagcgccaagacctattaccgggatgaacatatctacccttacatgtacctcgcagggtatcactgtcgcaacagaaacgtgagagaggctctgcaggcctgggctgacaccgccacagtcatccaggattacaactattgccgcgaggacgaggaaatatacaaagagttcttcgaggtagcaaacgacgttataccaaatcttcttaaggaggccgctagcctgctagaagccggagaagagaggccgggcgaacaaagtcaggggacccagtcacaagggtctgcactgcaagacccagaatgcttcgcccaccttttacgcttctacgacgggatttgtaaatgggaagagggctccccaacccctgtgctgcacgttggctgggcgacttttctcgtgcaaagccttggtaggtttgagggacaggtacggcaaaaagtgcgtatcgtatctcgcgaagcggaagctgcggaggcagaggagccatggggtgaggaggcgagagagggcagaagaagaggaccacggcgcgagagcaagccggaggagccaccgccacccaagaagccagcactggataagggcctgggtactggccagggagccgtgtcaggtcccccccggaaaccacctgggacggtcgcggggacggcccgggggccagaaggcggctctactgcccaggtgcccgcgcccaccgctagtccaccccctgaaggtcccgtgctgacatttcaaagcgagaaaatgaaaggaatgaaggaactgttagtggctaccaagattaattcttccgccataaaactccagttgacagctcagtctcaagtgcagatgaagaagcagaaggtttcaaccccgtcagattataccctgtcatttcttaagcgccagaggaaaggtttgtag

SEQ ID NO: 16101 - DNA, 786 bp, Artificial Sequence
  Description of Artificial Sequence: Synthetic coding sequence
atggggctgaaagctgcccagaagacactgttccccctccgatcgatagacgacgtggttagactgttcgcagctgaactgggtcgcgaagaaccggacttggtactgctctccctcgtgctgggtttcgtggagcacttcttggcagtgaaccgggtgataccaacaaacgtacctgaactgacgttccagccttcccccgctcccgaccctcctgggggactgacttacttccctgttgcagacttgagtatcatcgctgccctgtacgctaggtttactgctcaaatccggggagcagtcgacctgtctctataccctcgggaagggggagtgagtagccgcgagctggtgaagaaagtctccgacgttatttggaactccctgtcccggtcttattttaaagatcgagctcatatacagagtctcttctccttcataaccggcactaaactggacagctctggtgtggcctttgccgtggttggggcttgtcaggcactggggctgagggacgttcatttggctctttccgaggatcatgcctgggtggttttcggtccaaatggagaacagacagcggaggtcacgtggcacgggaaaggaaatgaggataggcgtggccaaactgtaaacgcgggagtggcagagcgttcttggctgtatctaaagggaagctatatgagatgtgaccggaaaatggaggtggcctttatggtctgtgcgattaacccttcaatagatctgcacaccgactctcttgagctgttacagttacagcagtag

SEQ ID NO: 16102 - DNA, 441 bp, Artificial Sequence
  Description of Artificial Sequence: Synthetic coding sequence
atgggcctcaaagccgcccagaaaactcttttccctctgcgaagtatcgacgatgtggtgagactgttcgccgcagaactgggtagagaggaaccggacctcgtactcctatcattggtgctagggttcgttgagcatttccttgcagtgaacagggtgatccccaccaatgtgccagagctgacatttcaaccctcccctgcacccgatccccccggaggactcacctactttcccgtggctgatctgtctatcatcgcagccctgtacgctcgattcactgcccagattaggggagctgtggatctgtcactctacccgcgggaggggggcgtgtctagtagggaactagtgaaaaaggtaagtgatgtgatatggaattctttatcccgctcatattttaaggatagggcccacattcagtccttatttagtttttag

SEQ ID NO: 16103 - DNA, 441 bp, Artificial Sequence
  Description of Artificial Sequence: Synthetic coding sequence
atgggtttgaaggctgcccagaagactctatttcctctccgctccatcgacgacgtcgtgcggctgtttgccgccgagctcggcagggaggaaccagacttggtccttctctccctggtactggggttcgtggaacactttctcgcagtgaatcgagtgatcccaacaaacgtgcctgaactcacatttcagcctagccccgctccagatcctccgggcggcctcacctacttcccagtcgctgacctgtctatcatcgcagcactgtatgccaggttcaccgcccagatcaggggtgccgttgacctgtccctctatcccagggaggggggagtatcttcgagagagctggtgaaaaaggtgagtgatgtgatttggaatagtttgtctaggagttattttaaagatcgggcacatatccaaagcttgttcagcttttag

SEQ ID NO: 16104 - DNA, 1041 bp, Artificial Sequence
  Description of Artificial Sequence: Synthetic coding sequence
atggggctgaaagccgcccagaaaacgctgtttccattacgctcaatcgacgacgttgtgaggctattcgctgcggaactgggcagagaagagcctgatttagtcctcctgagcttagttctggggttcgtggaacactttctggcggtcaatcgagttataccgactaacgtgccagaacttacatttcagccatcccccgcgccagacccaccaggtggtcttacctatttcccagttgctgacctatcaatcatcgcagctctctacgcccgcttcaccgcccaaattcgcggcgccgtggacctgtcactttatccacgtgaaggcggcgtctctagtcgggaactcgttaaaaaagtctccgatgtgatctggaattctttgagtagatcatactttaaagacagagcccacatacagtctcttttcagctttataaccggcactaaactagatagctctggcgtggctttcgcagtcgtgggtgcgtgtcaggccttgggcctgcgggacgttcacctcgcgctaagtgaggaccatgcctgggtggtttttggcccgaatggcgaacagacagctgaagttacttggcacggcaaaggcaacgaagacaggcgtggccagactgtgaacgccggagtcgccgaacgaagctggctttaccttaaagggtcatacatgcgatgcgaccgcaaaatggaggtggcgttcatggtgtgcgccataaacccctctattgatctacatactgattcactcgagctcctgcagttgcagcagaaactcctttggctgctgtacgacctgggacaccttgagaggtaccctatggccctggggaacctggccgacctggaggagctggagcccacgcccggaaggccagatcccctcaccctctaccacaaaggcatagcatcagccaaaacatactacagagacgaacacatctacccatacatgtatttagcgggctatcattgcagaaatagaaatgttagagaggccctgcaagcctgggccgatacggccacttag

SEQ ID NO: 16105 - DNA, 1848 bp, Artificial Sequence
  Description of Artificial Sequence: Synthetic coding sequence
atgggtctgaaagcagcgcagaagaccttgttccccctgagatcgatcgacgacgtagtgcggttgttcgccgcagagttaggaagggaggaacctgatctggtccttctttctctagtcctgggttttgttgaacacttcctagccgttaatagagtgattccgactaacgtcccagagctcactttccaaccatccccagcccctgacccccccggaggactaacctatttcccggtggcagacctttccatcattgccgcactctatgctagatttaccgctcagataaggggggccgtcgatctgagcctctacccacgggaagggggtgtaagctcccgggagcttgtgaaaaaagtaagtgacgtcatatggaatagtcttagccgttcatattttaaggatcgcgcgcatatccagtccttgttttcatttattactggatggtccccagtgggaaccaagttggatagttcaggcgtagcctttgccgtagtcggtgcatgccaagcgctcgggctgagagatgtccacttggccttgtccgaggaccatgcatgggtggtattcggacccaatggggagcagactgcagaggtaacgtggcacggcaaaggtaatgaggacagaagaggccaaactgtgaacgccggagtcgcagagaggagttggttatacttgaagggcagttacatgaggtgtgacagaaaaatggaggtggcatttatggtgtgcgcaataaatccttctattgatctccacacggacagcctggaattgctgcagctgcagcagaagttgctgtggctgctgtatgacctcggacatctcgaacggtatccgatggcccttggcaatctagcggacctcgaagagctggagcctactcccggccgtccagatccgctcactctgtaccacaagggaatcgcgtcagcaaagacgtactaccgggacgagcatatctacccctatatgtaccttgccggttaccactgtagaaatcgaaatgttcgggaagctctccaggcttgggcagacaccgctacggtgattcaggattacaattactgccgagaagatgaagagatctacaaagagttttttgaggtggccaacgacgttatccctaatctgttaaaggaggctgcgtctctgctggaggcaggagaggagcgacccggtgagcagagtcagggcacccagagtcagggatcggcgctgcaggatccagaatgtttcgcccacctgttgaggttctacgatggcatttgcaaatgggaggaggggagcccgacgcctgtgctgcacgtgggctgggccacgtttctggtgcagagcctaggacgttttgaaggacaggtgcggcaaaaagtccgcattgtgtctcgagaggctgaggccgcggaagccgaagaaccttggggtgaagaagcccgggagggcaggagacgaggcccaagaagagagagcaagcccgaggagcccccccctcctaaaaaaccagccttggacaagggtctgggcacaggtcagggggccgtgtccggaccaccccgaaagccacccggcaccgtggctggtacagcccgaggccctgagggggggtccaccgcccaagtccccgcgcccacagctagcccccctcctgaaggaccagtgctgacattccagagcgagaagatgaagggcatgaaggaactgctcgtggccaccaaaattaacagctctgccatcaagctgcagctgaccgctcagtcccaggtgcaaatgaaaaagcaaaaagtgtcgactccaagcgattacacactcagcttcctgaagcgacaaaggaaaggactgtag

SEQ ID NO: 16106 - DNA, 846 bp, Artificial Sequence
  Description of Artificial Sequence: Synthetic coding sequence
atgggcctgaaagctgcacaaaagaccctctttccactgcgcagtatagacgacgtagtcagattgtttgcagcagaactgggccgcgaagagcccgatctcgtacttctcagcctcgttctaggattcgtagagcatttcctcgccgtgaatagggtcattccgaccaacgtgcccgagctgaccttccagccctcacctgccccagatccgcctggcggtctgacctacttccccgtggccgatctgtctatcattgcggctctatatgcgagatttacagcccagatccggggagctgtggatctctcactgtacccacgagaaggcggcgtgagctcgcgcgagctggtcaaaaaggtttctgatgttatatggaacagcttatcccgttcctatttcaaggacagggcacatatccagagcctgttctctttcataacaggcaccaagttggactcgagtggtgtggcatttgccgttgtcggggcgtgccaggctctgggattgcgagacgttcatctcgccctctcagaggaccatgcttgggtcgttttcggacctaatggggaacagactgcggaggtgacctggcatggcaaaggtaatgaagatagacggggtcagaccgtgaatgccggagtcgccgagagatcctggctatatctgaaaggcagttatatgcggtgcgaccgcaagatggaggtggccttcatggtttgcgccataaacccttccattgacctgcataccgactccttggaactgctgcagctgcagcagaaactcctgtggctcctgtatgatctaggccaccttgagcgctacccaatggccttgggatag

SEQ ID NO: 16107 - DNA, 1656 bp, Artificial Sequence
  Description of Artificial Sequence: Synthetic coding sequence
atggccgctcctgtgcggcttggccgaaaaaggcctttgcctgcctgccccaacccacttttcgtccgctggctgaccgaatggagggacgaagctactcgcagtaggcggagaacacgctttgtgtttcaaaaagcccttaggtcgctgcgccggtatccacttcccctgcgaagcggcaaagaagccaagatcctgcagcactttggtgacggattgtgcaggatgttggacgagagattacagagacacaggacgtccggcggagaccacgcccctgattcccctagcggcgagaactctcctgccccacagggccgccttgctgaggtccaagactcaagtatgccggtgcctgcccagcctaaagccggcggttccggctcctattggccggcccggcactcaggtgctcgcgtgatattactggtgctttacagggaacacctgaaccccaacggccatcacttccttaccaaggaggagctgctgcaacggtgcgcacagaagtcacctcgcgtcgctccaggcagtgcccgcccgtggcctgctctaagaagcctgctgcataggaatctagtgctgaggacacaccaacctgcacgatacagccttactcccgagggtttagagctggcgcaaaagcttgcggagagcgaaggcctctcactgttaaacgttggtatcggccccaaggagccaccaggcgaagagacagccgtgcctggagccgcgtctgccgaattagccagtgaagctggcgtgcagcaacaaccattggaattgagaccaggtgagtatagagtcctcctgtgcgtggatattggtgaaacccgcggcggggggcatcgtcccgagttgctgagggaactacagaggcttcacgtaacgcatacagtgagaaagctgcacgtgggcgactttgtgtgggtggcacaagagacaaatccaagggatcctgccaacccaggagagctcgtgctggatcacatcgtcgagcggaaacggcttgacgatctttgcagctctatcattgatgggcgctttagggagcagaaattccggctcaaaaggtgtggcttagagaggcgggtttacctcgtcgaggaacacggtagtgtgcataatctatcgttgcccgaaagtacactgctacaagccgtcaccaatacacaggtgatcgatggcttcttcgttaagaggactgccgacatcaaggaaagtgccgcatacctcgctctgttgactcgcggcctgcagagactgtatcaaggtcataccctgagatcgaggccatggggcacccccggtaatcctgagtccggcgcgatgaccagccctaacccactgtgcagcctcctcaccttttctgattttaacgccggagccatcaaaaacaaggcccagagcgttcgagaggtgtttgcacggcagcttatgcaggtgcgtggcgtgtcgggggagaaagcagccgctctagtagatcggtatagcacccctgcatctctgttggccgcctatgacgcttgcgctactcctaaagagcaagagactctgctctcaacgataaagtgcggtaggcttcagagaaacctagggcctgccctgtctcgaacattgtctcagctgtactgtagttacgggcccctgacttag

SEQ ID NO: 16108 - DNA, 1656 bp, Artificial Sequence
  Description of Artificial Sequence: Synthetic coding sequence
atggccgcgcccgtgcgtttggggcgcaaaagacctctacctgcatgcccaaatccattatttgtgcgatggttgaccgaatggcgagacgaggccacacgtagcagacgcaggacgaggttcgtgtttcaaaaagccctccggagcctgcggaggtacccacttcctctgcgttctggtaaggaagccaaaattcttcagcatttcggggatggactgtgccgtatgctagatgagaggctccagcggcataggaccagcggtggtgatcatgcgcccgactccccttcaggcgaaaactctccggcaccacagggtagactggctgaagtgcaagacagcagtatgccggtacccgctcagccaaaagccggcggatcgggatcttattggccggctcggcattccggggcccgcgtcattctacttgtattatacagagagcatcttaatccaaacgggcaccattttctgaccaaggaagaattacttcagaggtgcgcccaaaagtcccctcgcgtggccccaggtagcgcccgcccttggcctgctctgcgatctctgttacaccgcaacctggtgcttcgcactcaccagcctgctagatattctctgacccctgaggggcttgagctagcccaaaaattagccgagagcgaaggactttcgctgctgaacgtcggaatcggacccaaggagcctccgggagaggagaccgctgtgccaggggcagcttctgcagaactcgcctcagaggccggtgtgcagcagcagccactggaattgagaccaggcgaatatagagtactcctgtgcgtggatatcggcgagaccagagggggaggccatcgcccagaattgttgagggaacttcaacggctgcacgtcacacacactgtgagaaagctccatgtgggcgactttgtgtgggtagcacaggagactaatcctcgggacccagcaaatcccggcgagctggtccttgaccacatcgtggagcgcaagcggctggatgacctatgttcgagcattatcgacggcagattcagagaacagaagttccgcttgaagcgctgtgggctggagcgacgcgtgtatctagtggaggaacacgggtctgtgcacaacctgtccctgccggagagtacactcttgcaggccgtaactaatacacaggtcatcgacggcttcttcgtgaagcgcacagccgatatcaaggaatccgcggcatatttagccctgctgacccgggggctgcagcggctgtaccaaggtcataccctgcgctcgaggccttggggcacacctggcaatcccgagtcaggggctatgacatcaccaaacccactctgcagtcttctcacattttccgacttcaatgcaggagcaatcaagaataaggcccaaagcgtacgtgaagtgttcgcacggcaattaatgcaggtgcgaggagtctccggggaaaaagcagcggcgttagtcgatcgttactctactccagcttccctgctggctgcttacgatgcttgcgccacacccaaggagcaggaaacgctcttatcaactattaaatgtggacggctccagcgtaatctgggacccgccctgagtaggacactgtctcagttatactgtagttatgggcccctgacatag

SEQ ID NO: 16109 - DNA, 2490 bp, Artificial Sequence
  Description of Artificial Sequence: Synthetic coding sequence
atgaacagcggcgtcgcaatgaagtacggaaatgatagctcagccgaactcagcgagctgcactcggccgcattggcatctttgaagggcgatatcgtggagctgaacaagcgcctgcaacagaccgaaagggagagagacctccttgagaagaagctggccaaagcccaatgtgagcagagccacctgatgcgagaacatgaggacgtgcaggagaggacgaccttgcgctatgaagagcggattaccgagctgcattctgtgattgctgagctgaacaagaagatcgacagactgcaaggcaccaccatccgggaggaagatgaatactctgaattacgcagtgagttgtcccagtctcagcacgaggtgaatgaggattctcgatcgatggatcaggaccagaccagtgtgtctatccctgagaaccagtcaacgatggtcaccgccgacatggataattgttcagacttgaattcagagcttcagcgggttcttaccgggttggaaaatgtggtatgcggtcggaaaaaatcttcttgctccttgagcgtggccgaggtggacaagcacattgagcagctgaccaccgctagcgaacattgcgacctcgccataaagacagtggaagaaatcgaaggcgtcttaggacgtgacttatacccaaacctggccgaggagcgcagccgttgggaaaaggaactcgccgggctccgcgaggagaatgagtccctcaccgctatgttatgttccaaagaggaggagttgaaccgcaccaaagcaactatgaacgcaatccgggaggagcgtgatcgtctgcgcaggcgcgtcagagagctgcagacgaggctgcaatccgtgcaggcgaccggcccatcatcaccaggccgcctgacttccacaaacaggccaatcaatcccagtactggcgagctgtcaacctcttcctctagtaatgatattccaattgcaaaaattgcagagagggttaagctctccaagacacggtctgaatcatcatcgtctgacaggccagtgctgggctcagaaattagtagcatcggcgtatcatcttcagtggccgagcatctcgcacacagcctgcaagattgctctaacatccaggagatcttccaaacactgtacagccacggctcagcaatatccgagtccaaaatacgcgagttcgaagtcgaaaccgaacgactgaactcacggatcgaacacctgaaatcccagaacgatcttctcaccattacactggaggagtgcaaatctaacgctgaacggatgagcatgctggttggaaagtacgagtccaatgccacagcactgagactcgcactccaatattccgagcaatgcatcgaagcctacgagctactcctggctctcgctgagagcgaacagtcactcatacttgggcagttccgagctgccggcgtgggcagttcaccaggcgatcaatccggggacgagaatatcacccaaatgctgaagagggcacatgattgtaggaagacagctgagaatgctgctaaagcactgctgatgaagctggatgggagttgtggcggtgcttttgccgtagcgggatgctcagtacaaccttgggagtctctgtcttcaaactctcacacgagcacgacaagctctacagcatcctcatgcgatacggagtttacaaaggaggacgagcaaagattgaaggattacatccagcaactgaagaacgatcgagctgctgtcaagctgacaatgctggaactggagtccattcacattgatccactgagctatgatgtgaaacctcgcggcgatagtcaaaggctagatctggaaaacgcggttctgatgcaagaattgatggcgatgaaagaagaaatggctgagttgaaggcacagctgtacctccttgagaaggagaaaaaagccttagagttgaaattgtctacgcgtgaggcgcaagagcaagcctacctagtgcacattgagcacctaaagagcgaggtggaggaacagaaggaacagcggatgcgttctctctccagcactagtagtggctctaaggacaaacccggaaaggaatgcgcagatgcggcctcacctgctctgtctctcgccgaattgcgaaccacttgttctgagaatgaattggcagccgaattcaccaacgctataaggagggaaaaaaagctcaaggctcgtgtgcaggagttagtttccgccttggagaggctcaccaaaagctcggagatacgacatcaacaatcagccgaattcgtgaacgacctgaaaagggctaacagcaacctggtggccgcgtacgaaaaggccaagaaaaaacaccagaacaaactaaaaaagctggaatcacagatgatggctatggtggaaagacacgagacacaagtgaggatgctgaaacagaggatcgccctgcttgaggaagagaacagccgccctcatactaacgagacaagcctctag

SEQ ID NO: 16110 - DNA, 2133 bp, Artificial Sequence
  Description of Artificial Sequence: Synthetic coding sequence
atgaaactggtgttcctggtgttgctgttccttggagctctcggactttgtctggcagggagacgccggagcgttcaatggtgcgccgtgtcccagccagaagcaaccaaatgttttcagtggcagcgaaacatgaggaaagtccgcggtcccccagtgagctgtatcaagcgggatagtccaattcagtgtattcaggcgattgcggagaacagagccgacgccgtgacattagatggcggatttatttatgaagcaggattagcaccctacaaacttaggcccgtggccgccgaggtgtacgggacagagcggcagcccaggacacactattatgcggttgccgtggtgaagaagggtgggtctttccagctcaacgagctgcagggacttaagagttgtcacaccggccttcggaggactgccggttggaatgtgcccatcggaacattgagaccctttctgaattggaccggcccgcccgagccaatagaggctgccgtggcccggttcttctcggccagctgcgtgcccggagccgacaagggacagttcccaaatctatgccgcctttgcgctggcacgggggagaataagtgcgcttttagctcccaggaaccctacttttcctacagcggagccttcaagtgtctgcgagacggggctggagatgttgcgttcatacgggaatccactgtgtttgaggacctatccgatgaggccgagcgcgacgaatacgagctcttatgcccagacaataccaggaagccggttgacaaattcaaggattgtcacctagccagggtccccagccacgccgtggtcgctcgcagcgtgaacggcaaagaagacgctatttggaatctgctgcgacaggctcaggagaagttcggtaaggacaaatcacctaagttccagctgttcgggagtccatcgggccagaaagacctgttattcaaggactcggccattggcttcagccgggtgcctccaaggattgactcaggactgtacttgggctccgggtatttcactgccatacaaaatctaaggaagagtgaggaagaagtggcagctcgtcgtgctagagtggtctggtgtgctgtcggcgaacaagagctgcggaagtgcaatcagtggtctggattaagtgagggcagcgttacctgtagcagtgcaagcaccactgaggattgtatcgccctggtgttaaaaggcgaggccgacgcaatgagcttagatggcgggtatgtgtataccgcaggtaaatgtggtttggtgccggtgctggctgaaaattataagtcacagcagtcatcagatcctgatcccaattgcgtggatagacctgtcgagggctacctggcagtcgctgtggtgcgccgttccgacacttcacttacatggaactctgtgaagggtaagaaatcatgtcacaccgcagtggatcgaacggccgggtggaacataccaatgggtctcttatttaatcagacagggagttgcaaatttgatgaatacttctcccagtcatgtgccccaggttcagaccctcggagtaatttatgtgccctgtgtataggagacgagcagggggaaaataagtgtgtgccaaattcaaatgagaggtattacggatacactggggcgtttcggtgcctggccgagaacgcaggagacgtggcattcgtgaaagatgtcacagtcttgcagaacactgacggcaataataacgaggcatgggccaaagacctcaagttagctgatttcgccttgctttgcctggacggaaagcggaaaccagttacggaggcccgatcatgccacctagccatggcccccaaccacgctgtggtctctcgtatggacaaggtagaaagattgaagcaggttttactgcatcagcaggctaagtttggtagaaatggatcggattgtcccgacaagttttgcctgtttcaatccgagactaaaaatctgctgttcaatgataacacagaatgccttgcccgattgcacggtaagacaacctacgaaaaatacctcgggcctcagtacgtcgccggaattaccaatctgaagaaatgcagcacctccccacttctcgaggcgtgtgagttccttaggaagtag

SEQ ID NO: 16111 - DNA, 1656 bp, Artificial Sequence
  Description of Artificial Sequence: Synthetic coding sequence
aagcccctgttgaatcacgttctcgcaataaagggaccaaggtcacgatggagaacattctacaatatagcgacccgcagaaaggccctcaagaatccgagcgaggagtacggtaaaattctggaggtggtgggaagatactccgtgcataatgctggtattagtttcagcgttaaaaagcaaggggaaactgttgccgacgtgcgcactctgccaaatgctagtacagtcgataatatacggagcattttcggcaatgccgtatcccgcgagttaattgaaatcggctgtgaagataagactctggcgtttaagatgaacggttatataagcaatgccaactactctgttaagaaatgtatcttcttactgttcatcaatcacaggctggtcgaatctacctcactgcggaaagctatagaaacagtttacgccgcttatttaccaaagaatacccacccattcttgtatctgtccctggagatctcgcctcaaaatgtcgatgtcaacgtccaccctaccaagcatgaggtccattttctgcatgaggagagcattttagagcgtgtacagcagcatatcgagagtaaattgctaggaagcaactcctcaaggatgtacttcacgcagaccctcctgcccggcctcgctggaccatcgggggagatggtgaagagcacaactagtctgactagttctagcacttctggtagttcggataaggtctatgcccatcagatggtgcggaccgattcaagagaacagaaactcgacgcgtttttgcagccactgtcaaagcctctgtctagtcagccacaagccattgttacagaagataagacagatatttcttcagggagggcccgccagcaggatgaagaaatgctggagttgcctgcccccgccgaagtggcggccaagaaccagagcttagagggcgacaccacaaaaggcaccagcgaaatgtccgagaagcgcggacccaccagctcaaacccacgtaaacgccatcgggaagactcggacgtggagatggtggaggacgattccaggaaagagatgacggcggcttgtacacctagacgcagaatcataaacctaacaagtgtcctgagtctccaggaggaaattaacgagcagggccacgaagtcttacgggagatgctgcataaccattccttcgtgggatgtgttaatccacagtgggccctggctcagcatcagacaaagctgtacctgctcaacactactaaactctccgaggaattgttttaccaaatactgatctatgattttgcaaattttggggtcctgagattgtctgagcctgctcctctgttcgatctagctatgcttgccttagacagcccggaatcaggctggaccgaagaggatggtccgaaagagggtctggctgaatacatcgtggaattcctgaagaagaaagctgagatgctggccgattatttctcactggaaatcgatgagtcagaggttcctggctctatccccaattcatggaagtggacagtcgaacacattgtttataaagccctgcgctcgcatatcctcccaccgaagcacttcaccgaggatggtaacatactgcagctggcaaatctgccagacctatacaaggtgttcgaacgctgttag

SEQ ID NO: 16112 - DNA, 351 bp, Artificial Sequence
  Description of Artificial Sequence: Synthetic coding sequence
atgagcgagaagagaggaccaaccagctccaacccacgcaagaggcatagggaagacagtgacgtggagatggtcgaggacgattcaaggaaagagatgactgccgcctgcacccctcgaaggagaatcatcaatctaacatcagtgctttcactgcaagaggaaatcaatgaacaaggacacgaggtactccgggagatgttgcataaccacagctttgttggttgtgttaaccctcagtgggctctggcacagcatcagactaagctgtacctacttaataccaccaaacttagagtgaagtgcttggcgccattccagacaccaggctctgggctctggaatacctag

SEQ ID NO: 16113 - DNA, 525 bp, Artificial Sequence
  Description of Artificial Sequence: Synthetic coding sequence
atgtcagagaagagagggcccacctcgtctaaccctcggaagaggcaccgagaggacagcgacgtagaaatggttgaggatgactccagaaaagaaatgacagctgcctgcactcctagacggaggatcattaacctgacgtctgtcctgagcctccaggaggaaatcaatgagcaggggcatgaggtcctacgcgagatgttacataatcactctttcgtgggatgcgtaaatccccagccgtggcacagcataaaacctagctatactttctccactcctccgtctttcagcgaggaactcttttatcagatcttgatctacgacttcgccaacttcggcgtgttacggctatcgtctgaagtcccagggtctatccctaacagctggaagtggacagtcgagcacatcgtttacaaggccctgcggagccacattctcccacccaagcatttcactgaggacggaaacatcctccagttggccaatctccccgatctctataaagtcttcgaacgctgctag

SEQ ID NO: 16114 - DNA, 1977 bp, Artificial Sequence
  Description of Artificial Sequence: Synthetic coding sequence
atggcctttgaggccctggcttcaatatcccacgtcgcccatgttaccattacaaccaagaccgctgacgggaagtgcgcttatcgcgcatcatactctgatggcaagctcaaggcccccccgaaaccctgcgcaggtaaccaggggacccaaatcactgtagaagatctgttttataacattgccacccgccggaaggctcttaagaatccttcagaggagtatggcaaaatacttgaagttgtcggcagatatagcgtccacaatgcaggaataagctttagcgtgaagaagcaaggagagacagtagccgatgtccggaccctgccaaacgctagcaccgtggacaatataagatctattttcgggaatgccgtctcacgcgagctgatcgagattgggtgcgaagataaaactttagccttcaagatgaatggatatataagtaacgctaactacagtgttaaaaaatgcatcttcctcctctttatcaaccacagactcgtagagagcacatcgctgaggaaagcgattgagaccgtatatgctgcttacttgccaaaaaatacgcatccctttctatatctctccctagaaatctctcctcagaacgttgacgtgaacgttcaccccaccaagcacgaggtccactttcttcatgaagagagtattctcgagagggtgcagcaacacatcgagtccaaactactgggctccaattctagtaggatgtatttcacccaaacccttctccctggcctggccggcccatccggggagatggtgaaatcgactacatctctgactagtagtagcactagcggaagcagcgacaaggtgtacgcccaccagatggtcagaacagactcacgcgagcagaagcttgatgcctttctgcagccattgtccaaacctctctccagccagccacaggccatagtgacagaggataaaaccgacatcagcagcgggagagcccggcagcaagacgaagaaatgcttgaattgcccgcgcctgctgaggttgcggccaaaaaccaatcactggagggtgacaccacaaagggaacctccgagatgtctgagaagaggggccctacatccagcaatccacggaagcggcatcgtgaggacagcgatgtggaaatggtggaggacgattcacgaaaggagatgaccgccgcatgtacgccaaggaggcgcatcattaatttaacctccgttctatctctccaggaggaaatcaatgagcaaggccatgaagtgctgcgagaaatgttacataatcatagctttgtgggatgcgtgaacccacaatgggccctggctcaacaccagactaaactgtacctgttgaatacaaccaagttgtcagaagaactattttaccaaatcttgatctacgatttcgccaattttggtgtcctgcggctctctgaacctgcacccttgttcgacctcgcaatgctcgctctggattccccagagagcggctggactgaagaggacggacctaaggagggcctggcagagtatattgtggagtttctcaaaaagaaagccgaaatgttagcagattatttctctctagagatcgatgaggaagggaacctgatcggcctgcccctcctcattgacaactacgtcccacccttagaaggcctccccatatttatcttgcgcttggcgaccgaggtgaattgggatgaggaaaaggagtgttttgaatctctttctaaggaatgcgcaatgttctattctattcgcaagcaatacatcagcgaggaaagtacgctctcagggcagcaatccgaggttcctggctctattcccaatagctggaaatggaccgtcgaacacatagtttacaaagcccttcgttcacacattctgccacctaagcattttaccgaggacggcaacatcctccagctggcaaacttaccggacctgtacaaagtgttcgagagatgttag

SEQ ID NO: 16115 - DNA, 960 bp, Artificial Sequence
  Description of Artificial Sequence: Synthetic coding sequence
atgattgagaactgccttgacgccaagtctacctccattcaggtgatcgttaaggaaggtggactgaagttaattcaaattcaggacaatggcacgggaattaggaaagaggacctagacatcgtttgtgaacggtttaccacctccaagttgcagagcttcgaagatctggctagcatctccacctatggtttccgcggagaagctctagcgagtatttcccacgtagcgcacgtgactattactactaagaccgcagatggcaagtgcgcatatcgggccagctactccgacggcaagctcaaggctccaccgaaaccctgcgccggaaatcaaggaacacaaattaccgtggaggatctgttctacaatattgcaacacgcaggaaagccctgaaaaacccttcagaggagtacggtaagattctggaagtagttggcagatattctgtccataatgctggtattagtttctctgtgaagaaacagggagaaactgttgccgacgtgcgtacgctcccgaacgcgtccactgtcgataacatacgatctattttcggcaacgcggttagtagggaactgatcgaaattgggtgcgaagacaagaccctggcgtttaaaatgaacggctacatcagtaacgctaattacagtgtgaagaaatgcatattccttctatttataaatcaccgccttgtggaatcaacctcccttcggaaggctatcgagactgtctacgctgcctacttgcctaaaaacacccaccctttcctgtatctgtccctggagataagccctcagaacgtggacgtaaacgtacatcctactaaacacgaggttcatttccttcacgaggagtcaattttggaacgcgtccaacagcacatcgagtcaaagttactgggttcgaatagctcccgaatgtacttcacacaaaaggaaacctctgggcgcttttag

SEQ ID NO: 16116 - DNA, 1548 bp, Artificial Sequence
  Description of Artificial Sequence: Synthetic coding sequence
atgaatggttacatcagtaacgctaactattctgtcaagaagtgcatcttcctcttattcatcaatcatcgacttgtggaatccacatcactaagaaaggcgattgaaacggtgtatgctgcttaccttcctaagaatacccatccgtttttgtacctttctctcgagatatcaccccagaacgtggatgttaatgttcatccaactaagcacgaggtccattttctgcacgaggagagcatcttagaacgcgtgcaacaacacattgagagcaagctgctgggatctaatagctcaagaatgtacttcacgcagacgttactcccagggctggccggcccatccggcgagatggtgaaaagcactacttcacttacaagtagcagcacctcagggagctccgacaaagtctacgcccaccagatggtgaggactgactcaagggagcaaaaactcgatgcattcctgcagcccttgtcaaagccattatcctcacagccacaggctattgtgactgaggacaaaaccgacattagctcaggccgggcccgccagcaagacgaggaaatgctagagttgcccgcgccagcggaggtggcagctaagaatcagtcactggagggagatactactaaagggacctccgagatgagtgagaaaaggggacccacaagctcgaatccccgcaaaagacaccgagaggatagcgacgtggaaatggtggaagatgactctaggaaggagatgacagccgcatgcaccccccggagaaggatcattaacttaacatctgtattatctctgcaggaggagattaatgagcagggacatgaggttctgcgagaaatgctgcacaaccattcatttgtaggctgcgtcaaccctcagtgggccctggctcaacaccaaacaaagctgtacctgctgaacacgacaaaactgtctgaggaactgttttatcaaatcctgatttacgatttcgccaattttggggtgctgcgattgagcgagcccgcaccgctctttgatctagctatgctcgcactggacagccccgagagtgggtggaccgaggaagacgggcccaaggagggactcgccgagtatatcgtagagttcttgaaaaagaaagctgaaatgcttgctgactatttcagcttggagattgacgaagagggtaatcttatcggtctacctctgcttatcgacaactacgtgccgcctctcgaaggtttacccattttcattcttcggctggccacggaggtgaactgggacgaggagaaggaatgctttgaaagcttatccaaagaatgcgccatgttttacagcatccggaagcagtatatatcagaagagtccacactcagcgggcagcaatccgaggtacctggatccatccccaactcctggaagtggactgtagagcacatagtatataaggctttgaggagtcatatcctcccacccaaacatttcaccgaggatggcaacattttacagctggccaacctcccagacctgtataaggtcttcgagcgctgctag

SEQ ID NO: 16117 - DNA, 2040 bp, Artificial Sequence
  Description of Artificial Sequence: Synthetic coding sequence
tgaaggctggacgaaacagtcgttaatagaatcgccgcgggcgaagtgatacagcgtccggcaaatgcaattaaagagatgattgaaaactgtttagacgcaaaaagtacctctatccaggtaattgtgaaggagggcggactgaagctgatccagatccaggacaatgggacgggaattcgcaaagaagacctggatatcgtgtgcgaacggttcacgactagtaagttgcagtcctttgaagacctcgcttcgatttcaacatacggcttcaggggcgaggcgttggcctccattagccatgtggcacatgtcactatcactacaaagactgccgatggcaaatgtgcgtacagagcatcttacagcgatggaaagctgaaggctccccccaagccgtgtgcaggaaatcagggtacacagataaccgtagaagacctgttctacaacattgcaacaagaaggaaggctctcaaaaacccctccgaagaatatggcaagattctggaggtcgtaggaaggtacagtgtgcacaatgctggcatctccttctccgtgaagaaacaaggcgagactgtggcagatgttagaaccctgcccaacgcttctactgtagacaatatccgttccattttcggaaatgctgttagtagggagttgattgagattggctgtgaggacaaaacactagcattcaagatgaacgggtatatatccaatgcaaattactcagtgaaaaagtgtatctttctgctgtttattaaccatcgactggtcgagtctacctcgctgcggaaggccatcgagacagtgtacgctgcttacctgcccaagaacacgcacccattcctgtatctgagtctcgagatttccccacaaaatgttgacgtcaacgtgcaccccaccaagcacgaagtgcacttcttacacgaagagagcattctggagcgggttcagcagcatatcgagagtaagctcctgggttctaactcctcacgtatgtattttacacaaaccctcctccctgggctcgcaggccctagcggagaaatggttaagtcaaccaccagtctcacctcatctagtacgagcggctcaagcgataaagtttacgcacatcaaatggtccgcacggacagtagggagcagaagttggatgccttcctccagcccttgagtaagccactgtcatcacagccacaggccattgtaacagaggacaagaccgatatatcttccggccgggcccgtcagcaagatgaggaaatgttggaactgcctgcccctgctgaagtggcagcaaagaatcagagccttgaaggcgacacaactaagggaaccagcgagatgtctgaaaaaaggggcccaaccagcagcaacccgagaaaaagacaccgagaggattctgacgtggaaatggtagaggatgactctagaaaagagatgaccgcagcatgcacacctcggcgaaggataattaacctcacttccgtcttgtctctgcaagaagagatcaatgagcaaggacacgaagtccttcgggagatgctgcacaaccattccttcgtgggctgcgtcaacccgcagtgggcactggctcagcaccagacaaagttgtatctgctgaatacgactaaattgtccgaagaactgttttaccagatcctgatctacgatttcgcaaattttggagtgctgcgactgtccgaacctgctcctctttttgacctggcaatgctcgccctggactccccggagagcggctggacggaagaagacggcccaaaagaaggcctggcagaatacatcgtggaatttctgaaaaagaaagctgagatgctcgccgattattttagtttagagattgatgaaagcgaagtcccaggttcaatacccaattcctggaagtggactgtcgagcacatagtgtacaaagcccttaggtctcatattctgcctccaaaacactttactgaagatgggaacattctacagctggctaaccttcctgacttgtataaggttttcgaaaggtgctag

SEQ ID NO: 16118 - DNA, 1548 bp, Artificial Sequence
  Description of Artificial Sequence: Synthetic coding sequence
atgaatggctacataagtaatgctaactattcagtaaagaagtgtatctttttgctgttcatcaatcatagacttgtggaaagcacctcccttagaaaggccatcgagaccgtgtatgccgcttatctgcccaagaatacacatccttttctgtacctgagtctggaaataagccctcagaatgtcgatgttaacgtgcatccgaccaagcacgaagttcacttcctgcacgaagagtctatcctggagcgcgtacagcagcacatcgaaagtaaactgcttggcagtaattcttctagaatgtattttacccagacattgttgcccggcctggccggacctagcggggaaatggtgaaatcaactacctctttgacgtcatcatcaacaagcgggtccagtgacaaagtgtatgcacatcaaatggtcagaactgacagccgcgagcagaagttggacgcctttttgcaaccattgtctaaaccactcagcagccagccacaggcaatcgtgactgaagataaaaccgacatttcttcgggacgagcccgccagcaggacgaggagatgctggaattgcctgccccagcagaagttgcggcgaaaaaccagtctttggaaggtgatactacaaaaggaactagcgagatgtccgaaaagcgaggacccacaagcagcaatccacgcaagaggcaccgcgaggatagcgatgtggagatggttgaggacgactcccgcaaagagatgacagccgcctgtacccctcgtcgaaggatcataaacttaacaagcgtgttgtccctccaggaggaaattaacgagcaggggcacgaggtgctgagggagatgctgcataaccatagcttcgtgggctgcgtgaatccccagtgggcccttgcacagcaccaaaccaagctgtacctgctcaatacgactaagctaagtgaggaactgttctaccagattctaatttacgacttcgccaattttggtgtacttaggctgtctgagccagcacccctgtttgatctggctatgctggcgctcgactcccctgagtctggatggaccgaagaagacggaccaaaagaaggactggccgagtacattgtcgagtttctgaagaagaaagccgagatgttagcggactacttttcgctggagattgacgaggagggaaatctcatcgggcttcccctgctgatcgataactatgttcccccacttgagggcctgccgatcttcattctacgcctggcaaccgaggtgaattgggacgaggaaaaggagtgtttcgagtcactgtctaaggagtgtgcgatgttctactcgatcaggaaacagtatatctctgaagagtccacattatcggggcagcagagcgaggtgccggggtctatccccaatagctggaagtggaccgtggagcacattgtgtacaaagccctccgcagccacatactccctcccaagcacttcacagaagacggcaacatccttcaactcgcaaacctcccagatttgtacaaagtcttcgaaagatgctag

SEQ ID NO: 16119 - DNA, 1383 bp, Artificial Sequence
  Description of Artificial Sequence: Synthetic coding sequence
atgaatggttatatcagcaacgcaaactactccgtcaagaagtgcatatttcttctttttattaaccatcgcctggttgagtcgactagcctgcggaaagccatcgagacagtttatgcggcctacttgcccaagaacacgcaccctttcttatacctgtcattggagatctcgccgcagaacgtggacgttaatgttcatcccaccaagcacgaggtgcacttcctccatgaagagtcaatcctggaaagagtccaacagcacatagagtccaaactgctgggatccaattcctcccggatgtacttcacacagacattgctgccgggcctcgcaggaccatcaggcgaaatggtgaagtctaccacatctctgacttctagcagcactagtgggtccagtgataaagtctatgcccatcaaatggtgcgaaccgactccagagagcagaagctggacgctttcctgcagcctcttagtaaaccacttagctctcagccccaggctatcgtgaccgaggataaaaccgatatctccagcggccgtgcgcgacagcaggacgaggagatgctcgagttgcccgcccctgccgaagtagcagcaaagaaccagtcactggaaggagataccacgaaaggtacgtccgaaatgagcgagaaacgagggcctacctcaagtaatccaaggaagcgacaccgagaagatagcgacgtggaaatggtggaggacgactccagaaaggaaatgaccgcggcatgcacgccaagacgccgaatcatcaacctgacatcagtgcttagcctgcaggaagaaatcaacgaacaggggcatgaggtgctgagagaaatgctccacaaccacagttttgtaggatgcgtcaacccgcaatgggcattggcacagcaccagacaaagctgtatctgctgaataccactaagctgtccgaagaacttttctaccagatcttgatatatgactttgcaaattttggcgtgctgaggctcagtgaacccgctccattatttgacctggcgatgctggcattagactcccctgaatccggctggacagaggaagacgggccgaaggaggggttagcagagtacattgtggaatttcttaaaaaaaaagccgaaatgctggccgactattttagccttgagattgacgaggagggcaaccttatcggcctccccctactgattgataactacgtgccgccacttgaaggcctgccaattttcattctccgcctggccacagaggttaattgggatgaagaaaaggagtgtttcgaatccctgtccaaagaatgtgccatgttttacagtatccgcaagcagtatatctccgaagagtccactttaagcgggcagcagtag

SEQ ID NO: 16120 - DNA, 843 bp, Artificial Sequence
  Description of Artificial Sequence: Synthetic coding sequence
atgattgagaattgcttggacgcgaagagcaccagtattcaggtgattgtgaaggaaggtggcttaaaactcattcagatacaagataacggcacaggcatacgaaaggaagaccttgacatcgtgtgtgagcgcttcacaaccagcaagttgcagagttttgaggacctggcctcaatatccacttatggctttcgcggcgaagctttggcaagtatttctcacgtcgcccacgtcaccataactacaaagacagcggatggaaaatgcgcgtacagagctagttatagcgacggcaagctgaaggcaccaccgaaaccttgtgcaggaaatcaagggacacaaattaccgtcgaggacctgttctacaacattgctactcggcggaaggcactcaagaacccatccgaggaatatggaaaaattcttgaagtagtgggccgctactctgtgcacaacgcagggatcagctttagtgtcaaaaagcagggagagaccgtcgccgatgtccgcacgcttccaaacgcttcaacagtggataacatcaggtcaatcttcgggaatgccgtatctagagagctaattgagattggctgtgaagataaaactcttgcctttaaaatgaatggttatataagtaacgctaactactccgtgaagaagtgcatttttttgctgttcatcaatcaccgtctggtcgagtccactagcctgagaaaggccattgagaccgtgtacgctgcatacttgcccaaaaacacacacccattcctgtacctgcgactctgttaccaggatctgctagcacccctgggcagatggttgaatccgcagcaggtttag

SEQ ID NO: 16121 - DNA, 1548 bp, Artificial Sequence
  Description of Artificial Sequence: Synthetic coding sequence
atgaatggctacatcagcaacgccaactattccgtcaaaaaatgcatcttccttctatttattaatcatagacttgtggagtcaacatcactccgaaaggcgatcgaaaccgtgtatgctgcgtacctcccgaagaatacccatccctttctgtacctctccctagagatttctccacagaatgtcgacgtgaatgtgcatccgactaaacacgaggtgcatttcttgcatgaagaatctatcttagagcgggtccagcagcatattgagagtaaactcttgggaagtaattcctcccgcatgtatttcacccaaactctgctgcctggtctcgcaggacctagcggggagatggtgaaaagcacgacatccctgaccagcagctctaccagcggaagctcagacaaggtctatgcccatcagatggtgcgcacggacagccgggagcagaagctggatgcattcttacagcccctgagcaaaccactctccagccaaccccaggcaatagttacagaggacaagacggacatctctagcggccgcgcaaggcagcaagacgaggaaatgctcgagctccctgcgcccgcagaagttgccgctaagaaccaatcgctggagggggatactacaaagggaacatctgagatgtcagagaaacgcggtcccacctccagcaacccccgaaaaaggcatcgcgaagacagtgacgtcgaaatggtagaggatgactcgagaaaagaaatgacagctgcttgtaccccccgccggcgtatcatcaacttgaccagcgtactgagccttcaggaagagatcaacgagcaggggcatgaggtccttagggaaatgctgcacaatcactcttttgtggggtgtgtgaatcctcagtgggccctagcccagcatcagaccaaactatatctgcttaataccaccaaactgtccgaagagctgttttatcagatattgatatatgacttcgcaaacttcggggtgctgaggctgagcgaaccggcaccgctgtttgatctcgccatgctagctttggactctcctgagagtggatggacggaagaggatggtccaaaagaaggactggcagaatacatcgtcgagtttctgaagaaaaaggccgagatgctggcggattacttctcattggagatcgatgaagagggtaacctgattggactcccactcctaatagacaattacgttcccccactggagggcctgcctatctttattctgcggctggcaactgaagttaattgggacgaggaaaaagagtgcttcgaatctctgtcaaaagagtgcgctatgttctattccattcggaagcagtacatctcagaagaaagtacactgtccggtcagcaatcggaggtacccggaagtatcccaaactcctggaaatggaccgttgagcacatcgtttacaaggcactgaggagtcacatcctaccgcctaagcacttcacagaggatgggaatatcctgcagcttgctaacctgcccgacctgtataaagttttcgaacgttgctag

SEQ ID NO: 16122 - DNA, 4290 bp, Artificial Sequence
  Description of Artificial Sequence: Synthetic coding sequence
atgatcaaatgtctgagtgtggaggttcaggccaagttgagaagcggcctagccataagctcattgggacagtgtgtggaggagttggccctcaactctatcgatgccgaagccaaatgcgtagctgtccgggtaaatatggaaacttttcaggtccaggtaatcgacaatggattcggaatgggttcagacgacgtggaaaaagtcggcaacagatactttacctctaagtgccattcagtgcaggacctcgaaaacccccggttttacggatttcgcggagaggccctcgctaatatcgccgatatggcaagtgccgtagaaatctcatcaaagaagaatcgaactatgaagacattcgtgaagttgtttcaaagtggcaaagccctcaaggcatgcgaggcggatgtgactcgggcttccgccgggaccacggtgaccgtttacaatcttttttatcagctacccgttcggagaaagtgtatggacccacggctggagttcgaaaaggtcaggcaacgtattgaggccttaagcttgatgcaccctagtataagtttcagcctgcggaatgacgtctctgggagcatggtgctccagcttccgaagacaaaggacgtttgttctagattctgtcagatctatggccttggcaagtctcagaagctcagggaaatcagttttaaatacaaggaattcgagctctcaggatatatttcttctgaagctcattacaataagaacatgcagttcttgtttgtgaacaaaagacttgtattacgaaccaagctccacaagctgatcgacttcctgctccgaaaagaatccatcatctgtaaaccgaaaaacgggccaacttctaggcagatgaacagttccttaaggcatcgctccaccccagagctttatggaatatatgtgatcaacgtgcagtgtcagttttgtgaatacgatgtgtgcatggagcccgctaagaccctgattgaattccagaactgggatacgttgttgttttgcattcaagagggagtcaaaatgttcctgaagcaagaaaagctgtttgttgaactgagcggggaggacataaaagagttttctgaggacaacggtttctcactgttcgatgctacgttgcagaaacgagtgacaagcgacgaacgttcgaatttccaggaggcctgcaacaatattttagactcttacgaaatgtttaaccttcaatctaaagccgttaaacggaagacgacagctgagaatgttaacactcaatcttccagggacagcgaagccacacgaaaaaacacaaatgacgcgtttctgtacatttacgaaagtggaggcccaggtcatagcaagatgacagaaccatctctgcagaacaaggacagctcctgtagtgagtcaaagatgttggagcaggaaaccatcgtggcatcggaggctggtgagaacgagaagcacaagaaaagctttttagaacactcctccctggagaatccctgcggaacctcgctggagatgttcctgagcccgttccagaccccatgccacttcgaagaatctgggcaggatctggagatctggaaagagtccaccacggtgaacgggatggccgccaacattctgaagaacaatagaatccagaatcaacccaaaagattcaaggatgccacagaagtgggctgccagcccctacctttcgccaccaccctatggggggtccattccgctcaaactgagaaggaaaaaaagaaagaaagcagcaactgtggccgcagaaacgtgtttagctacgggcgggtaaagctgtgcagcaccggatttattacacacgtcgtgcaaaacgagaaaacaaagtcaaccgagacggaacattcattcaaaaactatgttcgccccggcccaacaagggcccaggaaactttcggtaataggacgcgacactctgtcgagactcccgacatcaaggatctggcaagcacattgtcaaaggagagcggccagctcccaaataagaagaactgtagaactaatatttcctatgggcttgagaacgaaccaaccgctacctatacaatgttttctgcattccaggaagggtctaagaaatcccaaacggactgtattttgagtgatacttccccaagttttccatggtacaggcacgtaagcaatgatagtcgtaaaacggataagctgatcggattcagtaagccaattgtgaggaagaaactgagcttgtcaagccagctgggaagcctggagaagttcaaacggcaatatggaaaagtcgagaaccctctggacaccgaagtagaggagagcaacggagtgacaacgaacctttctctgcaagtggaacccgatatcctattgaaggacaaaaatcgactcgaaaactccgacgtgtgtaagatcacaacaatggaacattcagacagcgactccagttgtcagcccgcatctcacatcctgaattcagaaaagttcccattctctaaagatgaggattgcctcgagcaacaaatgcctagtcttagggaatcccctatgaccctcaaggagctgtccctgttcaatcgtaagccactggatctggagaaaagcagcgaatctctcgcatccaagctatctaggcttaagggctctgagagggagacccagacaatgggcatgatgagtaggttcaacgaattaccaaacagtgacagttctagaaaggacagtaaattgtgctctgtcctcacccaggacttttgtatgctgttcaacaataaacatgaaaaaaccgaaaacggcgtcattccaacctcggacagcgctacgcaggataatagtttcaacaaaaactcaaagactcattctaattctaacactaccgagaattgcgtaatctccgagacccccctcgtgctaccatataataattcaaaagtaaccggtaaggatagtgacgtcctcattcgcgctagcgaacagcaaattggctctctggactccccttctggtatgctgatgaatcccgtggaagatgcaacaggtgatcagaatggcatctgctttcaatcagaggaaagtaaggctcgcgcctgtagtgagactgaggagagcaatacatgctgctctgattggcagcgccattttgacgtggcattgggccgcatggtgtacgtgaataagatgaccggtctgtccacttttatcgcacccaccgaagatattcaagccgcctgcaccaaagatctgacaactgtcgccgtcgacgtcgtgctggagaacggatcacaataccgatgccagcctttcagatcagaccttgtgcttccgtttctgccaagagcccgagccgagcgcacggtcatgaggcaggataacagggacactgtggatgacaccgtttcctccgagtcccttcaatcacttttctcagaatgggacaacccagtgtttgctcgttaccctgaggtggcggtggacgtgagcagcggccaggcggaatctctggccgtaaaaattcacaacatcctgtatccctaccgcttcacgaaaggtatgatccatagcatgcaagtgttgcagcaagtcgataataaattcattgcttgcttaatgtcaaccaaaaccgaagagaacggtgaggcagactcatacgaaaagcagcaggctcagggcagcggaaggaagaagttgctgagctccaccctgattccaccactcgaaatcaccgtgaccgaggaacagcggcgcctgctctggtgttatcataaaaacctggaagatcttgggctcgagtttgtgttccctgataccagtgactccctagtgttagtgggcaaggtgccactctgctttgtggagcgggaagctaacgagctgcgcagaggtagatccacagttactaagagcattgtcgaggagttcatacgggagcagcttgaacttttgcagactactggcgggatccagggtaccctaccactgacagtccaaaaagtactggcctcccaagcctgccatggggccatcaaatttaacgacgggctttctctgcaggaaagttgccggttgattgaggcactgagttcttgtcaactgccgtttcagtgcgcacacggacggccgtcaatgctgcctctggccgacatcgaccacttagaacaggaaaaacagattaagcctaacctgaccaagttaagaaagatggcccaggcatggaggctcttcggcaaggctgaatgcgacacacggcaatcattgcagcagtctatgcccccatgcgagcctccttag

SEQ ID NO: 16123 - DNA, 4362 bp, Artificial Sequence
  Description of Artificial Sequence: Synthetic coding sequence
atgattaaatgcctctccgtggaggtccaagcaaagttgcggtccggcctggcaatatccagcctaggtcagtgtgtggaggagttggctctcaacagtatcgacgccgaagccaaatgcgtggcggttcgggtgaatatggaaacgttccaggttcaggtgatcgacaatgggttcggtatgggttcagatgatgtagagaaagtggggaataggtatttcactagtaaatgccactctgtgcaagacttggaaaaccctcggttttatggcttcagaggcgaagccttagcgaatatagctgacatggctagcgccgtcgagatcagctctaagaaaaatcgcactatgaagacatttgtgaagctcttccaatctggaaaggccttgaaggcctgcgaggccgatgttactcgcgccagcgccgggactaccgtgacagtatataacctattttaccagctgcccgtcagacggaagtgtatggatccccgactggagttcgagaaggtgagacagcggattgaggcacttagcctcatgcacccaagcataagcttttccttgagaaatgacgttagcgggagtatggtgctgcagctgccaaaaacgaaggatgtatgctcccgcttttgccagatctatggcttaggtaaatctcagaaactcagagaaattagttttaagtataaagaattcgaactgtccggatacattagttcagaggcacactataataaaaacatgcaattcctgttcgtaaataaacggcttgttctccggacaaaactgcataagcttattgattttctgctgcgaaaagagagcattatttgcaagcccaagaacggccctactagcagacaaatgaactcttcactcagacaccggagtactccagagctttacgggatctatgtgatcaatgtgcagtgtcaattctgcgagtacgatgtctgtatggagcccgccaagactctgattgaatttcagaattgggacacgctgctattttgtatccaggaaggggtgaaaatgtttcttaagcaggagaaactgtttgtggagctctcaggagaagatatcaaagaattctctgaagataacggtttttctctgttcgatgcgacattgcagaagcgagtcacttccgacgagcgctcaaattttcaggaagcgtgtaataatatcctggactcttatgaaatgttcaacctccagagtaaggccgtcaagcgtaagaccacagcagagaacgtgaatactcagtcgtctcgcgattctgaggccacccgcaagaatacaaatgacgctttcctgtacatttacgaaagcggaggccctggacactctaagatgacagaaccaagtttacagaataaggactcttcttgcagtgaaagtaaaatgctcgagcaggaaactatcgtagcctcagaggccggagagaacgaaaagcacaagaaatcctttctagagcattcttcacttgaaaatccatgtgggacttctttagagatgttcctgtcgcctttccaaactccgtgccactttgaggaaagtgggcaagatttggaaatctggaaggaatccacaaccgtgaatggcatggctgccaacattctgaaaaataataggatccaaaatcagcctaaaaggtttaaggatgctacagaggttggctgccagccattacccttcgcaacaacactttggggggtgcattcagctcagaccgagaaagagaaaaaaaaagagtcctctaattgtggccgacgaaacgtattcagttacggacgcgtgaaattatgctccacagggtttatcacacacgtcgttcagaatgagaagaccaagtccaccgagactgaacactccttcaaaaactacgtcagaccaggaccgactcgcgctcaggaaacatttggcaacagaacaagacattccgtagagacaccagatattaaggacctggcttccactctttccaaagaatccggacaactgcctaataagaagaactgtcgtacaaacatttcgtatggactggagaacgagcccactgctacctacacaatgttctctgccttccaggaagggagcaagaaatcacagactgactgcatcctttcagatactagtccaagttttccatggtaccgccatgtctccaatgatagccggaagaccgacaaactgatcggattttcaaaacctatcgtgcggaaaaaactcagcctgagttcccaactgggttctttagaaaaatttaaaaggcaatacggcaaggtcgagaaccctttggataccgaggtggaggagtctaatggagttaccaccaacctgagcctgcaggttgagcctgacatactgctgaaggacaaaaatcgcctggagaattccgatgtgtgtaagattactacaatggagcactccgactccgatagctcttgccaacctgcttcgcacattctgaattcggaaaagtttccattttcaaaagacgaagattgtcttgagcagcaaatgcccagcctgcgcgaaagtcccatgaccctgaaagagttgtcgctttttaatcgtaaaccactggatctggagaagagtagcgaatctctggcttctaagttatctcgtctgaaggggagtgagcgggagacgcagacaatgggtatgatgtcacgttttaacgagctccctaattctgatagttccaggaaggattctaaactttgttctgttctgacccaagatttctgcatgttgtttaataataagcacgagaaaacagaaaatggggttatcccaactagtgatagtgccacccaggataactcttttaataagaattctaaaacacatagcaatagtaatacaaccgagaactgcgtgatatcggagactcccctcgttctcccttacaataattccaaggttactggtaaagactccgatgtgctgattcgcgcgagcgaacagcagatcggttctctggactcccctagcgggatgttgatgaatccagtggaagatgcaaccggcgatcaaaatggcatttgtttccaatccgaggaatccaaagcacgagcctgctctgaaacagaggaatctaacacctgctgtagtgattggcagcggcactttgatgtggcactgggtcgaatggtgtacgtcaataaaatgaccggtttgtctaccttcattgcccccactgaggacatccaggcagcatgcactaaggacctgacaactgtggcagtggatgtcgtgttagaaaatggtagccaataccggtgtcaaccttttcgatctgatctggtactccccttccttcctagggcacgggcagaacgcaccgtgatgagacaggacaatcgggacacagtggatgatactgtatcctctgagagtctgcaatccctgttctccgaatgggacaacccggtgttcgcccggtatccggaggtcgctgtagatgtaagtagcggtcaagctgagtctctcgccgtcaagattcacaatattttatacccttaccgtttcactaaagggatgattcacagcatgcaagtgttgcagcaggttgataataagtttatcgcatgtttgatgagtacaaagactgaggagaacggggaggctgggggcaacctgctggtgctcgtcgatcagcacgccgcccacgagagaattcggttggagcagctcatcatcgattcgtatgaaaagcaacaggcccagggatccgggcgaaagaaactgctcagtagtaccctcatcccaccactagagataacagtgacagaggaacagagaaggctcctatggtgttaccacaaaaatctcgaggatctgggcctggagttcgtattccctgatacatccgattcactggtgcttgtaggcaaggttcctctgtgctttgtcgagcgcgaggccaatgagctgagaagggggcgctcaactgtcacgaaaagcatcgtggaggaatttatcagagagcagctggagctgttgcagaccactggggggatccaggggacactacccctgactgtacagaaggtgcttgcctctcaggcctgccacggtgcaattaaattcaatgacggactgtctttgcaggaatcgtgtaggttaatcgaggctctctctagttgtcagctgccattccagtgcgcccacggtagaccatctatgctgcccttggctgacatagatcacttggagcaggagaagcaaataaaacccaacctaacgaaactaagaaagatggcccaggcatggcgcctctttgggaaggctgagtgcgacactcgccagagtctacaacagtcaatgcccccatgcgaacccccatag

SEQ ID NO: 16124 - DNA, 1176 bp, Artificial Sequence
  Description of Artificial Sequence: Synthetic coding sequence
atggtatacgtaaataagatgacaggtctgtccacatttatcgcccccacagaagatatccaggctgcctgcaccaaggacctgaccactgtggcggtcgatgtggtcctagaaaatggatcgcagtaccgctgtcagcccttccggtctgatctggtgctcccatttctgccacgggcccgggcagagcgcacagtgatgcggcaggataatcgcgatactgtggacgataccgtatccagcgaatcgctccaatccctcttctccgagtgggacaatcctgtctttgccagatacccggaggtagcagtcgacgtcagctccggccaggcagagagcctggcagtgaagatccacaatattttgtacccctacaggttcaccaagggtatgattcattccatgcaggtgctgcagcaggttgacaataagtttatcgcctgtctaatgagcaccaagaccgaagagaacggagaggccggcggcaacctattagtactagtggaccagcatgccgctcacgagcgaattaggctggaacagctcattatagattcttatgaaaagcagcaggcacaaggcagcggacgtaagaagctcctttccagtaccctgatcccgccacttgagatcacggtaactgaggagcagcggaggctcttgtggtgttatcataagaatctcgaagatctgggtttggagttcgtgttcccggatacttctgatagcctggtgctggtcgggaaggtcccgctgtgctttgtcgagcgcgaggcgaatgaattgcgccgggggaggtccacagttacaaagagtatcgtcgaactactccagaccacaggtgggattcagggcaccttgcctctgacggtacagaaggtcttggcaagtcaggcttgccatggagctatcaaattcaacgacggtttgtccctgcaggagtcttgtcggctgatagaggccctctcttcctgtcagctgcctttccagtgcgctcatggccggccgagcatgctgcctttggccgatatcgatcatctcgaacaggagaagcaaataaaaccaaaccttaccaagctgaggaaaatggcccaggcctggcgattgtttggcaaagctgagtgcgatacacgacagtcactgcagcagtccatgcccccttgtgagccaccatag

SEQ ID NO: 16125 - DNA, 597 bp, Artificial Sequence
  Description of Artificial Sequence: Synthetic coding sequence
atgaaccctgtggaagatgcaactggcgatcagaatgggatttgtttccagagcgaggagtctaaggcccgcgcatgtagtgagaccgaggagagcaacacttgctgttctgactggcaaagacactttgacgtagctctcggacggatggtctacgtgaacaagatgactggcctcagcaccttcatcgcacccaccgaagacatccaggccgcatgcaccaaggatctgacgacagttgcggtggatgtagtcctggagaatggttcacaataccgatgtcagccctttcgaagcgatctagtgctgccatttttgcctagggctcgggccgagcgcacagtcatgcgccaggacaatagggacacggttgatgataccgtctcttccgagtcactacagagtctattctcagagtgggacaaccctgttttcgcccggtatccagaggtgcttcagcaggttgacaataagtttattgcctgtctgatgtcaaccaaaaccgaggaaaacggagaggcagccgaactcatgatgttgcaggatccatgctgccggcagagcagagaagacgagaaccacgagttctcactgtag

SEQ ID NO: 16126 - DNA, 489 bp, Artificial Sequence
  Description of Artificial Sequence: Synthetic coding sequence
atgatcaagtgtcttagcgtggaagtccaggcaaagcttcgctccggccttgcaatcagttccctgggtcaatgtgtggaggaactcgctctaaatagtatcgacgctgaggccaaatgtgtggccgttagagtaaatatggagaccttccaagtgcaggtgatcgataatgggttcggtatggggagcgacgatgtcgagaaagtcgggaataggtactttaccagtaagtgccactctgtgcaagatctggagaatccccggttttacgggttcaggggcgaagctcttgcaaacattgcagacatggcttcagcagtggagatttcaagtaaaaagaaccgcaccatgaagacatttgtgaagctgttccaaagcggtaaggcgctgaaggcttgtgaggctgatgttaccagggcaagtgcaggaaccaccgtgactgtctacaatctcttctatcagctcccagtgaggcggaagtgtatgtag

SEQ ID NO: 16127 - DNA, 4362 bp, Artificial Sequence
  Description of Artificial Sequence: Synthetic coding sequence
atgatcaaatgcctgagcgtggaggtgcaggccaagctgcgctctgggctagccatcagttctttaggtcaatgcgtagaagagctggcgttaaactccatagacgcagaagcaaagtgtgtcgccgttagagttaacatggaaaccttccaggtccaggtcatcgataatggctttggtatggggtctgatgatgtggagaaggtgggaaaccgttattttacgtccaagtgccactcagtacaggatctggaaaatccaaggttttacggattcaggggtgaggcactagcaaacattgcagacatggccagtgcagtggaaatctcatccaagaagaatagaaccatgaaaacattcgtaaaactgttccaaagcggcaaagctcttaaagcctgcgaagccgacgtgactcgcgcctctgcagggaccacagtgactgtgtataacctgttctaccagctgccagttcgacgtaaatgcatggaccctagactcgagtttgaaaaggtcaggcagcgtattgaggctttgagcctcatgcaccccagcatttccttctcattgagaaacgatgtcagcggctcgatggtgttgcagttgcctaagactaaggacgtgtgttcacgcttttgccagatttatggcctggggaaaagtcagaagcttcgggagattagttttaaatataaagaatttgaattaagcggatatatcagtagcgaggcacactataacaaaaacatgcagttcttgttcgttaacaagagactagtgttgcgcactaaattgcacaagctcatagattttctgctgcgtaaggaatccataatctgcaagccaaaaaacggcccaacaagcaggcagatgaactcttccctccgccacagaagcactccggagctgtacgggatctacgtaattaacgtgcaatgccaattttgtgagtatgacgtgtgtatggagcctgccaagacattaattgaatttcaaaactgggatactctgctgttttgtattcaggagggcgtgaagatgtttctgaaacaagagaagctcttcgtggaactctcgggagaggacatcaaggaattctccgaggataacgggttctccttgttcgacgcgactctgcaaaaaagagtgacaagcgatgaaaggagtaacttccaggaggcctgtaataacattctggactcttacgagatgtttaacctgcagagcaaggcagtaaagcgtaaaaccacggccgagaatgtgaacacccagagtagtcgggacagcgaggccacgcgcaagaacacgaacgacgcttttttgtacatttatgaaagtggcgggcctggacactccaaaatgactgagccatcactgcagaacaaggattccagctgtagtgagagtaaaatgcttgagcaggaaaccattgtggcttccgaggctggtgaaaacgaaaagcacaagaagagctttcttgagcactcatctctggagaatccttgcggaacctctctggagatgttcttaagccccttccagacgccctgccattttgaagagagtggtcaggacctggagatctggaaagagtcgacaaccgtcaacgggatggcggccaatattttgaagaacaacagaattcagaaccaacccaagaggttcaaggacgctacagaggtcggttgccagcccctccctttcgctaccaccctgtggggggtccatagcgcccaaacagaaaaagaaaagaaaaaggagtcctctaactgcggaaggagaaacgtcttctcctacggccgggtgaaactttgctccacaggattcatcacacacgttgtccagaacgagaaaaccaagtccactgagacggagcattcttttaagaattatgttaggccgggtccaactcgcgcccaggaaacatttggaaaccggactcggcacagcgtggagacacccgatataaaggatctcgcctccacgctttctaaagagtctggccagctgccaaacaagaaaaactgccgcacaaacataagctacgggctcgagaacgagcccaccgcaacgtacaccatgttctcagccttccaggaagggtcaaagaaatcacaaacggactgcattctgtcagatacatccccctcgtttccatggtatcgccacgtgtccaacgattcccgaaaaaccgacaagctgatcggatttagcaagccaatcgtccggaagaaactgagcctctcaagtcagctgggctcactcgagaaattcaaaagacaatacggcaaggtggagaacccactggacactgaggtcgaggaatcgaacggggttactactaatctatccctccaggtagagcccgacattctcctcaaagacaaaaatcggctggagaacagtgatgtatgcaaaataacaacgatggagcattctgactcagattcttcgtgccaacccgcttcacacatcttgaattcggaaaaatttccattctcaaaggacgaggactgcctggagcagcaaatgccatcccttcgtgagtcgccgatgacgcttaaggagctttctctctttaacagaaaacctcttgacctagagaagtccagcgaaagtcttgcttcgaagctctctcgcctgaaggggagcgaaagagagacccagaccatggggatgatgtcacgattcaacgaactaccgaatagcgattcaagtcggaaagacagcaaattgtgctcagtacttactcaggatttttgcatgctattcaataataaacacgaaaagacagaaaatggggtcattccaaccagcgactcagctacccaggacaattcatttaacaagaactccaagacacatagcaactccaataccaccgaaaattgcgtcatcagtgaaacgccgttagtattgccctataataattctaaggtcacgggcaaggacagtgacgtattgatcagagctagtgagcaacagatcgggtccctggactcacccagcgggatgttgatgaaccctgtagaagatgcgacaggagaccagaacggcatttgcttccaaagcgaggagagtaaggccagagcctgctctgagaccgaagaaagtaacacttgttgttctgactggcaacgccacttcgacgtagctctcggcaggatggtctacgtcaataaaatgactggattgagcacttttattgctcctaccgaagatattcaggccgcctgcactaaggatctcactacggtcgcggtggatgtggttttggaaaatggttcccagtaccgctgtcagccattccgcagcgacctggtgctgccttttctcccacgagcgcgagcagagagaacagtaatgagacaggacaaccgagacaccgtggacgacacagtatcctccgaatcgttacagtcattattttcagagtgggataaccccgtcttcgcacggtacccggaagttgctgttgatgtgtcctccggccaggctgagagccttgcggttaagatccataacattctgtatccttataggttcaccaaagggatgatacactctatgcaggtgctccaacaggtggacaataagttcatagcatgcctaatgtcgactaagacagaagaaaacggcgaggcggggggcaacctgttggtgctggtggaccagcatgcagcccacgaacggattagattagaacagctgatcatcgactcctatgaaaagcagcaggcacagggcagtggcaggaaaaagctcctgtctagcactctgataccccctctggaaatcaccgtgactgaagagcaacgacgtttgctgtggtgctaccacaagaacctggaagacctgggattggagtttgtctttcccgacactagtgactcactggttttggttggcaaggtccctctttgttttgtggagcgggaggcaaatgaactgcgacggggacgaagcacagtgactaagagtatcgtagaagaatttatcagggagcagctggaactgttacaaacaacgggagggatccagggcacactccccctgaccgtgcagaaggttctggcttcacaagcttgtcacggagctatcaagttcaatgacggcctctccctccaggagtcctgcagactgattgaagctctgtctagctgccagctgccctttcagtgtgctcacggtaggccttccatgctgccactcgccgacattgatcatctggagcaggagaagcagatcaaaccgaatctgaccaaactccgaaagatggcacaggcatggcgtctcttcggcaaggcagagtgcgacacgcgccagtccctccaacaatcaatgcctccttgtgaaccgccttag

SEQ ID NO: 16128 - DNA, 321 bp, Artificial Sequence
  Description of Artificial Sequence: Synthetic coding sequence
atgatcaagtgtctcagcgtggaggtgcaggctaaactgagatcaggtctcgcgatttcatcattaggccaatgtgtggaagagctggcgttgaactctatcgacgcagaggccaaatgtgtggccgttcgcgtaaacatggaaaccttccaggtgcaggtgattgataacgggtttggcatgggcagcgacgatgtcgaaaaagtggggaacaggtacttcacttccaaatgtcacagcgtccaggatctggaaaaccctcgcttctacgggttccgtggggaagcactggcaaacatcgctgacatggcaagcgcctag

SEQ ID NO: 16129 - DNA, 135 bp, Artificial Sequence
  Description of Artificial Sequence: Synthetic coding sequence
atggccgacaaaccagacatgggagagatcgccagcttcgataaagctaagcttaagaagactgagacacaagagaaaaacacgctcccaacaaaggagacaatcgagcaggagaagcggtcagaaatcagctag

SEQ ID NO: 16130 - DNA, 1026 bp, Artificial Sequence
  Description of Artificial Sequence: Synthetic coding sequence
atggccgtgcagcccaaagagactttacaactcgaaagcgccgctgaagtaggattcgtcagattcttccagggaatgccagagaagcccaccaccaccgtccgcctgttcgaccgcggagacttttataccgcgcacggggaagacgcattgctggctgcccgagaagtttttaagacccaaggtgtgataaaatatatggggccagccggcgctaaaaatttacagtctgtggttttaagcaaaatgaacttcgaatcattcgtaaaggaccttcttttagttcgacagtatagggtggaagtgtataaaaacagggccggtaataaggcttctaaagagaatgattggtatttggcttacaaagcatccccgggcaacctgtcccagttcgaggatattctgttcggcaataatgatatgtctgcctccattggcgtggtgggcgtgaagatgtctgcagtagacggacaaagacaagtaggagtcggctatgttgattctatccaacgcaagctgggactgtgcgagtttcctgacaatgatcagtttagcaacttagaagccctattgattcagatcggtccaaaggagtgcgtcctaccagggggggaaacggccggagacatgggtaaactaaggcaaataattcaacgtggcgggattttgatcacagagcggaagaaggcagacttttcaacaaaagacatttatcaggacctgaaccggctacttaagggaaagaagggtgaacaaatgaactcggccgtcttgccggaaatggaaaatcaggtcgccgtcagtagcctgtccgccgtcatcaagttcttagagctgctgtcagatgacagcaacttcggccagttcgagctgactacctttgatttttctcagtatatgaagctcgacatcgcagctgtgcgcgctctaaatctgttccagggttcagtggaggataccaccgggagccagtccctggccgcactcctcaacaagtgtaaaacaccccagggccagacttgttag

SEQ ID NO: 16131 - DNA, 2766 bp, Artificial Sequence
  Description of Artificial Sequence: Synthetic coding sequence
atggccgtgcagcccaaagagactctgcagctggagtcagccgcagaggttggtttcgtgcgattttttcaggggatgccggagaaacccactaccactgtgaggctatttgatcggggggacttttacactgcacatggcgaggatgccctcctcgctgccagggaggtgtttaagacacaaggggtgatcaaatacatggggcccgcaggggccaaaaatcttcaatcagtggtgctttctaagatgaacttcgagtctttcgtgaaagacttgctgctcgttaggcagtaccgtgttgaagtgtacaagaatagggccggaaacaaagcttctaaggagaatgattggtatctggcctataaggcttccccagggaatctgtcccagttcgaggatattcttttcggaaacaacgatatgtccgcatcaataggagttgtcggcgtgaaaatgagcgccgttgacggacagcggcaggtgggtgtggggtatgttgactcgatccaaaggaaactgggactttgtgagtttcctgacaatgatcagttctccaacctcgaggcactgctcattcagataggaccaaaagaatgcgtcctaccagggggagaaacggccggcgatatgggaaagttacgccaaattatccagaggggaggaatcttgatcacagaaagaaaaaaagcggacttttcgacaaaggatatctatcaggacctgaaccggctccttaaggggaaaaagggggagcagatgaactcagcagttcttccagaaatggagaaccaggtggcagtttcaagcctgtctgccgtgatcaagttccttgagttgctgagcgacgacagcaattttggtcagtttgaacttacaacgttcgactttagccaatatatgaagctggatatagccgccgtccgcgctttaaatctcttccagggttcagtcgaagacaccaccggttcgcagtctcttgccgctttgctgaataagtgcaagacacctcaggggcagaggctggtcaatcagtggatcaagcagccgctcatggacaagaaccgtatcgaggagcggctgaatttggttgaagctttcgtagaggatgcagagcttaggcagacgctacaggaggacctgctgagaaggttcccagacctgaacagactggccaagaagtttcagcgacaggctgctaatttgcaggattgttatagactgtaccagggaatcaatcagctacctaacgtaattcaggccctcgaaaaacatgagggcaaacaccagaagctcctactcgctgtttttgtcactcccctgactgaccttcggtcagacttctccaaattccaagagatgatcgaaacaaccctggacatggaccaagtcgagaaccacgaattcctcgtcaagccaagtttcgatcccaatctaagcgaactccgagaaataatgaacgacctcgagaaaaaaatgcagtccaccctcatctcggccgcgagggacctggggctggaccccggaaaacagatcaaattggacagtagcgcacaatttgggtattatttcagggtgacttgtaaagaagaaaaagtgctgcgaaataataaaaacttcagcacagtagacattcaaaagaatggggtgaagtttacaaactctaagctgacaagccttaacgaagaatacaccaagaacaaaaccgaatacgaggaggcccaggacgcaattgtgaaggaaatagttaatatatccagcggttacgtggaacctatgcagactttgaacgatgtcctcgcccagttagatgccgttgttagtttcgcccatgtcagcaacggtgccccagtcccttacgttagaccagccattctagagaaaggtcagggacgcattatcctcaaagcatcaagacacgcatgtgtagaggtgcaggacgaaatcgcttttattcctaacgacgtctatttcgagaaagacaagcagatgtttcacattattacaggtcctaacatggggggtaagtccacctatattcgccagactggtgtgattgtgctgatggctcaaataggatgctttgtcccttgtgaaagtgccgaagtgagtattgtggattgcatattggcacgggtgggggccggagattcccagcttaaaggagtgtccacttttatggcggagatgttggaaaccgcctctatcctgcgcagcgcaacgaaagatagcctaatcattatagatgagctggggaggggcacatcaacatacgatggctttgggctggcctgggctatcagcgaatacattgcaactaagatcggagcattctgtatgtttgctacacactttcatgagctgacagcactcgcgaatcagattcctactgtgaacaaccttcacgtaactgcactgacgaccgaggaaaccttgaccatgctttaccaggttaagaagggagtctgcgaccagtcctttggaatccatgtcgcagaactggccaattttcctaagcatgttattgaatgcgctaaacaaaaggctctcgagcttgaggagttccagtatattggcgagtcccaagggtatgacatcatggaacccgcagccaagaaatgctatctggagcgagaaaatctgagagttacagaacctaaagatcagtgtctcatcctgctgacttggaagcgcaagctgcgcggcggaaaaagatccgcctgcagtcggccggagcggcagaaccagggtagtggcgagctaagttag

SEQ ID NO: 16132 - DNA, 2163 bp, Artificial Sequence
  Description of Artificial Sequence: Synthetic coding sequence
atgatcgggatatggcacattcgcctgctgttggcaatcagcctgagcttgaagaccttttctctcgtcactatgatctgtcagcttccgctcgtcctctgggtgctcaagtgtccccagcttatggcgcgagatatgggcaaactgcgacaaattatacaacgcggcggaattctaattaccgagcgtaagaaagccgatttcagcacaaaagatatctaccaggacctgaatcgcttgctcaagggtaagaaaggggaacagatgaacagcgccgtgttaccagaaatggagaatcaggggagcgttgaggatacgacaggcagccaaagcctagccgcgctccttaacaagtgtaagaccccccagggccagaggctcgtcaatcagtggattaagcagcccctgatggataaaaacaggatcgaggagcgcttgaacctcgtggaggccttcgttgaagatgcagagcttagacagaccttacaagaagatcttttacggaggttccctgacctgaataggctcgcaaaaaagtttcagcggcaggccgctaatctacaggactgttacagattataccaagggatcaatcagttgccaaacgtcatccaagctctcgaaaagcacgaaggcaagcaccagaagttgctgctcgctgtctttgtgacacctttgaccgatctgcgcagtgatttttccaagtttcaagaaatgatagagactaccctggatatggatcaagtggagaaccacgaatttcttgttaaaccctctttcgacccaaacctgtctgagctgagggaaataatgaatgacctcgaaaaaaagatgcagagcacactgatttcagctgcacgggatctcgggcttgatcccggcaaacagataaagctggacagttctgctcagttcggctactacttcagagtaacctgtaaggaagagaaggtactgcggaataataaaaactttagcaccgttgacatacagaagaatggtgttaagttcactaactccaaactcacgagtctgaacgaggaatacactaaaaacaaaactgaatatgaggaggctcaggacgcaatagttaaagagattgtcaacattagttccggctacgtcgaaccgatgcagactcttaatgatgtgttggcccagttagacgctgttgtgtcttttgctcatgtgagtaacggcgctcccgttccctacgtgcgtcccgctatactggaaaaaggccagggaaggattattctaaaagctagccgccatgcctgcgtggaggttcaagacgaaatcgcatttatcccgaacgacgtctatttcgagaaggacaagcaaatgttccacattattactggccccaatatggggggaaagtccacatacattcgtcagactggagtgatcgtgttgatggcccagattgggtgcttcgtgccttgtgagtctgctgaggtgagtatagttgattgcatcttggcccgtgtcggcgccggcgattcccagctgaaaggcgtcagcacttttatggctgaaatgttggagacagcctccatcctgaggtcggccaccaaagattccttgatcatcattgacgagcttggacgcggaacctctacgtacgatggctttgggctcgcctgggccatctcagagtatatcgccaccaagattggcgccttctgtatgttcgccacacatttccatgaactcactgctctagcgaatcaaatcccgaccgtcaacaatttacatgtcactgcgttaacaactgaagagacattaaccatgctataccaagtcaaaaaaggggtatgtgaccagtcgttcggcatacatgtggctgaactggccaacttccccaaacatgtgatagaatgcgccaaacagaaagccctggagttggaggagttccagtatatcggcgagtctcaggggtacgacattatggaacctgcagccaaaaagtgttatttagaaagagagcagggagagaagatcatccaggaattccttagtaaggtaaagcagatgcccttcaccgaaatgagcgaggaaaatatcactattaagttaaagcagctgaaagccgaagtgattgccaaaaacaactcctttgtgaatgaaatcatcagcagaataaaagtgactacctag

SEQ ID NO: 16133 - DNA, 2433 bp, Artificial Sequence
  Description of Artificial Sequence: Synthetic coding sequence
atggccgtgcagccaaaggagacgctgcagctcgagagcgcggccgaggttggctttgtgcgattttttcaggggatgccagaaaaacccaccacaaccgtgaggctgtttgaccggggggacttttatacggctcacggtgaagacgccctgctggccgctagagaagtcttcaagacgcagggtgtgatcaagtatatgggtcctgcaggtgctaagaaccttcagagcgtggtactttccaagatgaacttcgagtcattcgtcaaagacctgctcttggtgcggcagtaccgggtcgaggtgtacaaaaaccgtgccgggaataaggcttcaaaggagaacgactggtatctggcatacaaggccagtcctggcaatttgtctcagtttgaagatatcctttttggaaacaatgatatgtctgcgtccattggagtggtaggagttaagatgtccgctgtcgatgggcagcgacaagtgggagtcggctacgtggactcaatccaacggaaactgggcctctgcgaatttcccgataatgaccagttttccaatttagaggctctgctcattcagattgggcccaaagaatgtgttttacctggcggcgaaactgctggtgacatgggcaagctacgtcagataatccagcgtggtggaatcctgatcacagagcgtaagaaagcggacttcagcactaaggacatatatcaagacctcaaccggctgctgaaaggcaagaaaggtgagcagatgaattctgctgtgctgcctgagatggagaaccaggtggcggttagttccttgagcgccgtgattaaattcctggaactgttgagcgacgatagcaactttgggcagttcgaactgacgacattcgatttctcacagtatatgaaactggacatcgccgcagtcagggcattgaatttgtttcagggatctgtggaggacactactggatctcagagcctagccgcgctcctgaataaatgcaagacgccccagggtcagcgattggtgaaccagtggatcaaacagccactcatggacaagaacagaatcgaggagagacttaatctggtggaagcgtttgtagaagacgcagaattgagacagacactacaggaagatctgctccgccgcttcccagatctaaatcgccttgcaaaaaaattccagaggcaagcggccaatttgcaggattgctataggctatatcagggcatcaatcagctgcccaacgtgatccaggcactagaaaaacacgaggggaaacatcagaaactgctactcgccgtctttgtgactcccctcaccgatttgcgatccgatttctccaagttccaagagatgattgagactacattggatatggaccaggtggagaaccacgagttcctggtgaagccatcctttgatcctaacctgagcgagctgcgtgagattatgaatgatctggaaaaaaaaatgcagagtacacttatatccgccgctagggacttagggctggacccaggcaaacaaatcaaactggacagctcagcccaattcgggtattactttagggtcacatgtaaggaagaaaaggtcttaaggaacaacaaaaacttttctaccgtggacatccaaaaaaacggagtcaagtttacaaattctaagctgaccagtttaaacgaggagtacaccaagaacaaaaccgagtatgaggaggcccaggatgccatagttaaggagattgttaacattagtagcggctacgtggagcctatgcagacgcttaacgatgtgctagcccagctggacgcggtggtgagcttcgcccacgttagcaacggggcccccgttccctacgtgcgacctgctattttggagaagggccagggacgaattattttgaaggcgagccgccacgcctgcgtggaggtccaggatgagattgccttcatccccaatgacgtttattttgagaaggacaaacagatgtttcatataataacagggcccaacatgggaggtaagagtacatatatcagacagacaggcgtgattgtgctcatggcgcaaattgggtgtttcgtaccatgcgaaagcgctgaagtcagtattgttgattgcatactggcaagggtgggcgctggagatagccagctcaaaggtgtgtccacctttatggccgaaatgcttgagaccgcctctattttgcgctcagccacaaaggattcactgatcatcattgacgagctgggacgtggcactagtacctacgatgggttcggcctggcttgggctataagcgagtatattgcgactaagatcggagcattttgtatgtttgccaccatcttcatgaacttactcccctggcctatcagatatcagctccttattatttacatgagtcagcactcaccactgaaaaggccctag

SEQ ID NO: 16134 - DNA, 507 bp, Artificial Sequence
  Description of Artificial Sequence: Synthetic coding sequence
atggataagaacagaatcgaggagagactgaatctggtggaggcttttgtagaagatgctgagctacggcagactctgcaggaagacctgctgagaaggtttcctgacttaaatcgcctggctaaaaaatttcagaggcaagctgcgaatctgcaggattgttaccgactgtatcaaggcatcaaccaactgccaaatgtgatacaggccctggagaaacacgaaggaaagcatcaaaagctcctgctcgcagtattcgttacacctctgactgatttgcgaagcgactttagtaagtttcaggaaatgatcgagacaacgctggacatggatcaggtcgagaaccatgagttcttggtgaaaccttctttcgaccccaatctgagtgaacttagggaaattatgaatgatctagagaaaaagatgcaatcaacgctcatcagcgctgctcgcgacctgggcggatcgctccagcctagatccagcaggctcgcgtgcgcgacatag

SEQ ID NO: 16135 - DNA, 1602 bp, Artificial Sequence
  Description of Artificial Sequence: Synthetic coding sequence
atggcagttcagccaaaagagaccttgcagctagagtcagccgctgaagtcggattcgtaaggtttttccaaggaatgcccgagaagccaaccactacagtaaggctatttgaccgtggagacttctatacggcccacggagaggatgcactgctggcagctcgcgaagtgttcaaaacccagggcgttatcaagtatatgggccctgccggcgccaaaaacctacagagtgtggtgctttctaaaatgaatttcgagagctttgtgaaggatttgctgctcgtccggcagtaccgggtcgaagtttacaaaaatagagcaggcaacaaggcctccaaggagaacgactggtacctggcttacaaggctagcccagggaatctttcccagtttgaggacatattgtttggaaataatgatatgtctgcctctatcggggtggtaggcgtgaaaatgagcgccgtggatggtcagcgccaggtcggagtgggatacgtggacagtattcaacgcaagctcgggctctgcgaattccctgacaatgatcagtttagcaatctggaggccctgctgattcaaatcggtcccaaggagtgtgtcctgcccgggggcgaaaccgcaggcgacatgggtaagttgcgacagattattcaacgtggaggcatcctgatcaccgagcgaaagaaagcggatttctctaccaaagacatctaccaagatcttaaccggctcctgaagggcaagaagggcgagcaaatgaactctgccgtcctgccagaaatggaaaatcaagtcgctgtgtcttccctctctgccgtcattaagttcctcgaactgctaagcgacgatagtaacttcgggcagttcgagctgactacattcgacttctcacaatacatgaaactggatatagcggccgtgcgggcgctcaacctctttcaaggctctgttgaggatactacaggcagccagagtctcgcagcccttctgaataaatgcaagacaccacagggtcagaggctggtgaaccagtggatcaagcagccactgatggacaagaacagaatcgaggaacgactcaacctggtagaggcatttgtagaagatgctgagctgcgacagactctgcaggaggacttattgagaagattccctgacctcaatagactggccaaaaagttccaaaggcaggcagcaaacctgcaggattgctacagattgtaccagggcatcaatcagttgcccaatgtgatccaggctctggaaaaacatgaaggcaaacaccagaaactcctcttggccgtgtttgttactccactcaccgacctgagaagcgactttagcaaatttcaggaaatgatcgagaccaccttagatatggatcaggtagagaaccatgagttcttggtgaagccaagctttgacccgaacctgtcagagctgagagaaattatgaatgacctcgagaaaaaaatgcagagtaccctaatctcagctgcacgggatctgggccttgatccaggtaagcagattaagttagattcctccgctcaattcggatactattttcgggtgacctgcaaggagaaatcaccttcctag

SEQ ID NO: 16136 - DNA, 1233 bp, Artificial Sequence
  Description of Artificial Sequence: Synthetic coding sequence
atggccgttcaacccaaggaaactctgcagctcgagagcgctgccgaggtaggattcgtgaggttttttcagggcatgcccgaaaagcccacgaccactgttcggctcttcgatagaggagacttctataccgcccatggagaggacgctctgctggccgctagagaggtatttaagacccagggagtgatcaagtatatgggccctgctggcgcaaaaaacctgcagtctgtcgtgctcagcaaaatgaactttgagagctttgtcaaggatctgcttctggttcggcagtatcgagtggaagtgtataagaatagagcgggcaataaggcgagcaaagaaaacgattggtatcttgcctacaaagcatccccaggcaacttgagccagtttgaggacatcctgttcggtaataacgacatgtcggcatcaatcggggtggtgggcgtgaaaatgtcagccgtcgacggacaaagacaagtgggtgttggctacgttgatagtatacagcggaaactcggactgtgtgaattccccgataacgatcagttttccaaccttgaggcactcctgatccagatcggacctaaggaatgcgtgctgccaggtggcgagacggccggtgacatgggcaagcttaggcagataatacagcgcgggggaatcctgatcacagagcgaaagaaagccgacttctccaccaaagacatttaccaagatttgaataggttgttgaaaggtaagaaaggagaacagatgaatagcgccgtcctcccagaaatggaaaaccaggtggctgtgtccagcctgagcgccgtcatcaagttcttggaactgctgtcagatgattcaaattttggacagtttgaactgacaacctttgatttcagccagtacatgaaactggacatagctgctgttagagccctcaaccttttccaggggagtgtggaggatactacgggctcccagtctttggcagcattgctgaacaagtgtaaaaccccccagggtcagagattagttaatcaatggattaagcagccactgatggacaagaatcggatcgaggagcggctgaacttagtcgaggccttcgtggaggatgccgaactgagacagaccctgcaggaggattactttgttgatagccaaattctgacggacctgccacgctccttcaaagataagcagcaaacctacaaaatagtcactgactctattcgcgtttag

SEQ ID NO: 16137 - DNA, 1458 bp, Artificial Sequence
  Description of Artificial Sequence: Synthetic coding sequence
atggcggttcagccaaaagaaaccctgcagctggaatcggctgcggaagtcggattcgtaagattcttccaggggatgccagagaaaccaacaaccacggtgagactgtttgacagaggagatttttatactgcgcatggggaggacgctttactggctgctcgcgaagtgtttaaaacccagggcgttataaagtacatgggccctgctggagcaaagaacctccagtcagtggtgctctccaagatgaacttcgagagctttgttaaggacctacttctcgtgcgtcaatacagagtggaggtgtacaagaaccgggccggcaacaaggcaagcaaggagaatgattggtatctggcttataaagcatctccaggaaatctatcccagtttgaggacatactgttcggcaataacgacatgtccgccagcattggggtggtaggcgtgaagatgtccgccgtcgacggccagagacaggtcggcgtgggatacgtggatagcatccagcgcaagctgggtttgtgcgaatttccagacaacgatcagttcagcaacctggaagccctgctcatacagataggtcccaaagaatgtgtacttccagggggggagactgcaggtgacatggggaagttgaggcaaatcatacagcgtggcggcatcctgatcactgaacgcaagaaggccgacttctccaccaaggatatttaccaggacctgaataggttgttgaaaggtaaaaagggggaacagatgaacagtgccgtgctgcctgagatggagaaccaagtggctgtttcctctctcagtgccgtcataaagtttttggagttactgtcggacgacagcaatttcggacagttcgagttaacaacttttgatttcagccagtacatgaagctggatattgccgctgtgcgggctctgaacctttttcagggttctgtggaggatacaactgggtctcagtctctcgcagctctgctgaataagtgcaaaactccccaggggcaacgcctggtgaatcagtggataaagcagccactgatggacaaaaaccgaatcgaggagagactaaatctggtagaagcctttgttgaagacgctgaattgcgtcagactctgcaagaggacttactacgcaggttccctgaccttaatagactggcaaaaaagttccaaaggcaggccgcgaacttgcaggattgctacagactctatcaggggattaaccagctgcctaacgtgattcaggccctggaaaaacacgagggcaaacaccaaaagttactgctggctgtatttgtaacccctctgaccgatttgcgatcagattttagtaaattccaggagatgattgagacaaccctcgatatggaccaggtagagaatcatgaattcctcgtaaaaccaagtttcgaccccaacttgtccgaattgagaaacaatgaatag

SEQ ID NO: 16138 - DNA, 2607 bp, Artificial Sequence
  Description of Artificial Sequence: Synthetic coding sequence
atgggcccagccggcgccaagaacctccagtctgttgttttatctaaaatgaacttcgaatctttcgttaaggatcttttacttgttaggcagtatcgcgtcgaggtttacaaaaaccgggcagggaacaaggcgtcaaaggaaaatgattggtacctagcctataaggcgagcccaggcaacctctcacagtttgaggacatcctgtttggtaataatgacatgagcgcctcaatcggggtggtgggagtgaagatgtcagctgtggatggccagcgacaggtgggggtcggatacgttgactctatccagcgcaaactgggactgtgtgagttccctgataatgaccagttttctaacctggaagcgcttcttattcaaattggcccaaaagaatgcgttctccccggtggtgagaccgcgggcgatatggggaaactccgccaaatcattcagaggggaggcatcctgattacagagcgtaagaaagccgatttctctaccaaggacatataccaggacctaaacagattgttaaaggggaagaaaggggaacagatgaatagcgcggtgctgcccgagatggagaatcaggtcgccgtctcctccctgagcgccgttatcaaatttctggaactgctcagcgacgatagtaacttcggccagtttgagcttaccacttttgacttctcccagtacatgaaactcgatatcgctgcggttagagcactgaacttgttccaaggtagcgtcgaagacacaactggatcccagtctttggccgcccttctcaataaatgtaaaacacctcaggggcagaggctggtcaaccagtggatcaaacagccactgatggacaaaaatcgtattgaggagaggcttaatctcgtggaagcctttgtcgaagacgccgagctccgccagaccctccaagaggacctgctgcgcaggttccctgacctgaacagactggcaaaaaagtttcaaagacaggcggccaatttacaggattgctacaggttgtatcagggtatcaaccagctgcccaatgttatccaggctcttgaaaaacatgaaggaaaacaccagaagctgcttttagccgtgttcgtcacaccactgactgaccttcgctcagatttctctaaatttcaggagatgattgaaacaaccctcgacatggaccaggtcgaaaatcacgagttcctcgtgaaaccttcatttgaccccaacctctctgagctgagagagattatgaacgacttagagaaaaaaatgcaaagcaccctaatttccgcagccagagacttagggctcgaccccggcaaacagattaagctggattcttcagcccagttcgggtactacttcagagtgacgtgcaaagaagagaaggtcttgcgaaacaacaaaaatttcagcaccgttgacatacagaaaaatggtgtgaaattcaccaactcgaagttgacatctctaaatgaggaatataccaaaaacaaaactgaatacgaagaggcccaggacgcgattgtgaaggaaatagtcaacattagctccggctacgttgagcctatgcagaccctcaacgacgtcctagcgcagctggatgccgtcgtctccttcgcccacgtgtccaacggcgccccagtaccttatgtgcgaccagctatcctggagaaaggccaggggcgcatcatcctcaaggcttcaagacacgcctgcgtagaagttcaagacgaaattgcctttattccgaacgatgtatatttcgagaaggataagcagatgttccacattataactgggccaaatatggggggaaagtccacctatatccgtcagactggagtcatcgtgttgatggcccagattggatgttttgtgccgtgtgagagcgccgaagtctcgatcgttgattgcatcctggccagagtcggtgctggcgactcgcaactgaagggggtgtctacattcatggctgaaatgctagagacagccagtatactcagatctgccacgaaggacagcctcattataattgacgagcttggtcgtggaacgtcaacttatgatggctttggactggcctgggctatttccgaatatatagccaccaagattggggccttctgcatgtttgcaactcatttccacgagctaacggcccttgcaaatcaaattccaacagtcaacaatttacacgtgaccgcactcactacagaggaaacactgactatgctgtaccaagtgaagaagggcgtgtgcgaccagagcttcggtattcatgtcgcagaattagccaactttcccaaacacgtcattgagtgtgctaagcagaaggcactcgaattagaagagttccaatacattggtgagagccagggctacgatataatggagcccgcagccaaaaaatgttatctcgagcgcgaacagggtgaaaaaatcatccaggaatttctgtctaaagttaagcaaatgcccttcacagaaatgagtgaggagaacatcacaataaaactgaagcagcttaaggccgaggtgatcgccaagaataattcgtttgtgaacgagattatctctcgaataaaggtaactacctag

SEQ ID NO: 16139 - DNA, 3414 bp, Artificial Sequence
  Description of Artificial Sequence: Synthetic coding sequence
atgagcaggagaaaacccgcctccgggggattagccgcaagttccagtgcccccgcgaggcaagcagtgttatcccgtttttttcagtctaccggcagccttaaaagtacttcctcatccacaggtgcagctgatcaggtggatccgggcgcagctgcagccgctgccgcggctgccgccgccgcccctccagcaccacctgctccagcctttccacctcagctccccccgcacatcgctacagagattgatcgcagaaagaaaagaccactggagaatgacggtcctgtaaagaaaaaggtcaagaaggtgcagcagaaggaaggcgggagcgacctcggtatgagcggtaactccgagcctaagaaatgcctgcgaacaaggaacgtgtccaaaagtctggagaagcttaaagagttttgctgcgacagtgcattaccccagtctcgggttcagaccgagtcactgcaagagcgttttgccgtgctcccaaaatgtaccgatttcgatgatatctcactgctccatgcaaagaatgccgtgtcttcggaggactcaaaacgccaaattaatcaaaaagataccaccttgttcgatctgtctcagttcgggtccagcaacacctcacatgaaaacctgcagaagacagccagcaaatctgccaacaaacggtccaaatctatatacacccctttagagctccaatatattgaaatgaagcagcagcataaggatgcagtcttgtgtgtggaatgcggatataagtacaggttctttggcgaggatgcggagattgcggcgagagaactgaacatctattgtcacctagaccacaatttcatgacagcgtcaatacctacccaccgcttgttcgtccatgtacggagattagtggctaaagggtataaggtgggggtcgtgaaacagaccgaaactgcagctctgaaagccattggtgataacaggtcttcccttttttccaggaagctcaccgcactgtatacaaaatctacacttatcggcgaagacgtcaaccccctgattaaactagacgatgccgtgaacgtggatgaaatcatgacagatacaagtactagctacttattgtgcatctccgagaacaaagagaatgtccgagataaaaagaaaggtaatattttcatcgggatcgtcggagtacagccggcgaccggagaggtcgtcttcgatagtttccaagactccgcaagtagatctgaactggaaacaagaatgtcctccctgcaacccgtggagcttctgctgccttccgccttgtctgagcagaccgaggctctgattcatagagccaccagcgtcagtgtccaggacgatcgtattagggttgagaggatggataacatctacttcgaatactctcacgccttccaggccgtgactgaattttatgcaaaagatactgtcgacatcaaaggcagccagataattagcggtattgtgaacctagaaaagcctgtgatctgcagtctggctgccatcataaagtacctgaaggagttcaaccttgagaaaatgctgagtaaaccggaaaattttaaacagttgtcttcgaaaatggaatttatgaccatcaacggcaccaccctgcggaatttggagatcttgcaaaaccagacggacatgaaaaccaaagggagtctcctgtgggtgctcgaccacacaaagacaagttttggccggcggaagctgaagaagtgggtcactcagcccctccttaagctgcgggagatcaacgcgcggttagacgcggtgtccgaggtcttacatagcgagtcatctgtgttcggacagattgaaaaccatctccgtaaactgcccgacatcgaacgggggctctgctcaatataccataagaaatgttctacccaggaattcttcttgattgttaaaactctgtaccacctgaaatctgagttccaggccatcatcccagcggtgaacagccacatccagtccgatcttctcaggacggtgatcttggagatccctgagctcctgagtccggtggaacattaccttaagatattgaacgagcaagcagccaaggtcggtgacaaaaccgagctcttcaaagaccttagcgattttccacttatcaagaagaggaaagatgagattcagggggtgatcgatgagatccggatgcacctgcaggaaatcaggaaaatcctcaagaatccatcggcacagtatgtcaccgtttcaggacaagagtttatgatcgaaatcaagaatagtgctgtatcctgcatcccaacagattgggtgaaggtaggaagcacgaaagccgtgagccgctttcactctccctttatcgttgagaattatcgacatctgaatcagcttcgtgaacagcttgttctcgactgttccgccgagtggttagattttttggaaaagttcagtgagcattaccatagcctttgtaaggccgtgcaccatctggctacagtggattgcattttctcccttgcaaaagtcgccaagcagggagattattgccgacccactgtgcaggaagagaggaaaatcgtgatcaaaaatgggagacaccctgtaattgatgtcctgctgggcgagcaggatcagtacgtacctaataacaccgatctgagtgaggatagcgagagagtcatgattataacaggccctaacatgggagggaagtcatcctacattaagcaggtcgctcttattaccattatggctcagattggatcatacgtacccgcagaggaagctacaatcgggatcgtggacggtattttcacgcggatgggagcggccgataacatctacaagggccagtccacatttatggaggagctgactgacaccgctgaaatcatacggaaggcaacatctcaaagtctagtgatcttagatgagctaggccggggaactagcacacatgatggaattgcaattgcgtacgcgacccttgagtactttatccgcgatgttaaatcactgactctgtttgttacgcactacccacccgtctgcgagctggaaaagaattattctcaccaagttggtaattatcatatgggatttcttgtgtctgaagatgaaagcaaattggaccccggggccgcagagcaggtacccgacttcgttacatttttgtaccaaataacgaggggtattgccgcacggagctacggcctgaacgtggccaaattagcagatgtcccaggcgagatcctgaagaaggctgcacacaaatcgaaagagctggagggactgatcaatacaaagagaaagcgcttaaaatacttcgccaaactgtggacaatgcacaacgcacaagacctccaaaaatggaccgaagaattcaacatggaagagactcagacgtcgctattgcactag

SEQ ID NO: 16140 - DNA, 3387 bp, Artificial Sequence
  Description of Artificial Sequence: Synthetic coding sequence
atgtccagaagaaaacctgcctctggcggcctggccgccagtagtagcgcacccgctcgtcaagccgtgcttagccgcttctttcagtcaacagggagtctgaaatctaccagtagttccactggggccgccgaccaggttgatccaggcgcagccgctgctgcagcccccccagcaccagcttttccaccacagttaccgcctcatatagcaaccgaaatagaccggcgcaaaaaacgtcctctggagaacgatggacccgtgaaaaagaaggtcaaaaaagttcagcaaaaagagggcggatctgacttaggcatgagtggcaattctgaacccaagaaatgtttgaggaccaggaacgtgtcaaagtccctggagaagctgaaagaattttgctgtgatagtgctctgccccagtctagagtacaaactgagtcactgcaggagaggtttgctgtcctacctaagtgtacggacttcgacgacattagtcttctgcacgcaaagaacgccgtatcatcagaagactctaagaggcaaattaaccagaaggatacgacgctgttcgatctgtctcagttcggatcatctaacacatctcatgagaacttgcaaaaaaccgcctctaaatcagccaataagagaagtaagtctatttacacccctctggaactgcagtacattgagatgaaacaacaacacaaagatgcggtgctgtgtgttgagtgcggatataagtaccgcttttttggggaagatgctgaaattgccgcaagggagctcaatatctattgccatctggatcataacttcatgactgccagcataccaactcacagattattcgtccacgttcgacggctcgtagcaaagggctacaaggtcggcgtggtcaaacagacagagactgccgcacttaaggccatcggcgataaccgttcatccctcttcagtcggaaattgacagccttgtatacaaagtctacactgattggagaagacgtgaaccctctgattaagcttgacgacgctgtgaatgtggatgagatcatgactgacactagtacttcatatctgctttgtatctctgagaataaggaaaacgtgagggacaagaaaaagggcaatattttcataggaattgtgggggtgcagccggcaaccggtgaggtcgtctttgatagcttccaggacagcgcctcccgatctgagctagagaccaggatgagcagtctgcagccagtggagctgctgctgccgtccgctctttctgagcagaccgaggccctgattcatagagctacctcagtgagtgttcaggacgaccgaatccgagtagaacggatggacaacatttactttgaatactctcacgccttccaggccgtgaccgaattttacgctaaggacacagtggatatcaaaggctcgcagatcattagtgggatcgtaaatctggaaaagcccgttatctgcagcctggccgccatcatcaagtacctgaaggagttcaacctcgagaagatgctgtcaaagcccgaaaattttaagcaactctctagtaaaatggaattcatgaccataaacggcacaaccctcagaaatcttgagattttgcagaatcagacagatatgaaaaccaagggctcacttctatgggttttagaccataccaagacctcgtttggacggaggaagcttaaaaaatgggttacccagccattgcttaaacttagagagattaacgcacggcttgatgcagtgtccgaagtcttgcactctgagtcctccgtttttgggcaaatcgaaaatcacctccgcaaactgcctgacatcgaacgaggcctttgttccatttatcacaagaagtgttccacacaagaattctttctgatcgtgaaaacactttatcacctcaaaagcgaatttcaggctatcattcccgcagtgaattcacacatccagagcgacctgctgaggactgtgatactcgagatccccgagttgttgagccccgtcgaacactaccttaagatcctgaatgagcaggctgctaaagtgggagacaaaacagagctgttcaaagatctgagcgatttccccctcatcaagaagaggaaagacgagatccagggagtgattgatgagataagaatgcatctacaggaaataaggaaaatactgaaaaacccatctgctcaatacgtgacagtctccggccaggagtttatgattgaaattaaaaacagtgctgttagctgcatccctaccgattgggtcaaggtcggaagtacaaaggcagttagccggtttcactccccttttattgtggagaattaccgccacctgaatcagctgagagaacagcttgtattggactgctccgccgagtggctggatttcttggaaaaatttagtgagcattaccactcactctgtaaggcggtgcaccacttggctactgtggattgcattttcagtctcgccaaggtggccaaacagggagattattgccgcccgacggttcaggaggagcggaaaatcgtgattaagaatggtagacaccccgtgatcgacgttctgttaggagaacaagatcagtatgtccctaacaatactgatctgagtgaagatagcgagagggtcatgatcatcacaggacccaatatgggagggaaatcctcttacattaagcaggtcgcactgattaccatcatggcccagatcggaagctacgtgccggcagaagaagcgacaatcggcatcgtggacggcatattcacccgaatgggtgctgccgataacatttacaagggccagagcacctttatggaagaattaaccgataccgcagaaatcatacgcaaggccactagccagtccctcgtcatactagatgagttaggaagggggacatccacacatgacgggattgccattgcctatgctacattggaatatttcatccgcgatgtgaagagtctgactcttttcgtgacacactacccccccgtttgtgagctggaaaagaactacagtcatcaggtgggcaactatcatatgggattcctggtatccgaagacgagagcaagctcgatccaggagctgccgaacaggtgcctgactttgtgaccttcttatatcagattactcgtggaatcgcagcaaggagctatggactcaacgtcgccaagctcgccgacgtgcctggtgagattctgaaaaaggccgcccacaaaagcaaggaattagaaggcctcatcaatacaaaacgtaagaggcttaagtatttcgcaaaactgtggactatgcacaacgctcaggacctccagaagtggacagaggagtttaacatggaggagactcagacctcactcctccactag

SEQ ID NO: 16141 - DNA, 2811 bp, Artificial Sequence
  Description of Artificial Sequence: Synthetic coding sequence
atgctgcgtcctgagatcagcagcacctcaccaagtgcacccgctgtctctccgtctagcggggagactcgctctccgcagggaccccgctataacttcggacttcaggagaccccccagtctcgccctagcgtgcaagttgttagcgcctccacatgccctggcaccagcggggcggccggcgatcgttcttcttcctcctcctccctgccctgccccgcacctaattccagacctgctcaagggtcatatttcggtaataaacgcgcctacgccgagaacacagtggcatctaactttacctttggcgctagcagcagttctgctcgggacaccaattacccccaaactctgaaaacacctctctcaaccggcaacccccagcggagcgggtacaagagttggacaccccaagtgggttattccgcatccagcagctccgctatctcagcacactccccttccgtcattgtggctgtggttgaggggagaggcctcgcaaggggggagataggcatggcctcaatcgacctcaagaatccacagattattctctcacagttcgccgacaacacaacatacgcaaaggtgattacgaaactgaaaatcctctcccctttagaaattattatgtcaaacacagcctgcgcagtgggcaattcaaccaagctgtttacactcataaccgagaacttcaaaaatgtgaacttcactaccattcagcgcaagtactttaatgagactaagggcctggagtacatcgagcaactctgtatagccgagttttcgacggtactgatggaggtacaatcaaagtactattgcctggctgccgtagctgccctgttgaaatatgtggagttcatacagaattctgtctacgcccccaagagcctgaaaatttgtttccaggggagcgaacagaccgctatgattgactcttcctcagcacagaatttggagctgctcatcaacaatcaggactaccggaataatcacacgctgttcggcgttttaaactacaccaaaacacccggcggctcccgccgcctccggtcgaacatcttggagcctctggtggatattgagaccataaacatgagactcgattgtgtccaagaactgcttcaagacgaagagctgttcttcggcctgcagagcgtgatctcacgatttcttgatacggaacagctgctgtccgtcttggtccagataccgaagcaagacaccgtgaatgcagcggagagcaagataaccaatctgatttacttgaagcatacacttgagttagtcgacccgcttaagatcgccatgaagaattgtaatactcctctgctcagggcctactacggtagcctggaagacaaaagattcgggattatcctagagaagattaaaaccgtgatcaatgatgatgctaggtacatgaagggctgcctaaacatgcgtactcagaaatgttatgccgtacgctccaacataaacgagttcctggacattgcccgcaggacatatacagaaatcgtggatgacatcgctggtatgatcagccaactcggggaaaagtactctttgcccctgcgaacttctttctccagtgctcggggcttctttatacagatgacaaccgattgtatagccctgcccagcgaccagctgcccagcgagttcatcaagattagcaaagtgaagaactcatactcattcacaagcgctgacctgattaagatgaatgagcggtgtcaggagtctttgcgtgaaatataccacatgacatacatgatcgtctgcaaactgctgagcgagatttacgagcatatccactgtctttacaaactgtccgatactgtgtctatgctagatatgttgctgagctttgctcacgcctgcacgctaagcgactacgtaaggccagaatttaccgatacactcgccatcaaacagggttggcaccctattcttgagaaaatatctgcagagaaacctatcgccaacaatacgtacgtgacagagggatctaactttctcattatcacagggcccaacatgtccgggaaaagcacctacctgaagcagatagcactttgccagatcatggctcagattggctcctacgtacccgccgagtatagctctttccgaattgcaaagcagattttcacaagaatttctactgatgacgacatcgagaccaactcatccaccttcatgaaggagatgaaggagattgcatatatactgcacaacgcaaacgacaaaagcctgattctgatagatgagcttgggaggggaactaatactgaagaaggtataggtatctgttacgcagtgtgcgaatatctcctgtccctgaaggcttttacactttttgccacacacttcctggagctttgtcacatcgacgcactgtaccctaatgtcgagaatatgcattttgaggtgcagcacgtgaaaaacacgagcagaaacaaggaggccattctttacacctacaagctttcgaaggggctaaccgaggaaaaaaactatggactcaaggccgcggaggtgtccagcctgcccccatcaattgttctggatgcaaaggaaatcaccacacagattactcggcagatcctgcagaaccaaagaagcacccctgagatggagaggcagcgtgcagtgtaccacctggcaacgcgtctggtgcagactgcgcgaaattcccagctcgacccagactccctgcgcatttacctcagtaatttgaaaaaaaagtacaaggaggatttcccacgaacggaacaggttcccgagaaaacagaggaatag

SEQ ID NO: 16142 - DNA, 813 bp, Artificial Sequence
  Description of Artificial Sequence: Synthetic coding sequence
atggccagcctgggcgccaatccaaggcggaccccacagggccctaggcctggtgcagctagcagtggcttcccatctccagcgccagtgccgggaccaagagaagccgaagaggaggaggttgaagaggaagaggagctggccgagattcacctttgtgttctatggaatagtggttacctaggtattgcctattacgataccagtgattcgaccattcattttatgcctgacgccccagatcatgaatcgcttaagctgctgcaaagagtgctggacgaaatcaatccccaatccgtggtgacctcggcaaagcaggacgagaacatgacccggttcctggggaaactcgcatcacaggagcatcgcgaacccaagagaccggaaatcatctttctccccagcgtagattttggcttggagattagcaagcagcggctgctctctggtaattactcttttattccggacgccatgaccgcaaccgaaaagattctatttctgtcatcgatcatccccttcgattgcttgctaacagttagagcccttggagggctcctgaagtttctgggccgccgcagaatcggggtggagctggaagattacaatgtgagtgttcctatcctcggcttcaaaaagttcatgttgacacatttagtgaatatcgatcaagatacatattccgtcctccagatcttcaagtccgaaagtcatcccagtgtgtataaggtggcttctggtctgaaggagggtttatcattattcggaatcttaaacaggtgccactgtaaatggggagagaagcttctgtag

SEQ ID NO: 16143 - DNA, 813 bp, Artificial Sequence
  Description of Artificial Sequence: Synthetic coding sequence
atggcatccctgggagcaaaccctcggagaacccctcagggtcccaggccgggtgcagccagctccggatttcctagccccgctccagtccctggtcctagggaagcggaagaggaggaagttgaagaggaagaggagctggccgagatacatctgtgtgttctgtggaactccgggtatctcggaatcgcctactatgacacctccgacagcacaatccatttcatgccggacgcacccgaccatgagtccctgaagcttctacagagggttctggacgagatcaacccacagtctgtagtcactagcgccaagcaggacgaaaacatgacaagattcttgggtaaacttgcatcccaggaacatcgtgagcctaaaagacccgaaatcattttcctgcccagcgtagattttggtctggagatttctaagcagagactactgagcggtaactactcatttattcctgatgctatgacagctaccgagaagatccttttcttatcttcaatcatccctttcgactgcctcctgacggttcgcgcgttaggaggacttcttaaatttctggggcgtagaagaattggcgtcgagttggaggattacaacgttagcgtgcctatattggggtttaagaagttcatgctaacccacctcgtgaatatagaccaagatacctatagcgtcctgcagattttcaagagcgagtcacatccaagcgtttataaggttgcaagcggcttgaaagaggggctgtcccttttcgggatactgaataggtgccattgtaaatggggagagaagctcctctag

SEQ ID NO: 16144 - DNA, 585 bp, Artificial Sequence
  Description of Artificial Sequence: Synthetic coding sequence
atggcctccctgggcgcaaaccccagacgaacgccccagggcccaaggccaggagccgcttcctcaggttttccctccccggcaccagtcccaggacctagagaggctgaagaagaggaagtagaggaagaggaggaactagccgaaatccatctgtgtgtgctgtggaatagcgggtatttgggaatagcttactacgacacctctgactccaccattcatttcatgcccgacgcgccggatcacgagtccctcaagcttctacaacgcgtgttagatgaaatcaatccacaatcggtcgtgactagcgccaagcaggacgagaacatgactagattcctggggaagctagcctcccaggagcaccgagaacccaagaggccagaaattatctttctgccttctgtcgattttggacttgagatctccaagcagcgattgctttccgggaattatagcttcattccagacgccatgaccgccacggaaaagatactgttcttgtcatctatcatcccgtttgactgccttctcactgtcagagccctcgggggtctgttaaaattcctgggccggaggaggtag

SEQ ID NO: 16145 - DNA, 813 bp, Artificial Sequence
  Description of Artificial Sequence: Synthetic coding sequence
atggctagtctgggtgcgaacccaagaagaaccccacaaggcccacggccaggagcggcctctagtgggtttcctagtccagcaccggttcctgggccaagggaagctgaagaagaagaagtggaggaggaagaagaactggccgaaattcacctttgcgtgctgtggaatagcggttaccttggcatcgcctactatgacaccagtgactccacgatccattttatgcctgacgccccagaccacgaatccctgaaacttcttcagcgagtgctggatgaaatcaacccacagtctgttgttaccagcgccaagcaggacgagaatatgaccaggtttctgggcaaactcgcttcccaggaacatagagaacccaagagacccgagatcatattcctgccttctgtcgatttcggtcttgagatttccaagcagcgattgctgtcaggaaattacagctttattcctgacgctatgaccgccacagagaaaatactgtttctatcttcaataatcccttttgactgcctgctgactgttcgagctctaggcggtcttctaaagtttctgggcaggcgccgaatcggtgtggaactcgaagactacaacgtctcagtgcccatccttggcttcaagaaattcatgctcacccatctagtgaatattgaccaagacacttattctgtactgcaaatcttcaagtctgagtctcacccctctgtctacaaggtggcctctggcttgaaagaaggtctctctctgttcggtatccttaaccgctgtcattgcaagtggggggaaaaactcctgtag

SEQ ID NO: 16146 - DNA, 864 bp, Artificial Sequence
  Description of Artificial Sequence: Synthetic coding sequence
atggcgtccctaggcgcgaatccacgtcgaacaccccagggcccccgccctggagcagcgtcgtctggatttcctagccccgctcccgtacctggaccaagggaggcggaagaggaggaagttgaggaggaggaggagctggctgaaattcacctgtgtgtactctggaacagcggctacctgggcatcgcttattatgacacttcagattctaccatccattttatgcccgatgccccggaccatgaatctcttaagctcctccagcgcgttttagacgagatcaacccccaatcagtagtcacctctgccaagcaggatgagaatatgaccagatttttgggtaaactggcctcacaggagcatagggagcccaaacgacccgaaatcatcttcctgccttccgttgatttcggtctggagatttcaaaacagcggctactttccggcaactacagcttcattcccgatgctatgaccgccaccgagaaaattctgtttctatccagcattattccattcgattgcttactgacacctccaggagatttgcggttcacccccataccgctcttgatcccgtcccaggtcagggccctgggcggactgctgaaattcctgggcaggagaaggattggggtggagttagaggactataatgttagtgttccaattctgggctttaagaagtttatgcttacgcacctggttaacattgaccaggacacctatagcgtccttcagatcttcaagtctgaatctcacccctcagtttataaagtggcaagtggactcaaggagggcctgtctctcttcggcatcttgaatcgatgccactgtaaatggggagaaaagctgttatag

SEQ ID NO: 16147 - DNA, 324 bp, Artificial Sequence
  Description of Artificial Sequence: Synthetic coding sequence
aagattttgtttttaagcagcattattccttttgattgcttgttgactgttagagcccttggggggctcttgaaatttctgggccgacggagaattggcgtggaactcgaagactacaatgtatccgtgccgatactcggtttcaaaaagtttatgttaacacacctggtgaacattgatcaggacacctatagtgtgcttcagatcttcaaaagcgagtcgcaccccagtgtgtacaaagtagcctccggattgaaggaagggctgtctctgttcgggattctaaaccgatgtcattgtaaatggggcgagaaactgctatag

SEQ ID NO: 16148 - DNA, 765 bp, Artificial Sequence
  Description of Artificial Sequence: Synthetic coding sequence
atggcttcccttggcgcaaatcccagaagaacaccgcagggtccgcgcccaggtgctgcttctagtggcttccccagtcccgctcctgtgccaggcccacgcgaagctgaagaggaggaggtcgaagaggaagaagagctggccgagatccacttatgtgtcctttggaattccggatatttgggcatcgcgtattacgatacatccgactcaactattcattttatgcctgacgctccggatcatgagtcactgaagcttctccagagggtgctagacgagataaatcctcagtcggtggtgacttctgccaagcaagacgaaaatatgacacggttcctcggaaaactagcttctcaagagcacagagaacctaagcggccggagattattttcctgcctagcgttgacttcggtcttgagatcagcaaacagaggctgctgtctggcaattatagttttatcccagacgctatgaccgctactgagaagatccttttccttagcagtatcatccctttcgattgtcttctgactgtccgagccctaggaggattgttgaagtttctgggacggcgccgtattggagtggagctcgaggattacaatgtgagcgtccccatcctggggttcaaaaagtttatgcttacccacctcgtgaacatcgaccaagacacttacaggctcgaatgcaacggcgctattagcgcgcagtgcaacttatgtttgcttggtagtagtgattcacccgcaagtgcttcctag

SEQ ID NO: 16149 - DNA, 1542 bp, Artificial Sequence
  Description of Artificial Sequence: Synthetic coding sequence
atggcgatggagatagacagcagaccaggtgggttacccggatcaagctgtaatctcggagctgcccgtgagcacatgcaagcagtaaccaggaattacatcacccacccaagggtcacataccggacagtctgtagtgtgaacggccccctcgtggtgttggacagagttaaatttgctcagtacgccgaaatcgtgcacttcactctgcccgatggcacccagcgcagcggtcaggtgcttgaagttgccggcactaaggccatagtgcaagtgtttgagggaacgagtggtatcgacgccaggaaaacaacgtgtgaatttaccggagatattttgagaacacccgtgtcagaggacatgctgggaagggtgtttaatggatccggaaagcctatagacaagggacctgtggtgatggccgaagactttcttgacatcaacggacagccaatcaacccacactcccggatttaccctgaagagatgatacagaccggaatctcacctatcgatgtgatgaattctatcgcaagaggccagaaaattcctatttttagcgccgccggcctgccccacaatgagattgccgcacagatctgtagacaggccggcctggtgaaaaagtcaaaggcggtactggattatcacgacgacaattttgctatcgtattcgcagcaatgggagtgaacatggaaacagctagattttttaagtccgactttgagcagaatggcacgatgggcaatgtgtgtctgttcctcaatcttgcaaatgatcccaccattgaacggatcatcaccccaaggctggctttgacgacggcggagttcctcgcatatcagtgcgagaaacacgtgctcgtaatcttaactgacatgagctcttacgcagaagctctgagggaggtgtctgctgcaagagaggaggtgcctgggaggcgcggttttccgggctatatgtatacagatctggccacaatctacgaacgcgcaggtagggtggagggcaggggaggctctattactcagatacccattctgaccatgcccaacgacgacataacgcaccccatcccagatctgacagggttcatcaccgagggtcagatctacgtggatcggcagttgcacaaccggcagatctatcctcccatcaatgtgctgccgtcgttgagtagactgatgaagtcggccattggtgagggaatgacacgaaaggatcacggcgacgtctcgaaccaactgtatgcatgctacgctatcggcaaggacgtgcaggctatgaaggctgtggtgggcgaagaggcccttacaagcgaagatttgctgtacctggaattcctccaaaaatttgagaaaaactttataaaccaaggaccgtacgagaatagaagtgtgtttgaatctcttgatcttgggtggaagctgctacggatatttccaaaggaaatgctcaagcgcatccctcaggccgtgatcgatgagttctatagcagggagggagcactccaggacctggctccagatacagctctatag

SEQ ID NO: 16150 - DNA, 759 bp, Artificial Sequence
  Description of Artificial Sequence: Synthetic coding sequence
atgtcacgtcaaagcactctctatagtttcttcccaaaatcccccgctctgtctgacgcaaacaaagctagtgccagggcctcccgggaaggcggaagggcagccgccgcccccggggcatctccctcgcccggaggcgatgccgcctggtccgaggctggtcccggtcccagacctttagctcgctctgcctctcctccaaaggccaagaacttgaacggaggactgagacggagtgtagcgcctgctgccccaacgtcctgcgactttagtccaggcgatctggtgtgggcaaagatggaaggctacccttggtggccctgcttggtgtacaaccatccattcgatggtacttttatcagagagaagggaaagagtgtgagagttcatgtccagttttttgatgactctcccacacggggatgggtctccaaacgcctactcaaaccctatacaggaagcaagtcaaaggaggcgcaaaaaggcggccacttttattcagccaaaccagaaatcctgagagccatgcagcgggccgatgaagctctgaacaaagataaaataaaaagactagaactggcagtctgcgacgaaccaagcgagccggaggaggaggaggaaatggaggtcggaacaacttacgtcaccgacaaatcagaagaggataacgaaatcgagagcgaagaggaggtgcaaccgaaaacccaaggcagtcggagatcaagccggcagatcaagaagaggagaaaaaagcggtag

SEQ ID NO: 16151 - DNA, 3177 bp, Artificial Sequence
  Description of Artificial Sequence: Synthetic coding sequence
atggttactggcaatggctccctcaagagaaagtccagcagaaaggaaacccccagcgcaactaaacaggcgacaagcatcagctccgaaaccaaaaacacccttagggcattttcagctcctcagaactcagaaagccaagcccacgtctccgggggaggcgacgattccagccgaccaaccgtatggtaccatgagactttggagtggctcaaggaagagaagaggcgcgacgagcaccggcgtcgtcccgaccaccccgactttgatgcgagcaccctttacgttccagaagattttcttaactcctgtacgccagggatgaggaaatggtggcagattaaaagccagaactttgatttggtcatttgttacaaggtaggaaaattctacgaactgtatcacatggacgcactaattggcgtgagcgagttagggctcgttttcatgaaggggaactgggcccattctggctttcccgaaatcgctttcggcagatatagcgatagtctggtgcagaagggctataaagtggcccgcgtggaacagactgaaactcccgagatgatggaagctaggtgccggaagatggcccatatttcaaagtacgatcgtgtggtgaggagggaaatttgccgcattatcaccaaagggacccagacatatagcgtcctggagggcgatccctcagagaattactccaaatacttattgagcctgaaggaaaaggaagaggattcctctggtcacacccgcgcttatggtgtctgcttcgtcgatactagcctgggcaaattcttcattggccagtttagcgatgaccgacactgtagtcgctttaggacactggtggctcactacccccctgtgcaggtcctgttcgagaagggaaatctttccaaagagactaaaaccatactcaagtcaagcctaagttgttccctgcaagagggtctgatcccgggatcccaattctgggacgcgtctaagacgctgcgcaccctgttggaagaagagtacttcagagagaagctctctgacggcatcggcgtgatgctacctcaagtgttgaagggcatgacatcagagtcagactccatcggtctgacccctggcgagaaatccgagctggctctttcagcactcggagggtgtgttttctatctgaagaaatgtctcatcgaccaggaactcctgtccatggctaactttgaagagtatattccgcttgattcggatactgtatccaccacaagaagtggggcaatcttcaccaaggcctatcaacggatggttctggacgctgtcaccctcaacaacttggagatttttctgaacgggaccaatggctcaaccgaggggacgctactggagagggtcgacacctgtcacacacccttcgggaagcgtctgctaaagcagtggctgtgcgcccctctttgtaatcactacgcaatcaatgacagactggacgccatcgaagaccttatggtggttccagataaaatctccgaggtggtggaattgctcaagaagctgcctgatctagaacgccttctgtctaagatccacaacgtcgggtcaccgctgaaatctcaaaaccaccctgatagtcgggctattatgtatgaggagaccacttactcgaagaaaaaaatcatagactttttgagtgccctagagggtttcaaagtgatgtgcaagatcattggaataatggaagaagttgccgacggattcaagtcgaaaatacttaaacaggtgatctctctgcagaccaagaacccagaaggtaggtttcctgatttgaccgtcgaactaaatcgttgggataccgcctttgaccacgaaaaggcacgaaagaccgggctgatcacacctaaagcaggctttgatagcgattatgatcaggcactggcagatattagggaaaacgagcagtcacttttagaatatctggagaaacaaagaaaccgtattggatgtcggacaatcgtgtattgggggatcggcaggaaccggtaccagctggagatccctgaaaatttcaccacgcggaatctgcctgaggagtacgagctgaagtctactaaaaagggctgcaagcggtactggactaaaaccatagaaaagaaacttgccaatctgatcaatgcagaagaacggagagacgtctcacttaaagactgcatgcgcaggctattctataattttgataaaaattacaaggactggcagagcgcagtcgaatgcattgccgtactcgatgtgctgttatgtcttgctaactactcccgcggaggcgacggtcccatgtgcaggccggtcatccttcttcctgaggatacccccccatttttagaactcaagggcagtaggcacccctgcatcactaagacattctttggggatgatttcatccccaacgatattctgattggctgtgaggaggaggagcaggagaacggtaaagcttactgtgtgctggtgactggacccaacatgggaggaaagtctactttgatgcgccaggctggcttgctggccgttatggcacagatgggatgctacgtacctgccgaagtgtgccggctgacaccaatcgaccgcgtgtttactcggctaggcgcttcggataggatcatgagtggcgagtcaacattcttcgtagagctgagtgagaccgcttccattttaatgcacgccacggcgcacagcctcgtgttagtggatgagctgggccgcgggacagcaactttcgacggaacagctattgcaaacgctgtggttaaagagctcgctgagactatcaagtgtcgcacccttttctctactcattaccattctctggttgaggactacagccagaatgtggctgtgcgcttggggcacatggcgtgcatggtggaaaacgaatgtgaggatcccagtcaagagactattacatttctgtataagtttattaagggagcctgtcccaaatcttatggctttaatgccgctcgccttgcaaatctcccggaggaggttattcagaaggggcacagaaaggcacgagagttcgagaagatgaaccagtctctgcggctattcagggaggtgtgtctcgcttcagaacgtagcaccgtagatgcggaggccgtgcataagctgctaactctgataaaggagctatag

SEQ ID NO: 16152 - DNA, 3693 bp, Artificial Sequence
  Description of Artificial Sequence: Synthetic coding sequence
atgagcagacagtcgaccttgtactcctttttcccgaagtctcccgcgctgtccgatgccaacaaggcatctgccagggcgagcagggaaggaggcagggccgcagccgccccaggtgcctcaccttcacctggcggcgacgccgcatggtctgaagccgggcccggtccacggcccttagctagatcagcgtcacctcctaaagcgaagaacctgaacggggggttaaggcgctccgtgggcaccacgtatgtcactgacaaatccgaggaggacaatgagatcgagagcgaggaggaagttcagccgaagacacagggaagcaggcgaagctcccgccagattaaaaagaggagagtgatcagcgactctgagtccgatatcggcggctctgacgttgagttcaagcctgacacaaaagaggaagggtcctctgacgaaatcagctcgggcgtgggggatagtgaatccgagggcctcaacagccccgttaaagtggcacggaagcgaaaaagaatggttactggcaatggtagtcttaagaggaaatcaagtagaaaagaaactccgtccgctacaaagcaggcaacaagtatttccagcgagaccaagaatacactgcgcgcatttagtgcacctcagaattccgaatcacaggctcatgtgtccggagggggagatgactcctcgagaccaacagtgtggtaccatgagactcttgaatggctcaaggaggagaagcgaagggacgaacaccggcgccggcccgaccacccagatttcgacgcatccactctgtacgtccccgaagatttcctgaacagctgtacacctggcatgcgcaagtggtggcagattaaaagccaaaactttgaccttgtgatttgttataaggtggggaagttctacgaactgtaccacatggatgctctgattggcgtgtcggaactagggctggtctttatgaagggcaactgggcacattcagggtttcctgaaattgcctttggtaggtattccgattcgttggtgcagaagggctacaaggtcgccagagttgaacagacagaaacaccagaaatgatggaagccaggtgtcgtaagatggctcacatctccaagtacgaccgggtggtccggcgcgagatttgtagaatcataaccaagggaacccagacttacagtgtgctagagggtgatcccagtgaaaattactccaagtacctactctccctgaaagaaaaggaggaagactctagtggtcatactagagcttatggcgtctgttttgttgatacatccctcggaaaattcttcatcggacaattctcagatgacagacattgtagccggtttcgcacactagtggctcactacccgccggtacaggtgctattcgaaaagggcaacctcagcaaggagactaagacgatcctgaagtctagtctttcctgctccctccaggaggggcttatcccaggcagccagttttgggacgcaagtaagacgcttcgcacgcttctcgaagaagagtactttcgggaaaagctctctgacgggattggcgtaatgttgccccaggtacttaagggaatgacaagcgagtctgattcgatcggacttacacccggcgagaagtctgagctcgccttatcagctctaggcggatgcgtcttctacctgaagaaatgcctgattgatcaggaactcctatctatggccaattttgaagagtatattccattggacagtgacacggtgtcgaccactagatccggggccatcttcacaaaggcctatcagaggatggtgctcgacgccgtaactctcaataatctggagatattccttaacggcacaaacggaagcacagaaggtactctgctggagcgcgtggacacatgccacacaccgtttggcaagcggctactaaagcagtggctttgcgcaccactttgcaaccactatgccattaatgacagactggatgccatcgaagatctgatggttgtgccagacaaaatttccgaggtggtggagctgttgaaaaaactgccggatttggagagattactcagcaaaatacacaatgttggcagccccctcaaatcacagaatcatcctgatagtagagcgattatgtacgaggaaactacgtattctaagaagaagatcattgattttttgagcgcactcgagggctttaaagtgatgtgtaagattatcggaatcatggaggaagtagctgatggttttaaaagcaaaatccttaagcaagtcatatctctgcaaaccaagaatccagagggcaggttccctgacctgactgtggagctcaaccggtgggataccgcctttgatcatgagaaagccaggaaaacgggactgattactcccaaggctgggtttgattcagattacgatcaggcactggcagatatcagggaaaatgagcagagtctgctggagtacttggagaagcaacggaatcggatcggctgccggaccatagtgtattggggcatcggcagaaaccgttatcagttggaaattccagagaacttcaccacacggaatctgcccgaagagtacgaactgaagagcacaaaaaaaggctgtaagcgttattggaccaagaccattgagaagaaactcgctaatctaataaacgcagaggagcgccgtgatgtcagcctgaaagattgtatgaggcgtctgttttataacttcgataagaactacaaagactggcagtcagccgtcgaatgcatagctgtgctggacgtgctgctttgcctagctaactattctcgagggggggacggtcccatgtgtcggcccgtgatcctcctgccagaagacactcctccattccttgaactcaagggatctcgacatccatgtatcaccaaaacattcttcggggacgacttcattcctaatgatatcctgatcgggtgcgaggaggaggagcaagagaacggcaaggcctattgtgtgctagtcactgggccaaatatgggggggaagtcgaccctgatgcggcaagccggactgctggcagttatggcacagatgggttgttatgtaccagccgaagtctgtcgactaacaccaatcgacagggtcttcactcgccttggagcgagcgaccgaataatgagcggcgaatccacattcttcgtggaactgtccgagaccgccagcattctcatgcacgccacagcacacagtctagtgttggttgatgaactggggagaggtaccgccacattcgatggcacggctatcgcaaacgcagtggtgaaggagttggctgaaactatcaagtgccggactctgttctcgactcattaccattccctggtcgaggactattcccagaacgtggcagtccgcctgggccacatggcgtgtatggtcgagaatgaatgcgaagacccctcacaggagacgatcacgttcctgtataaattcatcaagggtgcttgccctaagtcctacggatttaacgccgcccgcttggccaacctccccgaggaagtcatccagaagggccacaggaaggcccgtgaatttgaaaagatgaaccagtctttgaggctgtttagggaggtgtgccttgcaagtgagaggtccaccgtggacgccgaggcagtccacaagcttctcacccttatcaaggagctctag

SEQ ID NO: 16153 - DNA, 975 bp, Artificial Sequence
  Description of Artificial Sequence: Synthetic coding sequence
atgcggagattgttttataattttgacaaaaactataaagattggcagtcagcagttgagtgcatcgccgtgctggatgtcctcttgtgtcttgctaactattctcgcggcggcgacggccccatgtgcagacctgtcatcttgttacccgaggataccccgccatttcttgaactcaaaggcagccggcacccttgtataaccaaaacattcttcggcgatgattttatccctaatgatattcttatcgggtgtgaagaggaagaacaagagaatggaaagatcgtgtgtctgcttctggaccagatttggggtgcttcgttacgcatgcgccaagccggtcttctggccgtgatggcacagatgggctgctatgtgcccgcagaagtctgtaggttgacacctatagacagggtgtttactcggctcggtgcgtcagaccggattatgtctggggagtctacatttttcgtggagctttccgagacagcctccattctgatgcacgctacggcccattcgttggtgcttgtggatgaattagggcggggaacggccacctttgacgggactgcgattgccaatgctgttgtaaaggagttagctgaaaccatcaagtgtcgaactcttttctccactcactatcacatctccaggaggcttttcagcaagtgttgctgtttgggacacatggcctgcatggtcgagaatgaatgcgaggatccttcacaggaaacgatcactttcctctacaaattcatcaagggggcgtgccccaaaagttatgggttcaacgcggcaaggctagcgaacttacctgaggaagtaattcagaagggacaccggaaggccagggagttcgaaaagatgaatcaaagtttgcgtctgtttagggaagtctgcctagcaagcgaacgctcgacggtggacgctgaggcagttcacaagcttctgaccctgataaaagagctctag

SEQ ID NO: 16154 - DNA, 3201 bp, Artificial Sequence
  Description of Artificial Sequence: Synthetic coding sequence
atgagtcggcagagtaccctctactcttttttccctaagtccccagcactgagcgacgctaataaagcctctgcacgagcgtctcgggaaggaggacgtgcagcctgtccaagagggttatctttcccaagaagaggctgcggcctggaacgaggctgggcctggaggcctctggctagatcagcgtcaccccctaaggccaagaacctgaatggagggctgagacggtctgtggctccagccgctccaacttcatgtgacttttccccaggagatctggtctgggccaagatggagggctacccttggtggccttgcctggtgtataatcatccttttgatggcaccttcatcagggaaaagggtaaatccgtgagggttcatgtgcagtttttcgatgacagcccaacacgcggctgggtgtctaaaagactcttgaaaccatacacaggatcgaagagtaaggaagctcaaaaaggcggccacttttacagtgccaaaccggagatactcagagctatgcagcgggcggacgaagcccttaacaaggacaaaatcaaacgtcttgagctcgccgtctgcgacgagccttccgagccagaggaggaggaggagatggaagttggaaccacttacgtgaccgataagagtgaggaggacaatgagattgagtccgaggaagaggtgcagccgaaaacgcagggtagtcggagatccagtcggcaaatcaaaaaaaggagagtgatttccgattcagaaagtgacatagggggcagcgacgtcgaattcaagcctgatacgaaagaagagggatcatccgacgaaatcagcagtggggttggcgatagtgaaagtgagggtctgaattcacctgtgaaagtggctcgaaagaggaagcggatggtgacagggaatgggtcgcttaaacggaaaagtagcaggaaagagacaccaagtgccactaaacaggcgacctctatatcctcagaaactaaaaacactctgagagcattttcagctcctcagaattccgaaagccaagcccatgtgtctggcgggggcgatgactcctctcgcccaactgtgtggtaccacgaaacactggaatggctcaaggaagagaagagacgcgacgagcaccgccgaagaccagaccaccccgactttgacgccagtaccctctacgtgccagaggatttcttgaattcctgcacccccgggatgcggaagtggtggcaaatcaaaagccagaacttcgaccttgtcatctgctacaaagtgggaaaattctatgagttgtatcatatggacgcattgattggggtttccgaattaggccttgtgtttatgaaaggcaactgggcccatagcggctttcctgagattgcatttggacgctactctgattccctggtccagaaagggtataaggttgctcgggtcgagcagacagagacacctgagatgatggaagcccgctgtcgaaaaatggcccacatatccaagtacgacagagtggtgcgacgggagatatgcaggatcatcacaaagggtacacagacttactctgttttggagggggatccatccgaaaactactctaagtaccttctgagccttaaggaaaaggaagaggactcttcagggcatacccgcgcctacggcgtgtgcttcgtggacacaagccttgggaagttcttcatcggacagtttagcgatgacaggcattgctccagattccggaccctggttgcacactacccgccagtgcaagtgctctttgagaagggaaatttgtccaaggaaaccaaaaccatcctcaagtcctctttatcatgctccttgcaggaaggccttatacctgggtctcagttttgggacgcatctaaaaccctgcggacactgctggaggaggagtacttccgcgagaagctgtccgacggaatcggggtgatgcttccacaagtcctcaaaggcatgaccagcgagagtgatagcatcggcctgacccccggtgagaagtctgaactagccttgtctgccctgggaggctgcgtgttctacctcaagaagtgtttgatcgaccaagagctactgagtatggccaactttgaagaatatatacccctcgatagcgacacggtgagtaccacccggagcggtgccatctttacaaaagcctaccagagaatggtcttggatgcagtcaccctgaacaacttggaaattttcttgaatgggacaaatggctctaccgaaggcaccctcctagaacgagtggatacctgtcatacaccctttggcaagcggctcctgaagcagtggttgtgcgcaccgctttgcaaccactacgccatcaatgaccgtctagacgccatcgaggaccttatggtagtgcctgataagatttctgaagtggttgagctcctcaagaagctccctgatctggagcgcctgctttctaagatccacaacgtaggcagtccgctaaaatcccagaatcacccagactcccgtgctataatgtatgaagagaccacctacagtaagaagaaaataattgatttcttaagcgccttggaggggtttaaggttatgtgcaagataataggaatcatggaagaagtcgcagatggtttcaagtccaagattctaaagcaggttatctctctgcagacgaaaaacccagagggcagattccccgatttaacagttgagctgaatcgctgggacactgcgttcgatcatgagaaggccagaaagacaggactgatcacacctaaagccggtttcgactccgattacgatcaggctcttgcagacatacgagagaatgaacagtctctgctggagtacctggagaaacagcgcaacaggattggctgtcgaacgatcgtgtactggggaatcgggcggaacagatatcagttggagatccctgagaactttactacacgaaacctccctgaagaatacgagttgaaaagcacaaagaagggttgtaaaaggtattggaccaaaaccattgaaaagaaactggctaatctgattaacgctgaggaaaggcgcgatgtctctctcaaggactgcatgcgccgcttgttctacaactttgacaagaattacaaagactggcagtccgctgtcgaatgcattgcagtgcttggaaaaacactgaataaattagtgcttcggttgtag

SEQ ID NO: 16155 - DNA, 1569 bp, Artificial Sequence
  Description of Artificial Sequence: Synthetic coding sequence
atgagaaaacctagggccgcagtcgggtcagggcaccgcaaacaggccgcaagccaggagggcaggcaaaaacacgctaaaaataattctcaagccaagcccagcgcctgcgacgcgggcctggcgaggcagcctgaggaagtggttttgcaggctagcgtgagttcgtatcatctctttagggacgtcgcagaggtcactgccttccgcggtagcttactgagctggtatgatcaggaaaaacgagatctgccctggcggagacgtgccgaagacgaaatggatcttgataggagggcttacgctgtgtgggttagtgaggttatgctacagcaaacacaggttgcaaccgtaatcaattactatacaggctggatgcagaagtggcctactcttcaggacttagccagcgcgtctttagaggaagtcaaccaactgtgggctggtcttgggtattactctaggggaaggcgcctccaggaaggagcacggaaagttgtggaggaactgggcgggcatatgccaagaactgccgagacgctgcagcagcttttaccgggagttggccggtacacagccggcgccatagcctctattgccttcggccaggctactggggttgttgatggaaacgttgcccgggtgctttgtcgggtacgcgccatcggtgcagatccaagttctaccttagtttcccagcagctgtggggactcgctcaacagctggtcgacccagccagaccaggcgatttcaatcaggccgccatggaacttggcgccactgtctgcacaccccagaggcccctgtgctctcagtgtcctgtggagagcctgtgcagggcccgccagagggtggaacaagaacagctgctggcctccgggtcactttctggtagccctgacgtggaagaatgcgcaccgaacactgggcagtgtcacctctgcttgccaccatctgagccctgggatcaaacgctcggcgtcgtgaattttcctagaaaggcctcccgtaagccccctcgtgaggaaagttcggcaacctgcgtactagaacaacctggcgcactgggagctcagattctgctggtgcagcggcccaacagcggtttgctggccggtctatgggagtttcccagtgtgacctgggagccaagtgagcaactgcagcggaaagccctcctgcaggaattgcagaggtgggcaggtcctttacctgctacgcatctaagacacctcggagaggtagtacacaccttctcacacatcaagctgacataccaggtctatggtcttgcactcgaaggtcaaacaccagttacaacagttccgccaggggcccggtggttgacccaggaggagtttcacactgcggccgtgtctactgcgatgaaaaaagtgttccgcgtctaccaaggccagcaaccagggacatgcatggggagtaagcgaagccaagtgtctagtccctgctctcggaaaaaaccacgcatggggcaacaggtgctggacaattttttccgctcccacatctcaactgacgcacatagcctcaactctgctgctcagtag

SEQ ID NO: 16156 - DNA, 1566 bp, Artificial Sequence
  Description of Artificial Sequence: Synthetic coding sequence
atgaggaagccccgcgcagcagtaggatctggccatcgaaagcaggccgccagccaggaaggacgtcagaagcacgcaaaaaacaattcccaagctaagccgagcgcatgcgatggacttgcccgacagccggaggaggtggtgttacaggcctctgtgtcaagctatcacctgttcagagatgtggcagaggttaccgcgttccggggatctctcttgagctggtatgaccaggaaaagcgcgaccttccatggaggcggagggccgaagacgaaatggacttagatcggagggcttacgcagtctgggtgtctgaagttatgttgcagcagactcaagtggccacagttattaattattacacaggttggatgcaaaagtggcccaccctgcaagaccttgcctcggcttccctggaggaagtgaaccagctctgggcaggcctcggatactattccaggggcaggaggctgcaggagggagcccgcaaagtggttgaggagctgggtggacatatgcctaggaccgctgagacgctccagcagttattgcccggcgtcggacggtacaccgctggtgctattgcttccatcgcatttggtcaggctacaggcgtcgtcgatggcaacgtcgcccgagtgctttgccgggtgagagccattggtgctgacccatctagcacgttagtgagccagcagctttggggtttggcacagcaactggtggaccctgccagaccaggcgatttcaaccaggccgcaatggagctcggcgcaactgtgtgcactccacagcggcccttatgttctcagtgccccgtggagagtctgtgtagggcaaggcaaagggttgagcaggaacagctgttagctagtgggtcgctcagcggttctcccgacgttgaggagtgcgcccccaatacgggacagtgtcacctatgcctgccaccttccgaaccatgggatcaaacactaggcgtggttaacttccctcgaaaagctagcaggaagccacctcgggaagagagttccgctacttgcgtcctggagcaacccggagctctgggcgctcagatactgttggttcaacgcccaaactccggcttgctagcaggtctgtgggagttcccctcagtcacgtgggagccttccgagcaactgcaaaggaaagctttgttgcaagagctccagcggtgggctggcccactacccgcaactcacctcaggcacctgggcgaggtcgttcacaccttttcccacatcaagttgacttatcaggtgtatgggttggcattggaaggacagacacccgtgaccactgtacctcctggcgcaagatggctgacgcaagaagaattccatacagctgcagtttctactgccatgaagaaggtgttccgggtctaccagggccagcagccagggacctgtatgggctcgaagcgctcacaggtctccagtccttgtagccggaagaagccaagaatgggccaacaggtcttagataactttttccgttctcatatcagcacagacgcacactctctcaattcagctgcacaatag

SEQ ID NO: 16157 - DNA, 1641 bp, Artificial Sequence
  Description of Artificial Sequence: Synthetic coding sequence
atgaccccactcgtgagccgcctcagcagactttgggccattatgaggaagccacgagcagcggttggatcaggccatcgcaaacaggcagcaagccaggaaggacgtcagaagcacgctaaaaacaactcgcaggccaaacccagtgcttgtgacggtatgatagccgagtgcccaggtgccccagccggactggcccgacagccggaggaagttgtgttacaggcgtcagtgtccagttaccacctgtttagagatgtcgcagaggtcactgcgttccggggttccctgctttcttggtacgatcaggagaagcgagatctgccctggagaagacgcgcagaggacgagatggatcttgaccggcgcgcatatgctgtgtgggtgtccgaagtgatgcttcagcaaacccaggtagctacagtaatcaactactatacaggctggatgcagaaatggcctacgcttcaggacctggcctctgcatcactcgaggaggtgaatcagctgtgggcaggtctcggttattacagccgcggcagaaggttgcaagaaggcgccaggaaagtggtcgaggagctgggcggacacatgccccggaccgctgaaaccctgcaacagcttctgccaggggtgggaaggtatactgccggagccattgcatccattgctttcggccaggccaccggtgtagtcgatggcaacgtggctcgcgttctctgcagagtgcgggctattggggcagaccccagcagcacactggtgtctcagcagctctggggtctggcccagcaacttgtcgaccccgccaggccaggggatttcaatcaggcagccatggaactgggagctaccgtctgcacccctcagcgacctctatgctcacagtgcccagttgagagtttgtgccgcgcacgacaaagggtggagcaggagcagctgttggccagtgggagtctgagcggatccccagatgtggaagaatgcgcccctaatacaggacagtgccacctctgcctgcccccatctgagccctgggatcagacactgggtgtcgttaattttccccggaaggcctccaggaaacctccacgggaggagtcttcagccacgtgcgtgcttgagcagcctggggcactgggcgcccagatactcctggtgcagaggcccaacagcggattactagcaggtctttgggagttcccctccgtgacgtgggagccctctgaacagctgcaacggaaggctttgctccaggaattgcagcgctgggctggtccacttccagcaacacacttaagacatctcggtgaagttgtacatacgttctcccacataaaactcacctaccaggtatacgggctggcgctcgagggacagacgcccgttaccactgtgccacccggggctaggtggttaacacaagaggagtttcacaccgctgccgtttcaactgctatgaagaaagtcttccgtgtgtaccaggggcagcagcccgggacatgcatggggtccaaacgaagccaggtgagtagcccatgctctcgcaagaagcccagaatgggacagcaagtgctcgataatttttttagaagccacatctctacggatgcccatagcctaaactctgccgcccagtag

SEQ ID NO: 16158 - DNA, 1599 bp, Artificial Sequence
  Description of Artificial Sequence: Synthetic coding sequence
atgcgcaaacctcgtgccgcagtggggtcaggccatagaaaacaggccgctagtcaggaaggaagacagaagcatgcgaagaacaattcccaggccaagccatcagcctgcgatggaatgattgccgaatgccccggagcgcctgcaggacttgcaaggcaacctgaagaagtagtcctgcaggcttccgtctcttcctatcatctattcagagatgtagcagaagtgacagccttccggggctccctcctgtcctggtacgatcaggaaaaacgtgatcttccttggcgcagaagagcagaggatgagatggatctcgatcggagggcctatgctgtgtgggtctccgaggttatgcttcagcaaacccaggtggcaacagtcatcaactattacacagggtggatgcaaaagtggcctacgttgcaagatttagccagtgcctcacttgaggaagttaaccagttgtgggccggactgggttactactcccggggacggcggttacaagagggagctcgaaaggtcgttgaggaacttggaggtcatatgcccagaacagccgagactctgcagcagcttctgccaggagtagggcggtacacggccggagcgatcgcaagtatcgcctttggacaagctacaggagtcgtcgacggtaatgtagcaagggtcctctgtagggtgcgggctatcggagctgacccttccagtactctcgtttcacagcagttgtggggcctcgcacagcagctcgtggaccctgcccggcctggagactttaatcaggcggcgatggaacttggcgctactgtgtgcacacctcagcggcccctctgttctcagtgcccagtcgaaagcctgtgtcgggccagacagcgggtggaacaggaacagttattggccagtggttctttgagcggtagtcccgacgtggaagaatgtgcccctaacacgggacagtgccacctgtgcctgcctccatcagagccttgggatcagacccttggagtggtgaacttccctcggaaagcttctaggaaaccccccagagaagagtcttccgcgacctgtgttctagagcagcctggagcactgggagcccaaatcctcctcgtccagcggcctaattcgggactgctggccgggctgtgggagttcccttccgtcacctgggaaccatccgagcagctgcagcggaaggccctgctccaggagctgcaacgctgggcaggaccgttaccagcaacacacctccgccacctgggtgaagttgttcacacattctctcatattaagctgacatatcaggtgtatggactggccctcgaaggacagactcccgtgacaaccgtacctccgggcgccagatggctgacccaagaggagtttcatactgctgccgttagcacggcaatgaaaaaagtcttccgagtttaccagggccagcagcctgggacctgcatgggcagcaaacgctcccaggtatccagtccctgttcgcgaaagaagccccgaatgggccagcaagtgctagacaattttttccgctcccacattagtaccgacgctcactcccttaactccgccgcgcagtag

SEQ ID NO: 16159 - DNA, 1566 bp, Artificial Sequence
  Description of Artificial Sequence: Synthetic coding sequence
atgaggaagccaagggccgctgtagggagcggccacaggaaacaggctgcgtcacaggaagggagacaaaaacatgctaagaacaattcacaagccaaaccctccgcctgtgacgggctggctagacagcctgaggaagtggtgctccaagcgtccgtgagcagttaccacctttttcgggatgtagccgaggtgaccgcttttcggggttctctcctctcgtggtatgatcaggagaaacgggacctaccctggcgaagaagggcagaggacgaaatggatttagatcggagagcatacgccgtttgggtgagtgaggtgatgctgcagcaaacacaggtcgccaccgtgataaactattacacgggctggatgcagaagtggccaactctgcaggatttggctagcgcatccctggaggaagtcaaccaactgtgggctggtcttggatattactctagggggcggagattacaggagggcgctcggaaggtagtggaagagctggggggacacatgcctagaaccgccgaaaccctccagcagctactgcccggcgtgggcaggtacacagcaggggcaatcgcttcgatcgcatttgggcaagccactggcgtggtcgatgggaacgtggcaagggtcctgtgtcgagtcagagccattggagccgatccgtccagcacccttgtatcacaacagttgtggggccttgcccagcagctggtcgaccccgctagacctggggatttcaatcaggccgcaatggaactgggcgctacggtttgtacaccacaacgccctttgtgtagccaatgccccgtcgagagtctgtgccgggctcggcagcgggtcgaacaggagcagctgttggcctcaggaagtctctccggctctcccgacgtggaagaatgcgctcctaacaccgggcagtgccacttatgcttgcccccatcggagccgtgggaccaaacactgggcgtggtcaactttcctcgcaaagcatcacgtaagccacctcgcgaagagagcagtgcaacctgtgtcctcgagcagcccggagccctaggagcccaaattttgcttgtgcagagacctaacagcggcctccttgccgggttatgggaattcccaagcgtcacatgggagccaagcgagcagttacagcggaaggcgttgctccaggagctgcagcgttgggcagggccgttgcccgccacgcatctgcggcatctaggtgaggttgtgcatacattttcacatattaagctcacataccaagtctacgggctggcattagaggggcagacccccgtaaccacggtaccacctggagcgagatggctcacccaggaggagtttcataccgccgcggtgtccaccgccatgaagaaggttttccgcgtgtatcaagggcagcaacccggcacatgcatgggtagtaagcgatcccaagtttctagtccctgcagccgcaagaagcccaggatgggacaacaggttcttgacaactttttccggtctcacatcagcacagatgcccattctcttaactcggctgcgcagtag

SEQ ID NO: 16160 - DNA, 1611 bp, Artificial Sequence
  Description of Artificial Sequence: Synthetic coding sequence
atgacgccgctggtgagcaggcttagtagactgtgggcaataatgagaaagcccagagcagccgtgggatctggccacaggaagcaagcagcctcacaagaaggccgccagaaacacgccaaaaacaactcacaggcgaaacccagcgcatgcgacgccggcctggcaaggcagcccgaggaagtagtgcttcaggcctctgttagttcctatcacctgttccgcgatgtagcggaagtgacagcctttaggggatctcttcttagctggtatgaccaggaaaagcgggatcttccctggaggcgaagagcggaagacgagatggacttggaccggcgggcctacgccgtctgggtgagcgaggtcatgttgcagcagactcaagtcgcgaccgtgatcaactactacactgggtggatgcaaaagtggccaacacttcaagatttggcttcggctagcctcgaagaagttaaccagctctgggcaggattgggatattatagtagaggaaggagattacaggagggagcccgcaaagtggtcgaagagctgggcggacacatgccccgcacagcagagacccttcagcagttgctgccaggtgtcggcagatataccgcaggggcaatcgcaagcattgcctttggacaggcgaccggtgtagtggacgggaacgtggcccgcgttctgtgtagagtccgagcaatcggggccgacccctctagtaccctcgtctcccagcaactgtggggtctggcccaacagttagtggatcctgctaggcctggcgatttcaaccaggccgccatggagttgggcgccacagtctgtaccccccagcgcccactgtgcagtcagtgcccagttgagtcattgtgcagggcgcgccaaagggtggagcaggagcagctcctagcctcaggctctctgtcaggctcccctgatgttgaggaatgcgcccctaacactggtcaatgccacctgtgtctcccaccctctgaaccttgggatcagaccttgggcgtggtcaattttccccggaaagctagtcgcaaaccccctcgtgaagaatccagcgcaacatgtgtactggagcagcctggagccctgggggcgcagatacttttagtgcagaggccgaactccggcctacttgccggcctgtgggagttccccagcgtaacatgggagcccagcgagcagcttcagaggaaggccctcctccaggagctgcagcgctgggccgggccactgcccgcaacacacctgagacacctcggggaggtagttcacaccttctcccatattaaactgacataccaagtatatgggctcgctttggaaggacagacgcccgtgactactgtcccccccggagcgaggtggctaacgcaggaagagtttcacacagcagcagtctctacagccatgaagaaagtgtttagggtgtaccaagggcagcagcccgggacgtgcatgggcagtaaacgtagccaagtgtcttccccttgctccagaaagaaaccacgcatggggcagcaagtgttggacaactttttccgctcacacatctcgaccgacgctcacagtctgaactccgcggcacagtag

SEQ ID NO: 16161 - DNA, 1608 bp, Artificial Sequence
  Description of Artificial Sequence: Synthetic coding sequence
atgacacccctggtgagtcggttgtcacggttgtgggctattatgcgcaagccaagggccgctgtggggagtggccatcggaagcaggccgcttcacaggaaggacgtcagaaacatgctaaaaataactctcaggccaaacccagtgcttgtgatgggctggctaggcagcccgaggaagtggtcctacaggcctccgttagttcttatcacctcttccgggacgtagccgaagtgaccgccttcagaggcagtctgctgtcttggtacgatcaggagaagagggatctcccttggcgacggagagccgaagacgagatggacctcgacagacgagcttatgctgtctgggtgtctgaagtgatgctgcaacagacacaggtggccaccgtcatcaactattacactggctggatgcagaaatggccaacattgcaagacctcgcgtcagccagtctggaagaagttaaccaattgtgggccggcctgggctattattcgcggggccgcagactgcaggaaggagcaaggaaagtggtggaggaactgggtggacatatgcctcggactgctgaaacacttcagcagcttctcccgggcgtgggcagatatactgctggggccatcgcgtctatagccttcggacaggctactggagtggtggacggcaatgtggcacgcgtcctgtgccgtgtcagagccatcggcgccgacccatcatctacgcttgttagccagcagctgtggggattggctcagcagctcgttgaccctgctcggcccggggacttcaatcaggccgcaatggagcttggggcgactgtttgcacaccccagaggcccctatgctcccagtgtccggtagaatcactgtgtagagcccggcaaagggtggagcaggagcagctcctggcctctgggtctctgagcgggtcccctgatgtcgaggagtgcgccccgaatacaggccagtgccacctatgcttacctcccagtgagccgtgggaccagactctcggggtcgtcaattttccaagaaaggcctcccggaaacctcctagggaagagtcttccgcaacttgcgtcttagagcaaccaggggccctaggtgcccagattttgctcgtgcaacgccccaacagtggtctcctggcaggtctctgggagttcccgtctgtcacatgggagccctcagagcagctccagagaaaggctttattacaggagctgcagcggtgggccggccctctgcccgctacgcatctccgccacttgggtgaggtcgtgcatacctttagtcacattaagcttacctaccaggtttacggccttgcactagaaggacagactccggtcactacagtgccgcccggcgcacgctggttgacccaggaggagttccataccgctgccgttagtacggcaatgaagaaggtcttccgcgtgtaccagggacagcagcctggtacatgcatgggctccaaacgctcacaggtcagctccccctgcagcagaaaaaaacccagaatgggccagcaggtgcttgataacttctttaggtctcacatatctacagatgcccactctcttaactcagctgcccagtag

SEQ ID NO: 16162 - DNA, 876 bp, Artificial Sequence
  Description of Artificial Sequence: Synthetic coding sequence
atgagaaagcccagagccgccgtgggttccggccatcgcaagcaagccgcctcgcaggaaggtaggcagaagcacgctaaaaataattctcaggcgaagccaagcgcatgcgacgggatgatagcagaatgccccggcgctcccgcagggttggcaagacagcccgaagaggtggtgctgcaagcaagcgtatccagctatcacctgttccgcgatgtcgccgaggtgactgcctttagaggctcacttttaagctggtatgaccaggagaaaagagatctgccttggcgtagacgcgccgaagacgagatggacttggacaggagggcatacgccgtttgggtatcggaagtcatgctgcagcaaacccaggtggcaaccgttatcaactattatacaggttggatgcaaaagtggcccaccctccaagacctggcctccgcctccttagaagaagtgaaccagctgtgggctggcctgggctactacagccgaggacggaggctccaggaaggtgctcgtaaggtcgtggaggagctgggaggacacatgccccgcacagcggagaccttacagcaactgttgcccggggtgggacgttacacagctggagccatcgcttcaatcgcctttggacaagcgaccggtgtcgtggacggcaacgtagccagggtcttgtgcagagtccgcgccatcggcgcggaccctagcagcacgctggtctcgcaacagctgtggggacttgcccagcagcttgttgaccccgcgaggccaggggattttaaccaagcggccatggagcttggggccacggtgtgcacaccacagcgccccctgtgctcgcaatgccctgtggagtcactgtgtagagcatag

SEQ ID NO: 16163 - DNA, 1599 bp, Artificial Sequence
  Description of Artificial Sequence: Synthetic coding sequence
atgcggaaacccagagccgccgtaggctcaggtcacagaaaacaggcggcctcacaagaaggaagacagaagcatgctaagaataactcacaggccaaaccaagcgcctgcgacggaatgatagcagaatgtccaggtgcccctgcaggcctggcccgccagcccgaggaagtcgtgctacaggccagtgtgtcatcctaccacctatttcgcgacgtggccgaggtaacagcctttcgcggctctctgcttagctggtatgaccaggaaaaacgagacctaccctggcgccgacgggccgaagatgaaatggatctcgaccggagggcatatgccgtttgggtgtccgaggtgatgcttcagcagacccaagtcgcaaccgtgatcaactattacaccgggtggatgcagaagtggccgaccttgcaggacctcgcttccgcctcactggaagaggttaaccaactgtgggccggactcggttactactcgcggggtaggagactgcaggagggcgcccgtaaagtcgtggaggaactcggaggccatatgccacgaaccgctgagaccttacagcagctgctgccgggtgtgggacgttatacagctggggccattgcatcaattgcctttggccaggccacaggcgttgtagatgggaatgtggcccgggtcctgtgcagagtgcgggccataggggccgacccctcctccacacttgttagtcaacaactctgggggttggcccagcagctggtggatcctgcccgcccaggagacttcaaccaggccgccatggagttaggggcaaccgtctgcacgccacagcgccctctatgttctcagtgcccagtggaatccctgtgccgagcccgccagcgggtggagcaggagcaattgctcgcctccggatccctctcagggtcgccagacgtcgaagaatgtgctcccaacaccggtcagtgccatctgtgcctgccccccagcgagccctgggaccagaccctcggcgtcgtgaattttccccggaaggccagtaggaagcccccccgcgaggagagtagcgcgacctgcgtgctcgaacaacccggcgcactgggggcccagattctcctggtgcaacgacccaatagtggcctactcgcgggactgtgggagttcccatcagttacttgggaaccaagcgagcagctccagaggaaagcactgctccaggagcttcagagatgggctggcccactgccagccacccacttaaggcacctcggagaggtggttcataccttctcacacattaagctgacctaccaggtgtatggactggccctggaaggccagacccccgtgaccacggttccccctggagcccgctggctcacgcaggaggagtttcacaccgctgccgtttcaacagcaatgaaaaaagttttccgcgtgtaccaggggcaacagcctggcacctgcatgggatccaaaagaagccaggtaagctccccttgttctcggaagaagccccgaatgggccaacaggtgctcgacaattttttccgatcacacatctccactgatgcccactccctgaactctgccgcgcaatag

SEQ ID NO: 16164 - DNA, 1650 bp, Artificial Sequence
  Description of Artificial Sequence: Synthetic coding sequence
atgacacccctggtgagtcgactgtctcgactctgggccatcatgcgtaagcctcgcgccgcagtaggaagtggccacaggaagcaggcagctagccaggagggtcggcagaaacatgccaaaaacaattcccaagccaagccgagcgcctgtgacgcttgtgcgggtatgatcgccgaatgtccaggggcccccgctggactggcccggcagcccgaggaagtggttttacaggcatccgtgtcgtcttaccacctctttagggacgttgccgaggtgaccgccttcagaggatcattactttcatggtacgaccaagaaaagcgcgacttgccctggcgcagacgggctgaggatgaaatggatctggatagacgggcttacgctgtctgggtgtctgaggtaatgctgcagcagactcaggtggccactgtaatcaattactatacgggctggatgcaaaaatggccgaccctgcaggatctcgctagtgcctcccttgaagaggttaatcagctctgggccggcctggggtattattcacgaggacgacgcctgcaagaaggggctaggaaggtggtcgaggagttgggcggacatatgcccaggaccgccgaaacacttcagcaactgctgcctggagttggaaggtataccgccggagcaatcgctagcatcgcatttggtcaggccaccggagtggtggatggtaacgtggctagggttctttgccgcgtgcgagccataggcgcggacccatcgtccaccctggtgtcacagcagctttgggggctggctcaacaattggtggatcctgcccgtcctggagacttcaatcaagccgccatggaactgggagcgacggtgtgtacaccgcagcgaccattatgttcccagtgtcccgtggaatctctctgtcgagctcggcagcgggtggaacaagagcagttgcttgcatctggttctttgtcagggagcccagacgtggaagaatgcgctccaaacactggtcagtgccatctgtgtctcccgccctccgaaccttgggatcagaccctgggagtggtgaattttccacggaaagccagccgtaagccacccagagaagagagtagcgcaacatgcgtactggagcagcccggtgccctgggcgcgcaaatactgctcgttcagagaccgaactccggactgctggccggtttgtgggaatttccaagtgttacctgggagccgagcgagcaattgcagaggaaggcgttgctgcaagagctccagcgatgggcaggacctttgcccgctacgcatctcagacacctgggggaggtggttcacaccttcagccatataaaactgacctaccaggtgtacggtctagccctagagggacaaacgcctgtcaccacggtacctccgggagcccggtggctcacacaggaagaattccacacagccgctgtaagcaccgccatgaagaaggtgttcagagtgtatcaaggccagcagccagggacttgtatgggaagtaagcgtagtcaggtttcaagcccctgtagtcggaaaaaaccacgcatgggtcaacaggtgttggataattttttccgatcacacatcagtaccgacgcccactctcttaattcagccgcacaatag

SEQ ID NO: 16165 - DNA, 1566 bp, Artificial Sequence
  Description of Artificial Sequence: Synthetic coding sequence
atgcggaagcccagagccgctgtgggatcaggccataggaaacaagcagctagtcaagaaggtagacaaaaacacgcaaagaacaatagccaggccaagccttccgcatgtgatggtctggcacgtcaacccgaggaagtggtcctccaagcctccgtgtcaagctatcacttattcagagatgttgccgaggtgacagctttccggggctcactcctgtcctggtacgatcaggaaaagcgcgatctgccgtggagacggcgggcagaggacgaaatggatctggatagaagagcatacgctgtctgggtaagcgaggtgatgctacaacaaacgcaagtggcaaccgtcataaactattacaccggttggatgcagaagtggcctactctacaggatttagcaagtgcttccctggaggaagtgaaccagctgtgggctgggttaggatattattctcgcggccggagactgcaggagggggccagaaaggtggtggaggagttagggggccacatgccccgaactgccgaaacactgcagcagctgctgcccggagtcggccggtatacggccggggccattgcctctatcgctttcggtcaagccactggcgtggttgatggcaacgtggctcgcgtcttatgcagggtccgggccataggcgcggaccctagctctaccctggtgtcccaacagctgtggggtctggctcaacagctggttgaccccgctcgtcctggagatttcaatcaggcagctatggaactcggagcgacagtatgcacccctcagagaccgctgtgcagccaatgccccgtggaatcactgtgccgcgctaggcagcgcgtggagcaggagcagttgctcgcgtcaggaagcctttctggttctcctgatgtcgaagagtgtgcaccaaatactggtcagtgtcatttgtgcttgcccccttctgagccatgggaccaaactttgggagttgtaaacttcccacgcaaggcctcacgcaagcccccccgcgaagaaagttctgccacctgcgtcctcgaacaaccaggggcattaggcgctcagatcctgttggtgcaacgcccaaactcggggttgttggctggattatgggaatttccctcggtgacatgggaacccagcgagcaactccaacgcaaggctctccttcaagagctccagcgatgggcaggacccctgcccgccactcaccttcgtcatttaggcgaggttgtacacactttttcacacattaagctgacatatcaggtttacgggttagctttagagggccagactccggttacaaccgtccccccaggggccagatggctcactcaggaggagttccacacagcagcggtcagtactgctatgaagaaggtttttcgcgtttaccagggccagcaaccgggcacttgtatggggagtaagcgatcacaggtatcgtcgccctgtagtcgaaagaagccacgtatgggacagcaggtgcttgataattttttcagatctcatatctcaaccgatgcacattcactcaattcagcagcccagtag

SEQ ID NO: 16166 - DNA, 648 bp, Artificial Sequence
  Description of Artificial Sequence: Synthetic coding sequence
atgacccccctggtgagtcgcttgtcgcggctgtgggaggtaaaccagctatgggccggcttgggctattatagtagaggacggcgtctgcaggaaggcgccaggaaagtcgtcgaagaattaggtggtcatatgcctcgcacagcggaaacactccaacagctgctccctggcgtggggcgctacacggctggcgcaatcgcttccattgcctttggtcaggctacaggcgtggttgacgggaatgtggctcgtgttctctgtagggtgagagctataggcgccgacccaagctcaacactggtcagccaacagctctggggactggcccagcaactagtcgatcccgctcggcccggagatttcaaccaagccgccatggaattgggcgctaccgtctgcacccctcagagacccctgtgtagccaatgccctgtggagagcctgtgtcgtgcacgacaaagagtagagcaagagcagctgctggccagtggctccctgtctggcagtccagacgtagaagaatgtgctccaaacacagggcagtgtcacttgtgcctccccccttccgagccttgggatcaaactctgggcgtggtgaacttcccacgcaaggcctctcgcaaaccccctagggaggagtcttag

SEQ ID NO: 16167 - DNA, 693 bp, Artificial Sequence
  Description of Artificial Sequence: Synthetic coding sequence
atgacccccctggtatccagactgtctcgcctgtgggctatcatgcggaagcctcgggccgctgtggggtccggccaccgcaagcaggccgccagtcaggagggtcggcagaagcacgctaaaaataacagtcaagccaagccatccgcctgcgacggcggcgaatccacattgggttggcccggcctcctgtttagttggcctgctgctgctgggggcagctcagaaggtcttctggcaggcctttgggaattcccctccgtcacgtgggaacctagtgagcagctgcagaggaaggccctgctccaggaactccagcggtgggcaggacctctacccgcaacccacctgcgtcacctgggcgaagtagtgcataccttcagccacatcaaactaacctatcaggtttacggtctggccctggagggccagacgccagtaactacagtgcctccgggagccaggtggcttacccaggaagagttccatacagcagctgtgtcaacggcgatgaaaaaggtgtttagggtgtatcagggccagcagcccgggacatgtatggggagcaagcgctcccaggtctcctccccgtgcagtaggaaaaagccaaggatgggtcagcaggtcctcgacaacttctttcgttctcatataagtactgatgcacacagtttaaactctgctgctcaatag

SEQ ID NO: 16168 - DNA, 291 bp, Artificial Sequence
  Description of Artificial Sequence: Synthetic coding sequence
atgtcggataacgatgacattgaagtggaatcagacgaggagcagccgcggttccagtccgctgcggacaaaagggcacaccataacgccctcgaaagaaagcgcagggaccacattaaggattctttccactccctgcgggactcagttcccagcctacagggtgaaaaactgtatttcctgttttggaaattatgtacccccgtgttgcacaggcagagcctgatgcagaaatgccatactttcatttcgtcttaccaggtccacaaaaagaaggaatgcaaaatatag

SEQ ID NO: 16169 - DNA, 405 bp, Artificial Sequence
  Description of Artificial Sequence: Synthetic coding sequence
atgagtgataatgacgatatcgaagtagagtcagatgaggaacagccccgatttcagtctgcggccgacaaacgggcccaccataatgcgcttgagcgcaaaagaagggatcacatcaaagattccttccactcactgagggattcagttccaagcctccagggcgagaaagcctcaagggcccagattttggacaaggcaacagagtacattcaatatatgcggagaaagaatcacacgcatcaacaagacattgacgatctcaagcgccagaatgcacttttagaacagcagggtgagcacccgtcctcgtgggggtcatggccctgttgcgcacccgcccggtctggattcggcacatgggcctgtagagtacgtgccagtcacggagtgtgtgcccagtag

SEQ ID NO: 16170 - DNA, 252 bp, Artificial Sequence
  Description of Artificial Sequence: Synthetic coding sequence
atgtccgacaatgatgacatcgaagtggagtctgacgaggagcagcctcgcttccaaagtgcggccgataagagggcgcaccataacgccctggagcggaagagaagggaccacatcaaagattccttccacagtctgagggactcagtgccgtctctgcaaggtgagaaaggtaccaagatgaaactaacacttccccctgtgtttccctacgagcacctgcccttccccactgtattttgtcacggttag

SEQ ID NO: 16171 - DNA, 456 bp, Artificial Sequence
  Description of Artificial Sequence: Synthetic coding sequence
atgtcagataatgatgacatcgaggtagagagcgatgcagacaaacgcgctcatcataacgcactggagagaaagcggcgggaccacataaaggattccttccacagtcttagggattcagtaccatcactgcagggagaaaaagcttcgcgcgcgcaaattctagacaaagccacagaatacatccagtacatgagacgtaagaatcacacacatcagcaggatattgacgatctgaagcgacagaatgcgctcttggagcaacaggttcgcgcgctggagaaagcaaggtccagcgcccagctgcagacaaactaccctagctctgataatagcctgtacaccaacgcgaagggcagcactatttcagcattcgatgggggatcagattcttcttcagagagcgaaccagaggagccgcagagtcggaaaaaattacgcatggaagcctcatag

SEQ ID NO: 16172 - DNA, 483 bp, Artificial Sequence
  Description of Artificial Sequence: Synthetic coding sequence
atgagtgataatgacgacatcgaagtagaatccgatgaggagcagccaagattccagtcggcagcagacaagcgggcccaccataatgccctggagagaaagaggcgggaccacatcaaggactcctttcactctttgagagattctgtgccgtcccttcagggcgaaaaagccagtcgggcgcagattctcgacaaggctaccgaatacatccagtatatgagacgcaagaaccacacccaccaacaggacatcgatgacctgaagcgccagaacgcgcttctggagcaacaggttagggctttggagaaagctcgcagcagcgcccagcttcaaactaattaccctagttcggacaactcgttgtatactaacgctaagggttccacaatttccgcctttgacggcggtagcgattcgtctagcgagtcagagccagaggagcctcagagcaggaagaaactgcgcatggaagccagctag

SEQ ID NO: 16173 - DNA, 426 bp, Artificial Sequence
  Description of Artificial Sequence: Synthetic coding sequence
atgctgtccgtgaaaattacaagtatcttctccattttcttttttctgctgtttcaggaggagcagccgcgctttcagagtgcggcggataagcgggcccaccacaacgctttggaacgcaagaggcgcgaccacattaaagacagctttcactccctccgcgattcagtgccctcccttcagggggagaaagcatccagagctcaaatcctcgataaagccacggagtacattcagtacatgaggcgaaagaaccacacacaccaacaggatattgacgatcttaaaagacagaatgcactactcgaacaacagggcgagcaccctagctcatgggggtcatggccctgctgcgcccccgccaggagcggcttcgggacatgggcttgtcgagtgcgggccagtcacggagtttgtgcccaatag

SEQ ID NO: 16174 - DNA, 312 bp, Artificial Sequence
  Description of Artificial Sequence: Synthetic coding sequence
atgtcagataatgatgacattgaggtggaatctgatgaagaacaaccccggtttcagtcagctgctgacaagagggcacaccacaatgcactcgaacgcaagcgccgcgaccacatcaaggatagtttccatagccttcgggactcagttccaagccttcagggggaaaaagcaagtcgcgctcaaatcctggataaagccaccgagtatatccagtatatgagacgcaaaaatcatacccaccagcaggatatcgacgacttaaaaagacaaaatgccctgctagagcaacagggagagtctgagtcttag

SEQ ID NO: 16175 - DNA, 312 bp, Artificial Sequence
  Description of Artificial Sequence: Synthetic coding sequence
atgtccgataatgatgacattgaggtcgaaagtgacgaagaacagccacgctttcaaagcgccgcggataaaagagcacatcacaatgcactggagcgtaagagacgagaccacattaaagactccttccatagtctgcgggactccgtcccctccttgcagggagagaaggcttcgcgggctcagattttggacaaagccaccgagtatatccagtacatgcgcaggaagaaccatacacatcagcaagatatcgacgatctgaaaagacagaacgcactgcttgagcagcaaggtgagagtgagtcctag

SEQ ID NO: 16176 - DNA, 13923 bp, Artificial Sequence
  Description of Artificial Sequence: Synthetic coding sequence
atgcccgtgcctgacggcagcgtggccgccgcaggtctcggtcttggcctgccagccgccgattcgcgaggacattaccagctcctgctttccggacgggctctggcggataggtacaggcgaatctacactgcagcccttaacgacagggaccagggcggagggtctgcagggcaccctgcctcccgcaataaaaaaatcctgaacaaaaaaaaactcaaacgcaaacaaaagagtaaaagtaaggtgaagacacgcagtaaaagcgagaatcttgaaaacaccgtgattattcctgacatcaagctgcactcaaatcccagcgcattcaatatctattgcaacgttcgccactgcgttcttgagtggcagaagaaggaaatatcacttgctgccgcaagtaaaaatagcgtccagtctggagagtctgattctgatgaggaagaagagtccaaggagccgcctatcaaacttccaaagatcatagaagttggcctttgcgaggtgttcgagctcattaaggagacccgtttcagtcatccctcattatgtctgcgcagcttacaagcccttctgaacgtcctccaggggcaacagcccgaaggcctccagagcgaacctcctgaagtgctggaatccctgtttcagcttctgttggaaattaccgttcgatccactggaatgaatgacagcacgggacaaagtctgaccgctctctcatgcgcttgtctgtttagcctggtcgcctcctggggcgaaaccggaaggaccctgcaggccatttcagcaatcctcacaaacaacggctcccatgcttgtcagaccatccaggtgcctacaatactcaatagcctacaacgttcagtgcaagcagtgctggtcggaaagatccaaattcaggattggttcagtaacggcattaagaaggccgctttgatgcacaagtggcccttaaaggaaataagcgtggacgaagatgatcaatgtctactccaaaacgacgggtttttcttgtatctgctttgcaaagacggactttacaagataggaagcggctattccgggaccgtgaggggccacatctacaactctaccagccgcatccgtaataggaaagaaaaaaaatcatggctcgggtacgctcaagggtacttgctgtacagagacgttaacaaccatagcatgacagccattaggatctctcccgaaacgttggaacaggacggaactgtcatgctccccgattgtcacacggagggtcagaatattctgtttacggacggtgaatacatcaaccaaatagccgccagccgggatgacggctttgtggtgaggatctttgctacaagcactgagccggtcctgcagcaggaactgcagttgaagctggcgcggaaatgtctgcatgcatgcggcatcagcttgtttgacttggagaaagacctccacattatctctaccgggttcgatgaggaaagcgctattcttggcgccggaagggagttcgccctgatgaagactgccaacggcaagatctattatactgggaagtaccagagcctcggaattaagcaggggggcccaagcgcagggaaatgggtggagctgcccatcaccaaatcacctaaaattgtacatttcagcgtgggccacgacggcagtcacgcccttttagtagcagaagacggtagcatctttttcacgggttccgcttccaagggtgaagacggcgaaagcaccaaatcaaggcgccaatcaaagccttataaacctaaaaagatcatcaagatggaagggaaaatagtggtgtatacagcttgtaacaacggctcatcgtcagtcatctcaaaagacggcgagctgtatatgttcggaaaggatgctatttacagcgacagctcatcccttgttactgaccttaaaggccactttgtgacgcaggtggctatgggcaaggcccacacttgcgtgctgatgaaaaatggggaggtctggacctttggggtgaataacaagggtcagtgcgggcgcgacacgggagctatgaatcagggtggtaaaggatttggtgtcgaaaatatggccaccgcaatggacgaggaccttgaggaagaacttgacgaaaaagacgaaaaatctatgatgtgtcccccagggatgcataagtggaagctcgaacaatgcatggtttgcaccgtgtgtggcgactgtaccggctacggcgctagctgcgtgtccagcggccgacctgatagagtgccaggaggcatctgtggatgcggctctggtgagtcaggctgcgcagtctgtgggtgctgtaaggcctgtgctagggaactggacggtcaggaggcccgtcagaggggtattctcgatgctgtgaaggagatgatccctctggacctcctgctggcggtgccagtgcccggggtgaacatagaggagcacctacagcttagacaggaggaaaaaagacagagggtgatcagaagacacagattggaggagggtcgcggacctctcgtatttgcaggccccatttttatgaatcacagagagcaggccctggcccgtctgagatctcacccagcgcagcttaaacacaagcgggacaagcacaaagatggttcaggcgagcgaggagagaaggacgcatccaagatcaccacctaccccccaggatctgtgcggtttgactgtgaattgagagccgtgcaggtgagttgtgggttccatcactctgtggtactcatggagaatggggatgtgtatacttttggttatggacagcatgggcagctgggacatggcgacgtcaatagtcggggctgccccaccctggtccaggcactgccgggcccatcgacccaggtcaccgcaggatccaatcacacagcggtgctgctgatggacggacaagtcttcacattcggttcttttagcaaggggcagctgggcagacccatcttagatgtgccgtattggaatgccaaacctgctccaatgcccaacattgggagcaagtatggccgcaaggctacctggattggcgcatccggggatcagactttcttgcggattgacgaggcgttgatcaactctcatgtgctggctactagcgagatctttgcgagtaaacacattatcggcttagtacctgcgagcatctctgagccaccacccttcaagtgtttacttattaacaaagtggacggtagctgcaagaccttcaatgactctgaacaagaagacctccaaggatttggagtgtgcctagatccggtctacgatgtcatctggaggttccggcctaatacaagggagctgtggtgttacaacgctgttgtggccgacgccagactgcctagtgctgccgatatgcaatcacgatgctcaatactgagtccggaattggcactccccaccggatctcgcgccttgaccacgagaagccacgccgctctccacattttggggtgcctggatactttggctgccatgcaagatctcaaaatgggcgtggcctctacagaggaagaaacacaggcagtaatgaaagtctatagcaaagaagactatagtgttgtcaatcgatttgagagccatggtggaggttggggatactcagcccactctgtggaggccatacgcttcagcgctgacacagacatactgttaggcggattgggtctattcggcggtcggggtgagtacacagctaagatcaaactgtttgagctggggcccgatggaggggaccacgagaccgacggggacctgcttgccgaaacagatgtgttggcatacgactgcgccgcccgcgagaagtacgcaatgatgttcgatgaacccgtcctgctgcaggccggttggtggtacgtcgcctgggcaagggtgtccggtccaagttccgactgtgggagtcacggacaggcttccattaccaccgacgatggcgtggtgtttcaatttaaaagcagcaagaaatctaataatggcacagacgtcaacgccggacaaatccctcagctcctataccgcctccctacctctgacggttcagctagtaaaggaaagcagcagacttctgaacccgtccacatcttaaaaaggtcttttgcccgcaccgtttcagtcgaatgttttgaaagcctcttgtctatcctacactggtcatggactaccttggtgttgggggttgaggagttacggggcctgaaagggtttcagttcacagcaactctgcttgatttagagcgtctgcggttcgtcggtacctgctgcctgcggctccttcgagtgtatacatgtgagatctacccagtcagcgctaccgggaaggccgttgtggaagagacctccaagctggccgaatgcataggcaagactagaacgctcttacgcaaaatcctttccgagggagttgatcactgtatggtcaagctggacaatgacccccagggctacctctcccagccactgtccctgttggaggcagtgctccaggagtgtcataacacgttcacagcatgcttccattccttctaccctactccagcattgcagtgggcctgtttgtgtgatttattaaactgcctggaccaggatatccaggaagctaattttaaaacatcttctagccgcttactcgctgccgtgatgagcgccctctgtcataccagcgtaaagctgacaagtatcttccccatcgcctacgatggggaagttctattgcggagcattgtcaaacaggtgtcaacagaaaatgattccactctggttcaccgctttcctctattagttgcccacatggaaaaactgtcacagagcgaggaaaacatatccgggatgactagtttcagagaggtgcttgaaaagatgctggttatagtggtgttgcccgtacggaattctctccgccgggagaacgaattgttctccagccacctcgtgtcgaacacttgtggtttattggcctccatcgtgtccgagttgaccgcaagcgccctaggatcagaggtagacggtctgaacagcctccatagtgtaaaggcatcagcaaatagatttacaaaaaccagccaggggaggtcttggaacacgggtaacgggtctcctgatgccatctgtttctctgttgacaagccgggtatcgtcgtcgttggcttctccgtgtatggtggggggggcatacacgagtacgaactagaggtccttgtcgatgattctgagcacgccggcgattccactcattctcaccggtggacatccctggagcttgtgaaagggacctataccacggacgattcaccgagcgacatcgctgagatacgcctcgacaaagtcgtgcctctgaaggagaatgtcaagtatgccgtgaggctgcgcaattacggatctcgcaccgccaacggagacggtggcatgactactgtgcagtgtcccgatggcgtgaccttcacattttccacttgtagcctatcctcaaacggcacaaaccagacccgtggccagattccacagattttatactatcggtccgaattcgatggggacctgcagtcacagctgttgagtaaagccaatgaagaggataaaaattgctctcgcgcccttagcgtcgtgagtacagttgtgagggcatctaaagacctgttgcaccgtgccctcgccgtagatgccgatgacattcccgagttgttgtcttctagcagtctgtttagcatgctattaccacttatcatcgcatacatcggcccggtggctgcagcaatccccaaggtggctgttgaggtgttcggccttgtccagcagctgctgccgagtgttgccatcctcaatcagaaatacgctcccccagcattcaacccaaatcagagtactgattccaccactgggaatcaacctgagcaaggtctgagtgcttgtacaacaagctcccactacgccgtcatagagtcagagcacccgtataaaccggcttgtgtaatgcactacaaagtgacctttcccgaatgtgtgcggtggatgacaatcgaattcgacccccagtgcggcaccgctcaatccgaggacgtgctgagactgctgattccggttcgcacagtgcagaattcgggctacggtcccaagctgacatccgtccatgagaacctgaactcttggatcgagttgaagaagtttagcggatcatcaggttggcctactatggtgctagtcctgcctggaaacgaggctttgttttccctcgagactgccagcgactacgttaaggatgacaaggcgagcttttacggctttaagtgttttgctattgggtatgagtttagtcccggtcctgatgagggcgtgatccaactcgaaaaggaattggcgaatttagggggggtgtgtgctgcagcactgatgaaaaaagatctggcccttcccatcggtaatgaattagaagaggatctggaaattctagaggaggccgctttacaagtgtgcaaaactcattccgggatattaggaaagggattagccctttcacactcccccacgatcctggaagctctggaaggcaacctgccgctccaaatccagagcaacgagcagagttttctcgatgacttcattgcctgcgtgcctgggtcatccggcgggagactcgcacggtggctacagcctgactcctacgctgacccacagaaaaccagcctcatactgaataaggacgacataagatgtggctggccgacgaccattaccgtgcagaccaaggatcagtatggagatgtggttcacgtccccaacatgaaggtcgaagtgaaagcagttcccgtgagtcagaagaagatgtccctgcagcaagaccaggcaaaaaagccacagcgcatccccggcagcccggcggtgactgctgcaagcagcaataccgacatgacatacggtggcctggcctccccgaagttggacgttagctacgaaccgatgatcgtgaaagaggctcggtatatcgcaatcaccatgatgaaagtgtatgagaactacagtttcgaggagttaaggttcgcctcccccacgcctaaacggccaagtgaaaatatgttaatcagagtgaacaatgatggaacatactgcgcgaattggacgcccggggccattgggctgtacacgctgcatgtgactattgacggcatcgagattgatgcgggccttgaagttaaggtgaaagaccctccaaagggaatgatccctcctggtacccagctagtgaaacccaagtccgagccgcagccaaacaaggtgcggaaattcgtggcaaaagattccgccggtttgcggatccgaagtcatcccagcctccagtccgagcagattgggatcgttaaggtcaatggcacgatcacatttattgatgaaatccataatgatgacggggtctggcttagactgaatgatgagacaattaagaagtatgttcccaacatgaatggctatacagaagcgtggtgtctctccttcaatcagcatttgggcaagagtctgctcgtccctgtagacgagtccaagaccaacaccgatgacttctttaaggacataaactcttgttgccctcaagaggcaacaatgcaggaacaagacatgccatttctccgcggcggccccggcatgtacaaggtcgttaaaaccggcccatccggtcacaatatcagaagttgtccaaacctgagaggaatacctatcgggatgctcgttctgggaaacaaggtgaaggccgttggagaagtgactaatagtgaaggaacttgggtgcagcttgaccaaaactctatggtggaattctgcgagtccgatgagggggaggcatggagtctcgctcgcgaccgcggtggaaatcagtacctgaggcatgaggacgagcaggccctgttggatcaaaacagtcaaaccccacccccctcccctttttctgtgcaggccttcaataagggcgcatcatgctctgcacagggctttgattatggtctgggcaattccaaaggcgatcgaggcaatatcagtacgagttccaagcccgcttcaacttcagggaagtccgaactgtcctctaagcatagcagatctttaaagccagatgggcgcatgagtcggacaaccgccgaccagaagaagcccagggggaccgaatcactctctgcatcggagtcacttatcctgaagtctgacgccgcgaaacttcggagcgattctcactccagatcactttccccaaaccacaatacactccagacactcaaaagtgacggccgcatgccaagcagctctagggcagaaagccctggaccaggctcacgactgtcttcaccaaaacctaagaccctcccggccaaccgaagctctccatcgggcgcatccagtcctagaagttcaagtcctcacgacaaaaatttaccacagaagtcaacagctccagtgaagaccaaactcgatcccccccgtgaaagatctaagagtgattcatacactctggaccccgatacactgcgtaagaaaaagatgcctttaaccgagccattgcgcggtcgaagtaccagccccaagcctaaaagtgtgcctaaggacagtaccgacagcccaggctctgagaaccgcgccccgagcccacatgtcgtccaggaaaatttgcactcagaggtggtcgaggtttgcacttcctcaaccttgaaaactaatagcctgaccgatagcacttgtgacgactccagtgagtttaagtctgtagatgaaggatctaataaggtgcatttttctatcgggaaagctcctctgaaagacgagcaggagatgcgggcctcacctaaaatatccagaaagtgcgccaatcgccacacaagacccaagaaggagaagtctagctttttgtttaagggcgatggttcgaagccgttggagcctgcaaagcaggccatgtctccaagcgtggccgagtgcgctagggccgtgttcgcttcctttttatggcacgaggggatcgtgcacgatgcgatggcctgttcttcctttttaaagtttcaccctgaactgtctaaggaacatgctcctatccgcagcagcctgaattcacagcaaccaactgaagagaaggagacaaagctcaagaacaggcacagcctggagatctcaagtgcattgaacatgtttaatattgctccccatggacccgatatcagcaagatgggctccatcaacaagaacaaggtcctgagcatgcttaaggagcccccacttcatgagaaatgtgaggatgggaagaccgagactacgttcgagatgagcatgcacaacactatgaaatctaagtctccattgcctctgactctgcaacatctggtcgcattctgggaagacatctccttggctaccattaaagccgcttcccagaatatgattttccccagccccggatcatgtgccgtgctgaaaaaaaaagagtgcgagaaagaaaataagaaaagcaaaaaggagaagaaaaaaaaagagaaggccgaagtgagaccaagaggcaacctctttggcgagatggctcagttggcggtcggcgggcctgagaaggataccatttgtgagttgtgtggggaaagccatccttatcctgtgacttaccacatgcgccaggctcacccaggatgtggcagatacgccgggggacagggctacaatagcatcggccacttctgtggtgggtgggccggcaattgtggcgatggaggaattggcggcagcacttggtatcttgtgtgtgatcggtgcagagaaaagtacctgcgagagaagcaggcagctgcacgagaaaaagtgaagcagtcgcgtaggaaaccgatgcaagtgaagacgccaagagccctgcccacaatggaagctcaccaggtcattaaggccaacgcattgttcttgctttccctctcctcagctgccgaaccatccatcctctgttatcatcccgctaaacccttccagagtcagctacctagcgtcaaggaaggcatttcagaagacctgccagtcaagatgccgtgcctgtatctgcaaacgctcgctcgtcaccaccacgagaatttcgtcggctaccaagatgataatctgttccaggatgaaatgagatatctccgatctacatccgttcccgcaccctacattagcgttacacccgacgccagtcctaatgtgttcgaggagccagaatccaatatgaagagcatgccaccttcactcgaaacgtcaccaatcacagatacggatctggccaaaaggacagtgtttcagagaagctactcagtggtggcgagcgagtacgataagcaacatagtatcttgccggctcgggtgaaggcaatccctcggaggcgggtgaatagtggcgatactgaagtggggtccagcctcctccggcatccttcccccgaactgtctcggctgattagcgcacactcctccctgagtaagggagagagaaactttcagtggcccgtcctagcgtttgtaatccagcaccacgatctcgagggtctcgaaatcgccatgaagcaagccctccgcaaatcagcctgccgggtcttcgccatggaggccttcaattggctattgtgtaacgtcattcaaaccacatctctccacgacatcctgtggcatttcgtcgcctcacttacccctgcacccgtagaacccgaggaagaggaggacgaagaaaacaagacttcaaaagaaaattccgagcaggaaaaggacacccgagtgtgcgagcatccactgtctgacatcgtcattgccggggaggcagctcatcctctccctcacacgttccatcgtttgctccaaacaatctccgacctgatgatgtctctgccaagcggatcctctctgcagcagatggccctgaggtgttggtccctgaagttcaagcagagtgaccatcagtttttgcaccagtccaacgtgtttcatcacatcaataacattctttcaaaatctgatgacggggacagcgaggaaagcttttctatctcaatccagagtggattcgaggccatgtcccaggaactgtgtattgttatgtgcttgaaagatctcacaagtatcgtcgatataaagacatctagccgcccagccatgatcggatcgctgacggatggaagcacggaaactttctgggagagcggcgatgaagacaagaacaaaaccaaaaacatcacaattaactgcgtcaagggtatcaatgcccggtacgtgagtgtacatgtcgataatagtagggatctcggaaataaggtgacaagcatgacctttttgaccggtaaggccgtggaggatctgtgccgcatcaagcaggtggatctcgatagccgtcacatagggtgggtgacgtcagagttacccgggggcgataaccacattattaagattgagctgaagggacccgaaaacacccttcgggtgcgccaagtgaaagtcctcggatggaaggatggagagtcaaccaaaatcgccgggcagataagtgccagcgtggctcagcagcgcaactgcgaagcagagacattgcgcgtgtttaggctgataacctcccaagttttcggcaagctaatttctggagatgccgaacccacccctgagcaggaagagaaggcccttctgagctctccagaaggagaagagaaggtgtataacgctacgtccgacgccgacctcaaggagcacatggtaggaatcatatttagccgctctaagcttaccaacctacagaagcaggtgtgtgctcacatagtgcaggctatcagaatggaggccacaagagtccgcgaggaatgggagcacgcgataagcagtaaggagaacgcaaacagtcagcccaatgacgaggatgcttcgtcagatgcctactgcttcgaactactgagtatggtgttggcactaagcggaagtaatgtcggcagacagtatttggctcagcagctgacattgctacaagacctcttttcactcctgcacacagcctcccctcgggtacaacgccaggtgacctcacttttgagacgggttctacccgaggtgacaccatcccgcctggcctcaattatcggggtaaagtcccttcctcctgcggatatcagcgatataatccatagtacagagaagggcgattggaacaagctagggatacttgacatgttcctcgggtgtattgctaaagccttgactgtccagctgaaggcaaagggcacaactattaccgggactgccggcacaacggtggggaagggtgtcactactgttaccctccccatgatattcaattcatcttatttgcggaggggggaaagtcattggtggatgaagggttcgaccccaactcagatatccgaaataattatcaaattgatcaaagacatggcagctggacacttaagcgaagcctggagccgcgtcacaaagaacgcaatcgcagagacaatcattgcactcacgaaaatggaagaggagttcagatcccctgtgagatgtattgccacgacccgcctctggctggcattggccagcctgtgtgtgttggaccaggatcacgtcgaccggctgtcttccgggcgctggatgggcaaagatggtcaacaaaagcagatgcccatgtgtgacaaccatgacgacggagagactgcagctataatcctgtgcaatgtgtgtgggaacttatgtaccgactgcgaccgctttctgcacttgcatagaagaaccaagactcatcagcggcaggtgttcaaagaagaggaagaggccatcaaggtggatttgcacgaaggctgtgggagaaccaagctcttttggctcatggctctggccgactcgaaaacaatgaaggccatggtagagtttagagagcacacaggcaaacctaccacgtcttcgagcgaagcctgcagattttgcgggtcaaggtctgggaccgaattgtcagcagtcgggtctgtttgtagcgatgccgactgccaggaatacgctaaaatagcatgtagtaaaacccacccttgtggccacccatgcgggggtgttaagaatgaggagcattgcctgccttgcctgcacgggtgtgataagagcgctacatctctgaagcaggacgccgacgatatgtgtatgatatgctttactgaagcgctgtctgccgcccccgccattcaactcgactgctcacatatctttcacctgcaatgttgtcggagagttctggagaatcggtggctagggccacgaatcacattcggctttatctcctgccccatctgtaagaacaaaattaatcacattgtgctcaaggacctcctagatccaatcaaggaactctatgaggatgtacgccgcaaagctctgatgcgactggaatatgagggcctgcacaaaagtgaggcaatcaccacccccggtgtccgcttctataacgatccagctgggtatgccatgaatcggtatgcctactatgtttgttataaatgtaggaaggcctattttggaggggaagcccggtgtgatgcggaagctggcagaggggacgactatgatccccgcgagttgatttgcggcgcttgttctgatgtgagcagggcccaaatgtgtcccaaacacgggactgatttcctggagtacaaatgtaggtattgttgctctgtcgccgtcttcttctgcttcggcaccactcatttctgtaacgcctgccatgacgattttcaacgcatgaccagtattcccaaggaagagctcccacactgccctgccggccctaaggggaagcagttggaagggacggagtgccctctccatgtggtgcatccccccaccggagaagaattcgccctgggatgcggtgtctgcaggaacgctcacacattttag

SEQ ID NO: 16177 - DNA, 1542 bp, Artificial Sequence
  Description of Artificial Sequence: Synthetic coding sequence
atgcaggagcaggacatgccttttctgagaggagggcccgggatgtacaaggttgtgaagacaggtccctcaggccataatataaggtcctgcccgaacttgcgtggaatccctatcggcatgctcgtattgggcaacaaggtgaaagctgtgggagaggtgacaaattcagagggcacatgggtgcagctggatcagaacagcatggtcgagttctgcgaatctgatgagggcgaggcatggtcactcgccagagaccgcggcgggaaccagtacttacgtcatgaggacgagcaagctcttcttgatcagaatagtcaaactccccctccatccccatttagtgttcaggccttcaacaagggcgcatcatgctccgcgcagggtttcgactacggactcggtaattctaaagtgctgaccgtgctccccacggccggagaccaactgtcagcgattcttaattccatccagtccagaccaaatctgccagccccctcaatctttgaccaagccgcaaaacccccatcaagtctcgttcactctccgttcgtgtttggtcaacccctgagcttccagcaaccccagcttcagagtgatagaggtaatatttccactagcagcaaacccgcaagtacatctgggaagtcagaactatcctcaaaacacagtaggagtctgaaacctgacgggcgcatgagcagaactacagcagatcagaagaagccccggggaacagagtctctgtcagcaagcgagagcctgatccttaaatccgatgccgctaagttgcgctccgattcacacagtcgaagcctgtcccccaaccacaacactcttcagaccttaaagtctgatggccgcatgcctagctcctcacgagccgagtctcctggtcccggatcgcggctgtcgagccccaagccaaagaccctgcctgccaatcgctcttctccctcaggcgcttcctctcccagaagtagtagccctcatgacaagaaccttccccaaaaaagcacagcaccagtaaaaacgaaacttgatcctccaagagaacgctcaaaatctgattcctatactctggatccagacactctccggaaaaagaaaatgcccttaacagagcctctaagggggagaagcacgtctcccaaaccaaaaagcgtacccaaggattccaccgacagcccgggaagcgagaatcgtgcacccagtccccacgtggttcaggaaaaccttcactccgaggttgtcgaggtgtgtacctcaagcacactgaaaactaattctctgaccgacagcacgtgcgatgacagcagcgaattcaagtctgtcgatgagggtagcaataaggtgcacttcagtataggtaaggcccctctgaaagacgagcaggaaatgagggctagccctaagataagtcgcaaatgcgccaaccgacatacaaggcccaagcgcaaaatcgaattctcatttcagaggagatggatccaggcatttagagcaagtcaggctagccatgtgagcttttgtggtcggtag

SEQ ID NO: 16178 - DNA, 14037 bp, Artificial Sequence
  Description of Artificial Sequence: Synthetic coding sequence
atgatgatgtgcgccgctacagcaagtcctgctgccgctagctcaggactgggaggcgacgggttttatcctgccgccactttcagcagcagtccagctccaggggccctgttcatgcccgtccccgacggaagcgtcgccgccgctggtttaggactaggtttgcctgcggcggattctcgcggacactatcagctgcttctttcaggcagggcactcgccgataggtacagacgcatctataccgcagcccttaatgaccgcgaccagggaggaggctccgccggtcatcccgcctcgcggaataagaaaattctaaacaaaaagaagctgaagcgtaagcaaaagtctaaaagtaaggtaaaaactcgcagcaagtcagagaatctggaaaatactgtgatcataccagatatcaaactccactcaaacccttccgcatttaatatttattgtaatgtacgtcattgcgtgctggaatggcagaaaaaagagatctcccttgccgctgcctccaagaactctgtccaaagcggcgagtccgattctgacgaggaggaggagtcgaaagagccaccgatcaagctgcctaaaattattgaggtgggcttatgtgaggtcttcgagcttattaaggaaactcgcttttcccacccttccctgtgccttcggtcccttcaggcccttttgaatgtccttcaaggccaacagcctgaagggctgcaatctgagccccctgaagtgttggaatccttgttccaacttctgttagagattacggtgcggagcaccggcatgaatgacagtaccgggcaatcgttgaccgcattatcatgcgcctgcctgttttctcttgtagccagctggggagagaccggccgcacccttcaggcgataagtgcaattctcacaaacaacggatcccacgcatgtcagaccatacaagtccctaccattctaaactctcttcaacgttctgtgcaagccgttttggtgggtaagatccagatacaggactggttctctaacggaatcaaaaaagccgcgttaatgcacaagtggcccctgaaagaaatcagcgtcgacgaagatgaccaatgcctactacaaaatgacggattctttctctatctcctgtgtaaggatggactgtataaaatcggctctggctattccggtaccgtcagaggccacatctataacagcactagcagaatccgcaaccgcaaagagaaaaaatcgtggctgggctatgcccagggctatctcctctatcgcgatgtgaataaccacagcatgaccgccatcaggatctcccccgagaccttggaacaggatggaacagtgatgctgccagactgccataccgagggccagaatatcctgttcaccgacggcgagtacataaatcaaatcgcggcgtcgcgagatgacgggtttgtggtgcggatcttcgctactagtacagagccagtgctgcagcaagagctgcagctgaagctggcccgaaaatgtctacatgcatgtggtatcagcctgttcgacttagaaaaagacttacacatcatctcaaccggcttcgacgaggagagcgctatcttaggggccggacgcgagtttgccttgatgaagacagctaacggcaaaatttattacaccggcaaataccagagccttggcatcaaacagggcgggccatctgccggtaaatgggtggaactccctataaccaaatcccccaaaatagttcacttcagcgttgggcacgacggttctcatgccttgcttgtcgcggaggatggatccattttctttaccggaagtgcatctaagggagaagacggcgaatccacaaagtccagacgacagagcaagccatacaagcccaagaagattatcaagatggaaggtaagatcgtcgtgtatacagcatgtaacaatgggtctagttccgtgatcagcaaagatggcgaactgtacatgtttggtaaagacgccatttactctgattcgtcaagccttgtcacagaccttaaaggccatttcgtgacacaggttgcaatgggcaaagctcacacctgcgtcctcatgaaaaacggtgaggtctggacattcggggtgaacaacaaaggtcagtgtggtagagacacgggagccatgaatcaggggggaaagggatttggcgtggagaacatggccaccgcaatggacgaggacctcgaagaggagctcgatgaaaaggacgagaagagcatgatgtgtcctcccggcatgcacaagtggaagcttgagcagtgcatggtgtgtaccgtatgtggcgattgtaccggttacggcgcatcatgcgtcagctctggacggcccgaccgggtaccggggggcatctgcggatgtggctccggcgagtctggatgtgccgtgtgtgggtgttgtaaggcctgtgcccgcgagctggacggacaggaggctcggcaacgcggcattctagatgctgttaaagaaatgattcccctagacctgcttctggctgtcccagtgcccggggttaatatcgaagaacacctccagctgcgacaggaagaaaaacgtcagagggtgattagacgacataggctggaagagggcaggggacccctggtttttgccgggcctatcttcatgaatcatagagaacaggccctggccaggctacgctcccatcctgcccaactgaaacacaaacgggacaaacacaaagatggaagcggcgagcgaggggagaaggacgcttccaaaatcaccacctacccgcctggcagcgtccggttcgattgtgaactgagagctgtccaggttagttgtgggttccatcactcagtagtcctgatggaaaatggggacgtgtatacttttggatacggccagcacggccagctgggacatggggatgtgaactcccgagggtgtcctactcttgtccaggctctgccagggccgagtacccaggtgactgcaggttccaatcacactgcagtactccttatggacgggcaggttttcacttttggcagtttctccaaaggccagctgggtaggccaattctcgatgtgccctactggaacgcaaagcctgctccaatgcccaacatcgggagcaaatacggtcggaaggctacctggattggcgcatcaggcgaccagactttcctgcggattgacgaagctttaattaactcacacgtcctggccacgtccgagatcttcgccagtaaacacatcatcggcctggtgccggcgtctatttcagagcctccgcccttcaaatgtcttcttatcaacaaagtcgacggcagctgcaaaaccttcaacgacagtgaacaggaggatctccagggcttcggagtatgcctggacccagtgtacgatgttatctggaggttccgacctaatacacgagaattgtggtgttacaacgcggttgtcgcagacgccagactcccatcggccgctgacatgcagtcaagatgctccatcctatcacccgagctggctcttcctaccggctcacgcgcattaaccacccgaagtcacgccgcactgcacatcctgggctgcctggataccctggctgccatgcaggatctgaagatgggtgtagccagcaccgaagaggagactcaagctgtgatgaaagtttactcaaaagaggattattccgtggttaacaggtttgaatctcacggcggcggttgggggtattctgcccactccgtcgaggccattagattctcagcagatacagatattctgctcggcggcctgggactcttcgggggaaggggcgagtacaccgcaaagatcaagctgtttgagcttggccctgatggtggggatcatgagaccgacggggacctgctggctgagaccgacgtgctggcctacgactgtgccgctcgtgagaagtacgccatgatgttcgacgagcccgtcctcctgcaggcaggctggtggtacgtagcctgggcacgagtttccggacctagcagcgactgtggttctcacggacaggctagcattacgactgatgatggggtggtgtttcagtttaagagctctaaaaaaagcaacaatggcactgatgtgaatgcagggcagataccccagctgctgtataggctgcctacctctgacggcagcgcgagtaaggggaaacagcagactagtgaaccggtccatatcctgaagagatcgttcgcgcgcacagtgtctgttgaatgtttcgagagcctactgagcattctgcattggagctggaccactctggttttaggggtggaggagctccgtggtctaaaagggttccagtttaccgccactctactggacttagagaggttaaggttcgttgggacctgttgccttaggttacttcgggtgtacacctgtgaaatctacccagtgtccgccactggaaaggctgtcgtggaggaaaccagtaagcttgccgaatgcattggcaaaacgaggacgctgctccggaagatactcagtgagggtgtcgaccactgcatggtcaagcttgataacgacccccagggctacctgagtcagccactctcactgctggaagcagtgttgcaagaatgtcataacaccttcaccgcttgcttccactccttctaccctacacctgccctacagtgggcgtgtttgtgtgatctgcttaattgccttgatcaggacatccaggaagccaattttaaaacaagctccagcagattgttagccgctgttatgtccgcgctctgtcatacttccgttaagcttacatctatctttcccatagcctacgacggcgaggtgctcctgaggtccattgtgaagcaggtgagtaccgaaaatgattcaaccctcgttcatcgtttcccgcttctcgttgcacacatggagaaattgagtcagtcagaagagaatatctcaggcatgactagttttcgggaggtccttgaaaagatgctagttatagtagttctgcctgtgaggaattccctccggcgggagaacgagctcttttcttctcacctcgtctctaacacttgcgggctcttggcatccattgtatcagagcttacagcatcagccctggggtcagaagtggacggcctcaactcgctgcatagtgtgaaagccagcgctaaccggttcaccaaaacatcacaaggcaggtcctggaatacgggcaatggatcccctgacgcgatttgtttctccgtcgataagccaggcatagtcgtggtcggctttagtgtatacggaggtggcgggattcacgagtatgagctggaggtgctcgtggatgattccgaacatgccggagactctacacactcacaccgatggacttcactggagctggtcaagggcacttacactacagatgactcaccttccgacattgcggagatcagattggataaggtagtgccgttgaaggagaatgtgaaatacgcagtgcgcttgcggaactatggcagtagaactgctaatggcgatgggggcatgacaacggtccagtgccccgatggcgtaactttcactttctcgacttgctccttgagctcaaatggtaccaaccagacacgaggccaaatcccacagatcctctactataggagcgaatttgatggagatcttcaaagtcaactcctgagcaaggcgaatgaggaagataaaaactgcagtcgggccctttcagtagtgtcaacagttgtccgcgcatctaaggacctcctgcaccgagccttggctgtggatgcagacgacatcccggagctgttgagttcttcatctctgttttctatgcttctccccctgatcatcgcttatatcggaccagtcgccgctgctatacctaaagtggccgtagaggtgtttggactggtccaacagctgctgccaagcgtggcaatacttaatcagaaatatgcacctccggcgttcaaccctaatcaaagtacagattccacgacagggaaccaacctgaacaggggttgagcgcctgcaccaccagttcacactacgctgtcattgagtcagagcacccatacaagcccgcatgcgtgatgcactacaaagtgacgttcccagaatgtgtgcgctggatgaccatcgagtttgaccctcagtgtggaactgcacaatccgaggatgtcctcaggcttttaattccggtccgcaccgtccaaaattcagggtatgggcctaagctcacctctgtgcatgagaatctgaacagttggatcgagttgaaaaagtttagcgggtctagtggctggcccacaatggtactggtattgcctggaaatgaggctctgttttccctggaaacggcctccgattatgtgaaggatgacaaggcatccttctatggatttaagtgtttcgcgatcggctatgaattctcccctggtcctgacgaaggcgtgattcagctcgagaaggaactcgccaatctgggcggcgtttgcgccgccgccttgatgaaaaaggatctggcactaccaataggtaatgaattagaggaggatctggaaattttagaggaagctgccctccaagtttgcaaaacacattctggaattctcgggaaagggttggccctcagtcactctcctaccatcctggaggcgttggagggcaatctccccctccagattcaaagcaacgagcagtcctttctcgatgactttattgcatgtgtccccggctcctccggagggcgactggcacgctggctgcagccagatagctacgctgatccccagaagacctccctcatattgaacaaggacgacataaggtgtgggtggcccaccaccatcaccgtgcagaccaaagaccagtatggggatgtcgtacatgtcccgaatatgaaagtggaagtgaaggccgtgcctgtaagccaaaagaagatgagcttacaacaggaccaagctaagaaaccccagcggatccctggtagtcctgccgtgaccgcggcttcaagcaatacagacatgacctatgggggtctcgctagtcccaagctggacgtctcgtacgagcctatgatagtaaaggaagcacgatatatcgccatcacgatgatgaaggtgtatgagaattattcttttgaagagctgaggttcgcttcccctactcctaagcggccaagcgaaaacatgctcataagagttaataatgacgggacttattgtgctaactggacacctggagccatcgggctctatactctgcacgttactatcgacggtatcgagattgacgccggcctggaggtcaaagtgaaggatcccccaaaggggatgattcctccaggcacccaattggtgaagcctaaaagcgagccgcagccaaacaaagtccgaaagttcgtggcaaaagattccgctggcctgcgaatccgatcgcatccttctctgcagtccgagcagattggcattgttaaggtgaatggcaccattacgtttatcgatgaaatccataacgatgatggagtgtggctcagactgaacgacgaaaccatcaaaaagtatgtgcctaacatgaacggttataccgaggcctggtgtttaagctttaaccagcacttgggcaaatccctgctggttccagtagatgagagcaagacaaatactgacgactttttcaaggacattaattcatgttgcccacaggaggcgaccatgcaggaacaagacatgcctttccttcgcggcggacctggtatgtataaggtcgttaaaaccggcccatctgggcacaacatccgctcttgtccaaaccttcgcggtattcccatcggcatgctggttttaggcaataaagtcaaagctgtgggagaggtgaccaactccgaagggacatgggttcagctcgaccagaattccatggtggagttctgtgagagcgacgaaggggaagcgtggtccctggcacgggatagaggtgggaaccagtacctgcgccatgaagatgagcaggctttgctggaccaaaactcccagacccccccaccctcccctttcagtgtccaagcctttaataaaggcgctagttgcagtgcacaagggttcgactacggtctcgggaactcaaaaggcgatagaggcaacatttcaacgagctctaagcctgctagcacgagcggaaaatctgaacttagctctaaacactctcgctcactcaagcctgacggacggatgagccgcactaccgccgatcagaaaaaaccgcgcggtacagagtctctctcagctagtgagagcctgattttgaagtcggacgcagcgaaactgcggtccgatagtcacagccgctctctgagtcccaaccacaatacactacagactctcaagtcagatgggcgaatgccttctagctcacgtgcggaaagccccggcccgggctctaggctgagctcccctaaacctaaaacacttcccgctaatcgctcttcccccagtggggcctcctcaccacgcagttcttccccacatgataagaatctgcctcaaaaaagtaccgcgccggtaaaaacaaaactggatcccccacgtgaacgaagtaaaagtgattcctacacgctggacccggatactctcaggaagaagaagatgccgctgacagagccgctgcggggaaggagcacctctccgaaacccaagtctgtgccaaaagatagtactgatagcccggggagcgagaaccgcgccccgtctcctcatgtagtgcaagaaaatctgcattctgaggtggtggaggtctgtacttcatcaaccttgaaaacgaacagcctcaccgactctacctgtgacgacagctctgagtttaagtccgtcgatgaggggagcaacaaagtccatttctccatcgggaaggctcccctaaaagacgagcaggaaatgagagcttctccaaaaatctcccgaaagtgtgctaataggcatacgaggcccaagaaggaaaaaagtagttttctatttaaaggagatggcagcaaaccattagagcctgccaagcaagccatgagcccctctgtcgccgagtgcgcaagggccgtgtttgcttcttttttatggcatgaggggattgtgcatgatgcgatggcttgttcatcattcctgaaattccacccagagctgtctaaagaacacgcacctattcggagttctctgaactcacagcagcctaccgaggaaaaggagacaaaacttaagaaccggcactcgctagagatcagcagtgccctgaatatgttcaacattgctccgcacgggccagatatctccaagatgggctccattaacaagaataaagttctgagtatgctcaaggagccccccctgcacgaaaaatgcgaggacggcaaaaccgagaccacattcgaaatgagcatgcacaatactatgaagtccaaatcacccctacctctgacactccagcatctagtcgcattctgggaggatattagcctcgctactatcaaagctgcctcgcagaatatgatctttccatctccaggctcctgcgccgtgcttaaaaaaaaggagtgcgaaaaggagaacaagaagtccaaaaaggagaagaagaaaaaagagaaggcagaagtgcgcccccgcggaaatttattcggcgagatggcgcagctggccgtgggcggcccagagaaggacacaatttgcgagctctgcggtgaatctcatccttatccagttacctaccacatgcggcaggcacaccccgggtgcggccgctatgccgggggccagggctataactcaatcgggcacttctgtggcggctgggctgggaattgtggagatggtgggattggaggctcaacttggtatctcgtttgtgatcggtgccgagaaaaatacctcagagagaaacaggcagccgcccgagagaaagtgaaacaaagtcgccgaaagcccatgcaggtgaagacacccagagcactgcccactatggaggctcaccaggtgatcaaagctaatgccttgtttttgttatccctaagttccgccgcagagccttctatactctgttatcaccctgctaaaccgttccagagccaactgccaagtgtcaaggaagggatttccgaggacctccctgtcaaaatgccatgcttgtaccttcagaccctcgctcggcatcatcatgaaaactttgtgggctatcaggatgacaatctgttccaggatgagatgcgctacctaaggtcaacaagcgtgcctgctccttacataagcgtcacgccggacgcctcaccaaacgttttcgaggaacctgagagcaacatgaagtctatgcccccctcgcttgaaactagccccataaccgataccgacctggccaagcgtaccgtgtttcagcgctcatattccgtggtcgcatccgaatatgataaacagcattccattctgccggcacgcgtgaaagctatccctcggcggcgggtgaattcaggcgacactgaggtgggaagttccctgctgcgacatcctagtccagagttgtcccgtttgatcagcgctcatagcagcctgagtaagggagagaggaattttcagtggcctgttctggctttcgtaatccaacaccacgatctcgagggactggagatcgccatgaaacaggcactgcgcaaaagtgcttgtcgcgtcttcgcaatggaagcattcaactggttgctctgtaacgttattcagactacatccctgcatgatatcctctggcacttcgtcgcctccctgacgcctgcccccgttgagccagaagaggaggaggacgaggaaaataagactagtaaagagaattcggaacaggagaaggacacgcgtgtctgtgaacacccactatccgacatcgtcattgcaggcgaagctgcacatccactgccacatacgtttcacagactcctgcagacaattagcgacctgatgatgagcttaccaagtgggtccagcttgcaacaaatggcgctgaggtgctggagtctgaaattcaaacagagcgatcaccagtttcttcaccaatcaaacgtattccaccacatcaataacatccttagcaaatccgacgacggggactctgaggagagttttagtatctcgattcagagcggcttcgaggctatgagccaggagctgtgcatcgtgatgtgcctcaaagacctgacaagcattgtcgatatcaagacgagtagccgtcccgccatgattggaagcctaacagatggttcaacagagaccttttgggaaagtggcgacgaggacaagaacaagacgaagaacatcaccatcaactgcgtgaagggtattaatgctcggtatgtgtctgttcacgtcgacaatagtcgggacctaggcaataaagttaccagtatgacgttccttacgggcaaggctgtcgaggatctgtgccgaattaaacaggtggacttggactctagacacattggctgggttacatctgagctgcccggtggagacaatcatatcataaaaattgagctaaaaggccccgaaaacaccctacgcgtacgccaggtgaaggttctggggtggaaggatggcgaatctacaaaaatcgcgggccagatatccgccagcgtggcccagcagcgcaactgtgaggccgagacgctgcgcgtcttcagactaattacgtcccaggtgttcggaaagctcatcagtggcgatgctgagccaactcccgagcaggaagaaaaggcgttactgagcagcccagagggggaagagaaagtgtacaatgccaccagcgacgctgaccttaaggaacacatggttggcatcatattctcaagatcgaagctgacaaatctgcagaagcaagtgtgcgcacacatcgtccaggccattcgaatggaagcaacgcgggtgcgggaggaatgggaacatgctatctcatctaaggagaatgctaactcccagcccaacgacgaggacgccagcagcgatgcgtactgcttcgagctcttatcaatggtgcttgcactttccggctctaatgttgggcgtcaatacctcgctcagcagctgaccttgctgcaggacctgttttccctgctgcacaccgctagccccagagttcagcgccaggtcactagtctgctgcggagggtccttccagaggttactccctctagactggctagcatcatcggggtgaagtccctgcctcccgccgatatctccgacatcatacattctacagagaaaggagattggaacaagctggggatcttggatatgttcctgggctgtattgccaaggccctcacagtgcagctgaaggctaaagggacaacaattacaggtacagccgggacaactgtcgggaaaggagttacaacggttacgttaccaatgatctttaattcttcgtatttgaggagaggcgagtctcactggtggatgaaaggttctacccctactcagatctctgagattattatcaaattaattaaggacatggccgctggacacctgagtgaggcttggtcacgagtgaccaagaatgcgatcgcagagacaataatcgcactgactaagatggaagaggagtttaggtccccagttagatgtattgctacgactcgactgtggctggctctcgccagcctgtgtgttctggatcaggatcatgtagatagattaagttctgggaggtggatgggcaaggacggccagcagaaacaaatgcccatgtgcgacaatcacgatgacggtgagaccgccgcgattattctgtgtaatgtatgcggcaatctgtgtaccgactgtgatcgtttcctccatctgcaccgcaggaccaaaacccaccaacgacaggttttcaaggaagaggaagaggccatcaaagtggatctgcacgaagggtgcggacggactaagctgttttggctcatggccttggcagatagcaagaccatgaaggcaatggtggagttcagagagcacactgggaaacccacgacaagttcatccgaagcttgtcgcttctgcggttctcgatccgggacagagctgtctgccgtcggctcagtctgctccgatgctgactgccaggagtacgccaagattgcatgttctaagacacacccatgtggacacccgtgcggcggagtgaagaatgaggaacattgcctgccatgtctgcacggttgtgataaatctgctacctctttgaagcaggatgccgacgatatgtgtatgatctgtttcaccgaggccctcagtgccgccccagcgattcagctggactgttcccacatcttccacctgcagtgttgccggcgggtgctcgaaaatcggtggttgggacccagaatcacctttggttttatttcctgccctatttgtaaaaacaaaatcaaccacatcgtactcaaagatttgctggaccccattaaggagctatacgaggatgtaagacgcaaggctctgatgagactggagtacgaaggcctccacaagtccgaggcaatcacaacacccggagtgcgcttctacaacgacccggccggctacgcaatgaatcgttatgcatactacgtatgttataagtgcagaaaggcttacttcggaggggaagcacgttgcgacgccgaagccggacgaggagatgactacgatcccagagaactcatttgtggtgcatgctctgatgtttctagagcccagatgtgtcctaagcacgggaccgactttctagagtacaaatgcagatactgttgtagcgttgctgtgttcttttgtttcggaactacccatttttgcaatgcatgccacgatgactttcagaggatgacttccatccccaaagaggagttgcctcattgccccgccggacctaaagggaagcaattggagggaactgagtgccccctgcatgtggtccatcctcccactggcgaggaattcgccttggggtgcggtgtgtgcaggaacgcccacaccttctag

SEQ ID NO: 16179 - DNA, 13923 bp, Artificial Sequence
  Description of Artificial Sequence: Synthetic coding sequence
atgccagtgccagatggcagcgtggccgctgcaggcctgggactggggttgccggccgcagattctagaggacactatcagctactgttgtctgggcgcgcgctagccgatcgatacagaagaatatacaccgccgcactcaatgatcgagatcagggaggcggcagcgcagggcacccggctagcagaaacaaaaagatcctgaacaagaaaaagctcaagcgcaaacaaaagtcgaaatctaaggtaaagacccggagcaaaagcgagaacttggagaatactgtgattatacccgacatcaaactgcactccaatcctagcgcatttaatatttattgcaatgttcgccactgcgtcctagaatggcagaaaaaagaaatcagcctggctgcagcttctaagaactctgtacaaagcggcgaatcagactcagatgaggaggaggagtcaaaggaaccacctattaaactgcccaaaatcattgaagtggggctgtgcgaggttttcgagctgataaaagagactagattttcgcaccctagcctgtgcctccggagtcttcaggccctcctgaatgtcctgcaaggtcaacagcctgagggcctgcaaagcgagccccccgaggtcctggagtccctgttccagcttttgctcgagataactgtgagaagcaccggcatgaatgactccaccggtcagtcactaacagcgctgtcctgcgcttgcctgttcagccttgttgcttcgtggggtgaaactggccgcaccctgcaggccatttcagccattctcaccaacaatgggagccacgcttgtcagacaattcaggtgcccaccatccttaatagtttgcagcggagtgttcaggccgtgttggttgggaagatacagatccaggattggttctccaatggaattaaaaaggcagcactgatgcataagtggcccctgaaagagattagcgtggacgaggatgaccaatgccttctgcaaaacgacggattttttctttacctgttatgtaaggacgggctctataagatcggatcaggttacagcgggacagtcaggggacatatttataatagtacctcaagaatccgcaaccgaaaggagaaaaaatcatggctgggatacgctcaaggttacctcctgtaccgtgatgttaacaaccattccatgacagctataagaataagccccgaaactcttgaacaggacggtacagtaatgctgcccgattgccacacagaggggcagaacatcctatttaccgacggtgagtatattaaccaaatcgccgcttctcgggatgatggtttcgtggtgcggatcttcgccactagcacagagcctgtgctgcaacaggaactgcagctcaagctggctcggaaatgtctgcacgcctgcggcatctccttattcgaccttgagaaagacctgcacattatctctaccggatttgacgaggaaagtgccatactgggcgccggacgggaattcgccctgatgaagacggctaatggtaaaatctactataccgggaagtatcagtccctgggcataaagcagggtggacctagtgccggcaaatgggtcgaactgccaataaccaagagtcctaaaattgtccatttctccgtgggtcacgacggcagccacgctctccttgtggctgaggacggctccatctttttcactgggtctgcttctaagggggaagatggggagagcaccaagtccagaaggcagtcgaagccttataaaccaaagaaaatcataaaaatggaaggaaagattgtggtgtatacagcctgtaacaatggcagtagctctgtgatatcaaaggacggggagctatatatgttcgggaaggacgctatatatagtgactcaagcagcttggttactgacctaaaaggccactttgtgactcaggtggccatgggtaaggcacatacctgcgtgttgatgaagaacggagaggtctggacctttggtgtcaacaataaggggcagtgcgggcgggataccggtgcaatgaatcagggcggcaaaggatttggagtggagaatatggccacggccatggacgaagatttggaagaggaacttgacgaaaaggatgagaagagtatgatgtgcccgccgggaatgcataaatggaagctggagcagtgtatggtatgtacagtctgtggtgattgcaccggctatggggcctcatgtgtgtcgagcggaagaccagatcgtgtacctggggggatctgtggatgcggaagcggggagtctggatgtgccgtatgcgggtgctgtaaggcatgcgcacgcgagctggatggccaggaagcccggcagagggggattttggacgcagtgaaggaaatgatccctctggacctgctgttggccgtgcccgtgcccggagtgaatatcgaagagcatctgcaactccggcaggaggaaaagcgccaacgtgttatcaggcgccatcggctggaggaaggccgcggccctctagtcttcgccggcccaatctttatgaaccaccgggagcaggccctggcacgcctgcggtcacatcctgctcaactgaagcataagcgagacaagcacaaagacggtagtggagagagaggcgagaaggacgcgagtaagataacaacctatccgcctgggtccgtgcgttttgattgcgagctccgcgccgtgcaggtctcatgcggtttccaccatagcgtggtcctgatggaaaatggcgacgtgtataccttcggctatgggcagcacggccagttggggcatggagatgtgaattcccgaggctgccccacactcgttcaggctctcccaggcccctcaacacaggttacggccggatcgaaccatacagccgtactgcttatggacggtcaagtgttcactttcgggagcttttctaagggccaattgggccggcccatcctggacgtgccctactggaatgctaagcctgctccaatgcccaatataggatccaaatatggccggaaagcgacttggatcggcgctagcggcgaccagacctttcttagaattgatgaagccttgattaactcccacgtactcgcgactagtgagatcttcgccagcaagcacatcatcggattagtccctgcctcaattagcgaaccccctccttttaagtgtcttctgatcaataaggtggatgggagctgtaagacttttaacgactctgaacaggaggatctccagggattcggcgtgtgcctggacccagtgtatgatgtgatctggagatttcgccctaatacccgagaactttggtgttataatgcagttgtggctgacgctcggctaccaagcgcagctgacatgcagtctcgttgcagcatcctgagtcctgagttagcacttccgaccggcagtcgagccctaacaacaagatctcacgcagctctccacatccttggctgtttggacacactggctgctatgcaggatcttaaaatgggtgttgctagcacggaagaggagactcaagccgtcatgaaagtatacagcaaagaagactattctgtcgtgaacaggttcgagtcacacggtgggggttggggctactccgcacattccgtggaggcaatccggttcagcgccgatacagacattctcttggggggactgggtctgttcggtggcagaggagagtataccgctaagataaaactcttcgagcttggacctgatggcggtgaccacgaaacagatggcgacctgctcgcggaaacagatgtccttgcatacgactgcgccgcacgggagaaatatgcaatgatgttcgatgaacccgtgttgctgcaggcagggtggtggtatgtggcatgggcgagggtcagtggtccgtcctctgattgcggttcccacggtcaggcaagcatcacaaccgacgacggagtcgtcttccagtttaagagcagtaaaaagagtaataacgggaccgacgtcaacgcaggccagatcccccaactcctgtaccgtctgccaacaagtgacgggagtgcctcaaagggcaagcaacagacttcggaacctgtgcatattttaaagaggagttttgctcggactgtgtctgtggagtgttttgaaagcctcttatctatcctgcactggtcctggacaaccctagtgctgggtgtggaggaattgagaggactgaaaggcttccagttcacggccacgcttcttgatctggagcgcctgcgcttcgtgggcacgtgttgcttacgcctgctcagggtctatacctgcgaaatctaccccgtttctgctacaggcaaggctgtggttgaggagaccagcaaattggccgagtgcatcgggaaaaccagaactctcctgaggaaaatcttgagcgaaggagtggatcactgcatggtgaagctggacaatgatccgcaggggtatctgagtcagccacttagcctgctggaagccgtgctgcaggaatgccataacactttcactgcttgtttccatagcttttaccccactccagcgcttcaatgggcttgtctgtgtgacctgctaaactgtcttgaccaggacattcaggaggctaacttcaaaacatccagctctagactgttggctgctgtgatgtccgccctctgtcatacatccgtaaagctgacatccattttcccaatcgcttacgacggcgaggttttgctgaggtccattgtgaagcaggtgtcaactgaaaacgatagcactttggtgcatcgcttccccctgctggtcgcccacatggaaaaactgtctcagtcagaagagaatatcagtggcatgacctcattcagagaagtgctggagaaaatgctggtgatcgtcgttctgcctgtgaggaatagtctgagaagagaaaatgaactttttagcagccaccttgtgagcaacacatgtgggttgctggcatcgattgtgagtgaactcacagcaagcgcgctggggagcgaagtggatggtcttaatagccttcacagtgttaaagcatccgccaatcgattcactaagacatcccagggacgaagttggaataccggcaatgggtcaccagacgcgatttgcttctccgtggacaaaccagggatagtcgttgtcgggttctccgtctacggaggtgggggcatacacgagtacgaactcgaggtgctcgtcgatgattcggagcacgccggcgattccacacattcccacaggtggacgtcacttgaactggtcaagggtacttacactaccgacgactcaccatctgatattgctgaaataagactcgacaaagtggttccccttaaggaaaatgtcaagtacgccgttcgcttgagaaactacggcagcaggactgcgaatggagacggcggcatgaccacggttcagtgccccgatggggttacgttcactttttccacatgcagcctttccagcaacggaaccaaccagactcgtggacaaataccacagattctatactaccgttcagagttcgatggagacctccagagccaactgttatccaaggcgaatgaagaagataaaaactgctctagggcactgagcgtcgtgagcactgttgtgagggcatcaaaagatctgctacatagggctttagctgtcgatgcagatgatataccagaacttctgtctagttcgtctctcttctcgatgcttctaccgctcataattgcatatatcggcccagtcgccgcagctattccgaaagtggccgtggaggtgtttgggttggttcagcagctgctcccaagtgtcgcaatcctcaatcagaaatatgctcctcctgccttcaacccaaaccagtcaactgacagtaccaccggaaaccagccagaacaggggctctctgcgtgcactacctcctcccattatgcagtgatcgagtccgagcacccttataagccagcgtgcgttatgcattacaaagtgaccttccctgaatgtgtacggtggatgacaattgagttcgacccccaatgcggtactgctcagtccgaggatgtcttgagattgctgatccccgtgcgtaccgtacagaactccggctacggaccaaaattaacttccgtacatgagaacctgaatagctggatagaactgaagaaatttagcggaagcagcggctggccaaccatggtgctggtcctgccgggaaacgaggctctgtttagtctggagacagccagcgattatgtcaaggatgacaaagcctctttctacgggtttaaatgcttcgccattggttacgagtttagccctgggcctgatgagggcgtgattcagttggagaaagagctggccaatcttggaggggtctgcgccgccgcgctgatgaagaaagatctggcgcttcccattgggaacgaactcgaggaagatctcgagattctggaagaagcagccctccaggtctgcaaaacacattcaggtatccttggaaagggcctcgcccttagccacagccccactattctggaggcgctcgagggcaacttacccctccagatccagtccaatgagcagtcatttctggacgatttcatcgcatgtgttcccggcagttcgggcggccgactcgcccggtggctccagccagactcctacgcggatccccaaaagacctccctgattctgaataaggatgatatacgatgcggctggcccactaccatcactgtgcagactaaggatcagtatggagatgtcgtgcacgtccccaatatgaaagtggaggtcaaagccgtgcctgtaagtcagaagaaaatgtctttgcagcaagaccaagccaagaaaccacaacgcatccctggctcacccgcagtgacagccgcaagttctaatactgatatgacatacggcggcctggcctcccctaagctagatgtgagctacgagccaatgatagtcaaagaggctaggtatatcgccatcaccatgatgaaggtctacgagaactactccttcgaagaactgcgcttcgcaagcccaacacccaagcgaccctccgagaacatgttaattcgagtaaacaacgacggcacttattgcgccaactggactcccggcgccattgggttatatacccttcacgtaaccattgatggaattgaaatcgatgcggggctcgaagttaaagtgaaagatcctcctaaggggatgattccacctggaacacagctggtgaaaccgaaatctgagccgcagcccaataaagtacgcaaatttgtggctaaggactccgccggactgagaattaggagccatccaagcctgcaatcagaacagattggaatcgtgaaggttaacggcaccatcacatttatcgatgagattcacaacgacgacggggtgtggttaaggctcaacgacgagacaattaaaaagtacgttccgaatatgaatggatatacagaggcctggtgtctttctttcaaccagcatctcggcaagtccctccttgttcctgtggacgagtccaagactaacacggacgacttcttcaaggacattaactcctgctgcccacaggaggctactatgcaggagcaggacatgcctttcctgcgagggggacctgggatgtataaagtggtcaagacgggtccttccggccacaacattcggagctgccccaatctccgggggatccccatcgggatgctcgtgctgggtaacaaggttaaggcagtgggcgaggttacaaattctgaggggacctgggtccagctggaccaaaacagtatggttgaattctgcgagagtgacgaaggggaagcctggagcctcgcgcgcgataggggtggtaaccaataccttcgccacgaggatgagcaggctctcttagatcagaactctcagactcctcccccctcccccttctccgtgcaggccttcaataaaggcgcctcctgctctgcccagggatttgactacgggttagggaacagcaagggcgaccgcgggaacatctccacctcttctaaacctgcttcaacctcgggtaaatctgaattaagcagcaagcactctaggtcactcaaacctgacgggaggatgtcaagaacgaccgccgaccagaaaaaacctagaggcacagagagcctgagcgcatccgaatcgctcattctaaagtctgacgcagctaagcttcgtagcgactctcattctcggagcctgagccctaatcataatacactgcagaccctgaaatccgacggccgcatgccttcctcctcccgcgctgaatcccccggaccaggtagccggctgtccagccccaagcccaaaaccctcccggccaaccgttcctccccgtccggcgccagcagcccaaggtcatcttccccccacgacaaaaatctgcctcagaagtcgaccgctcccgttaagacgaagctggatccaccccgcgaacgctccaagtcagattcctacacccttgaccccgataccctacggaaaaaaaagatgccgctgacagaacccctgcgcgggcgaagcacctctccaaagcctaagtccgttcctaaagattctaccgactcgcccgggtccgagaaccgagcgccctcaccacatgtggtgcaggagaacctccatagtgaagtggttgaagtttgtacctcttccaccctgaagacaaatagcttaaccgatagcacatgcgacgattcttcagagtttaagtctgtcgacgaaggctccaacaaagtgcacttctcaatcgggaaagctcctctcaaggacgaacaagagatgcgggctagtcctaaaatctcaagaaagtgtgctaacaggcatactaggcctaaaaaggaaaagtcaagtttcctgtttaaaggcgatggctctaaacccctcgaaccggctaagcaggccatgtccccaagcgtggccgagtgcgccagagcagtgttcgcgtcatttctgtggcacgaagggatcgtgcacgacgcaatggcttgctccagctttcttaagttccacccagagctgtccaaagagcatgcgcctattcggtccagtttgaattcccagcaaccaacagaggagaaagagaccaaactcaagaatagacattcgttagaaatttcatctgctttgaacatgtttaacattgcgccccatggcccggatatttctaaaatggggtccatcaataaaaataaagtcttgagcatgctgaaagaacccccactacacgaaaaatgtgaggatgggaagacggagacaacctttgaaatgagtatgcataacaccatgaagtccaagtccccactcccattaacactgcaacacctcgtggccttctgggaagacataagtcttgctacgataaaagccgcaagccaaaatatgatcttcccatcacctggttcatgcgcagtactgaagaagaaggagtgcgaaaaggagaataaaaaatcaaaaaaggagaaaaagaagaaagaaaaggcagaagtgcgccccagagggaatctcttcggcgaaatggcccagctagcggttggaggccccgagaaagacaccatctgtgaactatgcggcgagtcccacccatacccagtgacctatcatatgaggcaagcgcaccctggatgcgggaggtacgcgggtggacagggctataactccatcggtcatttttgtggcggctgggcaggcaattgcggcgacggaggaattggcggttcaacgtggtacctcgtttgcgatcgatgtagggaaaaatacctcagagaaaaacaggccgctgctagagagaaggtgaaacaatcccgccggaaaccaatgcaggttaaaactcctcgcgctctgcccacaatggaggcccatcaggttataaaggccaacgctctctttttgttgagtctgagcagcgcagcagaaccttcaatcctgtgctaccaccccgccaagccgtttcaaagccagctgcctagtgtcaaggagggaatttctgaggacctgccagttaagatgccttgtctgtatctccagaccctggcgcgccaccaccatgaaaactttgtgggctatcaagacgacaacctgttccaggatgagatgcgttaccttcgtagtaccagtgtccccgctccttatatcagtgtcacccccgatgcgagcccaaatgtgttcgaggaaccagagtcgaatatgaagagtatgcctccctctcttgagacctctccaatcacagacaccgatctcgccaagagaacagtttttcagagaagctattctgtggtcgcctctgagtacgacaagcagcactccatcctccccgctcgcgtgaaggcaatcccacggaggcgcgtaaactctggtgacactgaagtgggttcatccctgctccggcacccctccccggagttaagcaggctcatcagcgcccactcttcactctccaagggcgaacgcaacttccaatggcccgtattagcgttcgtcatacagcaccatgatcttgaaggcttagagattgccatgaaacaggcactaaggaagtcagcctgcagagtgttcgccatggaagcgtttaattggctgctgtgcaatgtcatacaaacaaccagcctgcatgatatcctgtggcattttgtggcttctctaacacctgcgcccgttgaaccagaggaggaagaggatgaggagaacaagacctcaaaggaaaatagtgaacaggaaaaggatacaagggtgtgcgagcaccccctttctgatattgtcatcgctggagaagcggctcaccccctcccacatacattccatcggctgttacagaccatctccgacctgatgatgagtttaccttctggcagcagcctccagcagatggctctgagatgttggtcactcaagttcaagcagtccgatcaccaatttctgcatcaatctaatgtctttcaccatatcaacaatatactcagcaaatctgatgacggagactcagaagagtccttctctattagtatccagagtggatttgaagcaatgagccaggaactatgtatcgtcatgtgtttaaaggatttgacgtcgattgtagatataaaaaccagttccagacccgcaatgatcggatctctcactgacgggagtaccgaaacgttctgggagtcaggcgatgaggataaaaataaaaccaagaatatcaccatcaactgcgtcaaaggcatcaatgccagatatgttagcgtccacgtagataattctagggacttaggcaacaaggtcacatcgatgaccttcttgactggcaaagccgtggaagacctgtgtcgtattaagcaagtggatcttgatagtcgacacatcggatgggtcaccagcgaactgcctggtggggacaaccacatcattaagatcgagctgaaaggccccgagaatactctccgagtacgccaagtgaaggtgctgggctggaaggatggagaatctaccaagatcgccggtcagatatccgcatctgttgcccagcagcgcaactgtgaggctgaaaccctgagagtgtttagacttattacatcccaggtttttggtaagcttatatccggtgacgctgagcctacaccggagcaggaggagaaggcgctcttgtcctcgccagagggcgaggaaaaagtgtacaatgccacttcagacgccgatctcaaagaacacatggtcggaatcattttcagtcgttcgaaactgaccaacttgcagaagcaggtgtgtgcccacatagttcaggctattagaatggaagccacaagggtgcgcgaggagtgggaacacgccataagttctaaggaaaatgcgaatagccagccgaacgacgaggatgctagtagtgatgcctactgcttcgaactgctttcaatggtcctggctctgtcaggtagcaacgttggaaggcagtatctggcccagcaactgaccttgctgcaagatctgtttagcctcctgcacaccgcctcccccagggtccaacgccaggttacctcacttctgagaagagttctaccggaggtgacacctagccgactagcctccattataggcgtcaaatcactgccccccgccgatatcagcgacatcattcattcaactgagaaaggggattggaacaagctggggattctcgatatgtttttagggtgtattgctaaggcccttacagtgcaacttaaagcaaagggcaccactatcactggcactgccgggacaacagtcgggaaaggtgtcacgacagttacactgcccatgatattcaacagcagctatctgagacgcggcgaatctcactggtggatgaaagggagcacacctactcaaattagcgaaatcatcatcaagctgatcaaggacatggcggccggccacctttccgaggcttggtcacgcgtgacaaaaaatgccatcgctgagactatcatcgcccttacaaaaatggaggaggagttccggagccctgtccgttgtatcgccacaactagactgtggctggccctcgctagcctctgtgtgttagaccaggaccatgtggaccggctttcctctggacgttggatgggcaaggacggacagcaaaaacagatgcctatgtgtgacaaccatgacgacggcgagacagcagcaatcattttatgtaacgtgtgtggcaatttatgtaccgattgtgatagattcctgcatctccacaggcggaccaagacccaccagagacaggtcttcaaagaggaagaagaagctattaaggttgacctgcacgagggttgcggccgaaccaagctgttctggctgatggctttggccgactcaaagaccatgaaagcaatggtcgaattccgggagcatactgggaagcctaccacttccagcagcgaagcatgccgattttgcggaagcagatcaggcacagaactctcagccgtggggagtgtgtgctcggatgctgactgtcaggaatacgccaagatcgcctgtagcaaaacgcacccttgtggacatccctgtggaggggtgaagaacgaggaacactgtttgccctgcctccatgggtgtgacaaatccgcgacatcacttaagcaggacgcggatgatatgtgtatgatttgctttactgaggccctgtccgcagctcctgccattcagctggactgctcccacatattccacttgcagtgttgccggcgcgtgctcgagaacaggtggctcggtccccgcattacttttgggtttatcagttgccctatttgcaagaacaagatcaaccacatcgtactgaaggacctcctcgatcccatcaaggaactgtatgaggatgtacgccgcaaagcccttatgcgacttgagtatgagggcctgcataagagcgaagcaattacgacacccggggtcagattttataatgacccagctggctatgcaatgaatcggtatgcttactacgtgtgctacaaatgcagaaaagcctacttcggaggcgaggcccgttgtgatgcagaggcgggccgcggggatgattatgatccccgagaattgatctgcggcgcctgtagtgacgtcagccgcgctcagatgtgtcccaagcacggaacggacttcctggaatacaaatgccgctactgctgcagtgttgcagtgtttttctgttttggcaccactcacttttgcaacgcttgtcacgatgacttccagagaatgacctctatacccaaggaggaactgccccactgtcctgccggaccaaaaggcaagcaactcgaggggacagagtgtcccttacacgttgtccacccgccaacaggggaagagttcgcacttgggtgcggggtctgtcggaatgctcataccttttag

SEQ ID NO: 16180 - DNA, 930 bp, Artificial Sequence
  Description of Artificial Sequence: Synthetic coding sequence
atgcgtcccgatagggctgaggcccccggtccccccgcaatggccgccgggggccccggtgctggctcagcagccccggtcagtagtacctccagcctacccctagcagccctgaacatgcgggttcgtaggagactgtctctgttccttaacgttagaacacaggtggctgcagactggaccgccttggctgaggaaatggattttgagtatctcgaaatcaggcagctcgagacccaggccgacccaaccggccgattgctggacgcatggcagggccggcctggagccagcgttggccgcctgctggaacttctgacgaaactgggccgcgatgatgtcttgttagagctgggaccgtccatcgaagaagactgtcagaagtatatcttgaaacagcaacaagaagaagctgagaaaccccttcaggtggccgctgtggactcatccgtcccccgaaccgccgagctcgccggaattactaccttggacgaccctttaggtcatatgccagaacggttcgatgcattcatctgttattgcccctcagacattcagtttgttcaggaaatgattcgacagctcgagcaaacaaactacaggttgaaactgtgcgtcagcgaccgtgatgtcctgccggggacatgcgtttggagcatcgcgtctgaactgatcgagaagcgatgccgacgtatggtggtcgtagtatctgacgattatctgcagagtaaggaatgcgacttccagacgaagtttgcactgagcctctcgccaggggcgcatcagaagcgcttaatacctatcaagtacaaagcaatgaaaaaagagttcccctccattctccggtttataacggtatgcgattatacaaatccgtgcaccaagagctggttttggacccgacttgctaaagcactgtccctcccgtag

SEQ ID NO: 16181 - DNA, 858 bp, Artificial Sequence
  Description of Artificial Sequence: Synthetic coding sequence
atggccgctggcgggcctggagccggctcagcagctcccgtgagctctacttcctcactaccattggcggctttgaacatgcgcgtgaggcgccgactctcccttttcctcaacgtgagaacacaagtggccgccgattggacagcccttgccgaagaaatggactttgaatacctagagattaggcagctcgagactcaggccgaccccactggcgcatcagttggtagactgctggagttactcactaagctggggcgcgacgacgtgctgctggaactgggtcccagtatcgaggaagattgtcaaaaatacatcttgaagcagcagcaggaagaggccgaaaaaccactccaggttgcagcagttgatagttctgtgccgcgaaccgcagagctagcagggatcactacactcgacgaccctctgggacacatgccagaacgctttgacgctttcatctgttactgcccgagcgatatccagtttgtgcaagaaatgatccggcagttggagcagactaactaccgcttgaagctgtgcgtatccgaccgcgatgtgctcccaggcacttgtgtttggagtatagcctccgagttgatcgagaagaggtgccggcggatggtcgtggtagtgagcgacgactacctacagtctaaagaatgtgatttccagactaagtttgctctttctctttcaccaggcgctcaccagaagcgcctgatcccaattaaatataaagccatgaagaaagagtttccttccattcttcgatttatcaccgtttgcgattatacaaatccatgtaccaagtcttggttttggacgcggcttgctaaggcactgtctctgccttag

SEQ ID NO: 16182 - DNA, 954 bp, Artificial Sequence
  Description of Artificial Sequence: Synthetic coding sequence
atgagacctgacagagccgaagctcccggtcctcccgctatggctgccggtggccccggggccgggtcagcagcaccggtctcatctactagtagtctgcccctggcagctctgaacatgagagtgagacggcgcctctcactctttctgaatgtgcggacacaggtagcggcagactggactgcactggccgaagaaatggatttcgagtatctagaaattaggcagctcgaaacccaggcggaccccacagggcgcctgctggatgcctggcaaggtcgccccggcgcctcggttggtcgcttgcttgagctgctcacaaaactggggcgtgatgatgtcttactggagctcggaccgagtatcgaggaagattgtcagaagtatatactcaagcagcaacaggaggaggccgagaaacctctccaggtggctgcagtcgatagttctgtccccaggaccgccgagcttgcaggaataaccacactcgatgacccattgggacacatgccagagagattcgatgccttcatttgctattgcccttctgatatccagtttgtacaggaaatgatccggcaactcgagcaaaccaattatcggctcaaactttgtgtaagtgaccgtgacgtgctcccaggtacatgcgtgtggtcgattgcgagcgaactaatagaaaaacgattagctcgacggccacggggcggatgccggcgtatggtcgtggtggtgtccgacgattatttgcagagcaaagaatgtgatttccaaaccaagtttgctctgagtctgtctccaggagctcatcagaaaaggctgattccgattaagtacaaggctatgaaaaaagagttcccatctattttacgatttataacagtttgtgactatactaacccctgcaccaagagctggttctggacacgactcgcaaaagctctgagtctcccctag

SEQ ID NO: 16183 - DNA, 510 bp, Artificial Sequence
  Description of Artificial Sequence: Synthetic coding sequence
atggcagcaggaggcccaggggccggctcagcagcacctgtttcttctacaagcagcctaccacttgcggctttaaacatgagggtacgacggcgactgtcgctgtttctcaatgtgcgaacacaagtggcagccgactggacggcccttgccgaggagatggacttcgaatatctagaaattagacaactcgagactcaggccgatcctacaggccggctgctggacgcttggcaggggcgcccgggcgcttcggtcggtcgactgctggagctactcacaaagttgggtcgggacgacgtcctgctcgagttgggacctagtatagaggaggactgccagaagtatattctcaaacagcaacaggaagaggcagaaaagcctctccaggttgccgctgtggactctagtgtgccgccacatctgatgaccccgtgggggatctgtctcagtgtctcaatgccgtctagcgctattgcccctgccacaagcagcctctgcagacggtag

SEQ ID NO: 16184 - DNA, 963 bp, Artificial Sequence
  Description of Artificial Sequence: Synthetic coding sequence
atggagcttctctcacccccgctccgggacgtggatttgactgccccggatggtagtctgtgttcctttgccacaaccgacgacttctatgatgatccctgttttgactcacctgacctgcggttctttgaagacctggacccgcgcctgatgcacgttggtgcccttctgaaacctgaggaacacagtcactttccagccgccgttcacccagctcccggggccagagaagacgaacacgtacgtgccccatcggggcatcaccaagctggacggtgtctgctgtgggcttgtaaggcctgtaaacgaaagaccaccaatgctgatcggagaaaagctgccaccatgcgagaacgccgacggctgtccaaggtgaacgaagctttcgaaacccttaagagatgcacctcttccaatcccaaccagaggttacctaaagtggagatcctgcgcaacgccatcagatacattgagggtcttcaagctctgctgagagaccaggatgcagctcccccgggcgctgccgccgccttctatgcacccggcccactgcctcctggtcggggcggggagcattactccggtgacagcgatgcttcctccccccggtcaaattgcagtgatgggatgatggactactccggtccaccatccggtgcccgcaggagaaactgctacgagggcgcgtactataacgaggccccctctgaaccccgtcctggcaaatccgctgcagtttcgtctctcgactgcttgagctctatagtggagaggatttcaacagagtctccggccgctcctgctctgctgctggccgatgtgccctcggaaagcccccctcgccggcaagaagcagctgctccgagcgaaggggaatcctccggcgacccaacgcagtcccctgatgccgcacctcagtgtcccgccggcgccaaccctaatccgatttatcaggttctgtag

SEQ ID NO: 16185 - DNA, 5538 bp, Artificial Sequence
  Description of Artificial Sequence: Synthetic coding sequence
atgggtgatgttaagcttgtggccagtagccacatcagcaagacgagcctgagtgtggacccttcccgagtggattcaatgcctcttacggaagcccctgcgttcattctgccaccacgaaatctatgcattaaggagggcgctaccgctaagtttgaaggccgggtgagggggtacccggagccacaagtgacatggcaccgcaacggccagcctatcacatcgggagggaggtttctcctcgactgtggcatacggggcacctttagcctcgtgattcacgcagtgcacgaggaagaccgtggaaaatatacgtgcgaggcgacaaatggctcaggcgcacgccaggtgaccgtcgagttgactgttgaaggctcttttgccaagcagctcggccaacctgtggtatcaaaaactctgggcgaccgtttcagcgcccctgccgtcgaaaccagacccagcatttggggagagtgcccccccaaattcgccactaaattgggtagagtggtggtgaaggagggacagatgggcagattttcttgcaagattacgggcagaccacagccgcaagttacttggctgaaggggaatgtccctctgcagcctagcgccagggtgagcgttagcgaaaaaaatggaatgcaggtcctagagattcacggagtcaaccaggatgacgttggcgtatatacatgcctagtagtgaacgggtccggcaaagcaagtatgtcagccgagctgagcatccagggactcgactccgcgaacaggagcttcgtgcgcgagacaaaggccaccaacagcgatgtaagaaaagaggtcaccaatgttatttcgaaagaaagcaaattagattcactggaggccgcagcgaaatctaaaaactgcagctctccacagcggggagggagccctccctgggctgccaactcacagcctcagccccctagggagagtaagctggagagctgcaaagactcgcctcggactgcaccacagaccccagtgctccaaaaaacatcgagcagcataacactgcaggcagcccgcgttcaaccagagccgcgcgccccgggcctaggcgttctcagtcctagtggagaggagagaaagcggccagcccctcccaggcccgcgacattcccaacaaggcagccaggactgggatcccaagacgtagtgtcaaaggcagcgaatagacgtattccaatggagggacagagagacagcgctttccctaagttcgagtccaagcctcaaagccaggaagtcaaggaaaaccagacggttaaattcaggtgtgagggactggccgtgatggaggttgctccaagcttttcttcggtacttaaggattgcgccgtgatcgagggacaggattttgtgctccagtgtagcgttcgagggaccccggttccccgtattacttggctactcaacggtcagcctatccagtatgcacgcagtacgtgcgaggccggcgtggcggagctgcatattcaggatgctcttcccgaggaccacggcacatacacctgcctggcggagaatgcgctgggacaggtgagctgctcagcgtgggttaccgtacatgagaagaaaagtagccggaagagtgaataccttttacccgtggcgccctccaaacctactgcccccattttcctgcagggactgagtgatctgaaggtgatggatggctcgcaggttacaatgacggtccaagtcagcggaaaccctccaccagaggtcatctggctgcataatggcaacgagatacaggagtctgaagattttcatttcgagcagagaggaacacagcactccctgtgcatacaagaggtctttccagaagataccggcacatacacgtgcgaagcctggaatagtgctggtgaagtacggactcaggcagttctgactgtacaagagcctcacgacggcacacaaccttggttcattagcaagccaagatccgttaccgctagcctcggtcaatcagtgctgatctcgtgcgcaatcgcaggcgatcccttccccaccgttcattggctccgcgacggaaaggccctgtgcaaggacactggccattttgaggtgctgcagaacgaagacgtcttcacactggtgctgaaaaaggttcagccgtggcacgccggtcagtacgagattctgctgaagaatcgggtgggcgagtgttcttgtcaagtgtccctaatgttacagaactcatcagcccgggccctcccaagaggaagagaacctgccagttgtgaagacctctgcggaggaggggtaggagcggatgggggagggagtgacagatacggaagtctacgcccagggtggccagctcggggccagggttggctagaggaggaagatggtgaggacgttcgtggtgtgctgaagcgcagagttgaaactaggcaacacaccgaggaggccattcgccagcaggaagtcgagcagctggacttcagagatctccttgggaagaaagtttcaacaaaaacgttgtcagaggacgacttaaaagagatccctgccgagcagatggacttcagggccaacctgcaacgacaggtaaaaccaaagacagtaagtgaagaggagcggaaagtgcacagcccgcaacaggtggactttcgctcagtacttgctaagaaaggcactagtaaaacccccgttcctgagaaagtccccccccccaagcctgccactccagatttcagatcagtactcggggggaaaaaaaagctgcctgcggaaaacggcagctcctcagctgaaactctaaatgcgaaagctgtggaatcctctaagcccttgtcaaatgctcagccttctgggcccttgaaaccagttgggaacgccaagcccgctgagacgctcaagcctatggggaacgctaaacccgctgaaactttgaaacctatgggcaacgcaaagccagatgagaatctgaaatccgccagtaaggaggaactgaagaaggacgtcaagaacgacgtgaattgcaagaggggccacgctggaaccactgataacgaaaaaagatccgagtctcagggtactgcccctgcctttaagcaaaaactacaagatgtacatgttgccgaaggaaagaagctgttactccagtgccaggtgtcctccgatccacctgcgactatcatttggaccctcaacgggaaaacattgaagactactaagtttatcattttgtcgcaagagggtagcctctgttcagtaagcatagaaaaagccctccccgaggacaggggcttatataagtgcgtggcaaaaaacgacgcaggacaagctgagtgctcctgccaggtcacagtagacgatgctccagccagcgagaatacaaaggctcccgaaatgaagtctcggcggcccaagtcatccctgccgccagtcctaggcaccgagagcgacgcgactgtcaaaaaaaagcccgcaccaaaaacgcctcccaaagctgcaatgcccccacagattattcagtttcccgaagaccaaaaggtgagagctggcgagtctgtcgagttatttggcaaggtcacaggaactcagcctataacctgcacgtggatgaagtttcggaaacagatccaagaaagcgagcatatgaaggtggaaaactctgaaaatggctctaagttaactatactcgcagcaaggcaggaacactgcgggtgttacacactgctagtggaaaacaagttgggcagtagacaggcacaagtaaatctgaccgtcgtagataagcctgacccaccagctgggaccccatgcgcctcagatattagaagctccagtctgacactgtcctggtatggctcgtcttatgacggggggagcgccgtgcaaagctattctatcgagatctgggattcggctaacaagacttggaaggaattggcaacgtgtcgtagtacttcgtttaatgtacaggatctgctgccagatcacgagtacaagttccgcgtgagagccatcaatgtttatggcacgagcgaaccgagtcaggagtccgagctaacaacagtgggggaaaagcctgaagaacccaaagacgaggtggaggtatccgacgatgacgagaaagagcccgaagtcgactatcgcactgttaccataaacactgagcaaaaggtcagcgatttctacgatatcgaggagcgtcttggctccgggaagttcggacaagtgtttcggctcgtggaaaagaaaaccaggaaagtatgggctggtaaattttttaaggcttacagcgccaaggaaaaagaaaatatacggcaggagatctctattatgaattgcctgcaccacccgaaactggtacaatgtgtcgatgccttcgaggagaaggccaacatcgtaatggtgctagaaattgttagtggaggggagctgtttgagcgcatcattgatgaggactttgaattaaccgagagggagtgcataaaatacatgcggcagattagtgagggagtagaatacattcataaacagggcattgtgcacctggacctgaaacctgagaatattatgtgtgttaataaaacaggcacaagaatcaagctgatcgattttggcctcgctcggaggctcgagaacgccggttctctaaaggtgctgttcgggacacctgagtttgttgcgccagaggtgatcaactatgaacccatcgggtatgcgaccgatatgtggagcattggggtgatttgctacatcttggtaagtggattgagccctttcatgggcgataatgacaatgaaaccctagctaacgttacttctgccacatgggacttcgacgacgaggcgttcgatgaaatttccgacgatgcaaaggacttcatcagcaatctgttgaaaaaggatatgaaaaatagattagactgtactcagtgtctgcagcatccttggctgatgaaagacaccaaaaatatggaagctaagaagctgtccaaagatcggatgaagaaatatatggctcggaggaaatggcaaaaaacaggaaatgcggtgagggccattggccgcctaagctctatggccatgataagcggcctgagcgggcgcaagtcctctaccgggtcccctacctcccccttaaatgctgaaaaactggagagtgaagaggacgtatcccaggcatttctcgaggctgtggctgaagaaaaacctcacgtaaaaccttatttttccaagacgattcgggatctggaggtggtggaaggctcggccgctcgctttgattgtaagattgagggttatcccgacccagaagtggtatggtttaaggatgatcaatctatcagggagagtaggcacttccagattgattacgatgaggacggaaattgctctctgattattagcgacgtctgcggggatgacgatgcaaagtatacatgcaaggctgtgaactccctcggggaggccacctgtacggccgagttaattgtggagactatggaagagggggaaggcgaaggcgaggaggaggaagagtag

SEQ ID NO: 16186 - DNA, 2145 bp, Artificial Sequence
  Description of Artificial Sequence: Synthetic coding sequence
atgaaatcccggcgtccgaagtccagtttacctcccgtgcttggtacggagtctgacgccaccgtgaaaaaaaaacctgctcccaaaacacctcccaaagcggcaatgcccccacagatcatccagttcccagaggaccagaaagtgagggcaggggaaagcgttgaactcttcggaaaggtgacgggcactcagcctatcacgtgcacctggatgaagttcagaaagcagatacaggagtccgagcacatgaaagtggagaatagtgaaaatggcagcaagttaacaatactggccgcgagacaggaacactgcggctgttatacgttattggtggagaataagctgggctcacggcaggcccaggtgaacctgactgtggtagataagcccgacccaccagccggcacaccctgtgctagcgacattaggtcatcttctctgactctcagctggtacgggtcatcctacgacggaggttccgcggtgcagtcctactcaatagaaatctgggatagtgccaataagacctggaaggaactggcgacttgcaggtcaaccagtttcaacgttcaggacctcttgcctgaccacgaatataaattcagagtgcgggccatcaatgtatatggaacttctgagccttctcaggaaagcgaattaactacagtcggcgaaaagcccgaggagcccaaggacgaagttgaggtctctgatgacgatgagaaagagcccgaggtcgactatcgtaccgtaacaattaataccgagcaaaaggtttcggatttctatgatattgaggagaggcttggtagtggtaagttcggacaggtctttcgcctggtcgagaaaaagaccaggaaagtgtgggccggaaaattttttaaagcatatagcgccaaggagaaagagaacatccgccaagagatcagcatcatgaactgtcttcaccaccctaaactggtccagtgcgtagatgcattcgaagagaaagcaaatatcgtcatggtcctcgagattgtgtcgggaggtgaactgtttgaaagaatcatagacgaggattttgaactgactgagcgggagtgcatcaagtacatgaggcagattagcgagggagtagagtacatccacaaacaggggatcgtccatctggatctgaagccagaaaacatcatgtgcgtgaataagactggaacccgcataaagctgattgatttcggcctagctcgacggctggagaacgcgggatcgctgaaagtcctgttcggaacccccgaattcgtcgcaccggaagtgattaattatgaacctattggctacgccacggacatgtggagcatcggagtcatttgttatatcctagtcagcggcctaagcccttttatgggcgacaacgacaacgagacactggcaaatgtgacttctgctacttgggacttcgatgacgaagcatttgatgaaatctccgatgacgctaaggattttatatctaatctgctgaaaaaggacatgaagaaccgtctggattgtacacagtgtctgcaacacccgtggcttatgaaagataccaagaacatggaggccaaaaagctcagtaaagatagaatgaagaagtacatggcacggcgcaaatggcagaagaccggaaatgctgtcagggctatagggcggctgtcatctatggccatgatatccgggctcagcggccgtaaaagttctaccggtagtcctacatcacctctcaacgcggagaagctggagagcgaggaggacgtgtcccaggctttcctggaagctgttgcagaagaaaaaccccatgtgaagccatacttttctaagacaatcagggatttggaagtggtcgagggaagcgccgccagatttgattgcaagattgaaggctacccagaccccgaggtggtctggtttaaggatgaccaatctattagagagtcgagacactttcagatcgactatgacgaggacggcaactgtagcctgatcatctcagacgtctgcggcgacgatgatgcaaaatatacctgcaaggccgtcaacagtctgggagaagctacttgtactgcagaattaatagttgaaaccatggaagaaggcgagggtgagggtgaggaggaggaggagtag

SEQ ID NO: 16187 - DNA, 5592 bp, Artificial Sequence
  Description of Artificial Sequence: Synthetic coding sequence
atgggagacgtgaaactagtggccagtagccacatttcaaagacttcgctgtctgtggatccctctcgtgtagattcaatgcctctgacagaagcacctgccttcattttaccaccgaggaacctctgcatcaaggagggtgccaccgccaagtttgaaggcagagtgcggggataccctgagccccaggttacctggcataggaacgggcaaccgattacgtctgggggaaggtttctgcttgactgtgggattaggggaacttttagcttagtgattcacgcagttcacgaggaggaccgtggaaagtacacctgtgaagccaccaacggaagcggtgctcgtcaggtgactgtggaactgacagtggaaggatcattcgccaagcagctcggacagcccgtggtgtcaaaaacacttggagatcgattttcagcccccgcggtggaaacccggccgagtatttggggggaatgtcctccgaaattcgcgactaagctgggccgcgtagtggtgaaagagggccaaatggggagattctcctgcaagataactggtcgtccacaaccacaggtaacatggctcaaggggaacgtcccccttcaaccctctgcccgagtgagcgtgtccgaaaagaacggaatgcaggtcttggagattcacggcgtgaaccaggacgatgtgggagtttatacatgcctggttgttaacggctctgggaaggcctctatgtctgcagagctctccatccagggactagacagcgctaaccgcagctttgtccgcgaaacaaaagccactaactcggacgtcaggaaggaggtgacaaacgtcattagcaaggagagcaaacttgattctctagaggccgctgctaagtccaagaattgttcatccccccaacgcggagggtcacccccctgggcggcgaacagtcaacctcagcccccgagggagtctaaacttgaaagttgcaaggattctccacgcacagcgcctcagacgccggtcctgcagaaaaccagttcaagtattaccctgcaggcggcgagggtacagcccgagccacgtgccccggggcttggagttctgagcccttctggagaggagagaaagcgcccagctccacctagacctgcaacttttccgactagacagcccggcctggggagtcaggacgtagtctccaaagcagctaacagaagaattcccatggagggtcaaagggatagtgcgttccctaagttcgagtcgaagccacagtcccaggaagtgaaggaaaatcagacagttaaatttaggtgcgaagtaagcggcatacctaagccggaagttgcctggtttctggagggcacgcccgtgcgccgccaagaaggctccatagaagtatacgaggatgctggatcacattatctttgcctgttgaaagcccgcactagggatagcggcacatacagctgcactgcttctaatgctcagggccaactttcatgctcatggacgctgcaggtcgagcgtttggccgtgatggaggtggccccatctttcagtagcgtgctgaaggattgtgccgtcatagagggtcaggatttcgttctccagtgctcggttagaggtacacctgtaccacggatcacctggctgttgaatggccagccgatccagtacgcccggagtacatgcgaggctggggtggcagagctgcatattcaggacgcacttcccgaggaccatggcacatacacctgcctggcagagaatgctctcgggcaggtttcatgtagtgcctgggtgaccgtgcacgagaaaaaaagttctcgcaagtccgaatacctgcttccagttgctccctccaagcccactgccccgatattcctgcaaggcctcagtgaccttaaagttatggatggtagccaggtgactatgacggtccaggtcagcgggaacccaccccccgaagtgatttggctgcataatggcaacgaaatccaagagtccgaagatttccacttcgaacagcgcggtacccagcacagtctctgcatccaagaagtctttcccgaggacactggaacctacacgtgtgaggcgtggaactcagctggggaagtgcggacacaggcagtcctgactgtacaagagcctcatgacggtactcagccttggttcatatcaaagccccggtcagtcaccgcatcactgggccagtccgtgctgattagctgtgccattgcaggcgatcccttcccaactgtgcattggctgagagacggcaaagctctgtgcaaggatactggacattttgaagtactgcaaaacgaagacgtgtttaccctggtactgaagaaggtacagccctggcacgcagggcaatatgaaatactgctgaagaatcgtgtaggcgaatgttcgtgtcaggtgtcactgatgctgcaaaatagcagtgcccgggctctaccaagggggcgtgagccagcctcgtgtgaagacctgtgcggagggggggtcggcgcagatggaggagggagcgatagatatggctcactgcggcccgggtggcccgctcggggccaggggtggttagaggaagaggatggagaggacgtgcgcggcgtgttaaaacggagggtggaaaccagacagcacacagaggaggccatcaggcagcaggaagtagagcagctggatttcagagatttactcgggaagaaggtgtctacgaagacgctcagtgaagacgacctcaaggaaatacccgcagaacagatggattttcgcgcgaacctgcagcgccaggtcaagccaaagaccgtcagcgaggaggagcggaaagttcactcgccacaacaggtggacttcagatccgtgctagcaaaaaagggaactagcaaaactcccgtgcctgagaaggtgccccctcccaaaccagcgacccccgacttccgttctgtgcttggtggcaagaaaaaactcccagccgagaacggctcaagctccgcggaaaccctgaacgcaaaagccgtggaatcctctaagcctctgtcaaatgctcagccatctggccctttaaaaccagtcggtaacgcaaaaccagctgaaacgttaaaacctatgggtaatgcaaaacctgctgagaccctaaagccaatggggaacgctaaacctgatgagaacctcaaaagtgccagtaaggaagagctgaagaaggacgtgaagaatgatgtcaattgcaagcgaggccacgccggaaccaccgacaacgagaagcggtccgaaagtcaagggactgccccagcctttaaacagaagctgcaagatgtgcatgttgctgaggggaagaaactgctgttgcagtgtcaagtctccagcgaccctcctgccacgataatctggacgctcaacggcaagacacttaaaacaaccaagttcattatcctcagtcaggaaggctccctttgcagtgtctccatagagaaggccctgccagaagaccgtggactttataaatgcgtggccaaaaacgacgccggccaagccgaatgcagctgtcaggttactgtggatgatgcaccagcatccgaaaacaccaaggccccagaaatgaaaagcagaaggcccaagtctagtcttcctcccgtcctgggtactgaatctgatgctacggtgaaaaaaaagcccgcccccaaaacaccaccaaaagctgccatgccgcctcagataattcaattccccgaggatcaaaaggtaagggccggcgagtccgttgaactgtttggaaaagtgactgggacccaaccaatcacttgcacctggatgaagttcagaaagcagatccaggagagtgagcatatgaaagttgagaatagtgagaacggctctaagctgacgatactcgcggcaagacaagagcattgcggatgctacaccttactggtggagaacaaactgggtagcaggcaagcacaggtaaacctgactgtcgtggacaagcccgaccctcctgccggcacaccctgcgcttctgacattcgctctagttccctgacactgagttggtatggatcaagttacgacggagggtcagccgtgcagagctactcaatcgagatctgggatagcgccaataagacctggaaggagctggcgacatgtagatctacatcgtttaacgtccaggaccttcttcccgatcacgagtataaattccgagtaagagcaataaatgtctacggtacctctgaaccctcccaggagtccgaactaactacggtgggagagaaacctgaggaacccaaagatgaggttgaagtaagcgacgacgacgagaaagaacccgaagtggactatcggaccgtgaccatcaatactgagcaaaaggtgtctgatttctatgacattgaagagcgactgggctccggaaagttcggccaggtgtttaggttggtggagaagaagacccggaaggtatgggcggggaagtttttcaaggcctactctgctaaggagaaggagaatatcagacaggaaatttctataatgaactgcctgcatcatccaaagttggtacaatgtgtagatgcatttgaagagaaggctaatattgtcatggtattggagatcgtgtccggaggggagctgtttgagcggatcatcgatgaagactttgaactgacagaacgtgaatgcatcaagtacatgagacagatcagtgagggtgttgagtatatccataagcagggtatcgtccacctggatctgaaaccggaaaacatcatgtgtgttaataagactggcaccagaattaagcttatcgattttggcctggctaggagactagaaaacgctgggtctttgaaagtattattcggtactccagagttcgtcgctccggaggttatcaactatgagcctatcggctatgccactgacatgtggagtataggagttatctgttatatccttaaccggctagattgtactcagtgcttgcaacacccctggctcatgaaggacacaaagaacatggaagcaaaaaagctgtctaaggataggatgaagaagtacatggcccggaggaagtggcagaaaacaggcaatgcggttcgagccattggtagactatccagtatggcgatgatatccgggttgtccggtaggaagtccagtaccgggagcccaactagccctctaaacgctgagaaattggagtccgaggaagatgtatcccaagcttttcttgaagccgtcgccgaagaaaagccacacgtcaagccatatttcagcaaaacaatcagagatctggaggtcgtcgagggcagcgcggcccgttttgattgtaaaattgagggatatccagatcccgaggtggtgtggttcaaggatgatcaatccatacgcgagagtcggcacttccagatcgattatgacgaggatgggaattgttcacttatcatttcagatgtatgcggagacgatgacgccaagtacacttgtaaggctgtgaattccctcggcgaagccacttgtacggcagagctcatcgttgaaacaatggaagaaggtgaaggtgagggagaggaagaagaggagtag

SEQ ID NO: 16188 - DNA, 5745 bp, Artificial Sequence
  Description of Artificial Sequence: Synthetic coding sequence
atgggggatgtcaaattggtggcatcttcacacattagtaagaccagtttatccgtagacccatcgcgggtggatagcatgccccttactgaggcccccgcatttattttaccgccccggaacttgtgcatcaaggaaggagcaaccgcaaagtttgaagggagagtccggggctatcctgagccgcaggtgacgtggcaccgcaacggccagcctataacctcaggaggccgttttctcctggactgcggtattagaggaaccttcagcctggtaattcacgccgtgcacgaggaagaccgcggcaaatacacatgtgaggccaccaacggatctggggccagacaggtgacggtcgaattgacagtggaagggagcttcgcaaaacaattggggcagcccgttgtgagtaaaacgctcggcgaccgattcagcgcacccgccgtggagacgcggccgtccatttggggggagtgccctccaaagtttgccactaagctgggaagggtggtcgtgaaagagggtcagatgggcagattttcctgtaagattactggacgcccccagccacaagtgacctggctgaaaggcaatgtgccgttgcaaccttcagcacgagtaagcgttagtgaaaagaacggtatgcaggtgttggaaattcacggagttaaccaggatgacgttggcgtttatacttgtttggtcgttaacggaagcggcaaggccagtatgagcgccgagctttcaatccagggcctcgactcagccaatcgtagttttgtgagagaaacaaaagctaccaatagcgacgtacgaaaggaagtgacaaacgtcatatccaaagaatctaaacttgactctctcgaagctgctgccaagagcaagaactgctccagcccccagaggggtggcagcccaccttgggccgccaacagccagccacagcctcccagggagagtaagctggagtcctgtaaggatagtcccagaacggccccacagaccccagttctccagaaaaccagctccagcattaccctgcaggctgcaagggtgcagcccgagccccgagcgccaggcctgggagtgctgagtccatctggcgaggaacgcaaacgaccagcgccaccacgccccgcgacattcccaacccggcagcctgggctaggatcccaagatgtcgtctcgaaggcggctaacaggcggatacccatggaggggcagagagatagtgcatttccgaagtttgagtccaaaccccagagccaggaagttaaggaaaaccaaactgtcaagttccgctgcgaagtgagcggaatcccaaaacccgaagtggcatggttccttgagggcacccctgtgagacgtcaggaggggagtattgaggtgtatgaagacgctggttcccactatctttgccttctgaaggcccggacaagggactctgggacatatagctgcacagcatctaacgcacaaggacagctgagctgcagctggacactgcaggtcgaaagactcgctgttatggaagttgcaccttctttttccagcgtgctcaaagactgtgctgtgatcgagggtcaagactttgttctacagtgtagcgtccgagggacgccagtaccaaggatcacctggctcctgaacggacagccaatacagtacgcgaggtcaacatgtgaggcaggagtggcggaacttcatattcaagacgctctcccagaagaccatggtacatacacatgcctggctgagaatgctctgggccaggtgtcatgttctgcctgggtcactgtgcatgagaagaaatcctctagaaagtcagagtatctgctgccagtagcgccaagcaaacctacagcgcccatcttcctacagggactatctgatctgaaagtcatggatggatcccaggtaaccatgactgtccaggtgagtggcaaccctcctcctgaggtgatctggctccataacggtaacgaaatacaagaaagcgaagacttccactttgaacaacggggaactcaacattcgctgtgcatacaggaggtgtttccggaagataccgggacctacacctgtgaggcatggaacagcgccggcgaagtcaggacccaagccgtgctgaccgtccaggagccgcacgacggaacccagccatggttcatttctaaaccacggtcagtcactgcatctctgggccagtctgttctaatatcctgcgccattgccggggatccctttcccacagtgcactggctgagggatggcaaagcactttgtaaggacacaggtcacttcgaagtgctgcagaatgaagacgtgtttacactggtattgaagaaagtgcagccatggcacgctggacagtacgaaattctgctgaagaaccgcgttggcgagtgcagctgtcaggtgtcacttatgctgcaaaattcaagtgcaagagcattgccccgaggacgagaacccgccagttgcgaagatctgtgcggaggaggcgtaggcgcagacggcggcggtagtgacaggtacggctctctgaggccaggttggccggcacggggacaagggtggttggaggaggaggatggggaagatgtaaggggcgtgctgaagagacgagtggagacccggcagcatacagaggaggccatccgacaacaggaagtggagcagttggactttcgtgaccttctaggaaagaaggtcagtaccaagacgttatccgaagacgacctaaaggaaattcctgccgaacagatggattttcgtgcaaatctgcagcgccaggtaaagccgaagactgtttctgaggaggagcgtaaggtccattcaccccaacaggttgattttagatctgtactggctaaaaaaggcacctccaagactcctgtgccagaaaaagtgccacctcctaaacccgcgactcccgacttccgcagcgttctaggaggcaagaaaaagctccctgcggaaaacgggagcagctctgctgaaactctgaatgccaaagcagtcgagtcctccaaacctttgtccaacgcccaaccctctggccccttaaaaccagtgggtaacgccaaacctgccgagaccctgaagccaatgggaaatgccaagccggccgagaccctgaaacccatggggaatgcgaaacctgacgaaaatctcaaaagtgccagtaaagaagagctgaagaaagatgtgaagaatgatgtgaactgtaaacgcggccacgccggaacaaccgataatgagaaacgctcagagtctcaggggactgcacccgcattcaagcagaaactgcaagacgtccatgttgcagaggggaagaagctgttactgcagtgtcaagtttcatcggatccacccgcgaccatcatttggactctaaatggaaaaaccctcaagacaactaagttcattattctgtcccaggaggggtctctgtgctccgtatcaattgagaaggcactgccagaggacagaggtctgtacaagtgcgtggccaagaatgacgcgggtcaggcagagtgttcatgtcaggtaacagtcgacgatgcaccggcgtcggaaaatacaaaggcccctgaaatgaaatcccggagacccaagtcctccctaccccctgtgctgggtacagagagtgacgctactgttaagaaaaaaccggcccctaagactcctcctaaagccgccatgcccccacagattatacagtttcctgaggatcagaaagtcagagctggggagtcagtggaactttttggcaaggtgactggtacccagccaataacctgtacttggatgaagtttagaaagcagattcaggagagtgagcatatgaaggtcgaaaattcagagaacggctcaaagttgacaatcctggcggcgaggcaggagcattgcggatgctataccctgttagtcgaaaacaaactgggatccaggcaggcccaggtaaatctaaccgtggtagacaagcccgacccccctgcaggaacaccatgcgcatctgacatccgttcaagcagcttaaccctgagctggtacgggagcagttatgacggcggatctgccgtgcaatcatacagcattgagatctgggactccgcaaataagacttggaaggaattagcaacgtgtcggtctacatcatttaacgtccaagatctcctgccggatcatgagtacaagttcagggtgagagcaatcaacgtctatgggacaagcgaaccaagccaggaatcagaactgaccaccgtgggggaaaaaccagaagaacccaaggatgaagtggaggtgtccgacgatgatgaaaaggaacctgaggtagactaccgcacagtaaccatcaacacggagcagaaggtctcagacttctacgacatcgaggagagattgggctctgggaaatttggacaggtgttccgacttgttgagaagaagacaaggaaggtctgggcaggcaaattcttcaaagcgtattctgccaaagagaaagagaatattagacaggagatctcaataatgaactgcttgcaccaccctaagctggtgcaatgcgtggacgcttttgaggaaaaagccaacattgtaatggtattagaaattgtgtctgggggtgagctttttgagcgcataatcgatgaagattttgaactaaccgaacgcgagtgcatcaagtacatgcgtcaaatctcagaaggtgtggagtacatacacaagcagggcattgtgcacctggacctgaagcccgagaacataatgtgtgtgaacaaaacagggactcgaattaagctgattgattttggactggcccgccgattagaaaatgccggaagccttaaagtcttattcggtacccctgaatttgtcgctccggaggtgatcaattacgaaccaatcgggtacgccaccgacatgtggtctataggcgtaatatgctacattctggtgtcaggtttgagtcccttcatgggtgacaacgataatgaaacactcgccaatgttacaagtgctacctgggacttcgacgacgaagcttttgatgagatcagtgacgatgctaaggattttatctcaaacctgctgaagaaggacatgaagaaccggctagattgtacccagtgcttgcaacacccttggctgatgaaagacaccaaaaatatggaggctaaaaagttgtcgaaggatagaatgaaaaagtatatggctcgccgaaaatggcagaagactggtaacgcagtcagagcgataggcagactgagttctatggcaatgatctctggactgagcgggcggaagagcagcacaggctcacccacgtcaccccttaatgcagaaaagcttgaatccgaggaagatgtgtcccaggctttcctggaggctgtggccgaggagaaaccccatgttaagccatacttcagcaaaaccattcgtgacctagaggtggtggaggggtccgcggctcgatttgattgtaaaatcgagggatacccagatccagaagttgtttggttcaaagacgaccagtctatcagggagtcccgacattttcagattgattatgatgaagatggaaattgctcactcatcatttctgacgtctgcggagacgatgacgctaagtacacctgcaaggctgtaaacagcttgggagaagcaacctgcaccgcggagcttatcgtggaaactatggaagagggcgagggtgagggagaggaggaggaagagtag

SEQ ID NO: 16189 - DNA, 231 bp, Artificial Sequence
  Description of Artificial Sequence: Synthetic coding sequence
atgggagatgtaaagctcgttgcaagttcacacatctctaagacttcactttccgttgatccatcaagagtggatagcatgcctctgacagaagcccctgctttcatactccccccccggaatttgtgtatcaaggagggtgctactgcaaagttcgaagggcgcgtgcgggggtatccagaaccgcaagtcacatggcacagaaatggccagcctatcacaagcgggtag

SEQ ID NO: 16190 - DNA, 5592 bp, Artificial Sequence
  Description of Artificial Sequence: Synthetic coding sequence
atgggcgacgtgaagctggtggcctcgtcccacatctccaaaacaagccttagcgttgacccctcccgggtggatagcatgcccctgacagaggctccagctttcatccttccacctcgtaacctctgcatcaaagagggagcgacagcgaagttcgagggtcgcgtacgcggctaccctgaaccacaggtgacttggcatagaaacggccagcccattactagcggaggcagattcctgttggactgcggaatacgtggaactttttccctggtgatacacgcggtccacgaggaggaccgcggaaaatacacttgtgaggccaccaacgggtcaggggcgaggcaagtgactgtggaactgaccgtggaagggtctttcgctaagcagttgggacaacctgtcgtgagtaaaacactcggggacaggtttagcgccccggcggtggagacaagaccctctatttggggggaatgtccaccaaaattcgcaaccaaactcggccgggtggtagtgaaagagggccagatgggacggtttagttgtaagattaccgggaggccccagccacaggtcacttggcttaaaggcaatgtgccactccaacctagtgcacgggtgtctgtgtcagaaaaaaatggaatgcaggtactggagatccacggcgtaaatcaggatgatgtgggagtgtatacgtgcttggtcgttaacggcagcggtaaagcatctatgtccgcagaactgagcattcagggcttagactctgcaaacaggagttttgttcgggaaaccaaggctaccaacagtgatgttcggaaagaggtgaccaacgtaatctcaaaagagagtaaactggactcactggaggcggcagcaaagtctaagaactgcagttctcctcagagaggcgggtcacctccatgggccgccaattcccaaccgcagcctccacgcgagtcaaaactggaaagctgcaaagacagtccccgcacagcgccgcagacccctgtcctgcagaagacaagttcctcgataacgctccaggctgcgagggttcagcctgaaccccgcgctccggggctaggtgtcctctcaccttccggagaggaacgaaagcggcccgctccgcctcggcctgcaacatttcctacacgccagcccgggttaggatctcaagatgtcgtcagcaaggcggccaatcgccggatccccatggaggggcagcgagattccgctttcccgaagtttgaaagtaaaccccagtcacaagaggtgaaagaaaatcagacagtgaagttcaggtgtgaggttagcggtattcccaagcccgaggtggcatggtttctggaggggactcctgtccgaagacaagagggcagtattgaagtgtacgaggacgccggcagtcactatctgtgccttctgaaggcccggacgcgggactcaggcacctattcatgtaccgcctccaatgcacagggccagctctcatgctcttggacactgcaggtcgaacgactggcagtcatggaagtggctccatcatttagctcagtgctcaaggactgcgctgtgattgaaggtcaagatttcgtcttacaatgttccgtcagggggaccccagtgccgagaatcacatggctgttgaacggtcagcctattcaatatgcccggagtacttgtgaggctggagtggccgaactccatattcaagacgctctcccagaggaccatggcacttacacctgtcttgccgaaaacgctctggggcaggtgtcctgctctgcctgggttacagtccacgagaagaagtcctcccgcaagtctgaatacttgttgcccgtagcccctagcaagcctacagccccgattttccttcagggactctcagacctgaaagtcatggatggctcccaagtgacaatgacagttcaggtctcaggaaacccacctccagaggtgatctggctgcacaacggcaatgagatccaggagtcagaagacttccacttcgaacagcggggcactcagcattcattgtgcatccaagaagtgttccctgaggacactggcacttacacctgcgaagcatggaattctgccggcgaggtccgcacacaggctgtgcttactgtgcaggaaccccatgacggcacacaaccatggtttatttccaagcctcgatctgtgacagcgagtctgggacagtcagtgctgatttcctgcgccattgcaggtgatcctttccctacagtccactggctccgcgacggaaaagccctgtgcaaagacactggccatttcgaagtgctccaaaatgaggacgtattcacacttgtgctaaagaaagtgcagccttggcacgccgggcagtatgaaattctgctgaaaaacagggttggagagtgcagctgtcaggtgtcactcatgttgcagaattcatccgctagagcactcccacgcggcagggagccagcatcttgcgaggatctgtgcggaggaggggttggggcagacgggggtggatccgacaggtacggaagcctgagacctgggtggccagctagagggcaagggtggctggaagaggaggacggtgaagacgtgcggggtgtccttaaacgtcgggtcgaaactcggcagcatactgaggaagcgatccggcagcaagaggtagagcagttagactttagggatctcctgggaaaaaaggtctctactaagaccctttcagaggacgatctcaaggaaatccccgctgaacagatggattttagggctaacctacagaggcaggtcaaaccaaagacggtcagtgaagaagagcgcaaggtccatagcccacagcaggttgatttccgcagtgttctggctaagaagggaaccagcaaaacgccagtccctgaaaaagttccacccccaaaaccagctacccctgattttaggtccgtcctcggaggcaaaaaaaaacttccagctgaaaacggtagcagttccgccgagacactaaatgccaaggcagtcgagtctagtaagccattgtctaacgctcaacctagtgggccccttaaacccgtgggcaacgccaagcctgccgagacattgaagcccatgggcaatgctaagcccgcggaaaccctgaaaccaatggggaatgcaaagcccgatgagaaccttaagtcagccagcaaggaagaactgaagaaggacgtgaagaatgatgtcaattgcaagcggggccacgccgggaccaccgacaatgagaagcgctccgaatcccaggggacagctccggcttttaaacagaaactgcaggacgtgcatgtagccgaaggcaaaaagttgctgttgcaatgtcaggtctcatctgatcctcctgccacgattatttggacactaaacgggaaaactctgaaaactacaaaattcatcatcctgtcccaggaaggaagcctgtgttcggtgagcatcgaaaaggcgctgcccgaggatcgcgggctctacaagtgcgtagccaaaaatgacgcgggccaagccgagtgttcatgccaggtcaccgtggacgatgccccggcaagcgagaataccaaagcaccagaaatgaagtctagacgaccaaagagctccttacctcccgtcctcggaactgagtccgacgcaaccgtgaagaagaagcccgcccccaagacccctcccaaagccgcaatgccccctcagattatacagtttccagaagatcaaaaggtgagggctggtgagagcgttgaactgttcgggaaagttacagggacacaacctataacttgtacctggatgaagtttaggaaacagatccaagagtcagagcacatgaaagtggaaaacagcgaaaacggaagcaagcttaccatattggcagcccgccaagagcattgcggatgttacactctcctcgtggaaaacaaacttggtagtaggcaggcccaagtcaatctgacggtcgtagataaacctgacccccctgccggcactccatgtgcttccgacatcaggtcatcgtctttgacactgagctggtacggaagttcttacgatggaggatctgcagtccagtcatattctattgagatatgggactccgcgaacaagacatggaaagagcttgcgacgtgcagatccacctcatttaacgtacaggacctgctgccggaccacgaatacaaattccgcgtgagagcaattaatgtttacgggacgtccgaaccatcacaggagagcgaactgaccacagtgggcgagaagcccgaggaaccaaaggatgaggtggaggtgagtgacgatgatgagaaggagccggaggtggactataggaccgtgacgattaacacagaacagaaggtttcagatttctacgacatcgaggagcggttggggagtggcaaattcggccaggtttttcggctggttgaaaagaagaccaggaaggtgtgggctggcaagttttttaaagcctactcggctaaagagaaagaaaatatccgccaggagatttccatcatgaattgtcttcaccatcccaaactggtccagtgcgttgacgctttcgaggagaaggccaacattgtgatggtgctggagatagtctccgggggggagctctttgagagaatcattgacgaggacttcgagcttaccgaacgcgagtgcataaagtacatgcgccagatttctgaaggggtggagtatattcacaagcaaggcatcgtgcatctggatttaaagccagagaacatcatgtgtgtcaacaagacgggaacacgaattaagctgattgacttcggcttggctagacgtctagagaatgccggctctctcaaggtcctgtttggcactccagagttcgtggccccagaagtgataaactacgaacccattgggtacgcgacagacatgtggagcatcggggtgatttgctacatactgaatcggctcgactgcacacagtgcttgcagcatccctggctgatgaaggacacaaagaatatggaggctaagaagctgagtaaagatcggatgaaaaaatatatggccagaaggaaatggcagaaaaccggaaatgcagtgcgagccatcgggaggctttcttccatggctatgatttccgggctctcgggacggaagtcctcaaccggaagccctacttccccgctgaacgctgaaaaattggagagcgaggaagacgtaagccaagcttttcttgaggcagtcgccgaggagaagccacacgttaagccttatttcagtaaaacaatcagagacctcgaggtggttgagggctccgccgctcggttcgattgcaagatcgaaggctacccagatccggaggtcgtgtggtttaaagacgatcaaagtatccgcgagagccggcacttccagattgactacgatgaggacggcaattgctccctcattataagcgacgtctgcggggatgatgatgccaaatacacatgtaaagccgtgaactctctgggggaagccacatgtactgcggaattgatagtcgaaaccatggaggagggggaaggggaaggggaggaggaggaggaatag

SEQ ID NO: 16191 - DNA, 465 bp, Artificial Sequence
  Description of Artificial Sequence: Synthetic coding sequence
atggccatgatcagcggcctgtcaggtcgcaagagcagcaccggcagtccaaccagtccgttaaacgcggagaagctggagagtgaggaggacgtgtcccaagctttcctcgaggcagtcgctgaggagaaacctcatgtcaagccttacttctccaagaccatcagggacctcgaggttgtcgagggaagcgcagccagatttgactgtaagattgaggggtatcctgaccccgaagtcgtgtggttcaaggatgatcagagcatacgagagtcaagacatttccagattgactatgacgaagatggaaattgctctttaatcatttccgatgtatgcggcgacgatgacgccaagtatacctgcaaggctgtgaacagtctcggggaagcaacttgcactgcagaattaatcgtcgaaaccatggaagagggtgaaggggaaggggaggaagaggaagagtag

SEQ ID NO: 16192 - DNA, 5745 bp, Artificial Sequence
  Description of Artificial Sequence: Synthetic coding sequence
atgggggacgtcaaacttgtggcatcctcccatatatccaaaacctctctgagtgttgacccaagcagagtggacagcatgccattgaccgaggcaccggctttcatcctaccaccccgtaatctctgcatcaaggaaggagccactgctaagttcgagggaagggtcaggggatatcccgaaccccaggtgacatggcatcggaacggtcagccgattacatctggagggcgatttttactggattgcggtatccggggaacgtttagcttagtcatccatgcagttcatgaggaagacagggggaaatacacttgcgaggcaactaacgggtccggtgccaggcaagtcacagtcgagcttacagtggaagggagcttcgctaagcaactggggcagccagttgttagcaaaacgctaggcgacaggttcagcgcccctgctgtggagaccagacctagtatttggggcgagtgcccacccaaattcgccacgaagctgggtcgcgtggtcgtgaaggaaggacagatggggcgattcagttgcaaaatcacaggacgtccgcagccgcaggtgacctggctgaagggtaatgtaccgctgcaaccaagcgccagagtcagcgtgtcagagaagaatggcatgcaggtgctggagattcatggtgtcaaccaggacgatgtgggcgtatacacatgcctggtggtgaatgggtctggcaaagcgtccatgtcagccgagctctccatccagggcttggacagcgctaataggagtttcgtgagggagacaaaagcaaccaactccgacgttaggaaggaggtcactaacgtcatttctaaagaatctaagcttgacagccttgaggccgccgccaagagtaagaactgttcgtcaccccagaggggtggttctccaccctgggccgcaaattcccagcctcagcccccacgcgaaagcaagctggagtcatgcaaggacagtccccgaactgcgccccagacacccgtcctgcagaagacctctagctctatcacacttcaggctgcgagagttcagcctgagccacgggcaccgggactgggtgttctgagcccaagcggggaagaacggaagcgtcccgcccccccacggccagcaaccttccccaccagacagcccgggttggggagtcaagatgttgtcagcaaggccgccaatcgccggattcctatggaagggcaaagggatagcgcgttccccaaattcgaatccaagccacagtctcaggaggtgaaggaaaatcagaccgtaaagtttaggtgtgaggtaagtgggatacccaaacctgaggttgcctggttcctggagggcactcctgtcaggaggcaggaagggtcaattgaagtgtatgaggatgcaggctctcattacttgtgcttgctcaaggccagaacccgggactccggcacatactcatgcactgcttccaatgcccagggacagctctcttgcagctggaccttgcaggtggagagacttgccgtcatggaggtcgcacccagcttttcgagcgttctgaaggactgtgccgtaattgaaggccaagattttgtgctccagtgctcggtgcgcggtacccccgtgccacggatcacctggcttctaaacggccagcccattcagtacgcacgcagcacttgtgaggcaggcgtagcagaattacatattcaggacgcactgcctgaagaccatggcacctacacgtgcttggcagagaatgctcttggccaggtttcctgcagtgcctgggtaactgtgcatgagaaaaaatcatctcggaagagtgagtatctccttcctgtcgccccaagtaagccaaccgcccccattttcctgcaggggctctctgatctgaaagtgatggatggctcccaggtgacaatgaccgttcaggtttcgggaaatccgccacccgaggttatttggctgcataacggcaatgaaattcaagagagcgaggattttcactttgagcagcgaggcacccagcattccctgtgtattcaagaagtgttcccagaggacaccggcacttatacttgcgaggcctggaactccgcaggcgaggtacgcacacaggctgtgctaacagtgcaagaacctcacgacggcacgcagccctggttcatatcgaaaccacgctctgtcaccgccagcctggggcagtcagtgctcatctcctgcgccattgcaggcgacccgtttcccacggtgcattggctgagagatgggaaagccctctgcaaggacacaggtcacttcgaggttttgcagaatgaggatgttttcacactggtgctgaaaaaagtccaaccctggcacgctggtcaatatgaaatcctgctgaagaaccgtgtaggagagtgctcctgccaggtgtccctaatgctgcagaatagttcggccagggcgctacccaggggcagggaaccagcatcttgtgaagacctgtgtggaggcggggtcggcgccgatgggggcggcagtgaccgctatggaagtctgagaccaggatggcctgcccggggtcagggatggctggaggaggaagatggcgaggatgtgaggggagtgcttaaacgccgagtggagacacgacagcacactgaggaggcaatccgacagcaggaggtggaacaactggattttagggaccttctgggcaaaaaggtgagcactaaaacactgagtgaggacgacttaaaagaaattcccgccgaacagatggacttcagagcgaacctgcaacgccaagtaaagccaaaaactgtgtcggaggaggagagaaaagtccacagcccccagcaggtcgactttagaagtgtccttgctaagaagggaacatcaaaaacaccagtgcctgagaaagtgcccccccccaagcctgcaacccctgacttccgttctgtgcttggaggcaagaagaagctgccagccgagaacggcagttccagcgctgagaccttgaacgccaaagctgtggaatcttctaaacccctaagcaatgcacagccctcagggcccttgaagcctgtgggaaacgctaagccggccgagactctcaagcccatggggaatgccaaaccggcggaaacgttgaaacctatgggcaacgccaagcctgacgagaatcttaagagtgcatccaaggaagagctgaagaaagacgtgaagaacgacgttaactgcaaacggggccatgctgggactacggataacgaaaagcggtcagaaagccaaggtacagccccagcctttaaacaaaaattgcaggacgtccacgtggcagagggcaagaagctgttgcttcagtgtcaagtttcaagtgatcctccagcgaccattatctggacactgaatggcaagacccttaaaactaccaagtttatcattctctcacaggagggaagtctctgttctgtgtcaattgagaaggcactgcccgaggataggggcctttataagtgcgtggccaagaacgatgccggacaggctgaatgttcttgccaggtgacagttgacgatgccccagcgtcagagaacaccaaagcacccgaaatgaagtctagaagaccaaaatctagcctgcctcccgtgctggggaccgaaagcgacgccacggtgaagaaaaagcccgctccaaagacccccccaaaggccgcaatgccaccacagatcattcagtttcccgaggaccaaaaggttagggctggggagagtgtggagctgttcggaaaagtgactggcactcagcccattacctgcacatggatgaaattcagaaaacaaatccaggaatcagagcacatgaaggtggagaactctgaaaatggctcgaagctgacgattctcgccgctagacaggagcattgcggttgctacactctgctggtagagaataaactggggtctagacaagcccaggtaaatctaacagttgtggacaagccagaccccccggcgggaactccttgcgcatctgacatcagatcttcaagcctcaccctgagctggtacggctcgtcctatgacggcggctcggccgtacaatcttatagtatcgaaatttgggactccgcgaacaaaacctggaaggaactggccacctgccgctctacatcgttcaacgtgcaggacctcttgccagaccatgaatataaattccgcgtgcgcgccatcaatgtttacggcacgtcggagccttctcaggaaagcgagctaacaactgtgggcgagaaaccagaagagcccaaggacgaagtggaagtgtccgatgatgatgagaaagagcctgaggtcgactaccgcactgttactatcaataccgaacagaaagtgtcagacttttacgatatagaggaacgacttggctcaggcaagttcggtcaggtgttccggctggttgaaaagaaaacaaggaaggtttgggccggaaaattctttaaggcctattccgcaaaagagaaagagaacataaggcaggagatcagcattatgaactgtcttcaccatcccaagttggtgcagtgtgtcgacgcatttgaggaaaaggcgaacattgtgatggttcttgagatcgtttctggtggagaactctttgaacggattatcgacgaggactttgagctcacggagagagagtgcatcaagtacatgagacagatctccgagggtgtggagtacatccataaacaggggatcgtgcacctggatctgaagccagagaacatcatgtgtgtaaataagaccggaacccgcatcaagttaattgatttcggcctggctcgtagactcgaaaatgcaggatccctcaaggtactttttggcaccccggagtttgtggcacctgaggttataaattatgaaccaattggctacgccactgatatgtggtcaattggcgtgatctgttacattcttgtttccggattaagcccttttatgggagataatgataacgagaccctagcgaatgtaaccagcgcaacatgggacttcgacgacgaagccttcgacgagatttctgatgacgccaaggatttcatcagcaacttactcaaaaaggacatgaaaaatcgcctagactgtacccagtgcctccagcatccctggctcatgaaagataccaagaatatggaagcaaaaaaactgtccaaagataggatgaagaaatacatggcacggagaaaatggcagaagacaggtaacgcggtgcgcgccatcggaaggctgagcagcatggctatgatctcaggactgagcggccgtaaatcttctacgggtagccctacgtctccattaaacgctgagaagctggagagcgaagaggacgtgtctcaagcttttttggaagcagtggctgaggaaaaacctcacgtcaagccctacttcagcaaaactattagagaccttgaggtagtggaaggtagtgcagcacgtttcgactgcaagatcgagggttaccccgatcccgaggtggtttggttcaaagacgatcaaagtatcagggaatccagacattttcagattgactacgatgaagatggcaattgctctctgatcatttccgatgtgtgcggggatgacgacgcgaagtatacgtgcaaggccgtgaacagcctcggtgaggccacttgcaccgctgagctaatcgtggaaacaatggaggagggagagggggagggtgaagaagaagaggaatag

SEQ ID NO: 16193 - DNA, 5931 bp, Artificial Sequence
  Description of Artificial Sequence: Synthetic coding sequence
atggcccagcgcacaggtctggaggatccggagaggtatctgtttgtcgaccgagctgtcatttataatccagccacgcaggcggattggacagctaagaaactggtctggatcccatctgaacgacatggattcgaagctgcctcaattaaagaggagagaggggatgaagtgatggtcgaactggcagagaacgggaaaaaggccatggtaaataaggacgatatacaaaaaatgaacccgcccaagttctctaaagttgaagatatggcggagctcacatgcctgaacgaggcttccgttctgcacaacctgaaggataggtactattcaggcctcatttatacgtactccggattattctgcgtcgtgattaacccgtacaaaaatctccccatatatagtgagaatattatcgaaatgtatcgcggcaagaaacggcatgagatgccgccacacatttatgccatatctgagtcagcttaccgctgcatgcttcaagacagagaagaccagagtatcctttgcacaggggagtctggagccgggaaaacagagaacactaagaaggtaatccagtacctcgctcacgttgcctcatcccacaaaggacgaaaagaccataatatcccgggtgaactggagcgccagttgcttcaagccaaccccatccttgaatccttcggtaacgccaagacagttaagaacgacaatagctcacggttcggaaagtttataagaattaattttgatgtgacagggtatattgtcggcgctaacatagaaacatacctcttggaaaagagccgagcagtccgccaggcaaaagatgaaaggaccttccatattttctatcaactgctgtccggagccggcgagcatctgaagagtgatctgctgctggaggggtttaacaattacaggtttctatctaacggatatatcccaattcccggacagcaggacaaagacaacttccaagaaacaatggaggcgatgcacattatgggcttttcccatgaagagattctgagcatgcttaaggtggtgtcaagcgttctgcaattcggcaacatctcttttaagaaagagagaaacacagaccaggcctctatgccagaaaacactgtggctcagaagctgtgccatctcctgggtatgaacgtcatggagttcacgcgagcaatcttgactccccgcataaaggtggggagggactatgtgcaaaaggcgcagactaaagagcaggcggattttgcagtggaggcattggccaaggcgacctatgagaggctctttaggtggctcgtccacagaattaacaaagcactagatcgaacaaagaggcaaggggcaagcttcatcggcatcctggacatcgccgggtttgagatttttgagctcaatagctttgagcagctgtgtataaactacacgaacgagaaactacagcagcttttcaaccacacaatgttcatactggagcaggaggagtatcagagagagggaattgaatggaactttatagacttcgggttagacctgcagccatgtattgatcttattgaacggcccgcgaatccaccaggggtcctggcccttctcgatgaagaatgttggtttcccaaagcaacagataaaactttcgtagagaagctggtgcaagagcaaggctcccacagtaagtttcagaagccgcggcagcttaaggataaagccgacttctgtatcatacactatgctgggaaagtcgactataaggcagatgagtggctgatgaagaatatggatcccttgaacgataacgtcgcaaccctcctgcatcaatcttctgaccgcttcgtcgccgaactgtggaaagacgtggaccggatcgtgggtctggatcaggtaaccggaatgacagagactgccttcggatctgcttacaagaccaaaaaaggcatgtttagaaccgtcggacagttgtacaaggaaagcctcacaaaactgatggccactctccgcaacactaaccccaactttgtgagatgcattattcctaaccacgaaaaacgggcaggaaaactggaccctcatctggtgcttgaccagctgcggtgtaacggggtgctggaaggcatccgtatctgtaggcagggctttcctaatcgcattgtttttcaggaatttcgacagaggtacgagatcctgacaccaaatgcaatccctaagggatttatggacggcaagcaagcatgtgaacgcatgatccgggcccttgagcttgaccccaacttataccggatcggacagagcaagatattttttagagccggtgtgctggcccatctggaggaggagcgcgacttaaaaatcacagacatcatcatctttttccaggctgtgtgccgtggctacctcgcacgtaaggccttcgccaagaaacagcaacagctgtccgctttgaaggttctccagagaaactgcgccgcctatctgaagcttaggcactggcagtggtggagagtgtttacgaaagtgaagcccctccttcaggtgacacggcaggaggaggagcttcaagccaaggacgaagagctgcttaaggttaaggagaaacagacaaaggtggaaggggagctggaagagatggagcgcaaacatcagcaacttctcgaagagaagaacattctggccgagcagctacaggcagagactgaactgtttgccgaggccgaagagatgagagcccggctggctgccaaaaaacaggagctggaggagatcctccacgatctggagtctagagtggaagaagaggaagagagaaaccagatccttcagaatgagaaaaagaagatgcaggcacacattcaggacctggaagagcagttagatgaagaggagggggcccgccaaaagctgcaactcgagaaggtgaccgccgaggctaagatcaaaaagatggaagaggaaattcttctcctcgaggaccaaaattccaaatttattaaagagaaaaagctgatggaagaccgtatagccgaatgttccagtcagctggcggaggaggaggagaaagctaaaaacttagccaagattcggaacaagcaagaagtgatgatttctgatctggaagaacgcttaaagaaggaagagaagacccgccaggagctcgaaaaggccaaaaggaagttagatggagaaaccacagacctgcaagaccagattgcagaacttcaagcgcagatcgatgaattgaaattgcagctggctaagaaagaggaggaactgcagggtgcactagcgaggggtgatgacgagaccctgcataagaacaatgcactcaaagtggtgcgtgaactccaggcccagatcgctgagcttcaggaggatttcgaatccgagaaagctagcaggaataaggccgaaaaacagaagcgcgatctcagcgaggagctggaggcactgaaaacggagcttgaggatactctagacacaacagcagctcagcaggaactgaggactaagagagaacaggaagtcgccgaattaaaaaaagcactggaggaagagactaaaaaccatgaagcacagattcaggatatgagacagaggcatgccactgctttggaagagttatccgaacaactggagcaggctaagcgcttcaaggcgaacctggagaagaataagcagggactggagactgataataaggaactcgcctgcgaggtcaaagtccttcagcaggttaaagccgagtccgaacataagcggaagaagctggacgctcaggtgcaagagttacacgctaaggtgtctgaaggggataggctgcgtgttgagctggcggagaaggccagcaaactgcagaacgaactcgataatgtgagcactttgttggaggaggccgaaaaaaaggggatcaagttcgccaaagacgcagcctccctggagtctcagctgcaggacacccaggaactgctgcaagaagagacacggcaaaaactgaacctgtcctcccggattcgtcagctggaggaagagaaaaactctttgcaggaacaacaagaagaagaggaggaagccagaaagaatctggagaagcaagttttggccctccagtcccagctggccgacaccaaaaaaaaggttgacgacgatttgggcactatagaatctttagaagaggccaagaaaaagctgctaaaggatgccgaggcacttagccagagactggaggaaaaggccttagcatacgacaagctggaaaaaaccaagaaccggctgcagcaagagttggacgacctgacagtagacttggatcaccagcggcaggttgcaagcaatctggagaagaagcagaagaagtttgaccagctcctggctgaggaaaagagcatttctgcgaggtatgctgaggagcgagaccgcgctgaagcagaagcacgagaaaaggaaactaaggccctgtccctggcccgagccctggaggaggcccttgaagctaaggaagagttcgagagacagaacaagcagcttcgggcagatatggaggatctgatgagttccaaggacgatgtcgggaaaaacgttcacgagcttgaaaagtctaaaagagccctggaacagcaggtggaggagatgaggacccagctagaagagcttgaggacgaactgcaggcaacggaagacgccaagttgaggctcgaagtgaacatgcaagctatgaaagctcagtttgaacgtgacctacagaccagggatgagcagaacgaggaaaagaaaaggctcctcatcaaacaggtcagagagcttgaagcagaactcgaagatgagaggaagcaaagagcgttggcggtggcaagcaagaagaagatggagatcgacctgaaagaccttgaagctcagatcgaggctgctaataaggccagagacgaggttataaagcagttgcgaaagctgcaggcccaaatgaaggactatcaacgggagttggaagaagcgagagctagccgggatgaaattttcgctcagagcaaggagagcgagaagaagctgaagagcctggaggccgaaatcctgcaactgcaggaagagctcgcctcaagcgagcgggctcggaggcatgcagagcaagagcgggacgagcttgccgatgagattaccaactcagctagtggcaagtcagctcttctggacgagaaacggcgcctcgaagcacggattgctcagctggaggaggaactggaagaagagcagtcaaacatggaactgctgaatgatcgctttagaaaaactactttacaggtggataccctgaacgccgaactcgccgcagaacgctcagctgctcagaaatctgataatgctcgacaacagctcgaacgccagaataaggagctcaaagcaaagctccaggaacttgagggcgccgtaaaaagcaagtttaaggccaccatttctgccttggaagcaaagatcggtcagctggaggaacagcttgaacaggaggccaaggagagagcagccgcaaacaagctggtaaggcgcactgaaaagaagcttaaggagattttcatgcaggttgaggatgaaagaaggcacgcagatcagtacaaggagcagatggaaaaagcaaacgccagaatgaagcagctcaagaggcaacttgaagaagccgaggaagaggccacccgcgcaaatgcaagccgccggaagctgcagcgggagcttgatgacgccactgaggctaacgaagggttgagccgcgaggtgtccacccttaaaaacagacttcggagggggggaccgatcagcttctctagtagccgaagtggccggaggcagttacacctagagggcgcatcgctggaattatccgacgatgacactgagagcaagacttcagatgttaacgaaacccagcctccacaaagcgaatag

SEQ ID NO: 16194 - DNA, 6024 bp, Artificial Sequence
  Description of Artificial Sequence: Synthetic coding sequence
atggcgcaacgtacaggattggaggatccagaacggtacctatttgtcgatcgggcagtgatctacaatccagccacccaggcggattggacagcaaagaagctggtctggattccctcggagaggcacggcttcgaagctgccagcatcaaggaggaaagaggtgacgaagtgatggtggagctagctgaaaatggcaaaaaagctatggtgaataaagacgacatccagaaaatgaaccctcctaagtttagtaaggttgaggatatggccgaactgacatgcctgaatgaagcgtccgtgctccataacttgaaggaccgatattattctgggctaatctatacctatagtgggcttttctgtgtggtcatcaacccatacaaaaatctcccgatctatagtgaaaacattatcgagatgtatagagggaaaaagaggcatgaaatgcctccacacatttacgccatttccgagagcgcctaccggtgtatgctccaggacagagaggatcagtccatcctgtgtactggagagagcggcgctggaaagacagaaaacactaagaaagtgatccagtatctggctcacgtcgcgtcatctcacaagggccgcaaggaccataatattccacaggagtcccctaaaccggtaaaacaccagggcgaactggaacgacaactgttacaagcgaatcccattctggagagtttcggtaatgcaaaaaccgtaaaaaatgacaacagttctcgttttggaaaatttatccgcattaactttgacgtgaccgggtatatcgtgggggctaacatagagacatacctacttgaaaagtcccgcgcagttagacaggccaaggatgagcgcaccttccacatcttctaccagctgctcagcggtgccggcgagcaccttaaaagtgatcttctgctcgagggttttaacaactaccgtttcctgtctaacgggtacataccgatacccgggcagcaggataaggataactttcaggagaccatggaagcaatgcacatcatggggttctcccatgaggagatcctgagcatgcttaaggtagtgagttctgtgctccagttcggtaacatctccttcaagaaagaacgcaatacagatcaggcctccatgcccgagaatacagtcgctcagaaactgtgccatctcctgggcatgaacgtcatggagtttacaagagctatcctgacaccacgaataaaagtgggaagggattatgtgcagaaagcacagaccaaagagcaggcggacttcgccgtcgaagctctggccaaggccacatatgaacggctattccgatggctggtccaccgcatcaataaagccctggacaggacaaagagacaaggcgccagcttcatagggatcctagacatcgcaggcttcgaaatcttcgaattgaatagtttcgagcaactatgtattaattacacaaatgagaaacttcaacaactctttaatcacacgatgttcatcttagagcaggaagagtatcaacgtgagggcatcgaatggaatttcatcgatttcggccttgatctgcagccctgcatcgacctaatagagcgcccggccaatccccctggtgtgcttgccctcctcgatgaagagtgctggttccccaaggctaccgataagacttttgtggagaagcttgtgcaggagcaaggcagccattctaaattccagaaaccaaggcagctgaaggataaggcagatttctgtattatacactacgctggtaaggtggactataaggccgacgaatggctgatgaagaatatggatcctctcaatgataacgttgctaccttactccaccaatcttcagatcgcttcgtagcagaactttggaaagacgaaatccaaaacattcagagagcatctttttacgacagcgtctctgggcttcacgagcctccggtcgaccgcatagtgggcctcgaccaggtcactggaatgactgagaccgcgttcggaagcgcttacaagacaaaaaaaggtatgttccggaccgtgggccagctgtacaaagagtcactgactaagttaatggctacgctcagaaatacaaatccaaatttcgtgagatgcatcatccccaatcatgagaagagagctggaaagctcgaccctcatctcgtcctggaccagctgagatgcaacggagtactcgaagggattagaatttgtaggcagggcttccctaaccgtatcgtattccaggaatttaggcagaggtacgaaatattgacaccaaacgcaatacctaagggctttatggacgggaagcaggcctgcgagcgaatgatccgggcactggagctagacccaaatctgtaccgaatcgggcagtcaaagattttcttcagggccggcgtgctcgcccacctggaggaggaaagagacttgaagatcaccgacattatcattttcttccaggccgtgtgtaggggatacctcgcacggaaggcctttgccaaaaaacagcagcagttgtctgcccttaaggtcctgcaacggaactgtgccgcctacctcaagttacgccattggcaatggtggagggtgtttacaaaggtaaagcctctcctgcaagttacccggcaagaggaggagttgcaggccaaggacgaagagctcctgaaagttaaagaaaaacagaccaaagtcgaaggcgaattggaggagatggagcgcaaacaccagcagttgctcgaggaaaaaaacatccttgccgagcagcttcaagcggagactgaactgtttgccgaggctgaagagatgagagcccggcttgccgctaagaagcaggagctggaggagatattgcacgatctggaatcacgcgtggaagaggaagaggaacgaaatcagatcctacagaacgagaagaagaaaatgcaggcacatatccaggatctcgaggagcagctggatgaggaggagggcgcacgacagaaacttcaactggagaaggttaccgctgaggctaagatcaagaaaatggaagaggaaattcttctcttggaagaccaaaatagcaagtttattaaggagaagaagctgatggaagatcgaatcgcggagtgcagctcccagttggccgaggaggaagagaaagctaaaaatctggccaagataagaaataagcaagaggtcatgatcagcgacctggaagagcgtttgaaaaaggaggagaaaactcgccaggagttggagaaggctaagcgaaagttagatggtgagaccactgatctccaagatcagattgctgaactccaagctcaaatcgacgaacttaaacttcaattggccaagaaggaagaggagttgcagggcgctctagcccgcggggacgacgaaaccctgcacaagaataatgctctcaaagtggtgcgtgaactgcaggcccagatcgctgaactgcaagaggacttcgagtcagaaaaggcttcccgcaataaggcggaaaagcagaaaagggacttgtccgaagaactggaagctctgaagacggagctagaagacactctggatactacagcagcacagcaggagctgcggaccaagcgagaacaggaggtggccgaactgaaaaaggcacttgaggaggagactaagaatcatgaggcacaaatacaggacatgagacagaggcatgctaccgctttggaagaactttccgaacagctagagcaagccaagaggtttaaggccaatctggaaaaaaacaagcaggggctcgagactgataacaaggaactggcgtgtgaggtcaaagtcctccagcaggtaaaggcagagagcgagcataagcggaagaagttagatgcccaagtgcaggagctccacgctaaggtatccgaaggcgatcgcctcagggtggaattggccgaaaaagcgagtaagctccagaatgagctggacaacgtgagcacgctgctggaagaagctgagaagaaagggatcaagttcgcaaaagatgctgccagcttggagagtcagctccaggatacccaagagctgcttcaggaagagacacggcagaaactaaatttgtcctcaaggatacgacagctggaagaagagaaaaatagcctgcaggaacaacaagaggaagaagaagaggcacgcaaaaacctggaaaagcaggtcctggccttgcagagccagttggctgataccaaaaaaaaagtcgacgacgatcttggaacgattgagtccctggaagaagcaaagaagaagcttttgaaggatgcagaagccctcagtcagagactggaggagaaggccctcgcctatgacaaactcgagaagaccaagaatcgactgcagcaagagctggatgatctgacggtggacctggatcatcagaggcaggtagcttctaatttggagaaaaagcagaagaagttcgaccagctactagccgaagagaagtcgatttctgctcgttacgctgaggaaagggacagggccgaagcggaggctagagagaaagagacaaaggctctatccctggcccgggcgcttgaagaggctctagaggccaaggaggagtttgaacgccagaacaaacagctgagagccgatatggaggacctgatgtcaagtaaagatgacgtgggcaagaacgttcatgaactggagaaatctaagagagcactggagcaacaggttgaggagatgcggactcaattggaagagctcgaagacgaactgcaagccacagaggatgcaaaattgcggctcgaggttaacatgcaggcgatgaaagcgcaattcgaaagagacctccagactcgcgacgaacaaaacgaagaaaagaagcgactgttgattaagcaggtgcgcgaacttgaggctgagctggaggacgagagaaagcaacgcgccctggccgtggcttctaagaaaaaaatggaaatagatctgaaagacttggaagcacagatagaggccgcaaacaaggctcgggacgaggtcattaagcagctcaggaagctacaggcccagatgaaagactaccagagggagttggaagaggcccgagcctccagggatgagattttcgcgcagtctaaggagtctgagaagaaacttaagtctctcgaagccgagatcctgcaactgcaggaagagttggctagcagtgagagagcccggaggcatgcggagcaagagcgcgatgaactcgcagatgaaattacaaactccgcatcaggcaaaagtgccctgctggacgaaaagcggcgcctcgaagctaggattgcgcagctcgaggaggagttggaggaggagcagagcaacatggagctgctcaatgacagattcagaaagaccacccttcaagtcgatacgctgaacgcagagctggccgcagaaagatctgccgcccagaagtctgacaacgccaggcaacagcttgaacgtcagaacaaggagctgaaggcaaaactgcaagaactggagggagcggttaagagtaagtttaaagcaacaatttccgcgctcgaagccaagattggacaactggaagagcagctcgagcaggaggccaaggagagggctgcggcaaataaactagttaggcggacagagaagaagttgaaagagatttttatgcaggtcgaggacgagcggaggcatgccgaccagtataaagaacagatggaaaaggccaacgctcgcatgaagcagttgaaacgccaactagaagaggccgaggaggaagccacccgggccaatgcctccaggagaaagctgcagagagagttggacgacgccacggaagctaatgaaggccttagccgggaagtttcaaccctgaagaacaggctacgtcggggggggccaatctccttcagttcaagccgcagcggcagacgtcagcttcatcttgagggagctagcctggaattatccgacgacgacactgagagtaaaactagcgacgtgaatgaaacccagccaccccagtccgagtag

SEQ ID NO: 16195 - DNA, 5979 bp, Artificial Sequence
  Description of Artificial Sequence: Synthetic coding sequence
atggcgcagagaacgggccttgaggacccagagcggtacctgtttgtagatcgcgccgtgatctacaatccagccacacaggccgactggaccgctaagaaactggtctggatcccttcggagcggcacggcttcgaagcggccagcattaaggaggaaagaggcgacgaagttatggtggaattagccgagaacggtaaaaaagctatggtgaataaggacgatatacagaagatgaatcctccaaagttctcaaaggtagaggatatggccgaactcacttgcttgaacgaggcatcagttctccataatctcaaggataggtactactctggtcttatctatacctacagcggactgttctgcgttgtaatcaacccatataagaacctccccatctacagtgaaaacatcatcgagatgtatagaggtaaaaaacggcacgaaatgcctccacatatctacgccatttcagagtcagcctaccgctgcatgctccaggacagggaagatcaaagtatactgtgtacgggagagtcaggagctggcaagaccgagaatactaagaaggttatacagtacttagcccacgtggcctcttcccataagggacggaaggatcacaacattccacaagagagtccgaaaccggttaagcaccaggcaagcgccttactgtatggtgagctagagcgacaactgctgcaggcaaaccccatcttggaatctttcggcaatgctaaaactgtcaaaaacgacaacagtagccgtttcggtaaattcatccgcatcaatttcgatgtgactgggtacatcgtcggtgccaacatcgaaacatacctcctggaaaagtccagggcagtacgccaggcaaaagacgagaggacgtttcacattttctaccagttgctgtccggcgccggtgagcacctcaaatctgacctcctgctggaaggctttaacaattacaggtttctctccaatggatacatcccaattccaggccagcaggataaggacaactttcaagagaccatggaggctatgcatatcatgggcttcagtcacgaagaaatattgagcatgctgaaggtagtgtcctccgttctccaattcggtaacatcagtttcaaaaaggagcgcaacaccgatcaggcatcaatgccagaaaacacagtcgcccagaagctgtgccaccttttgggtatgaacgttatggaatttacaagagcgatactcactcccaggatcaaggtggggcgggactatgttcagaaagctcagactaaggagcaggctgattttgcagttgaagccttggcaaaggccacctacgaaaggctctttcggtggctggtccacaggatcaacaaagccctcgaccggaccaaaagacagggagcgtcattcattggcatactggatatagctggattcgagatattcgagctgaactcattcgagcagctatgcattaattacaccaacgaaaagctccagcagttatttaatcacacaatgtttattttagagcaggaggagtaccaaagagagggaatcgaatggaattttatcgactttggactggatctgcagccttgtatcgacctgatcgaacggcccgccaatccaccgggggtcctggcattgctagacgaagagtgctggttccccaaagcaacggataaaacatttgtggaaaaactcgtgcaggagcaaggtagccattccaagtttcagaagccccgacaactgaaagataaagccgatttttgcataatccattacgccggcaaggtcgattataaggccgatgagtggctcatgaaaaatatggaccccttgaacgacaatgtggccacattgctgcaccagagctctgacaggtttgtggcagagctctggaaagacgtggacaggattgtgggcttggaccaagtgacaggcatgacggaaacagcattcgggtccgcctataagacaaagaaagggatgtttcggacagtgggacagctgtacaaagagtcgctgaccaagttgatggccactctgcgcaataccaaccccaacttcgtgcggtgcatcatccccaatcatgagaagagggccggaaagttggacccacacctggttctcgatcagttaagatgcaatggcgtgcttgagggcataaggatctgtagacagggcttcccgaacagaatcgtgttccaggaattccggcagcgatatgaaatcttaactccaaacgccatccctaaagggtttatggatggtaaacaggcttgcgaacgaatgattcgtgccctagaattggaccccaatctgtatcgaattgggcagagtaaaattttcttcagagccggtgtactcgcacacctggaagaagagagagacttgaaaatcacggacatcatcatattttttcaagccgtatgcaggggctatctggctaggaaggcgtttgctaaaaaacagcagcagctttctgcgttaaaagtgcttcagcgcaattgcgcagcctatctcaagctgcgccattggcagtggtggagagtgtttaccaaagtgaagcctctcctgcaggtgacgcggcaggaggaggaacttcaggcaaaagacgaggaactcttaaaagtgaaggaaaaacagacaaaggtcgagggagaactggaagagatggagcggaaacatcagcagctgctggaagaaaagaacattttagcagaacagcttcaggccgagacagagctctttgccgaagctgaagaaatgagagcaagactcgcagctaagaaacaggaactggaagagatcctacacgatttggagtcccgggtggaagaggaagaagagcgcaatcagatcctacagaacgagaaaaagaagatgcaagctcatatacaagatctggaggagcaactggatgaggaagaaggagcgcgtcagaaattacaactggaaaaagtgacagcagaagcaaagattaagaagatggaagaagagatcctgctactagaggatcagaactcaaagttcatcaaagagaaaaagctcatggaagaccgcatcgctgaatgttcctcacaacttgccgaagaggaggaaaaggctaaaaatctggctaagatccggaacaagcaggaagttatgatttccgaccttgaagaaaggctcaaaaaggaggagaagaccaggcaggagctagagaaagccaaacgcaaacttgatggcgagaccactgatctgcaggatcagattgccgaattgcaggcccagattgacgaattaaagctgcagttggctaagaaagaggaagaactgcagggcgcactcgcccggggtgacgatgagacactccacaaaaataatgccctcaaggttgttagggaattgcaggctcaaatagccgagttacaggaggatttcgaaagtgagaaagcctctcggaataaggccgaaaagcagaagcgggacctctccgaagagctagaggctctcaagaccgaactggaagacacgctggataccacagccgcacagcaagagttacgtactaagagggaacaggaggtcgccgagctgaagaaggccctggaagaagaaactaagaaccatgaggcacagattcaggacatgaggcagcgacacgcaactgccctggaagagctgtcagagcagctcgagcaggcgaaacgatttaaagccaacctggagaaaaacaagcaaggcctggaaaccgacaataaggagctagcatgcgaagttaaggtgctacagcaagtgaaggccgaatcagaacacaaaaggaagaagttggacgcccaagttcaggaactccacgccaaagtctctgaaggcgacaggttgagagtcgagcttgcagagaaggcttccaagctgcagaacgagctggacaatgtcagcacactactggaggaggctgagaaaaagggaattaagtttgctaaagatgccgctagcctcgagagtcaactccaagacacccaggaactgctccaggaagaaacccggcagaagctaaatctgagctctagaattaggcaactagaggaggagaaaaattccttgcaagaacagcaggaggaggaggaagaagcacgtaaaaatctggaaaaacaggtcctggctctgcagtcacaactggccgacacaaaaaaaaaagttgatgacgatttaggaactatcgagtctctggaggaggctaagaagaaactcctcaaagacgccgaagcactgagccaacggctcgaagaaaaagccttagcttacgataaactggagaaaaccaaaaaccggctccagcaggagctcgatgatcttacagttgacttagaccatcaaaggcaagtggcctccaatctcgaaaaaaaacagaagaagttcgaccagctgctcgccgaggaaaagagcatctcagcacgttacgccgaggagcgggatagagccgaggctgaagcccgcgaaaaagagacgaaagctctgtccctcgctagggctctggaagaagccctggaagctaaagaggagtttgaacgacagaacaagcagctgagggcggacatggaagatctgatgagcagtaaggatgatgtcggaaagaacgtacacgaactcgagaaaagtaaacgggccctggagcagcaggtcgaagagatgagaactcagctggaagaactcgaggacgagctgcaagcaacggaagatgccaaactgaggctggaggttaacatgcaggctatgaaagcacagttcgaaagagacctccagaccagggacgaacagaacgaggagaagaaacgcctgctcatcaaacaggtgcgcgagttagaggcagagctggaagatgagaggaaacaacgagcactcgcagtggcctccaagaaaaagatggaaatcgacctcaaggatctggaggcacagatcgaagcggctaacaaggcaagggacgaggtcatcaagcagctgcgaaagctgcaggcccaaatgaaggactaccagagggaactagaggaagcaagagcaagtcgggacgagatctttgctcagtctaaagaaagcgagaaaaagctgaagtctctggaggccgagatcttgcaattacaggaggaactggcttcaagtgagcgagcccgaagacatgcagagcaggagcgggacgagctggcggatgagatcactaacagtgcctctgggaaatcagccctgttagacgagaaacgtcgtctagaggcaagaatagcccagctcgaagaagaactggaggaggaacaatccaatatggaattattaaacgatcgttttagaaagactaccttgcaggtcgatacattaaatgctgagctcgccgctgaaagatcggctgcgcagaagtctgacaatgcccggcagcagctggagcgacagaataaagaactcaaggccaaacttcaggagctggagggtgcagtaaagtccaaatttaaggccacaataagcgccctggaggctaaaatcggtcagctcgaagagcagcttgagcaggaggcaaaagagcgtgccgcagctaacaagcttgttcgacggaccgagaagaagctgaaagagatatttatgcaggtggaagatgagagacgtcacgctgaccagtataaggagcagatggagaaagcaaatgctcgtatgaagcagcttaaacgccagctggaggaggcggaggaagaggctacaagagccaatgcttcccgtcgcaaactacagcgggagttggatgatgccactgaagcaaacgagggcttgagccgcgaagtgtctaccctgaagaataggctgagaaggggcggacccattagctttagctcgtctaggagcgggcgtcgacaactgcacctggagggcgcctccctggagcttagcgacgacgatacagagtccaagacatccgacgtaaacgaaacgcagccccctcagtccgagtag

SEQ ID NO: 16196 - DNA, 5994 bp, Artificial Sequence
  Description of Artificial Sequence: Synthetic coding sequence
atggcccagcggactggactggaggacccagaaaggtacctgtttgttgacagggctgtgatctataatccagccacacaggcagactggacagctaagaaacttgtgtggatcccctccgagcggcatggctttgaggccgcctctataaaggaagaacgaggggacgaggtgatggttgagctggctgagaacggtaagaaagccatggttaataaggatgatattcagaaaatgaaccctccaaagtttagcaaggtcgaggacatggccgagctgacgtgccttaacgaagctagcgtgctgcacaatctgaaggatcggtattatagcgggctcatatacacatactcaggtctgttctgcgtcgtaattaatccctataagaacctaccaatttactcagagaacatcattgagatgtacagaggcaagaaaagacacgaaatgccccctcacatatacgcaatctcggagagtgcctatcgttgtatgcttcaggatcgagaagaccagtccattttgtgcacaggcgaatccggagcaggaaaaaccgaaaataccaagaaggtcatacagtatttagcccatgttgcatcaagccataagggacgcaaggatcacaatatccctggagagctcgagcggcagcttctccaggccaatccaattctcgaatcctttggcaatgcaaaaactgtgaagaacgataatagctcaagattcgggaagtttattaggatcaatttcgacgtgaccggctatattgtgggtgctaacattgagacctatcttctggagaagagtcgggccgtgaggcaggcaaaggatgaaaggactttccacatcttttaccaactgttatcaggagcgggtgagcacctgaagagcgatctcctgctggaggggttcaataactaccgatttttgagcaatggttacatccccatcccagggcagcaggataaagataacttccaggagaccatggaggctatgcatatcatgggattttcccatgaggaaatcttgtccatgttgaaagtggtctcatcagtgctgcaattcggcaacatcagctttaaaaaggagaggaacactgatcaggcttcaatgccagaaaacacggtcgctcagaagttgtgtcatctactgggcatgaatgtcatggagtttaccagggcgatcctaacccctcggatcaaggtgggtcgcgattacgtccagaaagcacagaccaaggaacaagccgactttgcggtagaggcgctggcgaaagcaacttatgaaaggctctttagatggctggtacacagaataaataaggcattggataggaccaagagacagggcgcttccttcattgggatcctcgacatcgctgggttcgaaatttttgagctgaacagttttgagcaactctgtattaactatacgaatgagaagctccagcaacttttcaaccacacgatgttcattctggagcaggaggagtaccaaagagaaggcattgagtggaatttcattgatttcggtctggatctgcaaccctgtattgacctgattgaacgtcccgcaaacccccctggagtgttggcgttgctggacgaggaatgctggtttccaaaggccacggacaagacattcgtcgaaaagctcgtacaggagcaggggagtcattccaaatttcagaagcctcggcaacttaaggataaggctgacttttgtattattcattatgcagggaaggtagactataaggccgacgaatggctgatgaagaatatggatccactcaatgataacgtggccactttgctgcaccagtcctcggatagattcgtggcagaactgtggaaagatgagatacaaaacatacagcgggcgtcattctacgacagcgtaagtggactgcacgagccacctgttgacaggattgttggcctagaccaggtcacaggtatgaccgagaccgccttcggatcggcttacaagactaagaaaggaatgttccgcaccgtgggacaactttacaaggagtcacttaccaagctgatggctacattgcgcaataccaaccccaactttgtacggtgtatcatccccaaccatgaaaaacgggccgggaagttggatccacacctagtgctggaccaattacgatgcaacggagttctcgaagggattcgcatttgtaggcaggggttcccaaatcggattgtgttccaggaattcaggcagcgttatgagatacttactccaaatgccatccctaagggctttatggatggcaagcaggcctgtgagaggatgataagggccctggaactggaccctaacctctatcggatcggacagagtaagatcttctttagagctggtgtccttgcccatctggaggaagagcgagatctaaaaattactgatatcattattttttttcaagctgtttgtcgggggtacctcgcacgaaaggcattcgcaaaaaagcaacagcagctttcagctctaaaagtattacagcgtaattgtgccgcttacctcaaacttaggcattggcagtggtggagagtgtttactaaagtgaagcccctcctgcaggtgacaagacaggaagaggagcttcaggccaaagatgaggaactgctgaaggttaaggaaaaacagactaaggtggaaggagaactagaggagatggagagaaaacaccagcagctgctggaagagaaaaacatcctggccgaacagttgcaagctgaaacggagctgtttgctgaggccgaagagatgcgggctcgacttgcagccaaaaagcaggagctggaagagatactacatgacctggagtcaagagtggaggaagaagaggaacgtaaccagattctccaaaacgagaagaaaaaaatgcaggcccatatccaagatctcgaggaacagctggatgaggaggagggtgctcgacagaagctgcaactggaaaaggttacagccgaggccaagattaagaagatggaggaggagattctgctattagaggatcagaacagcaaattcatcaaggaaaaaaagctgatggaagacagaatcgcggaatgtagttctcagttagcggaagaggaggagaaagccaaaaacttggcaaaaattcggaacaagcaggaggtaatgatctctgacttggaagaaaggctaaaaaaggaggagaagactcggcaggaactcgaaaaagccaagcgtaagcttgatggtgagaccacggacctccaggaccagatcgccgaattacaggcgcagatcgacgaattaaagttacagctagccaagaaggaggaggagttgcagggcgccctggcacgaggggacgatgagactcttcataaaaataatgctctgaaggtggtgcgggagctgcaagcacaaatcgcggagttacaggaggatttcgagagcgaaaaagcttctcgcaacaaagcagaaaagcagaagcgcgacctgtccgaagaactggaggctctgaagaccgagctagaggacacgttggatacaacagcagctcagcaggagctaaggactaaacgtgagcaggaagtcgctgaactcaagaaggcattagaagaagagacaaagaatcacgaggcacagattcaggacatgcggcagaggcacgctaccgccctggaagagctctccgaacagctggaacaggccaagcggtttaaggccaacctggaaaagaacaagcagggcttagaaaccgacaataaagagctggcatgcgaagtgaaagtattgcagcaggtcaaggccgagtcagagcacaaacggaaaaagcttgatgcccaggtgcaagaactgcacgctaaggtgtcggagggtgacaggctgcgagtcgaattggccgaaaaagcttctaaactgcagaatgaactggacaacgttagtacgctcttggaagaggccgagaaaaaaggcatcaagttcgctaaagatgccgcgtccctggagtctcagttacaggacactcaagaacttttacaggaggagaccagacaaaagcttaacctgagtagcaggatcagacagctggaagaagaaaagaactcactgcaggagcagcaggaggaagaggaggaagctcgcaaaaatcttgagaagcaagtgttggctctgcagagccagcttgccgataccaaaaagaaggtagacgatgatctcggcacaatcgagtcacttgaggaggctaagaaaaagttgttgaaggatgccgaagccctgagccagcggctagaagagaaagcccttgcttatgataagctggagaagacaaaaaacagactccaacaggagctcgacgacctgaccgtcgatttggatcatcagaggcaagtagcttctaacttggagaaaaagcagaaaaaatttgaccagctgctggcagaagagaagtctatttccgctcgctacgccgaagagagagaccgagcagaggccgaggcaagagagaaggagaccaaggctctgagcctggcccgcgctctggaagaggccctggaggcaaaggaggagtttgaacgtcagaacaagcagctgcgggcagatatggaagacctgatgtcatccaaggacgatgtaggcaaaaacgtgcacgagctcgagaaaagtaagagagccctggaacaacaagtggaggagatgagaactcaactggaggaactcgaagatgagctgcaggctacggaggatgctaaattgcggctagaggtcaacatgcaggcgatgaaagcccagttcgagagagatctacagacacgggacgaacaaaacgaagaaaagaagcggttacttatcaagcaggtcagggagctggaggcggaactggaggacgaaaggaagcaacgcgctctggccgtagcatctaaaaaaaaaatggagatcgacctgaaggatctggaagctcaaattgaagctgcgaataaggcgagagatgaggtgattaagcaattgaggaagttacaggctcaaatgaaagattatcagcgcgagctggaagaggccagagccagcagggacgaaatctttgctcagtccaaagagagcgaaaagaagctcaagagcctggaggccgaaattctgcagctgcaagaggaacttgcatcgtcagagcgcgcccgaagacacgccgagcaagaacgcgacgagctggccgacgaaattacaaattcagccagcgggaagagcgcgctgctcgatgaaaagcgcaggctcgaggcccgtatcgcacagctcgaagaggagcttgaggaggagcaatcaaacatggaacttttgaatgacagatttcgaaaaacaaccctccaggttgacaccctcaatgccgaacttgccgcggaaaggtccgcagctcaaaagagcgacaacgcccgacagcaactagaaagacaaaacaaggagctcaaagcgaagctccaggagttggagggggcagtaaagagtaaattcaaagccacgataagcgcgctggaagccaaaatcggccaactagaggagcagcttgagcaggaagcaaaggaacgggccgccgcaaacaagctggtgcggcgcactgaaaaaaagttgaaagagatctttatgcaggtcgaggatgaaaggagacacgccgatcaatacaaagagcagatggagaaagcaaatgccaggatgaaacaacttaagagacaactggaagaagccgaagaggaggccacccgagccaatgccagccggcgtaagcttcagagagaactggacgatgccaccgaggccaatgagggactgagtagagaggttagtacgcttaagaaccgtttgcggcgaggtggcccaatcagtttttcaagcagtaggtctgggcgcaggcagctgcacttagaaggggccagtctggagttgagcgatgatgacacggagtccaaaacgtccgacgtcaacgagacacagcctccacaatccgaatag

SEQ ID NO: 16197 - DNA, 567 bp, Artificial Sequence
  Description of Artificial Sequence: Synthetic coding sequence
atggctcagaggacaggcttggaggaccctgaacgatatctcttcgttgatcgcgccgtcatctataatccagctacccaggcagattggactgctaagaaattggtgtggattccctcagaacgccacgggttcgaagccgcttccataaaggaagaacgtggtgacgaagtgatggtcgaactcgcagagaacgggaaaaaagctatggtgaacaaggacgatattcagaagatgaaccccccaaagttcagtaaagtggaagatatggctgagttgacatgtcttaacgaagcgtctgtcctgcataacctcaaggataggtactatagcggactaatctacacctactctggtcttttttgcgtggtgattaacccgtacaaaaacctgccaatctactctgaaaatattattgaaatgtaccggggcaagaagcgacacgagatgcctccacatatctacgcaatttcggagagcgcttaccggtgcatgctacaggatcgggaggaccagagcatcctctgtaccggtgaatcaggtgctggcaagactgagaacacatag

SEQ ID NO: 16198 - DNA, 1446 bp, Artificial Sequence
  Description of Artificial Sequence: Synthetic coding sequence
atgtatgacgcggaaagaggttggtcgttgagctttgccggctgtggcttcctcggattttatcacgtgggcgccacgcggtgcttgtctgagcatgcaccacacctgctgcgtgatgcaaggatgctctttggagccagcgcgggcgctctgcattgtgtgggcgtcctgagcggcattccattggaacagaccttgcaggtgcttagtgatctggttcggaaagctcgctcccggaacatcggaatcttccacccttcctttaacttgagcaagttcctgcggcagggcctgtgcaagtgtctcccggctaacgtgcaccagctgatcagcggcaaaatcggaatcagcctcactcgggtgagtgacggcgaaaatgtgctcgtttcagatttccggtctaaggacgaagtggtagacgcactggtgtgcagttgctttatcccgttctacagtgggctcatacccccaagctttcggggcgtgcggtacgtggatggaggagtgtcagacaacgtgcctttcatcgacgcaaaaaccacgatcactgtttcacctttctacggagagtacgacatttgcccaaaagtgaaatctaccaacttcctccatgttgacatcacgaaactatcattgcgcttatgtacgggtaacctataccttctgtctcgcgcttttgtcccaccagatctgaaggtgctcggcgagatatgtctgaggggctacctcgacgcctttcgcttcctggaggaaaaggggatctgcaatcgcccccagccaggcttgaaatcctcctcagaggggatggatcccgaggtggccatgccctcttgggccaacatgagcctcgacagttcccccgaatctgcagccctggccgttcggctggaaggggacgagttgctcgatcacttacgcctgagcattcttccctgggatgaatctatcttggacactctctcacccaggctcgccaccgccttaagcgaagaaatgaaggataaaggcgggtacatgtctaaaatttgcaatctgttacctattagaataatgagctatgtcatgctaccgtgcaccctgcccgtggagagcgccatcgctatcgtccagaggttagtgacatggttacccgacatgcctgacgatgtgctgtggctgcagtgggtgacctctcaggtcttcacacgggttcttatgtgcttgctacccgcttctagatctcagatgcctgtctcctcacagcaggcgtccccatgtacgcctgaacaagactggccatgttggacaccttgtagcccaaaggggtgtcccgccgaaaccaaagccgaggccaccccccgcagcatactgcggagcagcctgaatttcttcctcgggaataaggtcccggccggcgcagaggggctgtctaccttcccctcatttagtctcgaaaagtctctttag

SEQ ID NO: 16199 - DNA, 4149 bp, Artificial Sequence
  Description of Artificial Sequence: Synthetic coding sequence
atgtacaaaggtaagaagagacatgaaatgccgccccacatctacgctatcacagacaccgcttatcggagcatgatgcaggatagggaagatcagtccatcttgtgtaccggggagtccggagccggcaagaccgaaaataccaaaaaagtgatacagtatctcgcgtatgttgcttcatcacataaatcgaagaaagatcaaggcgagctggagagacagctcctacaggctaaccccattttagaagctttcggaaatgccaagaccgtgaaaaatgacaacagcagcagattcggtaagttcattagaatcaatttcgatgttaacggctacattgttggggccaatatcgagacatacctgctggagaaaagcagagctatccgccaggccaaagaggagaggacctttcacatcttttactacttgctgagcggtgccggtgagcacctcaaaaccgatctgttactagaaccctataataagtaccggtttttgtcaaacgggcacgtgactatcccaggtcagcaggataaggatatgttccaggagaccatggaagcgatgcgcattatgggcatacctgaggaggaacaaatggggctgctgcgggtgatcagcggggtcctgcaactcgggaacattgtgtttaagaaggaaagaaatacagaccaggcatctatgcccgataacacggcggcccagaaggtgagtcacctgctcggaatcaacgtgacagactttacaagagggatacttactccacggatcaaggtcggacgtgattatgtccagaaagcgcaaactaaggaacaggccgattttgctatagaggctctggccaaggcaacgtatgaacggatgttcagatggttagtcctgcggatcaataaggcgctggacaagacgaagaggcagggcgcctctttcattggtatcttagacatcgctggcttcgaaatctttgacctgaactcttttgagcagctctgcatcaattacacaaacgagaaattgcaacagctcttcaatcacacaatgtttattctcgagcaggaagagtatcagcgagaagggatcgaatggaattttatagatttcggcctcgacttgcagccttgcatagaccttatcgaaaagcctgcggggccccctggaatcttggcactccttgatgaggaatgctggttcccaaaggcgacggataagtccttcgttgagaaggtgatgcaggaacaaggaacccacccaaagttccagaagcccaaacagctgaaggataaggccgatttctgcatcattcactacgccggaaaagtggactacaaggccgacgaatggctgatgaagaatatggaccctctcaacgacaacatagcaactttgctgcaccagtccagtgacaagtttgtgtcagagttatggaaagacgtcgatcggatcatcggcctagaccaagtcgccggaatgtctgaaacggccctacccggtgccttcaaaaccaggaaggggatgttcaggacagtcggtcagctgtataaagagcagttggccaagctgatggctactctccggaacaccaaccccaacttcgtgcggtgtatcattcccaaccacgaaaaaaaagctggcaagttagacccacacctggtcttagatcagctccggtgtaacggagtgttagagggaattagaatctgtagacagggctttccaaaccgtgtggtctttcaagagttcaggcaacggtatgaaattctgacgcccaattctattccaaaagggtttatggacggtaagcaggcctgcgtgctcatgatcaaggcactggagctggattccaacctatacagaattggtcaaagcaaggtcttctttagggcgggcgtccttgcccatctggaggaggaacgggacctgaagatcactgatgtgattataggattccaagcctgttgtcgcgggtatcttgccaggaaagcattcgccaagagacagcaacagctgaccgctatgaaggttctgcagcgcaattgcgctgcatacctcaagctgcggaattggcaatggtggaggctgttcacgaaggtgaaaccactgctgcaggtatcccgtcaggaggaggagatgatggccaaggaagaggaactggtgaaggtgcgagagaaacaactggcagcagagaaccggctgacagagatggaaaccctgcagtcgcagcttatggcagagaaacttcagttacaggaacagctccaagccgaaaccgagctttgtgccgaagctgaggaattaagagccaggctgactgccaagaagcaagaacttgaggagatatgccacgatctggaggccagagtcgaagaggaggaagaacgctgtcaacacctgcaggcagaaaagaaaaagatgcagcagaacattcaagaattggaggagcaacttgaagaggaggaaagcgccaggcagaagctgcagctggagaaggtgacaaccgaggcgaaactgaaaaagttggaggaagagctggacgatctcctggttgacttggatcatcagcggcaatcagcgtgtaatctggaaaagaaacagaagaagttcgatcaactgcttgcggaagaaaagaccataagtgctaaatacgccgaggaaagagacagagctgaggcagaggctcgggaaaaagagaccaaggccctgtctctggcccgagcactcgaagaggctatggagcaaaaggccgaattggagcgcctgaacaagcaattccggacagaaatggaggacctcatgtctagcaaggacgatgtcgggaagagtgtacacgagctggaaaaaagcaaacgcgccttagagcagcaagtggaggaaatgaagacacagctcgaagagttagaggatgaactgcaggcgacagaagatgctaagctgcgtctggaggtaaatctgcaggccatgaaggcacaatttgagagggacctgcagggacgggatgaacagtctgaagagaaaaagaagcagctggtaagacaggtcagggagatggaggctgagttggaagatgaacggaaacagcggagcatggccgtcgccgcacggaagaagctcgaaatggacctcaaggatttagaagctcacatagactcagcaaataaaaatcgcgacgaggctattaagcagctaaggaagctacaggcccagatgaaggattgcatgcgggagctagatgacacccgcgcctcccgggaagagattctggcgcaggccaaggaaaatgaaaagaaactgaagagcatggaggctgaaatgatccaattgcaggaagaactcgcagccgcagaaagggccaagagacaggcccagcaggagcgagacgagctggcagacgagattgccaactcgtcaggcaagggcgcattggcgctcgaggagaagcgcagactggaggcccgtattgcccaactggaagaggagctggaagaagaacaggggaacacagagctgattaacgatagactgaaaaaagctaatttgcagatcgatcagattaacacagatttgaacctggagcggtcacacgcccagaagaacgaaaacgcaagacagcagctggaaaggcagaataaagagttgaaagtcaagttgcaggagatggaagggactgttaaaagcaagtacaaagcaagcattacagcgctggaggctaaaattgctcagctcgaagaacagctcgacaacgaaactaaagagagacaggccgcctgtaagcaggtgagacgtacagaaaagaagctgaaggacgttcttcttcaagtcgatgatgaaaggagaaatgccgagcagtacaaggaccaggccgacaaggctagtactcggctcaaacagctcaaaagacagctcgaagaggccgaggaggaagcccagcgggcaaatgcttctcggcgcaaactccagcgcgaacttgaggacgcaactgaaactgccgacgcaatgaacagggaggtatctagtctgaaaaacaagcttcgccgcggcgacctgcccttcgtcgtgccccgcaggatggctaggaagggggcaggggacggctccgacgaggaggtggacggaaaagctgatggggctgaggccaagcctgccgaatag

SEQ ID NO: 16200 - DNA, 1689 bp, Artificial Sequence
  Description of Artificial Sequence: Synthetic coding sequence
gcttcaggaaccagaaggcgatggccacccacgacttcttggaggaggccacgcagaggatgcagcaggtcttggaccacctgctggtggacctggacgaccagtgctcgggccagggcgacctggaggcggtcccgtaggtccctaacctctagctggaggcgaagacgcccttcgctgcccagcatgcagcgaagcgcaacaggattgcggcgacggccggagcgtaggagaccccgcctctgcagatggcccggacccgaagaagctatggaacagaaagccgaactcgagcgcctgaacaagcagtttagaaccgagatggaagaccttatgtcttccaaggatgacgtcgggaagagtgtacatgagctggaaaaaagcaagagagctctggaacaacaggtagaggagatgaagacacagctggaggagctggaggatgagctacaagctaccgaggatgccaaacttcgtcttgaagtgaacttgcaagctatgaaggcccagtttgagcgcgacttgcagggaagggacgagcagtctgaagagaagaagaagcagttggttcgccaggtgcgcgagatggaggccgaactcgaagacgaacgcaagcagaggagtatggccgtagctgcacgcaaaaagctggaaatggaccttaaagacctggaggcacacattgatagtgcaaacaagaacagagacgaggccatcaaacagcttagaaaactacaagcgcagatgaaggactgcatgcgagagcttgatgacacacgggccagtcgcgaagagattctcgcccaggcaaaggaaaacgaaaagaaactgaaatctatggaggctgaaatgatccagctgcaagaggagctcgcagcggcagagagagctaagaggcaggcccagcaggaacgggacgagctggccgacgagatcgcgaattcgtcagggaaaggtgctttagccctcgaagagaaaaggagactagaggctcgaatcgcccagttggaggaagagctggaagaggagcaggggaacacagaactgattaacgaccggcttaagaaggccaatctacaaatcgaccaaataaacacagatttgaacctggagcggtctcatgctcagaaaaatgaaaacgcaagacagcagctggaacgacagaataaggaattgaaggtgaaactgcaagaaatggagggcaccgttaaaagcaaatataaggcgtccattactgcacttgaggctaaaattgcacaactcgaagagcagctggacaacgaaacaaaagaaagacaggccgcatgtaaacaggtgaggcgtactgaaaaaaaacttaaggatgtcctcctgcaggtcgatgatgagaggcgtaacgctgaacagtacaaggaccaggccgataaagcttccaccaggttgaagcaactgaagaggcagttggaagaggccgaagaggaggcccagcgggcaaatgcgagcagacgcaaactgcaaagagagctggaagacgctacagaaaccgctgatgctatgaatcgggaggtcagctcactcaagaacaaactgcggcggggagacctgccttttgtggtgccccgcagaatggcccgaaaaggtgccggcgatgggagcgacgaggaggtggatgggaaagcagatggtgccgaggctaagcctgcagagtag

SEQ ID NO: 16201 - DNA, 657 bp, Artificial Sequence
  Description of Artificial Sequence: Synthetic coding sequence
atggcccagcaggccgcggataagtacctgtatgtggataaaaatttcatcaacaaccccttggcgcaggctgactgggccgccaaaaagctggtctgggtcccctccgacaaatcaggattcgagcccgcatctctgaaggaggaggtgggagaagaggccatcgtggagctggtcgaaaatggcaaaaaagtgaaagtcaataaagatgacatacagaagatgaaccctccaaaattttcaaaagtggaagatatggccgagctaacatgcctgaacgaagcgtctgttctacacaaccttaaggagcgttattactctgggcttatctacacctatagcggcctgttctgtgtggtcatcaacccatataaaaatctcccaatatactccgaggagatcgtcgaaatgtataagggaaagaagagacacgagatgcctccgcatatctacgccattactgacacggcctaccggagcatgatgcaggatcgggaggatcagagtattttatgtacaggcgagtcaggggccgggaaaaccgagaacacaaagaaggtgattcagtacttggcctatgttgcctctagccacaagtccaagaaagatcaggaagcttatttcaagaacagggccgtcagactcggtgtactctag

SEQ ID NO: 16202 - DNA, 312 bp, Artificial Sequence
  Description of Artificial Sequence: Synthetic coding sequence
atggctcagcaagctgcagacaaatatctgtatgttgataagaacttcattaacaatcctctggcacaggccgactgggccgcaaaaaagctggtttgggtcccctccgataaaagcggtttcgaaccagcctcactaaaagaagaggtgggggaagaggcaatagttgaattggtagaaaatggaaagaaggtgaaagtaaacaaggatgatatccagaaaatgaacccacctaaatttagcaaagtggaagacatggcggaactcacctgcctgaatgaagctagtgtgctgcataatctcaaagagtag

SEQ ID NO: 16203 - DNA, 519 bp, Artificial Sequence
  Description of Artificial Sequence: Synthetic coding sequence
atgagctccaaacgggccaaggccaagactaccaaaaagcggccccaaagagccacatccaatgtatttgctatgtttgaccaaagccaaattcaagaatttaaggaggcgtttaacatgattgatcagaatcgtgatggcttcattgacaaggaagatcttcacgacatgttagcaagcctgggcaagaacccaacagatgaatacctggaggggatgatgtctgaagcccccggccctatcaactttacaatgttcctaacaatgtttggagaaaaattaaacggcaccgacccggaggatgtgattcggaacgccttcgcatgctttgacgaagaagcttcagggttcattcacgaagaccacctcagggagttgctgacaacaatgggcgatcgattcactgacgaggaggtggacgaaatgtaccgtgaggctcctattgataaaaagggcaactttaactatgtggagtttacaaggatcctcaagcatggcgccaaggataaagatgattag

SEQ ID NO: 16204 - DNA, 357 bp, Artificial Sequence
  Description of Artificial Sequence: Synthetic coding sequence
atgagttcaaagagggctaaggccaaaaccacaaagaagcggccccagcgcgccaccagtaacgtgtttgctatgtttgatcagagccagatccaggaattcaaagaggccttcaatatgattgaccagaacagggatgggtttatcgataaagaagatttacacgatatgctcgcctcactgggatttatccatgaggaccatctgagggagttgctgacaaccatgggcgaccgctttactgatgaagaggtggacgaaatgtatagggaggctcctatagacaagaaaggaaatttcaactatgtggagtttaccagaatcctcaagcatggagcaaaagataaggatgattag

SEQ ID NO: 16205 - DNA, 927 bp, Artificial Sequence
  Description of Artificial Sequence: Synthetic coding sequence
atgcaggagctgactttgtctccaggcccagccaagcttaccccaaccctggatccaacacatcgaatggagctgattctctccacttcccctgccgagctcaccctggatccggcctgccaacccaagctgccgctagattctacttgccagcctgaaatgactttcaaccccggtcctacagaattgacactcgatcccgaacatcagcctgaggagacgcccgcacccagcctggcggaactaaccctcgaaccagtgcacaggcgacctgagctgttggatgcatgtgccgatctaataaatgaccaatggccgcgcagccgcacaagcaggctgcattcattggggcagtcttcggacgccttcccgctctgcctgatgctcctgtcccctcacccaacattggaggcagcccccgtggtggtggggcacgcccgtttgtcccgggttctcaaccagcctcagagtctgctcgtggaaacggtagtcgtggcccgggcccttcgggggaggggcttcggccggcgcctgatggaaggtctagaggtgttcgcccgggctcgtggcttcaggaaactgcacttgacgacccacgaccaggtgcatttttatacgcacttgggttatcagctcggagagcccgtgcaaggactcgtttttacatcacgcaggctcccagcgactctgctcaacgccttccctaccgccccctctccccggccacctaggaaggcacccaacctcacggctcaagcagccccgcgcggacccaaggggcccccactgcctccaccacctccactgcctgagtgcctgacaatatctccaccagtgccctctggcccgccctctaagtctctgcttgagactcagtatcaaaatgtgcgggggaggccaattttttggatggaaaaggacatctag

SEQ ID NO: 16206 - DNA, 861 bp, Artificial Sequence
  Description of Artificial Sequence: Synthetic coding sequence
atggagctcatcctttcaacaagtcctgctgaattgacactcgaccctgcctgtcaacctaaactcccactggactccacctgccaacctgagatgacatttaatcctggaccaacagaactcaccctggaccccgagcaccagcccgaagagacaccagctcctagcttggcagaactgacactggagcccgtgcaccgacgtcctgagttattagacgcttgcgctgatctcatcaatgaccagtggccccgatctcgtacaagccggttacatagcttagggcaatcttcggatgcgttccccctgtgtctcatgctcctctcgccacacccaaccctcgaggcggctccagttgttgttgggcacgccaggctgagcagagtcctgaaccagccgcaaagcttactggtggagacagtggttgtagccagggcccttcgaggacgagggtttggtaggcgcctgatggaagggttggaagtgttcgcaagagctagagggtttaggaagctgcacctaacaactcatgaccaggttcatttttatactcacctcggataccagctgggcgagcccgtgcagggcctcgtgttcacctcacgacgtctcccagctaccttgcttaatgcatttcccacagcaccctcacctcgcccacctcggaaggccccaaaccttacagcacaagctgcacccagaggcccaaaagggcctccactgcctccccctcccccccttcccgagtgcctgacaatcagcccccccgtgccgagtgggcccccctcgaaatcacttctggagacacagtaccagaatgttagagggcgaccaattttttggatggaaaaggacatttag

SEQ ID NO: 16207 - DNA, 174 bp, Artificial Sequence
  Description of Artificial Sequence: Synthetic coding sequence
atggagctcatactctctacaagcccagccgagctgacgttagatccagcctgccaacctaagctcccactggactctacctgccagcctgagatgacctttaacccggggccaactgagctcacattggaccccgagcatcagccagaagaaacaccagcccccagcctctag

SEQ ID NO: 16208 - DNA, 861 bp, Artificial Sequence
  Description of Artificial Sequence: Synthetic coding sequence
atggagcttatcctgtcaacctctccagccgaactgactcttgatccagcatgtcagccaaagcttccattggattctacttgtcagcctgagatgacttttaatcctggaccaacggagttgacactggacccagaacaccagcccgaagagacccctgccccttccctggctgaattaacactggagccggtgcatcgaagaccagagctgttagatgcctgcgctgacctaattaatgaccagtggccacgcagccgaacctccagactgcattcactgggccagtctagcgacgctttcccattatgcctgatgcttttgagcccccatcccacactggaggctgcccccgtggtggttggccatgctagactgagcagagtccttaatcaacctcagagtctactggtggagacagtggttgtcgcccgtgcactgcggggaaggggctttgggcgccgactgatggagggactggaagtgtttgctcgcgcccgtgggtttcgcaagctccatttaactacacacgaccaggtgcacttttacacacatctgggataccaactcggcgagcctgtccagggcctagtatttacctctcgtaggctgcctgccaccctgcttaatgcattccccactgctccatctcctaggccaccaaggaaggcccccaatctcacagcgcaagctgcccctagaggcccaaaggggcccccgctcccccctcctccaccgctgccagaatgtctcacgatttctccccccgtaccttccggtcccccctcaaaatcattgcttgaaacccaataccagaacgtgcgtggtcggcccattttttggatggagaaggatatctag

SEQ ID NO: 16209 - DNA, 861 bp, Artificial Sequence
  Description of Artificial Sequence: Synthetic coding sequence
atggagctaatactgtctacttctccagccgaattgaccctggacccggcatgccagcctaagctcccccttgacagcacatgccagccagaaatgaccttcaaccccggaccaactgagctgacccttgatcccgagcaccagccagaagaaacccccgctccttccctggctgagctgactctggagcccgttcacagaaggcctgagctattggatgcatgtgccgacctaatcaatgatcagtggccaaggtcacgcactagccgtctccattccctggggcaaagtagtgatgcttttcctttatgcctgatgctgctgtctccgcaccccactctggaggcagcccccgttgtcgtggggcatgcgcgactttccagagttctgaatcagccacaaagcctcctagtggaaactgtggtcgtcgctcgcgccctacgggggcgcggcttcggacgccgactgatggaaggactcgaagtgtttgcccgagctagaggatttagaaaactccacctgacgactcacgaccaggtgcacttctatacccacctaggctaccagctaggcgagccagtgcagggcctcgtctttaccagtaggcgactccctgcgactctgcttaatgcgttcccaaccgctccctctccccggcctcctcgaaaggcgcctaatctcacagctcaggcagccccacgggggcccaaaggccctccactacccccccctccacctttgcctgaatgcctgacaatcagcccccctgtcccttctgggcctccctctaagagcctgcttgaaacacaataccagaatgtcagaggcaggcctatcttctggatggagaaggatatttag

SEQ ID NO: 16210 - DNA, 261 bp, Artificial Sequence
  Description of Artificial Sequence: Synthetic coding sequence
atggaattgattctgtccacatcgccagccgagctgaccttggacccagcctgtcagcccaagctcccactcgatagcacatgtcagcccgaaatgactttcaatccagggccaaccgaactcacgctcgacccagaacaccagccagaggagacacctgcacctagcctggcagagcttactttggagccagttcaccgcagaccggagctgctagatgcatgtgctgacctcataaacgaccagtggcccagatcctag

SEQ ID NO: 16211 - DNA, 30 bp, Artificial Sequence
  Description of Artificial Sequence: Synthetic coding sequence
atggagctgattctcagcacctccccttag

SEQ ID NO: 16212 - DNA, 987 bp, Artificial Sequence
  Description of Artificial Sequence: Synthetic coding sequence
atggctgagctccaggaggtgcagatcaccgaggagaagcctctgctgccaggccagactcccgaggccgcaaaaacacactctgtggagactccatatggctctgtgaccttcacggtctacggaacgcctaagcccaaacggcctgccatactcacttaccatgatgtgggactcaattacaagtcatgttttcagcccctttttcagttcgaggacatgcaggaaattatccagaatttcgtgcgcgtgcatgtggacgcaccgggtatggaagaaggcgctccggtgttccccttggggtatcagtacccatccctcgatcagttagccgacatgatcccatgcgtactgcaatacctgaatttctctactatcatcggggtcggggttggggccggcgcctatattctcgctcggtatgccttaacagggctcaccagctcaatacctgagatgatccttggtcacctgttctcgcaggaggagttgtctggcaatagtgaattaatccagaagtaccgcaacattatcacacacgcccctaacctggataatatcgaactgtactggaacagttataacaatagaagggacctaaacttcgagaggggtggggatattacgctgaggtgcccagtaatgctcgtggtgggcgaccaggccccacatgaagatgccgtcgtcgagtgcaactcaaagctcgatccgactcagacatcctttttgaaaatggccgatagcggtggtcaaccacaattgactcagccagggaaacttactgaggcctttaagtactttctgcagggcatgggctacatggcctcctcttgtatgacaagactatcccgctccaggaccgcttccctgacttcagctgcctctgtggatgggaaccgatctcggagccgcacgttgtcccagagttctgagagcggcacactgtcaagtggccctccaggacatacaatggaggtgagttgctag

SEQ ID NO: 16213 - DNA, 1116 bp, Artificial Sequence
  Description of Artificial Sequence: Synthetic coding sequence
atggctgagttgcaggaagttcagattactgaggagaaacccctgctgcccgggcagacgcccgaggcggccaaggaggctgaactagctgcgcgcattttgttagatcagggacagactcactcagtagagacaccttatggaagcgtgacctttactgtatatggaacacctaagccgaaacgcccagcgatcttgacttaccacgacgtgggcctcaattataagagttgctttcagccactttttcagttcgaagacatgcaggaaatcattcagaattttgtgagggtgcacgtggacgctcccggcatggaagagggcgctccggtgttcccactcgggtatcagtatccttccctggaccagctcgcagatatgatcccatgtgttttacagtacctgaacttctcaacaattatcggagttggagtgggtgcaggtgcatacatcttagccagatatgccctcaaccatccggatacggtcgaggggttggttttgataaacatcgaccccaatgccaaaggttggatggactgggccgcacataaactgaccgggctgacgagctcaatccccgaaatgatccttggtcatctcttctcccaggaggaattgtctggcaattccgaactgatccaaaagtatcgcaatattattacccacgcacccaaccttgacaatatcgaactgtattggaatagttataacaatcgccgagatctgaactttgaacgtgggggcgacattacgttaaggtgtccagtgatgctggtggtgggagaccaggccccacatgaagatgcagttgttgaatgcaattctaagctcgatcccactcagacttccttcctcaaaatggccgacagcggggggcaaccacagttgacacagcctggcaaactaacagaagcttttaagtattttttacagggcatggggtacatggccagcagttgcatgacgagactatctcggtctcgaactgcctcccttacatccgccgcatcagtagacgggaaccggagccgtagccgaacactcagtcagtctagcgaatccgggactctgtctagtggcccccctgggcacaccatggaggtgtcctgctag

SEQ ID NO: 16214 - DNA, 1074 bp, Artificial Sequence
  Description of Artificial Sequence: Synthetic coding sequence
atggcggagctccaggaggtgcagatcactgaagagaaacctctcctgcccggacagacacctgaagccgccaaaactcattccgttgagaccccatacggtagtgtcacgtttactgtttatggaaccccgaaaccaaaaaggcctgctatcctaacttaccatgatgtgggcctgaactacaaatcctgctttcagcccctctttcagtttgaggatatgcaagaaatcattcagaatttcgttcgcgttcacgtggatgctccgggtatggaggagggcgcccccgtgtttcccctgggctaccagtaccccagcctggaccagctggcagatatgatcccatgtgtgctgcagtatttgaacttctctactatcatcggtgtgggcgtgggcgccggggcatatatcctagctagatacgctctcaaccatccggacactgtggagggcttagtactgataaacatcgaccctaatgctaaaggatggatggattgggctgcacacaaattgacagggctgacaagcagtattccggagatgatcttgggtcacctgttttcacaagaagagctcagcggcaatagtgagttaatccagaagtaccgaaacatcattacacacgcccccaatcttgacaatattgaactttactggaacagttataacaaccgtcgcgacctgaattttgaaagggggggtgacataaccctcagatgcccagtgatgttagttgtgggcgatcaggcccctcacgaagatgctgtagttgagtgcaattctaagctggatcccactcagacctcttttttaaagatggccgactccggcggccagcctcagctgacgcagcctggcaaactcactgaagccttcaagtatttcctgcaggggatgggatacatggcttcatcatgcatgacaaggttgtccaggtccagaacagcctccctgacatcagctgccagtgtagacggtaatagaagcaggagtaggaccctgtcccaatcatcggagtcgggtacactcagctccggcccaccaggacacacaatggaggtgtcttgttag

SEQ ID NO: 16215 - DNA, 1074 bp, Artificial Sequence
  Description of Artificial Sequence: Synthetic coding sequence
atggctgagcttcaagaggtgcagatcaccgaggagaaacctttactcccaggccaaaccccagaagctgcaaagactcactccgtggagactccttatgggagcgtgacctttacagtctatggcactccgaaaccaaagaggccagccatcctcacgtaccatgatgtcggcctgaattataagtcatgttttcaacctctgtttcaattcgaggacatgcaagagattatccaaaattttgtccgggtacatgtagatgcacctggcatggaggagggagcccccgtcttccctctgggatatcagtacccaagtttagaccagctcgcagacatgattccttgcgtgttgcagtaccttaattttagcaccatcatcggagtgggcgtgggcgctggggcttatattctggcgaggtacgctctcaaccatccagacaccgtggaagggttagtgctgattaacattgatcctaatgcaaagggttggatggactgggccgctcataaactgaccggcttgacctcaagtatacctgaaatgatattgggacacctctttagtcaggaggaactgtctgggaattctgagctgatacaaaaatatcgcaacattattacgcatgcaccaaatcttgataatattgagctctactggaactcctataacaaccggagagaccttaatttcgagagaggaggcgatattaccctcaggtgccctgtaatgctcgtggttggtgatcaggcccctcatgaggatgctgtcgtggaatgcaactctaagttggatcctacgcagacttctttcctgaagatggccgattctggtggccagccacagcttacacagcccggtaaactgaccgaagccttcaaatattttctgcagggcatggggtacatggcctcttcgtgcatgactcgactaagcaggagccggacggcgtctttgacctccgcggcctccgtcgacggaaacagaagcagaagcagaacactgtcccaatcttccgagtccggaactctgtcttctggcccccctgggcatacaatggaagtaagctgttag

SEQ ID NO: 16216 - DNA, 1026 bp, Artificial Sequence
  Description of Artificial Sequence: Synthetic coding sequence
atggccgaactacaggaagtgcagatcactgaggaaaagcccctgctcccaggccagacccccgaggcagctaaaacgcatagcgtcgagacgccctacggatctgtgacttttactgtctatggaacgcctaaacctaagagacccgcgatactcacctatcatgacgtaggcctcaactacaagtcctgtttccaacctctcttccagtttgaggacatgcaggaaatcatccagaattttgtccgtgtgcacgtcgatgctcccggaatggaggaaggggctccggtcttcccgctgggctaccagtacccaagcctcgaccagctcgctgacatgattccatgcgtgttacaatatctgaacttcagtacaattatcggtgtcggcgttggtgcaggtgcatacatccttgcacgatacgccctgaaccatcccgacacagtggaaggactggtgctcatcaacatcgacccaaacgccaaagggtggatggattgggccgctcacaaacttacggggctgacgtcctcaatccccgagatgatcctcggccacctgttttcgcaggaggagctgagcggaaattcagagctgatccaaaagtaccgaaacattattacacatgccccgaatctcgacaatatcgagctgtattggaactcttacaataatagacgagatctgaactttgagcggggtggggacattacactgaggtgcccagtcatgctcgtggtcggggatcaggctccccacgaggatgccgtgatggctgactcggggggacaacctcagttgacacaacctggaaagctcaccgaggcctttaagtacttcctgcaggggatgggctatatggcatcctcctgcatgacaagattatctagaagccggacagccagccttactagcgccgcctcagtagatgggaaccgatcccgcagtaggactcttagccagtccagtgagtccgggacgctgtcgagtggaccacctggccacaccatggaagtgtcctgttag

SEQ ID NO: 16217 - DNA, 1083 bp, Artificial Sequence
  Description of Artificial Sequence: Synthetic coding sequence
atggcagagctccaggaggtgcaaatcaccgaagagaagcccctactcccgggccagacccctgaggcagccaaggaggcagagctcgcagccagaatcctcctcgaccagggacagacacactccgtcgaaaccccgtatggatccgtgacgttcaccgtttatggtactcctaaacctaaaagacctgccatcctcacttaccatgatgtggggttgaattataagtcttgttttcaaccactttttcagttcgaggatatgcaggaaattatacaaaatttcgttcgggtccacgtggacgcccctgggatggaagagggagctccagtctttccacttggctaccagtacccgagcttggatcagctcgctgacatgataccctgtgtgctgcagtatctgaacttctccaccatcattggcgtcggcgtaggggcaggtgcttacatactggcccgttatgccttgaaccaccctgacacagttgagggattagtgttaattaacattgacccaaatgcaaagggatggatggactgggcagctcacaagctgacaggcctcaccagtagcatccctgaaatgatcctgggacacttattctcacaagaagagctgagcggcaactctgaactgattcagaagtaccggaacataatcactcacgcgcctaatctcgacaatatagaactgtactggaactcctacaataatcgcagggacctgaacttcgaacgaggtggggatattactctgcgatgcccggttatgctcgtggtggaatgcaacagcaaactggacccaacacagacctccttcttaaaaatggccgattctggggggcagcctcagctaactcagcctggcaagttgacagaggccttcaagtatttcctgcaggggatggggtacatggccagctcatgcatgacaagactatctagatcccgcacggcatctctcacatctgccgctagcgttgacggcaatagatcccggtcaagaacactttctcagtcatccgagtccggcacgttgagcagtggacctcctggccacacaatggaagtttcttgttag

SEQ ID NO: 16218 - DNA, 1116 bp, Artificial Sequence
  Description of Artificial Sequence: Synthetic coding sequence
atggcagaactccaggaggtacaaatcactgaggagaagcctctgctccccggccagacaccagaagcagccaaagaggccgagcttgccgcccgcatactcctggaccaaggccagactcactctgtggagaccccttatggatctgtcacattcacagtgtacggcacacccaagcctaaacgcccggctattcttacctatcatgacgtgggcctcaattataaatcatgttttcagcccctgtttcagttcgaggacatgcaggagattatccagaactttgtgcgggttcatgtggacgcccctggcatggaggagggagcccctgtgttcccgctaggctatcaatacccttcgctggatcagctcgctgatatgatcccttgtgtgctgcaatacctaaacttctcaactataattggagtgggagtgggagcgggggcttacattttggcaaggtacgccctgaatcatccagatactgtcgaggggctggtgctaattaacatagatccaaatgccaaggggtggatggactgggcagcccataagcttactggccttacctctagcattcccgaaatgatcctgggacatctgttcagccaagaggaattatccggaaatagtgaactcattcagaagtaccggaacatcattacccacgctcccaatctggacaacatcgagctctattggaactcatacaacaaccgcagggatctgaacttcgagaggggcggggatatcaccttgcgatgtcccgtcatgcttgtggtcggagatcaggcgcctcacgaggatgcggtcgtggaatgtaatagcaaactcgaccccacccaaacctcttttctgaagatggccgatagtggtgggcagccgcagcttactcaacctggtaaactgaccgaagcattcaagtactttctgcaaggtatggggtatatggcttcaagctgtatgaccaggctcagtaggagcagaactgcatctctcactagcgctgcttctgtggacggcaataggtcacgttctcgtaccctgtcacagtcttcagagtcaggcactttgtccagcggaccaccaggacatactatggaagtttcctgttag

SEQ ID NO: 16219 - DNA, 1116 bp, Artificial Sequence
  Description of Artificial Sequence: Synthetic coding sequence
atggccgagctccaagaagtccagattacggaggagaagcccttactgccggggcagactcccgaggccgcaaaagaggccgagctggctgctagaattttgctggatcaggggcagacccacagtgtggagaccccttatggtagcgttacgtttaccgtgtacggtactccaaaacctaagcgtcctgcaatcctgacctatcatgatgtgggcctgaactacaagagctgctttcaacctcttttccaattcgaagacatgcaagaaatcatccaaaacttcgtgagggtgcacgttgacgccccaggcatggaagaaggtgcaccggtatttccgttgggctatcaatacccatctctagatcagttggctgacatgatcccctgcgtgctccagtatctgaattttagcacaatcatcggggtgggcgtgggcgcaggagcttatatactggcacggtatgcactaaatcatcctgatactgtagagggcctggtactgattaatatcgacccgaacgccaagggatggatggactgggcagcgcataagcttacaggactgacttcctccatacccgaaatgatattgggccatcttttcagccaggaagagctgtcgggtaactccgagctcatccaaaagtaccgaaatattatcacccatgctccaaatctggataacatcgagctttactggaactcatacaacaatcggagggatttaaactttgaacgaggcggcgacatcacgttacggtgcccagtcatgctggtggtcggcgaccaggcgcctcacgaagacgcggtagtggagtgcaattctaaactggatccaacccagacctcctttctcaagatggccgacagcggaggccaacctcagctgactcagccgggcaaactaacagaagccttcaagtacttcctgcagggcatgggctacatggcctcctcctgcatgacccggttgagcagaagtcggaccgcttcgctcacaagtgccgccagcgtagacggtaacagatctaggagtaggaccctcagtcagagctccgagtcaggaacgctgtcttccggcccccccgggcacaccatggaagtgtcctgctag

SEQ ID NO: 16220 - DNA, 987 bp, Artificial Sequence
  Description of Artificial Sequence: Synthetic coding sequence
atggccgagctgcaggaagtccagatcactgaggaaaagcctttgttacctggccagactccggaggcggcaaaaacccactctgtagagacaccttacggctcagtgacatttaccgtgtacgggacccccaaacctaaaaggccagcaatacttacatatcacgatgtggggctcaattataaatcatgctttcagccactgtttcagtttgaagacatgcaggaaattatccaaaacttcgtccgcgttcacgtcgatgcaccaggcatggaagaaggggctccggtgttcccacttggataccagtatcccagcctcgaccagctcgcagatatgattccatgcgtcctgcagtaccttaattttagcacgattatcggtgtgggcgttggcgccggcgcctacatcctagcccgctatgctcttacggggctcacatcctctattcccgagatgattctggggcacttgttttcccaagaagagttatctggaaatagcgaactgattcaaaagtataggaatataatcactcatgcccccaacctggacaacattgagctgtattggaattcgtacaacaaccgtagggatttaaattttgagaggggtggtgatatcacactgcgctgtcccgtaatgctggtcgttggcgaccaagccccgcacgaagacgccgtcgttgaatgtaacagcaaattagacccaacccaaacctcatttctgaaaatggccgacagcggcggacagccacaacttactcagccaggaaaactgacagaggctttcaaatatttcctccagggaatggggtacatggcgtcttcatgcatgactaggctttctaggtcacggaccgcgagcctcacctcagccgcaagtgtggacggaaatagaagcagaagtcgcacgctgtctcagtcgagcgagtccggcacgctctcatcaggcccgcccgggcacactatggaggtgagctgttag

SEQ ID NO: 16221 - DNA, 1026 bp, Artificial Sequence
  Description of Artificial Sequence: Synthetic coding sequence
atggccgagttgcaggaagtgcaaataacagaggagaaacccttattgcccgggcagacaccggaagcagcaaaaacgcattccgtagagaccccgtatggatctgtcacctttactgtctacggaacccctaagccaaagagacctgctattctaacctatcatgatgttggactgaactacaagagctgttttcagcccttatttcagttcgaggatatgcaggaaatcattcagaacttcgtgcgcgtgcatgtcgatgctccagggatggaagagggtgccccagtgttccctctgggatatcaatatccatcccttgaccaattagccgatatgatcccctgcgttttgcaatatctcaattttagcaccatcattggcgtgggggtgggggccggcgcatatattctggcgcggtatgctctgaaccatcccgataccgtggagggattagtgctgataaacattgatcctaatgcgaaaggttggatggactgggctgcacataagctgacaggcctaacaagttccatccccgagatgatcctgggccaccttttctcccaggaggagttaagcgggaactccgaactaattcagaagtacaggaacatcattacgcacgctcctaatctggacaatatcgagctgtactggaacagttataataaccgcagggacctgaatttcgaacgtggcggggatattactctgagatgccccgtgatgctagtggtaggggaccaggctccacacgaagacgccgtcatggcagacagcggcggccagccccaactgacacagccaggcaagctgaccgaagcattcaagtatttcctgcaggggatgggttacatggcatcctcatgcatgactcgcttgtcaaggtcccgtaccgcttccctcacatctgccgcctccgtcgatggcaaccgtagcaggagccggacactctcacaatcatccgagagcggcactctgagctccggcccacctggtcataccatggaagtgtcatgctag

SEQ ID NO: 16222 - DNA, 1116 bp, Artificial Sequence
  Description of Artificial Sequence: Synthetic coding sequence
atggccgagttacaagaggtccagattaccgaagagaaacctcttctcccaggccagacacccgaagcagcaaaggaggccgagttggctgccaggattcttcttgatcagggccaaacccattccgtagagacaccctacgggtcagtgaccttcacagtttacgggactccgaagccgaaaaggcctgctatcttgacctatcacgatgttggcctcaattacaagtcctgctttcagccgttgtttcaatttgaggacatgcaagagatcattcagaattttgtacgggtccacgttgatgcgccaggaatggaagagggggctccagtcttcccactggggtaccagtatccttcactggatcagctagccgacatgatcccttgcgtgctgcaatacctaaatttctccaccattattggcgtcggcgtcggggccggcgcttacatcttagctcgttacgccctgaatcatccggacacagtggaggggttggtgcttatcaatattgatccgaatgccaaggggtggatggactgggcagcccataagttaactggcctgacaagcagcattcctgaaatgattctcgggcatctctttagtcaggaggaactttctgggaatagtgagcttatccagaaataccgaaacattataacgcatgcacccaacctcgacaacattgaactttactggaactcctacaataaccgcagggatttaaatttcgagcgtggcggcgatatcaccctgaggtgcccagtcatgctcgttgttggcgaccaggctcctcacgaggacgcggtggtcgaatgtaattcaaaacttgaccctactcaaacatcgtttctgaaaatggccgactctggtggacagcctcagctgacccagcccggcaagctcactgaagcctttaaatattttctgcagggcatggggtatatggctagtagctgtatgacaagactttctcgctccaggaccgcctcactgacatccgcagcttccgtcgatggcaacagatcccgatctagaacactgtcgcagagctccgaatcaggaacattgtcgagcggacctccaggccataccatggaggtgagctgctag

SEQ ID NO: 16223 - DNA, 1104 bp, Artificial Sequence
  Description of Artificial Sequence: Synthetic coding sequence
atggagaatggggggagcatgcaagccacaatggcagagcttcaagaagtgcagattactgaggagaagcccttactgccgggacagacaccagaagccgcaaagacacattcagtggaaaccccctatggctccgtcaccttcactgtgtatggcactcccaaaccaaaacgacccgctattctcacgtatcatgatgtgggtcttaattataagtcctgcttccagccactatttcaattcgaggacatgcaggagattattcagaactttgtgcgagttcacgtggacgctccgggcatggaggagggggcacccgtttttcccctgggatatcagtacccctctttggatcagctagctgatatgatcccctgcgtactccaatacctcaacttctccaccatcatcggagtcggtgtgggcgccggtgcttacatcctcgcgaggtatgccttaaaccaccctgacaccgtcgaaggacttgtgctcattaatatagatcccaatgcaaaagggtggatggactgggccgcccataagcttacggggctcacatcatccattcctgagatgatcttgggtcacctcttctctcaggaagagctgtctggaaattctgagctcatccagaaataccggaatatcatcacccatgcccctaatttggataatattgagctgtactggaactcatataataatcgacgagatctgaactttgagcgcggaggcgacattacattgagatgtcccgttatgctggttgtgggtgatcaggccccgcatgaggatgctgtggtggaatgcaattcgaagctagaccctactcaaaccagcttcttgaaaatggccgatagtggcggccagccccagttaacgcagccaggcaaactgaccgaagcctttaaatatttcctccagggcatgggctacatggccagctcttgcatgacccgcctctctaggtcaagaacagcatctctcacaagtgcggccagtgtggatggaaacaggtcccgctctagaacgctcagccagagctcagagagtggaacactttctagtggcccacccgggcacactatggaagtgtcgtgttag

SEQ ID NO: 16224 - DNA, 504 bp, Artificial Sequence
  Description of Artificial Sequence: Synthetic coding sequence
atggccgaactgcaggaagtccaaattacggaggagaagcctctgctccctggtcagactcctgaagcagccaagacacatagtgtggagacaccatatggatctgtgacatttaccgtctatgggaccccgaagccaaagcgccccgcaatcctgacttatcatgacgtcgggctgaactacaagagctgcttccagccactgttccagtttgaagacatgcaggagattattcagaacttcgtgagagtgcatgttgatgccccaggcatggaagaaggagcccctgttttcccactcgggtatcagtatccttctctcgatcagctagctgacatgatcccctgtgtgttgcagtacttgaatttcagcacaatcataggtgtaggggtcggagccggagcatacatactcgcacgctacgctctcaatcatccagatacagtggaaggccttgtgctgatcaatatcgatccgaatgccaagggatggatggactggtag

SEQ ID NO: 16225 - DNA, 1074 bp, Artificial Sequence
  Description of Artificial Sequence: Synthetic coding sequence
atggccgagctccaggaggtgcagataaccgaagaaaagccactgctaccagggcagactccagaggccgccaaaacccattctgtggagacgccctatggctccgttacctttaccgtctacggcactcctaaacctaaaagacccgccatcctgacatatcacgacgtgggccttaattataagtcttgttttcaaccactgttccagttcgaggacatgcaggagattatccagaacttcgtcagggtgcacgtggacgcgccaggaatggaggaaggagcccctgtcttcccacttggctaccaatacccttcactggatcagctggctgatatgatcccttgtgttctccagtacctgaatttctccacaattataggggtgggcgtcggagcaggggcttacattcttgccagatacgctcttaatcacccggataccgtggaggggctggtcctaatcaatattgaccccaatgccaaaggatggatggactgggcagctcataagttgactgggctcaccagctcaatcccagaaatgatcttgggacacttattttcccaggaagaattgagtggaaactctgagcttatccagaagtaccgaaatattatcacacatgctcctaacttagataacattgagctgtattggaacagttacaataatagacgcgatctgaacttcgagagggggggggatatcactcttcgctgtcccgtgatgctggtcgtcggggaccaggcacctcacgaggatgctgtcgtagagtgtaactctaagctggatcctacccagacaagctttctcaaaatggccgatagtggtggccagcctcaactgactcaacccggaaagctcaccgaggccttcaagtatttcctgcaagggatgggttatatggcttccagttgcatgactaggttgagcagatcccgaacagccagtctgaccagcgccgcctcagtcgatggaaacaggtcacgctcacgcacactctctcagtcatcagagtcaggaacactgagttccgggccgccaggacataccatggaggttagttgctag

SEQ ID NO: 16226 - DNA, 522 bp, Artificial Sequence
  Description of Artificial Sequence: Synthetic coding sequence
atggcagagcttcaggaggtacagattaccgaggagaagcccttactccccggacagacgcccgaggctgccaaagaggccgagctggccgcgcggattcttctagaccagggacagacgcattccgtagaaactccctacggcagtgtaacattcactgtgtatggcacgcccaagcccaagagacccgctatcttaacctaccacgacgtgggtcttaattacaaaagctgttttcaaccactattccagttcgaagacatgcaggaaattatccaaaactttgtgcgcgtgcacgttgatgcccctggcatggaggagggtgcccccgtgtttcccctcggctatcaatacccttcgctggaccagctggccgatatgattccatgtgtcctgcagtatcttaatttctccaccattatcggcgtaggcgtgggggccggcgcatatatactcgcccggtatgcccttaaccatccagatactgtggagggccttgtactcatcaatatcgatccctag

SEQ ID NO: 16227 - DNA, 759 bp, Artificial Sequence
  Description of Artificial Sequence: Synthetic coding sequence
atggcagaactgcaagaggttcagataaccgaagagaaacctcttctgcctggccaaactccggaggccgctaaagaagcagagttggccgccaggattctgctggaccaaggccaaacccactccgtggagacaccctacggcagcgttacattcacagtctatggaacacccaagccaaagagacccgccattcttacctaccatgacgtcggactgaactacaaaagttgctttcagcctctgttccagtttgaagatatgcaagaaatcattcagaacttcgtacgggtacatgtagatgccccaggtatggaagagggagcaccagtctttcctttgggctaccaatatccatcccttgaccagttggccgacatgatcccttgcgtgctgcagtacctgaacttttcaacaatcataggagtgggagtgggagcaggcgcgtacattctggcacgttacgcactgaaccacccagataccgtcgagggccttgtattaatcaatatcgaccccaacgccaaaggatggatggattgggcagcacacaagctaacagggctgacaagtagtatccccgagatgattctgggacatcttttttctcaggaggagctcagcgggaactcagaattgattcagaaatatagaaatatcattacccacgcccccaatcttgataatattgagctttactggaattcttacaataatcggcgggacttgaatttcgagcgtggaggcgacattacctag

SEQ ID NO: 16228 - DNA, 525 bp, Artificial Sequence
  Description of Artificial Sequence: Synthetic coding sequence
atggcagagctacaggaagtccaaatcacggaagaaaaacctctgttaccgggccaaactccggaagctgcaaagacacactccgtggagacgccctacggcagcgtaaccttcaccgtgtacggcacaccaaaaccgaagaggcctgccatcctgacctaccacgatgttggactgaactataagtcctgttttcagcctctgttccagtttgaggatatgcaagagatcatccagaattttgttcgcgtacacgtggatgctccaggtatggaagagggagcccctgtgttccctctgggatatcagtaccccagccttgatcagctggctgatatgattccatgcgtactccagtatctgaacttcagcactatcattggcgtgggtgttggtgctggtgcctacatcctggcccggtatgccctcaaccacccagatacagtggaggggcttgttcttattaatattgaccccaacgcgaaagggtggatggactgggcggcccataagcttacggggtag

SEQ ID NO: 16229 - DNA, 1074 bp, Artificial Sequence
  Description of Artificial Sequence: Synthetic coding sequence
atggctgagctccaggaggtgcagattaccgaagaaaaacccctgctgcctggccagacacctgaggccgcgaaaactcactccgtggaaactccctacggctcagtgacttttacagtttatggcacgccaaaacccaaaaggccggcgattctcacgtaccacgacgttgggttgaattacaaatcttgtttccagcccctctttcagtttgaggacatgcaggagattatacagaatttcgtccgagtgcatgtcgatgctccaggtatggaagagggagcacccgttttccccctgggatatcagtaccctagccttgatcagctcgccgatatgattccttgcgtgctgcagtatttgaactttagtaccatcatcggagttggcgtgggggcgggggcttacattctggccaggtatgccctgaatcaccccgatactgtggaggggctagttctcattaatatcgacccaaacgctaaagggtggatggactgggctgcccataaacttacgggcctcacctcctccatcccagaaatgatcctcggccacctgttctcacaagaggagttgtccggcaacagtgaacttatacagaaatatcgaaatattatcacgcatgcaccaaaccttgataacattgagctctactggaactcatacaataacaggcgcgacttaaattttgaacgcggcggagatatcacactgcgatgtcccgtgatgttggtggtcggcgatcaggcacctcacgaagacgcagtggtagaatgtaattctaaactagatcctacccagacaagctttctgaaaatggctgattccggcggtcaacctcagcttacgcagcccggcaagctcaccgaagctttcaagtacttcctccagggaatgggatatatggcctcttcttgtatgaccaggctcagccgcagcagaacggccagcctcacttcagccgcctctgtagatgggaatagatcgcgctcccgaacactgtcccagtcttctgagagcggcactttgagttccgggcctcctgggcacacaatggaagtgtcctgttag

SEQ ID NO: 16230 - DNA, 450 bp, Artificial Sequence
  Description of Artificial Sequence: Synthetic coding sequence
atggccgaattgcaggaggtgcagattaccgaggagaaacccctcttacccggacagactccagaagccgcgaaggaggcggaactggctgccagaattctgttggaccaagggcagacacattcggtcgagaccccctatggctccgtaacctttactgtctacggcacgccaaaacctaaaagacccgctatcctcacttatcacgacgtgggactcaactataaaagttgcttccaaccgctctttcaatttgaggatatgcaagagattatacagaactttgtgagagtacacgtggacgcaccaggaatggaagaaggcgcgccggtgtttcccttaggatatcagtaccctagtttagatcagctggcagatatgattccatgcgtgcttcaatatctaaactttagcaccatcataggtgtcggagttggggccggggcctag

SEQ ID NO: 16231 - DNA, 261 bp, Artificial Sequence
  Description of Artificial Sequence: Synthetic coding sequence
atggctgagttgcaggaagtgcagataactgaggaaaagcctctgctaccgggccaaacacctgaggcagccaaggaagccgagctggctgctaggatcttactggaccaggggcagactcactctgtggaaaccccttatggtagtgtgactttcaccgtgtatgggacacccaaaccaaagaggcctgctattctgacatatcacgatgttggactgaattacaaaagctgctttcagccgctgttccagtttgaatag

SEQ ID NO: 16232 - DNA, 390 bp, Artificial Sequence
  Description of Artificial Sequence: Synthetic coding sequence
atggccgagcttcaggaagtgcagatcacagaggaaaaacccctcctacctggccaaacacctgaagccgccaaggaagccgagctggccgcccggatacttctggaccaaggacaaactcattctgtcgagactccttacggaagtgttaccttcactgtatatgggaccccaaagcctaagaggccggcgatactgacctaccacgacgtcggcctgaactacaaaagctgcttccagcccctgttccagtttgaagatatgcaggagatcattcagaactttgtcagagtccacgtggacgcgccaggtatggaggaaggggctccagtgtttccccttggctaccagtatccttccctggatcagctcgctgacatgatcccttag

SEQ ID NO: 16233 - DNA, 447 bp, Artificial Sequence
  Description of Artificial Sequence: Synthetic coding sequence
atggcagagctccaggaagtgcagatcactgaagaaaagcctctcctgcccggacagacccccgaggcagctaaggaggccgagctagctgccaggatcttgcttgatcagggccagacacattcagttgaaactccctatgggagtgtcacatttactgtatacggtactcctaaaccaaagcggcccgctattctcacctatcacgatgtgggcttaaactataaaagctgttttcaacctttgtttcagttcgaggacatgcaggagattatccaaaacttcgttagggtacacgtggatgcacccggcatggaggagggtgcccctgtgttccccctcggctaccagtatccatctctagaccagcttgcggatatgattccatgcgtcctgcagtatcttaatttttcaactatcataggagtcggagtaggtgccggctag

SEQ ID NO: 16234 - DNA, 405 bp, Artificial Sequence
  Description of Artificial Sequence: Synthetic coding sequence
atggcagagctgcaggaggtgcaaattactgaggaaaaacctcttctgccaggccagacccccgaggcggcaaagacccactctgtggagaccccttacggatctgtgacgttcacagtatacggcacgccgaagcctaaacgtcccgcgatcctgacttaccacgatgtaggtctgaactataagtcgtgctttcagcccctctttcagtttgaagacatgcaggagatcatccaaaattttgttcgagttcatgtcgatgcccccggcatggaggaaggcgccccagtgtttccactcgggtaccaatacccatccttagatcaactagcagatatgattccttgcgtgcttcagtacctgaacttttcaacaattattggggtgggagtgggagccggatag

SEQ ID NO: 16235 - DNA, 327 bp, Artificial Sequence
  Description of Artificial Sequence: Synthetic coding sequence
atggccgaattgcaggaggtccagattacagaggagaaaccccttttacccggtcaaacgcctgaggctgcaaaaacacactcagtcgaaacaccgtatgggtctgtgaccttcacggtttacggaacccccaaacctaaacggccggctatcttgacttaccatgacgtgggactgaactacaaaagctgtttccagccactatttcagttcgaagatatgcaggaaatcatccaaaactttgtgcgtgttcacgtggatgcaccagggatggaggagggagcccctgtcttcccactgggctaccagtatccatccctcgactag

SEQ ID NO: 16236 - DNA, 363 bp, Artificial Sequence
  Description of Artificial Sequence: Synthetic coding sequence
atggctgaactgcaggaagtacagattaccgaagaaaagccgcttctgcccgggcagactcccgaagccgctaaaacacactccgtggagacaccatatgggtctgttacctttaccgtgtatggcactccaaaacccaagagacctgccatactcacttatcacgacgtcggactcaattacaagtcttgtttccagcctctcttccaatttgaagacatgcaggagattatccaaaatttcgtgagggtccacgtggatgctcctggtatggaagagggagctcctgtgtttccattaggctatcaatatccgtctctggatcagctagctgacatgattccctgcgtacttcagtactag

SEQ ID NO: 16237 - DNA, 300 bp, Artificial Sequence
  Description of Artificial Sequence: Synthetic coding sequence
atggcagagttgcaggaggtgcagattaccgaagaaaaaccccttctgcccgggcaaacacctgaagccgccaaggaggccgaactggcggcaagaatactgctcgaccaggggcagacccactctgtggaaactccatacggatctgtgacctttactgtgtatgggactccaaaaccgaaacggccagcaatcctaacataccacgatgtgggactcaactataagtcatgctttcagcctttgttccagtttgaggatatgcaggagatcattcaaaacttcgttagggtgcattag

SEQ ID NO: 16238 - DNA, 279 bp, Artificial Sequence
  Description of Artificial Sequence: Synthetic coding sequence
atggccgaactccaggaagtgcagatcacagaagagaagccactactgcccggccagactcccgaggccgcgaagacacattcagttgaaaccccgtatggatccgtgacatttacagtctacggaacacccaaacccaagcggcctgcaattctgacctatcacgacgtcgggctcaactataaatcttgctttcaaccgttattccaatttgaagacatgcaagaaatcatccagaattttgtgagagtgcacgtggacgcacctgggatggaatag

SEQ ID NO: 16239 - DNA, 462 bp, Artificial Sequence
  Description of Artificial Sequence: Synthetic coding sequence
atggctgagctgcaggaagtgcagatcacagaagaaaaaccattgctgcccgggcagacaccagaggccgctaaaactcactctgtcgagaccccgtacggcagcgtaacgttcaccgtgtacggcacaccaaagcccaaaagacccgcgatcctgacttatcacgatgtcgggctcaattataagagctgttttcagcccctgttccagtttgaagatatgcaggagattattcaaaacttcgtgcgcgtgcacgtggatgcccccggaatggaagagggagcacccgttttccctctcggatatcagtatccatctctggaccagttggctgacatgatcccctgcgttctccagtacctgaatttctctaccatcatcggcgtgggcgtgggtgccggggcctacattctggctcgatacgccttgaatcatcccgacacagttgaaggcctggtgtag

SEQ ID NO: 16240 - DNA, 1074 bp, Artificial Sequence
  Description of Artificial Sequence: Synthetic coding sequence
atggccgagctgcaagaagttcagattaccgaggaaaaaccactactacctggtcagactccagaggcagcaaaaacacattcagtggagaccccatatggtagcgtgacatttacagtctacggaactccaaaaccaaaaagaccagcaatcctgacgtatcacgacgttggtctgaactataaatcctgctttcagcccctgtttcaattcgaagatatgcaagagattatccagaacttcgtgagagtgcacgtggatgccccagggatggaggagggagcgccggtatttcccctcggttaccagtacccctccctggatcaactggccgatatgatcccctgcgtgctgcagtatttgaactttagcactatcattggggtaggcgtcggagccggggcatatatcctggccagatatgccttgaaccatccagacaccgtcgagggcttagtcctcatcaacatcgatcctaatgccaagggatggatggactgggcagcacataagttaactggactgaccagtagtataccagagatgatccttggacacctgttctctcaggaagagttgtctggaaacagcgaactaatacagaaatatcggaatattatcactcacgcaccgaacctagacaatatagaactctactggaactcttacaacaatagaagagacctcaacttcgagcggggtggcgacataactctcaggtgcccagtaatgcttgttgttggtgatcaggccccgcacgaggacgccgtggtagagtgcaactccaaactggaccctacgcagacttctttcctcaagatggctgactccgggggtcagccacagctcactcagcccggcaagttaaccgaagcattcaagtactttttacaagggatgggttacatggctagttcatgtatgacaaggctgagcagatctagaaccgccagtctaacgagcgccgcctcagtggacggaaaccgttccaggagcagaactctgagccagtcatccgagtccggcactctgtcatcgggtcctcccgggcacaccatggaggtctcttgttag

SEQ ID NO: 16241 - DNA, 585 bp, Artificial Sequence
  Description of Artificial Sequence: Synthetic coding sequence
atggcagagctgcaggaggtccaaattacagaggagaaacctcttctgcccggtcagacacccgaggctgcaaaagaagccgagttagccgccagaatcctgctggatcagggacaaactcactcggtggagacaccatacggatcagtcaccttcactgtttacggtacccctaaaccaaaacgacccgcaattctcacgtaccatgacgtcggcctgaattataaaagctgcttccagcccctgttccagtttgaagacatgcaggagatcatccagaatttcgttcgcgttcatgttgacgcaccaggaatggaagaaggggcgcccgtatttcctctggggtatcagtatccctccctcgaccagctggctgacatgattccttgtgtgctgcagtatttaaacttttccaccatcatcggcgtcggagtgggcgcaggcgcctatattctggctaggtacgcactgaatcaccccgataccgttgagggcctggtgctgattaatattgaccccaatgccaagggctggatggattgggctgcccacaaactgacaggactgaccagttccatcccatag

SEQ ID NO: 16242 - DNA, 387 bp, Artificial Sequence
  Description of Artificial Sequence: Synthetic coding sequence
atggccgaactgcaggaggtgcagattaccgaagaaaaaccactgttacccgggcagacccctgaagcggcgaagacacactcagtggaaaccccatacggaagcgtgacctttacagtgtacggcacgcctaagcccaaacgccccgccattctgacttatcacgacgtggggttaaattataaatcatgtttccagccactctttcagtttgaagacatgcaggagataatccaaaatttcgtccgggtccacgtagatgcgccaggaatggaggagggcgccccagtctttccactgggttaccaataccccagtctcgaccagctggccgacatgattccttgcgttctgcaatacttgaatttttctacgatcataggatag

SEQ ID NO: 16243 - DNA, 660 bp, Artificial Sequence
  Description of Artificial Sequence: Synthetic coding sequence
atggcagagctgcaggaggtgcagattactgaggagaagccccttttgcccgggcagaccccagaagccgccaaggaggctgagctcgctgcccggatcctgctcgaccaaggacagacccattcagtggagactccttacgggagtgtgacctttaccgtatatgggactcccaaacctaaacgccctgctatcctcacctaccacgacgtggggctgaattacaagagctgtttccagcctctgttccagtttgaggacatgcaggaaatcatccaaaattttgtgcgggtacacgtcgatgcacctggaatggaggagggagccccagtgtttcccttaggataccagtatcctagtcttgaccaacttgccgacatgattccctgcgtcctacagtacctgaacttctctacgatcattggggtcggggttggcgcgggggcatacatcttagcaaggtacgcgctcaatcacccagataccgttgagggattggttctcataaatattgaccctaacgcgaagggctggatggactgggccgctcacaagctgactggtctgacaagctccatcccagagatgattctcggtcacttattttcacaggaggaactttctgggaatagcgaactgattcagaagtatcgtaattag

SEQ ID NO: 16244 - DNA, 666 bp, Artificial Sequence
  Description of Artificial Sequence: Synthetic coding sequence
atggccgagcttcaggaggtgcaaatcacagaagagaaaccgttattgcctggacagactcctgaggcagcaaagacacacagcgttgaaactccttatgggtccgtcacatttaccgtgtacggcactcctaaacccaagaggccagccattctgacttaccatgacgttgggcttaattacaaaagctgcttccaacccctttttcagttcgaagacatgcaagaaattattcagaattttgtgcgcgtgcacgttgacgcgcccgggatggaggagggagcccctgtgtttccactgggttaccagtacccgagtttggaccagctggcagacatgatcccttgcgtattacagtatctgaacttctctactatcatcggcgtcggagtcggcgcaggtgcatacattttagcgcggtatgccctgaaccacccagacacggtggaggggctggttcttattaacattgaccctaacgcgaaggggtggatggattgggcggcccacaaattgacagggctgacatcctccatcccagaaatgatccttggccatctgttcagccaagaagagctgtccggtaactctgagttgatccagaagtaccgaaatataatcacgcatgctccaaatctggataacatcgagctgtattggaactag

SEQ ID NO: 16245 - DNA, 1116 bp, Artificial Sequence
  Description of Artificial Sequence: Synthetic coding sequence
atggccgagttgcaggaggtgcagatcacagaggagaaaccgcttctgcccggccaaacacccgaagcggccaaggaggcggagctggccgcgaggatcctattggatcagggccagacccacagcgtggagactccctatggctctgtcacctttacagtctacggtacaccaaagcccaagcgccctgccattctaacctaccacgacgtggggttaaactataagtcttgtttccagcccctgtttcagttcgaggatatgcaggaaataatacagaacttcgtccgtgttcacgtggatgctcccggaatggaagaaggagcccctgtctttcccctgggttatcaatacccttctttggaccagctggctgatatgattccttgtgttctgcagtacttaaacttctccaccatcattggcgttggcgtgggagccggcgcttatatcctagctcgttatgctcttaatcatcccgatacggtggagggactggtccttatcaatatcgatcctaacgccaagggatggatggactgggcagcacacaaactcacagggctcacatccagcatccctgagatgattctaggccatctattctctcaggaggagcttagtggtaactctgagctcatccaaaagtatcgcaacatcattacccatgcgcctaacttggataatatcgaactatactggaacagttacaacaataggagggacctgaatttcgaaagagggggtgatataaccctgcggtgtcccgttatgcttgtcgtaggcgatcaggctccacacgaagatgcagtagtggaatgcaacagtaagctcgaccccacgcagaccagcttcctcaaaatggccgactctggcggacagccacagctcacacaacctggtaagctgacggaggcctttaaatatttcctacagggcatgggatatatggcttcatcctgtatgacgcgactctcacggtcccggaccgcatccctaaccagtgcagcatccgttgacgggaacagaagccgctctcggacgctgagccagtcatctgaaagcggcactctgtcctcagggcctccaggccacactatggaggttagctgttag

SEQ ID NO: 16246 - DNA, 432 bp, Artificial Sequence
  Description of Artificial Sequence: Synthetic coding sequence
atggcagaacttcaagaagttcaaatcaccgaagagaagcccctcctgcctggccagacccctgaagctgctaaaactcatagcgtggaaacaccttacggatccgtgacttttactgtttacggcacacccaagccaaagcgtcctgctatcctgacataccacgatgtcggcctgaattataagagctgtttccaacctctgttccagtttgaagatatgcaggaaatcatccagaacttcgtcagggttcacgtggacgcacctggcatggaggaaggcgctccagtgttccctctcggataccagtatccctcgttagaccagctggctgacatgatcccatgcgttttgcagtaccttaattttagcacaatcattggcgttggggtgggggcaggcgcctacattctggctagatatgccctatag

SEQ ID NO: 16247 - DNA, 483 bp, Artificial Sequence
  Description of Artificial Sequence: Synthetic coding sequence
atggccgagctgcaggaagtacagatcacagaagagaaacccttacttccgggacagacccccgaggccgctaagacacattccgtcgaaacaccatacggaagcgtcaccttcacagtgtatggcactcccaaacctaagaggcctgctattctgacatatcatgacgtcggactgaactacaaaagttgtttccagccactctttcagttcgaagatatgcaggagataatacagaacttcgtcagggtgcatgtggacgcccccggcatggaagagggggcgccagtctttcccttggggtaccagtacccatccctagatcagttagctgatatgatcccttgtgtgctgcaatatctaaatttcagcacaattattggcgttggagtgggcgccggagcctatatcctcgcccggtacgccttgaaccatcccgacacggtggaaggtttagtgctcattaatatagaccccaattag

SEQ ID NO: 16248 - DNA, 426 bp, Artificial Sequence
  Description of Artificial Sequence: Synthetic coding sequence
atggccgagttacaagaagttcagataaccgaagaaaagccgttgttgcccggacagaccccagaggcagccaaggaagccgaactcgccgctagaatcttgcttgaccagggccaaacccactctgtcgaaacaccttacggttcagtgacattcacagtctatggcactccaaaacccaaacggcctgcgattctcacatatcacgacgtgggcctgaactataaatcctgtttccagcccttgttccaattcgaggacatgcaggaaattatccagaacttcgtccgcgtacacgttgacgctcccggcatggaggaaggggctccagtttttcccctggggtatcagtaccccagcctggaccagctcgcggacatgatcccctgcgttctgcagtatctgaatttctcaaccatcatttag

SEQ ID NO: 16249 - DNA, 357 bp, Artificial Sequence
  Description of Artificial Sequence: Synthetic coding sequence
atggccgagctccaggaggtccaaatcaccgaggaaaagcctctgctacctggacagacacccgaggcggctaaggaggccgagctagccgccaggatcctgctggaccagggccagacccattcagttgagactccatacggcagtgtaacctttacggtatacggaactcccaagcctaagaggccagctatcctgacctatcacgacgtgggccttaactataagtcctgtttccaaccactattccagttcgaggatatgcaggagattattcagaactttgtaagggtgcatgtagacgctccgggtatggaggagggggcccctgtatttcccctgggctaccagtactag

SEQ ID NO: 16250 - DNA, 423 bp, Artificial Sequence
  Description of Artificial Sequence: Synthetic coding sequence
atggccgagttgcaggaggtgcagattaccgaggagaagcctctgctacccgggcaaacaccagaggccgctaaggaggctgaactcgcagctcgtatattgctagatcagggtcagacccatagcgtcgaaaccccctatggctctgtgacattcactgtgtacggaactcctaagcccaagcgccccgctatacttacgtaccatgatgtcggcctaaactataagagctgtttccaacctttgtttcagtttgaagacatgcaggaaatcatccagaacttcgtacgggtacatgtcgatgcacccggaatggaagaaggtgcacctgttttcccactcggataccagtaccccagcttggatcagctagcagatatgataccatgcgtccttcaatacttaaattttagtaccatatag

SEQ ID NO: 16251 - DNA, 435 bp, Artificial Sequence
  Description of Artificial Sequence: Synthetic coding sequence
atggctgagctgcaggaggtccagatcaccgaggagaaacccttattgcctggacagactcctgaggctgcgaagacacacagtgttgagaccccgtatgggagcgtcactttcaccgtctacgggactccaaagcccaaacggccagcgattctgacctatcacgacgtgggtctgaactataaatcttgctttcagccgttattccagtttgaggacatgcaggagattatccagaatttcgttcgggtgcacgtggacgcccctggaatggaggagggagctccagtgttccccctcggttatcagtatccgtcactggaccagttggctgatatgatcccttgtgtgctccaatacctgaacttttccacgatcatcggggtgggagtgggcgcaggagcctatatcctggcaagatacgcccttaattag

SEQ ID NO: 16252 - DNA, 462 bp, Artificial Sequence
  Description of Artificial Sequence: Synthetic coding sequence
atggcggaactccaagaggttcaaattactgaggaaaaacccttgctgcctggtcaaacccccgaggcagccaaaacacacagcgtcgagacaccgtacggaagcgtgacatttacagtgtatggcactcccaagcctaagcgccctgcgattctcacataccacgacgtcggactgaactacaagagctgttttcagcccttgttccaatttgaagacatgcaggaaatcatccaaaactttgtccgcgtgcacgtcgacgcgccgggaatggaagagggggcaccagtgttcccgctgggataccaatatcctagtttagatcagctcgctgatatgatcccctgtgtcctgcagtatcttaatttttcaaccattattggagtgggcgtgggcgccggcgcctacatccttgcgagatatgctctgaatcacccggataccgtcgagggcctggtctag

SEQ ID NO: 16253 - DNA, 675 bp, Artificial Sequence
  Description of Artificial Sequence: Synthetic coding sequence
atggctgagttgcaggaagtccagatcacagaggaaaagcccctcctgcctgggcaaacccctgaggctgcgaaaacacattccgtagaaaccccctacggttccgtgacgttcacagtatacggcacacctaagcccaagcgtcctgccattctcacgtaccacgacgtcgggctgaactacaaaagttgttttcaacccttattccagtttgaggacatgcaggagattattcagaacttcgtgagagtgcacgtggatgctcccggaatggaagaaggggcaccagtttttcccttgggatatcaataccctagcctggatcagctcgcagacatgatcccttgtgtgttacagtacttgaatttctctacgatcatcggcgtgggggtgggagcgggcgcgtatatcctggcccgctatgcactgaatcaccccgacaccgtagagggactggtgctgattaatatcgatccaaatgcaaagggctggatggattgggcagcgcacaaactgactggcctgacgagcagcattccagaaatgatcttgggacacctgttcagtcaagaggaactgtctggaaattctgaacttattcaaaaataccggaatataatcacgcatgctcctaatttggacaacatcgagctctattggaactcatataattag

SEQ ID NO: 16254 - DNA, 453 bp, Artificial Sequence
  Description of Artificial Sequence: Synthetic coding sequence
atggccgagctccaggaagttcagataactgaggaaaaaccactgctgcccggtcagacccccgaggccgcaaagacccattccgtggagaccccatatgggagcgtcacctttaccgtgtatggaactcccaagcctaagcgtcccgccattctgacttatcacgatgtcggcctgaattacaaatcctgctttcaaccactctttcagtttgaagacatgcaagagatcattcagaactttgttcgcgtccatgtcgacgcacccgggatggaggaaggtgctcccgtgttcccccttggttatcaatatccgagcctggaccagctggcagatatgatcccctgtgttctccagtatcttaacttttctacgatcataggcgtgggcgtgggcgccggagcctacattctcgcacggtacgccctcaatcacccggacacagtggaatag

SEQ ID NO: 16255 - DNA, 384 bp, Artificial Sequence
  Description of Artificial Sequence: Synthetic coding sequence
atggcggaactccaagaggttcaaattaccgaagagaaacccttgctgcctgggcaaactcccgaggccgccaaaacacatagtgtcgagacgccctacggctcggtgacttttacagtgtatggtacacctaagccaaagcgtcccgccatccttacttaccatgacgttggacttaactacaagtcttgctttcagcccctctttcagtttgaggacatgcaagagatcatccagaatttcgtgcgcgtccacgtcgacgcccctgggatggaggagggggcccccgtgttccccctgggttatcagtatccctctcttgaccagctggcagacatgatcccttgcgtattacagtacttgaatttcagtacgattatctag

SEQ ID NO: 16256 - DNA, 450 bp, Artificial Sequence
  Description of Artificial Sequence: Synthetic coding sequence
atggccgagctccaagaagtgcaaatcacagaagagaagcccttgctacctgggcagactcctgaagccgctaagacccatagcgtggagacgccgtacggctctgttacctttaccgtgtacggcacacctaaacctaaaagacccgctatattgacctaccacgacgtggggcttaactataagtcatgttttcagccactgtttcagtttgaggatatgcaggagatcattcagaacttcgtgagagtgcacgtggacgccccgggtatggaagagggagcccctgtcttccccttaggctatcagtacccaagtttagatcagctggccgacatgatcccgtgcgtgttgcagtacttgaatttctctaccatcatcggagtgggtgtcggggccggcgcctacatactggccagatacgccctgaatcatccggatactgtgtag

SEQ ID NO: 16257 - DNA, 1128 bp, Artificial Sequence
  Description of Artificial Sequence: Synthetic coding sequence
atggacgaactccaagatgtgcagctgaccgagatcaagccgctgttaaatgataagaacggtactaggaatttccaggatttcgactgtcaggagcacgatattgagactacacacggggtggtgcacgtgactatccgtggtctacctaagggcaaccggcctgtcatcctgacctaccacgacatcggactgaatcataagagttgttttaatgcgtttttcaatttcgaggatatgcaggagatcacccagcacttcgcagtctgccacgttgacgcgccgggtcagcaagaaggggcccctagctttcctactggatatcagtacccaacaatggatgaattggctgaaatgctaccgcctgttctgacccacctatccctcaaaagtatcattggaatcggcgtaggcgctggagcctacatcctttcaagatttgctcttaaccaccctgaactcgtcgagggcctggttttgatcaatgtggacccttgcgctaaaggatggatcgactgggccgcatcaaaactgtctggcctcaccacgaatgtggtggatattattctagcccaccacttcggtcaggaggaactgcaagccaatctcgatctcatccagacgtaccggatgcacatcgcgcaggatatcaaccaggataatctccagctgttcctcaattcttacaacggccgccgggacctggagattgaaagacccatcctaggccagaacgataataaatccaaaactctcaagtgctcaacccttctggtggttggggacaacagccctgctgtggaagcagtggtggagtgtaacagccggctcaaccctattaacaccacactcctgaaaatggccgactgtggtgggttgccacaagtcgtgcagcccggaaaattaactgaagcttttaaatactttcttcagggcatggggtacatcccttccgcctcaatgacccgcctcgcgcgctcacgcacccactccacaagcagcagcttggggagcggtgaatccccttttagccgcagcgtgacgtccaatcagagtgacggaactcaggagtcttgcgagagccctgacgttcttgacaggcaccaaacaatggaggtgtcatgctag

SEQ ID NO: 16258 - DNA, 1092 bp, Artificial Sequence
  Description of Artificial Sequence: Synthetic coding sequence
atggacgagctacaagatgtgcagttgacagagatcaaacctttgttaaatgataaggagcacgatatcgaaaccacccacggagtggtccatgtgacgattcgagggctgccaaagggaaatcgtccagttatcttgacataccacgacattggactgaaccataagtcgtgcttcaatgctttctttaactttgaggatatgcaagaaatcacacagcatttcgctgtgtgtcacgttgatgcccccggacagcaagaaggggctccaagttttccaactggctaccagtaccccacgatggacgaactggctgaaatgctcccccccgtcctcacccacttatctctcaaatctatcatcggtattggggtcggcgctggtgcgtacatcctttcaaggtttgcattaaatcacccggaactggttgaagggctcgtcctcatcaacgtggacccgtgtgctaaaggctggatagattgggcagccagcaagctgtctggattgactacaaatgttgtggatataattctcgctcaccacttcggccaggaggaattacaggccaatctggacctgatccaaacatatcgcatgcatatcgcacaggatatcaaccaagataacctccagctgtttcttaacagctacaatgggcggagagacctcgagatcgaaagacccatacttggacagaacgataacaagtctaagacactgaagtgtagcacgctactggtggtaggtgacaactctcctgcagtggaagctgtggtcgaatgtaatagcaggctcaatccaataaatactacactacttaaaatggctgactgcggagggttgccccaggttgttcagcccggaaaattgacggaagcctttaagtattttttacaaggtatgggctatattccatcagcgtccatgacaaggcttgcgagatcaaggacacattccacgtccagttccttaggatccggagagtctccatttagtagatcagttacgtctaatcaaagcgacggaacccaagagtcctgcgaatcaccggatgttctcgaccgccatcagaccatggaagtgtcttgctag

SEQ ID NO: 16259 - DNA, 843 bp, Artificial Sequence
  Description of Artificial Sequence: Synthetic coding sequence
atggtgcaggagacatcccgtacgctcacagtacgttaccagtatcctacaatggatgagctcgcagaaatgttaccacctgtgttgacccatctatctttgaagtccatcattgggatcggggtcggggcaggagcgtatatcttaagcagatttgctctgaatcaccccgagttagttgaagggctggtgctgatcaatgttgatccatgcgctaagggctggattgactgggcggcgtccaagctgtccggccttacaacaaatgtggtggacatcatacttgcccatcacttcggacaggaggagttgcaagctaaccttgatcttatccaaacgtaccgcatgcacattgcacaagacataaatcaagacaaccttcagctcttcttaaattcttataacgggcgcagggacctcgaaatcgagcgtcccatcctgggacaaaacgacaataagagtaaaactctgaagtgctctaccttgctagtggtgggagataactccccggcggtggaagcggtagtcgaatgtaattctagactgaaccctattaacaccactctgcttaaaatggccgattgtggaggactgcctcaggtcgtgcagccaggcaagctgacagaagcctttaagtatttcctccaaggcatggggtatatcccttctgccagcatgacaaggttggctagatccagaacacattccacatcatccagcctcggttctggtgaatcaccattttcaaggtctgtcaccagcaaccaatccgatggcactcaggagtcttgcgagagcccagatgtgctggatcgtcatcagactatggaagtctcatgctag

SEQ ID NO: 16260 - DNA, 816 bp, Artificial Sequence
  Description of Artificial Sequence: Synthetic coding sequence
atgatccgctaccagtaccctaccatggacgagctggctgaaatgttgcctccggtgctcacacacctaagcctcaagagtatcatcggcattggagtgggtgctggtgcctacatcctaagtcgattcgccctgaaccacccagagcttgtcgagggattagttctgatcaacgtcgacccttgtgcgaagggctggatcgactgggctgcttccaagttgagcgggctgactaccaatgtggtcgacataattcttgcacatcactttggacaggaggaactgcaggcaaacctggatctgatccagacctatagaatgcatatcgcccaggacatcaatcaagataacctgcagctctttctgaattcgtataacgggcgccgcgatttagagatcgaaaggccgatcctcggccagaatgataacaaatcgaagacactgaaatgctccacattgttggtggtgggagacaacagtcccgcagtcgaggctgttgtggaatgtaattctcggctgaacccaatcaacacaaccctactgaagatggccgattgtggcggccttcctcaggtcgtccagcctggcaaactgactgaagcctttaaatacttcctgcaggggatggggtacatcccttccgcttctatgacacgacttgcccgaagcaggacccactctacttcatcttcactcggctcaggagagtccccgtttagccgtagtgtcacctctaaccagagcgacggtacacaggaaagctgtgagtctcctgatgttctagatcgtcatcaaactatggaggtgagttgctag

SEQ ID NO: 16261 - DNA, 420 bp, Artificial Sequence
  Description of Artificial Sequence: Synthetic coding sequence
atgccagaaggcccagagctgcatctggcgagtcagttcgtgaacgaagcatgtagggccctggtcttcgggggatgcgtggagaaaagctctgtctctcggaaccctgaagtgccttttgaaagcagcgcttatcgaatatcagccagcgctagaggcaaggagctgcgacttatcctgtccccactacccggagctcagccacagcaagagccgcgggccccccgtggcgcagccactccttgcccccccgccctgcttcacggcccagcgtggcccccagccagacctatgttcagaggccaccctcccgtacgacccctgggtccatgggggaaggtagccgccgggccgcgggctttgtgtctcgccggggtccctgccgtccagggagaatgcgctacaaagcccagcgggtag

SEQ ID NO: 16262 - DNA, 1173 bp, Artificial Sequence
  Description of Artificial Sequence: Synthetic coding sequence
atgcctgagggaccagaattacacttagctagtcaatttgtgaatgaagcctgcagagctcttgtcttcggaggttgcgtggagaaaagcagcgtgtctcggaatcctgaagttcccttcgagagttccgcctaccggatctctgcctcagctcgcggtaaagaactgcgcctaatcttgagccctttgccaggggctcagccacagcaagaaccgctggcattggtgttccgcttcggtatgtcgggatcctttcagctggtgcctcgggaagaactgcctcggcacgctcatctccgcttctacactgctcctccagggccacgtcttgcgctgtgtttcgtggatattcggcgctttggtagatgggatctcggcggaaaatggcaacccgggcgggggccgtgtgttttgcaggagtaccagcagttcagagagaatgtcttgagaaatctcgccgacaaggcatttgatcgtcctatctgcgaagcacttttagaccaacgcttcttcaatggaatcggaaattatctgagagctgagatcctatatagactgaagattccgccctttgagaaagcaaggtccgtcctcgaggccctgcagcaacacagaccttctcccgagttgactttgtcacagaagatcagaacaaaattgcagaaccctgacctgctcgagctgtgtcattccgtgcctaaggaggtggtccaacttggtgggaagggatacggctccgagagtggcgaagaggacttcgcggcctttagagcctggttgaggtgttacggtatgcctggcatgtctagcctgcaggaccggcacggccggacgatctggttccagggggaccctggacctctggctcctaaggggcgcaaatctaggaagaagaaatccaaagccactcagctcagtcctgaagaccgagttgaggatgccctgcctccaagcaaggcaccatcccggacacggcgggctaagcgcgatctgcccaagagaaccgctacacagcggcccgaggggacctccctgcaacaggatcccgaggcaccgactgtgcctaaaaaggggaggcggaaaggcaggcaggcagcaagcgggcactgccggcccaggaaagtgaaagccgatataccaagtctggaacctgagggcacatcagcttcctag

SEQ ID NO: 16263 - DNA, 1173 bp, Artificial Sequence
  Description of Artificial Sequence: Synthetic coding sequence
atgcccgagggcccagaacttcatttagcgagccagttcgtaaatgaagcctgtcgcgcactggtctttgggggctgcgtggaaaaatcttcagtgagccgaaaccccgaagtcccttttgaaagctctgcataccggatatctgcgtcagccaggggaaaggaactgaggttgatcttgagtcctttgccaggtgcccagcctcagcaagagcctctggcactggtcttccgctttggcatgtccggaagcttccaactggtgcctcgggaagaacttccccgtcacgcccacctccggttctataccgcccccccggggcctcgacttgcgctgtgcttcgtcgatatacgaaggttcggccggtgggatctgggcgggaaatggcagcctggtaggggaccgtgcgtgctgcaggagtaccaacagttcagggaaaatgtcctccggaatctggctgacaaagcctttgaccggccaatatgcgaggccctcctggaccaacggttcttcaacgggattgggaactacttacgggctgaaattctgtacaggctgaaaatccccccttttgagaaggccaggagcgtcctcgaggcacttcagcagcacagaccaagcccagaattgacactctcgcagaagatacgcaccaagctgcagaaccccgacctcttggaactctgtcattcggtgccaaaggaagtcgttcagttgggcggaaagggatatgggtccgagagtggagaggaggatttcgctgcatttcgcgcttggctgaggtgctatggtatgcccggcatgtctagcctgcaggataggcatggccgaactatttggtttcagggtgatccaggcccgctggctcccaaaggccgcaaaagccgaaagaaaaagtcgaaggccacgcagttgagtcctgaagacagggtcgaggacgcacttcccccatccaaggctcctagccggacaaggagggcgaaaagagacctgcccaagagaaccgctacacagaggccagagggcacgtcactgcagcaggaccccgaagctccaacggtgcccaagaaaggcaggaggaaaggacgacaggccgcttccggacactgcagaccaaggaaagtcaaggctgatattccgagcctcgaacctgaaggcacatcggccagttag

SEQ ID NO: 16264 - DNA, 999 bp, Artificial Sequence
  Description of Artificial Sequence: Synthetic coding sequence
atgcctgaaggccccctggtgcgcaagttccaccatctcgtcagccctttcgtgggacagcaagttgtgaagacagggggcagcagcaaaaaactgcagcccgcctccttgcagagtctatggctccaggatacgcaggttcatggaaagaagctgttccttaggttcgaccttgacgaggaaatgggcccaccgggcagtagtcccacacccgagccccctcaaaaggaggtccagaaagagggcgcagctgaccccaagcaggtgggagaacctagcggacagaaaaccttggatggcagtagtcggtccgcagagctggtgcctcagggagaggacgacagcgagtacctggagagagatgcacccgccggggacgcagggagatggttaagggttagctttggtctgtttggtagtgtctgggtcaacgatttttctagggcaaaaaaggcaaacaaaagaggtgactggagagatccttctcctaggctggtgctgcacttcggagggggcggattcctagccttttataactgccagcttagctggagctcctcccctgttgttacccccacctgcgatatacttagcgagaaatttcacagaggtcaagcactcgaggcacttggccaggcccaaccagtctgctacactcttctggatcagagatatttttccggcttgggtaatattattaagaacgaggctctgtatcgtgcagggatccacccactatctctcggcagtgttctgtctgcctcccgcagggaggtccttgtcgaccatgtagtcgaattttcaaccgcatggcttcagggcaaattccagggcaggccacagcatactcaagtgtaccaaaaagaacagtgccccgctgggcatcaggtcatgaaggaagcgtttggtccggaggacggtctgcaaagactgacttggtggtgtccccaatgtcagccccagctttctgaggagcctgaacaatgccagttttcatag

SEQ ID NO: 16265 - DNA, 954 bp, Artificial Sequence
  Description of Artificial Sequence: Synthetic coding sequence
atgccagaaggaccgctggtccggaagttccatcaccttgtgtcccccttcgtgggacaacaagttgtgaagacgggcggcagctctaagaagcttcagcctgccagtctacaaagtttgtggcttcaggacactcaggtgcatggcaaaaaactttttctcaggttcgatctcgacgaagagatgggcccaccaggatcatcaccaaccccggagcctccccagaaagaagtccagaaaaaaactctcgacggatcttccagaagcgcagaactggttcctcagggagaggacgatagcgagtaccttgaaagggacgcccctgccggcgacgccggtcgatggcttcgcgtttcttttggcttattcggaagcgtttgggtgaacgactttagccgcgcaaagaaagctaataagcgcggtgattggcgagatccaagtcctcgcttggtgctgcacttcggagggggcgggtttctggctttttacaattgccagctgagctggtcttcgtctcccgtggtgacccctacttgcgatattctgtccgagaagttccaccgcggtcaggccctcgaagccctgggccaagctcaacctgtttgctacaccctgctagatcaaaggtattttagcggactcgggaacataatcaagaacgaagctctgtacagagccgggattcaccctctcagcctaggcagcgtgctatccgccagccggagggaagtcctggtagatcacgtcgttgagttctcaacagcctggctgcagggcaaatttcagggcagaccccaacacacacaggtctatcagaaagagcagtgtcccgcgggacatcaagttatgaaggaggcttttggtcccgaggatggcctgcaaagactgacatggtggtgcccccaatgccagccacagcttagcgaagaaccagaacagtgtcagttctcatag

SEQ ID NO: 16266 - DNA, 816 bp, Artificial Sequence
  Description of Artificial Sequence: Synthetic coding sequence
atgggaccacccggctcttcacctaccccagaacccccccagaaggaagtacaaaaggagggggcagctgacccaaaacaggtcggggaaccttcaggacagaagaccctggacgggtccagtcgtagcgccgaactggtcccccagggcgaagacgacagcgaatatctggagagagacgccccagcaggcgacgcaggcagatggctcagggtgagctttggattgtttgggagtgtgtgggttaatgatttcagcagggctaagaaggcaaataaaagaggagactggcgcgacccaagccccaggttggttctccattttggaggagggggatttcttgccttctataactgccagcttagctggtcttctagccctgtggtgacacctacctgcgacatactgtctgaaaagtttcacagagggcaagcgctggaggccttgggccaggcacagcctgtctgttatacgctattggatcagagatattttagcggactggggaacatcattaagaacgaggccttataccgggcgggaatacacccactttcacttgggtcggtgctttctgctagcagaagagaggtcctggttgaccatgtggtcgaattcagcacagcttggttacaggggaaattccagggccgcccacagcatacccaggtctatcagaaagaacaatgcccagctggacatcaggtcatgaaggaagccttcggcccggaagatggactccagcgtctgacctggtggtgtccccagtgccagccacaactgtctgaggagcccgagcaatgtcaattttcctag

SEQ ID NO: 16267 - DNA, 999 bp, Artificial Sequence
  Description of Artificial Sequence: Synthetic coding sequence
atgcccgaaggcccattggttagaaagttccaccatttggtgtcccctttcgtgggacagcaggttgtgaaaacagggggctcttctaagaagttacagccagccagcctccagtcgctctggctccaggatacccaggtgcacggcaaaaagttatttctgcgctttgatctggatgaggagatgggacctccgggatcatctcctacgcccgagcccccccagaaggaagtgcagaaggagggggctgcagacccaaaacaggttggagagccaagcggtcagaaaaccctagacggctcaagcagatcggctgagcttgtcccccagggtgaggatgattcagaatatcttgaaagagacgcgccagctggtgatgccgggcggtggttacgggtgagctttgggctttttggctctgtctgggttaatgacttctcacgggccaaaaaggccaacaagaggggagattggcgcgatccgagcccccgcctggtgttgcactttggcgggggcggcttcttggctttctacaattgtcagctgagttggagttcttcccccgttgtgacacccacgtgtgacatcctgtcagagaagttccaccgaggtcaggccctggaggccctgggacaggcgcagcccgtttgctacacattgctcgatcaaaggtacttctccggtctgggcaatatcatcaaaaacgaagccttgtaccgcgcgggcatccacccactctccctcggctcagtccttagtgccagccgtcgagaagtactcgtcgatcatgtcgtcgagttcagtactgcatggctccagggtaagtttcaagggcgaccacagcacacccaagtgtaccagaaggagcagtgtcccgctggccaccaggttatgaaagaagcattcgggcccgaggatggtcttcagcggctgacatggtggtgtccacagtgccaacctcagctgagtgaagaacctgaacaatgtcaattttcttag

SEQ ID NO: 16268 - DNA, 999 bp, Artificial Sequence
  Description of Artificial Sequence: Synthetic coding sequence
atgccagaggggcccctggttagaaaatttcatcatctggtcagtccttttgtggggcagcaggtggtgaaaacgggaggaagttctaagaagttacaaccagcatctctgcagagtttgtggctgcaggacactcaggtgcatgggaagaagctgtttcttcgatttgacttagacgaggaaatgggccctccaggctcttctcctacgccagaaccgccacaaaaagaagtacagaaggaaggagccgctgatcccaaacaggtgggcgaaccctcagggcaaaagactctcgacggctcttcaaggtctgccgaactggttccacagggcgaagatgactctgaataccttgaaagagacgctccagcaggagacgccgggcgttggctccgtgtgtccttcggtctcttcggcagcgtttgggttaatgacttttctagggccaaaaaggcaaataagcggggcgactggcgcgacccttcaccaaggctggtccttcactttgggggcgggggtttcctggctttctataactgccaactatcctggtcctccagtcccgttgttacgccaacttgcgacattctttccgagaagtttcatcggggtcaagccctcgaggcattaggtcaggcacagcccgtttgttacacactgttggaccagcgctatttctctgggctggggaatattataaaaaatgaagccttatatcgcgctgggattcaccccctgagcctcggatcagtgctctctgcatcccggcgagaggtgctggtggaccatgtggtggagttctccaccgcctggcttcagggcaaattccagggccggccgcagcatactcaggtttaccagaaggagcagtgtcccgctggacaccaggtgatgaaagaggccttcggtccagaagatgggttacaacggctgacatggtggtgtccacagtgccagccgcagttgtctgaggaaccagagcagtgtcagttcagctag

SEQ ID NO: 16269 - DNA, 651 bp, Artificial Sequence
  Description of Artificial Sequence: Synthetic coding sequence
atgccagagggcccccttgtccgaaagtttcaccatctggtatctcccttcgtggggcagcaggtagtgaaaaccggtggcagctccaagaagctgcagcccgcttcattgcagtccctttggcttcaggatacccaggtccgcttggtcctgcatttcggtgggggcggatttctcgccttctacaactgtcagctttcgtggagttcctcgccagtcgtcaccccaacttgtgatatcttgtcagagaagttccaccgaggccaggccctggaagcgctgggccaggcacagccagtctgttacactttactagatcagcggtactttagtggactcggcaatatcattaagaatgaggccctctatcgagctgggatccacccactgtccctgggatctgtactgagtgcatcaaggcgggaagtgctcgtcgaccacgtggtagaattttcaacggcatggctgcaaggaaagtttcaaggacggcctcaacatactcaagtatatcaaaaggagcagtgccccgctggtcaccaagtaatgaaagaagcatttggtccggaggatgggctgcagcgtctgacctggtggtgtccgcagtgccagcctcaactgtccgaggaaccagagcagtgtcagttctcctag

SEQ ID NO: 16270 - DNA, 1818 bp, Artificial Sequence
  Description of Artificial Sequence: Synthetic coding sequence
atggtcgagggaccaggctgtactcttaacggagaaaaaatcagggcccgcgtcttacccggacaagcggtgacaggtgtcagggggtccgccctgcggtctctccagggccgcgctcttagactcgctgctagcactgttgtggtaagtcctcaggccgctgctttaaataatgatagctcacagaacgtactgtctttatttaatggatacgtttactctggcgtggagacattgggtaaggaactcttcatgtatttcggcccgaaagccttgcgaattcattttggcatgaaaggctttatcatgatcaaccccctggaatacaaatacaaaaatggtgcctccccggtgctcgaggtccagctcacgaaagacctgatttgcttttttgattcaagcgtggaattgaggaattccatggaatcacaacagagaattcgtatgatgaaagaattagacgtgtgctctcccgagtttagctttctccgcgcggagtctgaggtcaagaagcagaaaggccgaatgctaggtgatgtcctcatggaccaaaacgtgctcccgggggtgggcaacattatcaaaaatgaagctctgttcgacagcggcctgcaccctgcagttaaggtgtgtcaactgactgatgagcaaattcatcatctgatgaagatgattagagatttctctatacttttttatcggtgtcggaaggccggccttgcattgtcaaagcattataaggtatataaacggcctaattgcggccagtgtcactgtcggattacagtgtgcaggtttggcgataataatcgtatgacatatttctgtcctcactgtcaaaaagagaacccacagcatgttgacatctgcaagctgccaacaaggaacaccatcatcagctggactagcagccgcgtggaccatgtgatggattctgtagcccgcaaatcggaagagcattggacctgtgtcgtgtgtaccctcataaacaagccttcctcaaaggcatgcgatgcgtgcttgacttcaagacctatagacagtgtcttaaaaagcgaggaaaatagcacagtctttagccatcttatgaagtatccgtgcaacacctttggcaagccccatacagaagtcaaaattaatagaaaaactgcctttggcacgacaacactggtgctgaccgatttttccaataaatctagcacactcgagcggaaaaccaaacaaaaccagattcttgacgaggaattccagaattctcctcccgccagtgtgtgtctaaatgacatccagcatccatccaagaagactaccaacgacatcactcagccctcaagcaaggtgaatatatctcccaccataagcagcgaaagtaaattgttttctcctgcacacaaaaagccaaagacagcccagtactcgtcacctgagttgaaaagctgtaatcccggctactccaatagcgagctgcagattaatatgaccgatggcccacgtacgttgaatcctgatagccctcggtgttccaagcataatcgcctgtgtattttaagagttgtgggcaaggatggagagaacaagggtcgacaattctatgcatgtcccctgccccgcgaggctcagtgcggctttttcgagtgggcagacctttccttccctttctgtaaccatggaaaacgttccaccatgaaaaccgtgttgaaaatcgggccaaataacggaaaaaatttcttcgtgtgtccgctgggcaaagagaagcagtgcaatttctttcagtgggctgagaacggccccggcataaagatcatccccggctgctag

SEQ ID NO: 16271 - DNA, 1743 bp, Artificial Sequence
  Description of Artificial Sequence: Synthetic coding sequence
atgcccggatggccctggggactattgcttacagctggtacgctcttcgccgctcttagccccgggcctccagcaccagcagacccgtgtcacgatgaaggaggtgctcctcgcgggtgtgttcccggcctggttaatgccgcgttggggcgggaagtcctggcttcctcgacctgtggacggccagccaccagagcctgtgacgcttccgatccccggcgcgctcactctccagccctgctgacctctcccggggggacggcatccccattatgttggaggagtgagtctctgccacgcgcccccttgaatgtcacactgactgtgcccttagggaaggcctttgagctggtttttgtttccctgcgcttctgttcggccccacctgcgagtgtggctttgctcaaaagccaggatcacgggcggtcctgggcaccactgggtttcttcagttcccattgcgatctggattacggacgactgcccgctccagctaacggccccgcggggccagggccagaggcgctgtgcttccctgccccccttgcccagccagacggttccggattgctggctttcagcatgcaagacagctcgccccccgggttggatctcgactcttcacccgtactccaggactgggtgaccgccacagacgttagagttgtcttgacgcgccccagtacagcaggggaccccagggatatggaggccgtagtgccttatagttacgccgccacagacctgcaggtcgggggtcgttgcaagtgcaacggacatgccagccgatgcctgcttgacacccagggacacttaatctgcgattgccgtcacggaactgaaggaccggactgtggccggtgtaagcctttttattgtgaccgaccgtggcagcgggccactgccagggagtcccatgcgtgcctggcttgttcctgcaacggccatgcgagaaggtgtaggtttaacatggagctgtaccggctttcggggcgccggagcggcggcgtctgccttaattgtcgacacaataccgctggaaggcattgccactactgtagagaaggcttctaccgcgatcccggtcgtgccctctcggaccgcagagcttgccgggcctgtgattgccaccccgtcggagctgccgggaagacctgtaatcagacaaccggccagtgcccctgtaaagacggcgtaacgggtctgacttgcaatcggtgcgccccagggttccagcaaagcaggtcgcctgttgccccgtgcgtgaagacgccaattccagggccgacagaggactcttcacccgtccagccccaagactgtgattctcattgtaagcccgcaaggggcagctatcggatcagtctaaaaaagttttgcaaaaaggattatgctgtacaggtggccgtgggtgcgaggggcgaggcacgtggcgcatggaccagattccccgtggccgtactagcagtattcaggtctggagaggagcgggcgcgccgcggttctagcgcactgtgggtgcctgcgggtgatgctgcttgtggttgcccgaggctcctacctgggcggcgctatctactgttggggggaggacccggagctgcagccggaggggcagggggccgcgggcccggattaattgcggctcgcggctcactggtgctcccttggagagatgcctggacccgccgactgaggagattgcagcggcgggaaagacgcggtaggtgttctgctgcatag

SEQ ID NO: 16272 - DNA, 2547 bp, Artificial Sequence
  Description of Artificial Sequence: Synthetic coding sequence
ctcttctgtttcgtcttcagcgtaagtctgcaggttgacatcgtgccttctcagggtgagatctcagtcggagagagcaaattttttttgtgtcaggtggctggagatgcaaaggacaaggatatcagttggttcagtcccaacggcgagaagctaacgcctaaccaacagaggattagtgtggtttggaatgacgattcgtcctctacactcaccatttacaacgcaaacattgacgacgcaggcatttacaaatgcgtggttaccggggaggatgggagcgagagtgaggctactgtgaacgtgaagatctttcaaaagcttatgttcaagaatgcacccaccccccaggagtttagagagggtgaagatgcagtgatcgtgtgtgatgtggtgtcttctctcccaccgacaataatatggaagcataagggtagggatgtgatcctgaaaaaagacgtgaggttcatcgtcctctctaacaattatttgcagattagagggattaagaagactgacgagggaacttaccgctgcgaaggccggatccttgccagaggcgagattaatttcaaagatatacaagtcatcgttaacgtccctcctaccattcaggcccggcaaaatattgtgaacgccacagcgaatctcggccagagcgtaactcttgtatgtgacgcagaagggtttcccgaaccaaccatgagctggacaaaggacggcgagcaaatcgagcaggaagaagatgatgagaagtatattttctcagacgatagctctcagctcaccatcaagaaggtcgacaagaatgacgaggcagagtacatttgtattgccgagaacaaagcaggggaacaagacgctactatccatttgaaggtctttgccaagccgaaaataacttacgtggagaaccagactgcgatggagctggaggaacaggtgacacttacatgtgaagcgagcggagatcctatcccaagcatcacgtggcgcacctccacccggaatattagcagcgaggagaaagctagctggacgcgtccagaaaaacaggaaacccttgatggacatatggtggttaggagtcacgccagagtgtccagcctcaccctcaagtctattcaatacacagacgccggcgaatacatctgtactgcctctaacaccatcggtcaggacagtcagtcaatgtatctagaggtccagtacgcacctaagctgcagggaccagttgcggtctacacgtgggaaggtaatcaggttaatattacctgtgaggtctttgcctacccctctgctaccatatcttggtttagggatggccagcttttgccgtcttcgaattattccaacattaagatctataacaccccctcagccagctacctggaggtgacaccagacagcgaaaacgattttggaaattacaattgcacagccgtcaatcgcataggacaggagagtcttgaattcatcctggtacaggctgacacacccagcagtcccagcatcgaccaggtggaaccctactcctccaccgcccaggttcagtttgatgaacctgaagctaccggtggcgtaccaattcttaagtataaggctgagtggcgtgccgttggagaggaagtgtggcacagtaaatggtatgacgcaaaagaagcatcaatggaaggcatcgtgacaatagtcgggcttaagccagaaactacctacgctgtgagactggcagcactcaacgggaaagggctgggcgagatttccgcagcttccgagtttaagacccagcccgttccgggcgagccttctgctccaaaactcgagggacagatgggcgaagacggaaattcaataaaggttaatctgattaagcaggacgatggagggtccccgatacggcactatttggtgcgatatcgggcattatcaagcgaatggaagccagagatccggctccccagcggaagtgatcacgtgatgctgaagtctctcgactggaacgcggagtatgaggtgtatgttgtggccgaaaaccaacagggaaaatctaaggctgcacattttgtgtttagaaccagcgcccagccgacagctattcccgccaatggcagccctacctcagggctttccaccggggccatcgtggggattctcatcgttatattcgtcctactgctggtggtcgttgacattacatgttactttttgaataagtgtgggctgtttatgtgtatcgctgtaaacctatgtggtaaggctggccccggtgctaaaggaaaggacatggaagaaggcaaagcggctttttcaaaagacgagtccaaggagcctatcgtggaggtccgaacagaagaagaaagaacccccaatcacgatggcggcaagcataccgagccgaacgagactaccccacttaccgagccagagaagggtcctgtggaagctaagcctgagtgtcaggagaccgaaaccaaacctgcccccgctgaggtgaagacagtacctaatgacgctacccagacaaaggaaaacgagagcaaagcctag

SEQ ID NO: 16273 - DNA, 1995 bp, Artificial Sequence
  Description of Artificial Sequence: Synthetic coding sequence
attactatcagggatgaaatttgggtgctgttctgttttgtcttcagcgtgtctctgcaggtggatatcgtgccaagtcagggagaaatctccgtaggggagtctaaattctttctgtgccaggtggccggggatgccaaagacaaggatatcagctggttttctcccaacggggagaagttaacaccgaaccagcaacggatttccgtagtgtggaacgatgacagttccagcaccctgacaatttataacgccaatatcgatgacgctggcatctataaatgcgtggtgaccggcgaggacggcagcgagagtgaagccacggtgaatgtaaaaatattccaaaaactgatgttcaaaaacgcacctacccctcaggagttccgagagggcgaggacgcggtcattgtctgtgacgtggtgagctccctgccgcctacaataatttggaaacataaagggcgtgacgtgattctgaagaaggacgttagatttattgtgctcagcaataattacctgcagatccgcggaatcaaaaagaccgacgaggggacttacagatgtgagggccggattctggcacgaggagaaattaatttcaaggacattcaagtgatcgtcaatgtgccacccacaatccaggctcgacaaaacattgtgaatgcaacagccaatctagggcagagtgtcaccctggtctgtgacgccgaggggttccctgaacctaccatgtcatggacgaaggatggcgagcagatcgagcaggaagaggatgatgagaaatatatcttttccgatgatagtagccagcttactatcaaaaaagtcgacaagaatgacgaggcagagtacatatgtattgccgagaacaaagccggggagcaggatgccaccattcacctcaaggtgttcgctaaacctaaaattacctatgtggagaaccagaccgctatggagcttgaagagcaggtcacactcacatgtgaagcgagtggcgatccaatcccatcaattacttggcggaccagcacgaggaacatcagctcagaggagaaagctagttggactaggcccgagaaacaggagacactggatggtcacatggtcgtgagatctcatgccagggtgtcgtctctgaccctgaagagcatccagtacacagacgctggagaatacatttgtaccgcatctaacaccatcgggcaggattcccagtccatgtacctcgaggtacagtatgcgcccaagctccaggggccagtggctgtgtacacgtgggaaggcaaccaggtgaatatcacttgtgaggtcttcgcctacccatcagcgaccatctcttggttccgtgacggccaactactgccttcctccaattacagcaacattaagatctacaataccccatccgcctcctatctggaagtcacccccgattcagaaaacgactttggcaattacaactgcaccgcagtgaaccgcattggacaggagtccctcgagtttatccttgttcaagcagacactccatcttcgccctccatcgaccaggtggagccctattcttccacagcccaagtgcagttcgatgagccagaggcgacaggtggcgtgcctatattaaaatacaaagcagaatggagggctgtgggggaagaggtgtggcacagcaaatggtatgacgcaaaagaggcttcgatggaggggatcgtgactattgtgggtttgaaacctgaaaccacctatgccgtgaggctggccgccctaaacgggaagggcttgggcgagatttctgcggcttccgagttcaaaactcagcccgtgcaagcgcctcctccaacagcttctgcctctagttctacgcccgttcccctgtcccctccagacacaacatggccactccccgccctcgctacaaccgagcccgccaagaatattgcccagaatcactgctgcaatatgttccaggccggactacacaacgcgctgatgaaatag

SEQ ID NO: 16274 - DNA, 942 bp, Artificial Sequence
  Description of Artificial Sequence: Synthetic coding sequence
atggaaggcattgtcacaatagttgggctcaaaccagagaccacctacgccgtgagactggccgcactgaatggcaaaggcttaggtgaaatttccgctgcgtcagagttcaagactcaaccggtacacagtccgcccccccctgcatcagcctcttcgtccacgcctgtccccctttctcctcctgatacgggtgagccttccgcacctaagctggagggacagatgggagaagatgggaactccatcaaggtgaacctgattaagcaggatgacggcggtagtcctataagacactatttggtgaggtatagagcattatcaagtgaatggaaaccagaaataaggctgccctcgggctccgatcacgtcatgctgaaatcactcgattggaacgccgaatacgaggtttatgtcgttgcggaaaaccagcagggcaagtccaaagcagcccacttcgtgttcagaactagcgcccagcccacagccattccagccaatgggagtccgacatcgggcctgagcacgggagccattgtggggatactcattgtcatctttgtcctcctgttggtcgtcgtcgatataacctgttacttcctcaacaagtgtggactgttcatgtgcattgccgtgaacctatgcggcaaggccggcccaggtgctaaagggaaagacatggaagagggtaaggctgccttctccaaggacgaaagcaaggaacctattgttgaggtaagaaccgaagaagagaggacccctaaccacgacggtgggaaacacaccgaacccaacgaaactacccccttaactgaaccggagaaaggaccagttgaggccaaaccagaatgtcaggagactgaaaccaaaccagcccctgctgaagtgaaaaccgttccaaatgacgcgacgcaaactaaagagaatgaaagcaaggcatag

SEQ ID NO: 16275 - DNA, 570 bp, Artificial Sequence
  Description of Artificial Sequence: Synthetic coding sequence
atgacagaatataaattggttgtggtgggagcgggtggggtgggtaaatccgcactgacaattcagttgattcagaaccattttgtggacgagtacgaccccacaatcgaggacagttacaggaagcaggtagtgatagacggtgaaacttgcctattggatattctggacaccgcaggccaggaagagtacagcgcgatgcgcgaccagtatatgcgaacgggagaggggtttttgtgcgtctttgccattaataattcaaagtctttcgctgacataaatttgtatagagagcagataaaaagagtcaaagatagcgatgatgttccaatggtgctggtggggaacaagtgcgatctgccgacgaggaccgtcgacactaaacaggctcatgagctcgcaaagtcctatggtatccctttcatagagaccagcgctaaaacacgccaaggggtggaagacgccttctacaccctggtgagggaaattcggcagtaccggatgaagaagctgaattcttccgacgacggcactcagggctgcatgggtcttccttgcgtggttatgtag

SEQ ID NO: 16276 - DNA, 651 bp, Artificial Sequence
  Description of Artificial Sequence: Synthetic coding sequence
atgccaggtaacctgatgagccaaacttcaagggcagtgtctatttggaagttccccgcgaagctcgggaaaacccacggacaccgcgcccttgaggctactggcatgatgcttagggtattagtcggcgccgtgctcccagccatgctgttggccgcccctccaccaatcaacaagctagctttgttccctgataagtccgcctggtgcgaggctaaaaacattacccagatagttggccattctgggtgtgaggccaagagtattcagaatagggcttgccttgggcagtgtttctcctactccgttccaaatactttcccccagtctaccgagagcctcgttcactgtgacagttgtatgccggctcagtctatgtgggagatcgtgaccctggagtgccctggccatgaagaagtgccccgagtggacaagctggtggagaagatactgcactgttcctgccaagcctgcgggaaggaaccttcccatgaagggctttctgtatacgtgcagggcgaggacggtcccgggagccagcctgggacccaccctcaccctcatccccacccacatcctgggggacaaacacccgaacccgaagacccccctggagcacctcacacagaggaggaaggggccgaagactag

SEQ ID NO: 16277 - DNA, 546 bp, Artificial Sequence
  Description of Artificial Sequence: Synthetic coding sequence
atgatgttgcgcgtactggtcggtgctgtgctgcccgctatgcttttggctgcaccaccccctattaataagctcgctctgtttccagataaaagcgcatggtgcgaggccaaaaacatcacccagatcgtcggccactccggatgcgaagccaaatccattcagaatagggcatgcctgggtcagtgtttttcttactccgttccaaataccttcccacagtctacagaatcgctcgtgcactgtgacagttgcatgcccgcccagagtatgtgggagatcgtgaccttagaatgccccggccacgaagaagtgccaagggtggataaactggtggagaagattctccactgcagctgccaggcgtgcggaaaggagccttcccacgaaggcttgtccgtgtatgtccaaggtgaagatggccctggcagtcagcctggtacacacccccacccacatccacaccctcatccaggaggccagacccctgaaccagaggatccccctggggcaccccatacggaagaggaaggtgccgaagactag

SEQ ID NO: 16278 - DNA, 351 bp, Artificial Sequence
  Description of Artificial Sequence: Synthetic coding sequence
atgatgcttcgggttctggtgggcgccgtcctgcccgcgatgctcctggccgcacctccaccaataaataagctggccctgttcccagacaagtctgcatggtgcgaagcgaagaacattacgcaaattgtagggcactctggatgcgaggctaaaagcatccagaatagggcttgccttggtcagtgcttctcgtattcggtgcctaacacattcccccaaagcacggagtccctggtacactgtgacagttgtatgcctgcccagagcatgtgggaaattgtgacgttagagtgccccggccacgaggaggttccgagggtggataagcttgttgagaaaatcctctag

SEQ ID NO: 16279 - DNA, 492 bp, Artificial Sequence
  Description of Artificial Sequence: Synthetic coding sequence
atgttgcgcgtactggttggtgcagtgttacccgcaatgctgctggcagccccaccgcctatcaataagctggcactgttcccagacaaaagtgcttggtgtgaagcaaagaacatcactcagatcgtcgggcatagcggctgcgaggcgaagtctattcaaaacagagcatgtctgggccagtgcttttcttattctgtgcccaacaccttcccacagagcactgagtcgctggttcactgcgactcctgtatgcccgcgcagtctatgtgggagattgtgacattggagtgccctggacatgaagaggtgcctagagttgataagctggttgagaagatactacattgtagttgccaggcctgcggaaaggaaccatctcatgagggactgagcgtttatgtgcagggagaagatgggcccggaagtcaaccaggcacccatcctcaccctcatccacacccccatcccggcgggcagactccagagtag

SEQ ID NO: 16280 - DNA, 354 bp, Artificial Sequence
  Description of Artificial Sequence: Synthetic coding sequence
atgatgctccgggtactggtaggcgccgtgctcccagcgatgctgttggccgccccccccccgatcaataagctggccctcttccctgataagagcgcttggtgtgaagccaagaatataacgcaaatcgttgggcactccgggtgtgaggccaaatcgatccaaaatcgggcttgcctgggccagtgcttcagctactccgttcccaacacctttcctcagtcaacagaaagccttgttcattgtgacagctgcatgcccgcccagtcgatgtgggagatcgttacgctggaatgccccggccatgaagaagtgccaagagttgacaagctggtagaaaaaattctccactag

SEQ ID NO: 16281 - DNA, 330 bp, Artificial Sequence
  Description of Artificial Sequence: Synthetic coding sequence
atgatgctccgcgtactggtcggggccgtgctgcctgcaatgctgctggcagccccaccacccatcaacaaattagctcttttcccagacaagtccgcctggtgtgaggctaaaaatataactcagatcgttgggcatagcgggtgtgaggccaaatccatccagaaccgggcctgcttagggcaatgcttttcctactccgtgccaaatacgttcccacaatctactgagagtttagtccactgtgactcgtgcatgccagcgcagtccatgtgggaaattgtgactctggaatgtccaggacatgaagaggtcccgcgggtggactag

SEQ ID NO: 16282 - DNA, 387 bp, Artificial Sequence
  Description of Artificial Sequence: Synthetic coding sequence
atgatgctgcgcgtcctggtgggtgccgtgctacccgcaatgttactggccgcccctcccccgattaacaaactcgcactcttccccgacaaaagcgcatggtgtgaggctaagaatattacacagatcgttggccactctggatgcgaggcaaaaagcattcagaatcgcgcctgtttagggcaatgcttttcctattcggttccaaatacattcccacagtctactgaaagtctggttcactgcgattcatgcatgccagcccagtccatgtgggaaattgtgaccttagagtgtccaggtcatgaagaagtgccgcgcgtggataagctagtggagaagatcctgcactgctcttgccaggcctgcggtaaagagccctcttag

SEQ ID NO: 16283 - DNA, 543 bp, Artificial Sequence
  Description of Artificial Sequence: Synthetic coding sequence
atgcttagggtgctggtcggggccgtgctccctgccatgctgctggccgcaccgccacccatcaacaagcttgcattgttcccagataaatcagcctggtgcgaggcaaagaatatcacacagatcgttgggcattccggttgcgaggcaaaaagtattcaaaaccgcgcctgtctcggccaatgtttctcatacagcgtccctaacactttccctcagagtacggagtcgctggtacactgtgactcatgcatgcccgcccaatcaatgtgggagatcgttacactagagtgccctggccacgaggaggtgcctagagtcgacaagctggtcgaaaagatactccattgcagctgccaggcttgcggtaaggaaccgtctcacgaggggctatcagtttacgtccagggcgaagacggccctgggtcccagcctggcacgcatccgcaccctcacccccacccacatcccggtggacagacacccgaaccggaagatccgcccggtgcccctcacacagaggaggagggagctgaagattag

SEQ ID NO: 16284 - DNA, 8457 bp, Artificial Sequence
  Description of Artificial Sequence: Synthetic coding sequence
atggccgctcacaggcccgtcgagtgggttcaggctgtcgtctccaggttcgacgagcagttaccaatcaaaaccgggcaacagaacacacatacgaaagttagcaccgagcacaataaggagtgtctgattaatatctcaaaatataagtttagtttggtcatcagcggtctgactactattctcaagaacgtcaataacatgcgcattttcggggaggccgccgagaagaacctttacctgagccagcttataattctggacactctggagaagtgtcttgctgggcaaccgaaggacaccatgaggctcgacgagaccatgctggtgaagcagttgctccccgaaatctgccacttcctgcatacctgcagggagggcaaccagcatgctgccgagttacggaactctgcttccggcgtactgttcagcctctcctgtaataacttcaacgccgtcttctctaggataagtactcgcctgcaagagttaaccgtgtgcagcgaggataatgtggacgtacatgatattgaactattacagtacattaacgtggactgtgcaaaattgaagaggttgctcaaggagacagcgtttaaattcaaagctctgaaaaaggtggcccaactggctgtgatcaattcactggagaaggcattctggaactgggtggaaaactaccctgacgaatttactaaactctatcagatcccccagacagacatggccgagtgcgcggagaagctttttgacctcgtggatggctttgccgagtccacaaaaagaaaagctgccgtctggccactccaaataatcctgctgattctgtgccctgaaattatccaggatatcagcaaggacgtcgttgatgagaacaacatgaacaagaagctgtttttggattcactccggaaggccctcgccggccacggaggctctcggcagctgaccgaatcagccgccattgcgtgtgtgaagctgtgtaaggcctctacatatatcaattgggaggataacagcgttatatttttgctggtgcagtcaatggtcgtcgatctgaagaatcttcttttcaaccctagtaaacccttctcgcggggcagccaacccgcggatgtagatctcatgatcgattgtctcgtgtcctgtttcaggatatcccctcacaataaccagcacttcaaaatctgtctcgcgcagaatagcccaagcactttccactatgtcctggtaaatagcctccacagaattattactaactcagcgctcgactggtggcctaaaatagatgccgtctattgtcactccgttgaattgagaaatatgtttggagagacccttcacaaggccgttcaggggtgtggggcgcaccctgccatcagaatggcaccatcattgactttcaaagagaaagtcacgtcacttaagttcaaagagaaaccgacggacctggaaacccgatcatacaagtaccttttgctgtctatggtgaagctcattcatgccgatcccaagctgcttttgtgtaaccctcggaagcaaggaccagaaactcagggcagcacagcagaactcataaccggtctcgtccagctggttcctcagagccacatgcccgaaatcgcccaagaggcaatggaggccctcttggtgttgcaccagcttgacagcatagacctctggaacccggacgcacccgtggaaaccttctgggagatcagttcacagatgctattctacatatgcaaaaaattgactagccaccagatgctgtcatctacagaaattctgaagtggcttcgggagatactgatctgcaggaacaaattcttgttaaagaataagcaagccgacagaagctcttgccacttccttctcttttatggcgtggggtgcgacattccatcctcaggcaataccagccagatgtctatggatcatgaagagctgctacggacacccggcgcttcactccgcaagggcaaggggaatagcagcatggactccgcagccgggtgttccggcacaccacccatttgccggcaggctcagacgaagttagaggtggccctctacatgttcctttggaatccggataccgaggcggttctggtggcaatgtcctgctttaggcacttgtgtgaggaggcagacattagatgcggagtggacgaagtctctgtgcacaatctgctgcccaactacaataccttcatggagtttgcctccgtaagcaatatgatgtccaccggacgggctgcactgcaaaagagagtcatggctttattacgccgcatcgagcacccgactgcaggtaacaccgaagcatgggaagatacccacgctaagtgggagcaggccaccaagttgattttgaactacccaaaggccaaaatggaagacggccaggctgccgaatcactgcacaagaccatcgttaaaagacgcatgtcacacgtaagtggaggcggcagcattgatttaagtgataccgattcactgcaggagtggatcaacatgacgggatttctatgtgcgcttggtggggtgtgccttcagcaaagatccaatagcggtctcgccacttatagcccaccgatgggacccgtgtcggaaagaaagggcagcatgatctccgtgatgtcctccgaaggcaacgccgacacgcctgtcagcaaattcatggatcgattgcttagtctgatggtgtgcaatcacgaaaaggtgggactgcagattaggacaaatgtgaaagatttagtcggtttggagttgtccccggccctctacccaatgcttttcaacaagctgaagaacactatttctaagttttttgatagccaagggcaggtactcctaactgacactaatacacagtttgttgagcagacaatagctattatgaaaaacctgcttgacaaccacacggaggggagctcagaacacttgggccaggcaagcatagaaactatgatgcttaacctggtgcggtacgtgcgggtcctgggcaacatggtccacgctatccaaatcaagacaaagctctgccagttagtcgaagtgatgatggcccgccgggacgatctctctttctgccaggaaatgaaattccgcaataagatggttgagtacctgacagactgggtcatggggactagcaatcaggcagctgacgatgatgtcaaatgcctgacacgggacttggatcaagcaagcatggaagcggtcgtaagtctgctggccgggcttccgctgcagccagaggagggcgacggagtcgagttaatggaggccaagtcacaactgttcctcaagtacttcacactctttatgaatttgctcaacgattgtagcgaggtcgaggatgaatcagcccagaccgggggacggaaacggggaatgtctaggcgactggcctctttgcggcattgtacagttctcgccatgtctaacctgcttaatgcgaatgtggattccggcctgatgcatagcatcggtctgggataccacaaagacctgcagacgcgggctacgtttatggaagtcctgactaagattctccagcaaggcacagagttcgacaccctcgccgaaaccgtgttagccgaccggttcgaacggctggtcgaactcgttacaatgatgggcgatcagggcgaacttcccatcgccatggctctagccaatgtcgtgccttgttcacaatgggatgaactggctagagtgttggtcactctgttcgacagtcggcatctgttataccagttgctttggaacatgtttagcaaggaggtcgagctggcagatagtatgcagaccctgttcagaggcaatagcctggcttctaaaataatgacattttgttttaaagtgtacggggccacgtatctgcaaaagttactggaccccctgctccggattgtaattacttcttccgattggcaacacgtatcattcgaggtcgatccaactcggctggagccatccgagtcacttgaagagaaccagcgtaatctgcttcaaatgacagagaagttcttccacgccatcatctccagttcctctgaattccctccccaactccggagtgtgtgccactgcctttaccaggtggtgtctcagcgcttccctcagaactcaattggagcagtgggaagcgcaatgttccttaggttcattaaccccgctattgtttctccctacgaagccgggatcctcgacaaaaagcctccacctcggatcgaaagaggcctgaagttgatgtctaagatattacagagcatcgcaaatcacgttctttttactaaagaagagcacatgagacccttcaatgactttgtgaagtccaacttcgatgccgcgagacggttcttccttgacatagccagtgactgtcctactagtgacgccgtaaaccacagcctgagcttcattagcgatggtaatgtattagcgctccatcgtctcttgtggaataatcaggaaaaaatcggccaatacctgagctctaatcgagaccacaaagccgttggtcgacgcccttttgacaagatggcaaccctcctcgcatatctcgggcctcccgaacacaagcctgttgctgatactcactggagttctttgaatctgacctcaagcaaatttgaagaattcatgactcggcaccaagtgcacgagaaggaagagtttaaggccctaaaaaccttatccattttctaccaggcgggcacgtccaaggccggtaatcccattttctactatgtcgccagacggttcaagacaggtcaaatcaatggggacctgctgatttaccacgtcctcctaaccctgaagccttactacgccaaaccttacgagatcgtggtcgatctgacccacactgggccaagcaatcgcttcaaaactgactttttgtcaaagtggtttgtggtgttccctggcttcgcctacgacaacgtttctgctgtctacatatataattgtaatagttgggtgcgtgagtacacaaaataccatgagcgtttgctaactggcttgaaaggcagcaagcgacttgtctttattgattgccccggtaagctggccgagcatatcgaacacgagcagcaaaaactccctgctgcgaccctcgcactggaagaggatctcaaagtgttccacaatgccctgaagctggctcacaaggacacaaaggtgtccataaaggtaggctctacagcagtgcaggtgacatctgccgaaagaaccaaggtactgggtcagagcgtgtttctgaatgacatttattacgcctctgagattgaggagatctgcctggtcgatgagaaccagtttaccctcacaatcgctaatcaggggacaccgctgacttttatgcatcaggaatgcgaggccatagtgcagtccatcatacatatccgcacgagatgggagctgtcacagccggatagtatacctcagcacactaaaatcaggcctaaagacgtccccggaacgcttctgaatattgctctgctaaatcttggctccagcgatccttcactccggtcggccgcctacaatctgctctgcgccttgacgtgtacttttaatctaaaaatcgaaggccaactgctcgaaacaagtggactctgtattccagcaaataatactctgtttatcgtttcgataagtaagactcttgccgctaatgaaccacacctgacactggagtttttggaggagtgtatctcgggcttcagcaagagcagtatcgagctgaaacatttatgcttagaatacatgacaccttggttatccaatctggtgcgtttttgtaaacataatgacgacgctaaacgccagcgtgtgaccgccattctggacaagcttattacaatgacgattaatgagaaacaaatgtacccttccattcaggcaaaaatatggggatcacttgggcaaattaccgatctgctggacgtcgtgctggactcttttattaagacctcagccacgggagggttggggagcatcaaagcggaggtcatggctgacactgctgtggcactcgcctcagggaacgtgaaactagtgtcaagcaaggtgattggtcggatgtgtaagatcattgataagacctgcctgagcccgacccctactttggaacagcatctcatgtgggacgacatcgcgatcctggcgaggtatatgctcatgctcagtttcaacaactctttagatgtggccgcccacctgccctatctgttccatgtagtgaccttcctggtggccacaggtcctttaagcttgcgcgcttccacgcacgggctcgtaattaatattatccattcactgtgcacctgtagtcagctgcacttcagtgaagaaactaagcaagtcctccggctgtcactcaccgagttctctttaccaaagttttatctcctcttcgggatctcaaaagtgaagtcggccgccgtcatcgcattcaggtcatcttacagagatcgaagtttctcgcccgggtcttacgagcgggagacgtttgccctaacttccctggaaactgtgacagaagcccttctggagataatggaggcatgcatgcgagatatccctacctgcaagtggctcgatcagtggaccgagctagcccagaggttcgcttttcagtataacccatctcttcagccaagggcactcgtggtgtttggttgtatttcgaagagagttagccatggccagatcaaacagattatacgtatactgtcaaaggcactagagagctgtctgaagggccccgacacatacaactcacaggtcctcattgaagctaccgtcatcgccttaactaaactgcaacctctcttgaataaagactccccactgcacaaggctctcttttgggtggctgttgccgtcctgcaattagatgaagtaaatttgtacagcgccggaactgccttgctggaacagaacctccacactttggactcgttaaggatctttaatgataagagccctgaggaggtgtttatggccattcgcaacccactagagtggcactgcaaacagatggatcactttgtgggcctgaactttaattcaaacttcaacttcgcccttgtggggcatctcctgaaagggtacaggcacccaagcccagccatcgtggcgcggactgtgcggattctgcatactctactcaccctggtcaataagcaccgcaattgtgataagtttgaggtcaatacacagtcggtcgcctatttggctgccctgctgactgttagtgaagaagttaggtcccgctgcagtttgaagcatcgtaagagcttactgttgactgatatttctatggagaatgtgcctatggatacctatcccattcatcacggcgatccctcctatagaacactaaaggagactcagccatggtccagccctaaaggatcagaaggctacttggccgcaacgtaccctaccgtcggccagaccagccctagagctcgaaagtcaatgtcattagatatggggcagccaagtcaggcgaatacaaaaaagctcctgggtactcggaaatccttcgatcacttgatttccgataccaaggcaccaaaacgacaggagatggaatcaggtataacgactccgcccaagatgagacgggtcgccgagacagactacgagatggagacgcaacgtatctcttctagccaacagcatccacatctccgcaaggtcagcgtcagcgaaagcaatgtactgcttgacgaggaagtgctcactgaccccaaaatccaggccctgctgctgacagtacttgcaacgctggttaaatacactacagatgagttcgaccaaaggatcttatatgagtacctggctgaagcttcggtagtgttccccaaggtttttccagtcgtccacaacctgctggattctaaaattaatacactgcttagcctgtgccaggaccccaacctgctgaatcccattcacggaattgtgcaatctgtggtgtaccacgaggagagcccgccacaatatcagacatcttacctgcaatcgttcggctttaacggactgtggagatttgcgggaccgtttagcaaacagacgcagatacctgattacgcggaactgattgtgaaattcctcgacgcattgatcgatacgtatctgcctggaatagatgaggagacctctgaggaaagcctgctaaccccaacctccccatatccccccgcgctgcaatcacagttgagtatcacagccaatctgaatctgtccaacagcatgacttctctggccacttcgcaacattcacctgggatcgataaggaaaacgtggagctctcccccaccacaggacattgtaactctggccgaacacgccacgggtctgctagccaggtacagaagcaaaggtctgcaggcagcttcaagcggaacagtatcaagaaaatcgtgtag

SEQ ID NO: 16285 - DNA, 8520 bp, Artificial Sequence
  Description of Artificial Sequence: Synthetic coding sequence
atggctgcccataggccggtcgaatgggttcaggctgtggtcagccggtttgacgagcagctacccattaagactggccagcagaacacacacactaaagtaagcaccgaacacaataaggagtgtctcattaacattagtaaatacaaattcagcttggttatctccggactgacgacgatcctgaagaacgtcaacaatatgcgaatctttggtgaagctgccgagaagaacctgtacctgtctcagctgatcatcctcgacactctggagaagtgtttagctggacagcccaaggacaccatgcggctggacgaaacaatgctggtcaaacaactactgcccgaaatctgtcattttttgcacacatgccgcgaagggaaccagcacgctgctgagttgaggaattccgcgagtggcgtgttattcagtctgagttgcaataactttaacgcggtgttttctcgcatctcaacccgcttgcaggagctgacagtgtgtagtgaagataacgtcgacgtgcatgacatcgagctgcttcagtacattaatgtggactgtgctaagcttaaaaggctcttgaaagagacagctttcaaattcaaagcgcttaagaaggtggctcagctggcagtaattaattctttagagaaggcattctggaactgggtggaaaattatcctgatgaattcaccaagttgtaccagataccacaaacagatatggcggaatgcgcagaaaagttgtttgatctggttgacggattcgcagagagtaccaagcgaaaagctgcggtttggccactccagattattctgttgattttgtgtccagagattatccaggatattagtaaagatgtggtggatgagaacaatatgaacaaaaagctgtttctggactctctccgcaaagctctggccggccacggaggatcgcgtcagctgaccgaatctgcagccatcgcctgtgtgaagctatgtaaagcctcaacctacattaactgggaagacaactctgttatttttctgctggtgcagagcatggtagtcgatttaaagaatttactctttaacccctcaaaacctttctcaaggggcagccagcccgccgacgtggacctgatgattgactgcctcgtcagctgtttcaggatctccccccacaacaatcaacattttaagatttgtctcgcccagaatagccccagcactttccactacgtgctcgtgaactctctccacagaattataactaatagcgccctggattggtggcccaagatcgatgccgtttactgtcactccgttgagcttagaaacatgttcggcgaaactctgcacaaagccgtccaggggtgtggcgcgcaccccgccatccggatggctcccagcctcactttcaaggagaaggttacaagcttgaaattcaaggagaagcctacagacttagagactaggtcttataaatatctgttgctgagcatggtcaagttgatacacgccgacccaaaacttcttttgtgcaatcctcgcaagcagggaccagaaacgcagggttccaccgctgaactcatcaccggactagtacaactggtcccccagagccacatgccggaaatcgcacaggaggctatggaggcgcttttagttctgcaccagctcgactctattgatctttggaatcctgacgcccccgttgaaacattctgggagatatccagtcaaatgctattctacatctgcaagaagctcaccagccatcagatgctgagctcaactgaaatccttaaatggttaagagaaatcctgatttgccgcaacaagtttctgctgaaaaacaaacaagccgacaggtcatcctgccatttcctgctattttacggcgtcggctgcgatatccccagctctgggaacacctcccagatgtcaatggaccatgaggagctgctgaggactcctggagctagcctgagaaaggggaagggtaatagttctatggactctgccgccggttgcagtggcacaccccccatatgcaggcaggcgcagactaagctggaagtggccctgtatatgttcctctggaatccagacacagaggccgtgctggtcgccatgagctgcttccgccacctctgtgaggaggccgacattcgttgcggagtggatgaagtctccgttcacaacctgcttcccaactataacacatttatggagtttgcaagcgtgtcaaacatgatgagcacagggagggctgccctgcagaaaagggtgatggccttgctgaggcgtattgaacatcccacagctggtaataccgaggcatgggaggacactcacgccaagtgggagcaggctaccaagctgatactgaactatccaaaggccaaaatggaagacggtcaggccgctgagagcctccataagactattgtcaagagaaggatgagccatgtttcaggaggaggaagcattgacctcagcgacaccgatagccttcaggagtggataaatatgacaggcttcttgtgtgcactgggtggcgtttgtttgcagcagaggagtaattccggcctcgccacctacagcccaccaatggggcctgtttcagaacgcaaagggagcatgatatcagtcatgagttccgagggtaatgctgacactccagtttccaagttcatggaccgcctgctgtcactcatggtatgcaatcatgagaaggtgggcttgcagatccgaacaaacgttaaagatctcgttgggctcgaactgtctcccgctctgtatcccatgctgtttaacaaactgaaaaacacaatatcaaaatttttcgattcccagggccaggtattgttaactgatacaaacactcagtttgtggaacaaactatcgccattatgaagaatctcttggataatcacactgaggggagctccgaacatttggggcaggcgtcaattgagaccatgatgctgaacctagtgcggtacgtgagagtattgggaaatatggtccatgcgatccagattaagacaaagctttgccagctcgttgaagtcatgatggctcgccgcgacgatctctctttctgccaggaaatgaaattcaggaataagatggtggagtatctcactgactgggttatgggcacaagtaaccaagcggccgatgatgatgtgaagtgtttaacgagagacctggatcaggcctccatggaggctgtcgtaagcctgcttgccggcctacccttgcagccagaggagggagacggcgtcgagttgatggaagcaaagtcccagctgttcctgaagtacttcaccctttttatgaacttgctcaacgactgctctgaggttgaggatgaatctgcgcagactggtggaagaaagagggggatgagtcggaggcttgcgagtctgcggcattgtactgtcctggccatgtccaacctgctgaacgccaacgtggacagtgggctcatgcactctatcggactcggctaccataaggacctgcagacccgggccacttttatggaggttctcaccaaaatactgcagcagggcactgaattcgacactctggccgaaacagtgctggcagatcggtttgaaagactcgtggaactagtgacaatgatgggcgatcagggagagttgccgatcgctatggcactggccaatgtcgtgccttgcagtcaatgggatgagttagcccgggtactagtgacactgttcgacagccggcacctgctttatcagctcttgtggaacatgttcagtaaagaggtggaactagcagacagcatgcagactctttttcgcggaaattctctggcctcaaaaattatgacgttctgcttcaaagtttacggagccacttatctgcaaaagttgctagatccattgttgcgcatcgtgatcacctcaagcgactggcagcacgtgtcttttgaagtggacccaacacggctggagccttccgagagtttagaggaaaaccagcggaatctgttacagatgactgaaaagttcttccacgcgatcatcagcagttcttccgaatttcccccacaactgcggagcgtttgtcactgcttgtatcaggccacatgtcacagcttgctgaacaaggcgaccgttaaggaaaagaaggaaaataaaaaaagtgttgtctcccaaaggtttccacaaaattctataggagctgtgggttcagccatgtttctgagatttattaaccctgcaattgtgagcccctacgaggccggcatactggacaaaaagccccctcccaggatagaacgcggcctgaaattgatgagtaaaattctgcaatcaattgctaaccacgtgttgttcaccaaggaggaacacatgagaccatttaatgactttgtgaaatcaaacttcgatgccgccaggcgtttctttctggacatcgcatccgactgtccaacttccgacgccgtgaaccacagtctcagcttcatatccgacggcaacgtcctcgcccttcacaggctcctgtggaacaaccaggagaaaattggacagtatttgtctagtaatcgcgatcacaaggcggtggggaggaggccttttgacaagatggcgacattgctggcttatctgggccctccagagcacaaaccggtcgctgacacgcactggtctagcctgaatctgaccagtagtaaatttgaggaattcatgaccaggcatcaagtgcatgagaaggaggaattcaaagccctgaagacactttcgatcttctaccaagctggtacctctaaggctggaaatcccattttctattatgtggccagaaggttcaaaacaggccagatcaacggggatcttcttatctatcatgtcttgctgacactgaagccgtactacgccaagccgtatgagattgtagtggacctgacccataccggacccagcaatcgattcaaaacggacttcctttcaaagtggtttgtggtcttccctggatttgcatacgataacgttagtgctgtgtacatttacaattgtaactcctgggtgagggaatatacgaaataccacgagagactgctgacgggccttaaaggtagcaaaaggcttgttttcatagactgccccggaaaacttgcagaacacatcgaacatgagcagcagaaattgccagcggccacacttgctcttgaggaagatcttaaggtgtttcacaacgctctgaagttagcgcataaagataccaaggtttctatcaaggtgggctctaccgcagttcaggtgacttctgccgaaaggacaaaagtgctgggccagtctgtgtttctcaatgatatttactatgcgagcgaaattgaagaaatatgcctcgtcgacgaaaaccagtttacacttactatagctaaccagggaacacctttaactttcatgcaccaggagtgcgaggcaattgttcagtctatcatccacattcgcacaagatgggagctcagccagccagactcaatccctcagcacacaaagattcgaccaaaggatgtcccaggcaccttactgaatattgccctgttgaatctgggcagttctgatccgagtcttaggagcgccgcctacaacctgttatgcgcactgacctgtacctttaatttgaaaatagagggacagttgctggagacctctgggttatgtatcccggccaataacacactattcattgtgtcaatcagcaaaaccctagcagcaaacgagccccacctcacactcgagttcctggaggagtgtatttctggcttctccaaatcctccatcgaactgaagcatctttgcctcgagtacatgaccccatggctgtcgaacttggtacggttctgtaagcacaatgacgacgcaaagcggcagagggtgacagctatccttgacaagctgattaccatgactatcaatgagaaacaaatgtacccctccatacaggctaagatatgggggagtctgggacaaataacagaccttttggacgtcgtgctggattctttcattaagacttcagccaccggagggctcggttctattaaagctgaggtgatggctgacaccgctgtggctcttgcatccggcaacgttaagctggtttcctctaaggttatcggaagaatgtgcaagattatcgacaagacctgcctgtcacctaccccaactctcgagcaacacctgatgtgggatgacatagccatcctggcacggtacatgctcatgctgtctttcaacaactccctcgacgtggcagcccacttaccatacctcttccacgtggtgacgtttctcgtcgctacaggacccctgagtttgcgggcctctacgcacgggctggtgatcaatatcatacactctctttgcacgtgttctcagctgcatttctcagaggaaacaaaacaggtcttgcgtctgtcccttactgaattttcactgccgaagttctacctgctgttcggaattagcaaagtgaaatctgctgcagttatagctttccgctcgtcatatcgggaccgctctttcagcccagggtcctatgagcgtgaaacattcgcgctgaccagtctggagacggtcaccgaggccttgcttgaaataatggaggcttgcatgcgggatatccctacttgcaaatggctggaccagtggacagaactggcgcagagattcgctttccagtataatccttcccttcaacctcgggcattagtcgtttttggatgcatcagcaaaagggtcagtcacggacagatcaagcaaattatcaggatactgtcaaaagcgctggagtcctgtctgaaaggtcctgacacttacaatagtcaggtcctgatcgaggccaccgttatagcccttacaaagctccagcctctgcttaacaaggattcaccactccataaggccctgttttgggttgctgtggcggttctgcagttggatgaagttaacctgtactcggcagggacagcgctcctcgaacaaaacctccataccctagattcattaagaatttttaacgacaaatctccggaagaggtattcatggcaattagaaacccgctcgagtggcattgcaagcaaatggaccacttcgtcggtctcaactttaatagcaactttaacttcgctctggtggggcatttgctgaaggggtacaggcaccccagtcccgccatcgtggccagaaccgtgcgcatactgcacaccctactgaccctggtcaacaagcacaggaattgcgacaaattcgaggtgaatacacagtctgtcgcctacctggcggcgctgctaaccgtaagtgaagaagtgaggtctcgttgcagccttaaacacaggaaatctttgctgctaaccgatattagtatggagaatgtccctatggacacctaccccatccatcacggcgacccgtcatatcgtaccctcaaggagacccaaccttggagcagccctaaagggagcgaaggttatctggcagctacttatccaaccgtaggtcagacaagtcccagggccaggaaatcgatgtctctggacatgggtcaaccatcccaggctaataccaaaaaactgctgggaaccaggaaatcatttgaccatttaattagcgacacaaaggcaccaaagagacaagagatggaatccggtataacaacacctccaaaaatgaggagagtggctgagacagactatgagatggaaactcagcggatttctagctcccaacagcacccgcacttgcggaaggtgtcagtgtccgagtcaaatgtgctactggatgaggaggtgttaactgatccaaagatccaagcactgttactcactgttttagccactcttgtcaaatacaccactgatgaatttgaccagcgcattctttatgagtacttggccgaggcttccgtcgtgttcccaaaggtgttccccgtggtacacaacctgttggattccaagatcaataccctgctgagcctgtgtcaggatccaaatcttctgaatccaatccacggcattgtgcagtcagtcgtataccatgaggaaagcccccctcaataccagacctcctacctgcaaagcttcgggtttaacggactatggagatttgccggccccttttccaagcagacccagattcccgactatgcagaactcattgttaagttcctcgatgcgttaatcgatacttatctgccagggatcgacgaagagacgtctgaagagagcctgttgactcccacgtcaccatatcctccagctctgcagtctcaactgtccataacagccaacctaaacctgagcaattccatgacatccctagctaccagtcagcactcaccaggcatcgataaagaaaacgtcgagctgtcaccaacgacaggacattgcaactctggtcggacaaggcatgggagcgcatctcaggttcagaaacagagatccgcgggttcttttaaacgaaacagcataaaaaagattgtctag

SEQ ID NO: 16286 - DNA, 615 bp, Artificial Sequence
  Description of Artificial Sequence: Synthetic coding sequence
atgcacgagaggtacagtaatgtccaggtcgccgggcccgtcgatcgcacatcctcaaaggactcccccctgcataaggcgctattttgggtagccgtcgctgtactacagcttgacgaagtcaacttgtacagcgccggcactgcattgctggagcagaacctccacacccttgattcattaaggattttcaatgataagagccctgaggaagtcttcatggccatcagaaacccactggagtggcactgtaaacagatggaccatttcgtcgggctgaattttaacagtaatttcaactttgctctagtgggccatctgctgaaagggtaccgccacccctccccagctattgttgcacgcacggttagaattctacatactctcctcactctggtcaacaaacacaggaattgcgacaagtttgaggtgaatacccagagtgttgcatacctggccgccctgctgactgtgtctgaagaggtacgatccagatgctcactcaagcatcgcaaaagtcttctcttgactgatatttccatggagaacgtgcccatggatacctatcctatacatcatggagatccgagttacagaaataaggaaaagttctag

SEQ ID NO: 16287 - DNA, 1782 bp, Artificial Sequence
  Description of Artificial Sequence: Synthetic coding sequence
atggcagcccaccggcccgtggaatgggttcaggccgtagtctctcgatttgacgaacagttgcctattaagacagggcagcagaatacacacacgaaggtttctaccgagcacaacaaggaatgccttatcaatatttcaaagtataaattcagtctggtcatttctggcctgacgaccatactcaagaatgtcaacaatatgcgcatctttggggaggctgcagaaaagaacctttatctttcccagctcattatcctcgacacgcttgagaagtgcctggcggggcaacctaaagatactatgagactcgacgagaccatgcttgtaaagcagcttcttcccgagatctgccacttcctgcatacatgccgagagggaaatcaacatgcagcagaacttagaaactctgcttcaggagtattgttctctctgtcttgtaataacttcaacgcagtgttctcccgcataagtacacggcttcaggaattgacagtgtgcagcgaggacaacgtcgatgtgcatgatattgagctcctgcagtatattaatgttgactgtgccaaactgaaacgcctcctgaaggaaactgcattcaaattcaaagcgctcaagaaagtggcccagcttgcagtgattaacagcctcgagaaagccttctggaactgggtggaaaactatcctgacgagttcacaaaactctaccagataccccaaaccgatatggcggagtgcgccgagaagctattcgatctagtggatggcttcgccgagtctacgaaaaggaaggccgccgtctggccactgcaaatcatactgctgattttgtgccctgagatcattcaagacatttctaaggatgtggtggacgagaacaacatgaacaagaagcttttcttagactcattacgcaaagcgttagccggccacgggggatcacgccagcttacagagtctgccgccattgcctgcgtaaagttgtgcaaggccagcacatacattaactgggaggacaattccgtgatctttctcctggtgcagtcaatggtcgtagacttgaagaacctgctattcaatccttctaaaccgttttccagagggtcgcagcccgccgacgtggacctcatgatagactgtcttgtgagctgtttccgaatctccccccataataatcagcacttcaagatatgtcttgcccaaaactcaccttctacgtttcactatgtgcttgtgaacagcctacatagaattattaccaattccgctttggactggtggcctaaaatcgacgccgtgtattgtcacagtgtggagctaagaaatatgttcggcgagactttgcataaagccgtccagggatgcggcgctcaccccgccataagaatggccccgtctttgactttcaaggaaaaggtgacctccctcaagtttaaggaaaagcccaccgatctggaaactcgttcctataagtacttattgctctctatggtgaagcttattcacgccgatcccaagctgcttctatgtaaccccaggaaacagggtccagagacccaaggatcgacagccgagctcatcacaggacttgtccagttggtgcctcagtcccatatgcctgagatcgcacaggaggccatggaggccctcctggtgttgcaccagttggactccattgacctctggaaccccgacgctcctgtcgaaactttctgggagatccggtatatgtacttctatttcttgaatagcacattcaagttttatttcgttttcctttcctag

SEQ ID NO: 16288 - DNA, 1917 bp, Artificial Sequence
  Description of Artificial Sequence: Synthetic coding sequence
atgcacgaacgttactctaatgtgcaagtggccggccccgttgacaggactagctccaaattttgtggaagcttcaattgccgcttcgcattccagtacaatccttccctgcaacctcgcgcccttgtggtgttcggctgcatcagcaaaagggtatcgcacgggcaaataaaacagataattcggatactcagcaaagccttagagtcatgcttgaaaggccctgatacctacaactcacaagttttgatcgaggcaacggtcattgccctgaccaagctgcaaccacttcttaacaaggattcgcccctgcataaggccctgttttgggtggccgtggcagtactgcagttggacgaagttaatctgtactcagctgggacggctctcctggaacagaacctgcacacattggactcgttacgcattttcaacgataaatctccggaggaggtttttatggcgattcgcaacccactggagtggcattgtaaacaaatggatcactttgttggcctcaattttaactctaactttaattttgccttagtcggtcatctcctgaagggctataggcacccttccccagctattgtggccaggaccgtgcgcatactgcatacattgctcactctggttaacaagcatcggaattgcgataaattcgaggtgaacacacaatccgtggcctatctggccgccctgctaaccgtctccgaggaggtcagaagtagatgctcactgaaacataggaagagcttattgcttacagacatcagtatggaaaatgtacctatggacacataccctatacatcatggggaccccagctacaggaccttgaaggagacccaaccttggtctagccccaaaggcagtgaaggatacctggccgccacatatcccacagtgggtcagacttccccgagggctcgcaaatccatgtctctcgacatgggtcaaccctctcaggcaaacacaaagaagctactggggactcggaagagttttgatcacttgatttctgatacaaaggctcccaagaggcaggagatggagtccggaataaccacaccccccaagatgcgcagagtggccgagacggattacgagatggagacacagcggatctcttcttctcagcaacacccacacctaaggaaggtgtccgtgtccgaaagtaacgtcctgctggatgaggaagtactgactgatccaaagattcaagcacttttacttacagtcctggccaccctcgttaagtataccacagatgagtttgatcaacgtatcctttacgagtaccttgcagaggcctcagtcgtatttccgaaggtatttcctgtcgtgcataatctgctcgattccaagatcaatactctgctgtcgttgtgtcaggacccaaatctgcttaacccgatccacggcatagtgcagtcggtggtgtaccatgaagagtcaccgccccagtaccagaccagctacctgcagtctttcgggttcaatgggctgtggcgctttgcaggcccatttagcaagcaaacccagatacccgactacgcagagctcatagtgaagttcctggacgccctcattgatacctacctgcccggaatcgatgaggaaacttccgaggagagtcttctgactcctacaagtccatacccccctgccctacaatctcagctgtccatcacagccaacctaaacctgtccaactcaatgacatctcttgccacttcccagcactcacccggcatagataaggagaatgtggaactgagccccacgaccggccactgcaactctgggagaacacgccatggcagcgcctctcaggttcagaagcagcggagcgccggctccttcaaattggcgcttctgaatctgctgacggcgcaccagaactctctgtag

SEQ ID NO: 16289 - DNA, 7509 bp, Artificial Sequence
  Description of Artificial Sequence: Synthetic coding sequence
aactgggaggacaattccgtcatttttctgctcgttcaatcaatggttgtcgatctgaagaacttgctatttaatccttctaaacccttctctaggggcagccagccagcagatgtcgacttgatgatagactgtctagtcagttgctttcgtatcagcccacacaacaaccaacacttcaaaatttgcttggcccagaattcaccttctaccttccattacgtgctcgttaactcactccatcggattattacgaattccgccctggactggtggcccaagatcgatgctgtatattgtcacagcgtcgagctgaggaacatgtttggagaaacattgcataaagccgtgcagggatgtggagctcatcctgccattagaatggcacccagcctcaccttcaaggagaaggtcacttctttgaaattcaaagaaaagcctacggatctggaaacaaggagctataaatacctgttgctgtccatggtcaagctgatccacgctgaccctaaacttctactctgtaacccaaggaagcagggacctgaaactcagggtagcacagcagagcttataacaggactggtgcaactcgttcctcagtcccatatgccagagattgcccaggaagccatggaggccctgctcgtgctgcatcaactggactccatcgacctatggaacccagacgctccagtcgagactttttgggagatctcttcccaaatgcttttttacatttgtaagaagcttacttcccatcagatgctaagttccactgaaatcctcaaatggcttcgcgagatcttgatttgtaggaataagttcttactcaaaaacaagcaggcagaccgctcgtcgtgccatttcctcttgttctatggagttggttgcgacatcccttcttctgggaacacgtcccaaatgagtatggaccacgaagagcttttgagaacacccggggcgagtctccgaaaaggtaaaggcaattcttcaatggattccgccgccggttgttctggaacaccacctatctgccggcaagctcagacaaagcttgaggttgctctgtacatgttcctctggaaccccgatacagaggcggtgcttgtggctatgagctgcttcagacatctgtgtgaagaagccgacattaggtgtggcgtggacgaagtttctgtgcataatctactcccgaattacaataccttcatggagttcgcatccgtttccaacatgatgagcactggtcgagctgctttgcagaaacgggtgatggctctcctaagaaggatcgagcatcctaccgctggcaacacagaagcctgggaggatacacatgctaaatgggaacaggctactaagctgatcctgaactatccaaaggcaaaaatggaagatggtcaagctgctgagtccttacacaaaacgatcgtcaaacgacgtatgtcccacgtttctggtggcggatctatcgatctctctgatacggactccctgcaagagtggatcaatatgacgggatttctgtgcgccctgggcggcgtgtgtttgcaacagcggagtaactctggtttggcgacatactccccacctatgggaccggtctcagaaagaaaaggcagtatgatttcagtgatgtcctcggagggcaatgccgatacacctgtgtctaagtttatggacagacttctttcccttatggtgtgtaatcatgagaaagttggcctgcagattcgaacaaacgtcaaggaccttgtcggcttggagctgtcaccggccctatatccgatgctgttcaataagttaaaaaataccattagtaagttcttcgattcacaaggacaggtgctgcttaccgacactaacacacagttcgtcgaacaaacgatcgcaatcatgaaaaacctgttagataatcacaccgaagggtccagcgagcatcttggtcaagccagcatcgaaactatgatgctcaacctggtgcggtatgtgagggttctgggcaacatggttcacgccattcagatcaaaacaaagctctgtcagctggtggaggtaatgatggctaggcgggacgatctgtccttttgtcaggaaatgaaattccgaaacaagatggtggagtacctcactgattgggttatgggtacttctaatcaagctgcagatgatgatgtcaagtgtctgacgagagacctggaccaggcatctatggaagctgtggtgagcctgctagccgggttgccgctccaacccgaagaaggagatggtgtcgaactgatggaagctaagtcacagctgtttcttaaatacttcaccctgtttatgaacctgctcaacgactgttctgaagtggaggacgaatccgctcaaacagggggacgcaagagaggtatgtcacggagactagcgtcccttcgtcattgtaccgtactcgccatgagtaatctactgaacgctaatgttgactcgggcctgatgcattccattggcctcggctaccacaaagatttgcagaccagagccaccttcatggaggtgttgactaagatccttcagcagggaacggagttcgacacactggccgaaacggtacttgctgatcgcttcgagcgcctcgttgagcttgttaccatgatgggcgaccagggcgaactgcccatcgcaatggcactggcgaacgtggtaccgtgttctcagtgggatgagcttgccagggtgctggttactttgttcgatagtagacatctgctgtatcagttgctgtggaacatgttttctaaggaggtagaactggcagactccatgcagaccctctttaggggcaactctttagccagcaaaatcatgaccttttgtttcaaagtttatggggctacttatctccagaaactgctagaccccttactgagaattgtgatcacgtcgagcgactggcagcacgtcagttttgaagtcgaccccacaagactagagccatcagaatccctggaggagaatcaacgtaacctgctgcagatgaccgaaaagtttttccacgccataataagtagttcctccgagtttccccctcagctgagaagcgtatgtcattgtctgtatcaggtcgtttctcagcggttccctcagaattcaattggagcagtcggtagcgctatgtttctcagatttataaatcctgcgattgtctctccctacgaagcagggattctagataagaaacccccaccacgaatagaaagaggcctgaagctgatgagcaaaattttacagtccatcgccaaccacgtactgttcactaaagaagaacacatgcgcccctttaatgatttcgtcaagagcaacttcgatgctgcaagaaggttctttctggacatagcgtcagactgcccaacctctgatgctgtgaatcacagtctgagctttatctccgatgggaacgtgctagccctccataggttgttatggaacaaccaggagaagatcggacagtatctatctagcaaccgggaccacaaagccgtgggcaggaggccatttgacaagatggctacactgttggcctacctaggaccccccgagcacaaacccgtggctgatacacactggtcctctctaaatctgacctcatcaaagttcgaagaatttatgacacgacaccaagtgcacgaaaaggaggagtttaaagccttgaaaacgctgagtattttctaccaggccggaacctctaaagccggcaacccgatattttattacgttgctcggcggtttaagaccgggcagatcaatggtgatcttcttatttatcatgttctcctcacgctgaagccatactatgccaagccatacgagatagtggtggacttgacccataccgggcctagtaacaggtttaagactgactttttatctaaatggttcgttgttttcccaggatttgcatatgataacgtgagtgcagtgtacatctacaactgcaattcttgggttagagaatacacaaagtatcacgaacgactcctgaccgggctcaaaggaagcaaacggctggtgtttatcgactgcccggggaagctcgcagaacacatagaacacgaacagcaaaagctacctgccgccacgcttgcactcgaggaggatctcaaggtgttccacaacgctctcaagttggctcacaaggacactaaggtttcaatcaaagtgggctctacagctgtacaggtgacttcggcagagagaactaaggtgctggggcaatcggttttcctgaacgatatatactatgcgagcgaaatagaggagatctgcctcgttgacgagaaccaattcacgctgacaattgcgaaccaggggacccctttgacattcatgcatcaagaatgcgaggctatagttcagtcgataatccacattcggaccaggtgggagctttctcagccggactcaatcccccagcacaccaaaatccgccctaaggacgtcccgggcactttacttaacattgcactgctcaatctgggctcctctgacccctccctgaggagcgccgcttacaatttgctgtgtgctctgacctgcacattcaacctcaaaatcgaagggcaattactagagaccagtggactctgcatcccagccaataatactctcttcattgtctcaatatccaaaaccttggcagccaacgagcctcacctgacgctggaattcctggaagagtgtatttccggtttcagcaagtcaagtattgaactgaaacacctgtgtcttgaatatatgacaccttggctgtcaaacctggtcaggttttgcaaacacaatgacgatgctaaacggcagcgggtgaccgcaatcctggataaactcatcacgatgaccatcaatgaaaagcagatgtatccatcaatccaggccaagatctggggatccctaggacaaataaccgatctcctcgatgtcgtgctggactcctttatcaagacctccgctactggaggcttgggttccatcaaggccgaagtcatggcagatacagccgtggccctggcctccggaaatgtgaaactcgttagctcaaaagtgattggacgcatgtgcaaaatcatcgataagacatgcttgtctcctaccccaacactggagcagcacttaatgtgggacgatatcgccatcttggcgaggtacatgctcatgctttccttcaacaacagccttgatgtcgcggcccatttgccatatctgtttcacgtggtgacgtttttggtggcaactggcccgctgagtctgcgcgccagcacacatggcctcgtgatcaatataattcatagcctgtgcacttgctctcaactgcattttagcgaggagacgaagcaagtgctgcgcctctcactgactgagttcagtcttccaaagttttacttgcttttcgggatctcaaaggtgaagtcagcggcggtgattgctttcaggtcgagctaccgggaccgctcctttagtcctggctcctacgagagagagacatttgccctgaccagcctggaaacggtgaccgaggccctgctcgagataatggaagcctgtatgagagatattccaacttgcaaatggctggatcagtggacagagttagcacagagattcgcctttcaatacaacccctcccttcagcctagggcgctcgttgtgttcggatgcatatcaaaaagagtcagtcatggccaaatcaaacagatcattcgcattctgtccaaagctctggaaagctgtctgaaagggccagatacttataattctcaggttctaattgaggctaccgtgattgccctgactaaactacagcccctcctcaacaaagatagcccactgcacaaagcactgttctgggttgccgtggctgtcctgcagctggatgaggtcaatctgtactctgctgggacggccttgctcgagcagaacctgcataccctggactctctccggattttcaatgataaatctcctgaggaggtgttcatggccattagaaatccactcgagtggcactgcaaacagatggatcacttcgtgggtctcaacttcaactcgaacttcaattttgcattggtggggcacctgctgaagggctataggcatccgtcaccagccatagtcgcaagaacagtccgtatcctccacaccttgcttaccttagtgaataagcacaggaactgcgacaagtttgaagtgaatacccagtctgtcgcatacctggctgcccttctgacagtgtcggaggaggtgagaagcaggtgtagcctaaaacatagaaagagcctgctcctcacagacataagcatggagaacgtccctatggacacataccctattcatcacggcgacccttcatacaggacactgaaggaaacccagccatggtcctctccgaagggcagcgaaggctacctagccgccacttatcccactgtgggacagacctctcctcgtgcccgtaagagcatgagtctggatatgggtcaaccgtcacaggccaacactaagaagctactaggcactcggaagtcgtttgaccacctgatcagcgatacaaaagcgccaaaacgccaagagatggaatccgggataaccaccccacctaaaatgcgccgcgtggccgagaccgattacgagatggagacacaacgaatttcttctagtcagcagcatccacacctgagaaaagtcagcgtgtccgaatctaacgtcctattagatgaagaggttctgacagacccaaagattcaggcgctgctcctgactgtcctcgctacactcgttaaatacactaccgacgagtttgaccagcgcattctgtacgaatacctcgctgaggccagcgtggtgttccccaaggtgtttcctgtggtgcataatcttctagattccaagattaacacgttactgagtctctgtcaggatcctaatctgctgaatccgatccatggcatcgtccagtctgtggtgtaccatgaagaaagcccccctcagtaccagacttcctatctgcaatccttcggctttaatggcctgtggaggttcgccgggccattttccaaacagactcagatcccagactacgcggagctgattgtgaagttcttggatgccttgatcgacacctacttaccaggtatagatgaagaaacatctgaggaatccctgctgactccaacatcaccatacccgccagccttgcagtcccagctatctattacagctaatctgaacctgagcaatagtatgactagcttagcaaccagccagcactctcccgcatctctcccttgctccaagagcgcagtgtttatgcagctgtttccccaccagggcattgataaagagaacgtggagctgtctccaactacagggcattgcaacagcggacgcacccgccacggttctgcttcacaggtgcaaaaacaacggagcgcaggttcttttaagcgcaattccatcaagaagattgtctag

SEQ ID NO: 16290 - DNA, 1524 bp, Artificial Sequence
  Description of Artificial Sequence: Synthetic coding sequence
atggctggggcgattgcctcgagaatgagtttctcttccctgaaacgcaagcaaccaaaaaccttcacagtgcgaatcgtgactatggacgccgagatggaattcaattgtgaggtaaagaaacagatactggatgaaaagatctactgcccaccggaagcgtctgttctgcttgctagctacgccgtgcaggccaaatatggcgattatgatccgtcagtacataagcgaggctttctggcacaggaagaactgctccccaaaagggtcattaacctgtaccagatgacgcctgaaatgtgggaggaaaggattactgcatggtatgccgagcatcgtggtcgcgcgagggacgaggccgaaatggaatacctgaaaatcgcacaggacctggagatgtatggcgtgaactatttcgccataagaaacaaaaagggtaccgaactgctgctcggggtggacgcccttgggctgcacatttacgaccctgagaacagactgacccccaagatctcctttccttggaatgagattcggaatatcagctatagcgataaagagttcacgatcaagcccttagacaaaaaaattgacgtcttcaaattcaattcgtcaaaactgagagtaaataaactcatcctgcagctatgcatcggaaatcacgacctgttcatgcgtagacggaaagctgattccttggaagtgcagcaaatgaaagcccaggcccgagaggagaaagctagaaaacagatggaaaggcagagattagctcgcgaaaaacagatgagagaggaagccgaacggactagggacgagctggaaagacgactgctgcagatgaaggaagaggccactatggctaacgaagccctcatgcggtccgaagaaactgctgacctactggcagaaaaggcgcagattacagaggaggaggcaaagctcctggcccagaaggccgcagaggctgagcaggagatgcaacgcatcaaagctacagcaatcagaacagaagaagagaagcgcttaatggaacagaaagtgctagaggccgaggttcttgctctgaaaatggctgaggaatctgagcggagagcgaaagaggcagatcaattgaaacaggacttacaagaagctagggaggccgagagacgcgcaaaacaaaaattgctcgagattgctaccaaacccacttatcctcctatgaatccgattcctgcacctctgcctccagatataccaagtttcaacctgatcggggattcgctttccttcgattttaaggatactgacatgaagcggctctcaatggaaatcgagaaggaaaaagtagaatatatggagaaatcaaaacatttacaggagcagctgaacgaactcaagacggagattgaagccttgaagcttaaggagagagagacagccctcgacatcctccataatgagaattccgatcgcggaggctcatcaaaacacaacaccatcaagaagcctcaggcccagggtcgccgcccaatttgcatttag

SEQ ID NO: 16291 - DNA, 1788 bp, Artificial Sequence
  Description of Artificial Sequence: Synthetic coding sequence
atggccggcgcaattgcaagcaggatgtccttttcttccctcaagcggaagcagccaaaaacattcaccgtacgcattgtgacaatggatgctgaaatggaatttaactgcgagatgaaatggaaaggtaaggatctgttcgatctcgtgtgcaggacacttgggttgcgggagacatggttcttcggtctgcaatacactattaaggatactgtggcctggctcaaaatggacaagaaggtgttggaccacgatgtaagtaaggaggagcccgtcacatttcatttcctggcaaagttttatccggagaacgctgaggaagagcttgtgcaggagattacccagcatttatttttcctccaggttaagaagcagatcttagacgagaagatatactgtccccccgaagcctctgttctcctggcctcatacgcagtgcaagccaagtatggagactacgacccatctgtgcacaaaagaggcttccttgcacaggaggagcttctgcctaagagagtaatcaacctgtaccagatgactcctgagatgtgggaggaaagaattactgcctggtacgctgagcacagggggagagcccgagacgaggcggaaatggaatacctgaagattgctcaagatctggaaatgtatggggtgaattatttcgccatcaggaacaaaaaggggactgaacttttactaggagtggatgctctgggcctgcacatctacgaccctgagaatcgcctgacaccgaaaatctctttcccgtggaacgaaataagaaatatatcttacagtgataaggagttcacaatcaaaccattagataaaaagatcgatgtctttaaattcaactcttctaaactacgagttaacaaactgattttgcaactatgcattggcaatcatgacctcttcatgaggcggcgcaaagctgattcacttgaggttcagcaaatgaaagctcaagcacgagaagaaaaggctcggaaacagatggaacgccaaaggctagcaagggagaaacagatgcgagaagaggcggaaaggacacgagatgaacttgaacggcgcctccttcagatgaaagaggaggccaccatggcaaacgaggctcttatgagatcagaggagaccgcagatctgctggcagaaaaagcgcagataaccgaggaggaagcgaagttactggcacaaaaagcggcagaagccgaacaagagatgcagcggatcaaggccacagctatcagaaccgaggaggaaaagaggttaatggagcaaaaggttttagaagctgaggtattggccctgaagatggctgaggaatctgagcgacgcgccaaagaggcagaccaactgaagcaggatctgcaggaggcaagggaggccgaaagacgagcgaagcaaaaattacttgagatcgcaactaaaccaacttatccacctatgaacccaattccagccccgctgcctcccgatatcccctctttcaatttaatcggggactccctgtctttcgacttcaaggataccgacatgaagaggctgagtatggaaattgagaaagagaaggtcgagtatatggaaaagagcaaacaccttcaggagcagctgaacgagctgaaaacagaaatcgaggctctgaagttgaaagagagggaaaccgccctggacatccttcataatgagaattccgacagggggggctccagtaagcacaataccatcaagaaacttacactgcagtcagccaagagtagagtggcattcttcgaagagctgtag

SEQ ID NO: 16292 - DNA, 663 bp, Artificial Sequence
  Description of Artificial Sequence: Synthetic coding sequence
atggctggcgctatcgcttctcggatgagctttagttcacttaagcgcaaacagccaaagacattcacagttagaatagtgaccatggatgctgaaatggaatttaactgtgaggtgaagaagcagatcttagatgaaaaaatttactgtcctcccgaggccagcgtgttgctcgccagttacgctgttcaggcgaagaacaagaaaggcacagagctgctcctgggtgtcgacgccctgggcctccacatctacgatccggaaaataggctaactcctaagatatctttcccatggaacgaaatccggaacatctcctatagtgataaagaattcactattaaacctctggacaagaagattgacgttttcaaatttaactcttcgaagctgcgggtgaacaagctcattctccagttatgtataggaaatcatgacctcttcatgcggcggcgaaaagccgacagccttgaagtgcagcagatgaaagcccaagctcgggaagaaaaggcgaggaagcagggacagaggggacggtcggccgaagcgggtcctgctgggagcaccagaggtggagctaagtcccaggccgaggcccccggggattgtcatcaggctcacgtcccagcacacgagcccaactcctccaccgtagcaagttag

SEQ ID NO: 16293 - DNA, 1524 bp, Artificial Sequence
  Description of Artificial Sequence: Synthetic coding sequence
atggccggggctatcgcgagtcggatgtcctttagcagtctaaagaggaagcaacccaagacattcacagtaagaattgtcacaatggatgcagaaatggagttcaactgtgaggtcaagaagcaaatcttagatgagaaaatctactgcccaccagaagcatcggtccttttagccagctatgcggtgcaagctaaatacggcgattacgatcctagcgttcacaagagagggtttttggctcaggaagaattattgcccaaaagagtgataaacttataccagatgactccggagatgtgggaagaaagaataacagcctggtacgccgaacatcgcggaagagcccgagatgaggcagagatggagtatttaaagattgcccaggacctagaaatgtacggggtaaactatttcgctatacggaacaagaaaggcactgagctgctcctcggcgtggatgctttaggactacacatctacgatcctgagaatcggcttacaccaaagattagctttccttggaacgaaatcaggaacatctcatattcagataaagaattcactatcaaaccgctcgacaagaaaattgacgtttttaagtttaactcctcgaaactccgtgtcaacaaacttatactccagctgtgtattgggaaccacgatcttttcatgagaaggcgcaaagcagattctctagaagtgcagcagatgaaagcacaggcccgagaggaaaaggcccgcaagcaaatggaacggcaaaggttagcacgggaaaagcagatgagagaggaggcggaacgaacacgggacgaactggaacgtagactgttgcagatgaaggaggaggccacaatggctaacgaggctctgatgaggtctgaagaaactgcagatctgttggccgaaaaggctcagatcactgaggaggaggcaaagcttctagcccaaaaagctgcggaggccgaacaggaaatgcagcgtatcaaagccaccgcaattcggactgaggaggaaaagcgattgatggagcagaaagtgttagaagccgaggtgctggcacttaagatggcggaagagtctgagagacgcgccaaagaggccgaccagcttaagcaagacctccaggaggcaagagaggccgagaggagagcaaagcagaaactgctggagatcgccacaaaaccaacctacccacccatgaatcccatccctgcccccctgccccctgatattccctcttttaacttgattggggattccctgagttttgactttaaagacacagatatgaagcgactgagtatggaaatcgagaaggagaaagtcgagtacatggagaaaagcaagcatctccaggagcagctcaatgaactcaagacagaaattgaggccttgaaattaaaagagagagagactgccttggacatattacataacgagaattcagacagaggaggatcttcaaaacataacaccattaagaagccccaagctcagggacggagacccatctgtatatag

SEQ ID NO: 16294 - DNA, 1773 bp, Artificial Sequence
  Description of Artificial Sequence: Synthetic coding sequence
atggcaggtgcaattgcctcccgaatgagtttctcaagtctgaagaggaaacagccaaagacttttacagtgaggattgtcacaatggatgctgagatggagtttaattgtgaaatgaaatggaaggggaaagatttgtttgatctggtgtgtagaaccctagggttacgtgaaacctggttctttggccttcaatacacgattaaagatactgtggcctggctaaagatggataagaaagtcttagaccatgatgtgtcaaaggaagagcccgtgacctttcactttttggccaagttttacccagaaaacgcggaggaagagctagtgcaagaaattacgcagcacctgttctttctccaggtcaaaaaacagatcttggatgaaaaaatttactgtccccccgaagcgagtgtgcttctggcatcctatgccgtccaagccaagtatggcgactacgatccaagcgtgcataaaaggggatttttggctcaggaggagcttttaccaaaacgcgtaatcaatctgtaccagatgacccccgagatgtgggaagagaggatcaccgcatggtatgctgagcaccgggggcgtgcgcgcgacgaagcagaaatggaatatctgaagatagcccaggacctcgagatgtatggggttaattacttcgcaatcaggaacaagaagggtactgagttgctcctgggggttgatgcattaggcttacatatctacgacccggaaaacagactgactcccaagattagcttcccctggaatgagatccggaacatctcttactctgacaaggagtttacaatcaagccgctggataagaagattgacgtgttcaagttcaactcctccaagctgcgcgtgaataagcttatactgcaactgtgcattggcaaccatgacctgttcatgcggagaagaaaggccgacagtcttgaggtccaacagatgaaggctcaggcacgagaggagaaggcaagaaagcagatggagcgccaaagactggcacgagaaaagcagatgcgggaagaggctgagcggacccgagacgaactggaacggcgactactccagatgaaggaagaggccaccatggcaaatgaggctctaatgcggtccgaggaaactgccgatctcctcgctgaaaaggctcaaatcaccgaggaagaggcgaaactcttggctcagaaagctgctgaggctgagcaggaaatgcagcgaatcaaggctacagccattcggactgaagaggaaaagaggctgatggaacagaaagttctggaagccgaagtgctggcactgaagatggccgaagaatccgagcgtcgcgcaaaggaagcggatcagctgaaacaggacctccaggaagcgcgggaagcggaacggagggctaaacagaagttgcttgaaatagccactaaaccaacatacccacctatgaacccaatacccgcgccactcccacctgacataccttcttttaacctgatcggggactcactcagtttcgacttcaaggacaccgacatgaagaggctgtccatggagattgaaaaagagaaggtcgagtatatggaaaaatccaagcacctgcaagagcagctaaatgagctgaagaccgaaatcgaggcgttaaaactcaaagagcgcgagaccgcactagacatcctgcacaatgaaaacagtgataggggaggttctagtaagcacaacaccatcaagaaaccacaagcacaaggtcggcgtcccatctgcatttag

SEQ ID NO: 16295 - DNA, 1650 bp, Artificial Sequence
  Description of Artificial Sequence: Synthetic coding sequence
atggcgggcgctattgcttctcgtatgtctttttcatccctgaagagaaaacagcccaagacctttaccgtgcgcatagtgacaatggacgcggaaatggagttcaattgcgaaatgaagtggaagggaaaggacctgttcgatctagtgtgccgcactctcgggctgcgggagacctggttttttggactgcaatatacaattaaggacactgtcgcctggctgaaaatggacaaaaaggtgaagaagcagatcctcgacgagaaaatctattgccctcccgaggcttccgtgttgttggcctcctatgctgttcaggccaaatatggcgactacgatccttcagtgcataaaaggggatttttagcacaagaagagctgcttcccaagagggtgataaacctgtaccagatgacccccgagatgtgggaggaacgcatcaccgcctggtacgccgaacaccgcggccgcgctcgcgacgaagcagaaatggagtatctgaaaatagcccaggatttagaaatgtacggcgtgaactacttcgctataaggaacaagaaaggaactgagctcctgctcggggtggacgctctcggacttcatatttacgacccagaaaatagactcacccctaagatcagtttcccatggaacgagatccggaacatctcatattccgataaggagttcactattaaaccccttgacaagaagattgatgtgttcaagttcaactcttctaaattacgggtcaataagctgattctccaactgtgcatagggaaccacgatttattcatgcgccgtaggaaggcagactctctagaagtccagcagatgaaagcacaggccagagaggagaaagccagaaagcagatggagaggcaaagattagctcgtgagaaacagatgcgggaagaagcagaacgcacgcgggacgaactcgagaggcgcctcttgcagatgaaagaagaggcaaccatggcaaatgaagctctgatgagatctgaggaaacagccgacctcctcgctgagaaggcccagattactgaggaggaggctaaattgctagcacagaaggccgcagaagccgagcaggagatgcagcgtatcaaggcaactgccattcggacagaggaggaaaagcggctgatggaacagaaagtgctggaggcagaggttttagccttaaaaatggctgaggagagcgaacggcgtgcaaaggaggctgaccaactaaagcaggatcttcaggaagcacgggaagcggaacgtagagctaagcagaaactgctggagattgcaaccaaaccaacctaccctccaatgaacccaatcccggccccccttccccctgacataccaagcttcaatctgatcggcgactccttgagctttgacttcaaggacaccgacatgaagagactgtccatggagatcgaaaaggaaaaagtggaatacatggaaaagagcaagcatttgcaggagcagttgaatgagttgaagacagaaattgaagctctcaaactaaaagagcgggaaacagccttggacatcctgcacaacgaaaacagcgatcgagggggctcgtcaaagcacaacactataaagaaaccgcaggcacaggggagacgccccatttgcatctag

SEQ ID NO: 16296 - DNA, 1647 bp, Artificial Sequence
  Description of Artificial Sequence: Synthetic coding sequence
atggcaggagctatcgcatcccggatgagcttctcgtctctgaaacggaaacagccaaagaccttcaccgtgagaattgttaccatggatgcagagatggagttcaactgcgaagtcctagaccatgacgtgtccaaagaggaacccgttacgttccactttcttgccaagttctatcctgaaaacgcggaagaggaactcgttcaggaaattactcagcatcttttttttctccaggttaagaagcagattctcgacgaaaagatatactgtccgcccgaagcctcagtgcttctagccagctatgcggtgcaggcgaagtacggggactacgaccctagtgtgcataaacggggatttcttgcacaagaggaactgttaccgaagcgcgtgattaacctataccagatgacccctgagatgtgggaggagagaatcacagcatggtatgccgaacaccgcggccgggcgagagatgaggccgagatggaatacctaaagatcgcccaagatctcgaaatgtacggggtgaactacttcgcaattcggaacaaaaaagggacggagctcctcctgggcgtggatgcgctgggacttcatatctatgaccccgaaaaccgcctgactccaaaaatttcctttccctggaacgaaatccggaatattagttactctgacaaggaattcacaattaagcccctcgacaaaaaaattgacgtgttcaaattcaacagctcaaaattaagagtgaataagttgatcctgcagttgtgcatcggcaaccatgacctgttcatgcgccggcgcaaagcagacagcctagaagtgcaacaaatgaaagcccaggctagagaggaaaaagccagaaaacagatggagcgacagcgtcttgcaagggagaaacagatgcgtgaggaagctgagaggacccgtgacgagctggagcgacggctgctccagatgaaggaggaggctaccatggccaatgaagccctaatgaggagcgaggaaacagccgacctgctggccgaaaaggcgcaaatcaccgaggaagaagcaaaattgctggctcagaaagctgcggaggccgagcaggaaatgcagcgcatcaaagctaccgcaatccggactgaagaggagaaaagactcatggagcagaaagtcctggaagccgaagtgctcgctctcaaaatggctgaggagtccgagcgccgggctaaagaggctgatcaactgaaacaagacctgcaggaggcccgcgaggcagaaaggcgggctaagcaaaaactgttggaaatcgctactaagccaacatacccgccgatgaatcctatccccgcccctcttccccctgacattccttctttcaacctgatcggggacagcctgtcctttgattttaaagatactgacatgaagagactgtccatggagatcgagaaggaaaaagtggagtacatggaaaagagtaaacatttgcaggaacagctaaacgagctgaagactgagatcgaagcgttgaagctcaaggagcgagagactgccctcgatattctgcacaacgagaatagtgaccgcggaggttcttcaaagcataatacaattaaaaaacctcaggcccaagggcgacgcccaatctgcatctag

SEQ ID NO: 16297 - DNA, 1773 bp, Artificial Sequence
  Description of Artificial Sequence: Synthetic coding sequence
atggcaggcgcgattgcttcgaggatgagtttttctagccttaaacgcaaacagccaaaaactttcaccgttcgcattgtgacgatggatgcagaaatggagtttaactgtgaaatgaagtggaaaggcaaggatcttttcgatctggtctgccgtaccttggggctgagagaaacttggttcttcggtctgcagtacacaatcaaggatacagttgcttggctcaagatggacaagaaagtgctggaccacgacgtgtcaaaggaggagcctgtcacctttcattttctcgctaaattttacccagaaaacgcagaggaagagctggttcaggagattactcagcacctgttctttctgcaggtgaaaaaacagattctcgatgaaaagatctattgtccccccgaggcctcagtgctgctcgccagctacgccgtgcaggcaaaatacggagactacgacccttctgtgcacaaacggggtttcctcgcacaagaagagctcctccctaagagagtcattaacctgtatcaaatgactcctgagatgtgggaagagagaatcactgcgtggtacgccgagcatagggggcgagccagagacgaagccgagatggaatacctgaaaattgctcaggacttagagatgtacggcgtgaattactttgcgattcgcaacaagaagggcacggagctgctgctgggagtggacgccctcgggctgcatatctacgatccggagaaccggctgacgccaaaaatttcattcccctggaacgaaatccgaaacatatcatattctgataaggagttcaccattaagcctctcgacaagaagattgatgtgtttaagttcaatagttcaaagctcagagtgaacaagctgatactgcagttatgtatcggaaaccacgatctattcatgaggagaagaaaagcagatagtctcgaggtgcagcagatgaaagcccaggctcgtgaagaaaaggcacgcaagcagatggagaggcagaggctggccagggaaaagcagatgagagaggaggccgaacggacccgggatgaactggaaagacgcctgcttcagatgaaggaggaggctactatggccaatgaggctctcatgcgctcagaagagactgctgatttgctcgcggagaaggcacagattactgaggaggaagctaaactcctggcacagaaggccgccgaagcggagcaggaaatgcagagaattaaggctactgccatcagaaccgaggaagaaaaacgcctgatggaacaaaaagtgctggaggccgaagtccttgccctgaagatggccgaagaatccgagcggcgagccaaggaagccgatcagctgaaacaggatctccaggaggctcgcgaggctgaaaggcgggccaagcagaaactgctggaaatcgctaccaagcccacctacccccccatgaatcccattccggcccctcttccccccgacattccaagcttcaacctaattggggactctctgagcttcgattttaaggacacagatatgaagcgcttatcaatggagatcgagaaggaaaaagtcgaatacatggagaagagtaagcacctccaggaacaactaaacgagctgaaaacggagatcgaagccctcaaactgaaagaacgcgagaccgcgctcgacatcttgcataatgagaatagcgaccgtggtggcagtagcaaacacaataccatcaagaaaccgcaggcccagggacggaggcctatctgtatttag

SEQ ID NO: 16298 - DNA, 1806 bp, Artificial Sequence
  Description of Artificial Sequence: Synthetic coding sequence
atggcgggtgcgattgcttcccggatgtctttctcatctcttaaacggaagcagcccaagacctttacggtgcggatagtgacgatggatgcagagatggagtttaattgtgagatgaaatggaagggtaaagacctgtttgatctggtatgccggaccttgggacttcgggaaacttggttcttcggactgcagtataccattaaggacactgtggcatggttgaaaatggataaaaaagttctggaccatgatgtatcaaaagaggaaccagtgacattccactttctggccaagttctacccagagaatgcagaagaggagctggtgcaggagattacgcagcatctgttctttttacaggttaagaagcaaatcctggacgagaaaatctattgtcctcctgaagcttctgttctgcttgccagctatgctgtacaagcaaagtatggagactacgatccaagtgtgcataaacggggattcctggcacaggaagagctgttgcctaaaagagtgataaatctgtaccagatgacacctgagatgtgggaggaacgaataactgcctggtacgcagaacacagaggcagggccagagacgaggcggagatggaatatttgaagatcgcccaagacctggaaatgtatggtgtcaattacttcgcaatccgtaataaaaagggtaccgaacttctcttaggtgtcgacgccctcgggcttcacatctatgacccggagaacaggctgacacccaaaatcagttttccttggaatgagattcggaacatctcatactctgataaggagtttacaataaaacctctggacaagaagatagatgtattcaagttcaatagttccaaattaagggttaataagttgattctacaattatgtatagggaaccacgatctctttatgcgccgccgaaaggctgactcactagaagttcaacagatgaaggcacaagctcgggaagagaaggctagaaaacagatggagaggcagcggctggctcgggaaaagcagatgcgggaggaagctgaaaggactcgcgatgagctggaacgacgcctcctgcagatgaaggaagaggcaacaatggctaatgaagctttgatgaggagcgaagaggccgaacaggagatgcaacgcatcaaggccaccgcaatccgcactgaagaggagaaacggctgatggaacaaaaggtcctcgaggccgaagtgttggccttgaaaatggccgaggaaagtgagcggagagccaaagaggcggaccaattaaagcaagaccttcaagaagctcgggaggccgagaggagagccaaacaaaaactgctggagatcgccactaagcctacctatccacccatgaatcctatccctgcacccctgcctcccgatatcccgagtttcaacctaatcggagactcgttgtcattcgactttaaggataccgacatgaaacgtctctcaatggagatcgagaaagagaaagttgagtacatggaaaagtcgaagcaccttcaggagcagttaaatgagctcaaaactgagatcgaagctctgaaactcaaagagcgtgagacagccctcgatatcctacacaacgaaaattccgaccgcggcgggagctctaagcataacactattaaaaaaggcatgtttctgttctttttcattctgttttgttggttctccctcaagccgaaggctgaggaccttagtgcctttgagccttcaaatagtccatgtagagccccctctcccgagtggccaagtctgaagtcctcttcacggtag

SEQ ID NO: 16299 - DNA, 1686 bp, Artificial Sequence
  Description of Artificial Sequence: Synthetic coding sequence
atggcaggtgctatcgcctcaagaatgtctttctcgtcgcttaaacgcaaacaacctaagacattcacagtgcgcatcgtgaccatggatgccgagatggagtttaactgcgaaatgaaatggaagggtaaagatctgtttgaccttgtgtgtcgaactttgggcctgcgcgagacttggtttttcggccttcaatacacaattaaagatacggtggcatggctaaaaatggataaaaaggtgctggaccacgatgtctcgaaagaggagccagtaaccttccacttccttgcaaaattttatcccgagaacgccgaagaggagctggtgcaggagattactcagcatctgtttttccttcaggtgaaaaaacagatcctggacgagaagatatactgccccccagaagcaagtgtgctgcttgcatcttacgccgttcaagccaagtacggtgactacgacccttcagtgcataagcgcggcttcctggcccaggaggaactgctccctaagagggtgattaatttgtatcaaatgacccctgaaatgtgggaggaacgtattaccgcatggtacgccgaacacaggggtcgggccagggatgaggccgaaatggagtacctgaaaatagcccaggacttggagatgtacggagtaaattactttgccattcggaacaagaagggcaccgaactgctacttggagtggacgctctggggcttcacatctacgatcctgagaatagactgacccccaagatctccttcccctggaacgaaatacgaaatatctcatattctgacaaagagtttacaatcaagcctttggataagaaaatcgatgtcttcaagtttaatagctcaaagctgcgcgttaataaacttattctccaactgtgcatcggcaaccatgaccttttcatgagacgccgtaaggctgacagtctcgaagttcagcagatgaaagcgcaggcaagggaggagaaggccagaaaacaaatgaaggaggaggcaacgatggcaaatgaagcactgatgcggtccgaagaaaccgccgacttgctggctgaaaaggcacagatcaccgaggaagaggcgaaactcctggcccaaaaagccgccgaggccgaacaagagatgcagaggattaaggctactgctatacgaaccgaggaggagaaaaggctcatggaacaaaaggtcctcgaggccgaggttttagcactcaagatggcagaagagtctgagagacgagctaaggaggctgatcaactgaagcaggatctccaggaggcccgagaagctgaaaggcgggccaagcagaagctgttggagatcgcaactaagccgacttaccccccaatgaatccaattcctgctccactcccgcctgacattccctcctttaacctgattggagatagcttgtctttcgacttcaaggatactgatatgaagcgcctgtcaatggagatcgaaaaagagaaggtggagtacatggagaaatcaaaacatctgcaagagcaattgaatgagctgaagactgaaatcgaggccctgaagctgaaggagcgtgaaacagctctggacatccttcataacgagaacagtgatcgtgggggcagttccaagcacaacactattaaaaaaccacaagcccagggccggaggccgatctgcatatag

SEQ ID NO: 16300 - DNA, 1773 bp, Artificial Sequence
  Description of Artificial Sequence: Synthetic coding sequence
atggccggagctatagccagtcgcatgtcattttcgagtctgaaaaggaaacagcccaagacttttacggttcggatcgtcacgatggacgccgagatggagttcaactgcgaaatgaagtggaagggaaaagacctgtttgacttggtatgtcggaccctcgggctgcgcgagacctggttcttcggtctccagtatacaatcaaggatacagtggcctggttgaagatggataagaaggtgctcgaccatgacgtgtccaaggaggaacctgttactttccactttctggcaaagttttacccagaaaacgcggaagaagagcttgtacaagaaattactcagcacctattcttcttacaggtgaaaaagcagatcctcgacgagaagatctactgtccccccgaggcaagcgtgctgctggcctcttatgcagtgcaggccaagtatggcgattacgatccttccgtgcataaacgcggattcctggctcaggaagaactgcttccaaagagggtgatcaatctgtatcagatgacacctgagatgtgggaggaaagaataaccgcctggtacgcagaacataggggaagggcacgggatgaagcagaaatggaatatctgaagattgcacaggacctcgagatgtacggtgtcaactacttcgccatccggaacaaaaaggggacagaactcctccttggcgtggacgcattgggcctgcatatttatgatcccgagaaccggttgacacctaagatctcgtttccctggaatgaaatccgcaatatttcctattccgacaaagagttcaccattaaacccctggacaaaaaaatcgatgtgtttaaattcaattcatcaaaactgcgggtgaataaactcatcctgcaactctgtataggcaatcacgacctgttcatgagacggcgcaaggctgactctttggaagtacagcagatgaaggcccaggctagggaagaaaaggccaggaaacagatggagagacagaggttggccagggaaaagcagatgcgcgaagaagccgagcgtactcgcgacgagcttgaaagacggctactgcagatgaaagaggaggcaactatggctaacgaagctctgatgaggtcggaggaaaccgctgacctgttggccgagaaagcccagattaccgaagaggaagcaaagctgttagcccaaaaggccgctgaagcagaacaggagatgcagcgcattaaagcaaccgccatcaggaccgaggaggaaaagcgacttatggaacagaaggtactggaggcggaggtgcttgccctgaagatggccgaggaatctgagcggagggcgaaagaggctgaccaactgaaacaggacctgcaggaggcacgggaggccgaaaggcgcgccaagcagaaactgcttgaaatcgctactaagcccacataccctccgatgaaccccatcccagctcctctacctcccgatatccccagcttcaacttgattggagatagcctctcattcgattttaaagacacagacatgaaacggcttagtatggagatcgagaaagaaaaggtagagtacatggaaaagtcaaaacacctccaagaacagttgaacgagctaaaaactgaaattgaagcgttgaagttgaaagagcgcgagacggctctggacatcctccacaacgaaaattccgatagaggcgggtcctcgaaacataatactatcaagaaacctcaggcacagggacgcaggcccatttgtatctag

SEQ ID NO: 16301 - DNA, 498 bp, Artificial Sequence
  Description of Artificial Sequence: Synthetic coding sequence
atggccggagcaatcgcatcaagaatgtctttttctagtctgaagcgtaaacagcctaagacatttacagtgagaattgtgactatggatgccgaaatggaatttaactgcgagatgaagtggaagggcaaagacttgtttgatttagtctgccggacacttggactccgggagacctggttctttggactgcagtacacgatcaaagacacagtcgcatggttgaaaatggacaaaaaggtgctcgatcatgatgtgagcaaagaggaacctgtgaccttccacttccttgccaaattttaccctgagaatgccgaggaagagctggtgcaagaaattactcagcacttgttctttcttcaagtgaaaaaacaaattctagatgagaaaatttattgcccgccagaagcctcggtcctcttagcctcatacgctgtgcaagccaaactgaccttgcagtccgctaagagccgggtcgcattctttgaggaactttag

SEQ ID NO: 16302 - DNA, 663 bp, Artificial Sequence
  Description of Artificial Sequence: Synthetic coding sequence
atggccggagcgatcgccagccgaatgtcattttcctcccttaaaagaaagcaacccaagacttttactgtacgtatcgtgaccatggatgcagaaatggaattcaactgcgaggtgaaaaaacagatcctggacgagaagatttattgcccccctgaagcctcagttctgctggcatcatacgcggttcaagctaagaacaagaaagggactgaactgttgctgggtgttgacgccctgggactccacatctacgaccccgaaaaccgactcacacctaagatctcatttccatggaatgagattcggaatatctcttacagtgacaaagagtttactattaagcctctggacaagaagattgacgtattcaagtttaactcctcgaagttgcgggtgaataagttgatccttcaactttgtatcgggaatcatgacctgttcatgcgccggaggaaggctgattccctcgaggtgcagcagatgaaggcacaggcgagagaggaaaaagcgaggaagcagggccagcgaggcagatcggccgaggccggacctgctggcagtaccaggggcggggcgaagtcgcaggctgaggccccaggagactgccaccaggcccatgttcccgcccatgaaccaaacagctccaccgtagcctcctag

SEQ ID NO: 16303 - DNA, 2772 bp, Artificial Sequence
  Description of Artificial Sequence: Synthetic coding sequence
atggagcgaggcctgcctttattgtgcgccgtgctggccctggtcctggcacccgctggcgcctttcggaacgataaatgcggtgacactatcaaaatagaaagccccggataccttacatctcccggctacccacactcctaccatccgagtgagaagtgtgaatggctgattcaggccccggatccatatcagcggattatgatcaatttcaacccccactttgacttggaagacagagactgcaaatacgattatgttgaagtgttcgacggcgagaatgagaacggccatttcaggggcaagttctgtggaaaaattgccccacctcctgtggtgagtagcggccccttccttttcatcaaattcgtatccgattacgagacacacggggctggttttagtatacgctacgagattttcaagagaggacctgaatgtagtcagaattacactactccgtccggggtgattaagagtcccggatttcccgagaaataccctaactcgctcgagtgtacttacattgtcttcgtgccaaaaatgtccgaaatcatattagaattcgagagtttcgacctcgagcccgattcaaacccgcccggcggtatgttctgccgatatgaccgccttgagatctgggacgggtttcccgatgttggacctcatatcggccgatactgtgggcaaaagacgccaggccgaatcagatctagcagtggaatcctaagtatggtgttttacacagattctgcaatcgcgaaggaaggcttcagtgcgaactacagtgttctgcaaagttctgtgtcagaagatttcaaatgcatggaggcattaggcatggagtcaggcgaaattcactccgatcaaataactgcttcatctcaatactccacgaactggagcgccgagagaagccgccttaactaccctgagaacggctggacaccgggagaggattcttacagggagtggatccaggtggatttaggcctgctgcgctttgtcacagcggttggaactcagggggcaattagtaaagaaaccaagaaaaaatactatgtgaagacctacaagatagatgtgtccagcaatggagaggactggatcaccatcaaggaaggaaataaacccgtgctgtttcaggggaataccaaccctacggacgtcgtggtcgccgtattcccaaagcccttaataacaagattcgttcggatcaaaccagccacttgggagacaggaatcagtatgcgctttgaggtgtacgggtgcaaaatcacagactacccctgctccggtatgctaggcatggtaagcggacttatttccgattcacaaattacctcctctaatcagggagatcgtaattggatgcctgagaatattcggctggtgacgagccggagcggttgggccctgccccctgctcctcactcctatatcaacgagtggttacaaattgatctgggtgaggagaaaattgtccgcgggatcatcattcaaggcggcaaacaccgcgagaacaaagtcttcatgcggaagtttaagattggatatagcaataacggaagtgactggaagatgataatggatgactcaaaaaggaaggctaaatcatttgaggggaataacaactacgacacaccggagctgcgaacttttccagctctgagcacccgcttcattcggatatatcccgagagagctacacacggaggtctgggactgcgtatggagttattgggatgcgaggtggaggctcccaccgctgggcccactacccccaatggtaacttagtggacgagtgcgatgacgaccaagccaattgccatagcggtaccggtgatgactttcagctcactggtggcacaaccgtgttggccaccgagaagccgacagttattgacagtactattcagagcgagttccctacatacgggttcaattgcgaattcggctgggggagccataaaaccttctgtcactgggagcacgataaccatgttcagctgaagtggagcgttttaacctcaaagaccggcccaattcaagatcataccggagatggtaatttcatttatagtcaagctgacgagaatcagaagggcaaggtcgcccgacttgtgtcacctgtagtatattcccagaattcagctcactgtatgaccttttggtaccacatgtccggcagtcacgttggcacacttagagtgaaactccgctaccaaaaaccagaggagtacgaccagttggtgtggatggcgatcggacaccagggagatcactggaaggaaggaagagtgctcctgcacaaatcgttgaagctgtaccaggttatctttgaaggggaaatcggcaagggcaatttgggcgggattgccgttgacgatattagtattaacaatcatatctcacaggaagactgtgctaagccagctgacttagataaaaaaaatcctgaaatcaaaatagacgaaacaggctctactcctggctacgagggtgaaggagaaggtgataagaatatctcaagaaagccgggcaatgtgctcaaaacacttgaccccattcttattactataattgcaatgagcgccttgggggtgctcttaggcgccgtgtgcggcgtcgtgctgtactgtgcctgttggcacaatggtatgtcagaacgcaatctgagtgcgctcgaaaattacaatttcgaactcgtggatggtgttaagttgaagaaggataaactgaatacgcagagtacttacagtgaagcttag

SEQ ID NO: 16304 - DNA, 420 bp, Artificial Sequence
  Description of Artificial Sequence: Synthetic coding sequence
atggacgacagcaaacgtaaagcaaagagcttcgaagggaataacaactatgacacacccgaactgcggacattcccggctttgtcaacaagattcatccgaatataccctgagcgggccacccacggcggcctgggtctcaggatggaactgttaggctgtgaggttgaggcacccaccgctggacccaccactccaaacggaaacctggtcgacgagtgcgatgacgaccaggctaattgtcacagtggaactggagatgatttccagctcactggaggaactacagtcctagctacagagaaacccactgtgatcgactccacaatccagtcaggttcccgctttttcaagcaccatcataagcagcagtccatgcgacctcagaatctccatcacaactctatactgttgctctag

SEQ ID NO: 16305 - DNA, 1926 bp, Artificial Sequence
  Description of Artificial Sequence: Synthetic coding sequence
atggaacgtggcctacctctcctgtgtgcggtgcttgctcttgtgctagcacctgccggagcctttcgcaatgacaaatgcggcgacactattaagatagagagcccgggctacctgacttctcccggttacccacattcctaccatccatcggagaagtgcgaatggcttattcaggcccccgatccttatcagaggatcatgatcaactttaacccccactttgacctggaggatagagactgtaagtatgactacgtagaggttttcgacggcgagaatgagaatggccattttcgcggaaaattctgcgggaaaattgcgccaccgcctgtggtgtcttccggccccttcctcttcattaaattcgttagcgactatgagacccatggcgcggggtttagcattcggtacgaaatttttaaacgcggaccagaatgctcacaaaattacaccacaccatcaggcgtgataaaaagcccagggttcccggagaagtaccccaatagcttagagtgcacttacatcgtgttcgtccctaagatgagcgagatcattctggaatttgagagttttgacctggagccagacagcaatccccctggcggcatgttctgtagatacgacagactcgagatttgggatggcttccctgatgtaggcccgcacatcggccgttactgtggtcagaagacccccggaagaatcagaagtagcagtggaatcctgagcatggtgttctatacagacagcgccatagccaaagaagggttctccgctaactatagcgtcctccagtcaagcgtgagtgaggatttcaagtgtatggaggccctgggaatggaaagtggcgaaattcactccgaccaaattacagcatcatctcagtactctacaaattggagcgccgaacgcagtcgtctgaactaccccgagaacggttggacaccgggggaagatagctaccgggaatggatccaagtagacctcggcctgctgcgctttgttaccgctgtcgggactcagggggccatttccaaggagacgaagaagaaatactatgtaaagacctataaaatagacgtgagcagcaacggcgaagactggattacaatcaaggagggaaataagcccgtactgtttcaaggcaatacaaatcccaccgatgttgtcgtagccgtcttccctaaacccctgatcaccagatttgtgcggatcaagcccgccacctgggaaaccggaatttcaatgagattcgaagtttacggctgcaagatcaccgactacccatgttcaggaatgctcggcatggtctctgggttaataagcgattcgcagatcacatcctccaaccagggcgacagaaattggatgcctgagaacatccgcctggtcacgtcacgttccggttgggcgctaccccccgctcctcatagctatattaacgagtggctgcagatagatctcggggaagagaaaattgtacggggcattatcatccagggcggcaagcacagagaaaacaaagttttcatgcgcaagttcaaaattggatacagcaataatggttctgactggaaaatgattatggatgattctaaacgcaaggcaaaatcattcgaaggcaacaacaattatgatacacccgagctccgcacgttccctgctctgagcacaaggttcatccggatttacccagagcgagctacacatggggggctaggcttgcgcatggaactgctgggatgcgaagttgagggtacaataaacaccgaccaggagtgtccatgtgcaagagccttagcaaaagacgctaagaagaaaaagcggtgggccgattccacccactgtagatgtgtacgatctatacacggggagatgtggagcagtggcaaaggtgtctgttcattggatgccaatctctag

SEQ ID NO: 16306 - DNA, 567 bp, Artificial Sequence
  Description of Artificial Sequence: Synthetic coding sequence
atgtccgagataatactcgaattcgagagctttgacctcgagccggacagcaatccacccgggggcatgttttgtagatatgaccgcctagagatctgggatgggtttcccgacgtcggcccccacattggacgctactgtggacagaagacacccgggcgcataagatcgtcatctggaattctcagcatggtgttctacacggattcggcaattgcgaaggagggcttttccgctaactacagtgtgctgcaaagcagtgtgtccgaagacttcaagtgcatggaagcactgggcatggagtccggggaaatccacagtgaccaaataacggcttcttctcaatatagtactaattggtccgcggagaggtctaggctgaactaccctgaaaacggctggacacccggcgaggactcctacagagagtggatccaggacgccaagtaccgactcagggttagcgtcgtgagatccaagagttcctccagttcaactagtctggagcctaggcctttgtcctctttgaagctttcttttttttcctataagattaaaattacatag

SEQ ID NO: 16307 - DNA, 1830 bp, Artificial Sequence
  Description of Artificial Sequence: Synthetic coding sequence
atggagagagggctgccgctgctctgtgcagtgctggccttagtgctggcacccgcaggagcattccgcaatgacaagtgcggcgatacaattaagattgaaagtccggggtacttaacctccccaggttatccccatagctaccatccgtcagagaaatgcgagtggctgatccaggctcccgacccttatcagcggataatgattaatttcaaccctcattttgatctcgaagacagggactgtaagtatgactacgtggaagtcttcgacggcgaaaatgagaatggacattttagaggcaagttctgtggaaagatagccccaccacctgtagtgtcaagtggaccattcctgtttatcaagtttgtctccgactatgaaacgcatggggcaggattctcgattagatacgagatttttaagcggggacctgagtgctctcaaaactatactacgccaagtggtgttattaagtctcccggtttccccgaaaaatatcctaattcccttgagtgtacttacattgtcttcgtgcctaaaatgtccgaaataatcctggagttcgagagcttcgatctggaaccagacagcaacccccctggcggcatgttttgtcggtatgaccgcctggagatttgggacggctttccggatgtgggccctcatatcggtaggtattgcggacagaagacacccggcaggattcgctctagctccgggatcctctctatggtcttctacaccgattccgccattgccaaggaaggtttctctgctaattacagcgtgctccagtccagcgtgtctgaggactttaagtgtatggaggctctcgggatggagtcaggagagatacactcagatcagatcaccgcctccagccagtatagtactaactggagcgctgagaggagtcgcctgaattacccggagaatggctggactcccggcgaggatagctaccgggagtggatccaggtcgacctggggctcctcaggttcgtcacagctgtgggaacacaaggggccatctccaaagaaaccaagaagaagtactatgtgaagacttacaaaatagatgtgtcatcaaatggcgaggactggatcacaattaaagaaggtaataaacctgtactctttcaagggaatacgaaccccaccgacgtagtggttgctgtgtttccgaaaccgctgatcacacggttcgtcagaattaagcccgcaacatgggaaacaggcatcagtatgagattcgaggtctacggctgcaaaattactgattatccttgctctggaatgcttggcatggtatccggtctgatctcagatagccagattacaagctcaaatcagggggaccggaattggatgcccgaaaacatccggctggtcacgagccggagtggatgggctctaccccctgctccacattcttacatcaatgaatggctacaaatagatcttggtgaggagaagatcgttcgcggaataataatccagggaggcaaacatcgcgaaaacaaggtattcatgcggaagtttaaaatcgggtatagtaataatgggtcggactggaagatgattatggacgactcaaaacggaaggctaagtccttcgagggcaataataactacgacaccccggagctgcgtaccttccctgctctgtccacccggtttatcaggatctaccccgaacgagccacccacggaggactggggctccgcatggaactgcttggctgtgaggtagagggaggtactaccgtactcgctacagagaaacctacggtgatcgacagcacaatccagagtgggattaagtag

SEQ ID NO: 16308 - DNA, 1935 bp, Artificial Sequence
  Description of Artificial Sequence: Synthetic coding sequence
atggagcgtgggcttcctcttctctgcgccgtgctcgctctcgttttagcacccgcgggagcgttccgaaacgataaatgtggagatactattaagatagagagtcctggatacctcacaagtccgggttaccctcactcttatcatccgagcgaaaaatgtgaatggttgatccaagctcccgatccgtatcagaggatcatgatcaattttaacccccacttcgatctggaggatcgtgactgtaaatacgattatgtggaagtgttcgacggcgaaaacgagaatggacactttagaggcaagttctgtggaaaaatcgcacctccaccagtggtgtcttcggggcccttcctcttcatcaaatttgtgtctgactatgaaacacacggagcaggcttctctatcaggtacgaaatctttaaacgtggacccgagtgttctcagaactatactacaccctctggcgttattaagtcccctggctttcctgaaaagtatccgaactcgctcgagtgcacgtatatcgtgttcgttccgaagatgtctgagatcatcctggaattcgagagttttgacttggagccggattcgaatcctccaggtggaatgttttgccggtacgacagactggagatctgggacggctttcccgacgtgggcccccacatcggccgttactgcggccaaaaaactcccggaaggataagatcgtcttcagggatcctatctatggtgttctacactgattcggctatcgctaaggagggcttctccgctaactattccgtcctccagtcaagtgtgtccgaggattttaagtgcatggaggctctgggtatggaatccggcgaaatccattcagatcagatcacagcttcgtctcaatatagtacaaattggagcgcagaacggtcccggctgaactatccagaaaatggctggaccccaggcgaggattcttatcgagaatggatccaggtggatttaggattgctaaggtttgtcaccgcagttggcacccagggtgccataagtaaggagactaaaaaaaaatactatgtgaaaacatataagatagacgtgtcgtctaatggcgaggactggattacaattaaagagggcaacaagcccgtgcttttccaagggaacacaaacccaactgacgtagtggtggccgtgttcccaaaaccactcattacccggtttgttcgtataaagccggcaacctgggaaaccggcatctcaatgagatttgaagtatatggttgcaaaattaccgattacccttgcagcggcatgcttgggatggtatctggactcatcagcgactctcagatcacaagctcaaatcaaggtgaccgcaactggatgccagagaatatccggctggtgacaagccgatcgggatgggccctgccccctgccccccactcttatatcaatgagtggttgcagattgacctgggagaagagaaaatcgtgagaggaataatcatacagggaggtaagcacagggaaaataaggtatttatgagaaaatttaagattgggtatagcaacaacggtagtgattggaagatgataatggatgattccaaaagaaaggccaaatcctttgaaggtaataacaattatgatacaccggagctccgcacgtttccagctctgtctacacggttcattcggatatatccagagcgggccacacatggagggctgggacttaggatggaacttctcggttgcgaggtggaggcgcctactgctgggccgacgacacccaacggaaacctggtcgatgaatgcgacgacgatcaagcaaattgccactccggtacaggagatgacttccagctgacaggcgggacaacagttttagcaacggagaagccaaccgtcattgactctaccatccagagtggcatcaaatag

SEQ ID NO: 16309 - DNA, 2115 bp, Artificial Sequence
  Description of Artificial Sequence: Synthetic coding sequence
atggagagaggacttccgctgttatgcgccgtgttagcgctggtcctggctcctgcaggagctttccgaaacgacaaatgtggcgatacgatcaaaatcgaatcgccaggctacctgacctcccccggctacccacactcctatcacccatcagagaagtgcgaatggctgatccaggcccctgacccgtaccaaagaattatgatcaatttcaatccacactttgacctggaggatagagattgtaagtacgactacgttgaggtattcgatggcgagaacgaaaacggccacttcagaggaaaattctgcgggaaaatagctccccccccggtggtctctagcggccccttccttttcattaagtttgtcagtgattacgagactcacggggcgggctttagcatcagatacgaaatatttaagagaggccctgagtgctcccagaattacacaactcccagtggagttataaaatcacccggctttcccgagaaatatccaaattccctggaatgtacttatattgttttcgttcccaagatgtcagaaatcattctggaattcgagagttttgacctggagccagattccaaccccccgggcggtatgttctgtcgatatgatcggctcgagatctgggacgggttccctgatgtcggtccccatataggacgatattgtggtcagaagacccccggacggatacggtctagcagcggcatcctgtctatggtgttctacaccgacagcgccatagccaaagaaggcttttctgccaattactcagtgctccagtcatccgtctccgaggacttcaaatgtatggaagctcttggcatggagtccggtgaaatccattccgatcagatcactgcctcgtcccagtactccactaactggagcgctgagcgctctcggctcaactatccagaaaacgggtggacccccggcgaagatagctatcgtgaatggatccaggtggacctcgggctgttgagatttgtgaccgcagtaggaacgcagggtgctatttctaaggaaactaaaaagaaatactatgtaaagacatataaaattgatgtgagctctaatggagaagattggatcaccattaaggagggcaataagcccgtattatttcaggggaacaccaatcctacagatgttgtcgtggcagtcttccctaagccactgataaccaggtttgtgcggattaaaccagccacctgggagactgggataagcatgcgctttgaggtgtatggttgcaagattactgattacccatgcagcggcatgttaggaatggtcagtggcttgatttctgactcacagatcacgtcttccaaccaaggagacagaaattggatgcctgaaaatatcagactggtcacgtcacggtcaggctgggctttgccgcctgcaccacattcctatatcaatgagtggctgcagatagacctgggagaggagaagatcgttcgcggcatcatcattcagggcggcaagcaccgcgaaaataaggtttttatgcgcaagttcaagattggatactccaataacggtagcgactggaagatgattatggatgatagcaagagaaaggcgaagtcattcgagggaaacaataactacgatacccctgaattgagaacattccccgccctctctacacgcttcattaggatctacccagaaagggcaacccatggtggtttagggctgcgaatggagttgctgggatgtgaggtcgaagcacctaccgccggtcccacaaccccaaatggcaatttagtggacgaatgtgacgatgaccaggcaaactgtcatagcggcacgggggacgatttccagctcactggtgccgagactatctttatccccctgctctatcatttttcaagttgtctcagttgggatcaactcaccccagtgtgtgtgctagttacaccgcacggcagagaacttccgagaaataggtcttgcttggcccggacaagagcaagttccttcccccacgtcatatggattgacgaactcttcctcattgcaaccacgatttgtaacaataacctcagccattttgaatcccagcgcctgggcctgtcatag

SEQ ID NO: 16310 - DNA, 261 bp, Artificial Sequence
  Description of Artificial Sequence: Synthetic coding sequence
atggagttattgggatgtgaagtggaagctccgactgcaggtcctacaacgccaaacggaaacctcgtcgacgaatgtgacgatgaccaagcaaactgccacagcggtacgggcgatgactttcagctcaccggaggcaccactgtcctcgccactgaaaagccgactgtcatcgattctaccattcagtcagctcggctcgaggtctctactctgaatctgtccctgcacaacccaccccagcagaaagcattgatttag

SEQ ID NO: 16311 - DNA, 2772 bp, Artificial Sequence
  Description of Artificial Sequence: Synthetic coding sequence
atggaaagaggactccccctactttgtgcagtgctggcccttgtgctcgctcccgctggcgcgtttagaaatgacaagtgcggcgataccatcaaaatcgaaagcccaggctacctaacaagccctggatatcctcatagctatcatccttctgaaaaatgtgagtggctgatacaggcaccagacccctaccagcggattatgattaattttaatccccatttcgaccttgaggaccgtgactgtaagtacgactatgttgaggtgttcgacggcgagaacgagaatgggcacttccggggaaagttctgtggtaaaatcgccccgccaccagtagtgagctcaggcccattcctctttatcaaatttgtctcagactacgagacacacggggcggggttcagtataaggtacgaaatattcaagagaggaccagagtgcagccagaattatactaccccgagtggagtaatcaagagcccgggcttcccggagaaatatcctaattccttagaatgcacatacattgtgttcgtgcccaaaatgtctgaaatcattctggaatttgaatctttcgacctggagccagacagcaacccaccagggggaatgttttgcagatacgatcgtctcgaaatatgggatggcttccctgacgtcggcccgcacatcggccgttactgcggccagaaaaccccggggagaattaggagctcatctgggattttgtctatggtattttacaccgatagtgctatcgccaaagaaggcttctccgccaactacagcgttctgcagtcctcggtttctgaagattttaagtgcatggaggcccttggaatggagagcggagaaatacacagcgaccagataacagcatctagccaatacagtacgaactggagcgctgagcgctccaggcttaactaccccgagaatgggtggactccaggagaagattcctacagagagtggatccaggtcgaccttgggctcctgaggttcgtgacagctgtaggcacccaaggcgcaatctccaaggagaccaagaagaagtactacgttaagacttacaagatcgatgtatccagtaatggcgaagattggattactatcaaggaaggtaacaagcctgtactatttcaggggaatacaaatcccaccgatgtcgtggtggctgtttttcccaagccgctcataacccggtttgtacgaatcaaacctgctacatgggaaacgggtatttcgatgcgcttcgaggtttatggttgcaaaatcacagactatccgtgtagcggaatgctcggcatggtgtccgggctgatctctgattcacagatcacgtctagcaaccagggcgacagaaactggatgccagagaacatcaggctggtgacctcgaggtcaggctgggctctccctccggcccctcacagctacatcaatgagtggctgcagatcgatttgggggaggagaagattgtgcggggtatcatcatacaaggtggaaagcaccgagagaataaggtttttatgaggaaattcaaaatcggctattccaacaacgggtctgactggaaaatgattatggacgacagtaagcggaaggcaaagtcatttgaggggaacaataattatgacacacctgagttgagaacctttcctgccctgtcaactagatttatcaggatctaccccgaaagggccactcacggaggtctgggtctccgcatggagctgttaggatgcgaggttgaagctccaaccgccggcccaacaacacctaacggcaatctggtggacgaatgcgatgacgaccaggccaattgtcactctggcacgggtgacgatttccagcttactggaggcacaaccgtgttagcaactgaaaagccaaccgtcatagattccacaatacagtccgaattccctacctatggcttcaattgcgagtttggttggggcagccacaagaccttttgtcactgggagcatgataatcatgtacagctcaagtggtcagtcctcaccagtaagacaggaccaatccaagatcacactggcgatggcaacttcatctactctcaagcagacgagaatcaaaagggaaaggtggccagattggtgtctccagtggtgtactcccaaaattccgcccattgcatgacgttctggtaccacatgagtggatcccatgtagggaccttgcgtgttaaactgaggtaccagaagcccgaggagtatgatcagctcgtgtggatggctattggtcatcaaggagaccattggaaagagggccgtgtgttactccacaaatccctgaagttgtatcaggttattttcgagggcgaaatcggaaagggcaatcttgggggcattgccgtggatgatatatcaatcaacaatcacatttctcaagaggactgcgctaagccggcggaccttgacaaaaagaaccccgagatcaagatcgatgagaccgggtccacccccgggtacgagggggagggcgaaggtgacaaaaatatctcacgcaagcccgggaacgtcctgaaaacacttgatccaatcctaataactatcatcgccatgtccgcactgggcgttctcctaggtgcagtgtgcggcgtcgtgctgtactgtgcctgttggcataatggcatgtcagaaagaaacctcagtgctctagagaactacaatttcgagttagtagacggagttaaattgaagaaggataagctcaacacccaaagcacctattctgaagcctag

SEQ ID NO: 16312 - DNA, 2208 bp, Artificial Sequence
  Description of Artificial Sequence: Synthetic coding sequence
atgtctgagattatcctagaattcgaatcctttgacctcgagcctgatagtaatcctcccggtggcatgttttgtcgatacgacagacttgagatatgggatggctttccagacgtaggcccccatatcggtagatactgcggtcagaaaactccaggaagaatcagaagtagttcaggtatcctttctatggttttctacaccgattccgcgatcgcgaaagagggtttttcagctaattactcagtcctccagtcctccgtgtctgaggatttcaaatgtatggaggctcttggaatggagagcggggagatccatagcgatcagattacggcaagcagtcagtactccactaattggagcgcggaacggagccgcctaaactaccccgagaatggatggactcctggcgaagattcttatcgagagtggatccaggtcgatctggggctcctgcggtttgttacagccgttggcacccaaggagcaattagcaaagaaactaaaaaaaaatactacgtgaagacttataaaatcgatgtgtcctcaaatggagaagactggattacaattaaggaaggaaataagcctgtcctgtttcaaggcaacacaaaccctacagacgttgtggtggccgtgttccctaagccgcttattacacggttcgtccggattaagcccgcaacttgggaaacaggcatctcaatgagattcgaggtctacggatgcaagattactgattacccatgctctggcatgctgggcatggtgtctgggctgatctctgacagtcagatcactagcagtaaccagggagatagaaattggatgcctgagaacattcgactcgtgacaagtagaagtggttgggcactgccaccggccccgcatagttatatcaacgaatggctgcagattgatctcggcgaggagaagatcgtgagggggatcatcatacaggggggtaaacatagagagaataaagtgttcatgaggaagttcaaaattggatactccaataacggaagtgattggaagatgataatggacgatagcaagcgcaaggctaagagcttcgaaggcaataacaattatgacacccctgagctgcgtacattccccgcacttagcacgagattcatccgcatttaccccgagcgcgctacccatggcggactgggtctgcggatggaactgctcggttgcgaggtagaagcaccaaccgcaggcccaactacacccaatggcaacttagtggacgaatgcgacgacgatcaggccaattgtcattcgggaactggcggaaccacagtgctcgctaccgaaaagcctacagtgatcgatagcactatacagtcagaatttccaacctatggctttaactgtgagtttggctggggcagccacaagacattttgccactgggagcacgacaaccatgtacagctgaagtggtctgtactgacttcaaaaacagggcctatccaggatcacaccggagacggcaatttcatatactcccaggccgacgagaatcaaaaggggaaggtcgctagactcgttagtcccgtggtgtactcccagaactctgctcactgtatgaccttctggtaccatatgtccggcagtcacgttggaacgctccgggtgaaactgaggtatcagaaaccagaggagtacgaccagctcgtatggatggccatcggacatcagggggatcactggaaggaaggccgggtgttactccataagtctctgaagctgtaccaggtaatctttgagggagaaatcggaaaaggcaacttagggggtatcgcggttgacgacattagcatcaataatcatatctcacaagaggactgtgccaaacctgcggacctggacaaaaagaatcctgagatcaaaattgacgaaacgggttctacccctggctacgagggcgagggagaaggcgacaagaacatatccaggaaaccaggcaacgtgttaaaaacgctggacccaatcctgatcaccattattgccatgtccgctctgggggtcctgctgggcgctgtgtgtggcgtggtgctttactgcgcctgttggcataacggtatgagtgaaagaaacttatcagctctagagaattataacttcgaactggtggatggggtgaagttgaaaaaggacaaactgaatacacaatctacgtactcagaagcatag

SEQ ID NO: 16313 - DNA, 2721 bp, Artificial Sequence
  Description of Artificial Sequence: Synthetic coding sequence
atggagcgagggctgcccctcctgtgtgccgtgttagccctggtacttgcgcccgccggtgcatttaggaatgacaagtgtggcgatacgatcaaaatcgagtcaccaggctatttaaccagccctgggtacccacactcatatcacccatccgagaaatgcgaatggctgattcaagcaccagacccttatcaaagaatcatgatcaatttcaacccccacttcgacctggaagatagagactgcaaatatgactatgttgaagtgtttgacggggaaaacgagaacgggcatttccgggggaagttttgcggaaagatcgcccctcccccagttgtgagcagcgggccttttttattcattaaattcgtgagcgactacgaaacccacggtgccggatttagtattaggtacgagatttttaaacgcgggcccgagtgctctcaaaactacacaacgcctagcggcgtcatcaagtccccagggttccccgagaaataccccaactcgctggaatgtacgtacattgtgtttgttcctaaaatgtccgaaataatcctggagttcgagtctttcgacttggaacccgattcaaatcctcccgggggtatgttctgccggtacgatcgccttgagatctgggatggcttcccggatgtaggccctcatattgggagatattgcggtcagaaaacccccggcaggattcgatcctcctctgggattttgagtatggtgttttataccgatagtgctattgcaaaagaagggttctctgccaattactctgtacttcaaagcagcgtctctgaagattttaaatgcatggaggcccttgggatggaatctggagagatacacagtgatcagattacggcctcttctcaatactccaccaactggtccgccgagaggtcgagactcaactatccagagaacgggtggacccccggagaggactcttaccgggagtggattcaggtggatcttggcctactccgttttgtgactgctgtgggtactcagggtgctatatcgaaggaaactaaaaagaagtattatgtgaaaacatataaaatcgacgtttcttctaatggcgaggactggattactatcaaggaaggaaacaaaccggtgctttttcaggggaacacaaatccaacggacgtggtagtggctgtgttccccaaacccctaatcactcggtttgttcggatcaagcccgctacctgggaaaccggcattagtatgcggttcgaagtatatggttgcaaaatcactgattacccttgctccgggatgttgggcatggtgtcggggctgatcagtgattcacagatcacttcctctaaccagggggataggaattggatgcctgaaaatatccgcctagtcacctcaaggtctggctgggccttgcctcctgcccctcactcatatatcaatgagtggctgcagattgatctaggcgaagaaaaaattgtccggggcattataattcagggggggaaacatcgggaaaataaggtgtttatgagaaagttcaaaattggctactctaacaacggttccgattggaaaatgatcatggacgactccaagcgcaaggccaagagctttgaaggtaacaacaactacgatacccccgagcttcggacttttccggctctgtcgaccagattcatccgcatctatccagagcgcgccactcacggtggcctcgggttgcgcatggaactgcttgggtgcgaggtcgaggcgccaacggccgggcctacaacacctaatggcaacctcgtggatgagtgcgacgacgaccaggcaaactgtcattccggcacgggcgacgatttccagctgaccggagggactaccgtcctcgcgacggaaaagccaacggtgatcgactccacgatccagagcgagttccccacctacggatttaactgtgaattcggatggggaagccacaagactttttgtcactgggaacacgacaaccatgttcagctgaagtggtcagtgctcactagcaagacagggccaatccaggaccacaccggtgacggcaactttatctacagtcaggcagacgagaaccagaaagggaaggtggccaggcttgtatcaccagtcgtttattcccagaactctgctcactgtatgacattctggtatcacatgtctggatctcatgtcggcacgctccgggtaaagctaagataccagaaaccagaggaatacgatcaattagtgtggatggcgattggacatcagggggaccattggaaggaagggagggtgctcctgcacaaatcgttaaagctttatcaggttattttcgagggtgaaataggcaaggggaacttgggtggaatcgctgttgatgatatttctatcaacaatcacatcagccaggaggactgcgccaggagcactcccggatatgagggcgagggcgaaggagacaagaatatctcaagaaaacccggcaacgttctgaaaaccctcgatccaattcttatcactataatcgccatgagcgccttgggggtcttactgggcgccgtgtgcggagtcgtgctgtattgcgcatgctggcacaacggcatgtccgaacggaatctgtccgccctagaaaattataactttgagcttgtcgacggcgttaagctcaaaaaggataaactgaacacccagtccacttactcagaagcgtag

SEQ ID NO: 16314 - DNA, 318 bp, Artificial Sequence
  Description of Artificial Sequence: Synthetic coding sequence
aaccacatcagtcaggaagactgtgcacggtcaactcccggctacgagggagaaggcgaaggcgataaaaatataagccgtaagccaggtaatgttctgaagacattggatcccatactgatcacaattatcgcaatgagtgccttaggtgtgctcctgggagccgtctgtggagttgtgctgtactgtgcatgctggcataacggaatgtctgagcgcaatctgagcgctctcgaaaactataacttcgaactagtagacggagtgaagctcaagaaagacaaactcaatacccaatccacctactctgaagcatag

SEQ ID NO: 16315 - DNA, 234 bp, Artificial Sequence
  Description of Artificial Sequence: Synthetic coding sequence
tgacctactgccggacccacaacccccaatggaaacctggtggacgagtgcgacgacgaccaggctaattgtcactctgggactggtgatgacttccagctcactggcgggactactgtactggctaccgagaagccaacagttatcgatagcaccatccagtccgctaggctcgaggtgagcactctgaacttgagccttcataatccaccccagcagaaagccctcatttag

SEQ ID NO: 16316 - DNA, 303 bp, Artificial Sequence
  Description of Artificial Sequence: Synthetic coding sequence
tagacccatggtgggctgggtcttcgcatggagctgctgggctgcgaagtggaggccccgaccgcaggcccaactactcccaacggaaatttggtcgatgagtgtgatgatgaccaggccaattgtcactcaggaacaggcgatgactttcagttgacaggggggaccactgtgctagctaccgagaagccaacagtaattgactctaccattcagagcgggagtcggttctttaaacaccatcacaaacagcagtctatgagacctcagaacctgcaccataactccatactgttgctgtag

SEQ ID NO: 16317 - DNA, 711 bp, Artificial Sequence
  Description of Artificial Sequence: Synthetic coding sequence
gtggacttaggactgctgcgctttgttaccgccgtcggcacccagggagcaatttccaaggaaactaaaaaaaaatattatgttaaaacgtacaaaatcgacgtgtcctcaaacggtgaagattggataacaatcaaggaaggtaacaaacctgtgttattccagggcaataccaatcccactgacgtcgtagtggcagtttttcccaaacccttgattacccgttttgtccgcataaagcccgctacttgggagaccggaatctcaatgagattcgaggtgtacggttgtaagatcaccgattacccttgttctggcatgctgggcatggtctcaggattaatctcagactcccaaataacttcatccaatcagggtgaccggaactggatgcccgaaaacatcagactcgtcaccagccgtagcggatgggcgctgcctcccgcaccacacagctacattaatgagtggttgcagattgacctgggagaggagaagattgtgcgtggcatcatcattcaaggggggaagcatagagagaacaaagtcttcatgcgtaaatttaaaataggttacagcaacaatggtagtgactggaaaatgatcatggatgactcgaagcgaaaggctaaggtccgggcaggagactgggaggaggtaatcccatacgtgcttgacttcaaccaggggcccctcgcgttctctaggtag

SEQ ID NO: 16318 - DNA, 513 bp, Artificial Sequence
  Description of Artificial Sequence: Synthetic coding sequence
taacctggaggcatgttctgcaggtatgaccgcctggagatatgggacggtttccctgacgtggggccccatatcggcaggtattgcggccagaaaacacccggtagaatccgcagctcttcaggaatccttagtatggtgttctatacggacagtgcgatagctaaggaaggtttttccgcgaattacagcgtcttgcaatcttcagtctccgaagacttcaagtgcatggaagcactcggaatggagtccggggagatccatagcgaccagatcaccgctagctcccagtattccactaactggtctgcagagcgcagtcggttaaactatcccgaaaatggatggactcctggcgaagattcttatagagagtggatccaggatgctaagtacaggctgagagtttcagtcgtgagatctaaaagctcttcctcgtccacatcgttggaaccaaggcctctgtcatcactgaagttatcatttttttcctacaagatcaagattacatag

SEQ ID NO: 16319 - DNA, 2721 bp, Artificial Sequence
  Description of Artificial Sequence: Synthetic coding sequence
atggacatgttccccctgacttgggtgttcctcgccctttacttcagccgtcaccaggttaggggccagccagatccgccctgcggcggtcggctcaatagcaaggatgccggatacatcactagcccggggtatccccaggactaccctagccaccagaattgcgaatggattgtttatgccccagagcctaatcagaaaatcgtattaaattttaaccctcacttcgagattgagaagcacgattgtaaatacgactttattgaaatacgtgacggcgactcggagtccgcggatctgcttggaaagcattgcgggaacatcgcccctcctacaatcatcagttcaggttcgatgctgtacatacgatttacaagcgactacgccagacagggggctgggttctctttacggtacgaaatttttaaaacgggaagtgaagattgttccaaaaacttcaccagccccaatggcacgatagaatctcccggctttcctgaaaaataccctcataatttagattgtacctttacgatcttagccaaaccgaaaatggagattatcctccagttccttatattcgacctggaacatgatcctctgcaagtgggcgaaggtgactgcaagtacgactggctggatatatgggacggaatcccacacgtaggccccctgatcggcaaatattgtggtaccaagacccccagcgaactcagatcatcgacaggtatcctctccttgactttccataccgatatggccgtggctaaggacgggttttctgcccggtactacctggtccatcaagagccactggagaatttccaatgtaacgtacccttaggtatggagagcggtcggattgccaacgagcaaataagtgcaagttcaacctattccgacggaaggtggaccccccagcagagcaggctgcatggggacgacaatgggtggactccaaacttggatagcaacaaggagtatctgcaagtggatcttagatttctgacaatgctgactgccattgccactcagggggcaatctcgagggaaacacagaacggctactatgtgaagagctacaaactggaagtctctactaacggggaggactggatggtatacaggcatggaaagaaccacaaggtgttccaggctaataacgatgccaccgaggtggtactgaacaaactgcacgcccccttactgacccgctttgtgcgtattaggcctcaaacatggcactcgggaattgctctaagacttgagttattcggttgccgcgtgacagatgcgccttgctctaatatgttgggtatgctgtccggtctcatcgccgactctcaaatcagcgcatccagtacacaggaatatctgtggtctccaagcgccgcgagactggtatcaagccgatctggctggtttccccgaataccccaagcccaacccggcgaagagtggcttcaggtggacctggggaccccaaaaaccgtgaaaggcgttatcatccagggagcacgaggcggagattccatcacagcagttgaggcccgcgcttttgtgagaaagttcaaagtcagttatagcctgaatggcaaagactgggaatatattcaagacccccgcactcagcagcccaaattatttgaggggaatatgcattacgacactccagatatcagacggttcgacccgattccggcccagtatgttcgggtgtatccagagcgttggagccccgccggaatcggcatgagactggaagtgctaggctgtgactggaccgacagcaaaccaaccgtggagacactcggcccaacagtcaagtctgaagagaccaccaccccttatcccaccgaagaagaagccactgaatgcggtgagaattgtagctttgaagacgacaaggatctgcagttgcccagtgggtttaactgtaacttcgacttcctcgaggaaccatgtgggtggatgtacgaccacgcaaaatggctgagaacaacctgggcatcctcgtcaagccccaatgaccgtacttttccagatgatcgcaatttcttgaggctccagtctgattcccagcgcgagggtcaatatgcccggctcattagtccaccagtgcacctgccccggtcacctgtctgcatggagttccagtaccaagcgacgggcggccggggcgttgctctccaggtcgttcgagaagccagtcaggagtccaaactcctttgggtaatccgggaagaccagggaggtgagtggaaacacggccggattatcctgccctcctatgacatggaatatcaaatcgtgttcgagggcgtcattggaaagggccgctcaggcgaaattgccattgacgacatcaggatcagcactgacgtgcctctggagaactgtatggagcccataagtgccttcgcaggggaaaacttcaaaggcggaactctgctccctgggactgaacctaccgtggataccgttcctatgcagcctatccctgcatattggtattacgtcatggccgctgggggagcagtcctggttctcgtatctgtagccttagctttggtgttgcactatcaccgtttccgatacgctgctaaaaaaacagaccatagcatcacttacaagacaagtcactacactaatggcgcaccactggctgttgaaccaaccctgaccatcaaactcgagcaagacagaggttctcattgttag

SEQ ID NO: 16320 - DNA, 300 bp, Artificial Sequence
  Description of Artificial Sequence: Synthetic coding sequence
atggacatgtttccactcacatgggtgttcctcgccctgtattttagtaggcaccaggtgcggggccagccagaccctccatgcggtggccgattgaattccaaagacgctggttacataacctctcctgggtatccccaggactaccctagccatcagaattgtgagtggatcgtgtacgcacctgagcccaatcagaaaattgttttaaacttcaacccacactttgagattgagaaacatgactgtaacctgttgtctgcgtggaaaatcagcctgacatctaggtccttcgcatag

SEQ ID NO: 16321 - DNA, 1668 bp, Artificial Sequence
  Description of Artificial Sequence: Synthetic coding sequence
atggatatgttcccattgacctgggttttcttagccctgtatttctcccgccaccaggttaggggacagcccgacccaccgtgtggcggaagactgaatagcaaagatgccggctacattacctctcccggctacccccaggattacccgtcccaccagaattgcgaatggatagtgtacgccccagagccaaatcagaagattgtgctgaacttcaatccgcacttcgaaattgagaaacacgattgtaagtacgacttcatagaaattagagatggcgacagcgagtccgcggacttgctgggcaagcattgtggaaacatcgctccaccaaccattatcagctccggaagtatgttgtacattagatttaccagcgactatgcccggcaaggcgccggttttagtctgcgctatgaaatttttaagactgggtcagaggactgctcaaaaaacttcacaagtcccaacggtaccatcgagtccccgggctttccagaaaaatacccacataatcttgactgcacattcacgattctcgccaagcctaaaatggagatcatactgcagtttctaatttttgatctggagcatgatccgctccaggtcggtgagggggactgcaagtacgattggctggacatatgggacgggattccgcacgtaggtccgctgattgggaaatattgtgggactaagactccaagcgagctcaggtcttcaacaggaatattgtcacttactttccataccgacatggccgtggcaaaggacggtttctcggctcggtactacctcgttcaccaggaacccctcgagaatttccaatgtaatgtgccactggggatggaaagcgggaggatagcaaacgagcagatctccgccagcagtacttactcagacggtaggtggacaccacagcagagtcggctgcacggcgatgataatgggtggactccaaatttggactccaataaggagtatttgcaggtcgaccttcggttcctgaccatgctgacagccattgccacacagggcgcaatttctcgggagactcagaatggatactacgtgaagagttacaaactcgaggtttcaactaatggagaagactggatggtttaccggcacggtaagaaccacaaagtttttcaggctaataacgacgccaccgaagtggtattaaacaaactgcatgcccctctgctcaccaggtttgtccggattcgccctcagacatggcacagtgggattgccctgagactggaactgtttggttgtagagttacggatgcaccatgctccaacatgcttggcatgttaagcgggttaatagccgactcgcagatctcggcctcctccacccaggaatacttatggtctccaagcgctgcccgccttgtgagtagcaggtcaggatggttccccagaataccccaggcacagcctggcgaagagtggctccaggtagatttagggacacctaagacggtgaagggcgttatcattcagggtgcacgagggggagattctataaccgcagtagaagctagagcatttgttaggaaattcaaggtatcatatagcctgaatggcaaggattgggaatacatccaggacccccggacacagcaaccgaaggttggctgttcttggaggcctttgtag

SEQ ID NO: 16322 - DNA, 2706 bp, Artificial Sequence
  Description of Artificial Sequence: Synthetic coding sequence
atggatatgttccctctcacatgggtgtttctggccctatacttctccaggcatcaggtgaggggacagcctgatccaccatgtggggggcgcctcaactctaaggacgcaggttatatcacttcccctggttacccccaggattacccgtctcaccagaattgtgagtggattgtctacgctcccgagcctaaccagaaaatagtgttgaatttcaacccccactttgaaattgaaaagcacgactgtaagtacgactttatcgaaatccgagacggtgatagtgagagcgctgaccttcttgggaagcattgtggcaatatcgctccccccacaataatcagctccggctctatgttatacatccgtttcacgtccgactacgcaaggcagggtgccggtttcagtctgcgatatgagatctttaaaaccgggtcagaggattgttccaaaaactttaccagtccaaatggaacaattgaaagtccgggcttccccgagaagtatccacacaacctcgattgtacctttactattctcgctaagccaaaaatggagatcatcctccagttcctaatctttgaccttgagcacgaccctctacaagttggtgagggcgattgcaagtacgactggctcgatatatgggacggtattcctcatgtcggacctctgatagggaagtactgcggaaccaagacgccgagcgagctcagatcatccacagggattctgtctttgacatttcacacagacatggctgtggctaaagacggcttctccgccagatattaccttgtccaccaggaacctctggagaactttcaatgtaacgtaccactggggatggagtccggaagaatagccaatgagcagatttctgcctcgtccacttactccgacgggcggtggacgccccaacagagtcggttgcatggcgatgataatggatggacccctaatctcgatagtaacaaagaatacctgcaggtagatctgaggttcctgacaatgctgactgctatagctacacagggagctatctcgcgagaaacacagaacggctactacgtcaaaagctacaaactggaggtcagcaccaatggcgaggattggatggtgtaccgacatggaaagaatcacaaggtctttcaggctaataacgatgccacagaagtggtcctgaacaaactgcatgcccctctactgacacgcttcgttaggatccggcctcagacttggcactcgggtatcgcactgaggttggagctgtttggatgtagagtgactgatgccccatgttccaacatgctgggcatgctgtctggattaatcgccgacagccagatttcagctagttccactcaggagtatctgtggtcacccagtgccgcacgtctcgtgtcgtctaggtcaggatggttcccaagaattcctcaggcccagcctggggaggagtggctccaggttgatctgggcacacccaaaacagtaaagggggtcattatccagggagcaaggggcggcgacagcattacggccgtggaagcaagggcttttgtgaggaaatttaaggtgtcttattcactgaacgggaaagattgggaatacattcaagaccctcggacccaacagcccaagctgttcgaaggcaatatgcactacgatactcctgatatcaggcggttcgacccaatcccagcgcagtatgtgagagtgtatcctgagcgatggtctcccgctgggattgggatgagacttgaagtactggggtgcgattggaccgatagcaagcccactgtggagactctgggtcccactgttaagagtgaagaaaccacgactccttatcctactgaggaagaagcaactgaatgcggcgagaattgtagctttgaagacgataaagatcttcagttaccatcgggatttaactgcaactttgactttctggaagagccatgtggctggatgtatgatcatgcaaagtggctgcgtactacttgggcatcctccagctctccaaatgataggaccttcccagatgaccggaattttctgagactgcaaagtgacagtcagagggagggacagtacgccagactcattagccctccggtccacctgcccagaagtccagtttgcatggaattccagtaccaggccaccggcggccggggtgtggctctgcaggtcgttagagaggcgagccaggagtccaagctgctatgggtcatacgtgaggatcagggcggagaatggaagcacggccggattattctcccttcttatgacatggagtaccaaattgttttcgaaggggtgattgggaaaggcagaagcggggaaattgctattgacgatattagaatttccactgatgtgccactcgaaaactgcatggaaccgatatctgcattcgccgggggaaccctgctgcctggaaccgagccgaccgtagacactgtgcctatgcaaccgatccccgcttactggtactacgtgatggccgccgggggggcagtcctggtgttagtttccgtggccctggctctggtactgcattaccacagattccggtacgcagcaaagaagaccgatcattctattacttacaaaacctcccattatacgaatggcgcaccgctggccgtagagcccacactgacaatcaaattagaacaggatcggggtagccattgttag

SEQ ID NO: 16323 - DNA, 2781 bp, Artificial Sequence
  Description of Artificial Sequence: Synthetic coding sequence
atggatatgtttcctctgacgtgggttttcctggccctatacttcagccggcaccaggtaagagggcaaccagaccccccttgcggtggaaggttgaactcaaaagatgccggatacattacctccccgggatatccgcaggattacccatctcaccaaaactgcgagtggatagtctacgccccggagccaaatcaaaagatcgttctcaatttcaaccctcatttcgaaatagagaaacacgattgcaagtatgactttattgagattagggacggggattcagaatcagccgatctgctgggaaagcactgcggaaatatcgcccccccaacaatcatctcaagtggttctatgctctacatccggtttacttccgactacgcccgccagggagccggcttctcccttagatatgaaatcttcaagacaggatctgaagactgcagtaaaaacttcacaagtcctaatggcaccattgaaagcccaggattcccagagaagtacccacacaacttggactgtactttcactatcctggctaagccaaagatggagatcatcctgcagttcctgatatttgatctcgaacacgatccactgcaagttggagagggagattgtaagtatgattggctggacatatgggacgggattccacacgtgggccccttgattgggaagtactgtggcaccaagacaccaagcgaattgaggagcagtaccggcattctaagcctgaccttccatactgatatggccgtggccaaggacgggttctccgccagatattacttagtgcaccaggagcctctcgagaatttccagtgtaacgtgcccctgggaatggaatcaggccggatcgccaacgagcaaatttccgcctctagtacttactcagacggccggtggaccccacagcagtcgcgcctccatggagacgacaatggatggacaccgaatttagactcaaacaaagaatacctgcaggtggacttgagattcctaactatgctgaccgccattgcaacccagggtgcgatcagtcgagagacacagaatgggtactacgtgaaatcctacaagcttgaggtttcaacgaacggggaggattggatggtctaccgccatggtaagaaccacaaggtttttcaagctaataatgatgccacggaagtggttctcaacaagttacacgctcccttgctcacaaggttcgttcgcatccgcccgcagacctggcattctggcatagcacttagacttgaactgttcggctgcagagttacagacgcaccatgctctaacatgctcggtatgctcagcggcctgattgctgacagccagatctccgctagcagtactcaggaatacctctggtcaccatcagcagcacggctggtcagctcccgctcagggtggttccctcgtatccctcaggcacaacctggggaggaatggctccaagtggatctcgggacgcctaagacagttaaaggcgtcattatccagggcgctcgcgggggagacagcatcaccgcagtagaggccagagctttcgtgaggaagttcaaggtgagttattctctgaacgggaaagactgggagtacatccaggacccgcgtactcaacaacccaagctctttgaaggcaatatgcattacgatactcctgacatcagacgttttgaccccatcccggcacaatatgttagagtttaccccgaacgatggtctccggccggtattggcatgcgcctcgaggttctcggatgtgattggactgattcaaaacccaccgttgagaccctgggccctactgtgaaatcagaagaaacgaccaccccctatcctacagaagaggaggccaccgaatgcggtgaaaattgcagctttgaggacgacaaggacctgcaactgccctccggttttaactgtaattttgacttcctggaggaaccatgtggatggatgtatgatcacgccaagtggctgagaacgacatgggctagttccagttcaccgaatgacagaacattcccagacgatcgtaacttcctgcggttgcagagtgattcccagcgtgaaggccagtacgccaggctgatatctccccctgttcatctgcccaggtcacctgtatgcatggaatttcagtaccaggcaacaggtggcaggggagttgccctgcaagtggtcagagaagccagccaagagagcaagctactttgggtgattagggaagatcagggaggggaatggaaacacggtcggattatcctgcccagctatgatatggagtatcaaattgtttttgagggggtgatcggcaaaggcaggagcggcgaaatcgcgatcgatgatatcagaattagtaccgacgtacccctggaaaattgtatggaaccaatctcagccttcgccgtggatatacccgagatccatgaacgagaaggctacgaagacgaaatcgatgacgagtatgaagtggactggagcaattcatccagcgccacatccgggagtggtgccccatcaacggacaaagagaaatcctggttgtacacactcgaccccattctgattaccatcatcgcgatgtctagcctaggagtactgcttggggcaacctgcgcggggctgttgctatactgcacttgcagctattcggggctgtcctcccggtcttgtacaacactggagaactacaattttgagctgtatgacgggttgaagcacaaggtgaagatgaaccaccaaaagtgctgttcagaagcctag

SEQ ID NO: 16324 - DNA, 2796 bp, Artificial Sequence
  Description of Artificial Sequence: Synthetic coding sequence
atggacatgttcccgttaacgtgggtctttcttgcgctctacttctccaggcatcaagtgcggggccagcccgaccctccttgcggaggacgactaaattctaaggatgcagggtatattactagtcccggctatccacaggattatccgagccaccagaactgcgaatggatagtgtacgcaccagaacccaatcagaaaattgtcctgaattttaatccacattttgaaatagagaagcacgattgcaagtacgactttatcgagatacgggacggtgacagtgaatcagcagatttactcggtaaacactgtggcaatatagctcccccgaccatcatctcatccggttctatgttgtatatcaggttcaccagcgactatgcgcgccagggcgccgggttctcactgaggtacgaaatcttcaagaccggctctgaagattgctccaagaactttacttctccaaatggaacaattgaatcaccagggttccctgagaagtatccccataacttagattgtacgtttacgatccttgccaaacccaagatggagattattctgcagttcctaatttttgatcttgagcacgatcctttacaggtgggggagggagactgtaagtacgattggctcgacatctgggacgggattccccatgtgggacccttgatcggaaagtactgcggcacgaaaactccttctgagttgcgttcttctacaggaatcctgtctttaactttccatacggacatggcagtagccaaagatggctttagcgcgcgatactatctagtgcaccaagagcccctggaaaactttcagtgtaacgtcccccttggcatggaatccgggcgcatagccaatgagcaaatcagtgcttcttcgacctactccgacggaagatggaccccccagcagtccaggctgcacggtgacgataacggctggacacccaatctagactcgaataaggagtatctccaggtcgacctgcgcttcttgacaatgctcacagcgattgccacacaaggtgccatctctagagagacacagaatggatactacgtgaaaagctacaaactggaagtgagtaccaatggcgaagattggatggtttacagacatggaaaaaaccataaagtgttccaggccaataacgacgctactgaagtggtactgaacaaactgcacgcacctcttcttaccagattcgtgagaatccgccctcagacttggcattccgggatcgcgctgaggctcgagctcttcggctgccgagttactgatgccccctgctcaaatatgctgggtatgctttctggcctcatagccgatagtcagataagcgctagttcgacccaagaatatctgtggtcaccttccgcagcccggctcgtgagctcccggtcgggctggttccctcgcattcctcaggcccaaccgggcgaagagtggctgcaagtagatttagggaccccaaagaccgtcaagggagttataattcaaggtgcacgcgggggcgactccatcactgcggtagaagcacgcgccttcgtgagaaaatttaaggtgagctatagccttaatggcaaagactgggagtatatccaggatccacggacgcaacagcccaaactcttcgagggaaacatgcattacgacactcctgacattcgccggtttgatcccattccagctcagtatgtgagagtgtaccccgaacgttggtcacccgctggcataggcatgagactggaagttttggggtgtgactggacagattcgaaacctacagttgaaaccctgggaccgaccgtgaaaagtgaagagacaacaactccatatcctaccgaggaagaagcaaccgagtgcggcgaaaattgctctttcgaggacgataaggacttacagctgccatcagggttcaactgtaacttcgactttctggaggagccttgcggctggatgtatgaccacgccaaatggcttaggactacatgggccagctccagcagtcccaatgatagaacttttcctgacgatcgtaattttctcaggctgcaaagcgattcccaacgcgagggccaatatgcaagattgatcagcccacctgtccatctgccaagatccccagtgtgcatggaattccagtatcaggctaccggtgggagaggcgtagccctgcaagttgttagagaggcatcccaggagagtaaactcctatgggtgatccgggaggatcagggcggtgaatggaaacatgggcgcatcatcctcccttcctacgacatggagtatcagattgtgtttgagggtgtaatcgggaaggggcgatcaggagagatagctattgacgatataagaataagcactgatgtgcccctcgaaaactgtatggaacccatttccgcttttgccggagagaatttcaaggtggacatacccgagatccacgagcgcgagggctatgaagatgaaatagacgatgagtacgaagtcgattggtccaatagctcaagcgcaacctccggatcgggggcacccagtactgacaaagagaaatcctggctgtatacacttgatcccattttaataacaataatcgccatgagctctctgggcgttcttctgggagccacatgcgcgggacttctactatattgtacctgttcatactctggcttgtcgtcccggagctgcacaactctggaaaattacaactttgagttatacgacggcctaaagcataaagtgaagatgaaccaccagaagtgttgtagcgaagcttag

SEQ ID NO: 16325 - DNA, 2730 bp, Artificial Sequence
  Description of Artificial Sequence: Synthetic coding sequence
atggatatgttcccattaacatgggtttttctggctctttactttagccggcaccaggtacggggacagcctgatcctccatgtggcggaagattgaactccaaggatgctggttacatcacttcccccgggtatccgcaggactatcccagccaccaaaattgtgaatggatcgtttacgcacccgagcctaatcagaaaatcgtgctgaattttaatcctcactttgagatcgagaagcacgactgtaagtacgactttattgaaattcgcgatggcgattctgagagcgccgatctcctaggaaaacattgtggcaacattgcacctccgacaattatcagctctggctccatgctgtatatccgctttacctccgattacgccaggcagggcgcaggctttagtctgaggtacgagatattcaaaactgggtctgaagactgttctaaaaactttacaagcccaaacggtactatcgagagtcccggattccctgaaaaatacccacataacttggactgcactttcactatcttagcaaagccaaaaatggagataattttgcagttcttgatcttcgacctggagcacgacccgctccaagtgggggagggggactgcaagtatgactggttggacatatgggacggcatcccgcatgttggacccctgattggaaaatactgtggaaccaagactccatctgaactccggtcctccacaggaatcctgtccttgacctttcataccgacatggccgttgctaaagatgggttcagcgcaaggtattatttagtgcaccaggagcctttagaaaactttcaatgcaacgtgcctttagggatggagagcggtagaattgccaatgaacagatcagcgccagtagcacctactcggacggcaggtggacgccacagcagtcgaggttgcatggcgatgacaacggatggacaccaaatctcgatagtaacaaggaatatctgcaagttgacctgaggtttttaacgatgttgacagcaatcgccactcagggagccatatcgcgcgagactcagaatgggtactatgtgaaatcatataaacttgaagtttccaccaacggagaagactggatggtttatcgccatggcaagaaccacaaagtgttccaggccaacaatgatgcaactgaggtggttcttaataagctgcacgcgcctctgctgaccagattcgtccgcattaggccccagacctggcatagtggtattgctctaagactggagctgttcggatgcagggtgacagatgccccttgctccaatatgctcgggatgctctctgggctgattgccgattctcagatcagcgctagtagcacacaagagtacttgtggtctccttcagccgcacgtctcgtctcctctcgatccggctggtttccgagaattcctcaggctcagcctggtgaagagtggctgcaggtagatttggggacacccaagactgtaaaaggagttattattcagggggcaagaggtggtgatagtatcaccgctgtcgaggcacgcgcgttcgtgcgcaagttcaaggtctcctacagcctgaacgggaaagattgggagtacattcaggatcccaggactcagcaacccaagctcttcgaaggcaacatgcactatgatacgcctgatatcaggaggttcgatccaattcccgctcaatacgtgcgagtttaccccgagaggtggtccccggcgggcataggaatgaggctggaggtgttgggctgcgactggaccgattctaaaccgaccgtagagacactaggacctaccgtgaagtctgaagagactaccactccgtaccctaccgaggaggaggctactgaatgtggcgagaactgtagcttcgaagatgacaaggatctacagctgccaagtggctttaactgtaatttcgatttcctggaagagccttgcggctggatgtacgaccacgccaagtggctcagaaccacctgggcctcgagtagttcccccaacgatcgcacttttccagatgacaggaacttcctccggctccaatccgactcccaacgggaagggcagtacgccagactgataagcccccctgtgcatctccccaggtccccagtgtgtatggaatttcagtatcaggccactggaggccgaggggttgctcttcaggtggtcagagaggcatctcaggaatcaaaacttctgtgggtgattcgggaagaccagggcggtgagtggaagcatggacgaattatcttaccttcatacgatatggaatatcagatcgtattcgaaggcgtaattggcaaagggagaagtggagagattgccatcgacgatatcagaatttctaccgatgtgccgctagagaactgtatggagcccataagcgccttcgccgacgagtatgaggtagattggtcaaactcttcaagtgcaacaagcggtagcggagctccctctaccgacaaggaaaagagctggctgtacacactagatcccatcctgatcaccattattgctatgtcctcattgggagtcctgttgggtgcaacatgcgccggactgttgttatactgtacttgctcctactctgggctgtcctcacgttcttgcaccactctcgaaaactacaactttgaattatacgacggactcaagcataaagtgaaaatgaaccatcaaaagtgctgctccgaggcttag

SEQ ID NO: 16326 - DNA, 1668 bp, Artificial Sequence
  Description of Artificial Sequence: Synthetic coding sequence
atggacatgttcccactgacctgggtgtttcttgctttgtacttttcccgccaccaggtacgtggccagcccgatcccccctgtggggggcgcctgaacagcaaggatgctggttatatcacctctccaggctaccctcaagactatccgtctcatcagaattgcgagtggatcgtatacgcacccgaaccgaaccagaaaattgtactgaactttaatccgcactttgagatcgaaaaacatgactgcaaatacgactttatcgaaatcagagatggagactctgagtcggcagatttactcgggaagcactgcggaaatattgccccgcctactatcatcagctctggatcaatgttgtacatcagattcacctccgactatgcgcgccagggcgctggatttagtctacgctacgaaatttttaagaccggtagtgaggactgcagcaagaattttacaagccctaacgggacgatcgagtcccctggatttccggagaaatatccccataacttggattgcacattcactatcttagcaaaacccaaaatggagatcatcctgcagtttctgatcttcgacctggaacacgaccccctgcaggtgggcgagggggattgcaagtacgattggctggacatctgggatggaattccccacgtcggtccacttatcgggaagtattgcggaaccaaaaccccctcggaactgcgctcctctaccggaattttgtccctgactttccacactgacatggctgttgcaaaagatggattctctgccaggtactacctggttcatcaggagcccctggaaaactttcagtgtaatgtgccccttggaatggagagcggacggatagccaatgaacaaattagcgcctcgtctacttactcggatggtcgatggacgcctcagcagtctcgtctgcatggtgatgataacggttggacaccgaacttggactcaaacaaagaatacctgcaggtagatctgaggttcctgaccatgttgaccgcaatagccacccaaggtgccatctctcgagaaactcagaacggctattacgtgaagtcatacaaactcgaggtgagcaccaatggtgaggattggatggtgtaccgtcacgggaaaaatcacaaggtgttccaggcaaacaacgacgccacagaggtggtgctgaataaactacatgctccgctgttaacaaggttcgtgcgtatacgaccccagacgtggcactctggaattgccttaaggctggagcttttcggatgtagagtcacggatgccccttgttctaatatgctgggaatgttgtcgggccttatcgccgactcccagataagcgcctctagcactcaagaatatttgtggtctccctccgccgctcgcttggtgtcttctcgctccggctggtttccacgaataccacaggcacagcccggagaggagtggctgcaagtggatctgggcactccaaagacagtgaagggagtgatcatacaaggcgctcgcggtggcgactccattactgcggtggaggctagagcattcgtgagaaagtttaaagtcagctactcactgaatgggaaggattgggagtacattcaagatccgagaacccagcagcctaaggtcggctgctcatggaggccactatag

SEQ ID NO: 16327 - DNA, 309 bp, Artificial Sequence
  Description of Artificial Sequence: Synthetic coding sequence
atggatatgtttccactgacctgggtattcctggccctgtatttttctcgacaccaagttagagggcaacccgatcccccctgtggcggacgccttaacagcaaagacgctggctatattaccagccccggctacccacaggattatccgagccatcagaactgcgagtggatcgtttacgctcctgagccaaatcaaaagattgtgctcaacttcaatcctcattttgaaatcgagaagcacgactgcaaatatgacttcatcgagatcagggatggtgatagtgaaagtgctgacctgctgggttag

SEQ ID NO: 16328 - DNA, 2781 bp, Artificial Sequence
  Description of Artificial Sequence: Synthetic coding sequence
atggatatgttccccctgacatgggtgttcctcgctttgtactttagtcgtcatcaggtcagagggcaacccgaccctccttgtggcggcagacttaattctaaagacgccggatatattaccagccccggatatcctcaggactatccatcacatcaaaattgcgaatggatagtttacgcccctgaaccgaaccagaagattgtcctgaatttcaatccacatttcgaaattgagaaacatgactgtaaatatgatttcattgaaatccgcgacggcgactcagaatccgcagacctcctcggaaagcattgcggaaatatcgctcctcccaccattatttcaagcgggtccatgctttatatccggttcacctccgattacgctagacagggggctggattctcactgcgctatgagatcttcaagaccgggagtgaggattgttccaaaaactttactagccctaacggaaccatcgagagtcctggtttcccggaaaagtacccccacaacctggactgtacattcaccattctcgccaagccgaagatggagataatcttgcaatttctgatcttcgacctggagcacgatcctcttcaagtgggggagggcgactgtaagtatgactggctcgatatatgggacggcattccgcatgtaggtccactcatcgggaagtattgcggcaccaagaccccttctgagcttcgatcatccacagggattctttcactgaccttccacaccgacatggccgtggctaaagacggattctctgcccggtattatctggtacaccaggagcccctggagaactttcagtgcaacgtgccactgggtatggaatctggccggattgccaatgaacagatcagcgcaagtagtacctacagcgatggcaggtggactccgcaacagtctcgcctccacggggacgataatgggtggactccaaatttggactcgaacaaggaatatctgcaggtagatctgcgttttctgacaatgttgactgcaattgcaacccagggggcgattagccgggaaacccagaatggatattatgttaagtcatataagctggaagtcagcaccaacggagaggattggatggtctacaggcatggcaaaaatcataaagttttccaagcgaataatgacgccacagaggtcgtgttaaataaactccacgcccctttgcttacccgctttgttcgaatccgtccacaaacctggcatagtggaattgcactgcggttggagttgttcggatgccgggtgacggacgccccttgcagcaatatgctcggcatgttatccggtctcatagcagattcacagatcagtgccagcagcacacaggaatatctatggtccccatcagccgcccggttggtcagcagtcggagcggctggttcccacgaataccccaggcccagcccggtgaggagtggttgcaggtggacctgggaactcctaagaccgttaaaggggtgatcattcagggggcgcgcggcggcgactctataaccgccgtcgaggccagagcatttgtcagaaaattcaaagtgagttattccctgaatggcaaggactgggagtacattcaggatcctcgcacacagcagcctaagctgtttgagggcaacatgcattatgacacccccgacattcgcaggttcgaccccatccccgcccagtacgttagagtataccccgagcggtggagccctgctgggattgggatgcgccttgaggtgctgggttgcgattggacagacagcaaaccaactgtcgaaaccctcggccctaccgttaagtcggaagagacaaccactccataccctacggaggaagaggctacagagtgtggcgaaaactgcagttttgaggacgataaggacctacagttgccaagtggttttaattgcaactttgacttcctcgaagagccctgtggctggatgtatgatcacgcaaaatggctgagaacaacatgggcgtctagtagttctccaaacgaccgcacattccccgatgacaggaacttcctcaggcttcagagcgattcccagagggaaggccagtacgcccgccttatttcaccgcccgtgcatctccctcggtcccccgtctgcatggaatttcagtaccaggctactggtggtcgaggggttgccctgcaggtggtgcgcgaagcatctcaggagtccaaactgctgtgggtcatcagagaagaccaagggggagaatggaagcacggccgcatcattctaccatcttacgatatggagtatcaaatcgtgtttgaaggcgtgattggaaagggacgcagcggcgaaattgccatcgatgatattagaatttcaacggacgttcccctggagaactgcatggcaaccgtctctgccagtatcgtggatatccccgagatccacgagcgggaagggtacgaggacgagattgatgatgagtatgaggtagactggtctaacagcagcagtgcgacatccggaagcggagctccctccaccgataaagaaaaatcttggctgtatacactggatcctattctgatcaccattattgctatgagcagtctcggcgtactgctgggcgctacatgtgctgggcttttactgtactgtacatgtagttactctgggttgagttccagatcttgcaccacgctcgagaattacaatttcgagctatatgacggcctgaaacacaaggtcaagatgaatcatcagaagtgttgctcagaagcgtag

SEQ ID NO: 16329 - DNA, 2730 bp, Artificial Sequence
  Description of Artificial Sequence: Synthetic coding sequence
atggacatgtttcccctgacatgggtttttttagcattgtacttctcacgacaccaagtgagaggacagcctgacccgccttgtggcggccggttgaatagtaaggatgctgggtacatcacatcccctggctacccgcaagattatccttcacatcagaattgcgagtggatcgtgtatgcccctgaacccaaccagaaaattgtgttgaactttaatcctcatttcgaaatcgagaagcacgactgtaaatacgacttcatcgagatccgggatggcgactctgagagcgcggaccttctggggaaacattgcggaaacatcgctccaccgacaatcatctccagtggctcaatgctgtatatcaggtttacgagcgactacgcacgccagggtgccggattctccctgagatatgaaatcttcaagacaggaagcgaggactgttcaaagaactttaccagcccgaatgggacgattgagtcacccggattccccgagaagtaccctcataatctcgattgcacgttcaccatactggccaaacctaagatggagattatccttcagttcctgatctttgacctcgagcacgaccccctgcaggttggagagggcgattgcaaatacgattggttagacatctgggacggaattccacatgtgggcccactcattgggaaatactgcggaaccaagacaccctcggagctgaggagttccaccggcatcttgtcgctgaccttccacacagatatggccgtggccaaagacggtttttctgcaaggtactacctcgtgcaccaggagccactggagaacttccagtgcaacgtaccgctgggtatggagagtggcaggatcgcaaacgaacagatatcggcctccagcacctattcagacggccgatggacaccacaacaatctagattgcatggggacgataacggatggacacccaatctagatagcaacaaggagtatctgcaagtggatctcagattcttaacaatgcttacagccatagcaacacagggagccatctctcgggagactcaaaacggttattacgtgaagtcgtacaaactggaggtttccacaaatggagaggattggatggtgtatcggcacggcaagaatcacaaggtcttccaggccaataatgatgcgaccgaggtggtgcttaacaagctccacgcaccgcttcttacgagattcgtccggatcagaccccagacttggcacagcggaatcgcattgagattggaactcttcggctgccgcgtgacggacgctccatgcagcaacatgcttgggatgttgtcaggattgatcgctgattcgcagatcagcgcgagttccactcaagagtacctatggagccccagcgcagctcgccttgtttcttcacgctccggctggttcccaaggataccccaagcccagccaggagaagaatggttgcaggttgatctcgggactcctaagacagtaaagggcgtgattatccaaggcgctcgggggggcgattccatcactgccgttgaagcccgagcatttgtgcgaaagtttaaggtgagctacagccttaacggtaaggactgggagtatatacaagacccacgcacacaacaacccaagctcttcgagggaaacatgcactacgacacgccagacatcagaaggtttgaccccatacccgcccaatacgtgagagtttacccagagagatggagccccgccggcattgggatgaggctcgaggtactgggttgtgactggaccgacagtaagcctacagtggagactctcggcccaaccgtgaagtctgaggagacaaccactccgtatcccaccgaggaagaggccaccgagtgcggggagaactgttcgttcgaggatgataaggatctgcagctcccatcaggattcaattgtaatttcgacttcctagaagaaccatgtggctggatgtacgatcatgctaagtggctgcgtacgacttgggccagttcctctagcccaaacgacaggacattccctgacgacaggaactttttgcggctgcagtcagatagccagcgtgaggggcagtacgctaggctgatttctccaccagtccaccttccgagatcccctgtctgtatggagttccagtaccaggcgacaggaggcagaggcgtcgcgctgcaggtggttagggaagcgtctcaagagagcaagttgctgtgggttataagggaagatcagggcggggagtggaagcacggaagaattatcctaccaagctacgacatggagtaccagatcgtgttcgaaggcgtgatcggaaagggacggtcaggagaaattgccatcgacgatattcgcatatcaacagacgtgccgctcgagaattgcatgggccccaaagcttgcattgccgacgaatacgaggtcgactggagtaacagcagtagcgctacatccggtagcggagcccctagcacagacaaagaaaaatcatggctctacacactcgaccctatactcattaccatcatcgctatgtctagcctgggcgtgctcctgggggcaacctgcgccggattgctgctgtattgtacttgtagctattccggtcttagctctcgaagctgcacaacattagaaaattacaatttcgaattatacgacgggctcaaacacaaggtaaagatgaaccatcagaagtgctgcagtgaggcatag

SEQ ID NO: 16330 - DNA, 462 bp, Artificial Sequence
  Description of Artificial Sequence: Synthetic coding sequence
atgaccaagattaaagccgatccagacggacctgaggcccaagccgaagcctgctctggtgagcgtacatatcaggagctgttggtgaatcagaaccctattgcccagccattggctagccggcgcctgaccagaaagctctataaatgtattaagaaggccgttaaacagaagcagatccgtcgcggggtgaaagaagtacagaaattcgtcaacaagggagagaaaggcataatggtcttggccggcgatactctccccatagaagtgtactgtcatctcccagttatgtgcgaggaccgcaacttgccttacgtgtacataccctctaagaccgatctaggggcagcagccgggtcaaaacgccctacctgcgtgattatggttaagcctcacgaagaataccaggaggcctatgatgagtgcctggaagaagtgcagagccttcccctaccactttag

SEQ ID NO: 16331 - DNA, 273 bp, Artificial Sequence
  Description of Artificial Sequence: Synthetic coding sequence
atgaccaagataaaagccgaccctgacggccccgaggcacaggccgaagcctgcagcggcgaaaggacgtatcaggagctgctggtgaatcagaatccaatcgcccagcccctggccagtagacgactcacgaggaaactatacaaatgcataaaaaaggccgtcaaacagaaacaaattaggcgtggcgtgaaggaagtccagaaattcgtgaataaaggtgagaagggcacttgggtgcaacctcaagctcctagcgcccctcctgtttag

SEQ ID NO: 16332 - DNA, 2265 bp, Artificial Sequence
  Description of Artificial Sequence: Synthetic coding sequence
atgtggaaacttctgcccgccgccggaccggccggcggcgagccttaccgactgctgacaggggtcgagtatgtcgtgggtcgaaaaaattgtgctatactgattgagaatgatcaatcgatatctagaaatcacgctgtcctcacagctaacttctcagtcactaacctgtcgcagacagacgagatcccagtgcttacccttaaggataatagtaagtacggcacattcgtgaatgaggagaagatgcagaatggcttttcgcgcacgctgaagagcggcgacggcattacattcggagtctttgggagtaaattcagaatcgagtacgaacctctggtggcttgttcatcctgcttggatgtgtcagggaagacagccctcaaccaggccattcttcaactcggtggctttaccgttaataattggactgaagagtgtacgcatctggtgatggtgtcggttaaggtaacgattaaaactatttgcgccttgatatgcggcaggcctatcgttaagccagaatatttcaccgagtttctcaaggcggttgagagtaagaaacaaccgcctcagatcgaatcattctacccccctcttgacgagccttcgattggctctaagaacgtcgacctgtcaggaaggcaggaacgcaagcagatctttaagggcaagacttttatatttctgaacgcgaaacagcataaaaagctgtctagtgctgtcgtctttggtggcggggaggcccgattaataactgaggagaacgaagaggagcacaacttctttctggcacccggcacctgcgtggtggacactggaataactaatagccaaactttaatcccagactgtcagaagaaatggatccagtccatcatggatatgctgcagagacagggactgcgccctatccctgaggccgaaatcgggttggctgtgattttcatgactactaagaactattgtgacccccagggccaccctagcacagggctgaagaccacaaccccaggacctagcctgtctcagggggtctcagttgacgagaaactgatgccctccgctcctgtgaatactactacttatgtcgccgacaccgagtctgagcaagctgatacttgggatctgagcgagcgtcctaaggagattaaggtgtcaaagatggaacagaagttccggatgctgagccaggatgctccaacggttaaggaatcctgcaagaccagctccaataataacagtatggttagtaatactttagccaaaatgaggataccaaattatcagctctctccaaccaagttaccatcaatcaacaagagcaaggacagagccagccagcaacagcagaccaattcgattcggaactactttcagccatccacaaagaaaagagaaagagatgaagagaatcaggaaatgtcaagctgtaagtcagctcgcattgaaacctcatgctccctgttagaacagacccagccagcgacaccttccctgtggaagaacaaggaacagcatctaagcgaaaatgagcctgtcgacactaactcagataataacctttttactgataccgacctaaaatctattgtcaaaaattcagcttctaagagtcatgctgccgaaaagctcagaagcaataagaagcgggagatggatgatgtggctatcgaagatgaggtgctggaacaacttttcaaggacacaaaacctgagctcgaaatcgacgtgaaggtgcagaaacaagaggaagacgtcaatgtaagaaaacgccctcggatggatatagaaactaatgacacgttctcggatgaggccgttccagaaagttccaagatttcccaggagaatgaaatagggaaaaagcgagagttgaaagaggacagcctatggagcgccaaagaaatctccaacaatgacaaactgcaggacgactcggagatgctaccgaaaaagctcctgttgactgaatttaggtctctggtaataaagaatagcactagtaggaatccctctggtataaatgacgactacggacagctgaagaattttaaaaagtttaagaaagtgacatacccgggagccggcaaactgccccatatcattggagggagcgacttaatcgcccaccatgctagaaaaaatacagagctcgaagagtggctccggcaggagatggaggtgcagaaccaacacgcgaaagaggaatccctggccgacgacctttttagatacaacccttacttgaagagaagaagatag

SEQ ID NO: 16333 - DNA, 1437 bp, Artificial Sequence
  Description of Artificial Sequence: Synthetic coding sequence
atgtggaaattgctgcctgccgccgggccggcagggggagagccctatcgactcctgacaggggtcgagtatgtcgtgggccgaaagaactgtgctatccttattgaaaatgatcagtccatctcacggaaccacgccgttctgaccgccaatttctcggtgactaacctgagtcaaacggacgagatcccagtcctgactctgaaggacaactcaaagtatgggacttttgtgaatgaggaaaagatgcagaatggtttctcacgcaccctcaagagcggggacggcattacattcggcgtgttcggctctaaattccgaatagaatacgaacccctggtagcctgcagttcctgtttggatgtgtctggcaagacggccttaaatcaggcaatactccaactgggaggttttaccgtgaataattggaccgaggaatgtactcacctggtcatggtttctgtgaaggtcacaatcaaaactatttgtgctcttatctgtggccgaccaattgttaaaccagaatatttcacagagttcctgaaggcggtcgagtccaaaaagcaaccaccacagatcgaatcattctacccaccacttgacgagccaagcattggtagcaagaacgtcgacctttccggacgacaggaaagaaaacagattttcaaagggaagactttcatattcttgaatgcaaagcagcacaagaaactgtcctccgctgtcgtctttggaggaggtgaggcaagacttattaccgaggagaacgaagaggagcacaacttttttctggcacctgggacatgcgtggttgacactggcatcacgaactctcagaccttgattcccgactgtcagaaaaaatggatacagagtataatggatatgctccagaggcaggggttgcggcctatcccagaagccgagatcgggctggccgtgatatttatgactacaaagaactattgtgatcctcaggggcatcctagcacaggccttaagactactacaccgggtccctccctcagccagggtgtatctgtggacgagaagctgatgccttcagcacctgtcaacaccaccacctatgtggccgacactgaatcagagcaagccgacacgtgggacctatctgagcggccaaaggaaattaaggtgtcaaagatggagcagaagtttcgcatgctctcccaggacgcccccacagtgaaagagtcctgtaaaacttctagcaacaataactcaatggtgtcaaataccctggctaaaatgagaatccccaattatcagcttagccccaccaaacttccatctatcaacaaatccaaagatagagcatctcaacaacaacagaccaacagtattcggaattactttcaaccatccaccaaaaagagagagcggctacacctcaagaaaaagaagaagaaaaaatag

SEQ ID NO: 16334 - DNA, 333 bp, Artificial Sequence
  Description of Artificial Sequence: Synthetic coding sequence
atgggtgctagcggatcaaaagcaagaggactgtggcccttcgcgagtgctgcaggcggtggaggtagcgaggcagccggtgccgagcaagcactggttcgccccaggggtagagccgttcctcctttcgtcttcactcgcagggggtcaatgttctatgatgaagatggggatttggcacatgagttctatgaggaaacaatcgttacgaaaaacgggcaaaaacgggctaaactgagacgtgtccacaagaatctcattccacaaggaatcgttaagctcgaccacccccgcatccacgtcgattttcctgtgatcttgtacgaggtgtag

SEQ ID NO: 16335 - DNA, 1206 bp, Artificial Sequence
  Description of Artificial Sequence: Synthetic coding sequence
atgtggtctggggggtctggcaaggcgcgcggatgggaagcggccgctgggggccggtcttctccaggacgtctgagccgccgtcgcatcatgagtatgtcgcctaagcatactacacccttttctgtgtcggatatcttgtcccccttagaggagagttataagaaagtcggcatggaggggggaggattgggcgcaccattagctgcatacaggcaggggcaggccgccccccctaccgccgccatgcagcagcacgccgtgggtcatcacggcgcagtgaccgccgcctatcacatgaccgccgctggcgtaccacagctcagtcattccgctgtgggggggtactgtaatggcaacctcggaaatatgtcggagctgccaccataccaggataccatgcggaacagcgcatcaggacctggctggtacggcgctaatccagaccctaggttccctgctatttccagatttatgggcccggcatccggcatgaatatgtccggtatgggtggactgggcagcctcggcgatgtgagcaaaaacatggctccgttgccatcagccccccgacgaaagcggcgggttctgttctcacaggcccaggtctacgagctcgaaaggcgattcaagcaacagaagtatttgtccgccccagaaagagaacacctagcctccatgattcatctcactcctactcaagtgaagatttggtttcagaatcaccgttacaagatgaagagacaagctaaggacaaagccgctcagcagcagctgcaacaggattccgggggtggcgggggcgggggcggcacgggatgtcctcagcagcaacaagctcagcagcagtctcccagacgcgtcgccgtgcctgtgctggtaaaagatgggaaaccctgtcaggccggcgcccctgctccaggagccgcaagtttgcaaggtcatgcccagcagcaagcccaacatcaggcgcaggcagctcaggcagcagcagctgccatctccgtcggttccggaggggccggtctcggtgctcacccagggcatcagcccgggagtgctgggcaatcccccgatttggcccatcatgccgcttctcccgcagcccttcagggacaggtatcttccctgagccatctcaactcttccggtagcgactacggaaccatgagttgcagtacactcctttatggccggacatggtag

SEQ ID NO: 16336 - DNA, 1116 bp, Artificial Sequence
  Description of Artificial Sequence: Synthetic coding sequence
atgtcaatgtctccaaagcacactactccattcagtgtcagcgacatcctctctcccttggaagagtcctacaaaaaagtggggatggagggtggtggactcggagcccccttagctgcctatagacagggacaggcggcacccccaaccgcggcgatgcagcagcatgccgtcggccatcatggcgccgtcacagccgcctaccatatgactgccgccggcgtcccacagctctcacatagcgcagtaggaggctactgcaatggcaacctggggaatatgtcagagctccccccttatcaggatacaatgaggaacagcgcctcagggcccgggtggtacggcgctaatcccgatccccggtttccggcaatcagcagattcatgggccctgcctcaggcatgaacatgagcggcatggggggactcgggtcgctcggagacgtgagtaagaatatggccccactgcctagcgcacctcggagaaagaggcgtgtgctgttcagccaggcgcaggtctacgaacttgagcggcggttcaaacagcagaaatacctcagtgcacctgaacgtgaacacttggcttctatgattcacctgacacccacacaggtcaaaatatggttccagaaccacagatacaagatgaagaggcaggccaaggacaaggctgctcagcagcaattacagcaggacagtggcggtggcggtgggggaggtggtacaggctgtccacagcagcagcaggctcagcagcaatccccgaggagagtggctgttcctgtgcttgtcaaggatggcaagccatgtcaagctggggcacccgcaccaggagcagcttctctgcaaggccatgcccagcagcaggcccaacaccaggcccaagcagctcaggcggcagctgccgctatatcagtgggctccggtggcgcaggccttggcgcacaccccggccaccagcctggctccgcaggccagtcacccgacctcgcacaccacgccgccagtcccgcagcccttcaaggccaagtgagcagcctgtcgcacctaaattcctcagggagcgactacgggacaatgtcctgctccacgctgttatatggacgtacatggtag

SEQ ID NO: 16337 - DNA, 1116 bp, Artificial Sequence
  Description of Artificial Sequence: Synthetic coding sequence
atgtccatgtcccccaagcacacaacaccgttctctgtctctgacattttatcccccctggaggagagttataaaaaggtgggaatggaaggtggaggactgggcgcccctctagcggcgtatcgtcagggccaagccgcccctcctacagctgcaatgcagcagcacgctgtaggacaccatggcgcggttacggccgcctatcacatgacggcagctggcgtgccacagttgtcccactcggctgtcggaggctactgtaatggaaacctgggaaatatgtccgaactgcccccctaccaggacacaatgcgaaactccgcttccggaccaggttggtacggcgccaaccctgatcctaggttcccagctatatcccgatttatgggacccgctagtgggatgaacatgtccggaatgggaggactaggcagcctgggagatgtttctaagaatatggcacctttgccatcagcacctagacgcaagcggcgtgtgctgtttagccaggcgcaggtatacgaacttgaaagacggtttaagcaacagaaatacctgtctgcccccgagagagagcacctggcctccatgatacatctaacaccaacccaggtgaaaatatggttccagaatcatcggtataagatgaaaaggcaggccaaagataaggccgctcaacaacagttgcagcaggactctggtggaggtgggggtggcggtggtacgggctgcccacagcaacagcaggcacagcagcagtcacccaggcgagtggcagtccctgtgctagtgaaggacggtaaaccttgccaagccggagctcccgcccccggagccgcgtcattgcaggggcacgctcagcagcaggcccagcaccaggcccaggccgcgcaggctgcagcagcagccattagtgtgggctccgggggcgccggcctgggggcacaccctggacaccagccggggagtgccggtcagtcaccggacttggcccaccacgctgccagccctgcagctcttcaggggcaggtaagcagcttgagccacctgaactctagtgggagcgactatggtaccatgagttgttctactttactttatggacggacgtggtag

SEQ ID NO: 16338 - DNA, 1116 bp, Artificial Sequence
  Description of Artificial Sequence: Synthetic coding sequence
atgagtatgtcccctaagcacaccacaccattctctgtctccgacatcctatctcccctcgaggagagctacaaaaaggttggcatggagggcgggggacttggcgccccactcgctgcttatcggcagggtcaggctgccccacctactgccgccatgcagcagcatgccgtgggccatcatggtgccgtcaccgccgcttatcacatgaccgctgctggcgtacctcagctttcgcactcagcggtaggcggttattgcaacggcaacctcgggaatatgagcgagctgcctccctaccaggacacaatgcgtaacagcgcctcagggcccggttggtatggggctaaccccgatcccagatttccagccattagtcgatttatgggccccgcctccggaatgaatatgagtggaatgggcggcctgggatcgctaggggacgtgtccaagaacatggcacctctgcccagcgcacccagacggaaaaggagagtgctgttcagccaagcccaggtttatgagctggaaagaaggttcaaacagcagaagtatttgtcggcaccagagcgagagcatctcgcctctatgatccacctaactccaactcaagttaaaatttggttccagaatcaccgctacaaaatgaagcggcaagccaaagataaagctgctcaacaacagctccaacaggactcaggagggggaggaggcggcgggggcactgggtgtccccagcaacaacaagctcaacagcaatccccgcgcagagtggcggtaccagtgttggtgaaggatggcaagccctgtcaggctggtgcccccgctcctggcgcggccagtttacagggccatgcgcaacagcaggctcaacaccaggctcaagctgcacaggccgccgccgccgcaatctcagttgggtctggaggtgctggtctcggagctcaccctgggcatcaacctggctcagccggccagagtcctgatcttgcgcaccacgccgctagccccgccgcactccagggacaggtgtcttcactgtcacatttgaatagttccgggtccgattacggcaccatgtcatgcagcacgctgctgtacggaaggacctggtag

SEQ ID NO: 16339 - DNA, 105 bp, Artificial Sequence
  Description of Artificial Sequence: Synthetic coding sequence
atgtggtccggcgggtccgggaaagcaagggggtgggaagctgccgccggtgggcgaagctcccctggaaggctctcggcctatgcaccacctcttgtggcgtag

SEQ ID NO: 16340 - DNA, 573 bp, Artificial Sequence
  Description of Artificial Sequence: Synthetic coding sequence
atgttacgcgtccccgaaccgcgtcctggtgaggccaaggccgagggtgcagccccacccaccccctcgaagccactgacctcttttctgatccaggacatcctgagagacggagcccccgaggaagctgaaactctggcggaaactgagcctgagcgacatctgggaagctacctgctcgactccgaaaatacatccggtgctttgccgcggctgccacaaacaccgaaacaaccccaaaaacggagcagggccgccttttcccatacacaggtgatagaactggaaaggaagttttcccaccagaagtatctgtctgcgcctgaaagggcgcatctggccaaaaacctgaaactgactgagactcaggtcaagatctggttccaaaataggaggtacaaaaccaagaggaaacagttgagtagtgaactgggagacctggagaagcatagctcgcttcccgccctcaaggaagaagcatttagccgagccagtctggtgtccgtgtataactcttacccgtactacccctacttatactgtgtaggcagctggtccccggccttttggtag

SEQ ID NO: 16341 - DNA, 705 bp, Artificial Sequence
  Description of Artificial Sequence: Synthetic coding sequence
atgttgcgcgtccccgagcctaggcccggggaagcaaaagccgaaggcgcagctccgcccacaccatccaagccactaacatccttcctaattcaagacattctacgcgacggcgcgcagcggcaaggaggtcgcacatcctctcagaggcaaagagacccagaaccagagcctgagcccgaaccagaaggtggtcggtctcgggctggcgctcaaaacgatcaactgtctacgggccctagggccgcccccgaagaggctgagacgctcgccgagactgaacccgaaagacacctgggctcctacctgctggattctgaaaataccagcggagccttgcctcgtcttccccagacacctaagcaaccccaaaaacggtcccgggcagcattcagccacacacaggtcatcgagctcgaaagaaagttcagtcatcaaaagtatctctctgcaccagagagggcccatctggcgaaaaacctgaaattgactgagactcaggttaagatttggttccagaatcgtaggtacaagaccaaacgcaaacagctcagcagtgaacttggggacctggaaaagcactcctcccttcctgccctcaaggaggaagccttcagcagggcgtcactggtctctgtgtacaatagctatccatactacccatatctgtattgtgtgggctcctggtctcccgccttctggtag

SEQ ID NO: 16342 - DNA, 480 bp, Artificial Sequence
  Description of Artificial Sequence: Synthetic coding sequence
atgctccgggttccagaaccccgacccggcgaagccgagactcttgccgaaactgaaccagagagacatttagggagctatcttctggattctgagaacactagcggggcccttccccgtcttccacagaccccaaagcagccccagaagaggtctagggccgccttcagccacacacaggtgatagagctggaaaggaagttctctcaccagaaatacttatcggcaccagagcgggcccatttggccaagaatctgaaattgaccgaaacacaggttaaaatctggtttcagaaccggcgatacaagacgaagcgcaagcagttatctagcgagctcggcgatctggagaaacactcatccttgcccgccctgaaagaagaggcctttagccgtgcatccctcgtgtcagtgtacaactcatacccctactatccttacctgtactgtgtgggttcgtggtcaccagcattctggtag

SEQ ID NO: 16343 - DNA, 4212 bp, Artificial Sequence
  Description of Artificial Sequence: Synthetic coding sequence
atggctacacagcagaaagccagcgatgaaagaatttcgcagtttgaccataaccttctgccggagctctccgccctccttggcctggacgcagtgcaactggcaaaggagctcgaggaagaggaacagaaagagagggctaaaatgcagaaagggtataacagtcagatgcggagcgaggctaagaggcttaagacctttgtcacatatgaaccatactcttcctggatcccccaagagatggcagccgcagggttttactttactggcgtgaaatcggggatacagtgtttctgctgttctttgatactctttggggcaggactcaccagacttcccatagaagaccataagaggtttcaccctgattgtggatttttgcttaacaaggatgtaggcaacattgccaagtacgacatccgggtgaaaaacttgaagagtaggttgagaggaggcaaaatgcgttatcaggaagaggaggcccgtttggcatcgttccgcaactggcctttctatgtccaggggatttcaccctgcgtgctcagcgaagctggttttgtgttcacaggaaagcaggatactgtgcagtgcttttcatgtggcggctgcttggggaattgggaagagggagatgatccatggaaagaacacgccaagtggtttccaaagtgtgaattcctgaggtctaagaaatcctcggaggagatcacacaatatatccagtcctacaaaggattcgtggacatcacgggggagcactttgtgaattcttgggtgcaacgtgagctgcctatggctagcgcttattgcaacgactccatctttgcctacgaagaactgaggctggactcattcaaagattggcccagagagtctgccgtcggcgtagccgcattggcgaaggcgggcttattttacaccgggatcaaagacatcgtgcaatgcttctcctgcggaggatgcctggaaaaatggcaggaaggggacgacccactcgatgatcacactaggtgcttcccaaattgcccctttttgcaaaacatgaaaagcagtgcagaagtgaccccggacttgcagtcacgaggcgaactatgcgagttgctggaaaccacaagcgaaagtaatctcgaggactccattgccgtgggccctattgttcctgagatggcccagggcgaggcccagtggttccaggaagctaaaaatctcaatgagcagctacgggccgcatacacctcagcttcctttcggcatatgtccttgcttgacatttcgtccgacctggccactgaccatctattagggtgtgacctaagcatcgccagcaagcacatctcaaagcccgtccaggagcccctggtgctgccggaagtcttcgggaatctaaacagcgtgatgtgtgtggagggtgaagcgggaagcggaaagacagttttactgaagaagattgcctttttgtgggcgtcaggttgctgtccactgcttaatcgattccaactggtgttctacctgtcactgtcctctaccaggccagatgaagggcttgccagcatcatctgcgatcaactgcttgaaaaggaaggctcagtgactgagatgtgcgttaggaacatcatccagcaactgaagaatcaagttctcttcctgcttgacgactataaagagatatgctccattcctcaggttatcgggaaattaattcaaaagaatcacctctcaaggacctgtctgctcatcgccgttcgtactaacagggcgcgagacatccgcagatacctagagacaatactcgaaattaaggccttcccattttacaataccgtttgcattctccgaaagcttttttctcataacatgacaagacttcgcaagtttatggtgtattttggcaaaaaccagtctctgcagaagatccagaagactcccttgtttgtcgccgccatatgcgcacattggttccagtaccccttcgaccccagcttcgacgatgtcgccgtgttcaaaagctatatggagagactgtccttgcgcaataaggccactgccgaaattctgaaggcaacagttagctcttgcggagaattggctcttaagggattcttcagctgttgtttcgagttcaacgatgatgacctcgcagaggccggagtggacgaggatgaggacttaactatgtgtctgatgtcgaagtttacagctcaacgactgcggccattctataggttcctttctcccgcctttcaggaatttctggcaggcatgcgtcttattgagctccttgacagcgatcggcaggagcaccaagacctggggctgtatcatctcaagcagattaacagccctatgatgacggtgtccgcctacaacaactttctgaactacgtaagctcgctgcctagcacgaaagccggccccaaaatagtgtctcacctgctgcacttagttgacaataaagaatcattggaaaacatttccgagaacgacgattatctgaaacaccaacctgagatctctctgcagatgcagctgttacgcggattatggcaaatctgccctcaggcgtatttctctatggtgagcgaacacctgctcgtgcttgctctaaagacggcatatcaatccaacactgtggctgcatgctctccatttgtgcttcaatttctccagggccggaccctgaccttgggcgccctgaacttacagtatttttttgaccatcccgagtccctctctctactgagatcgatccacttccctattcgggggaacaaaacatccccgcgggctcacttttctgtgctggaaacttgcttcgacaagagccaggtgccgacaatagaccaggactacgctagcgctttcgaaccaatgaatgagtgggagcgtaacctggcggagaaggaggacaacgtcaaatcatacatggatatgcagcgcagagctagccccgacctaagcaccgggtattggaaactcagccccaagcagtacaaaattccttgcctggaagtagacgtaaacgacattgacgtcgtggggcaggatatgttggaaattctgatgactgtgttctcagcgagccagcgaattgaattgcatctcaaccacagtaggggattcatcgagtctattcgccccgcgcttgaactctcaaaagcatctgtaacaaaatgcagtatctccaaattggagttatctgctgctgaacaggagctgctgctgacccttccttctctggagagcctggaagtgtccggaaccattcagagccaggaccagatcttccccaatctcgataagttcctgtgtctgaaggaactgagcgtcgatttggaaggcaacatcaacgtgtttagcgtcatccctgaggagtttcccaactttcaccacatggaaaagttgctgatccagatatctgcagaatacgatccttccaaactcgttaaactcattcaaaactcgccgaacctgcatgtgttccacctgaagtgcaacttcttcagtgattttggcagccttatgacaatgctcgtgagctgtaagaagcttactgagattaaattctctgactcattctttcaggctgttccgtttgtcgccagcctgccaaactttataagcctgaagattttaaacctggagggacagcagttccctgatgaggaaacgtcagagaagtttgcgtatatcctcggaagtctgagcaacctggaggagctgatcctgccaacaggggacggcatataccgtgtggccaaattgatcatccagcaatgtcagcagctacactgtctcagggtgctgagcttttttaagaccctgaatgacgatagtgtcgttgagatcgctaaggttgccatctccggaggctttcagaaactggagaacctgaaactcagcatcaaccacaaaattactgaggaagggtatcggaacttctttcaagcactcgacaacatgccgaacttgcaggagctggacatttcccggcattttaccgagtgcatcaaagcccaggccaccacagtgaaatccctgtctcaatgtgtcctcaggttaccacgtctgattaggctgaacatgttatcttggctgctagacgccgacgatattgccctcctgaacgttatgaaagagagacatccccagtccaaatacctgactattcttcagaagtggattcttcccttctccccaattatccagaagtag

SEQ ID NO: 16344 - DNA, 3726 bp, Artificial Sequence
  Description of Artificial Sequence: Synthetic coding sequence
atgcccctgcacattggggatttcgtgtgggatagtaaggtacactcgcttcaaagtagcctgaacatctttagcctgctgcccactaagggtagaaccgaacacctctttttcagtcatatcctcagttttcactggccagctttctcaagcattaggctggaactatggattaatctcaggtgtgagtttcttcgttcaaaaaaatcgtctgaggaaattacccagtatatacagtcatataagggcttcgtcgacatcactggggaacactttgtgaattcatgggtccagcgcgaactgcccatggcaagcgcttactgtaacgattcgatcttcgcttatgaagagctaaggctggatagcttcaaagactggccccgtgagagtgcggtcggggtagccgccctggcaaaagccgggctgttttacaccggtattaaggacatcgtgcaatgcttttcgtgtggaggatgtctcgagaaatggcaggaaggagatgaccccctagacgatcatacgaggtgcttccctaactgcccttttttacagaatatgaaatcttccgctgaggtgacgcccgatctgcagtcaaggggagagctgtgcgagctcctcgagaccacatcagagagtaacctcgaggactccattgctgtaggccccattgtgcctgaaatggcccagggagaggcccagtggttccaggaggcgaagaaccttaacgaacaactccgggctgcatacacttccgcgagctttcgacatatgtccctgcttgacatatccagcgacctcgccacagatcacctccttggctgcgacttgtccatcgcctccaaacatatctctaaacccgtgcaagaacccctggtgctccctgaagtgtttgggaaccttaactctgtgatgtgtgtagaaggtgaagccggtagcggcaagacagtgttgctgaagaaaatcgcatttctgtgggcctctggatgctgccccttgctcaataggttccagcttgtgttttacctctcgttgagttccactcgccccgatgaggggttggctagcattatctgcgatcaattactggagaaggaaggaagcgtgacagagatgtgtgtgcgtaacatcatacaacaactcaagaaccaagttctgttccttctcgatgactacaaagagatttgctccatcccccaggtaattggaaagctgatccagaagaaccacctgtcccgcacatgcctcctgatagcagtgcgcaccaatcgggcaagggatattaggcggtacctcgagaccatactcgagattaaagcctttcctttctacaacacggtatgcatcctgcggaagttattcagtcataacatgacaagactcagaaaattcatggtctacttcggaaaaaaccagtccttgcagaagatacagaagactccactattcgtagccgctatttgtgctcactggtttcagtatcccttcgacccgagtttcgacgatgtggccgtgttcaaaagctatatggagagactgtccctgcgaaataaggccacggccgaaatcctcaaagcaactgtgagctcctgcggggaactggcgctgaaagggtttttctcatgttgtttcgagtttaacgatgacgacttagccgaggccggcgtcgacgaggacgaggacctgaccatgtgtctcatgagtaagtttaccgctcagaggcttaggcctttctaccgattcctctcaccagctttccaggaattcttagctggaatgcgcctgatcgaactgctcgactcggaccggcaagagcaccaagacctgggtctgtaccacctgaagcaaattaacagcccaatgatgaccgtgagcgcatataacaactttctcaattacgtaagttccctccctagtacaaaggcaggccccaagattgtgtctcatctgctacacctggtcgacaacaaagagagcctagaaaatatatccgaaaacgacgattacctgaaacatcagcctgaaattagcctgcagatgcagttgttaaggggcctgtggcaaatctgtcctcaggcgtacttcagtatggttagcgagcaccttttggtcctcgccttgaagaccgcttaccagtctaatactgttgcggcttgcagcccattcgttctccagttcctccaggggcgaacattaactctgggcgccttaaatctccagtacttctttgatcacccagagtccctgtcgctgctcagatccattcacttccctatcagaggtaataagaccagcccgcgcgcccacttttcagtgctggaaacctgcttcgacaagtcacaggtcccaactatcgaccaggactacgcgtcagcgtttgaaccaatgaatgaatgggagcgcaatcttgccgaaaaggaagacaacgtgaaaagctatatggacatgcagcggcgcgcatctcccgacctcagcacaggatattggaagctgtcacccaagcaatacaagattccctgtttggaagtcgatgtcaatgacatcgacgtggttggtcaggacatgttagaaatactcatgacagtcttctctgcaagccagcgcatcgagttacatttgaatcactccagggggttcattgaaagcattcgccccgcactggagttatccaaggcatctgtgaccaagtgttcaatctccaaacttgaattatctgccgccgaacaagagctgctccttaccctgccttccctcgaatctctggaggtatctggaaccatccagtcccaagaccagatcttccctaatctcgataagttcctgtgcctgaaggagctgtccgtggatcttgagggcaacattaacgtatttagcgtcattccagaggagttcccgaactttcaccacatggagaagttactgatccaaatcagcgccgagtacgacccctcgaagctggtaaagttaatccaaaattcacctaacctgcacgtgttccatctcaagtgtaatttcttttcagattttggcagtctgatgaccatgctagtgtcttgcaagaaactgactgagattaagttcagcgactcctttttccaggcagtcccttttgtggcctcgctgccaaacttcataagcttaaagatactaaatctcgaggggcagcagttccctgacgaggagacttcagaaaagttcgcatatattttgggctctctgtcaaatttagaagaactgatactgccaacaggagatgggatttatcgggtggcaaaactgatcattcagcagtgccaacagctgcattgtcttagagtactttccttcttcaagactctgaatgacgattcagttgttgagattgcaaaggtggcgatttcaggaggtttccagaaacttgagaacctgaaattgtcgattaatcacaaaatcaccgaggaaggttatcggaatttctttcaggccctcgacaacatgccaaatttacaggagctggacataagtagacacttcacagaatgcataaaggctcaggctaccactgtgaagtccctctcccagtgcgtgcttagactgcctcgcctgatccggttgaacatgctttcctggctccttgacgccgacgacatcgcgttgctgaacgttatgaaggagcgccaccctcagtcaaagtacctgactatcttacaaaagtggatactgcccttcagccccattattcagaagtag

SEQ ID NO: 16345 - DNA, 4212 bp, Artificial Sequence
  Description of Artificial Sequence: Synthetic coding sequence
atggccactcaacaaaaggcgtccgatgagcgcattagtcaatttgatcacaacctactgcctgagctgagcgccctgctcgggctagacgctgtccagttggccaaagaactggaagaggaggaacaaaaagagagagctaagatgcagaaggggtacaactcccagatgaggtccgaggccaaaagactcaaaacctttgtcacgtatgaaccctatagcagctggatcccccaggaaatggctgcggcaggattctacttcaccggggtcaagtctggcatccagtgcttttgttgcagcctgatcctattcggagcaggactcacaagactaccgatcgaagatcacaaaagatttcatcccgactgtgggttcctgctgaacaaggatgtcgggaatatcgccaaatacgacattcgcgtgaaaaatctgaaatcaagactgcggggaggaaaaatgcgttaccaagaggaggaagctcgtttagcgtctttcaggaactggccgttttacgtccaggggattagcccatgcgtactttctgaggccggctttgtgtttaccggaaaacaggatacagttcagtgtttcagctgcggcggctgtctcgggaactgggaggaaggggatgatccttggaaagagcacgccaagtggttccctaaatgtgagtttctccgatctaagaaatcaagtgaagaaattacccagtatattcagtcctataaaggcttcgtggacataactggcgagcattttgtcaattcatgggtccagagagagttacctatggcgagcgcgtattgtaatgacagtattttcgcctatgaggagctacgtctagacagttttaaggattggccacgcgagtctgcggtaggagtagccgccctggctaaagcaggcctgttctacaccgggattaaggatattgtgcaatgtttttcttgcggtggctgcctggagaagtggcaggaaggggacgaccctctggatgaccatacccggtgtttcccaaattgcccttttctgcagaacatgaaatcatccgcagaagttacccccgacttgcagagtcgcggagagctgtgtgagttgcttgaaacaacctcagaatccaaccttgaagacagcattgccgtcggtcctattgtccctgagatggctcaaggagaggcccagtggttccaggaggcgaagaatcttaatgagcagctgagagctgcatataccagtgccagcttccgtcacatgtccctgctcgacatctctagcgacttagccacagatcacttactgggttgcgacctttcaattgcatccaagcatatcagtaaaccagtacaggagccccttgtcttgccagaggtattcggcaacctcaactcagtgatgtgtgtggaaggcgaggcaggctcgggtaagactgtcttgttgaagaaaatcgcttttttatgggcctccgggtgttgtcccctgctgaatcgcttccagttagtgttctacctttccctgtcttctaccagacccgatgagggcttagcctctatcatttgcgatcagctcctggagaaagaaggaagtgtgactgaaatgtgtgtgagaaacataattcagcagctgaagaaccaggtgctgttcctactggatgactacaaggagatctgctccattccccaggtcattgggaaactgatccaaaaaaaccacctttcacgcacctgcctcctgatcgcagtgcgaacaaaccgcgctagggacattaggaggtatctcgaaacaattctggagattaaggcgttccccttctacaacacagtgtgtatcttgcgcaaattgttttcgcataatatgacccgtctgcgcaaattcatggtgtacttcggtaagaaccaaagcctgcagaaaatccagaagacacccttgtttgttgcggcaatatgcgcacactggttccagtaccctttcgatccttcgtttgacgatgtggccgtcttcaagagctacatggagcgccttagccttcgcaataaggcgaccgctgaaatactcaaagccaccgtctcttcatgcggcgagctggcgctaaagggcttcttttcttgttgcttcgagttcaatgacgacgatctggccgaggcaggggtggatgaggacgaggacctcaccatgtgccttatgagcaaattcactgcccaaagactgagacctttttaccgcttcttgtctcccgccttccaggagtttctggctggaatgcgactgatcgaactattagatagcgataggcaggaacaccaggatttggggctgtatcacctaaaacagattaattccccaatgatgacagtttccgcatacaataactttctaaactatgtatcaagcctaccttccacaaaggccggcccgaagattgtatcccatttgctccatctcgtggataataaggagtccttggaaaacatcagtgagaacgatgactatttgaaacatcagccagaaatctctctccagatgcagctgctcaggggtctgtggcagatatgtcctcaggcttacttttccatggtctctgagcatctgctggtgctggccttaaagaccgcttatcaaagtaacaccgtggcggcttgttcacccttcgtgctgcagttcttgcagggccgcacgcttactctcggcgcccttaatctccaatacttctttgaccacccagaaagcttgagcctgctccgaagtatccacttccccatccgcggcaacaaaactagtccaagagcacatttctcggtcttagagacatgctttgacaagtcacaggtccccaccatcgaccaggactatgcctctgcctttgagcctatgaacgaatgggaaagaaacctggccgagaaagaggacaacgttaagtcttacatggacatgcagcgaagagctagccctgacctctctacgggctactggaaactgtccccgaaacaatacaagattccgtgcctggaagttgatgttaatgacattgacgtggtagggcaagacatgttggagatccttatgacagtgttcagtgcctctcagaggattgagctgcacctaaaccacagtagaggtttcatcgaatccattcggcccgccctggaactcagcaaagcctcagtgaccaaatgttctatttcaaagctggaactatccgccgcagaacaggaattgttactcaccttgccttctctcgagtcactcgaggtatccggaacaatacagagtcaggatcaaatttttcccaacttggataagttcttgtgcttaaaagaattgtcggtggatttagagggaaacatcaatgtcttctccgtaattcctgaagagttccccaattttcatcacatggagaaactgttgatccagatatctgcagaatatgacccctcaaagctggtcaagctgatccagaatagtcccaacctccacgtctttcacctgaagtgcaattttttcagcgatttcggttcacttatgacgatgctggtgtcttgcaaaaaacttaccgagatcaagttctcggattctttctttcaggccgtgccatttgtagcttctctgcctaactttattagtctcaaaattctcaatcttgagggccagcagtttccggatgaggaaacatcagagaagttcgcatacatcctgggcagcttgtctaacctcgaggagctgatactgcctacaggggatggcatctacagggtagccaagctgatcatccagcagtgtcagcaactgcattgccttcgtgtactgtcattcttcaagacactgaatgatgattctgtcgtagagatcgcaaaagtcgccattagtggcggattccagaaactggagaatctcaaactgagtataaatcataagataaccgaagaaggataccggaatttcttccaggctcttgacaacatgcccaatctccaggaacttgacatttctcgccacttcactgagtgcatcaaggcacaggccacaactgtcaaaagcctgtctcaatgcgtgttacgcctgccacgtctgattcgcctcaacatgttgagctggttgcttgatgccgacgacatcgctctgttgaatgtgatgaaagaacggcacccccaaagcaaatacttgacaattttgcaaaaatggatactcccctttagtcccattatccagaagtag

SEQ ID NO: 16346 - DNA, 3726 bp, Artificial Sequence
  Description of Artificial Sequence: Synthetic coding sequence
atgcctcttcacatcggagacttcgtctgggactctaaggttcactcactacagtcctcgctcaatatcttcagcctgttgcccactaagggtaggacagagcacttgttcttcagccatattctgtccttccattggcctgctttctcaagtatccgcctggagctatggattaacctgcgttgtgaatttctccgttccaagaagagctccgaagagatcacccagtacatccagtcttataagggattcgtggacataactggggagcacttcgtgaactcttgggtgcagagggaattgcctatggcttctgcttactgcaacgactctatcttcgcttatgaggagttaagactggacagttttaaagactggccccgggaatccgccgtgggtgtcgccgccctggctaaggctgggctgttctacacggggattaaggacatcgtccaatgttttagctgtggagggtgccttgagaagtggcaagaaggcgacgaccccttggatgatcacactaggtgctttcctaattgtccatttctgcagaatatgaaatcatccgcagaagtcacaccagacttgcagagccgcggagaactatgtgagctcctcgagactacttccgaatctaacctagaggactcaatcgccgtgggtcccatcgtgccagaaatggctcagggcgaagcacaatggttccaagaagccaaaaatctcaacgagcaattaagagctgcttacaccagcgctagcttccggcatatgagccttttggatatatcaagcgatctggcaacagatcatctacttggctgtgatctttcgatagcgtcgaagcacatcagtaagcctgttcaagaacctcttgtcctccccgaagtgtttggaaacctgaattcagtgatgtgcgttgagggcgaagccgggagcggcaagacagttctgcttaagaagatagccttcctgtgggctagcggatgctgtccgctgcttaataggttccaactcgtgttttatctgtccttatctagcaccaggcccgacgagggactggccagcattatctgcgaccagttgctggaaaaggagggctccgtgacggaaatgtgtgtgcgtaatataattcagcaactaaaaaatcaggtactcttcctattggatgattataaagaaatttgcagcattccccaggtcatcggaaagcttatccagaagaaccatcttagtcgcacttgcctgttaattgccgtacggacaaacagagcccgagacatccggcgatatctcgagactatactggagattaaggcctttcctttttataacacggtgtgcatccttcgtaaactattcagccataacatgacgaggctacggaagttcatggtctattttgggaaaaatcaatcccttcaaaaaatccagaagactcctctgtttgttgccgctatctgcgcacactggttccagtatccctttgacccgtcattcgacgacgtggctgttttcaaaagttacatggaaagactctctttgcggaacaaagctaccgccgagattctcaaggccaccgtgtcaagctgtggcgagctggcgctaaagggattcttcagctgctgtttcgagttcaacgatgatgacctcgccgaagcaggcgtcgacgaagatgaagacctgactatgtgcttgatgagcaaattcaccgctcaacggctcagacccttctaccgatttctctctcccgctttccaggagtttttggccgggatgcgcctgatcgagctgcttgactctgaccggcaggaacatcaagatctgggtctttatcacctgaaacagattaacagccctatgatgacagtcagtgcctataataatttcctcaactatgtctcctcattgcctagcactaaggcaggcccaaaaattgttagtcatttgttgcacctggttgataataaagaaagtctcgagaacatttccgagaatgacgattatcttaagcaccagccagaaatttctcttcagatgcagctgcttcggggactttggcagatctgtccgcaggcttacttcagtatggtgtccgagcacttgctggtattagcactcaaaacagcctatcagagtaatacagttgctgcatgctccccgttcgttctgcagtttctccaggggcgtactctaacattaggggctctgaaccttcaatacttttttgatcatccggagtctctgtctctgttgcggtccattcactttcctattcgcggcaacaagacttcacctagggcacatttttccgtgcttgagacatgtttcgacaagagccaggtgcctacaatagatcaggattatgcctcggcctttgagcccatgaatgaatgggagagaaatctggccgagaaggaggacaatgttaagtcctatatggacatgcagaggcgggcaagtcccgacctgtccacaggttactggaagctgtctcctaagcagtacaagatcccatgtttggaggttgatgtcaacgacatcgatgtcgtgggacaggacatgctcgagatcctgatgacggttttctcggcatctcagagaatcgaactccatctcaatcactctcggggctttattgaatccatacgccccgccttagaactgtccaaagcctctgttacaaagtgtagcatctcaaaactggaattaagtgccgctgaacaggagctcttactcacgctgccttctctagagtcactggaggtgagcggaacaattcaaagccaagaccaaatatttcccaatcttgataaattcctctgcttgaaagaacttagcgtggacctcgaaggcaatataaatgtgttttcagttattcctgaggaatttcccaattttcatcacatggagaagttgctgatccagattagcgctgagtacgacccgtccaaactggttaagctgatacagaattccccgaatctgcacgtctttcatttaaaatgtaactttttctccgacttcggctctcttatgaccatgttggtgagctgcaaaaaactgactgaaattaaattcagtgactccttcttccaggctgtaccattcgttgcttctctgccgaacttcatttcactcaaaatactgaacctggaaggacagcagttcccagacgaggagacttccgagaagttcgcttacatcctcgggtcactgtcaaatcttgaggagttaatcctcccgacaggagatggaatttaccgggtcgccaaactgataatccagcaatgccagcaactgcattgcttgcgtgtgctcagtttctttaaaacgctgaacgacgacagtgttgtagaaattgcgaaagtcgctattagtggcggctttcagaagcttgagaaccttaagctctcgattaatcataaaataaccgaagagggttaccgcaatttcttccaggcccttgacaacatgccaaacctgcaagagcttgacatttcgaggcacttcacggaatgcatcaaggctcaggcaactaccgtcaaaagtttgagccagtgtgtcttgaggctgcccagacttatccggcttaatatgctctcttggctgctagatgctgatgatattgcactgctgaacgtgatgaaggagagacatcctcagagcaaatacctgacaatcttgcagaagtggattttgccattttcccctatcattcaaaagtag

SEQ ID NO: 16347 - DNA, 678 bp, Artificial Sequence
  Description of Artificial Sequence: Synthetic coding sequence
atgttaggcctggacgcatgcgaactgggcgctcaactgcttgagttactgcggttagcgctgtgcgctcgggtgttgctcgctgacaaagagggcggccccccggccgtggatgaggtcctcgacgaggctgttcctgaatacagagcccccggcagaaagtcactcctcgagatacgacagttagacccagatgacaggtccctcgcaaaatacaaacgggtgctgctgggcccccttccgccagcagtggatcccagtctccccaacgtgcaggtcacccgtctgacactgttgtccgagcaggcccccggcccagtcgtgatggatctgacaggggacctggccgtgctgaaggaccaggtgttcgttttaaaagagggcgtggactatcgggtcaagatcagtttcaaggtgcatagagagatagtgtctgggttgaaatgtttacaccacacctaccgaagaggcctgagagtggataaaacggtgtacatggtaggtagttacggacctagcgcgcaagagtacgaattcgtgacaccggtggaagaggcaccaaggggcgccctggtcaggggaccttacctggttgtttcccttttcacagacgacgatcgcactcaccacttgtcctgggaatggggcctatgcatctgccaggactggaaagattag

SEQ ID NO: 16348 - DNA, 882 bp, Artificial Sequence
  Description of Artificial Sequence: Synthetic coding sequence
atgcctgcccggagtggagctcagttttgtcgtagaatgggacagaagaaacagcgacccgcccgcgccgggcaaccccactcatcgtcagatgcagcccaggccccggcagagcaacctcactctagctccgatgctgcccaggcaccatgcccgcgagaaagatgcctcggccctcctaccactcccggcccctaccgatcaatctacttttcttctcccaaggggcacttgacccgactcggactcgaattttttgaccagcccgcggtgccactagccagagctttcctgggtcaggtcctggtccggagactgccaaatgggacagagctgaggggccgtatcgtcgagactgaggcctacttggggcctgaggatgaggctgctcactctagaggaggacgccagactcccagaaacagaggcatgttcatgaagcccggtacactctacgtgtacataatttatggcatgtatttttgtatgaacatttcaagccagggtgacggggcctgcgtgctgttgcgtgctttagagcctttggaaggacttgaaaccatgagacagcttcgctccacactgcgtaaggggaccgcctcccgggtgttgaaggacagagaactgtgctcagggcccagtaagctgtgtcaggccctcgcaatcaacaaaagtttcgaccagagagacttagctcaggatgaggctgtctggctggaacgaggacccctggagccatctgagcctgctgtcgtggcagctgccagagtgggcgtgggtcatgccggagaatgggcccgcaagccactaaggttttacgtgcgtggaagcccttgggtgtccgtagtggaccgtgtagccgaacaagacacccaggcttag

SEQ ID NO: 16349 - DNA, 846 bp, Artificial Sequence
  Description of Artificial Sequence: Synthetic coding sequence
atgggacaaaagaaacagcgacctgccagggctggccagcctcactcctcttctgatgccgctcaagccccagcagaacagcctcactcttcctccgacgcagcgcaggctccttgcccccgcgagcgctgcctgggtccacctactactcccggaccctatagaagcatttactttagtagccccaagggccaccttacccggttaggcctcgaatttttcgaccagcccgctgtaccgctggctcgggccttcctgggtcaggttttggtcagacggctccccaatggcacagagttgcgtgggcgtatcgtggagacagaggcctacttaggtcccgaagacgaagcagctcactctcgcggaggaaggcagaccccccggaaccggggtatgttcatgaaaccagggaccctctatgtgtacatcatatacggaatgtacttttgtatgaacatttccagccagggagacggcgcttgtgtgctgttaagagcgctggagccccttgaaggcctcgagacaatgcgtcagttgagatcgacattacgcaagggcaccgcttctcgagtcctcaaggatcgtgaattgtgcagtggaccctctaagctgtgccaggccctggccattaacaagtcctttgatcagagagatctggcccaggacgaggcagtgtggttagagagaggtcccctcgaacccagtgaacccgctgtagtagctgcggcgagggttggagtcgggcatgcgggcgagtgggctaggaaacccctgagattctacgttcgcggttccccatgggtgtccgtcgttgatcgggtcgctgaacaagacacacaggcgtag

SEQ ID NO: 16350 - DNA, 756 bp, Artificial Sequence
  Description of Artificial Sequence: Synthetic coding sequence
atgggccagaaaaaacaaagaccagcgcgggcaggacagcctcactctagtagcgatgcggcccaggctccggccgagcagccacattcatcatcagacgcagcccaggctccatgtcccagggagcggtgccttgggcctccgactacacctggtccctatagaagcatatatttttccagtcccaaggggcatctcaccagattaggactggaattttttgatcagccagccgtgccactggctagagcttttctggggcaggtcctggttaggcgattacccaatggtactgagctcagaggccggattgttgagaccgaagcttatctcgggcctgaggacgaagccgcccacagccgaggaggtcgccagactccacgtaaccgtggcatgttcatgaaacctggcactctatacgtttacatcatttatggtatgtacttttgtatgaacatctctagccaaggggatggggcctgcgttttgctcagggctctggagccactggagggtctggaaaccatgcgccagctgcggtccaccctgcgaaaaggtaccgcctctagggtactcaaagacagagagttgtgtagcgggccgagtaaactgtgccaggccttggctataaacaagagtttcgatcagcgggatctagctcaggacgaggctgtgtggttggaaagagggcctctcgaacccagcgaacctgctgtggtggcggcagccagggtcggtgtgggccacgcaggatag

SEQ ID NO: 16351 - DNA, 1044 bp, Artificial Sequence
  Description of Artificial Sequence: Synthetic coding sequence
atgcacgcccactgtctgccctttctgctgcatgcctggtgggccctgcttcaggccggagctgccactgtggcaactgcattgctgaggactagagggcagcctagctcgcccagccctctggcttacatgctgtccctgtatcgggatccattgccacgagcagacatcattagaagcttgcaagcggaagacgttgctgtagacgggcagaattggacttttgccttcgattttagcttcctgagtcagcaggaggatttggcctgggctgagctgcgccttcagctcagctcccctgtggacctgcccacagagggtagccttgccattgaaatatttcatcaacctaagcctgacacagaacaagctagcgattcctgccttgagcgttttcaaatggatctgttcacagttacactttcacaagtcacgttctccctgggttctatggttctagaggtcacgcggccactctccaaatggttaaagcatcccggcgcgctggagaaacaaatgtcccgcgtggctggagagtgctggccccggccccccacacccccagccactaacgtcctgttgatgctgtatagcaatctatctcaggaacagcgccagctcggaggaagtacactgctgtgggaagccgaatcctcctggcgggcgcaggagggtcaactctcctgggagtggggcaagaggcatcgcagacatcacctccccgacaggtcgcagctatgcaggaaagtcaagttccaggtggacttcaacctgatcggctgggggagttggatcatctaccccaagcagtacaacgcttacaggtgcgagggagagtgccccaatcctgtgggagaggagttccaccccactaatcacgcctacattcagagtctgcttaagcgctaccagccccaccgcgtacctagcacatgctgtgctcccgtgaaaactaagcccctctccatgctttacgtcgataacgggagggtcctgctggatcaccacaaagatatgatcgttgaagagtgtggctgcctgtag

SEQ ID NO: 16352 - DNA, 879 bp, Artificial Sequence
  Description of Artificial Sequence: Synthetic coding sequence
gatcagcagctgggcattcagaccaaggatgtggctgttgatggacagaattggactttcgcctttgatttttcatttctgtcccagcaagaagatttagcgtgggcggagctgcgcctgcagctctcatcaccagtcgatctgcctactgagggaagcctcgccatcgagatttttcaccaacccaaacccgacactgagcaggcatctgacagctgtcttgagcggtttcaaatggatctctttaccgttactctgtcgcaggtcaccttctctctgggctcaatggtcctggaagtcacaaggccactttccaaatggcttaagcatcctggtgctctcgaaaaacagatgagccgggtagctggggaatgttggccacggcctcccacacctccggccactaatgtgttgcttatgttgtattcaaatttgagccaagagcagcgacagctgggaggtagcacactactgtgggaagccgagagctcatggcgagcgcaggaaggccagctgagctgggaatggggaaagaggcatcggcggcaccacttgcccgaccggtcccagctttgtagaaaggtgaagtttcaggtcgacttcaatttgattggctggggctcgtggatcatctatccgaaacagtacaacgcctaccgctgcgaaggagagtgtccaaatccagtgggcgaagaatttcatccaacaaaccacgcttatattcagtctctccttaagcgataccagccgcacagggtaccctctacttgttgcgctcccgtcaaaactaagccactcagcatgttgtatgtggataatggccgcgtcctgctcgatcatcacaaggatatgatcgtggaggagtgcggctgcctgtag

SEQ ID NO: 16353 - DNA, 534 bp, Artificial Sequence
  Description of Artificial Sequence: Synthetic coding sequence
atggttcttttaagtacactgggcattgtctttcagggagaggggcctcccatttcctcatgcgatactggcactatggcaaactgcgaacgtacctttatcgcgattaagccggacggcgtgcagagaggcctcgtgggggagatcatcaagcgctttgagcagaaggggtttcggctggttggtctcaaatttatgcaagcctccgaagatcttctgaaggagcactatgttgatcttaaggatcgccccttttttgcagggctggtgaaatatatgcacagcggtcccgtggtggcaatggtttgggagggattgaacgtggtgaaaaccggacgcgttatgctcggggagaccaacccagccgatagcaaacccggaacaatcagaggcgacttttgcattcaagtcgggagaaatattatccacggaagcgactctgtcgaatccgcagaaaaagagattggactatggttccacccagaagaattggttgattatactagctgtgcccagaactggatttatgagtag

SEQ ID NO: 16354 - DNA, 534 bp, Artificial Sequence
  Description of Artificial Sequence: Synthetic coding sequence
atggttctcctgtccacgctcggaatagtgtttcagggagaggggccgcctatttcctcctgcgacactggaacaatggcaaactgtgagaggacatttattgctatcaagccagatggtgtacagcgcgggttggtgggagaaattatcaagcgcttcgagcagaagggatttagactcgtgggtttgaagttcatgcaagcctctgaagacctgttaaaggagcattacgtcgatctgaaagacaggcctttctttgcgggactggtgaaatacatgcattcggggcccgtggtggctatggtgtgggaggggctcaacgttgtgaaaactggtagggtgatgttaggagaaactaatcccgccgactctaagcctggcaccattagaggtgatttctgtatacaggtcgggcgaaatattatccacggaagcgacagcgtcgagtcagccgaaaaggagattggtctttggtttcacccggaagagttggtcgattatacatcatgcgcccagaactggatttacgagtag

SEQ ID NO: 16355 - DNA, 459 bp, Artificial Sequence
  Description of Artificial Sequence: Synthetic coding sequence
atggccaactgcgagcgcacttttatagctatcaagcctgacggcgtgcagcggggcctggttggagagataatcaaacggtttgaacagaagggcttcagactggttggccttaagttcatgcaggcctccgaggacttactgaaagagcactacgtagacctaaaagacaggcctttcttcgcgggcctagtgaagtacatgcactcaggacccgttgttgcaatggtttgggagggtctgaatgtggtcaagaccggcagagtgatgctgggggagactaatcccgccgatagtaagccagggacaattagaggcgatttctgcattcaggtgggccgcaatattatccatggcagtgacagtgttgagtctgcagaaaaagaaattgggctctggtttcaccctgaagaattggtggattacacctcttgcgcccagaattggatttacgagtag

SEQ ID NO: 16356 - DNA, 183 bp, Artificial Sequence
  Description of Artificial Sequence: Synthetic coding sequence
atggtgctgctgagcactcttggcattgtttttcagggcgagggtcccccaattagttcctgcgatacagggacgatggcaaattgtgagagaacattcatagctatcaaacctgatggagtccagagagggctcgttggggagattatcaaaaggtttgaacaaaagggattccgcctatag

SEQ ID NO: 16357 - DNA, 1443 bp, Artificial Sequence
  Description of Artificial Sequence: Synthetic coding sequence
atggccactgtcccaggcctgcaacctctccccacgttggagcaagacctggaacaggaggaaattttaatagtaaaagtggaggaggatttctgcttggaagaggaaccatctgttgagaccgaggacccctcaccggagacttttcggcagctctttcggctgttttgctatcaggaggtggctggtcctagagaagcactcagccgactgtgggagctctgttgtcgctggctccgtcctgagcttcgtaccaaggagcagatccttgaactcctggtcctggaacagtttcttacagtgttacctggagagattcaggcaagagtacgcgaacagcaacccgagagcggcgaggaggcagtcgtcctcgttgaaggcctgcagaggaaaccccggaagcaccgccaacggggcagcgaactgctcagcgatgatgaggtgccacttggcatcggaggccagtttttaaaacaccaggcagaagctcagcccgaagacttaagtctcgaagaggaggcacgcttctctagtcagcaaccccctgcccaattatctcaccgcccccagagagggcccctgctctggcctgagcgcgggcctccagcacccaggcatcaggagatggcaagcgcctccccattcttgtccgcctggtcacaagtgcccgtgaacttggaagacgtggccgtttacctgagcggagaagaacctaggtgcatggaccctgcacagagggacgccccgctggagaacgaaggccccggcattcagttggaggacggcggagatggccgcgaggacgccccactgaggatggagtggtaccgagtcctaagtgcccgatgccaggggcctggccatcccctgccgggccagagaccagcaccagtgcgcgggctggtgcgtcccgaccagccacggggcgggcctcctcctggtcggcgcgcctcacatggggccgacaaaccatacacatgccctgagtgtggaaagggtttcagcaaaaccagtcacctgaccaagcaccagcgcacacatacaggcgaaagaccatacaaatgtctggtttgcggcaagggcttcagcgatcgctctaacttcagcacccatcagcgggtgcatactggggagaaaccttatccttgtccagaatgcggaaagcgttttagtcagagcagtagcctcgtgatccatagaaggacacatagtggcgagcgaccctacgcttgcactcagtgtgggaagagatttaacaactcctcacacttctctgcccatagacgaacccacaccggagaaaagccttatacttgtcctgcctgcgggcgcggctttcgccgcgggaccgatttacacaaacatcaaagaacccacatgggagcgggctcactgcccacattacaacctgttgctcctggaggcccaggtgcgaaagcctag

SEQ ID NO: 16358 - DNA, 588 bp, Artificial Sequence
  Description of Artificial Sequence: Synthetic coding sequence
atgggcggtcttttttggcgttctgctctccgaggccttagatgcggacctagagcccccggcccaagccttctagtgagacatggcagtggtctgcccccctccgccctcaaacgagggcccagttggacaagagagagaacactcgtggctgtcaagccggacggggtgcagagaaggctcgtcggggacgtgatccagcgcttcgagaggcgtggctttacactggtgggaatgaaaatgctccaggcccccgagtccgtgcttgcagagcactaccaggacttgagaaggaagcccttctaccccgctctgattagatacatgagtagcggacctgtagtcgccatggtctgggaaggctacaacgtagttagagcctcgagggctatgattgggcacaccgacagcgccgaggccgcccctggaacaatcagaggggacttcagcgttcatataagcagaaatgtgatccacgcgtccgattccgttgagggagctcagcgcgagatccaactgtggtttcagtcatctgagctggtgagctgggcagatgggggccaacattcctctatccatcctgcttag

SEQ ID NO: 16359 - DNA, 354 bp, Artificial Sequence
  Description of Artificial Sequence: Synthetic coding sequence
atgaaaatgcttcaggcgccagaatctgtgctggcagagcactaccaagacctgcgtaggaagcctttctacccggcgctgatccgatacatgagctccggccccgtcgtagcgatggtttgggagggatacaacgtggtgcgggccagtcgagcaatgattggtcacacagattctgctgaagccgctcccggcacaattcgcggcgacttttcagtgcacatttccagaaatgtcatacacgcctcagattctgtggaaggggcacagagggagatccagttatggtttcagagcagcgaactggtttcttgggctgacggcggacagcattctagcatccacccagcttag

SEQ ID NO: 16360 - DNA, 510 bp, Artificial Sequence
  Description of Artificial Sequence: Synthetic coding sequence
tagtggcggtctgcactgcgagggttgcggtgcggacctagggccccaggtccttctctgcttgtcaggcatggctcagggggcccttcatggacacgggagcgcaccctggtggccgtcaagccagatggagttcaaaggcgtctcgtaggcgatgtgatccagcggttcgaacgccgggggtttactctggttgggatgaagatgttgcaggcccctgagagcgtgttagcagaacattatcaggatcttcggcgaaaacccttctaccctgccctgatccgatatatgtcatccggccccgtggtggcgatggtgtgggaagggtataatgtggtcagggcaagcagggccatgatcggccacaccgattctgcggaagctgctccagggactatacggggcgatttctctgtgcacatcagttctcatagactggccccactggatcgcggtcagcgtgagcagcaaatggtgccggggattccccagggggcccacgaagcttag

SEQ ID NO: 16361 - DNA, 702 bp, Artificial Sequence
  Description of Artificial Sequence: Synthetic coding sequence
atgggcggcttgttttggcgcagcgctctgcggggcctgagatgtggcccaagggcccccgggcctagtctgctcgtgaggcacgggagtggcgggcctagctggactcgtgaacgtaccctggtggccgtaaagccagacggcgtgcagagacggctggtaggagatgtaatccagcggtttgagcggcgcggcttcaccctggtgggcatgaagatgctacaggcaccagagtcagtgctggccgaacattaccaagatcttcgcagaaagccattctaccccgccttgattcgttatatgtcttccggaccagtggtggcaatggtgtgggaaggctacaatgtcgtgcgagcctccagggcgatgatagggcacaccgactccgcagaagcagcgcctggaacaatcaggggcgatttcagtgtccatatcagccggaacgttatccacgcatccgattccgtcgagggcgcgcaacgcgaaatccagctgtggttccagtcatctgagctgtcacccaccggcgccccatggcctagtagaagacctacctggcgcggcactactgtgtctccacgtaccgcgacgtccagcgccagaacctgttgcggaactaagtggccctcatctcaggaggccgcactggggctcggatccggactccttagattttcctgcggcacggccgcaattaggtag

SEQ ID NO: 16362 - DNA, 354 bp, Artificial Sequence
  Description of Artificial Sequence: Synthetic coding sequence
atgaagatgctccaggccccagaatccgtgttggctgaacattatcaagacttacggaggaagccgttctatcctgccctgatcagatacatgtctagcggacccgtagtggcaatggtatgggagggttacaacgtggtgcgcgcgagtcgcgctatgattgggcacacagatagtgccgaggcagcccccgggacaattcggggagacttctcagtgcatatatcacgcaacgtcatccatgcctcagattcagtcgaaggagctcagagggagatccagctctggttccagtcttccgaactagtctcttgggccgacgggggacagcattcctcgattcatccagcttag

SEQ ID NO: 16363 - DNA, 114 bp, Artificial Sequence
  Description of Artificial Sequence: Synthetic coding sequence
atgaaaatgctccaggctcctgagtctgtcctggcagagcactaccaggatctacgtcggaagccattctaccctgcgttaatcaggtacatgtcatctggcccagttgtgtag

SEQ ID NO: 16364 - DNA, 195 bp, Artificial Sequence
  Description of Artificial Sequence: Synthetic coding sequence
atgttcctccagtactatctgaatgaacagggggatcgtgtttatacactgaagaagttcgaccctatgggccagcagacttgctcagcccatccagccagattctcccccgacgacaagtacagccgccaccggatcacgattaaaaaaaggttcaaagtgcttatgacccagcaacccagacctgtgttgtag

SEQ ID NO: 16365 - DNA, 7668 bp, Artificial Sequence
  Description of Artificial Sequence: Synthetic coding sequence
atgccccctcttttggccccattgctgtgtctggcactgttaccagcactcgccgctcgtggacctcggtgttcacagcccggagagacgtgcctcaatggcgggaaatgtgaagctgccaacggcacagaagcttgcgtatgcggcggcgccttcgtcggtccacgctgccaggaccccaacccctgcctgtctacaccctgcaagaatgccggcacttgtcacgtggttgatcgacggggcgtcgccgactatgcatgttcctgcgctttgggttttagcggccctctgtgtcttacccctctggacaacgcttgtctcacaaatccttgccggaatggcggtacttgtgatttattgacactgactgaatacaagtgccggtgtcctcctggttggtctgggaagtcatgtcagcaggccgatccgtgcgcaagcaatccctgtgctaacggtggccaatgcctgccattcgaagcatcatacatatgccattgccctccctcttttcatggccccacgtgccgccaggatgtgaatgagtgtgggcagaagccagggttatgcagacatggtggtacatgccacaacgaggtcggatcataccgctgcgtctgtagggcaacccataccggccccaattgcgagcgcccatatgtcccctgcagccctagcccatgccagaacgggggcacctgcaggccgacaggagacgtcacccatgagtgtgcctgtctgccagggtttaccggccagaattgtgaggagaatatcgacgattgccccgggaacaactgcaagaacggaggagcctgtgttgatggagtgaatacttataattgccgttgcccccctgaatggacaggccaatattgtactgaggatgtggacgaatgtcagctgatgccaaacgcctgccagaacgggggcacttgccacaatacccacggaggatataactgcgtgtgcgtcaacggatggactggtgaagactgcagtgagaatattgacgattgtgcgtctgcagcttgcttccacggggctacctgtcatgatcgcgtggcctctttctactgtgaatgtcctcatggccgcaccggcctgctgtgccacctcaacgacgcgtgtatcagtaatccttgcaacgaaggatccaactgtgacactaacccagtgaatggtaaggccatttgcacgtgcccatccggctacacaggtcctgcatgcagccaagatgtcgacgaatgcagtttaggggcgaatccttgtgaacacgcgggcaaatgcatcaataccttaggtagctttgagtgccaatgtctgcagggatataccggcccgagatgtgagatcgatgtcaacgaatgcgtttccaacccctgtcaaaatgatgccacatgtcttgatcagatcggtgaattccagtgtatttgcatgcccggctatgagggcgtgcactgcgaggttaacacagatgagtgcgcaagctccccttgcctccacaacggcaggtgcttagataaaatcaatgaattccagtgcgaatgtccaacgggtttcaccggacatctgtgccagtacgacgtggacgagtgtgcctcaactccgtgcaaaaacggcgccaagtgcctggacggccctaacacttatacgtgtgtgtgcacagaaggctacacaggcacacactgtgaagttgatatcgacgaatgtgatcctgacccatgccattacggaagctgcaaagacggtgtggctacatttacttgcctgtgccgtcccggctataccggacaccactgtgaaaccaacataaacgaatgttcatcgcagccttgtaggcacgggggaacttgccaggaccgggataacgcatatctgtgtttctgtctgaagggaactacagggccaaattgcgagattaacttagatgactgcgccagctccccttgtgacagcggcacttgcctggacaagatagacggctatgagtgcgcttgtgaacccggatacacaggcagtatgtgtaatatcaacatcgacgaatgcgccgggaacccttgccacaatggtggcacttgcgaggatggaatcaatggcttcacttgccggtgccctgaaggatatcacgatcccacctgtctgagcgaggttaatgaatgcaactctaacccatgcgtacatggggcctgtagggattctctcaatggttacaagtgtgattgcgaccctggatggtccggtaccaactgtgacattaataacaacgagtgcgagtccaatccttgcgtgaatggggggacatgcaaggatatgacctccggttacgtgtgcacctgccgggaaggcttcagcggtcctaactgccaaacaaatatcaatgaatgtgcaagcaacccgtgtctgaatcaggggacttgcattgacgatgtcgcgggttacaagtgtaattgcctcctcccttacacaggagcaacctgcgaagtggtgctggcgccctgcgcgccctccccctgtaggaatggaggcgaatgcaggcagagtgaagattatgaatctttctcttgcgtgtgccctacggggtggcaagggcagacttgtgaggttgatattaacgaatgcgttctgagcccatgccgtcacggcgcatcgtgtcagaacacccatggaggctaccgatgccattgccaagctgggtacagcgggagaaactgtgaaactgacattgatgattgtcggcccaatccctgtcacaacggaggctcatgtacagatgggattaataccgccttttgcgattgccttccggggttccgcggcacattctgtgaggaggatataaatgagtgtgcctcagatccttgtcgcaatggcgccaactgcacagactgcgtagacagctacacatgcacttgcccagctggtttttccggcattcactgcgagaataatactccggactgcacagaatcatcttgctttaacggcggcacatgcgtggacggaatcaacagcttcacttgtctctgcccgccaggatttaccggttcttactgccagcacgatgtgaacgaatgcgactctcagccatgcctgcatggcggaacctgccaggacgggtgcggatcataccgatgtacctgtccgcagggatataccggtccaaactgccagaacctagtgcattggtgtgattcctcaccatgtaagaatggaggcaaatgttggcagacacatactcagtacaggtgcgagtgcccaagcggctggactggactatactgtgacgtgcctagcgtctcatgcgaagttgccgcacagcgccagggagtggacgtggcccgcctgtgccagcatggcggattgtgcgtggacgcaggaaacactcaccactgccggtgccaagccgggtacaccggctcatattgtgaagacctggtggacgagtgctcaccaagtccatgccagaatggagctacctgtacagattatctggggggctattcctgcaagtgtgtcgcagggtaccacggcgtcaattgctcagaggagatcgacgagtgcctgtcgcatccctgccagaacggcggtacctgcctggatctgcccaacacatataaatgctcttgtcctaggggcacacagggggtccattgtgagatcaatgtggacgattgcaatccccctgtcgatccggtgtcccgttcaccaaaatgtttcaacaatggtacttgcgtggaccaagttggcggttactcatgtacttgtcccccagggttcgtgggcgagaggtgcgaaggtgatgtcaacgagtgtctgtctaacccatgtgatgcgaggggcactcagaactgcgttcaacgcgtaaacgatttccactgcgagtgcagggccggtcacaccggccggaggtgcgaaagtgtaatcaacggatgcaagggtaagccgtgcaaaaacggcggcacttgcgcggttgcttcaaacaccgctcgtggcttcatttgcaaatgcccggcgggtttcgagggcgccacctgcgagaacgacgcccggacttgcggctccctccggtgcctcaatggaggcacatgtatctctggtcctaggagcccaacatgtctctgcctaggcccctttacaggacctgagtgtcagttcccagcctcgagtccttgcctggggggaaacccatgttacaatcagggaacctgcgagcctacatctgagagtcctttctatagatgcctgtgtcccgccaaattcaacggactgctgtgtcatatcctagattacagcttcggaggaggcgcagggagggacatcccaccccctttaattgaagaggcttgcgaactccctgagtgccaggaggatgcaggaaataaagtctgctcgcttcaatgcaacaaccacgcctgtgggtgggatggcggtgactgttcactgaatttcaatgacccctggaaaaactgcactcagtcccttcagtgctggaaatatttttccgacggccactgcgatagccagtgcaacagcgctggttgtctctttgatggattcgattgtcagcgggctgaaggacagtgtaatcctctgtacgaccagtactgtaaagaccacttcagcgacggccactgtgatcaaggctgcaattcagccgagtgtgagtgggatggactggattgcgcagagcatgttcctgaacgcctggcagccggtaccctcgttgtcgtcgtattgatgccccccgaacagctgcgcaacagttcttttcatttcttgagagaattgtccagggtgctccatacaaatgtagtgtttaagagggacgctcatggacaacagatgatatttccctattatgggcgcgaggaggaactgaggaagcatcctattaagcgtgctgcggagggttgggccgctcccgatgcattactaggccaagttaaggccagtcttctgccaggaggatccgaaggaggccggcgccggcgggagctggatcccatggacgtaagaggtagtatcgtctacctcgaaattgataatcgacagtgcgttcaagcttcctcacagtgctttcagagcgcaaccgatgttgcggcattcctgggcgcgctagcgtcactcgggtccctgaatatcccgtacaagatcgaggccgtgcagtcagaaacagttgaacctcctccaccggcccaacttcacttcatgtacgttgccgcagctgcttttgtgctgttattcttcgtgggctgtggggtgcttctgagtcggaaacgacggagacagcatggacagctgtggttccctgagggcttcaaggtcagcgaggcgtccaaaaagaagcgccgggaaccactcggggaggattccgtagggctgaagcccctgaagaacgcttctgacggagcactcatggatgataatcagaacgagtggggcgacgaggatctggagacaaaaaagtttcgattcgaggagcccgttgtccttcccgacctggacgatcagactgatcacaggcagtggacccagcaacatctagatgcagcagacttgagaatgtctgccatggctcccactcccccccagggcgaagttgatgctgactgcatggatgtgaacgtgcgtggtcctgacggttttactccacttatgatagcaagctgttctggcggcgggcttgagacaggaaacagtgaggaagaagaggacgctcccgccgtgatttccgactttatctaccagggtgcctccctgcataatcagaccgatcgtacaggtgaaaccgccctccacctggccgccaggtattccaggtcggatgctgccaagcgtttattagaagcctccgccgacgcaaacatccaggacaatatgggccgcacacctctgcacgcggccgtgtccgctgatgcccaaggcgtcttccagattctgatccgtaaccgcgctactgatctcgatgcacggatgcacgatgggacaactccactcattttggctgccaggctggctgtagagggcatgttggaggacctgattaatagtcacgctgacgtaaacgctgtggatgacctcggcaaatcggccctccactgggccgctgcagtaaataacgtggacgcagccgtggtccttttaaagaatggagccaataaggacatgcagaacaaccgagaggaaacacccctgttcctggctgccagagaggggtcttatgaaacagctaaggttctactagatcactttgccaatcgcgatattacggatcacatggatcggctgccgcgggacattgcacaggaacgtatgcatcacgatattgtgcgccttcttgatgaatataatctggtccggtcccctcaactccacggggctccactgggcggcacgccgaccctttccccaccactgtgctctcctaacgggtacctgggcagtctaaagcctggcgtacagggcaaaaaggtccggaagccctcctctaagggcttggcatgcggaagtaaggaagccaaggatctaaaggcccgtcggaagaagagccaggatggcaaggggtgcctgctggattcttcgggcatgcttagtccagtggactccctggagagcccccacggatatctcagcgatgtggccagccctcctttgctgcccagcccatttcagcagagtccctcagtgcccctaaaccacctcccaggtatgccggacactcacctgggcatcggacatctgaatgttgctgctaaaccagaaatggcagctctcggcggcggaggaaggctagcttttgagacaggaccgccacggctatctcatctccccgttgctagcggaacttctactgtgctcggcagtagctctgggggggcactgaattttaccgtcgggggatctacttccctgaacgggcagtgcgagtggttatcgcggctgcagtccggaatggtgcctaaccagtacaaccccctgaggggaagcgtggcacccggacccctcagcacacaggccccaagtcttcagcacgggatggtgggccccctgcacagctcactggcagcgtctgctctgagccagatgatgtcttaccagggattaccaagcactcggctggccacccagccgcatcttgtgcagacccagcaggttcaacctcagaacttgcagatgcagcagcagaacctgcaacccgctaacattcaacagcagcagagtctgcagccgcctccgcctccccctcagccacatttgggcgtgtcttccgccgcatcaggccacctgggaagatcgttcttgtcaggggagccttcgcaggctgacgtgcagccgttaggccctagtagtctggctgtccacacaatactacctcaggagtctccagctcttccgacaagcctcccgtcttccctcgtgccgcccgtgactgccgcccaattcctgactccaccaagtcagcattcttattcgagccctgtagacaacaccccttcccaccagctccaggtccccgagcacccattcctcactcccagtcctgaaagccccgaccaatggagctcctcctcaccccattcgaacgtgagcgattggagcgaaggcgtatccagtccacctacttctatgcagagtcagatcgctagaatcccagaagccttcaagtag

SEQ ID NO: 16366 - DNA, 6012 bp, Artificial Sequence
  Description of Artificial Sequence: Synthetic coding sequence
atgcagccaccgtctctgctgttactgttactcctgttactgctactgtgtgtttcagtggtgaggccaagaggattgctgtgcggctctttcccggagccctgtgcaaacggaggtacttgtctctctttatctttgggccagggcacctgccaatgcgcccccggcttcctgggcgagacatgccaattcccggatccttgccagaatgctcagctgtgccaaaatggggggagttgtcaagcattgctgcctgctcccctcggactgccatcttctccttcacccttaaccccttcgttcctctgcacgtgtttgccaggattcacaggcgaacgctgtcaggcaaagctggaagacccctgccccccatcattttgtagcaagcggggaagatgtcatatccaggcatctggaagaccacagtgtagctgcatgccagggtggacaggtgagcaatgccagcttcgggacttctgctccgccaatccctgtgtcaatggtggtgtgtgtctggctacataccctcagattcagtgtcattgtcctcctggttttgaaggccacgcttgcgagcgggacgtgaatgaatgtttccaggaccccggcccctgtcctaaagggacgagctgccacaatacattgggctcattccagtgtctgtgcccggtaggccaggagggccctagatgtgaactcagggccggtccatgtccgcccaggggctgttccaacggcggcacttgtcagctcatgcctgaaaaggacagcacatttcacctttgcctgtgtccacctggattcatcggacccgactgtgaggtaaacccagacaactgtgtatcccatcagtgccagaatggaggcacatgtcaggatggcctggacacctacacgtgtctatgcccagagacatggaccgggtgggactgtagtgaagacgtggacgagtgcgagactcaagggccgccccactgtcgcaatggaggaacttgccagaatagcgctggctcttttcattgcgtttgcgtgtccggatggggcgggacctcatgcgaggaaaaccttgatgactgcatcgccgccacttgcgcacctggtagtacttgcatcgatagggtgggatcatttagctgtctttgccctcctggtcgcacaggcctactgtgtcatttggaggacatgtgtctttcacaaccttgccacggcgatgctcaatgtagcactaacccacttacagggtctactctgtgcttgtgtcagccaggatactcgggacccacctgccatcaggacttggacgagtgtttaatggcccagcagggaccgagtccctgtgaacatggcggaagctgtcttaacaccccaggatcgtttaactgcctgtgccctccagggtatactggctcccgttgcgaggctgatcataacgaatgtctgagccagccatgtcatcccggctctacgtgcctggacctcctagcaacatttcactgcctctgcccccccggtctagagggacaactatgtgaggtcgaaaccaatgagtgtgcgagcgctccatgcttaaatcatgctgactgccatgatctactaaatgggtttcagtgcatttgccttccgggattctctgggactagatgtgaggaagatatcgacgaatgcagatctagtccatgcgccaatgggggtcagtgccaggatcagcctggagcgtttcattgtaagtgcttgcctggattcgaaggaccaaggtgtcagaccgaggtggacgaatgtctgtccgatccctgccccgtcggtgcttcctgcctggatctccccggcgcttttttttgcctttgccctagcggatttacaggtcagctgtgcgaagtccccctttgtgcacccaacctctgccagcctaagcagatatgtaaggatcagaaggacaaggctaattgcttgtgccctgatggcagccctggatgcgccccacccgaagataactgcacctgccatcacggacactgtcagcgctctagctgtgtgtgtgatgtgggctggacaggcccagaatgcgaggctgagcttggcgggtgtattagtgccccttgtgcccatgggggtacctgctatcctcaaccaagcggttacaattgtacctgcccgactgggtataccggcccaacttgctcggaagagatgacagcttgccactctggaccttgtttgaatggaggttcttgtaatcctagccctggagggtattattgtacctgccctccatcccacactggaccccagtgtcaaacctctacagactactgtgtctccgctccctgctttaacggcggcacatgcgtgaataggcccggtacttttagttgcttatgcgctatgggctttcaggggccccgctgcgagggcaagctccgacccagctgtgcggatagcccttgtaggaatcgggccacatgtcaggactcaccccaggggcctaggtgtttgtgtcctacggtgtatacagggggaagctgtcaaactttgatggatctgtgcgcacaaaaaccctgccccagaaattcccattgcttacagaccggtccaagttttcactgtctgtgtttgcagggatggaccggccctctgtgtaatctgccactgtctagctgccagaaggccgccctgtcccaaggtatcgacgtgagttccctgtgccacaatggagggttgtgtgtcgattctggtccaagttacttctgccattgtccgcccggatttcagggctccctatgccaggaccatgtaaacccctgcgagagcagaccatgtcagaatggcgctacctgcatggcgcagccatctggttacctctgtcagtgtgctccaggatacgacggccagaattgctcgaaggaactggacgcctgccaatcacaaccttgtcacaatcatggcacatgtacccccaaacctggaggatttcattgcgcctgcccccccggattcgttggcctccgctgcgagggcgatgtcgatgaatgcctggaccagccttgtcaccccaccggaactgctgcatgccactccctggcaaacgctttttattgccagtgcttgcctggccacacggggcagtggtgcgaggtggaaattgatccttgtcatagccagccttgcttccacggcggcacctgcgaagcaacagccggatcgccactcggcttcatttgccattgcccaaaagggttcgaaggacccacttgctcacatcgagccccgagctgtggtttccaccattgccatcacggcggactgtgccttcctagtcctaaaccagggtttcccccgcgatgcgcatgtctgagcggctatgggggcccggattgcttgacacccccggccccgaaaggctgtggccctccatcaccatgcctgtacaacgggagttgtagtgagacgaccggtttagggggcccgggattccggtgctcttgtccccacagttctccgggaccaaggtgtcagaagcccggagcgaagggttgtgaggggcgttctggagatggcgcatgtgatgccggctgctccggacctggcggaaattgggacggaggcgactgctcacttggggtgcctgatccttggaaaggctgccctagccatagcaggtgctggctactgttcagagatggtcaatgtcatccccaatgcgacagcgaggagtgcttatttgatggatatgactgcgagaccccgccagcttgtactcccgcctatgaccagtactgccacgatcacttccacaatggccattgcgaaaaagggtgcaatactgctgagtgcgggtgggatggaggcgactgtcgtccggaagacggggacccagagtgggggccatctttagcactcctcgtggtgctgtcccccccagcactcgatcagcagttattcgccctcgccagagtgctgtcactcacactacgcgtcggactgtgggtcaggaaagaccgggacggaagagatatggtttacccatatcctggagcacgcgccgaagagaagctggggggtaccagagatcctacttaccaggagagggctgctcctcaaacccagcctttaggcaaagagactgacagcctgtccgccggatttgtcgtggtgatgggagttgacctgagccgatgtggtcctgaccaccccgcgtcacggtgtccatgggatcctggactactgctcagatttctcgctgcaatggcagccgtgggggcgctagaacctcttctgcccggccccctcctggctgtacatccccatgcagggacagcaccaccggccaatcagctgccttggcctgtgttgtgctctcccgtggctggcgtaatccttctggccctcggggccctcctagtgctgcaacttataagacggcggcggcgagagcacggagctctgtggctgcccccaggctttaccagaaggcctcgtactcagtcagcaccgcataggcgtcgaccgcctctaggtgaagacagcataggactaaaggcacttaagccaaaggcagaggtggatgaggacggggttgtgatgtgcagtggaccagaggagggcgaagaggtgggacaagctgaggagactggacccccctcaacatgccaattatggagcctgagcggcggatgcggtgccttaccacaggctgctatgttaactcctccacaggagtctgaaatggaggcccccgacctggacacccgcggcccggacggagttacccctttgatgtccgcagtttgttgcggggaggtgcagtcagggactttccagggcgcttggctgggatgtcccgagccatgggaacctctactcgatggaggagcctgtccgcaggcacacaccgtcggcacaggagagacacccctgcacttggccgcccgtttttcccgtccaacagctgctcggcggctgctggaagctggcgctaatcccaatcagcccgaccgggccgggagaactccactgcatgcggctgtcgcagcggacgcaagagaggtgtgccaactcctgttgaggagcagacaaacagcggtagacgccagaacagaggacggtacaacaccactgatgctagccgctagactggcagtagaagatctggttgaggagcttatcgcggctcaggcggacgtgggagctagagataagtggggtaaaacagctttgcattgggctgcggccgtcaataatgcgagggccgccaggtccctgctgcaggccggtgcggacaaagatgcccaagacaaccgggagcagaccccactgttcctcgcggcccgagagggggccgtggaggtcgcccagctgttgttaggtctgggggcagctcgtgagctacgtgatcaggccggtctcgctcctgctgacgtggcgcaccagcgcaatcactgggatttgttaaccctgctcgaaggcgccgggccccccgaagcgcgacacaaggccacccccggcagggaggcaggcccctttcctcgagctaggactgtctcagttagcgttccgccacatggaggtggcgctctgcctagatgtcggactttgtcggccggcgccggacctcgtggcggcggcgcatgtttacaggcccgcacctggtccgtggacctcgctgcacgcggtggtggagcctactcacattgtcgctcgcttagcggcgtcggtgctgggggcggacctacccctcgaggaaggaggttcagtgcaggtatgagaggtccgagacctaatcccgccatcatgaggggcagatacggcgtcgccgctggacgggggggacgggtgagtactgacgattggccttgcgattgggtcgcactgggagcttgtggcagcgcctcaaacattccgatccctcccccctgcctcaccccaagccccgagcgtgggtccccacaactggactgtggaccgcctgctctccaggagatgcccatcaaccagggaggagagggcaagaagtag

SEQ ID NO: 16367 - DNA, 561 bp, Artificial Sequence
  Description of Artificial Sequence: Synthetic coding sequence
atgtccgctgtctgctgtggagaagtacagtctggaacctttcagggtgcttggttgggttgcccagagccatgggagcctttgctggatggcggggcatgtcctcaggcccacactgttggaaccggcgagacaccactacaccttgctgcacgcttttccaggcctaccgcggcccggcgcttactggaagcaggagccaatccaaaccagcctgaccgggccggcagaacccctttgcacgcagctgtggcagcagacgctagggaggtgtgtcaactgctgttaagaagcagacagaccgccgttgatgcgagaacagaggacggcacaacgccacttatgctggccgcccgtctggcagtggaagacctggtggaggagttgatcgcagcccaggcagacgttggagcccgcgacaaatggggcgccgatgctgcaataccaggtggtgctggtcgcagcggggggtcaagccccgcaacggccggcgccggcggctctccccgggctgcaggtccaggttgggcctcggcggggggtcgtagatcacccacttag

SEQ ID NO: 16368 - DNA, 1734 bp, Artificial Sequence
  Description of Artificial Sequence: Synthetic coding sequence
atgcactggctcagaaaggtgcagggattgtgtactctgtgggggactcagatgtccagcaggacactgtacatcaactcacgccaactagtctccctccaatggggtcatcaggaggtgcccgccaagttcaatttcgctagcgatgtgctggaccactgggccgacatggaaaaggcaggtaaaaggctgccgtccccagccttgtggtgggttaacggaaagggcaaggaacttatgtggaactttagggaactctcagaaaactcgcaacaggcagctaacgtactaagcggagcatgtggcctccagaggggtgatcgcgtggctgtggtgttgccaagggtgccagagtggtggctggtcatcctcgggtgcatcagagctggcctaatcttcatgcccggaaccatacagatgaagtctaccgatattctgtacagactccagatgtccaaagcgaaagctatcgtggcaggcgacgaggtgatacaggaagtggacaccgtcgcatctgaatgcccctcccttcgtattaagctgttggtttctgagaagagctgtgatggctggctcaatttcaagaagctgctgaatgaagcctctactactcatcattgcgttgagactggatcacaagaggcatctgccatttatttcacgtccgggacaagtggattgcccaaaatggctgaacattcctactcatcactggggctgaaggccaaaatggatgcaggctggacaggcctgcaggcaagcgacatcatgtggaccatcagtgacaccggctggattttaaacattctgtgctctctgatggaaccttgggctctgggcgcttgcaccttcgtgcacctcctaccgaagtttgatccgcttgttatactgaaaacccttagctcgtacccgatcaaatccatgatgggtgctcccatagtttaccgtatgctgcttcaacaggatctcagttcctacaagttcccacacctccaaaactgtgtcaccgtcggtgaatcgctcctccccgagaccttggagaattggagggcacaaaccggcctggatatcagggagagctatggccaaacagaaaccggactgacgtgcatggtatccaaaacaatgaaaattaaaccaggctacatgggtaccgcggcttcctgttacgatgtacaaatcatagatgataagggcaatgtactgccccctggaaccgagggtgacattggtattcgggtaaagccgatcagacctatcgggatattttccggttacgttgacaaccctgacaaaacagctgctaatatccgcggggatttctggctgctgggcgaccgcggaattaaggacgaagacgggtattttcagtttatggggcgtgctaatgacatcatcaactctagcggctaccggataggcccctctgaggtggagaatgccctgatggagcaccccgccgtagtcgagaccgctgtaatctcaagccctgatccggttcgaggcgaagttgtgaaggctttcgtcgtgctcgcctcccaatttctgagtcacgatcccgaacagttgacaaaggaactgcagcagcatgtcaagagcgtgacagcaccttataaatatccacggaagatcgaatttgtgcttaatctgcctaagaccgtgaccgggaaaatccagagagctaagctccgcgataaggagtggaagatgtctggcaaggctcgagcccaatag

SEQ ID NO: 16369 - DNA, 4368 bp, Artificial Sequence
  Description of Artificial Sequence: Synthetic coding sequence
atgggcggcgcatgcagtagctttacaacctcatcctctcccacgatttatagcacgtccgtcaccgatagtaaagccatgcaagtggaatcttgctctagcgccgtaggcgtctccaaccggggggtgagcgaaaaacagctcacatcaaacaccgtccagcaacatccgtccactccgaagcgccacacagtcttgtatatcagccctcccccagaggatcttctagataatagccgtatgtcctgtcaggacgaggggtgtgggctggagtctgagcagtcttgttccatgtggatggaagattcacccagtaatttctccaacatgagcacgtcatcctataacgataacacagaagtgccaagaaagtccaggaagaggaaccctaaacagagacctggagtcaagaggcgagactgtgaggagtctaacatggatattttcgatgccgatagcgccaaggctcctcattacgtcctctcacaactgactacagacaataaaggaaactcaaaagctggcaacgggacccttgagaaccagaaaggcaccggggtgaaaaagtctccaatgttgtgtggccagtatcctgttaaaagtgagggcaaggaacttaaaattgtagtgcaaccagagacacagcaccgcgcacgttatctcaccgaagggtcacgaggttcagtgaaggatcgaacacagcaggggttccctactgtaaagctggagggacataacgaacccgttgtcttacaggtctttgtgggaaacgactccgggcgggttaagcctcacggtttttatcaagcatgcagagtaaccgggaggaataccacaccatgtaaggaagtggacattgaaggaaccacagtgattgaggtggggcttgaccctagcaacaatatgacattggctgtggactgtgtcgggattttgaaactacggaacgcagatgttgaagcaagaatcgggatcgccggcagtaagaagaagagcacgagggcgagattggtgttcagagttaatatcatgcggaaagatggtagtactctgactctacagacaccctccagtcctatcctttgcacccagcctgccggtgttcccgagattcttaaaaaaagtctccattcctgctccgtcaaaggagaagaggaagtgttcctcatcggcaaaaatttcctgaaaggcaccaaggtcatctttcaagagaatgtatccgacgagaatagctggaaaagtgaggctgagatcgatatggagctgtttcatcagaaccaccttattgtaaaagttccaccgtaccacgatcaacacatcacactgcccgtttctgtgggcatttatgtagtgaccaatgctggtcgcagtcatgatgtccaaccattcacgtacacacccgaccccgctgcagcaggtgccctaaacgtaaatgtgaagaaggagatatctagtccagccaggccatgttcttttgaggaggccatgaaggctatgaagactaccggatgcaaccttgacaaggtcaacattattcctaacgccctcatgacaccgctgatcccttcctccatgatcaagtccgaggatgtaactcctatggaggtgaccgcggaaaagcgatcttctactatcttcaaaaccaccaagagtgtcggatcaacacaacagacacttgaaaatattagcaacatagctggaaacggctcattctcttccccatcttcaagtcatttgccttccgagaacgagaagcagcagcagattcaaccaaaagcctacaaccctgaaacgctgacaaccatacaaacccaagacatctcccagcctggcacctttccggcggtctcggccagtagccagctacctaattcagacgccctgctccagcaggcaacccaatttcaaaccagagagacacaatcacgggaaatcctgcagagtgatgggaccgtggtgaatctcagccaactaaccgaggcatcacaacagcagcagcagtccccattgcaagaacaagcccaaacacttcagcaacagatcagcagcaacatcttccccagtccaaacagcgtatctcagctccagaacaccatccagcagttgcaggccggatcatttactggtagtacagccagcgggtccagtggttccgtcgacttagtgcagcaggtgctcgaggctcaacagcagctgagcagcgtgttgttctctgctcccgacggcaatgagaacgtccaagagcagctatccgctgacatattccaacaggtcagtcaaatccagagtggcgtcagtcccggcatgttcagcagcaccgagcctacagtgcacacacgtcctgataatctgctgcccgggcgagccgagagcgtacacccccaaagcgagaatacattgagcaatcagcagcagcagcagcagcagcagcagcaggtgatggagtcctctgccgccatggtcatggagatgcaacagtcaatctgtcaagccgctgctcagattcagtcagaactgtttcccagtacagcctcagctaacggaaatttgcagcaaagtcctgtttaccagcaaactagccatatgatgtcggcactgagtacaaacgaggacatgcagatgcagtgtgagctattttcctctccacctgcggtctccggcaatgagactagtacgaccaccactcaacaggtcgccaccccggggacaacaatgtttcagacatcttctagcggtgatggtgaagaaactggcacccaggcaaaacagatccaaaatagtgtgttccagacaatggttcaaatgcagcattctggggacaatcagccacaagtcaacttgttctcctctaccaagtccatgatgagtgtgcagaactccggtacacagcagcaggggaacggtttgtttcagcaaggcaatgagatgatgagtctgcagtccggaaacttcctccagcagagtagccatagccaggcccagctgttccacccacagaatcctattgcagacgcgcagaatttatctcaggagacacaggggtctctcttccatagtcccaaccctatagttcactctcaaacctctacaacttctagtgaacagatgcaaccccctatgttccactctcaatctacgatcgccgtactgcaaggttctagtgttcctcaggatcagcagagcactaacatcttcttgagccagtcacctatgaataacttgcaaacaaatacagtagctcaggaagcatttttcgccgcaccgaactcaatctcgccacttcaatcaactagtaacagcgagcaacaggctgctttccagcagcaggcaccaatctctcatattcagacacctatgttgtcacaagagcaagctcaaccccctcaacagggattgtttcaaccacaggtcgccctgggaagtctgccgcctaatccaatgccacaaagccagcaggggaccatgtttcagagccagcacagcattgtggcgatgcagtccaattctcccagccaggagcagcaacagcaacagcagcagcagcaacagcagcagcagcagcagcagcaatccatccttttttccaatcaaaacaccatggccactatggcttccccaaagcagcctcctcccaacatgatcttcaatcccaatcaaaatcccatggccaatcaggagcagcagaatcagtcgatatttcatcagcaaagtaacatggctccaatgaaccaggaacagcagcctatgcagtttcagtctcagagcaccgtgtcctcgctccagaacccgggcccaacacaaagcgaatcttcccaaactccactcttccacagctcgccgcagatacaactagtgcagggctctcccagctcccaggaacagcaggtaaccctttttctgagcccagccagtatgtcagccttgcagaccagtataaatcagcaggatatgcagcagagtcctttgtactcacctcagaataacatgcctggcatccaaggcgctacctccagtccccagcctcaggccacactatttcataacaccgctggaggcactatgaaccaactccagaactccccaggctcttctcaacagacgtctgggatgttccttttcggaattcagaacaattgttcccaactccttaccagcggacccgcaacactgcccgatcagttaatggcaatctcccagccgggacagccccagaatgagggccagcctcccgtcacaaccttgctcagtcagcagatgccagaaaacagccccctggcttcaagcatcaacactaatcaaaatatcgagaagattgacctcctcgtgagtctccaaaaccaggggaacaacctaacgggctccttttag

SEQ ID NO: 16370 - DNA, 4647 bp, Artificial Sequence
  Description of Artificial Sequence: Synthetic coding sequence
atgccctcggactttatcagcctgctctcagcggacctggatctggaaagccctaagtctctttatagcagagattcactcaagttgcacccatcacaaaattttcatcgcgcagggctgctcgaggaatcagtgtatgatctgttacccaaggaattacagttacccccatctcgagagacttctgttgcatccatgagccagacgagtggaggagaagccgggtctcctccacccgctgtagtcgctgcggacgcctcttctgccccatcttccagctccatgggaggcgcctgcagcagttttacgaccagttctagtcctactatatattctacgtcagtgacggattctaaagcaatgcaggtggagtcctgcagctcggcagtgggggtcagcaatcgaggggtgtcggaaaaacagctcacctccaatacagtgcagcagcaccctagcaccccaaaacggcacacagtgctgtatatttccccccctccagaggacctgctggataattcacggatgtcgtgccaggatgagggctgtggcctcgaatctgagcagagttgtagcatgtggatggaagactctcctagtaatttcagtaacatgagcacttcctcttataacgacaacacagaggttcctcgaaagtcaaggaaaagaaatcctaaacaaagacctggcgtgaaaaggagggattgcgaggaatccaacatggatatcttcgatgcagactctgctaaggccccacactatgtcctgtctcagctgacgactgataacaagggaaattctaaagctggaaatggcacactggaaaaccagaaagggactggcgtcaagaaatccccaatgttgtgtggacagtaccccgtcaaaagcgagggcaaggaactgaaaatcgttgtgcagccagaaacgcagcaccgtgctcgatatctcactgaggggagtcggggttcggtaaaggacaggacgcagcaggggttccccaccgtgaagcttgagggccataatgaaccggtagtcctccaggtatttgtggggaacgacagcggaagagttaaaccacatggcttttaccaggcatgcagagtcacaggtcgaaatacaactccctgcaaggaggttgacatcgagggcactactgtgatcgaagtgggcctggaccctagcaataacatgactctggctgtggactgcgtcggaatccttaaactcaggaatgcggacgtcgaagctaggatcggtatagcaggctctaagaaaaaatcaactagagctcgcctggtctttcgcgtcaatattatgagaaaagatggtagcaccttgaccctgcagaccccttcatctccaattctctgtacccaacccgccggcgtcccggagattctgaaaaagtccctccactcttgttctgtgaagggtgaagaggaggtgtttctgatcggaaagaactttctgaaggggaccaaggtaatttttcaggaaaacgtgtcggatgaaaattcttggaagtctgaagccgaaattgacatggaattgtttcatcaaaatcaccttatagtcaaggtgccaccctatcatgatcagcacataaccctgccggtctcagtgggaatctacgtggtcaccaacgccgggagatcacatgatgttcagcctttcacttatacaccagaccccgctgcaggtgccttgaacgtcaacgtgaagaaagaaatttctagtccagctcgaccgtgttcctttgaggaagctatgaaagcaatgaaaaccacgggctgtaacctcgacaaggttaacatcatccccaatgctctgatgacgccactaatcccatcctctatgatcaagtctgaagacgttacccctatggaggtcaccgccgagaaaaggtcgtctacaatctttaaaactacaaagtctgtaggctctacacagcagacactggaaaacattagcaacatagccggaaacggctcattcagctcaccatcctccagccatctgccaagcgaaaatgagaagcaacagcagattcaacccaaagcctacaacccagagactctaactaccatccagacccaggacatttcacagcctggaacatttcctgctgtgagtgcctcctctcagctgcccaacagcgatgcccttctgcagcaagctacccagttccagacgcgggaaacccagtcccgggagattctccagtccgatggcactgtggtgaatttgtcacagctcactgaggcatctcagcagcagcaacagtcccccctgcaggaacaagcccagaccctccagcagcagatctcctcaaacattttcccttctcccaatagcgttagccaattgcagaacaccatccagcagctccaggcaggctctttcaccgggagcaccgcctcagggtcaagcggatccgttgatctggtgcagcaggtgctggaggcccaacagcagctgagttctgtgctattcagtgcccctgacggaaacgaaaatgtgcaggagcaactcagtgcagatatcttccaacaggtttcgcaaatccaatccggagtgtcgcctggcatgttttcttcaaccgaacctactgtccatacacgtccagataacctcctcccaggtagagccgaatcagtgcatcctcagtctgagaataccctaagtaaccagcagcaacagcaacaacagcagcaacaggtgatggagagcagcgctgccatggtgatggagatgcagcagtccatctgccaggccgcagcccagattcagagcgaactttttcctagcactgcctcggccaacggaaatctgcaacaatctcctgtctatcaacaaacgtctcacatgatgtctgccctcagtaccaatgaggatatgcaaatgcagtgtgaattatttagcagccccccagctgtcagtggcaacgagaccagcactaccaccacccagcaggtggcgacaccgggaacaacgatgtttcagaccagttctagcggcgatggtgaggaaactgggacacaggcaaagcagattcagaacagcgtgttccaaaccatggtgcagatgcagcatagtggggataaccagcctcaggtgaatcttttctcttccacaaagtctatgatgtctgttcaaaactcaggcacccagcaacagggcaacgggttgttccagcagggcaacgagatgatgagcctccaaagtggcaattttctgcagcaatcatcccactcacaggcccaattgttccacccacaaaaccctatagccgacgcccaaaacctgtcccaggagacccagggcagtctatttcattcccccaatcccatagttcactcccagacgagcaccaccagctctgagcaaatgcagcctcctatgttccattcccagagcactatcgctgtcttgcaggggtcatcagtaccacaagaccagcaatcaaccaatatcttcctgagtcagagccctatgaataacctgcagacaaatactgtagcccaggaggctttttttgccgctccaaattccatttctccactgcaatccacatccaattcagagcagcaagccgctttccagcagcaagccccaatctcccacatccaaacgccaatgctttcccaggagcaggctcagccgcctcagcaggggctgttccagccacaggtagcactcggttcactcccaccaaatcctatgccacaatcacagcaaggtaccatgtttcagtctcagcactcaattgtggctatgcagagcaactcgccctcccaggagcagcaacaacagcagcaacaacagcagcaacagcagcagcaacagcaacagtcgattttgttcagtaaccagaacaccatggcaaccatggcatcccccaagcagcccccacccaatatgattttcaaccccaatcagaatccaatggccaatcaggagcagcagaaccagagcattttccaccagcagtcaaacatggctcctatgaatcaggagcagcaacctatgcagttccagtctcagagcactgtgtcctctctccagaacccaggtccaactcagagcgagtcctcacaaactccgctctttcactcatctccacagatccagctggtgcagggctcaccctcaagccaggagcaacaggtcacactgtttttatcccctgcctcaatgagtgctctccagacttcaatcaatcagcaagatatgcagcagtcgccgctatacagcccccagaataatatgcctggcatccagggcgcgaccagctccccccagccccaggccaccctgttccataataccgcgggtggtaccatgaaccaacttcagaacagtccaggctcaagtcaacagaccagtggcatgtttctgtttggaatccaaaataactgctctcaactcctgacttccgggcccgctaccctccctgaccagctcatggctatcagtcaacctggccagcctcaaaatgaaggacagcccccagtgaccactctgctgtcacagcagatgcccgaaaattccccactcgctagcagcattaatactaatcagaacatcgaaaaaattgacctgttggtgtctctccagaaccaggggaacaatttaacggggtccttttag

SEQ ID NO: 16371 - DNA, 4368 bp, Artificial Sequence
  Description of Artificial Sequence: Synthetic coding sequence
atgggtggtgcctgctcttcttttacgacatcgagcagtcctacgatctactcaacgtccgttaccgactccaaggcaatgcaggttgagtcttgctccagtgctgtcggggtctcaaataggggtgtatctgagaagcaactcacttctaacacggtccaacaacacccgtctactcctaaaagacatacagtactgtatatctcccctccacctgaggatctcttggacaactcaagaatgagttgtcaggatgagggctgcggactggagtctgagcaaagttgctcgatgtggatggaggactccccaagcaactttagcaacatgtccacctcatcttataatgataataccgaggtgccccgcaaaagcaggaagagaaaccccaagcagaggccgggggttaagagacgagattgcgaagaaagtaacatggacatttttgacgctgattcagcaaaagcaccacactatgtgctatctcagcttaccactgataataaggggaactcaaaggccggcaatggcactctggagaatcaaaagggaacgggggtaaaaaaatcccctatgctgtgcggacagtaccctgtgaagagcgaagggaaagaactaaagatcgtcgtccagcccgagacccagcacagagcccgttatctcacagaggggtcccggggctcagtcaaagatagaacgcagcaggggtttcccacagtgaaattggaggggcacaacgagcccgttgtgctccaggtcttcgtcggaaatgactccggccgtgtcaaaccccacggcttctaccaggcctgtagagtgactggccggaataccaccccttgtaaagaggtagatatcgagggcactaccgtgatagaagtaggtcttgacccaagcaacaatatgaccctggccgtcgattgcgtaggaatcctcaaattgcgcaacgcagatgtcgaggctcggatagggattgccgggtccaagaaaaagagcacaagagcccgactagtgtttagagtgaacattatgcgcaaggacggatccacacttactcttcagaccccaagcagccccatcttatgcacgcaacccgccggggtccctgagatcctcaagaagtctctacacagctgttcagtcaagggtgaggaagaagtcttccttatcggtaagaattttttaaaaggtacgaaagtaatatttcaagagaatgtgagcgacgaaaactcctggaaatctgaggccgagattgatatggagctgttccaccaaaatcatctgatcgtgaaggttccaccctaccatgatcagcacattacgctgcctgtgtcagtgggtatttacgttgtgaccaatgccggacgcagccatgacgtccagccattcacttacacaccagaccccgcagcggccggagcccttaacgtcaatgtcaaaaaagaaattagcagccccgccaggccttgttctttcgaagaagcgatgaaggctatgaaaacaactggctgcaacctcgacaaagtgaacattatcccgaacgcgcttatgacccccttaatcccatcaagcatgattaaatctgaagacgtgacccccatggaggttaccgccgagaagcgatctagcaccatcttcaagaccaccaagtcggttggcagcacgcagcagaccctcgagaacatcagcaatatcgccggaaacgggtcttttagcagtccctcttcctctcatctgccgtccgagaacgagaagcaacagcagatacagcctaaggcctacaatcccgagaccctgacaactattcaaacccaggatataagtcaaccaggtacattcccggctgtgtcagcgagcagtcagttgccaaactccgatgccctgctgcaacaggcgacacaatttcagactcgagagactcaatccagagagattctgcagagtgacggcacagtcgtgaacctgtcccagctcacggaggctagtcagcagcaacagcagtcccccttacaagaacaggcccagacattacagcaacaaataagctcaaatatcttccctagccctaacagcgtgtctcagctgcagaacacaattcaacagctccaagcaggctccttcacaggctccactgcgtccgggagttcaggctcagtcgacttggtgcaacaggtcctcgaagcccagcagcaactctcgtcagtgcttttcagtgctcctgatggaaatgagaacgtgcaggaacagttgtccgccgacatcttccaacaggtgtctcagattcagtcaggagtcagtccaggcatgttttctagtaccgagcccaccgtacacacgcgtcctgacaacctgctgcctgggcgcgcagagagcgtgcatccccagtcggaaaataccctgagtaatcagcagcagcagcaacagcagcagcaacaagtaatggagtcatcagccgccatggttatggaaatgcaacagagcatctgtcaggccgccgcacagatccaaagcgaactttttccctcaacggccagcgctaatggaaacctgcagcagtcgccagtgtatcaacaaacatctcatatgatgagcgctctttctaccaatgaagacatgcagatgcagtgcgaattgtttagctcacctccagctgtgagcggtaacgaaactagtacgactactacacagcaagtcgccacccccggcactacaatgtttcaaacctctagttctggcgatggggaagaaactggaacccaggccaagcaaattcagaatagtgtgtttcaaaccatggttcagatgcagcacagcggcgacaaccagccccaggtcaacctgttctcaagcaccaaatccatgatgtccgttcagaactccggaacccagcaacagggaaacgggctgtttcagcaagggaatgagatgatgtcactccaatcaggcaacttcctccagcaaagtagccacagccaggcccagctgttccatccacagaacccgatcgcagacgcacagaacctttcccaggagacccagggaagcttattccactcacctaatcctatcgtgcattcacagactagtacgacttccagcgagcagatgcagccacccatgtttcatagccagagcaccatcgcggtgctgcaggggtcttccgtcccccaggatcaacaaagtacaaatatctttctgtctcagagtccaatgaacaacctacagaccaataccgttgcccaggaggcgttcttcgccgcacctaatagcatttctcccctgcaatccacatctaattcagagcaacaggccgcatttcaacagcaagcccctataagccacatacagactccaatgctgtcccaggaacaggctcagcctccccagcaaggattgttccagccacaggtggcattgggatcacttccccctaaccctatgccacagtcacagcaagggaccatgttccaatctcaacattccatcgtggcaatgcagagtaacagcccaagccaggagcaacagcagcagcagcagcagcagcagcagcagcagcagcagcagcagcaaagcattctcttcagcaaccaaaacaccatggcgactatggcatcgcctaaacaaccccccccaaacatgattttcaacccaaatcaaaacccaatggccaatcaggagcagcagaatcagagtatctttcatcagcaatcaaatatggcacccatgaatcaggagcagcaacccatgcaattccaaagtcaaagcacagtctcctccctgcagaaccccggtccaacacaatccgagagctcccaaacccctctgttccacagcagcccacagatacaactagtacaaggttctccgtccagccaggaacaacaggtaaccctgtttctctctcccgcgagtatgagtgccctgcagacatctatcaatcaacaggacatgcagcagtcccccctatacagcccccaaaacaacatgcctggaatccagggcgcaacaagctcacctcaaccgcaagcaacgctgttccacaacacagctggtggtaccatgaaccaactgcagaactctcctgggagctctcagcagacgagcggaatgtttctgttcggcatccaaaacaactgctctcaactgctaaccagcggaccagcaactcttccagaccagctgatggctatctcacagcctggccagccccaaaatgaaggccaacccccggtgactacacttctttcacagcagatgccggagaattctcctctcgcttcatcaatcaatactaaccagaacattgagaagatagacctgctggtctccctccaaaatcaaggaaacaatttgactggatccttctag

SEQ ID NO: 16372 - DNA, 4596 bp, Artificial Sequence
  Description of Artificial Sequence: Synthetic coding sequence
atgcctagcgatttcatctccctgctgagcgccgatttagacctggaatctcccaagagtctgtactcacgggagagtgtatacgacttgttgcccaaggagctgcagttgcctccaagccgcgagacatccgtcgcatctatgagccaaactagcggcggagaagcggggtctccaccccctgcagttgtcgccgccgacgcgagtagcgccccaagctcctcctcaatgggcggggcgtgttcctcttttacaaccagcagttcccccacgatttactctacttccgtcacagacagtaaggctatgcaagtggagagctgttcctcagctgtgggcgtgagtaatcgcggtgtgagtgaaaaacagctgacatcaaacactgtgcaacagcacccctccacccctaagcgacacactgtcctatatatcagtccgcccccagaggatttactggataatagcagaatgtcttgtcaggatgaaggctgtgggctggagagtgagcagagctgcagcatgtggatggaggattctccatcaaactttagtaacatgtccacttcatcttacaacgataacaccgaagtgcctcggaagagcaggaaacggaaccccaagcaacgtccaggggtcaaaagacgggactgcgaagagtctaacatggatatatttgacgctgactcggcaaaggcaccgcactacgtactctcccaactgactacagataacaaaggcaacagtaaagccggcaatgggacacttgaaaaccagaaggggacaggtgtgaagaagtcgcccatgttgtgcggccaataccctgtgaagtccgagggaaaagagctaaaaattgtagtacagcccgagacccagcacagggcccgctacttaactgaaggtagtcggggatcagttaaggacagaacacaacaaggatttccaaccgtgaagctcgagggccataatgagcctgtggtgctgcaagtttttgtcggcaatgatagcggcagagtgaaacctcatgggttttaccaggcttgccgtgtgacagggaggaacacgacaccatgtaaagaagtggacattgagggcaccactgtcatcgaagtaggactcgacccctcgaataacatgacactggccgtggactgtgtgggaattctcaagctccgaaacgctgacgttgaagctcggatcggcatcgctgggagcaagaagaagtctactagagcaagattggtattccgcgtcaacataatgcggaaagacggaagtactctgactttgcagacaccatctagcccaatcttatgtacccagcctgctggagtgcctgagattcttaagaaatctctacatagctgctcagtcaagggggaggaagaggtcttcctaataggcaaaaacttcctgaagggaaccaaagtgattttccaggagaacgtctctgatgagaatagttggaagtctgaggccgaaatcgacatggagctgttccaccagaatcatcttattgtgaaggtgccaccatatcacgatcagcatatcaccctcccagtctcggtaggcatttatgtagtgaccaatgcagggcggtcacacgacgtccagccctttacatatacccctgatcccgctgccgccggcgctctgaatgtgaacgttaaaaaagaaattagttcccctgccagaccttgctccttcgaagaggctatgaaagccatgaaaactacagggtgcaatctcgataaggtgaatattattcctaacgcacttatgacccctctgatacctagctctatgattaaaagcgaggatgtgacccccatggaagtcacagcagaaaagagatcctccacgatattcaaaactacaaaatccgtcggttcaacccagcaaacactcgagaacattagcaatatcgctggtaatggaagcttttccagccctagttcctcgcatttgccatcagagaacgagaagcagcaacagatacagcccaaggcctataaccccgaaaccttaaccacaatacagacacaggacatctctcagcctgggacgttccctgcagttagcgcatcaagtcagcttccgaactccgacgccctcctgcagcaagcaacccagttccaaaccagagagacgcagtcacgcgaaatattacaaagtgatgggaccgtcgtgaatcttagtcagttgacagaagcatcccagcagcaacagcagtcacccctccaggagcaagctcagacactccagcaacagatttctagcaacatattcccgtccccaaatagtgtctctcaacttcagaatacaatccagcagctgcaggccgggtccttcacgggctccaccgcatctggttcttccggcagtgtggacctcgtccagcaggtgttagaagcccagcagcagctgtccagtgtgttgtttagcgccccggacgggaacgagaacgtccaggagcagctaagtgcagatatctttcagcaggtcagccaaattcaatccggtgtaagcccaggcatgttttcgtcgaccgaacctaccgtgcatacccggcctgataaccttctgccgggtagagcagagtctgtgcatcctcagagtgagaacaccctctccaaccagcagcagcagcagcagcaacagcagcaggtaatggaaagctctgcagccatggtaatggagatgcagcagtcaatctgccaggcggcggctcaaattcaaagcgagttgtttccaagcacggcttcagccaacgggaatctgcaacagtctcctgtgtaccagcaaacaagccacatgatgtctgccttatcgaccaacgaagacatgcaaatgcagtgcgagctttttagcagccctccagcagtttctggcaatgagacgagcactaccactacccagcaggtggcaacacccggaacaaccatgtttcaaaccagcagcagcggagatggcgaagaaacgggaacccaggcaaagcaaatccaaaacagcgtctttcagactatggtgcaaatgcagcactctggggacaatcagcctcaggtcaacttgttcagtagcacgaagagtatgatgagcgtacagaactcgggcactcagcagcagggaaacggactgtttcaacaaggcaacgaaatgatgagtctgcaatccggaaacttcttacagcaaagcagtcactcccaggcccaactgtttcacccgcagaatcctatcgccgatgcacagaatctgtctcaggaaacccaggggtcactgttccacagccccaaccctattgtccattcccaaacctcgaccacctcctcagaacagatgcagccaccgatgtttcactcacaatccacaatagctgtgctgcagggcagttctgtaccgcaagaccaacaatccacgaatattttccttagccagtcacctatgaataaccttcaaactaataccgtggctcaggaagctttttttgcagcccctaactcaattagtccactgcagagcacaagcaatagcgagcaacaagcagcattccagcaacaagcgccaatttcacacattcagacaccaatgctgtctcaggaacaggcccagcccccccagcagggcctttttcaaccacaggtggcccttggatcccttcccccaaatcctatgccccagtctcaacaggggactatgttccagagccaacactctatcgtggccatgcaaagcaatagccctagtcaagagcagcagcagcagcaacagcaacaacagcagcagcagcagcaacagcaacagagcattctgttctccaatcagaatactatggcaaccatggcttcaccaaaacagccgcctcctaatatgattttcaatccgaaccagaaccccatggctaaccaggaacagcaaaatcaatccattttccatcagcagtctaatatggcacccatgaaccaagaacaacagccaatgcagttccagagtcagtctacagtgagtagcctccagaatcctgggcccacccagtcagagtctagccaaaccccacttttccactcctctccacaaatccaactggtacaaggaagcccatcatcgcaagaacagcaggtcacactctttctgagcccagcgagcatgagtgcgttacagacgagcattaatcagcaagatatgcagcagtccccactgtactcaccccaaaacaatatgcctgggattcaaggcgccacctcctctccacagccccaggccacccttttccataatactgccggcggaaccatgaaccagctgcaaaacagccctggatccagccagcagacctctggaatgtttttgtttggtattcaaaataactgttctcagctccttaccagtgggcctgctactctacctgaccaactgatggcgatatcccagccaggccagccacaaaatgaggggcagccacctgttaccactttgctgagtcagcagatgcccgagaattctccccttgcttcttcgattaataccaatcaaaatatagaaaagatcgacctgttggtgtcactccagaaccagggaaataacctgacggggtcattctag

SEQ ID NO: 16373 - DNA, 4368 bp, Artificial Sequence
  Description of Artificial Sequence: Synthetic coding sequence
atgggcggggcatgcagcagctttactacctcttcttccccgaccatatactccacctcagttacagactccaaggctatgcaggttgaatcgtgttccagtgccgtgggagtgtcaaaccgcggcgtctcagagaagcagcttacatcaaacacagttcagcagcatccgagtacacctaagagacacactgtcctgtatataagcccacccccagaggacctgctagataactcccgaatgtcttgtcaagatgaggggtgcggcttggagtcggagcagtcatgttccatgtggatggaagactcgccctccaacttcagcaacatgtctacctctagttacaacgacaatactgaggtgccacggaaatcaagaaaacgaaaccctaaacagcggccgggggtgaagcggcgggactgcgaggagtctaacatggacatcttcgacgccgatagcgccaaagccccccattatgtcttatcacagcttaccactgacaacaagggcaactcgaaggccgggaatggcacattagagaaccagaaggggaccggagtgaaaaaaagtccaatgctgtgcggtcagtacccagtgaaatcggaggggaaagagttgaaaattgtggtacagccagaaacccagcaccgagcgcggtaccttaccgagggaagccgcggaagcgtgaaagacagaactcagcaaggcttcccaactgttaagctggagggccataacgaacccgtggttttgcaagttttcgtgggaaacgactcagggagagtcaagccccacgggttctatcaggcctgcagagtcacgggccgcaacactacaccttgcaaagaggttgacatagaggggaccactgtgatagaagtgggcctggacccctctaacaatatgaccttggccgtcgactgcgtgggtattctgaagctgagaaacgccgacgtggaggcgcggattgggatcgcagggtccaagaagaagagcacacgcgcccgacttgtgtttagggtgaacatcatgcgcaaggatggatccactctgaccttacaaacaccgagctcacccattctctgtacccagcctgcaggagtccccgagattctgaagaaatccctgcactcttgcagcgtgaaaggagaggaagaagtctttctcatcggaaaaaatttcctcaagggcacgaaagtaatctttcaagagaatgtgagtgatgaaaatagttggaagagtgaggcggagatcgatatggaactttttcaccagaatcatcttatagtgaaggttcctccctaccatgaccagcacattacccttccagtgagcgtcgggatctacgtggtgaccaatgcaggccgatcccacgacgtccagccatttacctatacaccagacccagccgctgccggcgcgctgaacgttaatgtaaagaaggagattagttctcccgccagaccctgttcctttgaagaggccatgaaggccatgaaaaccaccggatgcaatttggacaaagtaaacattatcccaaatgccctgatgacccccctgatcccatccagcatgattaagtctgaagacgttactcccatggaagtgacagccgagaagcgctccagcactatatttaagacaactaagtcagtgggcagcacacaacagacactagagaatatatcaaatattgctgggaacggaagctttagtagccccagtagctcacatctgccctcagaaaacgagaagcagcaacagattcagcccaaagcctataaccccgaaaccctgaccaccattcaaacacaggacatctcacagcccggcacttttccggcggtctctgcatcatcccagcttccgaattctgatgcactcctgcagcaggctacccaattccagacccgggagacgcagtctcgagagattctgcaatccgacgggactgtcgtgaacctttctcaacttaccgaagcttctcagcagcagcaacagtctcctttgcaggaacaagcccagacgctccaacaacagattagctcaaatattttcccatcacccaacagtgttagtcagctgcaaaacaccatccaacagctgcaggccgggagtttcaccgggtctactgcatcaggtagctccggttcggtggatcttgtgcagcaggtgctggaagcacagcagcagcttagctcagtgctgtttagcgcgcccgatggtaatgagaatgtccaagaacagttgtcagctgatatctttcaacaagtctcgcaaatccagagcggggtctcacctgggatgttttctagtacagaacccacggtgcatacccggcccgacaacctattgccaggcagggccgaaagcgtgcatcctcagtccgaaaacaccttatcaaatcagcagcagcagcagcagcagcagcagcaggtcatggagtctagcgcagccatggttatggagatgcagcagtcaatttgccaagccgctgctcagattcaaagcgaactgttccctagcacagcctccgccaatggcaaccttcaacagagtccggtgtaccagcagaccagtcatatgatgtccgctttaagcaccaacgaggacatgcaaatgcagtgcgaattattttccagcccccctgccgtttctggcaacgaaacgagcaccacaaccacacagcaggtggccacgcctggcactaccatgtttcagacatcctcatccggcgacggtgaggagaccggcactcaggcaaagcagattcaaaattccgtatttcaaacaatggtccaaatgcagcattccggggataaccagccacaagtcaatcttttttcatcaaccaaaagcatgatgtccgtccaaaatagcggtacccagcaacagggaaacggcttgttccagcagggcaacgaaatgatgtccttacagtctgggaacttcctccagcaaagctcccactctcaggcccagctgttccacccccaaaacccgattgcggacgctcagaacctgtctcaggaaacccagggatcactgtttcacagccctaaccccattgtgcattctcagacgagtacaacctcaagtgagcagatgcaaccccccatgtttcacagccagtccacaatagcagtcctgcaggggtcctccgtgccccaggatcagcagtcaactaatatctttctttcccaaagcccgatgaacaatctccaaacaaacactgttgcccaggaagcattttttgctgcccccaatagcatctctccgctgcaatctacaagcaattcagaacagcaggccgcattccaacaacaagctcccatttctcacatccagacacccatgctgagccaagagcaggcccagccacctcagcaggggctgtttcagccccaggtggcgctgggttcattaccgccaaatccgatgcctcagtcccagcagggaaccatgtttcagtcacagcactctatcgttgccatgcagtccaactcaccgtcccaggagcagcagcaacagcagcagcagcagcagcagcagcagcagcagcagcagcagagtattctcttctccaatcagaacacgatggctaccatggcatcacctaagcagcctccacctaacatgatctttaatccaaatcagaatcccatggcgaatcaggagcagcagaaccagagcatttttcatcagcagagtaatatggcgcctatgaatcaggagcaacagccaatgcaattccaaagtcagtcgacagtgagttcattacagaacccaggccctacgcagtctgaaagcagtcagacccctcttttccatagcagtccccaaatacagcttgtccagggtagtcccagctctcaggagcagcaggtcacactgttcctctcccccgcatctatgagtgccctgcaaactagtatcaaccagcaggatatgcagcagtccccgttatacagtccccagaataatatgcccgggatccaaggcgcaactagttcgcctcagcctcaggccactctgttccataacaccgccggtggtactatgaatcaactgcagaactctcctggatcaagtcaacagacaagcggtatgtttctgttcggcattcagaataattgttcacagctactcacctctggaccagcaaccctgcccgatcagctcatggccatttcacagcctggtcaacctcagaatgagggccagcccccagtcacgacactcctttcccagcagatgcctgaaaacagccccctggctagctccatcaacacgaaccagaacattgaaaaaatcgatcttctcgtgtcactgcagaaccaggggaataacctgaccggcagcttttag

SEQ ID NO: 16374 - DNA, 4647 bp, Artificial Sequence
  Description of Artificial Sequence: Synthetic coding sequence
atgccctcagatttcattagccttctgtcagccgatttggatctggaatctcccaagagcctgtatagcagagattccctcaaactgcacccctcacagaatttccaccgggccggccttttagaggagagcgtgtacgacctgttaccgaaagaattacagctaccccctagccgcgagacctcagtagcatcaatgagccaaacctccggcggtgaagcgggttcccccccacccgccgtggtagctgcggacgcgtcctcagctcccagcagctctagcatgggtggagcctgcagtagcttcactacgtcatcttcacccaccatttacagtacctccgttacagactccaaggctatgcaggtggagtcctgctccagtgcggtgggtgtgtccaacaggggcgtatcggagaaacagctgacctcaaataccgtacagcagcacccttcaacgccaaagcgtcatacagtcctgtatatttcacctcccccagaagacctgcttgataactctaggatgtcgtgccaggacgaggggtgcggcctggaaagcgagcagtcttgttccatgtggatggaggattcccctagcaacttcagcaacatgtcaactagctcctacaacgacaataccgaagtcccacgtaaaagtcgtaagcgaaacccgaagcagagacccggtgtaaagcgcagggactgcgaagaatccaatatggacatttttgacgccgattcagccaaagcaccccattatgtgctgagtcagctgacgactgataacaagggcaactcaaaggctggcaacggaacactggaaaaccagaagggcactggggtcaagaagtcaccgatgttgtgtggccagtacccagttaaaagcgagggcaaggagctgaagatcgttgtgcaacctgaaacacagcacagagccagatacctgacagagggtagtagaggcagcgtgaaagacagaacacagcaggggtttcccaccgttaagctggagggccacaacgaacccgtcgtgttacaggtgtttgtagggaacgattcaggtcgcgttaaaccacatggtttctatcaagcctgccgggtcaccggccgaaatactacgccttgtaaagaagtggatattgaagggacaactgttatcgaagttgggctggaccccagtaacaacatgactctggcagtcgattgcgttggcatcctcaagcttcggaacgccgacgtggaggcccggattgggatcgccggctcaaaaaaaaagtcaacccgcgctcgccttgtatttcgcgtgaatatcatgcgaaaggacggctcaaccctgacgctacagacaccctcaagtccgatcttgtgtacgcagccggctggagtaccagaaatcctgaaaaaaagccttcatagctgtagcgtaaagggggaagaagaggtgtttctgatcggaaagaattttctgaaaggaaccaaagtcatctttcaggagaatgtgagcgacgaaaactcatggaaatccgaggctgagatcgatatggagctgttccaccaaaatcacctcattgttaaggttcctccataccatgaccagcacataactctcccagtgagcgtaggtatttacgtcgtgactaatgctggcagaagccatgatgtgcagcccttcacctacacacccgaccctgcagctggcgcactcaatgtgaatgtgaaaaaggagatcagcagcccagcaagaccttgttcatttgaagaggcgatgaaagcaatgaaaactactgggtgcaacctggataaagtcaatattatccccaatgcgctcatgacaccactcattcctagctccatgattaagagcgaagatgtcacaccgatggaggttactgccgaaaaaaggtcatctacaatttttaagaccaccaaatctgtagggagcacgcaacagacattggagaacatcagcaatatcgcaggcaacggatccttttcttcaccctcatcttctcatctcccatccgagaatgaaaaacagcagcaaattcagccgaaagcctacaatcctgagacccttaccacaatccagacacaggacataagccagcctggcacctttcccgctgtcagtgcgtccagccagctgcccaactctgatgccctgctccagcaagcaacccaatttcagacgcgtgagactcagagccgggagattttacaaagtgacggcaccgtggtaaacctgtctcaactgacagaggcttcacagcaacagcagcagtcaccacttcaggaacaggctcagactctccaacagcaaattagctcaaatatctttcctagccccaactcagtgtcacagttgcagaacaccatacagcagctacaagctggttcttttaccggaagtacagctagtggctcatccgggtcggtcgatctggtccagcaggtcttggaggctcaacagcagttatcttctgtgctgttcagcgcacctgacgggaacgaaaatgtgcaggaacagttgagcgccgacatcttccaacaggtgtcccaaatccagagcggagtgtcaccagggatgttctccagtaccgagcccactgtgcatacaagacccgacaatttactgccaggtagagctgagtcagtgcacccacagagcgagaataccttgtccaaccagcagcaacagcaacagcagcaacagcaggtgatggaaagctccgctgcaatggttatggagatgcagcagagcatatgtcaggccgcggctcaaattcaaagcgagctgtttccaagtactgcgagtgccaatggtaacttgcaacagagcccagtataccagcagacatctcacatgatgtctgcactttccacgaatgaagacatgcagatgcagtgtgagctcttttcttcccctcctgccgtcagtggaaatgagacctctaccacgaccacacaacaagtggcaactccaggaacaaccatgttccagacgtcgagttcaggagatggggaagagaccggaactcaggcgaaacaaatccagaactccgtgttccagacgatggtccaaatgcagcactcgggcgacaatcaaccccaggtcaacttatttagctctactaagtccatgatgtctgttcaaaatagcggaacccagcagcaagggaacgggcttttccagcagggtaacgaaatgatgtcactgcaaagtggtaatttcctgcaacagtcttctcactcacaggcgcagctcttccacccccagaaccctattgccgacgcccagaatctgtcccaggagacacaggggtccctttttcactcccctaaccccattgtccactcacagacatccactacatcatctgagcagatgcagcccccaatgttccattcgcagtcgacaattgcggtgctgcaggggagctccgtgcctcaggaccagcaatcgacaaatatcttcctcagccagtctccgatgaataacttacagaccaatactgttgcacaggaggctttctttgccgccccgaatagcatttcccctttacaaagcacaagtaattcagagcagcaagcagctttccagcagcaggctcctatttcacacatccagacgcctatgcttagccaggagcaggcccaacctccacagcagggactctttcagccacaagttgccctcggcagcctcccacctaaccccatgccccaaagccaacaaggtactatgttccaatcacagcactccattgtggccatgcaaagcaattctcctagccaagaacaacagcaacagcagcaacaacaacagcagcagcagcagcaacagcagcaaagtattctgttttccaaccaaaatactatggccaccatggcgtcccccaaacaacctccaccaaacatgatcttcaaccccaatcagaaccccatggctaatcaggaacaacagaatcaaagtatctttcaccagcagtctaacatggccccaatgaatcaggagcaacagcccatgcagttccaaagccagtccacagtgagctcgttgcagaacccagggcccacacagtcagaaagctcccagacccctctctttcactcaagcccacagatacagctggtccagggatccccctcatcccaagaacagcaggtgactttattccttagccccgcgtccatgtccgccctccagacaagtattaatcagcaggacatgcagcagagcccactgtatagcccccagaacaatatgccgggaatccaaggggcaactagctctcctcagccgcaggcaacactttttcacaacaccgcagggggaaccatgaatcagttacaaaactccccagggtctagtcagcaaacgtccggaatgtttctgtttgggatccagaacaactgcagtcagctgctgacctcaggaccggccaccctgccagatcagctgatggctatttctcagcccggccagcctcagaatgagggccagcctccagtgacaacactgctgagccaacagatgcccgagaacagccccttagcctccagcataaacacgaaccagaacattgagaagatcgatctgttagtctcgctgcagaatcaggggaataatctcaccggaagtttctag

SEQ ID NO: 16375 - DNA, 4650 bp, Artificial Sequence
  Description of Artificial Sequence: Synthetic coding sequence
atgccttcagatttcatttctctactcagcgcagacctcgatctggagagcccaaaatcactctattctagagactcattgaagcttcacccttctcagaactttcaccgcgccggccttttagaggagtcagtctacgatctgctgcccaaagagctgcagttgcccccatcaagggagacatctgtggctagcatgagccaaactagcgggggggaggccggctctcccccgcctgcagtcgttgccgccgatgcatcgtcagcgccttccagctcatccatgggcggcgcttgctcgtcatttacgacatcttctagccccacaatatattcgactagcgtcaccgactcaaaagctatgcaggtcgagagttgttcaagcgcggtgggggtgtccaatcggggtgtgtccgagaagcagctgaccagcaacaccgtccagcagcaccctagtactccgaagcggcacactgttctttacattagtcctccccctgaggatctgttggacaattcaaggatgagctgtcaggatgaaggctgcggcttggagagcgaacagtcttgcagcatgtggatggaggactcccccagtaacttttctaacatgtcaacgtctagctataatgataataccgaagtccctagaaaaagtagaaagcgcaatccgaagcagcgccccggtgtgaaaaggcgagattgtgaggagtctaacatggatatcttcgatgctgattcggcgaaagcgccccactatgtgctatcccagctgacaacagacaacaaggggaattccaaggccgggaatggcacgttggaaaaccagaaaggcacaggggtcaagaagtcaccaatgctgtgtggccagtaccccgtgaaatcagaaggaaaagaactgaaaatcgtggtgcagcccgagacacaacatagagcgcggtatctcactgaggggtcaaggggatctgtcaaggatcgtacacagcagggatttccaactgtcaagctggagggccacaacgaaccagtggtactacaagtctttgtgggaaatgacagtggccgagtaaagccccacgggttctaccaggcatgccgcgtaactggacgtaacactacaccgtgcaaagaagtggatatagagggtacaacggtcatagaagttggacttgacccttctaacaacatgacactggcagtggactgtgttggaatcctgaagttgaggaatgccgacgtggaagccaggatagggattgccggctccaagaagaagagtacaagagcgcgattggtgttccgagtgaacattatgcgcaaggacggttccacactgacgctccaaacgcccagctccccaatcctgtgcacccagcctgccggcgtgcccgagatcctgaaaaagagtcttcattcctgtagtgtgaagggtgaggaggaagtctttctaatcggtaaaaatttcctcaaaggcactaaagtcatattccaggagaatgtttctgacgagaattcatggaagtcagaggcagagatcgatatggagctgtttcatcagaatcatcttatagttaaagttcccccatatcacgaccaacatatcacccttcccgtctcagtcggcatttatgtagtgacgaacgccggacgttcccacgacgtgcaacctttcacttataccccagacccagcagccgctggagcactaaatgtcaatgtgaaaaaggagatatctagtccagccaggccctgttcctttgaagaagccatgaaggccatgaagacaaccggttgcaacctcgacaaggtgaatatcattcccaacgcactgatgacacccttgatcccttcaagcatgatcaagagcgaggatgtgacacccatggaagtcacagcagagaaacgaagcagtaccatatttaaaaccaccaaaagcgtgggctctacacagcaaacgctagagaatatttctaatatcgctggcaatggctctttttcgagcccctctagttctcatctgccgagcgaaaacgagaagcagcagcagatccagcctaaggcctataatcccgaaacgttgacaactatccagacacaggacatctctcagccggggacgtttcccgcagtgtctgcctcgtctcagctccctaacagcgacgccctcctccagcaagcgactcagttccagacgcgtgagacccagagccgtgaaatcctgcagagcgacggcaccgtcgttaacttgagccaactaaccgaggctagccagcagcagcaacagtccccattgcaggagcaggcacagacgttgcagcagcagatttcatctaacatctttccttcacccaatagtgtgtcgcagctgcagaatactattcaacagcttcaggccggctctttcacaggatccacagccagcggctctagtggaagtgtggacttagttcagcaggtgttagaggcacagcagcagctgagctctgtcctcttttcagcacctgatggcaatgagaacgtccaagaacagctgagtgcagacatcttccaacaagtgtctcaaatccaatcaggagtgtctccggggatgttctccagcaccgagccaacagtgcatacgagaccagacaacctcctgcctgggcgagccgagtctgtgcatccacaaagcgagaacacactgagcaaccaacagcagcagcaacagcagcagcagcaggtaatggagagtagcgctgcaatggtgatggaaatgcagcagagcatctgccaagcagctgcccagattcagagtgaactgtttcctagcacagcctcagccaatgggaacctgcagcagagcccagtttatcagcagacaagccacatgatgagtgccctgtctacaaacgaagacatgcaaatgcagtgtgagctgttcagttcgccacccgccgtgtccgggaacgagacttctaccacaacaactcagcaagtggccacccccggtacgacgatgttccagaccagttcctctggagatggtgaagagaccggtactcaagctaaacagattcaaaactcagtgtttcagaccatggtgcagatgcaacactcaggagataaccaaccccaggtcaaccttttctctagcacgaaatccatgatgtctgtgcagaactctggcactcagcagcagggtaatggtctgttccagcagggcaatgagatgatgtctttacagagcggaaactttctgcagcaatcgtcccactcacaggcccagcttttccaccctcagaaccccattgctgatgcccagaatctgtcacaggaaacacaggggagtctgttccacagtccaaatcccattgtccacagtcaaaccagcacaacatccagcgaacagatgcagccgccaatgttccattctcaaagtaccatagcagtgctccaggggtcaagcgtccctcaagaccaacagagcaccaatattttcctctcccagtctcctatgaataatctgcagacgaacacagtcgcccaggaagcttttttcgccgcacctaacagtatatccccgctgcagagcacctctaatagcgagcagcaggctgctttccagcagcaagcacccatcagccacatccagactcccatgctttcacaggaacaggcccagcctccgcaacagggcttgttccagcctcaggtcgccctgggcagtctcccacccaaccctatgcctcagtctcagcaggggacaatgtttcagtcccagcattccatcgtagctatgcagtctaatagcccttcgcaggagcagcagcagcaacagcagcagcaacagcagcagcagcagcagcaacagcagtcaattctgtttagcaaccagaataccatggcaactatggctagtccgaagcagccccccccaaatatgatcttcaatcctaaccaaaaccccatggctaatcaggagcagcagaaccagtcaatcttccaccaacaatctaacatggcgcctatgaatcaagagcagcagcctatgcagtttcaatcacagagtacagtgtcctccctgcagaacccagggcctactcagtctgaaagcagtcagacaccactttttcacagctctcctcagatccagctcgttcagggctcacctagctcacaggaacagcaggtgacgttattcctgagccccgcatcgatgtccgcactccagacctccattaatcaacaggatatgcaacagtctccattgtactcacctcaaaacaacatgcctggtattcagggcgccacctcttcgcctcagcctcaggcgaccctcttccacaacaccgctggtggaacaatgaaccagcttcagaattcccctggctcatctcaacagacgagcggaatgttcctctttggcatccagaacaattgttctcaactactcaccagcggccctgcaaccctgcccgaccaattgatggccatctcccagccggggcagcctcagaacgagggccagccaccggtcaccaccctcctcagccagcagatgccggagaacagtcccttggcctctagcataaataccaaccaaaatatcgagaagattgatctactggtctcactgcagaatcaaggaaataacctgacgggctcattctag

SEQ ID NO: 16376 - DNA, 2151 bp, Artificial Sequence
  Description of Artificial Sequence: Synthetic coding sequence
atgccatctacctcctttcccgtgccatccaagttccctctcggacctgcagctgcagttttcgggaggggagagaccttgggaccagccccaagggcaggtggcaccatgaaaagtgccgaggaggagcactacgggtatgcctcctcaaatgtgtcgccggcgctgccccttcccacagcccacagcacactccccgcgccatgtcataatctgcagacttccactccaggtatcattccacccgcagatcaccccagtggttacggcgcagcactggacggaggcccagccggctattttttatcttcaggtcataccaggcctgatggcgcacccgctctagaatccccacgcattgaaattacgagctgcctgggactgtaccataacaataaccagtttttccatgacgtggaagtagaagatgtgttaccaagctctaagagatccccttccaccgctactttaagcctcccctctctggaggcataccgggatcccagttgcctttcccccgccagctccctgtcatcccgtagctgtaacagtgaggcttcatcgtatgagtccaattattcgtacccttatgctagccctcagacatccccttggcaatctccctgtgtgagcccaaaaacaactgaccctgaggagggctttccccgcggactgggagcgtgcacactcctgggttccccgagacactctcctagcacaagtcctagggcctcagtgacggaagagagctggctcggagcgcgaagcagcagaccagcatcaccctgtaacaaacggaagtactctcttaatggtagacagcccccttactccccccaccatagcccaactcccagccctcacggctcccctagagtgagcgtgacggatgattcctggcttgggaataccacccagtacacatcatcagccattgtggcagcaatcaacgccctcacaacagactcctcattggacctgggggatggcgtccctgtgaaaagtcggaagaccactctggagcagccgccatctgttgccttaaaggtggagcccgtgggtgaggacttgggctccccccccccgcccgctgatttcgctcccgaagattattcctccttccagcacatccgtaagggcggcttttgcgatcaatatctcgccgtgccacagcacccataccaatgggctaagccgaaacccctctccccaacctcctatatgagcccaaccctgcccgcactcgattggcaacttccaagccactcgggaccatacgagctgcggatcgaggtgcagcccaagagtcatcaccgggctcattacgaaaccgaggggtcccgcggagctgtgaaggcttccgcaggaggacaccccattgtccagctgcatggctatttggagaacgagcctctgatgcttcagctgttcataggcaccgccgatgataggcttctgaggccacatgccttttatcaggtgcataggattacaggcaagactgtatcgacgacttcacatgaggccatcctctctaatacaaaggtcctcgagatcccccttctgcctgaaaattctatgcgcgccgtgattgactgcgccggaatcctgaaacttagaaactccgacattgagcttagaaagggggagacagacatcgggcgtaagaacaccagagtaagactcgtcttccgcgtccacgtacctcagccttccggtaggactctttcactccaggtagcttcaaacccaatcgagtgttcgcagcggtctgcccaggagctcccactggtggaaaagcagtccactgattcctacccggtggtggggggaaagaaaatggtgctctctgggcataatttcttacaggatagcaaggtcatattcgtcgaaaaagctcctgatggacatcatgtctgggaaatggaagcaaagactgatcgggatttatgcaagcccaacagtctcgtagttgaaatccccccctttagaaaccagcgtatcacgagccctgtgcatgtgtccttctatgtctgcaacggaaagaggaaaaggtcccaatatcaacgattcacatacctgcccgcaaatggaaacgccattttcttaactgtatcccgggagcacgaacgggtagggtgctttttctag

SEQ ID NO: 16377 - DNA, 2478 bp, Artificial Sequence
  Description of Artificial Sequence: Synthetic coding sequence
atgcctagcacctccttcccagtcccgagtaaattcccattggggcccgccgcagccgtcttcggaagaggtgagacactcggcccagcccctagggctggaggcacgatgaagtcagccgaggaggagcactacgggtacgcgtcaagtaacgtttcacctgccttgcccctcccaaccgctcactcaactctgcccgctccgtgccataacctacagactagcactcccggcattatccctcccgccgaccacccctcaggctatggagcagcactggacggaggtccggctgggtactttctctcctctggacacactaggccagacggcgctcctgccctcgagagccctcggattgagataactagctgcctaggtttatatcacaacaacaatcagttttttcatgatgtagaagtggaggatgtcctgccgtccagcaagaggtcaccttccacagctactttgtctctgccatcactggaagcctacagagacccatcttgcctttccccagccagctccttgtcctcccgtagctgcaacagcgaagcttcttcctacgagtctaattattcatacccctatgcaagtcctcagacgagcccgtggcaatccccgtgcgtcagtccaaagaccacagaccccgaagaggggttccccaggggcctgggggcctgtacattacttgggtcaccacggcattcgccctctacctctccgcgtgcctctgtgaccgaggagagttggctgggcgccagaagttctagacctgccagcccctgcaataagaggaagtactctctcaacggccggcaaccgccctactcccctcaccattctcccactccttccccccacgggagtcccagagtctctgtgacggacgatagttggctgggcaataccacccagtacacctcttccgccattgtcgctgctatcaacgccttgacaacggattcgtccctcgacttaggcgatggagttccagtgaagtccagaaaaaccacactggagcagcccccatctgttgcactaaaggtggagcctgtcggagaagatttagggtcacccccccctccggccgattttgcacctgaagattactcttctttccaacatatcagaaaaggaggcttctgcgatcagtacttggctgtaccacaacatccgtaccagtgggcgaagcccaaacccttgtctccaacatcctacatgtcaccaacacttcccgctctggactggcagcttcccagccactcaggcccctatgagttgcgaatcgaggtgcagcccaagtcccatcacagggcccactacgagactgagggatcccggggcgcagtgaaagcaagcgcaggaggtcaccctatcgttcaactgcatggctatctggagaacgaaccactaatgctgcagttgttcattggcaccgcggacgacagattgcttcgccctcacgcgttctaccaggtgcataggatcactggcaagacagtgagcactaccagccatgaggcaatcctgtccaacacaaaagttttggaaataccgttattaccggaaaactcaatgcgcgccgtgatcgactgcgcagggatcctgaaactgcgtaacagcgatatcgagttacgcaaaggcgaaacggacatcgggagaaagaatacccgcgtccgcctggtgttccgggttcatgtgccacagccctcaggacgtaccctgagtcttcaggtcgcatctaacccaattgaatgctcccagcgaagtgcacaggaattgccacttgtggagaaacagtctaccgactcctaccccgtggtaggagggaaaaagatggtgctcagcgggcacaatttcttacaggacagtaaagtgatcttcgtggaaaaggcccccgatggacatcatgtgtgggaaatggaggctaagactgatcgcgatctgtgcaagcccaacagcttagttgtggagattcccccatttcgaaatcagagaattacctctcccgtgcatgtgtccttctacgtctgtaatggaaagaggaaacggtctcaatatcagcggttcacgtaccttcctgccaacgtccccattatcaagaccgaacccaccgacgattacgagccagcccccacctgtggaccagtcagccaaggactgtccccattaccgaggccatactatagccagcagctggctatgccccccgatccaagctcatgtcttgtggccgggtttccaccatgccctcagagaagcaccctgatgccagccgcacccggcgtgtcaccaaaactccatgacctgagcccagccgcttataccaaaggagtggcctctccaggccactgtcatcttggcctcccccagccagcaggggaggcacctgccgtgcaggatgtgccccggcccgtagccacacaccccggctcaccagggcagccaccacctgccctgctacctcagcaatag

SEQ ID NO: 16378 - DNA, 2832 bp, Artificial Sequence
  Description of Artificial Sequence: Synthetic coding sequence
atgccaagcactagttttccggttccttctaagttcccactcggtccagccgccgctgtcttcgggagaggcgagactctgggtcccgccccgcgcgccggtggaaccatgaaaagcgctgaggaggagcactatggctacgcctcttccaatgtctcacccgccctccccctccctaccgcccacagtactttgcctgcaccttgccacaaccttcaaactagcacgcctgggatcatccccccggccgaccacccaagcggctatggggctgcattggatggagggcctgccgggtacttcctaagctccggacatactcgtcccgacggcgcaccagcactggagagcccccgcattgagattacatcttgtctgggcctgtaccacaataacaaccagttttttcatgacgtggaggttgaggacgtcctcccgagcagcaagcgaagtccaagtacagcaactctcagtctgcctagcctggaggcttacagggacccatcctgcctgagcccagcttctagcctttccagtaggtcttgcaatagcgaggcatccagctacgagagcaactactcctacccgtacgcctctccccagacgagtccctggcagagcccctgcgtttcccccaagactaccgacccagaagaaggattcccccgtggtctgggcgcgtgtactctgctcggcagtccacgccactctccatccacttcccccagggcatctgttaccgaagagtcctggctcggggcgagatccagccggccagcgtccccctgtaacaagcgaaagtattccctgaacggccgacaacctccttactctccacaccatagcccaaccccctcgccacatggcagtcctcgtgtttctgtgaccgatgatagctggctaggcaacactactcaatacactagctcagccatcgtggccgccattaacgctctcaccacagatagtagtctggatttgggtgacggagtgcctgtgaagagtcgaaagaccacactagaacagcccccctcagtggcccttaaagtagagcccgtgggggaggacttagggtctcctccgcctcccgctgacttcgcacccgaagactacagctcattccagcatatccgaaaggggggtttctgtgatcagtatcttgccgtcccgcagcacccataccaatgggccaagcccaagccactttctcctactagttacatgtcccctacactacccgctctagattggcagttacccagccatagcggaccctacgaactcaggatcgaagtccagcccaagtcacatcatcgggcccactacgagaccgagggatctcgaggagcagttaaagcttcagctggtgggcacccgatcgtgcagctccacggatatttggaaaacgaacctctcatgctgcaactgtttatcggcactgcagacgacagactactgaggccacatgctttttatcaagtccacaggattacgggcaaaacggtgtccaccacaagccatgaggccattttatccaatacaaaggtcttagaaattcccctactcccagagaattctatgcgggcagtcatcgattgtgctggcatcttgaagctcagaaattctgacatcgaacttagaaaaggcgaaacggatattgggagaaaaaatacacgtgttaggctggtctttcgagtccacgtgccccagcctagcggaagaactctgtccttacaggtggcatctaaccccattgagtgttcccagcgtagtgcgcaggaactgccactcgtggagaagcaatcaacagacagttaccctgtcgtcggagggaaaaagatggtgctgtctggacataacttcctgcaagacagcaaggtaatttttgtcgagaaggctcccgacggccatcacgtctgggaaatggaggctaagacagaccgcgacctgtgcaagcccaattcactggtcgtggagataccccctttccgcaaccagcgtataacctcccctgttcatgtgtccttctacgtctgcaacggaaaacgaaaaaggagccaataccagcgttttacctatctgcccgccaatgtgccaattatcaagacagaacccacggatgattacgagcccgcgcctacgtgtggaccagttagccaaggactctcccctctgccccgtccctactactctcagcagctggccatgccccctgacccctcctcttgcctggttgctggattccctccctgcccacagaggtcaaccctcatgcctgcggcccctggcgtttcaccaaaactgcatgacctttctccggctgcgtacacgaagggcgtcgccagccccgggcactgtcatctgggcctcccacagccagcaggcgaggcccctgccgtccaagacgtccccaggcccgtggcaacccatccagggagtccgggacagccaccacctgccttgcttccccagcaggtttccgccccgccgtcaagctcttgtcccccaggtttggagcacagcctctgcccgtcttctcctagcccaccattgcctcctgccacacaggagcccacatgtctgcagccctgtagcccagcttgtccacccgccaccggccgaccacagcacctgccctcgaccgtgaggcgtgatgagtctccaacggcgggaccccggcttcttccagaagtacatgaagatgggtcccctaatttagctcccatacctgtcacagtgaaacgggaaccggaggagctggaccagctgtatttagacgatgttaatgagattattcggaacgacctgtcctcaactagtactcactcctag

SEQ ID NO: 16379 - DNA, 2793 bp, Artificial Sequence
  Description of Artificial Sequence: Synthetic coding sequence
atgaccggactggaggaccaggaatttgacttcgagttcctcttcgagttcaaccagcgcgatgagggagccgctgccgcagctcctgaacactacggttacgcatcctccaacgtgtctccggccctcccactccccaccgctcactctaccctgcccgccccatgtcataatttacagacgagtacacccggcatcataccacccgccgaccacccaagcggctatggagccgctttggacggaggtcccgctggatactttctcagctcagggcacaccagacccgatggtgctcctgcccttgagtcaccccgtattgaaatcacaagctgcctcgggctgtaccacaacaataaccaattttttcatgacgtcgaagtcgaagacgttctacctagtagcaaacggagcccatctacagccacactttcacttccctctcttgaggcctatcgcgacccttcatgtctgagtcccgcgtcttcactttcatcccggtcttgcaactcagaggcctcaagttacgagagcaactacagctacccatacgccagccctcagacttcgccttggcaaagcccttgtgttagtcctaaaacaacagacccggaggaagggttccccaggggactgggcgcttgcacacttctgggttctcctcgccattcaccttctacatctcctagggcctccgtcaccgaggagtcctggctgggcgctagaagctcccgaccggcctctccgtgcaacaagcgtaagtattctttaaatgggaggcagccgccgtacagcccacaccattcccctaccccatctcctcacggctcccccagggttagcgtaactgatgattcatggttagggaacaccacccagtacacatcctctgctatcgtggctgctatcaatgccctgacaactgatagttcactggatctgggagacggcgtccccgtgaaaagtcgtaaaacgactctggagcaaccaccatccgtggcgctcaaagtggaaccagtgggtgaggatttaggtagtccgccaccacctgcggactttgcaccggaagactactcctcatttcagcacatccgaaagggggggttctgcgaccagtacctggccgtaccccagcatccatatcagtgggctaaacccaaacctctgagccctacatcatacatgtcccctaccctccccgctctggattggcagctacctagccatagcgggccctatgagctgagaattgaggtacagccaaaaagccaccatagagcccattacgagactgaggggtccagaggcgccgttaaagcctctgccggagggcatccgatcgtccagcttcacggctatttagagaacgagcccctcatgctacagctgttcattggaaccgctgacgatcggctgttgagaccccacgccttttatcaggttcatcgtatcaccggtaaaacagtgtctacaacctcacacgaagcaatcctctctaacaccaaagtccttgaaatccccctgctcccggaaaattccatgagggccgtcatcgactgcgccggcattcttaagctgaggaacagcgatatcgagctgaggaaaggcgagaccgacatcgggcggaagaacactcgcgttcggctggtgttccgcgttcacgtgccgcaaccatctggccgaacccttagcctgcaggtggctagtaatccgatcgagtgctcgcaacggtcagcacaggagctaccattggttgagaagcaatccacagacagctaccccgtggtcggggggaaaaagatggtgctgtccggacacaacttcctgcaggatagcaaggttatatttgtggagaaggcgcctgacggacaccatgtgtgggagatggaagccaaaacagatagagatctctgcaagcctaattccctagtggtcgagattccacctttccgtaaccagcgaataacctcacccgtgcacgtttctttttacgtctgcaatgggaagagaaagaggtctcagtaccagcggttcacttacctgcctgcgaacgtgcccatcattaagacggaacccactgacgattacgagcccgcccccacctgcggacccgttagccaaggattaagcccgctgcctagaccatactacagtcaacaactggctatgccacctgacccgtctagctgcctagtggccggctttcccccgtgcccccagaggtctaccctgatgcctgctgctcccggcgtgagccccaaactccatgatcttagtcccgcagcctacacaaagggcgtcgcatcccccggtcactgccatctgggactgccacagcctgccggggaggcccctgccgtgcaagatgtgcctagaccagtcgcaacacaccccgggagtcccggtcagcccccccccgctcttctgccgcagcaggttagtgcccccccatcctcgagttgcccacctgggctggaacacagtctttgcccttcttccccaagccctcctttgccacctgccacccaagaacccacttgtcttcagccatgttctcctgcctgtcctcctgctacgggacgacctcagcacttgccctccactgtaaggagagatgagtcacccaccgcagggcctaggctgcttcccgaggttcacgaggatggcagtcccaatctggccccaatccccgtcactgtgaagcgggaacctgaagaattggatcagctctatctcgacgatgtgaacgagattatcagaaacgatctctcctccactagtacacattcctag

SEQ ID NO: 16380 - DNA, 1062 bp, Artificial Sequence
  Description of Artificial Sequence: Synthetic coding sequence
atgttacagctctttattgggactgcagatgatagactgctgcggccacatgccttctatcaggtgcatcggatcacggggaaaactgtgagtacaacctctcacgaggccattctgtcaaatactaaggtccttgagatccctctcctccctgaaaatagcatgagggccgttatcgactgcgcagggattcttaaattgcgcaactccgacatagagctccgcaagggcgaaaccgacataggtcggaagaacacccgtgttaggttagtttttagagtgcatgtgcctcagccaagtggtcggactctctctttgcaggtggccagcaatccgattgagtgcagccagcgaagtgcccaggagctcccgctggtagaaaaacaatccaccgactcttaccccgttgttggtggcaagaaaatggtgctgtccggccataattttctccaggactctaaggtaatatttgtggaaaaagcacccgatgggcaccacgtctgggaaatggaagcaaaaactgacagagatctctgcaagcctaactctctcgtcgtcgaaatcccacctttccggaaccagaggataacatcaccggtgcatgtcagcttttacgtgtgcaacggcaaacgaaaaaggtctcagtaccagcgtttcacctacctgcctgccaatgtgcccatcatcaagactgagccaacagacgactacgaacctgcacccacttgtgggcctgtatcccagggcctgtccccgttgcctcggccatactattcccagcaactggcgatgccacccgacccatcttcatgcctggtcgcaggatttcccccttgtcctcaaaggtctaccctgatgccggccgcccctggagttagccccaagcttcacgacctttcccctgccgcctacactaagggcgtggcaagccccgggcattgccacttgggccttccgcagccagccggcgaggcacccgcagttcaagatgtgccacgtccagtggccacacacccgggcagtcccggtcagccaccaccggcactgctcccccagcagtag

SEQ ID NO: 16381 - DNA, 2724 bp, Artificial Sequence
  Description of Artificial Sequence: Synthetic coding sequence
atgaagtccgggactcttgaacattacgggtatgcttcatcgaacgtgagtccagcactgcctctaccaactgcccattctactcttccggccccctgtcacaatctgcagacctctactccaggtataattcctccagcagatcatccaagcggatacggggcagctttagacgggggaccagccggctattttttatcatcaggacacacacggcccgatggcgccccagctttggagtccccccgcatcgagattacctcctgcctgggcctgtatcataataacaaccagttcttccacgacgtggaggttgaggacgtgttgcccagctctaaacggtctccatctacggcaacattatccctgccctcactcgaggcataccgtgatccctcatgcctgtccccagcttcctccctgtcgtctagatcgtgcaattcagaggcgagctcgtatgaatctaattatagctatccctacgccagccctcagacatccccctggcaaagcccttgcgttagtcctaagactaccgaccctgaggagggttttccccgagggctcggagcctgcacactcttagggtcaccaagacactccccttcaacaagcccaagggccagtgtgacggaggaaagttggcttggcgcaaggagtagtcgccctgcttctccttgtaataagaggaagtatagtctgaacggccggcagcctccatactccccacatcactcaccaaccccctccccccatggctcaccccgggtatccgtgaccgacgatagctggcttggaaatactacgcagtacactagttcagcaatcgtagcagcaattaacgcccttactacagacagctccctggatttaggtgacggtgtccctgtcaagagtaggaagaccacactggaacagcctccatctgtcgcgttgaaagtggagccggtcggagaagacctggggagtcctcctcctcctgccgacttcgcacccgaggactacagttcgtttcaacatatccgaaagggtgggttctgtgatcagtatctggctgtgccccagcacccttatcagtgggcgaagcccaaaccgctgtctcccactagttatatgagccctaccctgccagctctcgattggcagctgcctagccatagcggcccctatgagttacgaatcgaggtgcaaccaaagtcacaccacagagcccattatgagaccgagggcagccgcggtgcagtgaaagcaagcgctggtggccatcccattgtgcagttgcatggctatttggagaacgaaccactcatgctgcagcttttcatcggtaccgctgacgaccgcctcttgaggccccacgctttctatcaggtgcacagaatcacagggaagacagtgtctaccacatcacatgaggcaatcctgtcaaacaccaaagttctggagatcccattactgcctgagaacagcatgagggccgtaatcgattgcgctggcatactcaaattgcgcaactccgacattgaactgaggaaaggggagacagacataggcaggaagaatactcgcgtgagactagtgtttcgtgtgcacgtgcctcaaccttctggtcggaccctctccctccaggtagcctccaacccgatcgaatgtagtcagagaagtgcccaagaactgcccctagtggaaaagcagagcacagactcctacccagtcgtaggcggaaaaaaaatggtgctctccgggcacaattttctgcaggactctaaggttatctttgtagagaaggctccagacggtcatcatgtctgggaaatggaagcaaaaaccgatagagatctatgtaagccaaactcactcgtcgtagaaattcccccttttcgtaatcaacggatcacaagcccagtgcacgtgtcgttttacgtatgtaacgggaaacgcaagaggtcccagtaccaacggtttacatatctccccgcaaacgttccgatcatcaagaccgagccaacagacgactacgaacctgctcccacgtgtggcccagtttcccagggcctctctcccctgccacggccctattatagtcaacagctggcaatgcctccagatccctcctcatgtctggtggcagggttccctccttgtcctcaaagatcaacactaatgcccgctgctcccggggtgtcccccaaattacacgacttgagccccgcggcatacacgaagggtgtggcctctcctggccactgccacctagggcttccgcagccagccggtgaggctcctgccgttcaggacgtaccgcgccctgttgcaacacaccccgggagccccggacagccccctcccgccctcttaccccagcaggtatcagcacctccttcttcctcatgcccccccggactagagcatagcttatgcccgagcagcccctccccacccttaccacctgccacccaggagcctacctgcctgcagccctgctcccccgcctgtccaccggccacaggtcggccccagcacctgccatcaactgtgcggagagacgagtctcctactgccggcccccggctgctccccgaagtgcacgaggacggaagccctaacttagcccccatcccagtgactgtgaaacgagagccagaagagctcgatcaactctatctagatgatgtgaatgagatcatacggaacgacctatcctccacgtctacccactcttag

SEQ ID NO: 16382 - DNA, 2745 bp, Artificial Sequence
  Description of Artificial Sequence: Synthetic coding sequence
atgacagggttggaagaccaggagtttgacttcgagtttttgttcgagtttaaccaacgcgatgaaggagccgcggcagccgcccctgaacattacggatatgcaagcagcaacgttagtccagccttacctctcccaacagcccattcaactctccctgcaccttgtcataacctgcaaaccagtaccccagggatcatcccaccagccgatcacccttctggctatggcgctgccctggacgggggccccgccggatactttctgagcagcggacatacaagacctgacggtgctcccgcccttgaatcaccccgcattgaaataacatcctgtctcgggctgtatcacaacaacaatcagttcttccatgacgtggaggtggaggatgtgctacctagtagcaagaggtccccaagtaccgcaactctgagtctcccatcccttgaggcgtatcgcgatcccagttgtctctcaccagccagcagcctatccagccgctcttgcaatagcgaggctagctcttatgagtctaattatagttacccttatgccagcccacagacctctccctggcaatccccctgcgtgtcccctaaaactactgatcccgaggagggttttccccgggggttgggtgcgtgcacactactcggatcacccagacattcaccttcaacttcccccagagcctctgtgacggaggagagctggctcggggcccgtagcagcaggcccgcgtccccatgtaacaaaagaaaatactctctgaatggacgtcagccaccctacagtcctcatcatagcccaacacccagcccccatggaagccctcgcgtctcagtcactgacgacagttggctgggcaacaccacgcagtatacttcatcggccattgtggccgccattaatgctctgaccacagactccagcctcgatctgggtgatggagtgccagttaagagccgtaagacaacactcgagcagcctccctccgtggctttgaaggtggagcccgttggggaggacttgggtagtccaccacctccggcagactttgctcccgaggattactcaagcttccaacatattcgtaaaggtggcttttgtgaccagtacttggcagtgccacaacacccttaccagtgggctaaacccaagcctttatctcctacgtcttatatgtcgccgactcttcctgcactggattggcagctgcccagccacagcggtccatacgaattgcggatcgaagtgcagcccaaatctcaccaccgtgcacactatgaaacagagggcagtaggggggccgtcaaggcttccgccggcggacaccctatagttcagctgcatgggtatctagaaaatgagcctcttatgctccaactcttcatcggaaccgctgatgacaggttactgagaccacacgcattttatcaggtgcatagaatcaccggcaaaacagtgagcacaacaagtcacgaagcgatccttagcaataccaaggtgttagagataccactgttgcccgagaattcaatgcgcgcagtgattgactgtgcgggcatcctcaaactacgcaacagtgacatcgaacttaggaaaggagagacagatatcgggcggaaaaatacccgggtacggctggtcttcagggtgcatgtgccacagccttctggtcgtacactgagcctccaggtcgcttcaaacccgatcgagtgttcgcagcgctctgctcaggagctcccgctcgtcgagaagcagtccaccgattcctaccccgtggtgggggggaagaaaatggtgctgagcggacacaacttcttacaagattcaaaagtgatattcgtggagaaggctccggacgggcaccatgtttgggaaatggaagccaaaacagatcgcgacctctgtaagccgaactccctcgtggttgagataccccccttcaggaaccagagaattacatcgcccgtacatgtctccttttacgtctgcaatgggaaaaggaaacggagccagtaccagagatttacatacctgcctgcaaacgtgccaatcattaagaccgaacccactgatgattacgagcccgcaccaacgtgcggtcccgtgtctcagggactgtcccccctgcctagaccttactacagccagcagcttgccatgcccccagacccctcgtcttgtctggtggcggggttcccgccgtgcccgcaacgaagtactctcatgcctgccgcaccaggggtttccccaaagctgcacgacttgagtcccgcagcttacaccaagggggtggcatcacctggacactgtcacctggggctgccacagccggccggcgaagcaccagccgtccaggacgttccaaggccggtcgccacccatccgggtagcccaggccagccaccgccagccttgttacctcagcaggtcagcgcaccacccagctcaagctgtccacccggcttagaacattctttgtgcccttcatcccctagcccaccactgcctcctgcaacacaggaaccaacctgtctgcaaccgtgttccccagcctgcccgcctgctacaggtaggcctcagcaccttccttctacagtgagacgagacgagagccccaccgctgggccacgcttgcttccggaagtacacgaggacggctccccaaaccttgcacccatccctgtgaccgttaagcgcgagcccgaagagctcgaccaactctacctggacgattag

SEQ ID NO: 16383 - DNA, 2142 bp, Artificial Sequence
  Description of Artificial Sequence: Synthetic coding sequence
atgccttcgactagctttcctgtgccgagcaaatttcctctgggacccgcggccgcggttttcggtagaggtgagactctgggccctgctcctcgggccggcggtactatgaagtccgcagaagaagagcactacggatacgcctcttctaatgtttccccggcgcttcctttaccaactgctcacagcaccctcccagctccctgccacaaccttcagacatctactcccggcatcatcccacccgccgatcacccttcaggatacggagctgcactggatggcggccccgcggggtacttcctgtcaagcgggcacacccgacctgacggtgctcccgcgttagagagtcctaggatcgagattacaagctgtttaggcttgtatcataacaacaaccaattctttcacgatgtcgaagtggaggatgtgcttccttcatctaaaagatcccccagcactgctacactgagccttccatcactagaagcttatagagatcctagctgtttgagccctgccagctccctatcctctaggtcatgcaatagtgaggcatcttcttatgaatccaactatagctacccatatgctagccctcagaccagtccatggcagtctccctgcgtcagcccaaagacaaccgaccctgaggagggatttccgagaggccttggtgcgtgcactctgctgggcagccctaggcatagccctagtacaagccctagagcatctgttactgaggagtcctggctgggagcccgatcctcccgacccgcctcaccatgcaataagagaaagtattctctgaatggaagacagcccccttacagccctcatcatagcccaacgccatcaccacatggaagccctcgtgtatcagtcacagatgatagctggttgggaaataccactcagtatacaagcagcgccatcgtcgcagctatcaatgctctgacaacagacagcagtctggatttgggcgatggtgtgccagtgaagtcccgcaagacaaccctggagcagccccctagtgtagctctgaaggtggagcctgtaggcgaagatctggggtccccacccccccccgccgatttcgctccagaggactacagctcattccagcatatcagaaaaggaggtttttgtgatcagtatctggccgtaccgcaacacccttaccaatgggctaagccaaagcctctcagccctaccagctatatgagccccactcttccagccttagactggcagctgccttcacatagtggtccctatgagctgagaatcgaggttcagcctaagagccaccaccgtgcccattacgagacagaaggatcgagaggtgcagtgaaggccagcgccggcggccatccaattgtgcagctccacggataccttgagaacgagcctcttatgctgcaattgttcataggtacagcggacgataggcttctgcgacctcatgccttctaccaagtccaccgtatcactggtaagactgtgagtacaaccagccacgaggcaatactgagtaatactaaagtgttagagattccactactgcccgaaaactctatgcgtgcggtcatcgattgtgcagggattttaaaactgagaaattcagacatagaactccggaagggagaaaccgacattggtcgcaaaaataccagggtgagactggtgttcagagtgcacgtaccccaaccctccggcaggacactttccctacaagtggcatccaaccccatcgagtgtagtcagcgctcggcccaggagcttcctctggttgaaaaacagtctactgatagctatccggttgtgggcggcaagaaaatggtgctctctgggcacaactttctgcaggactctaaggtgatcttcgtggagaaagcccctgacgggcaccacgtgtgggagatggaagccaagaccgatcgcgacctctgcaagcctaattccctcgtagtcgaaattccaccttttcgtaatcagcgtataacctcccccgtccatgtgtccttttacgtgtgcaatggtaagaggaaacgtagccaatatcagcgcttcacgtaccttccagctaacgtaaatgaaattattcgtaacgacctatcttctacaagcactcattcgtag

SEQ ID NO: 16384 - DNA, 1416 bp, Artificial Sequence
  Description of Artificial Sequence: Synthetic coding sequence
atgttgcagcttttcattggcacagctgacgatcgacttcttcggccacacgcgttttaccaggtccaccggattactggaaagaccgtgagcactacctcccacgaagccattctgagcaacactaaggtcctcgagattccactgctgccagagaactcaatgcgagcagtgattgattgtgcaggaatccttaagctgaggaactctgacatcgagctccgaaaaggcgaaactgatattggcaggaagaacacccgagtgcggcttgtattccgggtgcacgtgccccagccctcgggacggactctgagcctgcaagttgcctcaaaccccatagaatgctctcagcggagtgcccaggaacttcctctggtcgagaaacaaagcacagatagttatccggtggtaggggggaagaaaatggtgctgagcggacataatttcttgcaagattccaaagtgatttttgtggagaaagcccctgatggtcaccacgtgtgggaaatggaagccaagaccgatcgcgacttgtgtaaacctaatagtctggtcgtcgagatcccccctttccgcaatcaacgcataacatcaccggtccacgtatctttttatgtatgcaacggcaagcgaaagagaagtcagtatcagaggttcacctatctcccagccaacgtccccattattaaaaccgaacccacagatgattacgaacccgcccccacctgcggccccgtttctcaaggactgtccccactgccacgtccgtactattctcagcagctcgcgatgccacctgatccgtcctcctgcctggtggccggcttccccccttgcccacagagatctaccttaatgcccgccgcacctggtgtgtcacccaaactgcacgatttatcccctgccgcctacacaaagggtgttgcgtccccaggacactgccacctgggtctgcctcagccagcaggggaagcccccgctgttcaggacgtgccacgtcctgtagcaacccaccctggaagtcctggccaaccccccccagcactattaccccagcaagtctcagccccaccatccagtagttgtcctcccggactagaacatagtctatgcccaagcagcccttcacctcctctcccccccgcgacgcaggaaccaacctgccttcagccatgctcaccagcttgtccacccgccactggccgacctcagcacttaccgtcaactgtgagaagggacgaaagtccaaccgccggaccacgtcttctacctgaggtgcacgaagacggatcacctaatctcgcccccatccctgttacggttaagcgggagcccgaggagttggaccaactttatctcgacgatgttaatgaaattattaggaatgacctgagctccacttcaacccacagttag

SEQ ID NO: 16385 - DNA, 2766 bp, Artificial Sequence
  Description of Artificial Sequence: Synthetic coding sequence
atgaacgcccctgagagacagccccagcccgacggaggcgacgctcccggtcacgaaccgggcggctcgccccaggatgagctggatttttccatcttattcgactacgaatatctaaacccaaatgaggaagagccgaatgctcacaaggtggctagtcctccatcagggcctgcttatcctgacgacgtgttggactacggcctgaagccttatagcccgctggcctctctctctggagaacccccaggtaggtttggcgagcctgaccgggttggtccccagaaatttctgagcgccgccaaaccagcaggcgcatccggcttatctccaagaatcgagattacaccctcacacgaactcattcaagccgtgggccccctcagaatgcgggacgcagggctcctcgtcgaacagcctccacttgctggggtggccgcaagtccacgctttacacttcccgttcccggctttgagggctacagggaaccactgtgcctctcgccagctagttctgggagctcagcaagctttattagcgatacctttagtccgtatacctccccttgcgtcagtcctaacaatgggggccctgacgacctatgcccacagttccagaacatcccagcccattacagtccacggacgtctcctatcatgtctccccgcacgagtctggcagaggattcctgcttaggtcggcactctcctgtgcccagaccagctagtaggtcgagttctcctggggccaaacggagacattcctgtgccgaagcacttgtcgccctgcccccaggtgcgtccccccagcggtcccggtcgccatcgcctcagccatcctcacacgtggcgccacaggaccatggaagccctgccggataccctcctgtcgctgggtctgcagtcataatggatgctctcaattccttagccactgacagtccttgtggtattcccccaaaaatgtggaagacaagtcctgaccccagtccagtatccgcagctccatccaaggctggcctgccacggcatatttaccccgccgttgaatttctcggaccctgtgagcaaggcgagaggcgaaatagtgctccagagtcaatcctgcttgtcccaccgacctggcccaaaccactggtcccagcaataccaatctgctcaattcctgtgactgcaagtctgcctcctctggagtggccgctgtcttcccagagtggatcctacgaattgcggattgaggtccagccaaagccccaccaccgggcccattacgagactgaggggtctaggggcgctgttaaagcacccacagggggccatccagttgtgcagctgcacggatacatggaaaacaagccactcggcctgcagatctttataggcactgcagatgagagaatccttaagccacacgcattctatcaggtacatagaatcacagggaagaccgtgacaacaacatcctacgagaaaattgttggcaacaccaaagtcctggaaatcccactcgaacccaagaataacatgcgcgccactatcgattgcgcaggcatccttaaactgagaaacgcagacatcgaacttcggaagggcgaaacagatattgggcgcaaaaatacacgggttagactggtgtttcgtgtacacatccctgaatccagcgggcgcatcgtttctcttcagacagcctccaaccccatcgagtgcagccaaagatctgcgcatgagctgccaatggttgaacggcaggacaccgacagctgtcttgtctacggagggcagcagatgattctcaccggccaaaatttcactagcgagagtaaggtcgtgtttaccgagaagactacagatggacagcagatctgggaaatggaggcaacagtggacaaggataaaagccaacccaacatgttgttcgttgaaataccggaatataggaataaacacatcaggactcctgtgaaagtgaacttttatgtgattaacggaaagcgcaaaaggtcccagccacagcacttcacataccacccagttcctgctataaagactgaacccacagatgagtacgaccctacactcatctgcagtcccacccacggaggacttgggagtcagccctactacccccagcaccctatggtggcagaatctccctcctgcctcgtggcaactatggccccttgccagcagtttcggactggcctcagcagccctgacgctcggtatcagcagcaaaacccagctgctgtgttatatcagaggtcaaagagtctcagcccctctttacttgggtaccagcagcccgcactcatggcagctcccctatccctggcagatgcccacagatcggttttggtgcacgctggaagccagggacagagtagcgcgctgctccatcccagcccgactaaccagcaggcgagtccagtaatccattacagtccaactaaccagcaactccgctgtggtagccaccaggagttccagcatatcatgtattgtgagaatttcgccccggggacgactcgaccgggccccccacccgtttcgcaagggcagaggctctcacccgggagctaccccaccgtgattcagcagcaaaatgccacctctcaaagggccgccaagaatggcccccctgtctctgaccagaaagaggtccttcctgccggagtcaccatcaagcaggaacagaatctcgatcagacttaccttgacgatgagctaatcgacacccatctgtcgtggattcagaacatattatag

SEQ ID NO: 16386 - DNA, 978 bp, Artificial Sequence
  Description of Artificial Sequence: Synthetic coding sequence
atgtctccacgcacatctctggcagaagattcgtgtctgggcaggcactcccctgtccctagaccagcctcccggtccagctcacctggggccaagcggaggcactcctgcgcagaggcccttgtggcccttccccctggagcatccccccagagatctcgtagcccttctccgcagccgtcaagccacgtcgctccccaggatcacgggagcccagccggttatccccctgtggccggatcagcagtgattatggacgctctgaactcactagcaactgattctccctgcggaatcccacccaaaatgtggaagacatcccctgaccctagccccgtcagtgcagctccttcgaaagccgggctgccacgccatatctacccagcggtggagtttctcggcccctgcgagcagggcgagcggcggaacagcgctcctgagagcatcctgttagtcccacccacgtggcccaaacccctggttccggccatccccatttgctccattcctgtgactgctagcctgccccctctagagtggccgctgagtagccagagcggaagttacgaattgcggattgaggtccagcccaaacctcaccaccgcgcccactacgagacagagggctcaagaggagccgtcaaggcgcccaccggcggacaccccgtcgtgcaactacatgggtacatggagaataagcccttaggcctccagatctttatcggaacagcagacgagcggatattgaagccacatgcgttctaccaggtgcacagaattacgggaaaaactgttaccaccactagctacgaaaaaattgtgggaaatacgaaagtgctcgagatcccactcgaacccagtaccgctccccacctgctctccccctttatgttcataagtcagccaggggtgcacacacgcattaacgtctgggcccttagcggattgagcctgaaggaactggcaacttctctctag

SEQ ID NO: 16387 - DNA, 2778 bp, Artificial Sequence
  Description of Artificial Sequence: Synthetic coding sequence
atgaacgctccggagagacaaccacaacccgacggcggggacgctccaggacatgagcccgggggttccccacaggacgagttggatttctctatattgtttgactacgagtaccttaatcccaacgaagaggagcccaacgcccataaggtggcttctccaccatcagggcctgcctatcccgacgatgtgttagactatggactgaaaccatacagccccctcgcctctctgagcggggaaccccctggtaggttcggcgagcccgatagggtcggtcctcagaaatttctgagtgcggcaaaaccggccggagccagtggtctgagcccaaggattgagattacaccttctcacgaactgatacaagcagtgggccctctacgcatgcgggacgcggggctgctggtagaacagccacctctggccggggttgccgcctccccacgctttactctgcccgttcctggattcgaggggtacagagagccattatgcctgtccccagcgtcatctggaagcagtgcctccttcatttcagacaccttctccccatacacatcaccttgcgtctctcctaacaacggcggacccgatgatctttgtccccagtttcaaaacatcccagcacactactcacccagaacgtctcctataatgtccccaaggacttctcttgccgaggacagttgcctcgggcggcactcacccgtcccccgccccgcctcccgctcaagtagcccgggggcgaaaagacgtcacagctgcgctgaggctctggtcgccctgccacctggtgcaagccctcagaggtctcggtctcccagccctcagcctagctctcacgtcgctccacaggatcatggctctccagccgggtaccctcccgtggcagggtcagcagtcatcatggatgccctgaattccctggctacagattcaccatgcgggattccacctaagatgtggaagacctcccctgacccaagccctgtgagtgctgcccctagcaaagcgggcctccctcggcatatataccctgcagtagagtttctgggaccgtgcgaacagggggagcgccggaactctgctcctgagtccatcttactggtacctcccacatggcccaagcccctggtgcccgccattcctatctgtagtattcctgttacagcatctctgccgcctttggagtggcccctgtcatcccagagcgggtcatacgaactgaggatagaagttcagcctaaaccgcaccaccgggcacactacgaaacggagggatcacggggtgccgtcaaagctccgactgggggtcatcccgtggtacagttgcatggctacatggagaacaaaccactgggcctgcaaattttcataggtactgctgatgaaagaattctgaaacctcacgccttctaccaagtccacaggatcaccggcaagaccgttacaaccacaagctatgaaaaaatcgtgggcaacacgaaggtgttagaaatcccgttagaacccaagaacaacatgagggctaccatcgactgcgcgggcatactgaaactcaggaacgcagatattgaactaaggaagggcgagaccgatattggcagaaagaatacgcgagtgagactggtgtttcgggttcacatccctgaatcttccgggagaatagtttcactccagactgcatccaatccaattgagtgctcacagcgatccgctcatgagctgcccatggtcgaacggcaggacaccgactcgtgtctcgtgtatggcggccagcagatgatactaacagggcaaaactttacctcagagagcaaggttgtctttacagagaagaccacggacggccaacagatttgggaaatggaggccacagttgataaggataagtcccagcccaacatgctgtttgtcgagattcccgaatatcgaaacaagcatatacgaacaccagtgaaagtgaacttctacgttattaacggaaagagaaagcgctctcagcctcagcatttcacatatcaccccgtgccagctattaaaaccgagcccacagatgagtacgacccaaccttgatttgcagtccaacacatgggggactggggtctcagccttattatccacaacatccaatggttgccgaatcaccaagttgcctcgtagctaccatggctccgtgccaacagttccgcaccggattgagctcacccgatgcccgatatcagcaacagaaccctgcagctgtcctctatcagagaagcaagtcgctctccccgagcctgctgggataccagcagccagctctgatggccgcaccgctcagcctggccgatgctcaccggagcgttttggtccacgcgggtagccaggggcagtcttcggctctccttcacccttctcccactaaccagcaagcttcccccgttatacattactcccctacaaatcagcagctgcgctgcggcagccaccaggaattccaacatatcatgtactgcgaaaattttgctccaggaacaacacgtcctgggcccccacctgttagtcaagggcagcgactttcccctggctcctaccctacggtaattcagcagcagaacgcaaccagtcagagggccgctaagaacggtccccctgttagcgaccagaaggaggtgctgcctgcgggcgtaacaatcaagcaggaacagaatctggaccagacctacctggatgacgtgaacgagattatccgaaaggaattttctgggccgccggcgcgcaaccagacttag

SEQ ID NO: 16388 - DNA, 2706 bp, Artificial Sequence
  Description of Artificial Sequence: Synthetic coding sequence
atgcagagggaagcagcattccggctcggccattgtcatcctctgcgcatcatggggtcagtggatcaggaggagccaaacgctcataaggtagcctctcctccatccgggcctgcctacccagacgatgtgttagattatggtctaaagccttactcaccgttggcatccctgagcggcgaacctcctggaaggttcggagagccagatcgggtgggaccccaaaagttcctgtccgcagcaaagcccgccggcgcttccggccttagtccacggatcgaaattacaccctcccatgaactcatccaggcggtgggtccactcagaatgagagatgcgggactcttggtggaacagccccccttagctggagtagccgcctctccacgcttcacactgcctgtgccaggctttgaaggctaccgggagcctctgtgcttatcacccgcatcatcaggcagttccgcaagcttcatttcagacacattctctccgtacacttctccatgtgtgagccccaataatggtggtccagatgacctctgtcctcagttccagaacattcccgctcattacagtcccaggacctcacctataatgagcccaagaacaagcctggcggaggatagctgcctgggtcggcactctccagtgccaaggccagcttccagaagcagctcacctggcgccaagcgcaggcatagctgcgccgaggctctagtcgcactgcctcccggtgcttcacctcagaggagcaggtccccatccccacagccctcctctcacgtggctccacaggatcacgggagccctgccggatatcctccggtggcgggttcggcagtcatcatggatgccttaaactccctggcaaccgattctccttgcgggatcccacccaagatgtggaaaactagcccggacccgtcaccagtgtccgccgctcccagtaaggcaggactgccacgtcacatttatccagcggtcgagttcttgggcccttgcgagcagggtgagagacggaactccgctccagagtctatcctgctggtgccccccacctggcccaaaccactcgtgcctgccattcccatatgctcaattccagtaacggctagtctcccacctctcgagtggcctttatcctcccagtctggctcgtatgagttgcggatcgaggtacagcctaagccgcaccatagagcccattacgagaccgaaggcagtagaggtgccgtgaaggcccccactggcgggcacccggtcgtgcagctacacggatatatggagaacaagccattagggctacagatattcatagggacggcagacgaaagaatcctgaagcctcacgctttttaccaggtgcataggataacaggtaaaaccgtaaccaccacaagttatgaaaaaatagtgggaaacaccaaagtgctagagatccccctggaacccaagaataacatgcgagcaacgatcgattgtgcaggcatcttaaaactgaggaatgccgatatcgagctcagaaaaggtgaaacagacataggtcgaaaaaatacaagagtccgcctggtattcagggtccacatccctgagagctcaggccgaatcgtttcattgcagactgcaagcaacccaatagaatgcagccagagatccgcacacgagttgccaatggtggaacggcaggacaccgacagttgcttggtatatggaggacagcaaatgattttaacaggtcagaactttaccagtgagtccaaagtcgtcttcacggaaaagacaaccgatggacagcagatttgggagatggaggcgactgtggataaggacaaatctcagccgaacatgttgttcgtagagattccggaatacaggaacaagcacatccggacgccagtgaaggtgaatttttacgtgatcaacggcaaacgaaagaggagccagcctcagcattttacgtaccatcctgtcccagccatcaagaccgagccaaccgacgagtatgatccaactttaatctgctcccctacacatggaggcttgggtagccagccttactacccccagcaccctatggtggctgagagcccctcttgcctggtcgccacaatggccccctgccagcagtttcgtacgggactctcgtctcccgacgcccgatatcagcagcagaatcccgctgccgtcctgtaccaaagatctaaatccctgtccccgagtctcttgggttaccagcagcccgccctcatggcagcccctctgagcctggcggatgcccataggagtgtcctggtgcatgctggctcacagggtcagtcctctgcactgctccatccaagtcctacgaatcaacaggcaagcccagttattcattattccccaacaaaccagcagttaagatgtggatcccatcaggagtttcagcacattatgtattgtgagaattttgctccagggacaacacgaccaggaccaccacccgtgtcacaaggacaaaggctaagcccgggatcctacccaaccgtcatccagcagcagaatgctactagccaaagagctgccaaaaatggacccccggtcagcgatcagaaggaggttttgcctgcaggggtgaccattaaacaggagcagaacctggatcagacatacctggatgacgaattgattgatacccacctgtcctggattcagaacatactctag

SEQ ID NO: 16389 - DNA, 3207 bp, Artificial Sequence
  Description of Artificial Sequence: Synthetic coding sequence
atgacgacggctaactgtggagctcacgacgagttggacttcaagctcgtgttcggcgaggacggggccccagctccgcctccacctggttcccggcccgccgaccttgaacctgacgactgtgctagtatctatattttcaatgttgacccgccaccttccacactaaccacacccctgtgcctgccccaccacggcctgccctcgcattcatctgtgctcagcccatccttccagttgcagtcccacaagaattacgagggcacgtgtgagatccccgaatcaaagtattccccactgggtggtcctaagcctttcgagtgcccttccattcaaattacctctatctctccaaactgccatcaggaactcgacgcccacgaggatgatctgcaaattaacgacccggagcgggaatttctggagcgcccttcccgcgaccatctttatctgccacttgagccctcttacagggagtctagtctttcccccagcccggctagcagtatcagttccaggagttggttctcagacgctagctcatgcgaatcactgtcccacatatatgacgacgttgactccgagctgaatgaagccgcggctagattcaccctgggttcacccctgacctctcccggcggctcgcccggagggtgtccaggggaggaaacatggcatcagcagtacgggctcggacatagtctgtcccctaggcagtcaccttgtcactccccaagatcatctgttacagatgagaattggctgagccctagacctgcctcaggaccttcctcacgcccaactagcccctgcgggaagcgcaggcactcatctgcggaagtgtgttacgctgggagtctgtcacctcatcactcacctgttccctcgcccgggcattcccctcggggttccgtcacagaagatacctggttgaacgccagcgtgcacggcggttctggcctgggaccagcagtgtttccattccaatactgcgtcgagactgacataccactgaaaacaagaaagaccagtgaggaccaggctgcaatccttcccggaaagcttgagctgtgcagcgacgatcaaggctccctgtcccccgcccgggaaacgagcatcgacgacggccttggtagccaataccccctcaaaaaagactcttgtggggaccagtttctgagtgtgcctagtccttttacgtggtccaagcccaagccgggccacaccccaattttcagaaccagttcccttccccccctggactggccccttccagcccactttggtcagtgcgaactgaagatcgaggttcagccaaagacacaccacagggctcattacgaaacggaggggagtcgtggagccgtgaaggccagcacaggcggacaccccgtagtgaaactcctgggttataatgagaaacctatcaacctgcagatgtttattggtaccgccgatgataggtacttgcggcctcatgctttctatcaggtgcaccgcattacgggcaagaccgtcgcgactgcatctcaggaaattattatcgcatccacaaaggtgttggaaatccccttactgccagaaaataatatgtctgcctcaattgattgcgctggcattctaaaattaaggaacagtgacatagagttgcggaagggcgaaaccgacattggacggaagaacactcgcgttcggctagtgtttagggttcatataccccagccaagcggaaaggtgctgtctttacagattgccagcatccctgtggaatgctcccagcgcagcgcccaagaattacctcacattgagaagtattctataaactcctgttccgtaaacggaggccatgagatggtcgtgaccgggagtaatttcctgcctgagtccaagataatctttctggagaaagggcaggatgggagaccgcaatgggaagttgagggcaaaatcatccgggagaaatgccaaggtgctcacatcgtgctggaggtaccaccctaccataacccagcagtcactgcagccgttcaggtacacttttacctctgtaacggtaaaagaaagaagagccagagccagagatttacctatactcctgtgctaatgaaacaggagcaccgcgaggagattgacctgtcctcagttccctcccttccagtgccccatccagcccagacccagaggccatcctccgactccggatgttcccatgactctgtcctgtccggccaacgttcgctgatctgttccatcccgcagacatacgcctccatggttacatcctcacacttaccacagcttcaatgtagggacgaaagtgtgagtaaagagcagcacatgatcccatccccaatcgtgcatcagccgtttcaggtcacaccaacgccgccagttggctcaagctatcaacccatgcagaccaacgtggtgtacaatggcccaacctgtctgccaattaacgccgctagctcccaagagtttgatagcgtgctgttccagcaggacgcaaccctctctggcttagtgaatctcggttgccagccactttctagtatcccgttccacagttcaaactccggatccactggacatctgctggcacatacgccacactctgtccacacccttccccatttgcagtcaatgggataccactgttcaaatacaggccaacgttctctctcttccccggtggctgatcaaattaccggccagccaagctcccaactgcaacccatcacctatggaccctctcacagtggatcggcaaccacagcttcaccagctgcctcacaccctcttgctagcagccctttaagcgggcctccgtctccacaactgcagccaatgccttatcagtcgccatcctctgggaccgcaagttccccctcacccgcaaccaggatgcactcgggccaacactccacccaggctcaatctacggggcaaggaggcctttctgcaccctcctctcttatttgccattccctgtgcgatcccgcgtcatttccgcccgacggagccacagtgtccattaagcctgagcctgaagaccgcgagccaaattttgctaccatcggtctccaggacattacgcttgacgacgaccagttcatctctgaccttgaacatcagccgtccgggtcagctgagaagtggccaaaccattctgtattatcctgccctgctccgttctggaggatctag

SEQ ID NO: 16390 - DNA, 3228 bp, Artificial Sequence
  Description of Artificial Sequence: Synthetic coding sequence
atgacaaccgctaattgcggtgcccacgacgaactcgatttcaagctggtgtttggcgaagatggtgcaccggctcccccaccgcccgggtcacggcctgcagaccttgagccggatgactgcgcttctatttacatctttaacgtggacccaccacccagcacactgactaccccgctctgcctgcctcaccatggcttacctagccattcaagcgttctgagccccagtttccagctgcaatctcacaagaactacgagggaacttgtgagatacctgagagcaagtacagtccccttggtggtcctaaacccttcgaatgcccgtcaattcagatcacaagcattagcccaaactgccaccaggaattagacgcacatgaagatgacctgcagatcaacgaccccgagcgggagtttttggagagacccagcagggaccacctgtacctgccgctggagccttcttatcgtgaaagcagtctgtcaccttctccggcaagcagtatttctagcaggtcgtggttcagtgacgcctcaagctgtgaatcccttagtcacatttacgacgacgtggatagtgaactaaacgaggccgcggcaaggttcacgctgggttctcctctaacaagccccggtgggtctcctggcggctgtccgggcgaggagacgtggcatcagcagtacgggttgggtcactctttgtccccaagacagagtccttgccacagcccccggagtagtgtgacggatgaaaattggctgtcccccagaccagccagcggcccatctagcaggcccacatcaccttgcggtaaacgtcgacattcatcagctgaggtgtgttatgcggggtcactgagtccccaccatagtccagttcccagccctgggcactcacctcggggctccgtgactgaagacacttggcttaatgcatcggttcatggcggaagcggcctgggccctgccgtgtttccgtttcagtattgcgttgaaaccgatattccccttaaaacaagaaagacctccgaggaccaggccgccattctgcctgggaagttggaattatgcagcgatgatcaaggctccctaagccctgctcgggagacctcaatcgacgacgggctagggagtcagtatccccttaagaaggactcctgtggtgatcagttcctttccgtgcctagcccttttacctggtcaaagcccaagcctgggcacaccccgatcttccgaaccagctcactaccccccctggactggcctctgcctgcccatttcggccaatgtgagctgaagatagaggtacaaccaaaaacgcaccacagggctcactatgagacagagggatcccgaggggcggtgaaggcatctacgggggggcaccccgtagtgaagctgttaggctacaatgagaagcctataaacctgcaaatgtttataggaaccgctgacgacaggtaccttagacctcacgctttttaccaggtccatcgcatcaccggcaagacagtcgcaacagccagccaggagataattatcgcatcgacaaaagtgttagagatccctctgttgcccgaaaataatatgtcggcaagcatcgattgtgccggaatactcaaacttagaaacagtgatattgaactcagaaaaggtgagacagacatcggtcggaagaacacccgcgtgaggttagtctttcgggtgcacattccccaaccttcggggaaagtgctgtcactgcaaatcgcctccatcccagtggaatgcagtcagaggagtgcacaggaactgccacacattgagaagtacagcattaattcctgtagcgttaatgggggacacgagatggtggtaactgggtcaaacttccttcccgagagtaagataatctttctggagaaaggacaggatggccgacctcagtgggaagtggaaggcaagattatccgagaaaagtgtcaaggggcccacatcgtgttggaagtgcccccctaccacaacccagctgtgacggccgcagtgcaggtgcatttctatttgtgcaatggtaagaggaaaaagagccagagtcagcgattcacatatacccccgtgttgatgaagcaggaacacagggaggaaatcgatctgtcttctgtgccttctttgcctgtgcctcacccagcacagacccagaggccttcctctgattctggctgcagccacgactccgtactgagtgggcagagaagcttaatctgtagcatccctcagacctatgccagcatggtgaccagtagccacctgccacagctccagtgccgggatgaaagtgtgtccaaagagcagcacatgattccttcccctatcgtacaccagcccttccaagttacgccaactccgccagtgggatcctcctaccaacccatgcagactaatgtagtttacaatgggcctacttgcctgcccatcaacgctgcctccagtcaggagttcgactccgttctattccagcaagatgctaccctcagcgggctagtaaacctagggtgtcagccccttagtagcatcccttttcattcatctaacagcggctctaccggacatctgctggcgcacactcctcactcagtgcatacattgccccacctgcagtccatgggttaccactgctccaataccgggcagcggagtcttagtagccccgtggcagaccagatcacaggtcaaccctcttcccagctgcagcctataacatatggcccttcccactcaggttctgctactaccgccagtcccgcggcgagccatcctttggcctcatcccctctctctggaccacctagcccacaactgcaacccatgccataccagtccccatcttcaggtacagcttctagtccatcacctgcaacacgaatgcatagtggtcaacacagcacccaggctcagtccacgggacagggggggttgtcagcccccagcagcctgatctgtcactcgctttgtgatccggcctcatttccaccagatggagctacagtgtcgattaaaccagagcctgaggatcgagagccaaactttgccacaatcgggcttcaagacatcaccctggacgacgtcaacgaaatcattggtagagacatgagtcagatcagtgtgtcgcagggcgcgggagtgtctagacaggcaccgctgccatctcctgaatcactggatctcggccgaagtgacggcctttag

SEQ ID NO: 16391 - DNA, 3198 bp, Artificial Sequence
  Description of Artificial Sequence: Synthetic coding sequence
atgacaacagcaaattgcggggctcacgatgaactggactttaagttggtatttggcgaggatggagcgcctgctcctcctccacccggctctaggcccgcagatcttgagcctgacgattgcgcttccatttacatattcaatgtggatccaccgcccagtaccttgacaaccccactgtgtctgcctcatcatgggctgccatcacactcttcagtgttgtcaccatcctttcagcttcagtcccataaaaactatgaaggcacatgtgagataccagagtcaaagtacagtccgttggggggtcccaagccgttcgaatgtcctagcatccagataacctcaatcagccccaattgccaccaggagctagacgctcatgaggacgacctacaaataaacgacccagaaagggaatttctggagcggccttccagagaccacttatacctgcctctggaaccctcctaccgtgagtcaagcctttcaccttctcctgcgagctccatttcttcacgttcctggttttcagacgcaagtagctgcgaatctctaagtcacatctatgacgacgtggattctgaactgaatgaggccgcagctcggttcaccctcggatccccactgacttcaccaggcggcagtcccggtgggtgtcctggagaggagacgtggcatcaacagtacgggctgggccactccttgtctcccagacagagcccatgccactcacctcgttcaagtgtgaccgacgagaactggctgtcaccgcggcccgcgagcggcccgtctagccgtcccacctccccctgcggcaaaagaagacactcatctgcagaggtctgttacgctggatcattatcacctcaccactcgccggtgccctctccaggacactccccgagggggtccgtgactgaagacacttggctgaacgcctctgtgcatggtgggtctgggctgggtcctgccgtgtttcctttccaatactgtgttgaaaccgatattccacttaagacacgcaagacgtccgaagatcaagccgctatcctgccaggaaaacttgaactgtgttccgatgaccaggggagccttagccccgctcgggagacatctattgacgatgggctgggcagccaataccctctgaaaaaagactcatgtggcgatcagttcttatccgtgccaagtccctttacttggagtaaacccaagcccggccacaccccaatctttcggacttcaagcctgccacccttagattggcccttgcctgcccattttggtcaatgcgagctcaagattgaagttcagcccaagactcaccaccgagcccactacgagacagagggctctcgcggggcagtcaaggcttctactggcggccaccccgtggttaaactgctggggtataacgaaaaacctatcaacttgcagatgttcattggtactgcagacgaccgctacttgaggccccacgccttctaccaggtccacagaattacaggcaagaccgtggccacagcttctcaggaaattatcattgcatcgacaaaggttctggagatcccattactaccagaaaacaacatgtctgcgtccatagactgcgctggcattttaaagctgcgaaactccgacatcgaactgcgaaagggtgagacagacatcgggcgcaaaaatacacgggtgcgtttagtattcagggtccacataccccagcctagtgggaaagttttgagtctacagatagccagcatccccgtcgagtgttcacagcgcagcgcccaagagctgccacacattgagaagtactccattaacagctgttccgtcaatggcggccatgaaatggtggtaaccggctcaaatttcctgccggaaagcaaaatcatctttttggaaaagggacaggatggccggccccagtgggaggtggaaggtaaaatcatccgagagaagtgtcagggcgcccacatagttctggaggtgccaccatatcacaacccagccgttaccgctgcagttcaagtgcatttttacttatgcaacgggaagagaaagaagagccagagccagaggttcacatatacccctgtcctcatgaagcaggagcatagggaagagattgatttgagctcagtgccctctctgccagtccctcacccagcacagacgcagaggccttcatccgactccggctgcagtcatgacagcgttctgagtggccagagatccctgatatgtagcatcccacagacctatgcatctatggttaccagttctcacctgccccagctgcagtgccgcgatgagagtgtttcaaaggagcagcacatgataccttccccaatagtccaccagccattccaggtgactccaacccccccagttgggtcatcataccagccgatgcagaccaatgtcgtgtacaacggacctacctgcctgccgatcaatgccgcctctagccaggaattcgactctgtcttattccagcaggacgcaacgttaagtggattggtgaatctggggtgtcagcccctgagctctatcccttttcattcatccaattctggttccaccggtcacctgctggctcacacccctcacagcgtgcacacactcccccacttgcagtcgatgggctaccattgttccaacaccggccaacgttccctctcctctccagtcgccgatcaaataacaggtcagcctagctctcaactgcagccaatcacctacggcccttcccacagtggctcagccactacagcatctccggccgcaagtcacccacttgcatcatctcccctgtcgggccctcccagcccacagctgcaacctatgccctaccagtccccttcttccggcacagcatctagtccctctcccgcgacgagaatgcactctggccagcattctacacaagcccagagcacaggccaagggggcctgtcagcccctagtagcctcatttgtcactcgctgtgcgatcctgcatcctttcctcctgacggcgccaccgtgtcgatcaagcctgaaccggaagatcgggagcctaattttgctactattggcctccaagatatcacgcttgatgatgatctgttcacgtccaacaacttcgatttactgcagctgagacccactttctggcccgtgccagctggtcgctatctgagaaacctagaatag

SEQ ID NO: 16392 - DNA, 1770 bp, Artificial Sequence
  Description of Artificial Sequence: Synthetic coding sequence
atgtttattggaaccgcggatgaccgctatctgcgccctcacgccttctaccaggtgcacaggattacagggaaaaccgtcgccactgcctcgcaggagataatcatcgctagtacaaaagtgctggaaatcccacttctccctgaaaataacatgagcgcaagcattgactgtgcaggtatactcaagctgaggaatagcgatatcgagctgcgtaaaggtgagacggatattgggagaaaaaacacccgggtgcgcctggtattccgggtgcacatcccgcaaccttctggtaaggtcttgtctcttcagatcgcctccatccccgtcgagtgcagccagcggtcagcacaggagctcccacatatcgagaagtattctattaatagttgttccgtgaacgggggtcacgaaatggttgtgacaggcagcaatttcctacccgagagtaaaattatcttcctcgaaaagggacaggatggcaggccacagtgggaagtggagggcaagatcattcgcgagaaatgtcaaggcgcgcacatcgtgttggaggtgccaccataccataacccagccgtgaccgcagctgtgcaggttcacttctacctatgcaatggtaaaaggaagaagtcccagagccagcgattcacatacacccccgttctcatgaagcaagagcatcgagaagagatcgacttgtcctcagttccaagcctgcctgtcccacacccagcccagactcaaagacctagcagcgattctggctgtagccacgacagcgttctgtccggtcagagatcgctcatttgctccattccccagacctatgctagtatggttacgagctcccatttacctcaattgcagtgccgtgacgagagcgttagtaaggagcaacacatgattccttccccaattgtccaccagccatttcaggtcacacctaccccaccggtgggctcaagttatcagcccatgcagacaaatgtcgtatataacggacccacctgcttgccaataaacgcagcctcctctcaggagttcgattctgtgctgttccaacaagatgcaacactgtcaggcttggtcaatctcggttgccagcccttgagctcaatacccttccattcctccaactctggctctacaggccatctgctggcccacacaccccattcagttcatactttgccccatctccagtccatgggataccactgttcaaacacgggccagcggagtctgtctagcccagtggctgaccagataaccggccagccaagcagccagctgcaacccataacttacgggccctcacatagtggaagcgctaccaccgcctccccagcggccagccacccattggcttctagtcctctcagcggccctccatctccgcagctgcagccaatgccttatcaaagcccaagcagtggaactgcctcatcacctagccccgctacccggatgcacagtggccagcatagcacacaggcccagagcacagggcaggggggtctctcagctcctagcagcctgatctgccattctctgtgtgacccagcaagtttccccccggatggggccacagtgtccataaaacccgaaccagaagatcgtgaacctaattttgccacgatcggactgcaggatatcaccctcgatgacgaccaattcatcagtgacctggagcaccagccaagcggttctgccgagaagtggcctaaccatagtgtcctctcttgtcccgccccattctggagaatttag

SEQ ID NO: 16393 - DNA, 2709 bp, Artificial Sequence
  Description of Artificial Sequence: Synthetic coding sequence
atgggcgccgcttcttgcgaggatgaagaactggaattcaagttggtctttggcgaagagaaggaggcccctcctctgggcgctggcggcctgggtgaagagctggattctgaggatgctcctccctgctgcagacttgccctgggggagcctcctccctatggcgctgcacccataggtattcctcggcctcctccaccacgccctggtatgcatagtccgccccctcgccctgcaccttcacccggtacttgggagagtcagcccgcaaggtctgtgagactgggcggcccaggcgggggagctggcggtgccggaggcggcagagttctagagtgcccgtccattcgcattaccagcatcagtccgactcctgagccccccgccgcgctcgaagacaatccagacgcctggggcgacggtagcccacgggactatccaccgccagagggcttcggcggctatagggaggccggagggcagggcggaggtgcgtttttcagtccatctcccggcagttctagccttagctcctggtcgttcttttccgatgcaagcgatgaggccgctctgtatgctgcatgtgatgaagttgaaagcgaactcaacgaggcggccagtaggttcggtctaggcagtcctctgccttcgcctagagcttctcctagaccctggacacctgaggacccgtggagtctctatgggccaagccctggcggcaggggccctgaggattcctggcttctcctttctgctccaggcccgacacccgctagccccaggccggcaagcccatgtggaaagcggcggtactcgtcctcaggcacgcccagttctgccagtccagcactgagccggcgtggttcattgggggaggagggatctgagccaccccccccaccaccactgcctctggcacgggaccccggctcaccaggtccttttgactatgtcggagctccaccagcagagtctattccacagaagacaagaagaacaagctctgaacaggctgtggctctgccacggtcggaggagcctgctagctgcaatggcaagctgcccctcggtgcagaggagagtgttgccccccccgggggaagcaggaaagaagtcgcaggtatggactacctagctgtcccttcccccctggcctggagcaaggcaagaatcggcggccactctcccattttcagaacttcggccttgccaccccttgattggcccctcccaagccagtatgaacagctagaactcagaatagaggtgcagccgagggcccaccaccgcgctcattatgagaccgagggtagccggggagccgtaaaagcagcccctggaggacaccccgtcgtcaaacttctgggctattctgaaaaacccctgactctgcagatgtttattggcaccgctgatgagcgaaacctgcgcccccacgctttctaccaggtccaccggattacaggtaagatggtggctaccgcatcttacgaggccgtggtgtccggcaccaaggtgctcgagatgacgttgctccccgaaaataacatggccgccaacatcgactgtgctggcatactcaaactgaggaatagcgatattgaactcagaaaaggcgaaaccgacatcggccgaaagaacacgcgagttcggctggtattccgtgtgcacgtgcctcagggaggaggaaaggtggtgtccgttcaagctgccagcgtgccaatcgagtgttcgcagcggagcgcgcaagagctccctcaggtggaggcgtactctcctagtgcctgctccgtgcgtggtggggaggagctggtgctcactggtagtaatttcctcccggacagcaaagtcgtctttatcgaacgaggacccgacggcaagctgcagtgggaggaggaagccaccgtgaataggctgcagtccaacgaggtcacactcacactcacagtccctgagtatagtaataagcgcgtgtctaggcccgtgcaggtctacttttacgtgtccaatggacgccgcaaacgcagccccactcagtctttcaggtttctcccagtcatatgtaaagaggaacccctgcctgacagttcactgcgcggctttccgagcgcttcagctacccccttcggcacagacatggacttttcccctcccagacccccgtacccgtcttacccgcatgaggaccccgcctgcgagacgccatacctgtctgagggtttcgggtacggcatgccgcccctttatcctcagacagggcctccaccaagctaccggccagggctcagaatgttccctgagacacggggaactacagggtgtgcacaacctccagcagtgtcctttctccctaggccttttccttcagacccatatggcggacggggaagtagcttttcactgggtctgccattctcgcctcccgcccccttcagaccccctcccctccccgcaagccccccactcgaaggacccttcccaagccaatcggacgtgcaccccctacctgctgaagggtacaataaggtcggccctgggtacggacctggagaaggggcccccgaacaggaaaaatcaagaggcggttactcaagcgggttccgcgactcggtaccgatccagggaattacccttgaagaggttagtgagatcatcggccgcgatctgtccggctttcctgcgccgcccggagaggaaccgcctgcttag

SEQ ID NO: 16394 - DNA, 2895 bp, Artificial Sequence
  Description of Artificial Sequence: Synthetic coding sequence
atgatcacaacactgccctccctgctgcccgcttccctcgcttccatatctcaccgggtgactaacctgcctagtaactcactttcacataacccaggcctgtccaagccggatttccccgggaatagctcccccggtcttccaagctcctcttctcccggccgggacctgggagcacccgcagggagcatgggcgctgcgtcctgcgaggatgaagaattggagttcaaactggtcttcggggaggaaaaagaagctccccccctgggcgccggggggcttggcgaagagctcgactctgaagatgcaccaccatgctgtagacttgccttgggggagccccctccatacggagccgctcccatcggcatccccaggccacctcccccaaggcccggaatgcatagtcccccgcctaggcccgcgccatctccaggaacttgggagtctcagccagcccgatcagtgagattgggtggccctggagggggcgctggcggagccgggggggggcgagtactcgagtgcccctcaatcaggatcacctcaatatctccaacccctgaaccccccgccgcactagaggacaacccagacgcctggggggatggctcccctcgggattatccaccccccgagggattcggtgggtatcgggaggctggcggccaaggggggggtgcctttttttccccatctccaggctctagttctctgtcatcatggagctttttctcagacgctagtgacgaagctgcattgtacgccgcttgcgatgaagtggaatcagagctgaacgaggccgccagtagatttggcctcgggtcaccactgccatccccacgggctagccctcgaccttggactccagaggatccctggtccttgtatggaccctctccaggcggaagaggtcccgaggatagttggctcctgttaagtgcaccaggaccaacccccgctagtccaaggccagctagtccctgcgggaaacggaggtactcctcttctgggaccccctcttctgcctcaccagctctgtctcggcgcggttctctcggggaagaggggagcgagcccccaccacccccacccctcccccttgcccgggatcctggttcaccaggcccattcgactatgtgggtgccccccccgcagaatctattcctcagaaaactagaagaacctcatccgagcaagccgtcgcgttacccaggagcgaagagccggcatcttgtaatggtaaactaccgctaggcgccgaggaaagtgtggcccccccaggtgggagccgtaaggaggttgccggaatggattacctcgcggtcccatcgcctctggcgtggagcaaggcgagaatcggtggtcatagccccattttcagaacgtccgccctgcctcccctggactggccactgcccagtcagtacgagcagctggagctcaggatcgaggtgcagccacgagcgcatcatcgtgcccattatgaaacagagggcagtcgtggcgccgtaaaggcggccccaggtgggcatcctgtcgttaaacttctgggttactccgaaaaaccattaacactgcagatgtttataggtacagcggacgaacgcaacctccggccccatgctttctaccaagttcacagaattacaggaaaaatggtggctacagccagctatgaggccgtggtttctgggacaaaggtccttgagatgacactgctgcccgagaataacatggcagccaatattgattgcgccggaatcctgaaactgaggaattcagatattgaattacgaaaaggagagactgatatcggccggaagaacacccgtgtccgtctcgtgttccgcgtgcatgttccccagggcggcggaaaggttgtctccgtgcaggccgcgtctgttccaatcgaatgctcccagagaagcgctcaggagctcccccaagtagaggcctatagtccaagtgcatgctcggtgcgaggcggcgaggagctggtactcactgggagcaatttcctcccggactcaaaagtggtgtttattgaaagaggtccagatggaaagctccaatgggaggaggaggccacggtgaacaggcttcaaagtaacgaagtgaccctcaccctgactgtgcctgagtatagcaacaagcgggtcagccgcccagtccaggtctatttttatgtaagcaatggtagaagaaagcggtccccaactcagagcttccgatttctccccgtcatttgtaaagaggaacccttacccgattccagtcttaggggcttcccatccgcctccgcaacacccttcgggaccgatatggacttttcaccaccacgaccaccatatccctcctacccacacgaggaccccgcatgcgaaaccccctacctgtcagagggttttggctatggcatgccgccactgtatccgcaaaccggacctccaccatcttatagacccggacttagaatgttccccgagactcgggggacaaccggctgcgctcagccgccagctgtatcattcctgccaagaccttttccatccgacccttacgggggccgcggatcttctttctcgctgggcctgcctttttccccaccagccccatttcgcccgccacccctgccagcgtctccacccctggagggcccctttccatcacaatctgatgtgcaccccctacccgctgagggatataacaaggtaggtccaggctacgggcccggagagggagctcccgaacaagagaaatctcgcggggggtactccagtggatttcgggacagcgtgcctattcagggaataaccctggaagagggaggttgtggcactggcggttgtgagtgtgaatgcgtgcaggagatagccttacatgtctgttag

SEQ ID NO: 16395 - DNA, 2670 bp, Artificial Sequence
  Description of Artificial Sequence: Synthetic coding sequence
atgcctgcctcaatctctagtatctttcccggcccaaccttacttctgagctgcggttccgaagaactggattcagaggacgctcccccttgctgtcgccttgccctcggagagccacctccctatggagcagcacctatagggataccccgccccccacccccaagaccaggaatgcattctccaccacccagacctgctccaagtccagggacttgggagtcacagcccgcccggtctgtcaggctggggggccccggcggcggcgccggtggcgccggcggaggtagggtgctggagtgcccaagcatccgcatcacttccatatctccaacccccgagccgcccgccgctcttgaagataaccctgacgcctggggagatggctccccaagggactacccgccccccgagggattcggggggtacagagaggcaggcggacaaggcggtggtgcctttttcagccctagccctggtagcagctccctgagttcttggagctttttctctgacgcttcggatgaggctgctttatatgcagcctgcgacgaggtggagtccgagcttaatgaggccgcttctagatttggccttgggtcccctctccccagtcctcgtgcctcaccacggccatggacccctgaggacccatggagtctctatggaccatccccaggcggaagaggccctgaggactcatggctccttctgagtgctcctggccctacacccgcgtccccccgcccagctagtccatgcggtaagcggcggtactctagctcaggtactccttcaagcgctagtcctgcactctcaagaaggggcagtcttggagaggagggaagcgagccccctccgccgccccccttgcctctggctcgagaccctggcagcccaggaccctttgactacgtgggggctccccccgccgagagcattccacaaaagacccggcggacatcctcagagcaggccgtagccctgccccgctctgaagagccagcatcttgcaatggcaagcttccactgggagcagaggagtctgtcgctcccccgggcggctcgcggaaggaggtggccggaatggactacctggccgtaccatcacctttggcgtggtccaaggccaggatcggtggtcacagtcctattttccgaacctctgcattgcctccactggactggccccttccctctcagtatgagcagcttgaactccgcatagaggtgcaaccccgggcacatcatcgcgcacattacgagacagagggctctagaggcgccgtcaaggcggctccgggcggacaccccgtcgtgaaactcctggggtatagcgaaaagccgttaaccctacaaatgtttattgggactgccgatgagcgcaacctccggccccacgccttttaccaggtgcacagaatcaccgggaagatggttgccacagcctcttatgaggcagtggtgtcaggcacaaaggtgctcgagatgacgttattgcccgaaaacaatatggctgctaacattgattgtgccggaatcttaaagctccgtaactcagatattgaacttcgcaagggggagaccgacatcggacgtaagaatactagggtcagattggtgttcagagtgcacgtaccccaaggcggagggaaggtggtgagcgtacaggccgcgtccgtgcctattgagtgctcacaacgaagcgcgcaagaactgcctcaggtggaagcttattctcctagcgcgtgcagcgtccgaggcggagaggaactagtcctgacaggatcaaatttcctacccgatagcaaggtcgtatttatagagaggggacctgacgggaagctgcagtgggaggaagaagctacggtgaatcgccttcagagtaatgaagtcacactgactctaaccgtacccgaatactctaataagcgtgtgtctcgtcccgtccaggtgtacttttatgtcagtaatggacggaggaaacgatcgccaacacaatctttcaggttcctaccagtgatttgtaaagaggaaccactccccgactcctccctgcgcggctttccgagcgcctcggccacccccttcggcactgacatggacttctcccctccccgcccaccttacccctcctatccccacgaagacccagcctgtgagactccgtacctttctgagggctttggctatggtatgccccctctctatccccagacagggccgcctccctcttacaggcccggcctgcggatgttccccgaaacccggggcacaactggatgcgcccagccacctgctgtgagctttttgcctaggccatttccttccgatccctacgggggtcgtggaagttccttctccttgggtttgcccttcagccctcccgcaccctttagacccccaccactgccagcctcacccccactggaaggtcctttccccagtcagtcggacgtacacccacttcccgcagaggggtacaataaggttggccctgggtacggcccaggcgagggcgcacccgagcaggagaagtctcgagggggctattcctccggattccgggactccgtgcctatccaaggaataacactggaggagggagggtgcggtacaggtgggtgcgagtgcgaatgcgtccaggagatcgcactccacgtgtgctag

SEQ ID NO: 16396 - DNA, 2745 bp, Artificial Sequence
  Description of Artificial Sequence: Synthetic coding sequence
atgctgtcagggagggacctcggggctccagccggctcaatgggggctgccagttgcgaggacgaggagctggagtttaaactcgtgtttggagaagaaaaggaagcacccccactaggagctggagggttaggcgaggagttggactccgaagatgccccaccctgttgccggctggctctcggagaacctcctccgtatggcgctgccccaatcgggatacccagaccccctccacctcggccaggtatgcattccccaccccctagacctgcacccagtcccgggacttgggagagccaacctgctcgctctgtgcgcctggggggcccaggtggaggggccggcggggctggcggcggccgagtgctggagtgtccaagcatcagaatcacgagcattagccccactccagaacctccagccgctttagaagataatcctgacgcatggggcgatggatcaccacgggattatcccccaccagagggatttggggggtatcgtgaagcaggcggacagggcggcggcgcctttttcagtccgtcccctggttcctcttcactgagttcttggtcattttttagcgatgcctctgatgaagctgccctgtacgctgcttgtgatgaggtcgagagcgagcttaatgaggccgcctcccgctttggattggggtcccccctaccatcccctagggctagtccccgcccatggacgccagaagacccttggagcttgtatggacctagccctggaggccgtggacccgaggacagttggcttctgctatcggcccccggacccacgcctgctagtccgaggcccgcgtcaccgtgcggaaaaaggcggtatagctcgagtggaaccccatcttccgccagcccagcgctgtcacggcgaggaagtctcggtgaagaggggagcgagcccccgccaccgccacctctgcctctcgcgagagatcctggttctccaggcccatttgactatgtcggagctccccccgctgagagcatcccacagaaaacgaggagaaccagctcagagcaggcagtcgcactacctagatccgaagaaccagcaagctgcaatggcaagctacctctcggggccgaggagtccgttgcccctccaggcgggtcccggaaagaagtcgctggcatggactacctagctgtgccttcacccttggcttggtcaaaggcaagaattggcggacacagtcccatattccgaaccagcgctctcccccctttggattggccgcttccaagtcagtacgagcaacttgaactccgcatcgaggtacagccgcgggcccaccaccgagcccattatgagacagaaggcagtaggggtgccgtaaaagccgcaccgggcggtcatcccgtggtcaagcttctcggttattctgagaaacctctgacgctccagatgtttattggtacagccgatgagaggaacctgagacctcacgctttttatcaggtccaccggattaccggaaaaatggtggcaactgcaagttatgaggcggtagtaagcggaactaaggtgctcgagatgaccctgttgcccgagaacaatatggcagcaaacatagactgtgccgggatcttaaaactgcgtaactctgatattgagctgcgaaaaggcgagaccgacattgggcggaaaaatactcgtgtgagactggtatttcgggtgcatgttccacagggaggaggtaaagtcgtcagcgtccaggccgcctctgtgccaatcgaatgttcacagcgatcagcccaggaactcccacaggttgaggcgtactctccgtccgcttgctctgtcagaggcggggaagagctggtgctgacaggctctaattttctccctgattctaaggtcgttttcattgagcgaggccccgacggaaaactccagtgggaagaagaggcgaccgtcaacagactccagtctaacgaagtcacactgacccttaccgtccctgaatacagcaataagagagtttccaggccggtgcaggtgtatttttacgtgtcgaatgggcggcgaaaaagatccccaacgcagtccttccggttcttgcctgtgatctgtaaagaggagccccttcccgatagctccttacgtggattcccctcagcgtcagctacacctttcgggacggatatggatttctcgccgcctcgaccaccttacccctcctatccgcatgaagaccctgcctgtgagacaccctacctgagcgaaggctttggatacggcatgccacccctgtatccacagaccggccctcctccaagctaccggcctggattacggatgttcccagagacccgcggtaccacagggtgcgcacagcctccggccgtatcatttctgccccgaccttttcccagtgacccatacgggggccgggggagcagtttcagtctgggcctgcccttttcccccccggctcctttccgtccaccccccttaccagcatccccccctcttgagggtccgtttccttctcagagtgacgtgcaccccctcccggcagaaggctacaacaaagtgggccctggctacggccctggcgagggtgccccagaacaggaaaagagccgcggaggctattcaagtggattcagagactctgttcctatccagggtatcacactggaagaagggggctgcggtactggcgggtgtgaatgcgaatgcgtgcaagagattgcactgcatgtatgttag

SEQ ID NO: 16397 - DNA, 2802 bp, Artificial Sequence
  Description of Artificial Sequence: Synthetic coding sequence
atggcagatggcggggccgattctgccgcccagcgactgcccgaagggccgggaagagtcgctcccggaagagatcttggagctccggctgggagtatgggcgccgccagctgtgaggatgaagagctcgaatttaagctcgtttttggagaggaaaaagaggccccccccttaggcgctggagggctgggggaagagctggatagcgaggacgccccaccctgttgcaggctggcactgggcgagccaccgccttacggcgctgctcccattggaatcccaaggccacccccaccccgccctggaatgcacagtcccccacctcgccctgcccctagcccgggtacttgggaaagccaacccgctaggagcgtaaggttgggaggacccggaggcggtgctgggggtgcgggcgggggccgcgtgctggagtgcccctctatcaggatcacgtcgattagccctaccccagaaccccccgccgctcttgaagataaccccgacgcctggggtgatggttcgccccgtgactacccaccaccagagggatttggcggctacagagaagctggcggccagggcggaggagcctttttcagtccaagtcccggatcatcttctctatctagctggtcctttttctctgacgcatcggacgaagccgcgctgtacgcagcttgcgacgaagtggagtccgagctgaacgaagccgccagtcgatttggactgggatcccctttaccctcgcctcgtgctagccccagaccctggacccccgaggatccctggtccctgtatggtccttcacctggaggcagaggccccgaagattcttggctgcttctatccgcgcctggtccgacccctgcaagtcctcgcccagcttcaccctgcggtaaacgccgttactcgagcagcgggacccccagttcagcgagcccagcactgtcaagaaggggaagcctcggcgaggagggtagtgagcctccacctcctccgcccctgccactggccagggaccccggcagtcctggcccctttgactatgtgggagctcctcccgctgagtccattcctcaaaagaccagaagaactagctcggagcaggcagttgccttgcctagaagtgaagagcctgcttcctgcaatggtaaattgcctctgggtgccgaagaatcagtggccccgcccgggggcagccgcaaggaggttgcagggatggattacttggctgtgccctcaccacttgcctggtcaaaagccagaattggaggtcattcccctatattccgaacctctgccttaccccccctcgattggcctctgcccagtcaatatgaacagctggaacttcgcattgaagtccagcccagggcgcaccatagggcccactacgagactgaaggcagtcgaggggcagtgaaggcagccccaggagggcatcctgttgtgaagttactggggtacagcgaaaagccacttaccctgcagatgttcatcggcactgcggacgaacggaacttacggccccacgcgttttatcaagttcaccgtatcaccggcaagatggtggcaaccgcgtcatacgaggccgttgtgtccggtacaaaagttctcgagatgacccttctgcccgaaaacaacatggcagccaatatcgactgtgcagggatcctcaagcttcgtaatagcgatattgagctgcgtaagggtgaaaccgatattgggcggaaaaacacccgggtgagattggtcttccgggttcacgtgccacagggcggcggcaaagtcgtctccgtccaggcggcaagtgtcccaatcgaatgcagtcagcgatccgcgcaggagctcccacaggtggaagcctactcacccagcgcatgctccgtacggggaggggaggaattggttctgaccggatctaactttctcccggacagcaaagtcgttttcattgaaaggggaccagacgggaaactccaatgggaggaggaagccaccgtcaacaggctgcaatcgaatgaggtgacccttacgcttactgtgccagaatattctaacaagcgggtgtcaaggccagtgcaagtgtatttctatgtgagtaatggacgcaggaaacgcagtcctacccaaagttttagattcctcccagttatctgtaaagaagagcctttgccagacagcagcctgcgcggctttccaagtgcctccgccactccattcggaaccgacatggacttctctcctcctcgccccccttacccatcttacccccacgaggatccagcctgcgagaccccttatctttcagagggcttcgggtacgggatgcctcccctgtacccccagaccggccctcctccaagctatcggcctggcctgagaatgttccctgaaacaaggggaaccacagggtgtgcccagcccccggccgtcagctttctgcccagacctttccccagcgacccttatgggggcagaggcagttcattttcgctgggtctccctttttcacctccggccccctttagacccccccccctccccgcttctccgccattagagggccctttcccgagccagagcgacgttcatcccctaccagcagaaggttataataaggtaggtcccggctacggccccggcgagggagcgccagagcaggagaaaagcaggggtggatattcatctggatttcgcgatagcgtaccaattcaaggaattacgcttgaggagggtgggtgcggcacagggggctgtgaatgcgagtgcgtgcaggaaatcgcacttcatgtatgttag

SEQ ID NO: 16398 - DNA, 2481 bp, Artificial Sequence
  Description of Artificial Sequence: Synthetic coding sequence
atggccgacggcggtgccgactcagctgcccagagactgcccgagggccctggccgggtcgcacccggtcgcgacctgggggcacctgcgggcagcatgggtgcagcttcttgtgaggacgaggagttggagttcaaacttgtctttggggaggaaaaagaagccccaccactgggggccggggggctcggggaggagcttgacagcgaggatgcgcccccttgctgtcgcctggccctgggagagcctcctccatacggcgctgccccaattggaataccccggccacctccaccacgacctggcatgcatagtcccccacccaggcccgcaccaagcccaggaacatgggagtcccagcccgcacgcagcgttcgcttggggggtcctggaggcggggccggaggggcgggggggggccgggtactcgagtgcccgagcatcaggatcacaagcatttctccaacacccgaaccaccagctgctttggaagataatcccgacgcatggggcgatggctccccccgtgactacccgcctcctgaggggtttggcgggtatagagaagccggaggccagggtggaggcgcatttttttcgccctcccccggaagcagttccttgtccagttggagttttttctctgatgcctcagacgaagcagcgctctatgccgcctgcgatgaagtcgagtccgaattgaatgaagcagcttctaggttcggactcggctccccactgccctccccgagggcaagccctagaccttggaccccagaagacccttggagcctttacggacccagtccaggcggacgcgggccagaggactcctggctgctgctttcggcgcccggacctacacctgcaagtccccggcccgctagtccatgtgggaagcgcagatatagcagctccgggaccccctctagcgcttctccagctctgtccagacggggatctcttggggaagaggggtccgaacctccacctccacccccactcccactagcacgcgaccccggctcaccaggccctttcgattatgtaggagccccgcccgcggaatccattcctcagaagacacggaggacaagtagcgaacaggccgtggctctgccgcgctccgaggaaccggcttcgtgcaacggaaagttgccgttgggagccgaggaatctgtagccccacctggcgggagtcgcaaagaggtagctggtatggactatttggccgtgccctcgccattggcctggtcaaaggccaggatcgggggccactctcctatatttcggacatccgcactacctccactggattggcccctgccatcccagtacgaacagcttgaactacgcatagaggtgcagcctagggcccaccatcgagctcattacgaaacggaaggctctcgcggagccgtaaaagcagccccaggggggcaccccgtcgtcaaactgctcggatactctgaaaagccccttactctacagatgttcatcggcactgcagatgaacgcaatctgagaccccatgctttctatcaggtccacaggatcacaggaaaaatggtagctactgcttcttacgaggctgtggtgagcgggaccaaagtactggagatgacactcctcccagagaacaacatggcagcaaatattgactgtgcaggaatcctgaagctgcgcaactccgatatcgaactaagaaaaggcgaaacggacattggccgcaagaacacacgagtacgcctcgtgttcagggtgcatgtcccacaaggcggagggaaggtcgtgtccgtgcaggccgcctctgttcctatcgagtgtagccagcggtcagcccaagaattacctcaagtggaggcatacagtccctctgcttgtagtgtgagaggaggggaagagcttgtgctgaccggttctaacttcttgcctgattcgaaggtcgtgtttatcgaaagaggaccagacggcaaactgcagtgggaggaagaagcaacagtgaatagactgcagtccaatgaggtgacccttacccttacagtgcctgagtattctaacaaacgggtgtctcggcctgtgcaggtgtatttctacgtaagcaacggaaggaggaaacggtcacctacccaatccttccgcttcttgccagttatctgcaaagaagaacctcttcccgactcctccctgagaggctttccatcagcatctgctacacccttcgggaccgatatggatttcagtccccctcgccctccctacccaagctatcctcacgaggaccccgcatgcgaaaccccttacctctctgaaggttttggctatggaatgccgcccctgtatcctcagacgggacctccgccttcctatcgcccgggtctgagaatgtttcctgagactaggggcacgactgtgtcagaaataattggtcgtgatctgtctggattcccagccccccccggggaagaaccccctgcttag

SEQ ID NO: 16399 - DNA, 2706 bp, Artificial Sequence
  Description of Artificial Sequence: Synthetic coding sequence
atgggtgccgcctcctgtgaggacgaggaactggaatttaagttggtgttcggcgaggagaaagaagcgcccccccttggcgcaggcgggttgggggaggagctggactccgaggacgcacctccctgctgtcgcctagccctgggagagcccccaccatacggtgcagcccccattggcattccacgacctcctccgcccagaccaggaatgcattctcctcctccgcgtccagctccctcacccggaacttgggagtctcagcccgctagatcagtccggcttggagggcctggaggcggagccgggggagcaggtggggggagagtgttggagtgccccagcatccgtatcacctccatcagtcctaccccagagccacccgcggctttggaagacaaccctgatgcctggggagacggcagcccccgcgattatccaccaccagagggcttcgggggatacagagaggccggaggccaggggggaggagctttttttagcccgtctcctgggagttccagcttgagctcttggtcattctttagcgacgctagtgatgaggctgctttatatgccgcttgcgacgaggtggaaagcgaattaaacgaggcagcttcacgtttcggcctaggatctcccctgcctagtccaagagcctctccgagaccatggacacccgaggacccgtggtcactgtatggaccttcacctggcgggcgcggaccagaagatagctggctgttgctttctgcccctggcccgacgcccgcaagcccacgaccagccagcccatgtggcaagaggcgctactccagcagcggaaccccctctagtgccagtcccgctctgtcccggcggggctcattaggggaagagggaagcgagcctcctcctccacctcccctgcctctggcccgggaccccggatcaccaggtccctttgactatgttggtgcccctcctgcggagagcattcctcagaagaccaggcgcacgtcctcagagcaagctgtggcgttacctaggagcgaagagccagcgtcatgcaacggaaagttgccacttggggccgaggaatcggtagctccgcccggagggagtcgcaaggaagtggccggaatggattatcttgctgtccctagccctttggcatggtctaaggctaggatcggcggacattcccctatctttcgcaccagcgctctacctcccctcgactggcctttgccttcccaatacgaacagctggagctgagaatagaggtacagccacgggctcatcatcgggcccattacgaaaccgaagggtcccgtggcgccgtaaaggcagccccaggcggccacccagttgtgaagctcctaggttactcggagaagcccctgactcttcaaatgttcatcggtaccgctgacgaaaggaatctgcgcccccatgcattctatcaggtgcataggatcaccggaaaaatggtggccactgcttcctacgaagctgtggtcagcggcactaaggtcttagaaatgacactcttgccagaaaacaacatggccgccaatattgactgtgccgggatactgaagctgaggaattctgacatcgagttacgaaagggagaaactgacatcgggcgtaaaaatacccgcgtgagactggttttccgggtccatgtaccccagggggggggtaaggtggtctctgtccaggctgcatcagtgccaattgaatgcagtcaaaggtcggctcaggagctgccgcaggttgaagcctattctccttcggcttgtagcgtccgagggggtgaggagctggtcctaacggggtctaatttccttccggactccaaagtcgtgttcatcgagcgcggaccggatggtaagctgcagtgggaagaagaagctaccgtgaaccggctgcagtctaacgaggtgaccctgactctcaccgtgcccgaatacagtaataaacgcgtgagtaggccagtacaggtgtacttttacgtcagtaatggccgcaggaaaagatcgccaacccaaagttttagattcctacctgtgatttgtaaggaagagcccttgccagacagttccctgcgggggtttcccagtgcctctgccaccccctttggcaccgatatggacttttcacccccacgccctccataccctagctatcctcacgaggaccctgcttgtgaaactccctatctgtcggaggggttcggctatggtatgccacctctctaccctcaaaccggaccgcccccttcataccggccaggtttgaggatgtttcccgagacccgtggtactaccggctgcgcgcagccgccggctgtgtcattcttacctaggccttttcccagcgacccttacggggggcgaggctcttccttctccttaggacttcctttctccccacctgccccatttagacctccgccgttgcccgcttctcctccattggagggtccttttccttcccagtcagacgtgcatcccctgccagccgaaggatataacaaagttgggccagggtatgggcccggggagggcgccccagagcaggaaaaatccaggggaggttactcgtcaggattccgtgacagcgtacccatccagggtattaccctggaagagggtggctgtggtacgggaggatgcgaatgcgagtgcgtacaggaaattgccctccacgtgtgttag

SEQ ID NO: 16400 - DNA, 2499 bp, Artificial Sequence
  Description of Artificial Sequence: Synthetic coding sequence
atgcactcgccacctcctagaccagcaccctcccctggaacttgggagagtcaacccgcccgatccgtgagactgggcggacctgggggtggagcgggtggcgctggcggaggccgtgttctggagtgtccgtcaatcagaattacgtcaataagtcccaccccagaaccgcccgccgctctggaggacaatcctgatgcatggggcgacggctccccacgtgattatccaccacccgaagggttcggagggtatcgggaggccggaggccaaggcggtggtgcgtttttctcccccagccccggctcttcttcgttgagtagttggtcattcttttccgatgctagcgacgaagccgccctgtacgctgcctgtgacgaggtagaatcagagctaaacgaggccgcatcccggttcggactcgggtcaccgttgccgagcccacgcgcctcaccccggccatggacaccagaggacccctggtcactctacgggccctctcccggaggtcgaggcccagaggactcatggctactgctgtccgccccagggcccacccctgcatctcctcggcccgctagtccgtgtggtaaacgacgctacagttccagcggcacaccttcgtccgcatctcccgctctgtcgagacgtggctccttgggtgaggaggggagcgagcccccgccccccccgccacttcccctcgcccgagatcctggttcccccgggccattcgactatgtcggcgcacctcccgccgaatcaataccacagaagactagacgcacttctagcgaacaagccgttgctctgccgagatccgaagagcccgcatcatgtaacggcaaattacctttaggagcagaggagagcgttgcaccacctggcggcagtcgaaaggaggtggctgggatggactacttagcggtcccatcccccctggcctggtccaaggcccgaattgggggccactccccaattttcagaacttctgcactgccccccctggactggcctttacccagccaatatgagcagttggaactccggatcgaagtacagccccgagcccatcaccgtgctcactacgaaaccgagggcagcagaggtgcagtcaaggccgccccgggcggacatccggtggtcaagctgttgggatactcagaaaagcctctcaccctccagatgttcatcggtactgctgatgaacgaaacctgcgaccacacgcattctatcaagtccaccggatcaccggcaagatggtagccaccgcctcctacgaggccgtggtatctgggacaaaggttttggaaatgacgctgctgcctgagaacaacatggccgctaacattgactgcgctgggatcttgaagctccggaactctgatatcgagctccggaagggagaaacagatatcgggagaaagaacacaagggttcgcctggtgtttcgggtgcatgtgccccagggaggcggaaaagtcgtgagcgtgcaggccgcatctgttcccattgagtgttcacagcgatccgcacaggaactgccccaggtcgaggcatatagcccttcagcctgttctgtcagaggcggagaagagctcgtgctcaccggatccaatttcttgcccgattcgaaagtggtgttcattgagcgggggcctgatggaaagctgcaatgggaggaggaagccaccgtgaatcgcctccagtctaatgaagtaactctcaccctcacagtacctgaatactccaataagcgcgtgtcacggccagtccaggtctacttttacgtgtccaacgggagaaggaagcggagccccacacaaagcttccggttcttgcccgtgatctgtaaggaagaaccgcttcccgattcgagtctccggggcttcccttcagcctctgctacccccttcgggacagatatggatttttctccgcctcggccaccttacccctcttaccctcatgaggatcccgcttgtgagacaccgtacctgtcagagggtttcggatatggtatgcctcctctgtatccccaaacaggccctccaccaagttacagaccaggcctgagaatgtttcccgaaactcgcggcactactggctgcgcccagccccccgcagtgtcctttcttcctaggccattcccgtccgacccatacggcggacgtgggtcttccttttcccttggcctgccgttttcgcctcctgctccattccgccctccaccactgccagcttctccgcccctggaaggcccattcccatcccagtccgacgttcatcctttgcctgccgaaggatacaacaaagtggggccagggtatggtcccggcgagggagcccccgaacaggaaaagagccgcggtggctacagtagcggcttccgggacagtgtccctatccaggggattaccctggaggaggtctccgagatcattggtagggatctctccggctttccagcccccccgggagaagagccacctgcgtag

SEQ ID NO: 16401 - DNA, 2385 bp, Artificial Sequence
  Description of Artificial Sequence: Synthetic coding sequence
atgggtgccgccagctgtgaagacgaagagctcgagttcaagttggtttttggcgaagaaaaagaggcaccacctctaggtgccgggggtttgggcgaggaacttgattcggaagacgctccaccctgctgccggttggccctgggcgagccccccccctacggggccgctccgatcggcatccctaggcctcctccacctagaccaggcatgcactctccgcctccccgaccagctccaagcccaggcacatgggagagtcagcctgcacgctcagtgcgcctgggaggacccggcggcggggcaggcggagctggaggggggagagtgctcgagtgtccctctatacgcataacgtctatctcgcctacaccggagcctcccgcagctctcgaggacaatcccgacgcctggggtgatgggagcccacgtgactacccccccccggagggattcggaggctaccgcgaagccggggggcagggaggaggggcattcttctctccgagccctggctcctcatctctcagcagctggtctttcttttccgatgcctccgacgaagcagccttgtacgccgcttgtgatgaggtagagagcgaactgaatgaggccgcgtctcgtttcgggctcggcagtccacttcctagcccaagggccagtccccgaccatggacgcctgaagatccctggtctctctacggcccaagtcctgggggaaggggccccgaggattcatggctgctgctttctgccccaggtcccacacccgcaagccccaggccggcatcgccctgtggcaagaggcgttattcgtcctccggaacccctagttctgcctctcccgccctctcccgtaggggatctctcggggaggaaggctcggagccgccgccgcccccccccctgcctctggcacgggacccggggagtcctggcccttttgactatgtgggcgccccccccgccgagtccatcccgcagaagactcggaggacaagctcagaacaagccgtggctctgccccgatctgaagagcctgcttcttgcaatggaaagctgcctttaggtgcagaggagtccgtcgctccccctggaggctcgagaaaggaagtagccggaatggattatctggccgttcccagccccctcgcctggtccaaggctcgtatcggaggccattcccctatttttcgcacctctgcactgcctccccttgactggccactgcctagccagtacgaacagctggagctgagaattgaagtgcagccccgggcccatcaccgcgcgcattacgagacagagggatccaggggagctgtgaaagcagcaccaggtgggcatcccgtggtcaagctgcttggatacagcgaaaagccgttgacattacagatgttcataggcactgcagacgagcggaacctgcggccacacgcattttaccaagtccatcgcattacagggaaaatggtggccactgcttcctacgaggccgtggtatccggcaccaaggtgctggagatgactctattacccgagaacaatatggccgcgaacattgactgcgctggaattctgaagctccggaactcagacatcgagctgaggaagggggaaactgatattgggagaaaaaataccagagtgcgtctggtgttccgggttcatgtgccccaggggggcggcaaggtcgtaagcgtccaggccgcttccgttcctatcgagtgtagccaacggagcgcgcaagagctccctcaagtggaagcttattctccttccgcctgtagcgtgcgtggtggggaggagcttgttctcacgggatcaaactttcttccggattcgaaggtcgtttttatcgagcggggccccgatggcaagctccagtgggaagaagaggcaactgtgaaccggttgcagagtaatgaggtaaccctgactttaacggtccccgaatactccaataaacgggtctcccgacccgttcaggtgtacttttacgtgtctaacggccgacgcaagaggagtcccacacagagttttaggttcctaccagtcatctgtaaggaagagcctttaccagacagctccctgagaggcttcccttctgccagcgcaactccctttggtaccgacatggactttagcccccccagaccaccatatccatcttaccctcacgaggatcctgcatgcgagacaccatatctgtctgaaggattcggatacgggatgcctcctctgtaccctcaaacgggacctccaccttcatatcgcccagggctgaggatgtttcctgagacacgcggtacaactgtttctgaaattataggtcgagacctgtctggatttcctgccccccccggagaggagcctccggcttag

SEQ ID NO: 16402 - DNA, 2499 bp, Artificial Sequence
  Description of Artificial Sequence: Synthetic coding sequence
atgcacagtcctcctcccaggcccgctcctagccctgggacgtgggagtcacaaccagccagatctgtcagattagggggccccggcgggggcgcaggcggggctggaggcggcagggtattggagtgtcctagcataagaatcacctcaatcagccccacaccggagcctcctgccgccctggaggataaccctgacgcttggggagatggttcacccagggactaccctcctcccgagggatttgggggctacagggaagcagggggacaggggggaggagcgttcttctccccaagcccaggcagctcctcattgagtagctggtctttcttctccgacgcttcagatgaggccgccctgtatgccgcttgcgacgaagtcgagtctgaactgaacgaggccgcttcacgtttcggtctgggctcgcccttaccatctccgcgggcaagccctcgcccctggactcccgaagacccatggagtctgtatggcccctccccaggaggacgcggaccggaggactcatggttattgctgtcagcgcctgggcctaccccagcttcccctagaccagctagcccctgcgggaagaggcggtactcatcctcaggaacaccctccagcgctagccctgcactcagtcgccgcgggagtctgggagaagagggctctgagcctccaccaccaccgcctctgcctctcgctcgagaccccggaagtccaggacctttcgactatgtgggtgcgccgcctgctgagagcatcccccagaagacaaggcgcaccagctctgagcaggcagtggccttgccccgctcagaagaacctgccagctgcaacggaaagttgcccctcggggccgaagagtcagttgctccccccggagggagccgaaaggaagtagctggcatggactacctggccgtcccttcccctctggcctggtctaaggcaagaattggcggccattctcctatcttccggacctcagctctcccacccctcgattggccccttccatcacagtacgagcaactggagttgagaattgaagttcaacccagggctcatcacagagctcactacgagaccgaagggtcccggggggctgtgaaggctgcccccggcgggcacccagttgtgaagcttctgggttactctgaaaagccactcacgcttcagatgtttatcggcaccgccgacgagaggaacctcaggccccacgccttttatcaggtccacagaattactggcaaaatggttgcaaccgcctcgtacgaagccgtcgtttctggcaccaaggtcttagaaatgactctcctcccggagaataacatggctgcgaacatagactgtgcaggaatccttaaattgcggaattccgacatagaattgagaaagggggagactgatatcggacgcaagaatacccgggttcgactcgtttttcgcgtgcacgtgccgcaaggtgggggaaaagtggtgagtgtacaggcagcaagcgtgccaatagagtgctctcaacggtccgcccaggagctgccccaagtcgaggcatactccccttccgcgtgttctgtaagggggggcgaggagctcgtcctgaccggctctaattttctaccggattcaaaggttgtgtttattgaacggggaccggacggaaaactgcagtgggaagaggaagccaccgttaacaggctgcaaagtaatgaagtaacactcacacttaccgtgccggagtactccaacaagcgcgtgagcaggccggtgcaagtctacttttacgtgagcaatgggagaagaaaaaggagccccacccaaagtttcagattcctccccgtgatatgcaaagaggagccactacctgactccagtttacgagggtttccctccgcttcggcaacaccttttggaaccgacatggatttctcgccacccagaccaccctacccaagttacccgcacgaagaccctgcgtgcgaaaccccgtacttgtccgaaggctttgggtacggtatgcctcccctgtacccacagactggcccacctccttcttaccgtccgggcttgcgcatgtttccagaaacaagagggactactggctgcgctcaaccacccgcggtgtcattcctaccacggccattcccctctgacccgtacggaggcagaggctcttcctttagcctgggactgcccttctcacctcccgctccctttaggcctccgcctctgccggcctctcctccgcttgagggacctttcccctctcagtccgacgtgcatccacttcccgcagaagggtataacaaggttgggcccggatacggcccgggagaaggagcccctgaacaagagaagtcaagagggggctattcctctggattccgagattctgtgcctatccagggaattaccttggaggaggttagcgagatcatagggagagatttgtccggttttccagcaccccccggcgaagaaccaccagcttag

SEQ ID NO: 16403 - DNA, 990 bp, Artificial Sequence
  Description of Artificial Sequence: Synthetic coding sequence
atgtttattggaaccgctgatgaacggaacctgaggcctcatgccttttaccaggtgcaccgcatcaccggtaaaatggtcgctacagcctcctatgaggctgtggtttctggcacaaaagtattggagatgaccctcttacccgagaacaatatggcagccaacattgattgcgccggaatcctcaaattgcggaactccgacattgaactacgcaagggagagactgatataggcaggaagaatacacgagtacgcttggtttttcgcgtgcacgtgccccagggaggcgggaaggttgtttccgtccaggcggcttccgtcccaatcgaatgctcccagagaagcgcacaagagttgccccaggtggaagcctactcgccctccgcttgcagtgttaggggaggcgaagagctcgtgctgacaggatctaatttcttacccgacagtaaggttgtgttcatagagagagggcccgatggcaaactccagtgggaggaagaagccacggttaataggctgcaatccaatgaggtgaccttgacactcaccgtccccgagtactctaataaaagagtctctcgcccagtacaggtttacttttatgtgtcgaacggccggcggaagcgtagtccaacccaaagttttcgctttcttcccgtcatttgcaaggaagagccgctccctgattcaagtttacgcggatttccatctgcctctgccacaccattcggtaccgacatggatttttccccacctcgccctccttatccttcctacccccacgaggatcccgcctgtgagaccccctatctctccgagggctttggctatgggatgcccccactttatcctcagaccggccctcccccttcataccgcccaggcctccggatgttccccgagacaaggggaactactgtctcagagattatcgggcgtgacctaagtgggtttcccgcgcctcctggtgaggaaccccccgcatag

SEQ ID NO: 16404 - DNA, 2574 bp, Artificial Sequence
  Description of Artificial Sequence: Synthetic coding sequence
atgatcacaaccttaccttcactcctgccggcaagcttagcgtctatctcgcatagagtgacaaacttacctagcaactcgctctctcacaatcctggcctcagcaagcccgatttcccaggtaatagctctcctggtcttccttcaagcagtagccccggcagagatctgggagctcctgcagggtccatgggtgccgctagctgcgaagatgaagaactggaattcaagcttgtttttggtgaggagaaagaggccccgccattgggcgcaggcgggcttggcgaagaattagactccgaggacgcccccccttgctgcaggttggcacttggggaaccccccccctatggtgctgcccccatcgggatacctagacccccacctccaaggcctggaatgcatagccctccacccaggcctgccccaagccccggcacctgggaaagccaacccgccaggtctgtccggctcggaggccccggggggggggctggtggagccgggggaggaagagtgctggagtgcccgtctattcgcatcacgtcgatcagcccaacacctgaaccgcccgctgccctagaggataatcctgacgcttggggggacgggtctccccgggattacccccctccggagggttttggcggctacagggaagccggtggacagggagggggcgccttcttctcccctagccctggcagctccagcctgtccagctggagtttcttctccgacgcctccgatgaggccgctctatacgccgcctgcgacgaagtggagtcagaattaaacgaggccgctagccggtttgggttgggttcccctctgcccagccctcgcgcgagcccccgcccctggacaccggaggacccgtggtcactctatgggccttctcctggcggccggggtcccgaagatagttggctgctcctctctgcccctgggcccacaccagcctccccccgacctgcttcgccttgtggaaagcggaggtatagtagctcaggtacccccagctcagcctcccccgctctgagtcggagaggcagtctgggcgaagaagggagtgaaccgcctccacctccacctttgccccttgcccgtgatccaggatcccccggaccatttgattacgtcggggctccaccggctgaatcaattcctcaaaaaacccggcgcacgagtagcgaacaggccgtggcgctgcccagatcagaggaaccagcttcctgcaatggaaagctgccattaggagcagaagaaagcgtggccccccctggtggaagtcggaaggaggtggcaggtatggactatctcgccgtaccctcacctctggcttggtctaaagcccgtattggtggacactcacccatcttcaggacctcggccttgccacccctggactggccactcccctcccagtatgagcagctggaactcaggattgaagtgcagccacgggctcatcatcgggcgcattacgagactgaaggctcccgaggcgccgtcaaggcggctccgggaggccatcctgtcgtaaagctactgggttatagcgagaaacccctgacactgcaaatgttcataggaacagccgatgagcgaaacctgaggccgcacgccttctaccaagtccatagaatcaccggcaaaatggtggccaccgcgagctacgaggcagtcgtaagcgggaccaaagtcctggagatgacccttctccctgagaataacatggctgctaatatagactgcgctgggatccttaagttgcgtaattcggacattgaactgcggaaaggtgaaacagatataggacggaaaaatacccgcgtgagactggtgttccgcgttcacgtcccacaagggggtggaaaggtggtgagtgtccaagcagcctccgttcctattgaatgctctcagcggtccgcgcaggagttgccacaggtcgaagcatacagcccgtcagcttgctcggtgcggggcggtgaagagcttgtcttaacaggaagtaatttcctgcctgatagtaaggttgtcttcattgagagagggcccgatggcaagctgcagtgggaagaggaagctaccgtgaatcggttgcagagcaacgaagtcaccctgaccctcacggtacccgagtatagtaataaaagggtgagccgcccagtgcaggtatacttttatgtttccaatggccgcagaaaacgatcacctacccagtcttttcgttttctgcccgtcatttgtaaggaagagccactgcctgatagctcgctgcgcggttttccaagcgctagcgctacaccatttggcacagatatggatttcagcccacctcgccccccctatccctcctacccccatgaggaccccgcctgtgagacaccatatctgtcggagggctttgggtacggtatgccccccctttatccacaaacaggaccaccgccttcttaccggcctgggcttcggatgttccctgagactagagggaccacggtgtccgaaattataggcagggatctgagcgggttccctgcccccccaggtgaggaaccacccgcctag

SEQ ID NO: 16405 - DNA, 2175 bp, Artificial Sequence
  Description of Artificial Sequence: Synthetic coding sequence
atgcacagccctcctcccagacctgcaccctcacctggaacctgggagtcccaacccgcgagatctgttaggctcggagggccaggcggcggtgccggaggagccgggggaggacgtgttttagagtgcccctccatccggatcactagcattagtcccactcctgagcctcctgcagcgctggaggataatcccgacgcctggggcgatggcagtcctagagactatccccctcccgagggatttggcggataccgggaagcaggagggcagggagggggcgcattcttttctccctcccctggcagttctagtctcagcagctggagttttttcagtgatgccagcgatgaggccgccctgtacgctgcctgcgacgaagtagaaagcgagctcaatgaagcggccagccgctttggcctgggctcccctctccctagtcctcgggcatcgccacgaccctggacccccgaagacccttggagtttatatgggccttcacccggcggaagagggcctgaggactcttggctgttactgagtgctccaggccctacacccgcatccccgcgcccggcctctccttgcggtaagcgcaggtactcctccagtggtactccttcaagcgcctccccggcgttgtcacgccgtggctccctcggcgaggaaggctccgaacctccaccacctcctccgctgccgcttgcccgtgatccgggcagtccaggaccctttgactacgtgggagcgcctccagccgagagcattcctcagaagaccaggcgcacatcttcggagcaggccgtggcactcccaagaagcgaggaacctgcctcatgtaatggcaagctaccattgggggccgaggagagcgtagcgccacccggaggttctcggaaagaagtcgctggaatggactacctcgccgtgccctcaccacttgcatggtcaaaggcacggattgggggtcatagccctatctttcggacctccgcccttcctcctctggactggccattgccatctcagtatgaacaactcgagctgagaatcgaagtgcagccacgtgcccaccaccgcgcgcactatgaaaccgaaggaagcaggggcgcggtaaaagccgccccaggcggtcaccccgtggttaagctacttgggtattccgagaagccactgacactgcagatgtttattggaacagccgacgaaaggaacctgaggcctcatgccttctaccaggtccaccgaattacaggcaagatggtcgccacagcctcttatgaggcagtcgtatccggcaccaaggtgttggagatgacgcttttgccggaaaacaacatggccgcgaacatagactgcgctggtatcctgaaactcagaaacagtgacattgagctccggaagggagagactgatatcggtagaaagaacacgcgtgtgaggctggtttttagggttcacgtccctcagggcggcggcaaagtggtatcagtgcaagcggcttctgtgcccatcgaatgttcacaacgcagcgcccaggaattgccacaggtggaggcctacagcccttctgcctgctccgtcagaggaggagaagagttggtgctgacaggcagtaattttctgcctgactccaaggtggttttcatcgaacgaggccccgacggcaagcttcagtgggaagaagaggccaccgttaatcgcctgcaatctaatgaggtaactctgactctgacagtaccagaatactctaacaagcgggttagcaggccagttcaggtctacttctatgtcagtaacggcagaaggaaacggagccccacacagagctttcgtttcctgcccgtgatttgcaaagaggagcccctgccggattcctccctgcgtggctttccatccgcttctgcgactcccttcggcactgatatggacttcagccctcctcgccctccttatccctcctacccacacgaggatcccgcctgtgaaaccccctacctgtccgaaggctttggttatggcatgccacctctgtacccccaaactggtccacctccatcctaccgaccagggttgcggatgttcccggaaacaagaggaacgacagttagcgagattatcgggcgagatttgagtggcttccctgctccaccaggggaggaaccccccgcgtag

SEQ ID NO: 16406 - DNA, 432 bp, Artificial Sequence
  Description of Artificial Sequence: Synthetic coding sequence
atgggggctgcttcctgcgaggatgaagaactcgaatttaagctggtattcggcgaagagaaagaagctcctccacttggggcaggcggcttaggagaagagctcgactccgaagacgcacccccttgctgcaggctggcccttggggaaccccccccttacggtgcggcacccattggaattccgagacccccaccccctcgacccgggatgcacagcccaccccccaggcctgcaccctcgccagggacgtgggagtctcagcctgcgcgatctgtgagactcggcggccccggcggcggagcaggtggagccggcggcggcagggtgctcgagtgtccctctatcaggataacatcaatctcccctacccccgaaccccctgctgccttagaggataatcccgacgcctggggcgacgggtctccgtag

SEQ ID NO: 16407 - DNA, 2424 bp, Artificial Sequence
  Description of Artificial Sequence: Synthetic coding sequence
atgctgtctggacgtgatctgggcgcccctgctggcagcatgggtgcagccagttgtgaggacgaggagctcgaatttaagttggtgttcggggaggaaaaggaggctccccctctcggggctggtggcctgggagaagagctggactccgaagatgcccctccgtgttgtagactagccctaggcgagccacccccctacggggcagctcctattggaatcccaagaccgcctcccccaagacccggcatgcacagccctcctccacgtccagcaccaagtcctggcacctgggagtctcaacccgcaagaagcgtcagactgggcggacccggtgggggagcaggaggcgcagggggaggaagagtcctggagtgtccatctattcgtattacatccatctcgcccacccctgagcctcctgctgctctggaggacaatcctgacgcctggggggacggatcccctagggactatccacccccagagggcttcggcggatatagggaagccggcggtcagggtggcggagcattctttagcccttccccaggttcatcaagcttatcaagctggagctttttctctgatgcctcagacgaggcagccctgtacgcagcgtgcgatgaggtagaatcagagctgaacgaggccgcatccaggttcggactgggatcaccactcccttccccaagggcttccccacgaccttggacaccagaggacccttggtcactgtacggcccaagtcccggcggcagaggacctgaggatagctggctgctgctaagcgctcctggcccaacacctgcatctccacggcccgcatcaccctgtggtaaaagacggtactctagttccgggaccccctcgtcagcttcacctgcgttaagtcggcgcggtagcttgggtgaagaggggtctgaaccccccccgcctcctccattgccactcgctagagacccaggctcccccgggccttttgattacgtgggcgcaccgcctgccgagtcaatacctcagaagaccaggcgaacttcttccgagcaggctgttgccttgcctagaagcgaagagcccgcaagctgtaacgggaaactgcctctgggggctgaagagagcgtcgcacctccaggcggctctaggaaggaagtggccggcatggattatctggccgttcctagtccattggcctggagcaaggctagaataggtggacacagtcccatcttcagaaccagtgcactgcctccattggactggccattaccaagccaatatgaacagctagagctgcgcatcgaagtccaaccgagggcacaccatcgggctcactatgagaccgaaggctcaagaggcgccgtgaaagccgccccaggaggccatcccgtggtgaaactgctgggctactctgaaaaaccgttaacactccagatgttcattggcactgccgacgaacgaaatctcagaccccatgcattttatcaagttcatcgtataaccggtaagatggtagccactgccagttacgaggccgtggtctccggtaccaaggtgcttgaaatgacactactgccagagaacaacatggctgctaacatcgactgtgccggaatccttaaactgcgcaacagtgatatcgagctgagaaaaggtgagacagacatcggccgtaaaaacaccagagtgagactcgtatttcgtgtccatgtgccacaggggggcgggaaagtagtgtcagtgcaggctgcgagcgtgcccatcgagtgctctcagagatccgcgcaggaacttccccaagtggaggcttactctccctccgcctgttccgtaaggggtggagaggagctggtgcttacggggagcaactttctgcccgatagcaaagtggtgtttattgaacggggacctgatggaaagctgcagtgggaggaagaagcaaccgtcaatcggctgcagtctaatgaggtgactttgaccttaacagtccccgagtactccaacaagagagtgagcaggccggtacaagtgtatttctacgtcagcaacgggcgcagaaagcgctctccaacccaatctttccggtttctcccagtaatctgtaaggaggaacccctacctgactcaagtctgcgggggtttccatccgcatccgctactccttttggaaccgatatggacttctcgccccctaggcccccatacccatcctacccccacgaagacccagcctgcgagacaccatacctttctgagggctttgggtacggaatgccaccactgtatccgcaaacgggaccccctccgtcctacaggcccggtctgcggatgtttccagagactcgtggcactactgtttctgagatcatcggtcgagatctgagtggattcccagctcctccaggggaagaacctccagcctag

SEQ ID NO: 16408 - DNA, 1311 bp, Artificial Sequence
  Description of Artificial Sequence: Synthetic coding sequence
atgttcatcggaactgctgatgagcgcaaccttcgcccccatgccttttatcaggtgcataggatcactggcaaaatggtggccacagccagctatgaggccgtcgtgtcagggactaaggtcctagagatgaccctcctccccgagaacaacatggcagccaacatcgactgtgctgggattctgaagctgaggaactccgacattgagctccgcaagggggagactgacattggacgcaagaataccagagtaaggttggtgttcagagtccatgtgccacaaggaggcggaaaagtggtgagcgtacaggccgctagcgtgccaatcgagtgcagtcagcgcagcgctcaagagctacctcaagtggaggcctattcgccgagtgcttgctcagtccggggcggcgaagaattagttctcacaggatccaacttcctacccgatagcaaggttgtgttcattgagagaggtcccgacggtaagctgcagtgggaagaggaggcaactgttaatcggctccagagcaacgaagtgaccctcacactgaccgtcccagagtatagcaataaaagggtgagtaggccagtgcaggtctacttctatgtttctaatggcaggcgaaagagatcaccaactcagtccttccgattcctcccagttatctgcaaggaagagccccttcccgactcaagccttcgaggatttccgtcagcttccgctactccatttgggacagatatggacttctcccccccaagaccgccataccctagctatccgcatgaggaccctgcttgcgagactccttacctgtcagagggcttcggatacgggatgccccccctgtacccacagacagggcccccccctagctacagacccggccttagaatgtttccagagacgaggggcactactggatgcgcgcaaccacccgccgttagctttttacctcggccattcccatcagatccctacggtggacgtggaagctcgttcagcttgggtctacccttctccccgcccgcaccttttcgccctcccccccttccggctagcccaccactggaagggccgttccctagccagagcgacgtgcaccccctgccagcagaagggtacaataaagtgggccccgggtacggcccaggggagggtgccccggaacaggagaaatctagaggcgggtactcaagcggatttagggactcggtgcctattcaaggaattacccttgaggagggaggatgtggaaccggggggtgcgagtgtgagtgcgtccaggaaatcgccctgcatgtatgttag

SEQ ID NO: 16409 - DNA, 570 bp, Artificial Sequence
  Description of Artificial Sequence: Synthetic coding sequence
atggactttagccctcctagacccccttaccctagctacccccacgaagacccggcatgtgaaacaccttacctgtctgaaggctttggctacggaatgcctcccctttaccctcagactggcccccccccctcatacagacccggtctccggatgttccctgaaacgagagggactacaggatgcgcgcagccccccgctgttagtttcctgcctcggccctttccatccgacccctacggcggccggggctcaagcttttctctcgggctcccctttagccccccagcaccatttcggcctccaccccttcccgctagcccacctctcgagggacccttcccctcacagtctgatgtgcatcctctgccagccgagggttacaataaagtgggaccgggatatgggccaggggagggcgcccctgagcaggagaagagccgaggaggctactcaagtggattcagggatagtgtaccaatccaggggattacacttgaagagggcggctgcggtaccgggggatgtgagtgcgaatgcgtgcaggagattgctctccacgtctgctag

SEQ ID NO: 16410 - DNA, 2673 bp, Artificial Sequence
  Description of Artificial Sequence: Synthetic coding sequence
atgcccgcttcaatatcatccattttcccagggccaaccctgctgctctcgtgtggcagcgaagagctggattctgaagatgccccaccctgctgccgactggccctcggcgaaccccccccgtacggcgccgcacccatcggcattccaaggccgcccccaccaaggcccggcatgcactcaccacctccaagaccagccccaagccccgggacatgggagagccagcctgcgaggagcgtccggctgggaggcccaggcgggggcgctggaggcgcaggcggaggccgagtccttgaatgcccttcaatccggattacaagcatatctcccaccccagagccgcctgccgctctggaagacaaccctgatgcctggggtgatggctcaccaagggactaccctcctcccgagggcttcggagggtaccgggaagcgggcggccaggggggtggcgcattcttcagtccgtcccctggaagctcttcattatctagctggtcctttttttctgacgcctccgacgaggccgccctatacgccgcgtgtgacgaggtcgagagcgagttaaacgaagccgcctcacgttttgggctcggatccccactgccctccccccgggcatcgccacggccctggactccggaggacccatggtctctctacggcccatccccaggcgggcgcggccctgaggattcttggcttctactgagcgcacctgggccaacgcccgcatcaccacgccctgcatcaccctgcggaaagagaagatacagcagctccggaacacctagctcagcctcgcccgccctgtcccggagaggctctcttggcgaggagggaagcgaacctccccctcctccacctcttccactggcccgggacccgggctctcctgggccatttgattacgtcggggcccctcccgctgagtccatcccgcaaaaaaccaggcggacaagttcggagcaggccgtagccctgcctcggtcagaagagcccgcctcatgcaacgggaagctgcccctcggagcagaagaatcagtggctcctccaggcgggagtcgcaaagaggtggccggcatggattatctggcagtgccctcacctctggcctggtccaaggctcgcatcggcgggcactcgcctatttttcggacttccgcattaccccccttagactggccactccccagccagtacgagcagttagagttaaggatcgaagtgcaaccaagagcacaccacagagctcattacgagactgaaggtagcaggggggcagtgaaagcagcccccggggggcacccggtcgttaagctgttggggtatagcgagaagcctttgacactacagatgtttattggaaccgctgacgaaagaaaccttaggccccacgcattctatcaggtgcacagaattacgggtaagatggtcgccaccgcatcctatgaggcagtcgtgtctgggaccaaggtgctagaaatgacattgctgccagagaacaacatggctgctaatatcgactgtgcggggattttgaagttgagaaacagcgacatcgagctgagaaaaggggaaactgacatcgggcgaaagaatacccgggtgcggctggtgttccgggtacacgtccctcagggagggggcaaggtcgtgtctgtgcaggctgcctccgtgccaattgagtgctcccagcgctctgcccaagagcttcctcaggtggaagcatattctccttctgcttgctccgtgcgtggcggagaggaattggttctgacaggtagcaacttccttcccgactccaaggtggtgttcattgaacgcggtcccgacggaaaactgcagtgggaggaggaggccactgtaaatagactgcaaagcaacgaagtaaccctgacactgacggtgcccgagtattctaataagcgggtgtcaaggccagtccaggtgtacttttacgtatccaatgggcggagaaaaaggagtccaacccagtcttttagatttctgccggtcatttgtaaggaggagcccttacccgactcctcgcttcgagggttccctagtgcatcagccactcctttcggcacagacatggacttttcacctccccgtcctccatatccctcttacccccatgaagatcctgcctgcgaaactccttacctgtcggaaggctttggctatggcatgcctccgctttaccctcagacaggcccaccgccctcttaccgccctggcctgcgcatgtttcccgagactagaggcactaccgggtgcgcacagcccccggctgtgtcctttctgccacgccccttcccaagtgatccctacgggggccgcggctctagcttttcactcggactaccttttagcccccctgcaccattcaggccacctccactgcccgcctctcccccactcgaaggaccattcccatcacagagtgacgtccaccctctgcctgcagaggggtataacaaggtagggccaggctatggccccggagagggtgcgcctgagcaggagaaatcaagaggtggatatagtagcggatttcgtgattcagtgcccatccaaggcatcactctggaagaggtttccgagatcatcggccgagacctctccggcttccctgctccacccggggaggaacccccagcttag

SEQ ID NO: 16411 - DNA, 2748 bp, Artificial Sequence
  Description of Artificial Sequence: Synthetic coding sequence
atgctcagcggccgggatctgggagcgcctgcaggaagtatgggggcggcttcatgcgaggacgaggaactggagtttaaactggtctttggcgaggagaaggaggctcctccactcggggccggcggcttgggtgaggagctcgactcggaagatgcacctccctgttgtagattagcgttgggtgaaccaccaccctatggtgccgctcctattggcatcccaagacctcctccaccacggccaggaatgcactctcctcccccgcgtcccgcgccctcccccggtacctgggaaagccaacctgctagaagcgtgcggctgggggggcccggagggggggccggaggagccggtggtgggagagtcctggagtgcccttccatcagaattaccagcatctcacccacccctgagccgcccgccgcgcttgaagataacccagacgcttggggcgatggctcccctagagactatccgcctccggagggatttggtggttatcgcgaggctggcggtcaaggagggggggcgtttttcagcccctccccgggctcttcctctttgtcctcctggtctttcttcagcgatgcttccgacgaggccgccctatacgccgcgtgcgacgaggtggaaagcgagctgaatgaggctgctagtaggttcggcctaggaagcccgctgcctagcccaagagctagtcccagaccctggaccccagaagatccatggagcctgtatgggcctagcccaggcggccgtggaccggaagatagctggttactgctctcagcaccaggtccaactcccgcatctccccgacctgcgagcccctgtggcaaacgccgctacagttctagcggaacaccaagctcggcttcgccggcgctgtcgcgccgcgggagcctcggagaggaaggatccgagcctccgcctcctccccctctacctctcgcaagagacccgggctcgccgggcccctttgattacgtgggggcgccccctgcggagagcatcccacagaagaccagaagaacaagcagcgaacaagccgtggcactccccaggagcgaagaacctgcctcatgcaacggcaaattgccattaggagccgaagagtccgttgcaccgcctgggggcagcagaaaagaggttgccggaatggattaccttgccgtgccttcgcccctggcatggtcaaaggcccgcatcggcgggcattctcccatcttcaggacatcagcgttgcctcccctggactggccacttcccagtcagtatgaacagctggagttgcgtatcgaggtgcagccacgagcacaccacagagcccactatgaaaccgagggctctagaggcgcagtgaaagcggcgccaggtggccatcccgtcgtgaagctccttggctattccgagaagcccctcacgctgcagatgttcatcggaaccgctgacgagaggaacctgcgacctcatgcattttatcaggtgcatcggataacagggaagatggtcgccactgcctcttacgaagccgttgtcagtggaactaaagtactggagatgaccctgttgcctgagaacaacatggcagcaaacatcgattgcgccggtatcctgaaactgcgtaactcggacatcgagctgcgcaagggagaaactgatatcggtcgtaaaaacacgagggtgcgtctggtatttcgtgtccatgtacctcagggaggagggaaagttgttagtgtccaggccgcttcagtgccaatagagtgcagccagcgttcggcccaggaactccctcaggttgaggcctactcccctagcgcctgcagtgtgagaggcggggaagagttggttctgacaggcagtaatttcctgccagattctaaagtcgtcttcatagaacgcggccccgatggaaaacttcagtgggaggaggaagcaacagtgaaccggcttcagtctaatgaagtcacactaacactgaccgtgccggaatatagtaataagagggtgagcagacctgtgcaggtgtacttctatgtatccaatggcagaagaaagagatcacctactcaatccttccgcttcctgcccgtgatctgcaaggaagaacctctgcccgactcgagtctacgaggctttccttcagcttccgccaccccatttggcaccgatatggacttcagtcctcctcgtcccccctatccttcttatcctcatgaagatcccgcctgcgagaccccctacctgtccgagggttttggctatgggatgcctccattgtatccacagacaggaccaccccccagctacagacccggactgaggatgttccccgaaactagggggaccactggttgcgcgcagccccccgctgtcagctttcttccccgccccttcccatccgatccatatggagggcgaggctcttccttttcactggggctgccttttagtccgccagcacccttcagacctccacctctgcctgctagtcctcccctcgaggggccgtttccgtcccaatctgatgtgcacccactgccagccgagggctacaacaaggtgggacccggttacggacccggagaaggggcgcccgagcaagagaagtctcggggaggttattctagtggtttcagggacagtgtgccaattcagggtatcaccctggaggaggtctccgagataattggacgggatctgagtggcttccccgctcctccaggcgaggagccgcctgcatag

SEQ ID NO: 16412 - DNA, 573 bp, Artificial Sequence
  Description of Artificial Sequence: Synthetic coding sequence
atggacttttcaccccctcgacccccatatccatcatatccccacgaggatccggcctgtgagacaccgtatctgtccgagggatttggatacggtatgcctccactgtacccccagactggccctccgccctcatatcggcctggactgcggatgttcccggaaacgagaggaaccacaggttgcgcccaaccccctgctgttagtttccttccacggccattcccaagcgacccctatggtggacggggcagctccttcagcttgggcctcccattttctccacccgctcctttccgccccccacctctgcctgcaagcccaccactggagggtccgtttcctagccagtctgatgtgcatccactgccggctgagggctataacaaagtgggacctggttacggaccaggcgagggcgcaccggaacaggagaaatctcgagggggatattccagcggcttccgcgattctgttcctatccaggggattactcttgaggaggtgagcgaaataataggcagagacttgtccgggtttcccgctcctcccggcgaggagccgcctgcgtag

SEQ ID NO: 16413 - DNA, 2349 bp, Artificial Sequence
  Description of Artificial Sequence: Synthetic coding sequence
atgcctgcatccatatcttcaatctttcccgggcccacgcttctgctcagttgcggctccgaggagttggactccgaggatgcccccccgtgctgtcgcctggctttgggggaaccccctccatacggagcagcaccaatcggaatcccgagaccacctccccccagaccaggtatgcacagcccgccccctcggcctgcccccagtccaggaacttgggaaagtcagcccgcccgttcagttaggctgggaggaccaggcgggggcgctggcggagccgggggcggacgggtgctagagtgtccaagcatccgcataacaagtatctcccctactcccgagcctccagccgccctagaagacaacccagacgcctggggcgatggctctccccgtgactatccccccccagaggggttcggcggctacagagaggccggagggcaaggcggcggggcctttttctctccaagtcccggctcaagcagcctatccagttggtcattctttagcgacgcttcggacgaggccgcactttacgccgcttgtgacgaggtcgagtctgaactcaacgaggccgccagcagatttggactggggtcaccactgccaagccccagggctagccctagaccatggacacccgaggacccatggtctctctacggaccatctcccggcggcaggggtccggaagatagctggttattactgtcagcccccggacccacacccgcttccccccgtccagctagcccctgtggcaaacggagatatagttcctcgggcacgccatcctccgccagtcccgccctttcccgaaggggctcccttggtgaggagggctctgagccaccccctcctcccccactgcctctagcccgggaccctggatcaccaggaccgttcgattacgtcggcgcgcctccagccgaatctatcccccagaaaactagacggacgtcttcagaacaagctgttgcactcccacggagcgaggagccagcctcctgtaatggaaaactgccattaggagccgaggagtccgtagctccacccggtggtagcaggaaggaggttgctggtatggattacttggcagtgcccagccccctggcttggtctaaagcaaggatcgggggccatagtcctattttccgcaccagcgcactccctcctttagactggcccctaccctcccagtatgagcagctggagctgcgaattgaggtgcagcctagggcccatcacagggcgcattacgagaccgaaggaagccggggggcagtgaaagcagccccaggaggacatccagtggtgaagttattaggctattcagagaaacctctcactcttcagatgtttatcgggacagcggacgaacgaaatcttcggcctcatgcgttttatcaagtgcataggatcactggtaaaatggtggccacagcaagctacgaggctgtcgtctcaggcacgaaggtcctggagatgaccttactcccagaaaataacatggccgcgaatattgactgcgccgggatcctgaagctaaggaacagtgacatcgaacttcgcaaaggggaaacggacattggcagaaaaaacacgagagtgaggctagtcttccgagtgcacgtgccgcaaggggggggtaaggtggtttccgtgcaggcagcatcagtaccaattgagtgttcacagaggtctgcccaggagctgcctcaagtcgaggcttactctccctccgcttgctcagtgagaggaggcgaggagctggtgctcacaggaagtaatttcctgccagactctaaggtagttttcatcgagaggggacctgacgggaaactccagtgggaggaggaggctaccgtgaacagattacagtccaacgaggtgacactgacactgacggtgccagaatacagcaataaaagggtgagcaggcccgtccaggtatacttctacgtgtcaaatggaaggcggaagcgcagccccacacagtcctttaggttcttacccgtcatatgtaaagaggagcctttgcccgattcttcactacggggcttcccaagcgctagcgcaactcctttcggcaccgatatggactttagtcccccacgccctccgtacccctcctaccctcatgaagaccctgcctgcgaaaccccatacctgtcagaaggcttcggatacggaatgcctccgctatacccccagaccgggcctcctccctcctacagacctggcctaagaatgttccctgaaactagagggacaacagtgtcagagatcatcgggagggacctcagtgggttccctgcacccccaggcgaggagccacccgcgtag

SEQ ID NO: 16414 - DNA, 2805 bp, Artificial Sequence
  Description of Artificial Sequence: Synthetic coding sequence
atggccgacggaggcgctgatagtgcagctcagaggctccccgagggacccggacgggtggctccggggcgggacctgggggccccggcaggtagcatgggcgctgcctcctgcgaggatgaggagctcgagtttaagctcgttttcggggaggagaaggaggcgcccccacttggagccggcgggctgggtgaggaacttgactcagaggacgcccctccatgctgtagactggctttgggggagccaccaccttacggagctgcacccattggcataccacggccacctcccccgcgccccggaatgcacagtccccccccacgccctgctccctcgccagggacttgggaatcgcagccagcgagaagtgtgcgacttggtggcccaggcggcggtgccggaggagcaggcggcgggagagtgctggaatgtccatcaatccgaatcacctcaatcagccctaccccggaaccaccagcagctctggaagataatccagatgcttggggcgacgggtcacctagagattatccacctcccgaaggctttgggggatatagggaagcaggcggacaggggggaggagctttcttttcaccttcacctggaagctcttctctgagctcatggagtttcttcagcgacgcctcagacgaagcagccctgtatgccgcgtgtgatgaagtggagagcgaactcaacgaggcggcctcgagatttggacttgggagtccacttccatcgccccgggctagcccacggccatggacccctgaagacccctggtcgctgtacggacccagcccgggtgggaggggccccgaggatagctggcttctactgagtgcacctgggcccaccccggcatccccacgccctgctagcccctgtggtaagcgccggtatagctcgtccgggacaccctcttcggcctcaccggcattgagccgccgcggtagcctcggcgaggagggatctgagcccccaccaccacctccactgcctcttgcgcgggacccaggctctccgggaccgtttgattacgtgggggcaccacctgcggagtcaataccccagaagacgaggcgcacttcttctgagcaagctgtcgccctcccacgtagcgaggagccagcttcgtgtaacgggaagctgccactgggggccgaggagtcagtggcgccccccggcgggagccggaaggaggtggccggtatggattacctagcagtcccctcaccattggcctggagcaaggcacggatcggtgggcatagtccaatcttcagaacaagcgcactacctcctttggactggccactgccatctcagtacgaacagcttgagctgcgtattgaagttcagccaagagcacatcatagagcccactatgaaacggaaggaagtcgaggcgctgtgaaggccgcccccggcggccaccccgtagtgaagctgcttggatattctgagaagcctctgacactacagatgtttattggtaccgcagatgagcgcaatctacgcccacacgctttttatcaggtccacaggatcaccggcaaaatggtcgcaactgcctcttacgaggctgtcgtttccgggactaaggtgttagagatgaccctgctgcctgagaataacatggcggcaaacatcgactgcgccgggatactgaaactaaggaacagcgatatcgagctgagaaaaggcgaaactgacattggccgtaagaatacgagagttagattagtcttccgagttcatgtcccacagggaggtggtaaggtcgtctcagtccaagctgcatcagtgcctattgagtgtagccagaggtcagcacaggaacttccacaggtcgaggcctatagcccaagcgcttgctcagtccgaggcggcgaagagctggtgctgacagggagtaattttcttcctgacagcaaggtggtgtttatcgaaagggggcccgacggtaagttgcagtgggaagaggaagccacagtcaatcgcctgcaatctaacgaggtcaccctcactctgaccgtccccgagtatagcaataaacgcgtgtcgcgcccagtacaggtctatttttacgtttccaacggccggcggaaacggagccccacacagagctttagatttctgccagttatctgcaaagaggagccactccccgactcttcattacgaggctttccctcagcatctgccactccttttggtaccgatatggatttttcccccccaaggcccccttatccaagctatccccacgaagaccccgcatgcgaaaccccttacctttccgaagggttcggctatggtatgccccctctgtaccctcaaaccggccctccaccttcatataggcccggccttcgaatgtttccggaaacacgggggacaaccggttgcgctcagccccccgccgtttctttcttgcctcggcccttcccaagcgacccatacggcggacgaggatcttcattttctttgggactcccattctctcctccagcaccattcaggcccccacctctcccagcatcccctccgctcgagggacctttcccgtcccagtcagatgtgcatccactgcctgccgaaggatacaacaaggtgggacctggttacggcccaggcgagggagcccctgagcaggagaagagccgaggtggttactctagcggctttcgcgactcggtcccaattcagggcatcacactcgaggaagtgtcagagattattggccgggatctttccgggttccccgcccctcccggggaggagccgcctgcttag

SEQ ID NO: 16415 - DNA, 1314 bp, Artificial Sequence
  Description of Artificial Sequence: Synthetic coding sequence
atgttcattggcaccgctgacgagcgaaacctacgcccccacgcattctatcaggtacacagaattactggcaagatggtggcaaccgcttcatacgaggccgtggtctcaggcacaaaagttttagagatgacactgttaccagaaaacaatatggccgctaatattgattgtgccggcatcctgaagctgcggaactcagacatcgagctaagaaaaggagagacagacattggaaggaagaatactcgtgttagacttgtgttccgagtccacgtaccccaggggggaggaaaagtagtgagcgtccaggctgcttcagtacctatagagtgcagtcagcgctccgcccaggagttgccgcaggtcgaagcatactctccttccgcttgctctgttcgcgggggggaagagctggttttgaccggctcaaatttcttacccgacagcaaggtggttttcatcgagcgggggccagacggaaagctccagtgggaggaagaagctaccgtcaaccgccttcagagcaacgaagttaccctgactcttaccgttcctgaatattccaacaagcgggtctctaggccagtgcaggtgtatttttacgtttccaatggaagaaggaagaggagccctacgcagtcttttcgattcctcccggtcatttgcaaggaggaacccctgccagattcatcactcagaggcttccccagcgctagtgccacgccgtttggaacagatatggatttttccccccctcggccgccatacccatcttatcctcacgaggatcctgcatgtgagactccatacctgtccgaaggcttcggctatggaatgccccctctctatccacagacgggtccacccccctcttatcgccctggcctgcggatgtttccagagaccagaggtacaactgggtgcgcacaacctcccgccgtcagtttcctccctcgacccttcccctcagatccttatggaggacgggggagcagtttctcactcggcctcccattttctccccctgcgccttttagaccaccaccccttccagcctcacctcccctggaggggccctttcctagccagtccgacgtccacccgctgcctgcagaaggctataataaggtcggacccgggtatggacccggcgaaggggcaccggaacaggagaaaagtcgcggggggtactcgtccggctttcgggactctgtgccaatccaaggtattactctggaggaagtctcagagatcatcggccgggatctgtccggtttccctgcgcctccaggggaggagccccccgcctag

SEQ ID NO: 16416 - DNA, 2496 bp, Artificial Sequence
  Description of Artificial Sequence: Synthetic coding sequence
atgcacagtcccccgccaaggcctgccccatcacccggaacatgggagtcccagcccgctcgcagtgttagactagggggacccggcgggggagccgggggggccggaggcggacgcgtactcgagtgtccttctatcaggataacaagcattagtcccacgccagagcctcctgccgccttagaggataacccagatgcctggggggatgggtcacccagggactatcccccccccgagggtttcggcggataccgggaagcggggggacagggggggggggccttcttttccccttcaccaggcagctccagtctgagttcatggagtttcttctctgatgcaagtgacgaagccgcgctgtatgccgcctgtgatgaagtggaatctgagctaaatgaagcggccagcaggtttggactcggctctccattaccaagcccacgcgcctcccctcgtccatggaccccagaggacccctggagtctgtatgggccatctccagggggtcgcggcccagaggactcatggttgcttctctccgctcccggtcccacacccgcctctcctagaccagcctcaccgtgcggaaagcgtcggtactctagcagcggcactccgtccagcgcctccccagctctgagcaggcgtggttctttgggcgaagaggggtcagagccgcccccaccaccgcccctgcctctggcaagagatcctggatcccccgggccttttgactatgtcggggccccgcctgccgagagcatcccacagaagacacgaagaacttcctccgaacaagctgtggccctgcccaggagcgaggagcctgccagttgtaatgggaaactgcctctgggagctgaggaatctgtggcacctcccggggggtctaggaaagaggtggccggcatggactaccttgctgtgccttcccctctcgcctggtctaaggcacggattgggggtcactccccaatttttcggacctctgcgctgcccccattggattggcctctgccaagtcagtacgagcagctggagctgcgaatcgaggtccagccaagagcacatcacagagcacactacgaaaccgaggggtcaagaggtgcggtgaaggcggccccaggcggacaccctgttgtcaagctgctggggtatagtgagaagcccctgacactgcaaatgttcatcggcactgccgatgagagaaatctgcgaccccacgccttttaccaggtgcatcgcatcacgggtaaaatggtggctacagcctcatacgaggcagtcgtaagtggtacaaaggtcttggagatgacactgctccccgagaacaacatggcggccaacatcgactgtgccggaatcctcaaactgagaaacagtgacatagaactaagaaaaggcgagacagacattgggaggaaaaatactagggtacgactggttttcagagtgcatgtgccccaaggaggaggaaaagttgtgagcgtgcaagccgcaagtgtgccgattgaatgttctcagcgcagtgcgcaagaactccctcaggtcgaggcctactcacccagtgcgtgcagtgtcagagggggggaagagttagtcctcacaggctcgaacttcctgccagattccaaggtggtgtttatcgaacgcggacctgatggtaaactgcagtgggaggaggaggccactgtgaatagactccagtctaatgaggttaccttgactctgaccgtccccgagtactccaacaagcgtgtgagccgccccgttcaggtgtacttctacgtcagcaacggtagacgaaagcggtccccaacgcagtcattccgattcctccctgtcatttgtaaggaggagcccctgcctgacagctcgttgcgggggttcccttcagcctcagcaacaccctttggtaccgatatggattttagcccaccaagacctccctatccctcctatccacatgaagatcctgcctgtgaaactccatatttatctgagggtttcggctatggcatgccgcctctctaccctcaaacaggaccacctccgtcttatcgtccagggctccgtatgttccctgaaacccggggtactacagggtgtgcacagccaccagccgtctccttcctccctcgcccattcccttccgacccttacggtgggcgcgggtctagtttttctctgggcctgcctttcagtcctcctgccccattccgccctcctccattgccagcatcgcctccactggagggcccttttccatcccagtccgacgtgcaccctctgcccgcagaagggtataacaaggtaggccccgggtatggtcctggcgaaggcgcccctgagcaggagaaatctcgtggcggttattccagcggatttcgggactcggtgccaatccagggtattaccttggaagagggggggtgcggcaccggtgggtgcgaatgtgaatgcgtacaggaaatcgcgttgcatgtgtgttag

SEQ ID NO: 16417 - DNA, 249 bp, Artificial Sequence
  Description of Artificial Sequence: Synthetic coding sequence
atggatttctccccccctcggcccccatacccttcctatccccatgaagatcccgcttgcgagaccccctatttgtccgaagggtttggatatggcatgcctcctctatatccccagacaggcccccctcccagctaccggccagggttaagaatgttcccggaaaccaggggtaccacagtgtccgagatcatcggaagagacctgagtggttttcccgccccccccggcgaggaaccaccggcatag

SEQ ID NO: 16418 - DNA, 315 bp, Artificial Sequence
  Description of Artificial Sequence: Synthetic coding sequence
atgtcttctgctgcaagaagcagactgactagggctacccggcaggagatgctcttcctggccctgttgctgctgcctgtcgtggtggcattcgcgcgggccgaggctgaggaagatggggacctccagtgcctgtgcgtgaaaactacttctcaggtgaggccaaggcacataacttctttggaagtcattaaggctggaccccattgccccacagctcagcttattgccacgctgaaaaacgggcggaaaatctgcctggatctacaggcccttctatacaagaagattattaaagagcatttagagagctag

SEQ ID NO: 16419 - DNA, 2907 bp, Artificial Sequence
  Description of Artificial Sequence: Synthetic coding sequence
atggctgaagatgatccatacctgggacgcccggaacagatgttccatttggaccccagcttgacgcacaccattttcaatcccgaggtcttccagccccagatggccctgcccactgacggcccctatctgcagatccttgagcagccgaaacaacgcggatttcgctttaggtacgtttgtgaagggcccagccacggtgggctacctggtgcatcttctgagaaaaacaaaaaaagctacccacaagtgaaaatctgcaactacgtcggcccggcaaaagtaatcgttcagctcgttactaatggaaagaatatccatcttcacgcccatagccttgttgggaagcactgtgaagacggtatatgtaccgttaccgcaggacctaaagacatggttgtgggcttcgcaaatcttggcatactgcacgtgacaaaaaagaaggtgttcgaaacactcgaggcccgaatgaccgaggcttgtatcagggggtataacccaggtctgctggtgcaccctgaccttgcctacctccaggccgaaggaggaggtgacagacagctgggggatcgcgaaaaagagttaatccggcaggcagctctccaacaaaccaaggagatggacctctcagtggtgcgactcatgtttacggcatttctaccagatagtacaggttcgtttacgaggcgactggaacctgtggtgagcgacgcaatctacgactcaaaagctcctaacgcttctaacttgaagattgtaaggatggacaggaccgcaggctgtgtcaccggtggcgaggagatctatctgctgtgcgataaagttcagaaagacgacatacaaatcaggttctacgaagaggaagagaacggaggagtctgggagggatttggcgacttcagtcccacagatgtacatagacaatttgccatcgttttcaaaacgccgaaatacaaagatatcaatatcactaaaccggcctctgtattcgtgcagctacgtaggaagtccgacctagaaacttcagagccaaagcctttcctctactaccccgaaattaaggataaggaggaggtacagcgcaaacgccagaagttaatgccgaatttctcagactcctttggcggcggttcaggtgcaggggccggaggtggcgggatgttcgggagcgggggcggggggggcggtactggcagtacaggccctggatattcctttcctcactatgggtttcccacatacggtgggattaccttccatccgggcactaccaagagcaatgcggggatgaagcacgggacaatggatacggagtcaaaaaaagaccccgagggatgcgataagtctgacgataaaaacaccgtgaatctgttcggcaaagtgattgaaacaaccgaacaggatcaggagccttctgaagctacagtaggtaatggagaggtgacgctgacctatgcaacgggtaccaaggaggagtccgccggcgtgcaagacaacctttttcttgagaaggcaatgcagcttgcaaagcgacatgctaatgcgttgttcgactatgcagtgactggcgatgttaagatgcttctggctgtccagcggcacctgaccgctgtgcaggatgagaacggagactccgtactgcacctggccatcattcatctgcattcccagctggttcgagatctgttggaagtgacttccgggctgatctccgacgatattataaacatgcggaatgacctctaccagacccctctgcacctggccgtaatcaccaaacaagaggatgtcgtggaggatttactccgagctggcgccgatctctcactcctcgaccgtcttggaaactccgtgctccatctggccgcgaaagaaggtcatgacaaggtcctcagtatcctgctgaaacacaagaaggctgccttgctcctggaccatcccaatggcgatggactaaatgctatccacctcgccatgatgagcaatagtctgccttgcctgctgctcttggtggccgctggggctgatgtgaacgctcaggagcagaagagtgggcgtaccgctcttcatctggccgttgaacacgataacatctcacttgctggatgcctgttattggagggggatgcacacgttgattcaacaacttacgacggaaccacacctctgcatatcgccgcaggcaggggcagcactaggctcgccgcactgctgaaggccgcgggcgctgacccgctcgtagaaaatttcgaaccactgtacgaccttgatgattcttgggagaatgcaggtgaggatgagggggtcgtgcccgggaccactcccctggacatggcaacatcctggcaagtgtttgacatcctgaatgggaagccttatgagccagaatttacctctgatgacctcctcgctcagggcgatatgaagcagttagctgaggacgtcaagttacagttatacaaactgctcgagatccctgacccagataaaaattgggccacactggcccagaaactgggtctgggtattctcaacaatgcctttcggctttctccagctccaagcaagacactaatggacaactacgaggtgagcggtgggactgtgagggaattagtggaggctctccgtcagatgggttataccgaagccatcgaggtgatacaggccgccagtagtcctgtcaaaaccactagtcaggcccactcactgcccctctctccagcatcaacccggcagcagattgatgagctccgagactcagactccgtttgcgattcaggggtggagacctcctttcggaagttaagctttacagagtcacttacttcaggcgcctctttgctgactttgaataagatgccacacgactatggccaggagggccccctcgaagggaaaatctag

SEQ ID NO: 16420 - DNA, 2907 bp, Artificial Sequence
  Description of Artificial Sequence: Synthetic coding sequence
atggccgaggacgatccttatcttggccggccagagcagatgtttcacctggatcctagcctcacacataccatcttcaacccagaggtgttccagccccagatggcactgccgacagacgggccatacctgcaaattctggaacagccaaaacaaaggggcttccggttcagatatgtgtgtgaagggccatcacatggcggactgcctggggctagctccgagaaaaacaaaaagtcctatccccaggtgaaaatatgcaactatgtcggacccgccaaggtgattgtacagcttgtaacgaatggaaaaaatatccatctgcacgcccattccctggttgggaagcactgtgaagatggaatttgcacagtcaccgcagggccaaaggacatggtagtagggttcgccaatttgggcatcttgcacgtgaccaagaagaaggtcttcgaaacgttggaggcaaggatgacagaagcgtgtattaggggctacaatcccggtttgctggtgcatcccgacctcgcctacctgcaggccgaaggcggaggggaccggcagctaggcgaccgcgagaaggagcttatacgccaggccgcactgcaacagaccaaagagatggacctgagcgtagtgcggttgatgttcacggcgttcctccccgactccactggtagctttactaggcggctcgagccagtggtctcagatgcaatctacgacagcaaagcacccaacgcatcaaacttgaagattgtgaggatggataggacagccgggtgcgtaacgggcggcgaagaaatatacctgctctgcgataaggtgcagaaggacgatattcagatccggttctacgaggaagaagagaatggtggggtctgggaggggttcggggattttagcccaacagatgtacatcgccagtttgccatcgtttttaaaacccctaaatataaagatatcaacataactaaacctgcttctgtttttgtgcagctcagaaggaagagtgatctcgaaacgagcgagccaaaacccttcttgtactatcctgagataaaggacaaagaagaggtccagcggaagcgccagaaacttatgcccaatttcagcgactccttcggcggagggtccggtgcgggcgccgggggaggcggaatgttcggcagtggaggtggcggcggcgggacgggatctacgggccccggctatagcttcccacactacggctttcctacttatggcggaattacattccatcccggcactacaaaatctaacgcgggtatgaagcatggtactatggataccgagtcgaaaaaggaccctgaaggatgcgataaaagcgacgataagaatacagtgaacctgtttggcaaggtgatcgaaaccacggagcaggatcaggaaccttctgaggccacggtgggaaacggagaggtgactcttacttatgcgacagggaccaaagaggagtcagcaggcgtgcaggataatctcttcctagaaaaggccatgcagctcgccaaacgccacgctaatgctctttttgactacgccgtcaccggggatgtgaaaatgctcctggccgtccagcggcacctaacagccgtacaggacgaaaatggtgattccgtccttcacttggccattattcatctgcacagtcagctcgtccgcgacctgctagaagtaacaagcgggctgatcagtgatgatattattaacatgcggaacgatttatatcaaacccccttgcatctggcggttattaccaaacaagaggacgtagtggaagacctactccgcgccggggcggatttgtctctccttgatcgcctgggcaacagcgtcctccatctcgctgccaaggagggtcacgacaaagtcctaagcatcctgctcaagcacaagaaggccgcccttctcctcgatcaccctaatggagacgggctgaatgccatccacctagctatgatgtcaaacagtctgccctgtctgttactgctggttgctgcgggagccgatgtgaacgctcaggagcaaaaaagcggccggacagccctccatctagcggtggagcacgataatatctccttggctgggtgccttctcctggagggggatgcacacgtggactccacaacatatgacggcactacacctctgcatattgcagcgggacgcggaagcacccggctcgcagccttgcttaaagcagctggtgcggacccccttgtcgagaacttcgaacctctctacgatttggacgatagttgggagaatgcaggagaggacgaaggggtggtgccaggaacaacccccctggacatggccacaagctggcaagtcttcgatattctgaatggtaaaccctatgagccggaatttacctccgatgacctcctcgctcaaggtgatatgaagcagctggcagaggacgtaaagctgcagctttacaaactgttggaaattccggaccccgataagaactgggccaccctggcccagaagctgggtctgggtatcctaaacaacgccttcaggctgtccccggcaccctcaaagactctcatggacaactacgaagtcagcggcgggacagtccgggagctggtcgaggcattgcgccagatgggctacactgaagcaatcgaggtgatccaggcggcttcaagcccagtgaagacaacctctcaggcccatagcctccccctctctcccgcctccacgcgccaacagatcgatgaactgagagatagtgatagcgtgtgcgattcgggcgtggagacgagttttagaaagctatcctttactgagtcccttacctccggcgcctccctccttaccttgaacaagatgccccacgactatggacaagaagggcctttagaagggaaaatatag

SEQ ID NO: 16421 - DNA, 438 bp, Artificial Sequence
  Description of Artificial Sequence: Synthetic coding sequence
atggccgaggatgacccgtacctcggtcgtcctgagcagatgtttcatctggatccctcgctcacacacacgatcttcaacccagaggtctttcagccccagatggccctgcccaccgccgacggaccttatttgcagatcctggagcagccaaagcaacgaggattcaggtttcgatacgtttgtgagggccctagtcacggggggcttccaggtgcttcaagcgagaaaaataaaaagagctatccccaggtgaaaatttgcaactatgtcggcccggctaaggtgatcgtgcaattagtcactaatggcaagaacattcacctacatgcccattctctagtggggaagcactgtgaagacggaatctgcacagtgaccgcagggccaaaagacatggtggtaggatttgcaaatctggggatcctgcacgtctag

SEQ ID NO: 16422 - DNA, 225 bp, Artificial Sequence
  Description of Artificial Sequence: Synthetic coding sequence
atgaagcgcacaacatcctttagaatggcagaggatgacccatacctgggccggccagaacagatgttccatctcgacccatcacttacacacaccatttttaatcccgaggtttttcagcctcaaatggcgctgcctacagacggcccttatcttcaaatactggagcaaccaaagcagcgaggatttagatttagatatgtttgtgagggacccagtcactag

SEQ ID NO: 16423 - DNA, 1923 bp, Artificial Sequence
  Description of Artificial Sequence: Synthetic coding sequence
atggctgcactttacagaccaggcctgagactcaactggcacgggctgtcacccctcgggtggccaagctgccgctcgatacaaacattgcgcgtcctgtctggagatctcgggcagctgccgaccggcatccgagattttgttgaacatagcgccaggctctgtcaacccgagggcatccatatatgcgatgggacggaagccgagaacacagcaacactaacacttttagaacaacagggtttgatccgtaagttacccaaatataacaattgctggctggcgagaactgatccaaaggatgtagccagagtggagagcaagacagtgattgtgaccccaagccagcgagataccgtccagctgcctcctgggggggctcgggggcagttggggaactggatgagccccgctgatttccaacgcgccgtggatgagaggtttcccggttgcatgcagggaaggaccatgtatgtgctccccttcagtatgggacccgtcgggagtcctctcagccggattggggtgcaactcaccgattccgcctatgtggtagcttccatgcgaatcatgacaaggctcggaactccagtgctccaggcacttggcgacggcgatttcgtgaaatgtttacactcagtagggcagcctctaaccggacagggtgagcctgtctcccaatggccctgtaaccccgaaaagacacttattggtcatgttccagaccagcgagaaattatctcctttggaagcgggtacggaggcaactctctgctgggcaaaaaatgtttcgccctgcgcatcgcttccaggcttgctcgcgatgaaggttggttggccgaacatatgctgatcctgggtattacgtccccagcaggtaagaagaggtacgtggccgccgcttttccctccgcatgcgggaagaccaacctggccatgatgaggcccgctctaccgggctggaaagtggagtgcgtgggcgatgatatcgcctggatgaggtttgacagcgagggcagattacgggcgattaatcctgagaacgggttcttcggggtggccccaggcactagtgccaccaccaatcccaacgctatggccacaatccagagcaataccatctttactaacgttgcagagaccagcgacggcggagtctattgggagggaatcgatcaacccctgccaccaggcgtgacagtcaccagctggctggggaagccatggaagcccggtgacaaggaaccctgcgcccaccccaactctcggttttgcgcaccagcaagacagtgccctatcatggatccagcctgggaggctcccgaaggcgttccaatcgacgcaattattttcggcggtagacgtcccaaaggggtacctcttgtttatgaagcgttcaattggagacatggcgtctttgtggggtccgccatgcgcagcgaaagcaccgccgccgctgagcataaaggtaagatcatcatgcatgaccctttcgcaatgagaccgttcttcggctacaatttcggccattatctcgaacattggctgtcaatggaggggagaaaaggggcacaactcccccgaattttccacgtcaactggttccgtcgagacgaagccggacacttcctatggcccggctttggcgagaacgcaagggttctcgactggatctgtagacgactcgaaggggaggacagtgcccgggaaacaccgatcgggctcgtgcctaaggaaggcgccctggacctgtctggactgcgagctatagacactactcagctgttcagcctccccaaagatttttgggaacaggaggtgcgcgacattcgctcctaccttacagagcaggttaatcaggatctgccaaaagaggtgttggcggagttagaagctctggagagaagggtacacaaaatgtag

SEQ ID NO: 16424 - DNA, 3477 bp, Artificial Sequence
  Description of Artificial Sequence: Synthetic coding sequence
atgacccacggggaggaattagggagcgacgttcaccaggactcaatagtcctgacatacctggagggtctgctgatgcaccaggccgccggcggatccggtaccgctgtggataagaaatcagctggccacaatgaggaggaccagaattttaatatatccggtagcgcttttcctacatgtcaaagcaacggccccgtactcaacacgcatacctaccagggttctggaatgctgcatcttaaaaaggcacgcctgttgcaaagctccgaggactggaatgctgctaaacgaaagcggctgtcagacagcatcatgaatttgaatgtcaaaaaagaggctctgctcgcggggatggtggattccgtgcctaagggcaaacaggattccaccttactcgcgtcactgctgcagagcttcagcagcagactccagacagtcgcactcagccagcagattcggcagagcttgaaggagcaaggatatgccctctcccacgatagcctcaaggttgaaaaggacctgaggtgctacggtgtggcaagttcccacctcaagactttgttaaaaaagtcaaaggtgaaggatcagaaacctgacacaaacctgccggatgttaccaaaaatctgattagagacaggtttgcggagtccccgcaccatgtaggtcagagtggaactaaagtcatgagtgagcctctgtcttgcgctgccaggctacaggccgtcgcatccatggtcgagaagcgggcatctccagccacaagtccaaagccctccgtcgcatgctcccaactggctctcttgctgagctccgaggcacacctgcagcagtacagtcgtgagcatgccttaaagacccagaacgcaaatcaggccgccagtgagaggctagcggccatggcacgcctacaggaaaacgggcagaaggacgtgggatcataccagctgcccaaagggatgtctagtcacctgaatggtcaggcgcgaactagcagtagtaagcttatggcctcaaaatcttccgctactgtgttccagaatcctatgggcatcatcccatcttcacccaaaaatgcgggctacaagaactctctggagcggaataatatcaaacaggccgccaacaatagcctgttgctgcacttattaaagagccagaccattccaaaaccaatgaacggacacagtcatagtgagaggggaagtattttcgaagagtcctccacccccacaacgatagatgagtacagcgacaacaatccctctttcacagacgactctagcggcgatgagtcctcatatagcaactgcgtccccatagatttgtcttgcaagcacagaacagagaaaagtgagtcagatcaacctgtgagcctggataattttacccagagcctgctgaatacctgggatcctaaggtgccagatgtggatatcaaagaggaccaggatacttctaagaactccaagctaaatagccaccagaaagtcacactgctgcagctgctgctcgggcacaagaacgaagaaaatgtggagaagaacacatcccctcagggcgtgcataacgatgtgagcaagtttaacacacaaaactatgcccgcacctctgtcattgagagtccttcaacaaatcgtacaactccagtgagtacccctccactcctgaccagtagcaaggctggctcaccgatcaatctctcacagcacagcttggtgattaaatggaacagccccccatatgtgtgttccacccagagcgagaagttgaccaacacagcttctaaccactccatggatctgactaagagcaaggaccctcccggcgaaaagccggcgcagaatgaaggtgcacagaacagcgccacctttagcgcctcaaaacttctgcaaaacctggcccagtgtggaatgcaatccagcatgagtgtcgaagaacaacggccaagcaaacagttacttaccggtaacactgacaaaccgataggtatgatcgatagactaaattctcctctgttgagtaacaagacaaacgccgtggaggagaataaagcatttagcagtcagcccaccggacccgaacccggcctctcgggtagtgagattgaaaacctgttggagaggcgtacagtgctgcagcttttgctggggaatcccaacaaaggcaagtccgagaagaaagagaaaaccccgctgagggatgagagcacccaagagcactcagagcgtgctctgagcgagcagattttaatggtgaaaattaaatcagagccatgcgatgacttgcaaatcccaaatactaacgtccatctcagtcacgacgcaaagagcgctccctttctcggaatggctcccgcagtccagcgatcagccccagccctgcctgtgagtgaggatttcaagtctgagcctgtatcccctcaggacttctcatttagcaagaatggcttactgtctcggctgctgcgtcagaatcaggactcatacttggctgatgatagcgaccggagtcatcgaaacaatgaaatggccttgctggagtctaaaaacctgtgcatggtaccgaagaagagaaagctgtatacggaacctctcgagaacccattcaagaaaatgaaaaacaacatcgtggatgccgctaacaaccactcagcaccagaggttctatatggaagcctcctgaaccaggaggagctcaagtttagccgaaacgatttggaattcaaataccccgccggacatggctcagcctcggaatccgagcatcggagttgggcgcgcgagtccaagtctttcaacgtgttgaagcaactgttattaagcgagaattgtgtgcgcgatttgagtccgcataggtccaactcagtggccgattccaaaaagaaggggcacaagaataacgtaacaaactctaaaccagagttctcaatctcttccttgaacggtctgatgtacagctccacacagccctcatcatgcatggataacagaaccttctcatatcccggagtagtgaagacacccgttagcccgactttccctgagcaccttggctgcgctggcagtcgacctgagtccggcctcctgaacggctgcagcatgccttccgagaaagggcccatcaagtgggttattactgacgctgagaagaatgagtatgaaaaggacagccccaggctgacaaagacaaatcctattctgtactacatgttgcagaaaggaggcaactcagtaacgagtagggagacccaggacaaagatatctggagggaagcctcttcagctgaatctgtgtcccaggttactgccaaggaggaactgctccctacagcagaaaccaaggcctccttctttaacctgcgcagcccatacaattcccatatgggtaataacgcgagccgcccccacagtgccaatggtgaggtgtatggactgcttgggagcgtcctgacaatcaagaaggaatctgaatag

SEQ ID NO: 16425 - DNA, 3477 bp, Artificial Sequence
  Description of Artificial Sequence: Synthetic coding sequence
atgacccacggtgaggagcttgggtccgatgtgcaccaggactccatcgtgctgacgtacctagaaggtctactcatgcaccaggcagcgggaggaagcgggaccgctgtagacaagaagtctgccggccacaacgaggaagaccagaacttcaacattagcgggagtgcttttccaacatgccagagcaacggaccagtgctgaatacccacacgtaccaggggagtggcatgctccatctcaaaaaggcacggctgttgcaaagctcagaagattggaacgctgcaaagaggaaacgcctatctgacagcattatgaatttgaatgtcaaaaaggaggccctccttgccggaatggtggacagcgtgcccaaagggaagcaagattccactctcctcgcttcactcctacagtccttctcgtccagactacagacagtggctttgtcacagcagattaggcaatccctaaaagagcagggttacgctctctcccacgatagccttaaggtggagaaagaccttagatgctacggagtagctagctcgcacctgaaaacacttctgaagaaatccaaagtgaaggaccaaaaacctgataccaatttgcctgatgtgacgaagaatctgatcagagaccggttcgctgaatcacctcaccacgtcggacagagcggtacaaaagtcatgagtgaacctctgagctgcgcggcccggttgcaggcggtcgcctcaatggttgaaaaaagagcctctcccgctacttctcctaagccaagcgtagcctgctcccaactggcactcctgctctctagcgaagcacatctgcaacagtatagtagggagcatgcccttaagacccagaacgccaaccaggcagccagcgaacgcctggctgccatggcaaggttacaggaaaacgggcagaaggatgtgggctcctatcaactccctaaggggatgtcgtctcacttgaatggccaggcccgaaccagcagtagcaaacttatggcaagcaagtcgtccgctacagtcttccagaaccctatggggatcataccttccagtcccaagaacgcaggctataagaacagcctcgagaggaacaatatcaagcaggcggcgaataacagtcttctactgcatctgctcaagtcacagaccatccccaaaccaatgaatggtcactcgcactcagaacgtgggagcatcttcgaagagagctctaccccgaccacaattgacgagtactctgataacaatccgagtttcaccgatgactcgagcggagatgaaagttcttatagcaactgtgttcctatcgatctgagttgtaaacaccgaacagagaaatcagagtcagaccaaccagtgagccttgacaatttcacacagtcactgcttaatacctgggaccctaaagtgcctgatgtggatatcaaggaggatcaggacacatccaagaatagcaaactcaacagccaccagaaggtgacactcttgcaactcttgctggggcacaagaacgaggaaaacgtagagaaaaacacctcccctcagggcgtgcacaatgacgtgagcaaatttaatacacagaattatgctcgcacgtccgttattgaaagcccttccaccaacagaactactccggtgtctactccgcctctgttaacctcctctaaggccggcagccccattaatctcagccagcatagtctcgtgattaaatggaactctcctccttacgtgtgttcgacgcagtctgagaaactaaccaacactgcctccaaccactcaatggacctgaccaaatcaaaggacccgccaggggaaaaacccgcgcaaaacgagggagctcagaatagtgccaccttctccgcctcgaagttgctgcagaacttggcccagtgcggaatgcagagctcaatgtccgtggaggagcagagacccagtaagcagctgctgacgggaaataccgataagccgattgggatgattgacaggctgaattcacccctgctaagcaacaagaccaatgctgtggaggaaaacaaggcatttagcagtcagcccactggaccggagccagggctgtccgggtccgagattgagaatctgttggagcggcgtactgtgctgcagctgttactgggcaatcctaataagggaaagagtgagaaaaaagagaagaccccactgagggacgaatctacccaagaacatagcgaaagagcccttagcgaacagatccttatggtgaaaataaaatcggaaccctgtgatgacctccaaatccccaacaccaacgtacatttgagccacgacgcaaaatcagcccccttcctgggaatggcaccagccgtccagcggagcgctcctgctttacctgtctcagaggattttaagtccgagccggtaagcccacaggatttctctttttcaaaaaatggcctgctgtcccggctgctgcgccagaaccaagactcctacctcgcagacgattccgacagatcccatcggaacaatgagatggctctgcttgagtccaagaatctatgcatggtcccgaagaaacgaaagttatacacagagcccctggaaaatcctttcaagaaaatgaaaaacaatattgtcgacgcagctaataaccatagcgccccggaggtcctttacggcagcctgctgaaccaggaggaactgaaattctcacggaatgatctggagtttaaataccctgccgggcatggatcagcttcagaatctgagcaccggagttgggcgcgtgagagcaaaagtttcaatgtgctcaaacaactgcttctgtcagaaaattgcgtgagagacttgagtccccatagaagtaattcagtagcagacagtaaaaaaaagggacacaaaaacaatgttacaaacagcaagccggagttctcaatcagcagtttaaacgggcttatgtactcatccactcaaccgtcctcttgtatggataaccgcacctttagctaccccggggttgtcaaaactccagttagccctaccttccccgaacatctgggctgtgctggcagcagaccagaatccgggctactgaacggttgttctatgccttctgagaaaggcccaatcaagtgggtgattacagatgccgaaaaaaatgagtacgagaaagacagccctcggttaactaaaaccaacccgatactttactacatgctgcagaagggaggtaacagtgtgacaagcagagagacgcaagacaaggatatctggcgagaggcgtcgtctgccgagtcagtgtcgcaagtgactgccaaggaggagctattgcctacagctgaaaccaaagcgtctttctttaatcttcggtccccctataactctcatatgggtaacaacgcctcccgaccccatagcgctaatggagaagtctatggcctgctgggtagcgttctgacgattaaaaaagaaagcgaatag

SEQ ID NO: 16426 - DNA, 3477 bp, Artificial Sequence
  Description of Artificial Sequence: Synthetic coding sequence
atgactcacggcgaagaactgggctcagatgttcaccaagatagcattgtcttgacctacttagagggactactaatgcatcaggccgcagggggaagtggaaccgccgtggacaagaagtccgctggacacaatgaggaggatcaaaactttaatatttccgggagcgcattccccacatgccagagcaatggacctgtgcttaatacccacacttaccaagggtctggcatgctacatctgaaaaaagcccgccttctccagagcagcgaagactggaacgctgctaagagaaagagactgagtgacagtataatgaatctcaatgttaagaaggaagccctccttgctgggatggtcgactccgtgccaaaagggaagcaggatagtactctgttagcctcactgctacagtcatttagtagcaggctgcaaactgtcgccctgtcccagcaaatcaggcagtccttgaaagaacagggatatgcattaagtcacgattcattaaaggtcgaaaaggatttacgctgctacggggtcgcatcctcccacctgaagacgctgctgaaaaagagcaaagtcaaagaccagaagcccgataccaacctgcccgacgtcactaaaaatctgattcgggacagatttgcagagtcccctcaccacgtggggcaatccggaacaaaggtcatgtctgagcccctgtcctgtgctgccagactgcaggctgtggcctctatggttgaaaagagagcttctccagctacttcccctaagccaagcgtagcctgcagccagctggcgctactgctttcctccgaagctcacttacaacagtatagtcgagaacacgcactgaagacacagaatgctaatcaggccgcctccgagcgattagcggccatggcccggctgcaggaaaacggtcagaaagatgtggggtcctatcagctcccgaaagggatgtcatctcatcttaatggccaggctagaactagtagctccaagttaatggcctctaaaagctccgccacagttttccagaaccccatgggtatcatccccagctctcccaagaatgccggatacaaaaactccttggaaagaaataacatcaagcaggcagccaataactctctcctccttcacctgctgaagtcacagaccatcccaaaaccaatgaacggccactctcactccgagagaggaagtatctttgaggaatcttctaccccgacgaccattgatgagtactcagacaacaacccttcctttaccgacgactccagcggagatgagtccagctactctaattgcgttcccattgatctcagctgcaagcacagaacggaaaagtccgaatccgatcaacctgtcagcctagacaatttcacacagtcgctgctcaatacctgggacccaaaggtgcccgacgtggacataaaagaagaccaggatacctccaagaatagcaagttgaatagccaccaaaaagtgacacttctgcaattgctgttaggccataagaatgaggagaatgttgagaagaacacatcaccccagggcgtacacaacgacgtatcaaaatttaatacccagaattatgcccgcaccagtgttatcgaatctccgtctaccaaccgaacaacccccgtcagcactcctccgttgctcacttctagcaaagctgggtctcccattaatttaagccagcattcattagttattaagtggaattcaccgccgtacgtctgcagtacccagagtgaaaagctaactaacaccgcaagtaaccactcaatggatctcaccaagtctaaggatccacccggtgagaagccagctcagaacgaaggggcgcagaactccgccacgtttagcgctagcaaacttctccagaatctcgctcagtgtggaatgcagtcctctatgagcgtggaggaacagagacctagcaagcagttgctcacgggaaatactgacaaacctatcggcatgatcgaccggcttaacagtcctttgctgagtaacaaaacgaatgccgtggaagagaacaaggccttttcttctcagccaaccggccctgaaccagggctatctgggtcagagatcgagaatctccttgagcggagaacggttctccagctgctcctcggcaatcctaacaagggaaagagtgaaaaaaaagaaaagacgcctctccgtgatgagagcacacaggagcactcagagcgtgccctgtctgagcagatccttatggtgaaaataaagtccgagccttgtgatgatctgcagatacccaataccaacgtgcacctgtcacacgatgctaagagtgcaccctttttaggaatggctcctgcagtgcaacggagcgctccagctttgccagtgtccgaagactttaaatctgagcccgtgtcaccacaggacttcagcttcagcaaaaacggtcttttatcaagactgttacgccaaaatcaggatagttatcttgcggacgacagtgacagaagccaccggaataacgagatggccctcctggagtctaaaaacctctgtatggtacccaagaaacgaaagttgtacacagaaccacttgagaacccatttaagaagatgaagaacaatattgtagacgcagctaacaatcacagcgccccggaggtcctttacggctccctgttgaaccaggaggaactgaagttttctcggaacgacctggagttcaagtaccctgccggccatggctctgcctcggagagcgagcatcggtcttgggccagggaatctaagtcatttaatgttcttaaacagctgctgctgtcagagaactgcgttcgggacctgtctcctcacagatccaatagtgttgccgacagcaaaaagaagggccataagaacaacgtgaccaacagcaagcccgaatttagtatctcctccctgaatggcctgatgtacagttcaactcagccatccagctgtatggacaatcgaacattttcatatcccggcgtcgtgaagacacccgttagtcctaccttccctgagcacctggggtgtgcaggcagtaggcctgagtcaggcctattaaatggctgcagtatgccctccgagaaagggcccatcaagtgggtcatcacagacgccgagaagaatgagtacgaaaaggattctccacgtctgactaagacaaatcctatcttatattacatgctgcagaagggaggaaactcagtcacgagccgagagacgcaggacaaggatatctggcgcgaggctagctctgccgaatctgtaagccaggtgacagctaaggaggaactcctaccaactgcagagacaaaagcctccttctttaacctgcggtctccttataattctcacatgggcaataatgcttcacgcccccactccgccaacggggaggtgtatggcctgctgggatctgtcctcacaattaagaaagagtccgagtag

SEQ ID NO: 16427 - DNA, 201 bp, Artificial Sequence
  Description of Artificial Sequence: Synthetic coding sequence
atgacccacggcgaagagttaggcagcgatgttcatcaagactccatcgtgctgacttaccttgaaggcctgttgatgcaccaggcggccgggggatcaggcaccgccgttgacaaaaaatctgcaggccataatgaggaggaccagaacttcaatataagcggaagcgcattccctacgtgccagagtaacgggccctag

SEQ ID NO: 16428 - DNA, 4176 bp, Artificial Sequence
  Description of Artificial Sequence: Synthetic coding sequence
atgccctcgtctttgctcggggccgccatgccagcctccaccagcgcagcggccctgcaggaggcgctggagaacgcaggacgtctcatagatcgacagttacaggaggatagaatgtatcctgacttgagtgagttattgatggtgtcagcgcctaataaccctaccgtctcaggcatgagcgatatggattaccctctccaggggccaggtctgctgtctgtgccaaacctccccgaaatatctagcattcgacgggtgcctcttccgcccgaactggtggagcagttcggccatatgcagtgcaattgtatgatgggcgtatttccgccaatcagtcgggcgtggctcacaattgatagcgatattttcatgtggaactatgaggatggaggtgatctggcgtactttgatggtcttagcgaaactatcctagctgtgggcttggtcaagccaaaagccggaatattccaaccgcatgtcagacacctcttggtgcttgcaacaccggtggacattgtcatcttagggctgtcctacgcgaacctgcagactggctccggcgtactaaacgacagcctctccggcggcatgcaactcctgccagatcctctgtacagcctcccaaccgacaacacatacctcctaacaatcactagcacagataacggacgtattttcctggccggaaaagatggctgtctttatgaagtcgcttatcaggctgaagcggggtggtttagccagcgctgccgcaagataaaccattctaaatcaagcttatcctttctcgtccccagcctcctgcagttcacatttagcgaagatgaccccatcctccagatcgctattgacaatagtcggaacatactgtatacaagatctgaaaagggcgttatccaagtttacgacctggggcaggacggccagggcatgagtcgggtggccagcgttagccagaacgcgatcgtctcggcggcaggcaatatagctcgcacaattgatagaagtgtgttcaagccgattgtccagattgccgtcatcgaaaattcggagtccctggactgccagttgctagccgtcacccacgctggagtgcgactctatttctccacctgtccattccgccaacccctggctcgacccaacacacttaccctggtgcacgttagactgccaccagggttcagcgcgagttcaactgtggaaaagcccagtaaagtgcacagggctctgtatagtaaggggatcctcttgatggccgctagcgagaacgaggataatgatattttatggtgcgtgaaccacgacaccttcccttttcagaaacccatgatggagactcagatgaccgccggcgtagacggccatagttgggccctgtcggccatcgatgagctgaaggtagacaaaatcataacacctttaaataaagatcacatcccaatcacagacagtcccgtagtggttcagcagcacatgctgccacctaagaaattcgttctgctcagcgctcaggggagcctgatgtttcacaaattgcggcccgtggatcaattgagacacttgcttgtatcgaatgtcggcggggatggtgaggagatcgaaagattctttaaattacatcaagaagaccaggcatgtgcgacatgcctgatcctcgcttgctctacagctgcttgtgatagagaggtctccgcctgggccacacgcgccttttttcgatatgggggtgaagcccagatgcggtttccgacaacattacctccaccctccaacgtgggacctatacttgggagtccagtctatagttctagccccgtccccagcggcagcccttacccaaatccctcctttctgggaactcctagtcatgggatccaacccccagccatgtctacgccagtctgcgccctgggaaacccggccactcaggctacaaatatgtcctgcgttacaggtcctgaaattgtttatagcggtaagcataacggaatttgtatttatttcagcaggattatgggtaacatatgggatgcctccctggtggtggagcgaatcttcaaaagtggaaatcgggaaatcactgccattgagtccagtgtcccctgccagctccttgagagtgtgttgcaggagctaaagggtctgcaggagtttctagatcgcaattcccagtttgcaggtgggcctctcggaaaccctaacactacagccaaggtgcagcagaggctcataggatttatgaggccagaaaacgggaatcctcagcagatgcagcaggagctacaaagaaagtttcatgaggctcagctgtccgagaaaattagcctacaggcaatccaacagctggtgagaaagtcttaccaggccttggccctatggaaactcctgtgcgagcatcagtttacaatcatcgtagccgaattacagaaagaactccaggaacaactcaagataactacattcaaagatttggtcatccgcgacaaagagctgaccggtgccctgatagcatcattgattaactgctacatacgtgataatgcagcggtagacggaatctcccttcatcttcaggacatatgtcccctgttgtacagcactgacgacgctatttgctcaaaggcgaatgaattgctgcagaggagccgccaagtgcagaacaaaacagagaaggaacgtatgctgagggaatcactcaaagagtatcagaaaatatccaatcaggtcgacctgtcgaacgtgtgtgcccagtaccgacaagtacgcttttacgagggcgtggtggagcttagcttaacggccgccgaaaaaaaggatcctcagggcttaggactacatttttacaaacacggtgagccggaagaggacattgtggggctgcaggcgttccaagaacgactgaacagctacaagtgtattaccgacaccctgcaagaattggtaaaccagagcaaggcagcgccacagagcccttctgtcccaaaaaaaccgggaccccccgtgctgtcatcagatcctaatatgctctccaatgaggaggctggacatcatttcgagcaaatgctcaagctgtcacaaagaagcaaggatgagttgttttctattgccctgtacaattggctcattcaagtagacctggcagacaagctgctgcaagtcgcaagccctttccttgagccccatctcgtccgtatggcaaaggttgaccagaacagagtccgatacatggacctcctttggaggtattacgaaaaaaaccgctcattttctaacgccgctcgcgtcctgagccgcctcgcagacatgcattccactgaaatctctttgcaacaacgcctggagtatatcgctcgagcgatcctgagtgcgaagagtagcactgcgatctcaagcatagctgcagacggggagttcctccatgaacttgaggaaaaaatggaggtggcaaggattcaactccagattcaggagacattgcagcgacagtatagccaccattcatccgtccaagatgcggtgtctcagctggatagcgagctcatggacatcaccaagctctacggggaattcgccgatcccttcaaactcgcagagtgtaagctcgcaattatacactgcgccgggtacagcgaccctatactggtacagactttgtggcaggatattatagagaaggagcttagtgacagcgttacgctctcctcgtcagatcggatgcacgctttaagtctgaagattgtgcttctgggtaagatttacgccggaacacctaggtttttccccttagattttatcgtccagtttctggagcagcaggtgtgtaccctgaattgggacgttggcttcgtcattcaaaccatgaacgaaataggcgtcccattaccacgtctgctcgaagtttacgatcagctctttaaatctcgggacccgttttggaatcgaatgaaaaagccccttcacttattggattgtatccatgttcttcttattaggtatgtagagaaccccagccaggttctgaactgcgaacgtaggcgcttcactaatctctgtctagacgccgtgtgtggatacttggtggagctgcaaagcatgtcaagtagcgtagcggtacaggcaatcaccggcaattttaagagcctccaagccaagttagaacggttgcactag

SEQ ID NO: 16429 - DNA, 2334 bp, Artificial Sequence
  Description of Artificial Sequence: Synthetic coding sequence
atggattccaaggagtctttgacccctgggcgggaagagaacccttctagtgtgctggcccaagagcgaggcgatgtgatggacttctacaagactttgcgcgggggggctacagtgaaggtttccgcctcaagcccttccctcgctgtggcctcccagtctgactctaaacaacggaggctgttggtggacttcccaaaggggtcggtgtcaaacgctcagcagccagacctttctaaggctgtgtcgctgtccatgggcctttacatgggggaaacagaaactaaggtgatgggtaacgacctgggcttcccccagcagggccagatatccctgagctccggtgagactgacctaaaacttttggaggagtctattgccaaccttaataggagtacatcagtgccggagaatcctaaaagctccgcatccacggccgtatcagccgctcctaccgagaaggagtttccaaagacccattcagatgtatcctccgagcagcaacaccttaaaggccagaccgggactaatggcggaaacgtgaaactgtacaccacagatcaatcaactttcgacatcctccaggaccttgagttttcaagcggtagtcccggcaaggagactaatgagtctccttggagatcagacttgctcattgatgaaaactgtctgttgtccccactcgcgggggaggatgactcttttctgctagagggaaactctaacgaggattgcaagccattgatcctgcctgacacgaagccgaagattaaggataacggcgatctggtcctgtcctcaccctcaaatgtgacattgcctcaagtgaaaaccgaaaaagaagattttattgagctgtgcactcccggagtgatcaaacaggagaagctagggacagtatattgccaggcgtcattcccgggggccaatatcataggcaacaagatgtccgctatcagtgtccatggagtctcgacatcaggaggccagatgtaccattacgacatgaacacagcaagcttaagtcaacagcaggaccagaagcctatttttaacgtcattccgccaatcccagttggctctgaaaattggaatagatgccaggggtctggcgacgacaatttgacatccctcgggactctcaacttccctggtcgtactgtgttctcaaatggatattcttccccctctatgcggccagatgtgtccagcccccccagctcctcatctaccgctactactggccccccacccaaactatgcctggtctgtagtgatgaggcctccggatgtcattacggggtcttaacatgtggatcatgcaaggtgttttttaaaagagcagtagagggccagcataactatttatgtgccggcagaaacgactgtatcatcgacaagattcgccgtaagaactgtccggcatgccgctatcgtaagtgtctacaagctggaatgaacctggaggcacggaaaacaaaaaagaagataaaaggcatacaacaagcaactacaggcgtctctcaggaaactagcgagaaccctggaaataaaactattgtgcccgctacgttacctcagctaacacctacactagtgagcctcctcgaggtaatcgagccagaagtcctctacgccgggtatgattcttcagtcccagattcaacatggcgcataatgactacactcaatatgctgggggggcgccaggtgatcgcagccgtgaagtgggcgaaagccattcccggtttccggaacctgcacctggatgaccagatgaccttactccagtactcctggatgtttttgatggcattcgccctggggtggaggtcatatcgacagtcctctgcgaacttgttatgtttcgctcctgatttgataattaatgaacagcgtatgaccctcccttgcatgtatgatcaatgtaaacacatgctctatgtgagcagtgagttgcaccgcctgcaagtaagttacgaagagtacctgtgcatgaaaaccctactgctgctctctagcgtccccaaggacggcctgaagtcacaagaactgttcgatgaaatcagaatgacttacattaaggagctggggaaggccatcgtgaagcgggaggggaacagcagtcagaactggcagcgattttaccagcttacaaagctgctggactcgatgcacgaggtcgtcgagaacctgctgaactattgttttcagacattcttagacaagacaatgagtattgaattccccgagatgctagccgagattatcaccaatcagatcccgaagtacagcaatggcaatatcaagaagctgttattccaccaaaagtag

SEQ ID NO: 16430 - DNA, 1782 bp, Artificial Sequence
  Description of Artificial Sequence: Synthetic coding sequence
atggactccaaggagtccctcacccccggccgagaagaaaatccatcctctgtcctggcccaggagcgtggtgatgtgatggatttctacaaaacgctccggggcggtgctacagtaaaggtaagcgccagcagcccatcactggccgtggcgagccaatcagacagcaaacagcgacggctcttagtagactttccgaaggggtctgtgagcaatgcacagcagcccgacctgtccaaggctgtgagtcttagtatggggctctatatgggggaaaccgaaacaaaggtgatgggcaatgacctcggttttccccagcaagggcagatctctctatcgagcggggagaccgatctgaaattgctagaagagagtatcgctaatctcaacagaagcacatcagtgccggaaaatcctaaatcttccgccagtaccgctgtgagtgctgccccaactgagaaagagtttccaaaaacacactcagacgtaagttcggagcagcagcatctaaaagggcagaccggtaccaatggcggcaacgtgaaattgtatacgaccgatcagtccacatttgacatcttacaagacctggagttctcttctggttcccctggcaaggagaccaacgagtccccttggcgcagcgatctattgattgacgagaattgcctactctcccctctggctggcgaggatgactcattcctgttggaaggaaactctaatgaggattgtaagccactgattctcccagacacaaagcctaaaataaaggacaacggagatctggtcctgtcaagtccctcaaacgtgacgctccctcaagttaagacagagaaagaagatttcattgaattatgtactccaggtgttatcaagcaggagaaattaggtactgtgtattgccaggcctcctttcccggcgctaacattatagggaacaagatgagcgctatctctgtacatggggtctcgacctcaggggggcagatgtaccattatgatatgaatacggcctctctgtcgcagcagcaggatcagaaacccatctttaacgttatccccccaattcctgtgggatccgaaaactggaaccgctgtcagggttctggggacgacaacctgacaagtctcggcacactaaactttcccggccgaaccgtcttcagtaatgggtactcatctccatctatgaggcccgacgtgagcagcccacccagctcttcaagtaccgccactacaggacccccccccaaactctgtcttgtgtgtagcgacgaggcatctggctgccattacggagtactaacttgcggctcctgtaaagtttttttcaagcgcgcagtggagggacaacacaattacctctgcgctgggcgtaacgactgcatcattgacaaaatccgacgaaaaaattgtcccgcctgcagatatcgcaaatgtctgcaggcagggatgaacctcgaggtggttcccaaggatggactgaagtcgcaggagttgttcgatgaaataaggatgacatatattaaagagctgggcaaagccattgtcaagagagagggtaatagtagccagaactggcagagattctaccagctgaccaaactgctagactcaatgcatgaggtagtggagaatcttctgaactattgctttcagacctttctggataaaacaatgtctatcgagttccccgagatgctggctgagattataactaaccagataccaaagtactccaatggcaatatcaaaaagcttctatttcatcagaagtag

SEQ ID NO: 16431 - DNA, 2334 bp, Artificial Sequence
  Description of Artificial Sequence: Synthetic coding sequence
atggattcaaaggaaagcctcactccaggtcgcgaggagaacccgagctccgtcctcgctcaggaacgaggggacgtgatggacttttataaaacgctgagggggggggcaaccgttaaggtatcagcttcaagcccatctctggccgttgcaagccaaagcgactccaagcaaaggcgtctgctggtggacttccccaagggcagtgttagcaatgctcaacaaccagatctcagcaaagctgtctcgctgtcaatgggactgtacatgggagagactgaaactaaagtgatgggtaatgatctgggatttcctcagcaggggcagatctctctgagctcaggagagactgacttgaaactgttagaggagtcgatcgctaatttaaacaggagtacttctgtgcccgaaaaccccaaatctagcgctagtactgctgtttcggcagcgcctaccgaaaaggagtttcccaaaacacactccgacgtttcttctgaacaacagcatctgaaaggccagacagggactaacgggggcaatgtcaagctgtatactaccgaccagtccacgttcgacattctgcaagatcttgaattcagctccggctcccctgggaaagagacgaacgaatctccctggaggtccgacttgttgatcgatgaaaattgtcttttaagtcccctggctggggaggacgacagctttctgttggaagggaacagcaacgaagactgcaagcctctaatcctccccgatacaaagcccaagattaaagataatggtgatctcgtgctgtcttccccgtccaatgtgaccctccctcaggtgaagaccgaaaaagaagacttcattgagctgtgcacacctggagtgataaagcaagaaaagctgggcacagtctattgccaggctagcttccctggcgctaatattattgggaacaaaatgtccgcaatatcggtgcacggggtcagtacctcaggcggacagatgtaccactacgatatgaacacagcctccctatcgcagcagcaggatcagaagccgattttcaatgtaattccacccatccctgtcgggagcgaaaattggaaccgttgtcaagggtcaggcgacgataacctcacaagtctcggcacacttaactttccaggaagaacagtgttcagtaatggatactccagcccctctatgcgccccgatgtgagcagtcctcccagctccagtagcacagcgacgactggacccccgcccaagctgtgcctcgtgtgcagtgacgaggcatctggctgccattacggagtcttaacgtgtggctcatgtaaggtgtttttcaagcgagccgtagagggacagcataactacttgtgcgccggcaggaatgattgtatcattgataagatacggcggaagaactgtcccgcttgtcgttataggaagtgtctgcaagccgggatgaatctagaagcccgaaaaacaaaaaagaagatcaagggtatccagcaggcaacaaccggagtgagtcaggagacctccgaaaatccgggaaacaagacaatagtgcctgctacactgccccaacttacacctactttggtgtctttgttggaagtcattgagcctgaagtgctgtatgccgggtacgactcatcagtgcccgattcaacgtggaggattatgactacactgaacatgctgggaggccgccaggttatcgccgccgtcaagtgggcgaaggctattcctggcttccgcaacctccacctggatgatcagatgacccttctgcagtactcatggatgttcctaatggcctttgcacttgggtggcgatcctaccgacagagctctgcgaacctgctttgttttgctcctgatctgataatcaatgagcagcgaatgactcttccttgcatgtatgatcagtgcaaacacatgctgtatgtgagtagtgaattgcatagactgcaggtcagttatgaagaatatctgtgtatgaagacactgcttttgttaagttccgtacctaaggatggcttaaaaagccaggagctgttcgatgagatcagaatgacttacatcaaggagttgggaaaggcaatagtgaaacgagaaggaaactcttctcaaaattggcagcgattctaccagctgacaaagctgctggattctatgcacgaggttgttgaaaatttgctaaattactgctttcagaccttccttgataagactatgtctatcgaatttcccgagatgcttgccgaaattatcaccaaccagattcctaagtactccaatggcaacatcaaaaagctgcttttccatcagaagtag

SEQ ID NO: 16432 - DNA, 2337 bp, Artificial Sequence
  Description of Artificial Sequence: Synthetic coding sequence
atggattcaaaagagagtttgacacctggaagggaagagaacccttccagcgtgttggcccaggagcgaggcgacgtgatggatttttacaagactttgcgagggggagctacagtgaaggtctcagccagttccccaagtctggcagtggccagccagtctgacagcaagcaacggcgattactggtagatttccccaaaggcagcgtcagtaacgctcaacagcctgatctgtcgaaagccgtcagcttgagcatgggcctgtatatgggcgaaaccgagacaaaggttatgggtaatgacctgggcttcccacagcagggccagatcagcttgagttctggggaaaccgacctaaagttgctggaggagtccattgctaacctaaatcgaagcacatccgtcccagaaaatcccaaaagctctgctagcaccgccgtgtccgctgctcccaccgagaaagaattcccaaagacacactccgatgtgtcctcggagcagcaacatctcaagggtcagacaggaaccaatggaggcaatgttaagctgtatacaaccgaccagagcacctttgacatccttcaggatctggagttcagttctgggtccccggggaaggaaactaatgaaagcccttggaggagcgacctgttgatcgatgaaaattgtctactctccccgcttgctggagaagacgattcttttctcctggagggcaatagtaatgaggactgcaaacccctgatcctgccagacacaaaacctaagattaaggataacggagacctggtgctcagctcgccatccaatgttacccttccacaagtaaaaaccgagaaggaggatttcatcgagctgtgcacccccggagtaatcaagcaggagaagctgggtacagtttactgtcaagccagtttcccaggcgctaacatcataggtaataaaatgtccgcaatttcagtgcatggtgtttctacctccgggggccaaatgtatcattatgacatgaacacagcttccttatcccaacaacaggaccaaaaacctatattcaacgtgatcccgcctattcctgtcggcagtgagaactggaatcgctgtcagggctccggcgacgacaacctgactagcttaggcacattgaacttcccgggacgcacagtgttttccaacggttactcaagcccttcgatgaggccagacgtgtcttcccctcccagtagctcctccacagctacgacaggccctcccccaaaactgtgcctggtgtgttccgatgaagctagcggatgccattacggtgtgctgacatgcggtagctgcaaagtcttctttaaaagagccgtagaagggcgtcagcacaattatctttgcgcaggcagaaatgactgtatcatcgataagatcagacggaagaactgtccggcgtgccggtacagaaaatgcttgcaagctggcatgaatctcgaggcacgcaagacgaagaaaaaaattaagggaattcagcaggcaactactggagtgtcacaagaaacctctgaaaatccagggaataagactatagtaccagctaccctacctcaattaacgccaaccctggtttcactgctcgaggtcattgaacccgaagtgttgtatgccgggtacgatagctcagtgccggactcaacctggagaattatgacaacactgaatatgctgggaggtcggcaggttatcgcggccgttaaatgggcaaaagccattcctggcttcagaaatctgcaccttgacgaccaaatgacactgctgcaatacagttggatgttcttaatggcctttgctctgggttggcgctcctaccgccaatcctctgcaaacctgctttgtttcgcccctgacctcattatcaacgaacagagaatgacgctgccttgtatgtacgaccagtgcaagcacatgctctacgttagctctgagctgcataggctgcaggtctcgtatgaggagtatctgtgtatgaaaaccctactccttctctcctctgtccccaaagacggcctgaaatcccaggaattgtttgatgagattaggatgacttacattaaggagctcggcaaagcaattgtaaagcgagaaggcaatagctcccagaattggcagagattctaccagctgaccaaactgctagactcaatgcatgaggtggtggagaacctgctgaattattgtttccagaccttcctcgataaaaccatgagtatcgagtttcccgaaatgttggcggaaattattacgaaccaaatccccaaatattcaaatgggaacatcaagaagttgttatttcatcagaaatag

SEQ ID NO: 16433 - DNA, 2229 bp, Artificial Sequence
  Description of Artificial Sequence: Synthetic coding sequence
atggactcaaaagagagcctgaccccaggtcgagaagagaaccccagcagtgtcctggcccaggagcgcggcgatgtgatggatttttataaaacccttcgcgggggcgcaactgttaaagtgagcgcctcgtccccctctttggccgtagcaagtcagtctgacagcaagcagcgaaggctgttggtggacttccccaaaggctcagtgagcaatgctcagcagcccgacctgtccaaagctgtgtcactgtcaatggggctctacatgggagagaccgagaccaaggtgatggggaacgatttggggttcccccagcaaggtcaaatttcactgtccagcggtgagacagaccttaaactgctagaggaatctatcgcaaacctgaaccggagcaccagtgtccccgaaaaccctaaatctagtgcctctacggccgtttcggccgcgcctaccgagaaagaattccccaaaacccactcagatgtgtcaagcgagcagcagcacctgaaaggtcagacaggaactaatggcggcaacgtgaagctgtacacaactgatcagtcaactttcgacatcctccaagatcttgagttcagctcgggctcccccggcaaggaaacaaatgagagcccctggcggtccgatcttctgattgatgaaaactgcctgttgagccctctggctggcgaggatgattcttttcttctggaaggtaattctaacgaggattgtaagcctctcatcctgcccgacaccaagccaaaaataaaagataacggtgacctggtcctcagctctccctcaaatgtaacactgcctcaggttaaaacagaaaaggaggacttcattgagctgtgtacccccggcgtcatcaagcaggagaagcttgggaccgtgtactgccaggcatccttccctggagctaatattatcggaaacaaaatgtcggcaatctcggttcacggagtcagtacaagtggtggtcaaatgtatcactatgatatgaataccgcttccttgtctcagcaacaggatcaaaagccaatattcaatgtgattccaccaattccagtggggtcggaaaactggaaccgttgtcagggttctggcgacgataacctcacctcactgggcacacttaacttccctggcagaactgtcttcagcaacggatattcatcacctagcatgaggccagacgtgtccagccctccaagcagcagttcaactgcgactactgggccaccccccaagctctgtcttgtttgcagcgacgaggcctccggctgtcactacggggtgctcacttgtggtagctgcaaagtcttcttcaagagagctgtggaaggtcagcacaactatctgtgtgccggacgcaacgattgcataattgataagatcagacgcaagaactgcccggcttgtagataccgaaagtgcctgcaggccgggatgaatttagaggctcgaaagacaaaaaaaaaaataaaaggcattcaacaggctaccactggagtcagccaggaaactagcgagaatcctggcaacaagacaatcgtccctgcgaccctgcctcagctgacccccacactagtctccctgctggaggtgatcgagcccgaagtactatatgccggttatgatagcagcgtcccagatagtacctggcggattatgacgaccctcaacatgctgggaggacgccaggtaatcgcagcagtcaagtgggccaaagccatacctgggtttagaaacctgcatctggacgaccagatgactcttctgcaatacagctggatgttcctgatggccttcgctttgggctggcgcagctaccgccagtcctctgcaaatctgctgtgcttcgcgcctgatttgataatcaacgagcaaagaatgaccctcccttgtatgtacgaccaatgcaaacatatgttatacgtgtcatctgagctgcatcgcttacaggtgagctacgaggaatacctgtgcatgaaaactttgcttctgctcagctcggtcccgaaagacggactgaaaagccaagagcttttcgacgaaattagaatgacctacataaaagagttaggaaaagcaattgtgaagagagaagggaacagcagccagaattggcaacgattttatcagctgactaagctactggattccatgcacgaaaatgtgatgtggctgaagcctgagagtacctcacatactctcatctag

SEQ ID NO: 16434 - DNA, 1143 bp, Artificial Sequence
  Description of Artificial Sequence: Synthetic coding sequence
atgcggccggacgtttcctctccaccttcttccagcagcacagcaacaactgggccaccccccaagctctgtctggtttgcagtgacgaggcgagcggctgtcattacggtgtcttaacatgcggttcatgtaaagtatttttcaagcgtgcggtggagggccagcacaattacttgtgtgcgggaagaaatgactgcataatcgacaagatacgcaggaaaaactgccccgcctgcaggtacaggaaatgcttacaggctggtatgaacctggaagcacgcaagacgaaaaaaaaaatcaagggcatacagcaagcgaccacaggagtctcccaggaaacgtctgaaaaccccggcaacaaaaccatcgtgccggcaacgctgcctcagctgacacctaccctggtgtccctgctggaggtcatcgaacccgaggttctgtacgcaggatacgattcaagcgttccagatagcacctggcggattatgactaccctgaacatgctgggcggccggcaagtgatagccgcagttaagtgggctaaagctatccctgggtttcggaacttacacctcgatgaccagatgaccttgctccagtattcttggatgtttcttatggcttttgcccttgggtggagaagttaccgtcaatcttctgcaaacttgctgtgctttgcacccgacctgattatcaacgagcagcgaatgactctgccatgtatgtacgatcagtgcaagcatatgttatacgtgagcagcgagctgcatcgtctgcaagtgtcgtacgaagagtacctgtgcatgaaaaccctgctgctgttgtcatccgtccctaaagatggactcaagagccaagagctctttgatgaaatccggatgacatatatcaaggagctcggaaaggcaattgtcaagagggaaggtaacagctcccagaattggcagaggttctaccaactcacaaaacttctggactctatgcacgaagtggtggaaaatcttcttaactattgctttcagacattcttggataagaccatgtccatcgaattcccagaaatgctggctgagatcatcacaaaccagatccccaagtacagcaacggcaacatcaaaaagctgttgtttcaccagaaatag

SEQ ID NO: 16435 - DNA, 2256 bp, Artificial Sequence
  Description of Artificial Sequence: Synthetic coding sequence
atggattcaaaggagtccttaacacctggaagggaggaaaacccttcaagcgtgctggctcaggaaaggggggatgtgatggatttttacaaaaccctgcgcggtggcgcaactgtcaaggtgtccgctagtagcccaagtcttgctgtggcgtctcaaagcgattctaaacagcggcggctgctggtggatttcccaaaaggcagcgtgtcaaacgcacagcagccagatctatccaaggccgtatctctcagtatgggactgtatatgggcgagactgagactaaggtgatgggaaatgatctcggctttccccagcaggggcagatctctttgagcagcggcgaaaccgacctgaaactgttggaagagagtattgccaatctgaacaggtcaacatccgtcccagagaacccaaaaagtagcgcctcgacagcagtgagtgctgctccaaccgaaaaagagtttcccaaaacgcactctgacgtatcttctgagcagcagcacctgaaaggtcagactggtaccaatggcggaaacgtaaaactatatactaccgatcaaagtaccttcgacatattgcaggaccttgagttctcgtcaggaagcccgggcaaggagactaatgagtccccctggcgcagcgatctgctgattgatgagaactgtctgctctctcctttggccggagaagacgacagttttctgctcgaaggaaactccaacgaggactgcaaaccacttatactgcccgacaccaagcccaagataaaggacaacggcgacctggtcctgtcgtcgccctctaacgtgacacttccacaggtgaagacagagaaggaagatttcatagaactttgtactcctggagtcatcaaacaggaaaagcttggtaccgtctattgtcaggcctccttccctggggcaaatatcatagcgtctctctctcagcagcaggatcagaaaccaatctttaacgtgatccctccaatacccgtcggctccgaaaactggaaccgatgccagggctccggagacgataacttaacaagcctgggcacactcaatttccctgggcgcacagtttttagcaatgggtacagctctccctccatgcgacccgacgtctctagccccccgtccagctccagtacagcgactacagggccacctcccaagctgtgcttagtttgttccgatgaagcgtctgggtgtcactatggagtgctcacctgcggttcctgcaaggtgttcttcaagcgcgccgtggagggccagcataattacttgtgtgcaggaaggaacgattgtatcattgacaaaatacgccggaaaaactgccccgcttgtaggtaccggaagtgtcttcaggctggaatgaacctggaagccagaaaaactaaaaagaagattaagggtattcagcaggctacaacaggagtgtcccaggaaacatctgaaaacccagggaacaaaaccatagttccagcaactttgccccagctcacccctacactcgttagtctgctcgaggtgatcgaacccgaggtactctatgccggatacgactcctccgttcctgattctacctggcgcatcatgacaaccttaaatatgttaggaggacgccaggtgatagcagccgtgaagtgggccaaagcgataccagggttcagaaatctgcaccttgatgatcagatgactctgctccagtactcctggatgtttttaatggcctttgccctcggctggcggagctatagacagagctcagcaaatcttctgtgcttcgcacctgacctcataattaatgaacaaagaatgactttgccttgtatgtatgaccaatgtaagcatatgctgtatgtttcctcagaattgcatcgcctacaagtctcctacgaggagtacctatgtatgaaaactctgctcctcttatcctcagtccccaaggatggtctgaaatctcaggagctgtttgatgaaattaggatgacctacattaaggaactgggtaaggccattgtgaagcgcgagggtaactcctcacagaattggcagcgcttctaccagctgacaaagctgctcgacagcatgcatgaagtggtcgagaatcttctaaactactgtttccaaacattccttgataagacaatgagcatcgagtttccagagatgctcgccgaaatcattacaaatcagattcctaagtatagcaatggcaatattaagaagcttcttttccaccagaaatag

SEQ ID NO: 16436 - DNA, 435 bp, Artificial Sequence
  Description of Artificial Sequence: Synthetic coding sequence
atggactcaaaggaatcactgactcctggccgcgaggagaacccctctagcgtccttgctcaggaaagaggggacgtcatggatttttataagacgcttaggggtggtgctaccgtcaaagtcagtgccagctcaccctcactggccgtcgccagccagagcgattctaaacagaggcgcctcttggtggactttcccaagggcagtgtcagcaatgcgcagcaacctgacctgagcaaggctgtcagtctgtccatggggctgtatatgggtgaaacggaaactaaggtaatgggcaatgatctgggtttccctcagcagggccaaatttcactgtcctccggcgagaccgaccttaagctgctggaggagagcatcgccaacctcaacaggtctacttcagtgccagaaaaccctaagagctccgcaagttag

SEQ ID NO: 16437 - DNA, 438 bp, Artificial Sequence
  Description of Artificial Sequence: Synthetic coding sequence
atggacagtaaagagagcctaacaccaggaagggaggagaaccctagctccgtgttagctcaggaacggggcgacgtgatggacttttacaagactctcagggggggtgccacggtgaaggtgagcgcaagcagccccagcctcgcggttgcatcccagagcgactccaaacaacggcggctactggtggacttcccgaaggggagcgtgtcaaacgcccagcagcccgatctcagtaaggccgtaagccttagcatgggactctatatgggggagaccgaaactaaggtcatgggcaatgatctggggttcccccaacagggacagattagcctctcctcgggggagactgatctgaaattactcgaagaaagcattgctaatctcaataggtcaacatccgtcccggagaatcctaaaagtagcgccagtacttag

SEQ ID NO: 16438 - DNA, 2334 bp, Artificial Sequence
  Description of Artificial Sequence: Synthetic coding sequence
atggattccaaagagagcctgacgccaggtagggaggagaatcctagctccgtcctagcccaggagagaggagacgtgatggacttctataaaacactgcgggggggggccactgtcaaggtctccgcctcttcaccaagcctggccgtggcctctcagtcggacagcaaacagcgtagattgttagtcgatttccccaaaggttccgtctctaacgcccagcagcctgatctgtcgaaggctgtttcactgtccatggggctgtacatgggcgagactgagaccaaggtgatgggtaacgatctaggtttcccgcagcaaggacaaatctccctgtcttccggcgagacagatctaaagttgctggaggagtcaatcgcaaatctgaatcgcagtacttccgtccctgaaaatccaaagtcctcagccagcactgccgtgtctgctgccccaactgagaaggaatttcccaagacacatagcgatgtgtcttctgaacagcagcatctaaagggccaaaccggcaccaacggcgggaacgtcaagctttacaccactgaccaatctacctttgacatactccaagatctggaattctcgagtggaagcccaggtaaggaaactaacgagagcccttggcggtctgatttgctgatcgacgaaaactgtttgctttctccgctggcgggcgaggatgactctttcctgttggagggtaacagcaatgaggactgcaagcccctgattctgcctgatacaaagcctaaaatcaaagacaacggagatctcgtgctcagttccccatcaaacgtaactctgccccaagtcaaaaccgaaaaggaggattttattgagctttgtactccgggggttatcaaacaggagaagttaggtaccgtgtactgccaggcgtccttccctggtgccaatatcatcggcaacaaaatgtcagctatcagtgtgcatggcgtatcaacttctggtggacagatgtaccattacgacatgaatactgccagcctgtctcagcagcaggaccagaagcccatctttaacgtaattccacctattcctgttgggagcgaaaactggaaccgttgccaggggtcaggcgacgacaacttaactagcctcggcactctgaacttccccggtcgcaccgttttctccaatgggtacagcagtccctctatgcgccctgacgtgtccagtcccccatcctccagctcaactgctaccaccgggcccccccctaagctgtgtctggtgtgtagtgacgaggctagcggatgccactatggagttttgacttgtggcagttgtaaggtgttttttaaaagagcagtagagggccaacacaattatctgtgcgccggaaggaatgattgcattatcgacaaaattcggagaaaaaactgtccggcttgcagataccgcaaatgccttcaagctggcatgaacctggaagctcgcaagactaagaagaaaattaaaggtatccagcaagctacgacaggggtgtctcaggagaccagcgaaaaccccggtaacaagactatcgtgcccgctactttgcctcagctgactcccaccttggtaagccttctggaagttatcgaacctgaggtactctatgccggttacgattcttcagtcccagacagtacctggcggatcatgacaacgttaaatatgctgggtggcaggcaagtcatcgcagctgtgaagtgggccaaggccattccagggttcaggaatcttcacctcgacgaccaaatgaccctcctacaatattcatggatgttcctgatggcttttgcactcggctggagaagctaccggcagtcctctgccaatctgctgtgttttgctcccgaccttataatcaacgagcagagaatgacgctgccatgtatgtatgatcagtgcaagcacatgctgtatgtgtcatccgagctgcacaggctccaggtttcttatgaagagtatctgtgcatgaaaacattgttgctcttgagctccgttcccaaggatgggcttaagtcccaggaactttttgacgaaatcagaatgacatacattaaggagcttggaaaggcaatcgtgaagcgggaggggaatagttctcagaactggcagcgcttttaccaactgacaaaactgctggactccatgcacgaggttgtggaaaacttgcttaactattgttttcagaccttcctcgacaaaacgatgtccattgagttcccagaaatgctagccgaaatcataaccaaccagatccctaagtattcgaatggtaatatcaagaagctgctgttccatcaaaaatag

SEQ ID NO: 16439 - DNA, 2337 bp, Artificial Sequence
  Description of Artificial Sequence: Synthetic coding sequence
atggatagcaaagagtccttaacaccgggcagggaagagaatccttcttccgtgctcgcccaagagaggggcgacgttatggatttctacaaaaccctccgcggcggggccacggtcaaagtgtcagcttccagtccttcgctagccgtcgccagccaaagcgatagtaagcagcggcgcttgctggtagattttcccaaaggatcagtgagtaacgcgcaacagccagacctgagcaaagctgtctcactgtccatgggcctctacatgggcgagaccgaaaccaaggttatgggaaatgatctgggctttcctcaacaaggccagatttctctgtcgagcggggagaccgacctgaaacttctggaggaaagcatcgcgaaccttaacaggtctacttcagtccctgaaaatcccaagtcaagtgcatctacagccgtctccgcggccccaaccgagaaggagtttcccaaaactcatagtgacgtcagttctgagcaacagcatcttaagggacaaaccggcaccaatgggggcaatgtaaaactgtacacaacagaccagagcactttcgatattttacaagacctggagttttcctccggctccccaggcaaagagactaatgaatctccatggcgctcagacctgctgatagacgaaaattgccttctgagcccactggcaggtgaagatgacagcttcttgttggagggaaacagtaacgaagactgcaagcccctgatactgcccgatactaagcccaaaattaaggataacggcgatctcgtgctgtcgagcccctctaatgtaacgcttccacaggtgaaaacagagaaggaggacttcattgaactgtgcacccctggggtgatcaagcaagagaaacttggaaccgtgtactgccaagccagtttccccggggccaacattatcggcaataagatgtcagcaatttctgtgcatggcgtaagcacctctggcggtcaaatgtatcactatgacatgaatacagcttccctatcgcagcagcaggaccagaaacctatatttaatgtgattcctccaatccctgtgggttccgaaaactggaaccgctgccaggggtcaggagacgataatctaacatcgctgggcacactgaacttccccggtaggaccgttttctccaacggttacagcagccctagtatgcgaccagatgtgtcttcccctcccagtagctcgtctaccgccaccactgggcctccaccgaagctatgcctggtatgcagcgatgaggcgtccggatgtcactacggagtgctgacttgcggatcctgtaaagtcttctttaagcgcgctgtggagggacgccaacataattatctgtgcgccggacgcaacgactgtattatagataagatccgacggaaaaactgcccagcatgtagatatagaaagtgcctgcaggctggcatgaatttggaggcgaggaaaaccaagaagaagattaaaggcatccagcaagcaaccacaggagtgagccaagaaacgagtgaaaatcccggcaacaaaaccatcgtgcctgccaccctgccccagttgacccctactttggtgtctctcttggaagtgatagaaccagaggtgctgtatgccggatatgacagtagcgtcccagatagcacatggaggatcatgacaacactcaatatgcttgggggcagacaggttatcgccgccgttaagtgggcaaaggctatccccgggttccgcaatctgcacctcgatgaccaaatgaccttgctgcagtattcctggatgtttttaatggcattcgcgctcgggtggaggtcctacagacaatcatcagccaacctgctctgcttcgcccctgatctaatcattaatgaacagcgcatgacgctgccttgcatgtatgaccagtgcaaacacatgctgtatgtgagcagtgaattgcatcggttgcaggtaagctatgaggagtacctgtgtatgaaaacactgcttctgctgtcctctgtgccaaaagacggactgaagtcacaggagctgttcgatgagatccgtatgacttacattaaagagttaggaaaggcaattgtgaagagggaggggaatagttctcagaactggcagcggttctaccagctgaccaagctcttagactctatgcatgaagtagtggaaaaccttcttaattattgctttcagacattccttgataagactatgtctatagaattcccagaaatgctagcagagatcattaccaaccaaatccctaaatactccaacgggaacatcaaaaagcttctgttccaccagaaatag

SEQ ID NO: 16440 - DNA, 438 bp, Artificial Sequence
  Description of Artificial Sequence: Synthetic coding sequence
atggatagcaaggagtcattaacgcctgggagagaagaaaatcccagtagcgtgctagcccaggaaagaggagacgtgatggacttctataaaacactgcgcggtggagccactgtcaaagtgagcgcttctagcccaagcctggcggtcgcaagccagtctgattctaagcagaggcgcctccttgtcgatttcccgaaaggtagcgtgagcaacgcccagcaaccagacctgagcaaagctgtgtctctttccatgggcctgtatatgggtgaaactgaaaccaaggttatggggaacgatcttggtttcccacagcagggacagatcagtctctccagcggcgaaactgatctcaaactgctggaggaatctatagccaacctgaaccgtagcaccagcgtgcctgagaacccgaaaagcagcgccagcacgtag

SEQ ID NO: 16441 - DNA, 438 bp, Artificial Sequence
  Description of Artificial Sequence: Synthetic coding sequence
atggacagtaaggagagcttgaccccggggagagaagagaatccttcatcggtgcttgcacaagagcggggtgatgttatggacttttataagactctgcgtgggggggccaccgttaaggtgagtgctagctcaccctccttggccgtggcaagccagtccgattccaaacaacgcaggctccttgttgatttcccaaaaggttctgtttcaaatgcgcaacaaccagatctaagtaaagcagtgtcactctccatggggctttatatgggtgagaccgaaaccaaggtaatgggaaacgatttgggcttccctcagcaaggtcaaatctcactgtcctcgggcgagactgatctaaagttgttggaggagagcatagccaacctgaatcgtagcacctccgtacctgagaacccaaagtccagcgcaagtacttag

SEQ ID NO: 16442 - DNA, 438 bp, Artificial Sequence
  Description of Artificial Sequence: Synthetic coding sequence
atggactccaaggagagtctgaccccgggacgagaggaaaatccttccagcgtcctggcccaggaaagaggggacgttatggacttttacaagacactaaggggaggggccactgtcaaggtgagtgcttccagcccctcactcgctgttgccagccaatctgattcaaaacagcggagactgcttgtggatttccctaagggaagcgtctccaacgcccaacagcccgacctgtcaaaggcagtgtctctgtcaatgggtttgtatatgggagagactgaaacaaaggttatgggtaacgatttggggtttccacagcagggtcagatctcactttcaagcggcgaaactgatctgaaactcctggaggagtcaatagctaatttgaaccggagcacaagcgtccccgagaatcctaagtcctcagcttctacttag

SEQ ID NO: 16443 - DNA, 1914 bp, Artificial Sequence
  Description of Artificial Sequence: Synthetic coding sequence
atgcacgattcaattcgcttcggaaatgtggacatgccatgcgtgcaggctcagtacagccccagtcccccaggatcttcatacgctgcccaaacctacagttctgagtacacaactgagattatgaacccggactatacaaaactgacaatggacttaggttctacagaaatcactgctacagccaccaccagcctcccatccatttccaccttcgtggagggatacagcagcaactatgaactgaagcccagctgcgtgtatcaaatgcagaggcctctgattaaagtggaagagggaagggccccttcataccaccaccaccatcaccaccatcatcatcaccaccatcaccaccagcagcagcatcagcaaccctcgatcccacccgcctccagtccagaagatgaggtgctgccgagtacatctatgtatttcaaacaatctccaccaagtacaccgaccaccccagcttttccccctcaggccggagccctgtgggatgaagcactcccaagtgctcccggctgcattgccccaggcccactgctggacccgcctatgaaagcagttcctacagtggctggagcccgctttcctctgttccattttaaaccatcccccccgcaccctcccgcaccatctcctgccggagggcatcacctggggtacgaccctacagccgccgcggctctatctctaccactgggagctgcagcagccgctgggtcacaggcggcagcgctggaaagccatccttatggcctacctctggccaagagagccgccccattagctttccccccgcttggcctaactccttcgcccacagcatctagtctgcttggcgaatccccatcactgccgagtccaccttccagaagctcttcctctggtgaggggacatgtgctgtgtgcggagacaatgccgcttgtcaacactacggagtaaggacttgcgagggctgtaaagggttttttaaaagaacagtccagaagaatgctaagtatgtttgccttgccaataaaaactgtccagtggataagaggagacggaatcggtgtcaatactgccgctttcagaagtgtctctctgtaggaatggtcaaagaggtggtgcgaaccgattcactgaaggggaggcggggccggctgccaagcaaaccaaaatccccattacagcaggagcccagccaaccatcacctccaagccccccaatctgtatgatgaatgctttagtacgcgcactaaccgactctacccctcgtgatctggactactcgcggtattgtcccacggatcaagcggccgcggggacggacgctgagcatgtgcagcagttctataacttgctgaccgcttcaatcgatgtgtcaagatcctgggcagaaaaaattcccggtttcactgacctgcccaaggaggaccagacactgctcatcgagagcgctttcctcgagttattcgtcttgcggctatctatcagaagcaacaccgccgaggacaaattcgtattctgtaacggcctggtgctgcatcggctgcaatgcctcagagggttcggcgaatggctggactccatcaaagacttctcactcaaccttcaaagtcttaaccttgatattcaagctctcgcttgcttatcagcacttagcatgataaccgaaaggcatgggctgaaggaacccaagcgcgtcgaggaactttgcaataaaataacaagctccttaaaggaccaccagagcaaaggccaggccctggaacccactgagagtaaagttttaggcgccctggtggagctgcggaagatctgtactctgggcctgcagaggatcttttatctaaagttggaggatttggtgagccccccatcgatcattgataagttgtttctggacactctgccattctag

SEQ ID NO: 16444 - DNA, 1332 bp, Artificial Sequence
  Description of Artificial Sequence: Synthetic coding sequence
atgccatgcgtacaggcacagtattctccgtcccccccaggaagttcttacgcagcccagacttactccagtgaatataccacagagatcatgaaccccgactacacgaagctaaccatggatcttgggtcaaccgaaatcacagctacagccactactagcctgccgtcaatttcaaccttcgtggagggctactcctctaattacgaactgaagccctcgtgcgtgtaccagatgcaacggccactgatcaaggtcgaagaaggaagggcaccaagttatcatcaccaccaccaccaccaccatcaccatcaccaccaccatcaacagcaacaccagcagccaagtatccctccggcaagctcccctgaggatgaggtgttgccctcaacttcaatgtatttcaagcagtccccaccgtccacgccaaccacaccggctttcccgccgcaggccggtgccctgtgggatgaagccctcccgagtgcccccgggtgcatcgccccaggacctttgctagatcccccaatgaaggctgtgcctacagttgccggcgcacgattcccccttttccacttcaagccgagtcctccccatccgccggctccctcaccagccggcgggcaccacctggggtacgacccaacagctgctgccgccctgtcgctgcccctgggcgccgccgctgccgctgggtctcaagccgctgcactcgagagtcatccttatggccttcccttagccaaaagggcagctcctctggccttcccccccttgggattgaccccgtcacctactgcctcatctctgctcggggaaagcccttctctaccgagccctccatccaggagctctagcagtggcgagggaacatgcgctgtctgtggagacaacgctgcatgccaacactacggcgtgcggacttgtgaaggctgcaaagggtttttcaagcgaacagtccagaaaaacgcgaagtacgtgtgcctcgcaaataaaaactgccccgtggacaaacggaggcgcaataggtgccagtactgtaggttccagaagtgcctgtcagttgggatggtgaaagaggtcgtccgaactgactccctgaagggcaggaggggacggctgccttctaaacccaaatctcccttgcagcaggaacctagccagccttctcccccttctcccccaatttgtatgatgaacgctctggtgcgggctctgactgatagcacgccgcgggacttggactactctcgggtctcatttatgatctcctgcttccagatgaacgatcagggcctgtatctttggctgttggtcatcagggtcgactag

SEQ ID NO: 16445 - DNA, 894 bp, Artificial Sequence
  Description of Artificial Sequence: Synthetic coding sequence
atgaaagcggtccccactgtggccggcgcccgattccccctgttccacttcaaacctagccccccacatccccctgcaccatccccagcgggaggacatcatctcggttatgatccaactgctgccgccgccctgtctctgccactcggcgccgccgcggcagctggtagccaggctgctgcactcgaatctcatccttacgggttaccactggctaagcgcgctgctccgctggccttccctcctctcggattaacgccatcccccactgcatccagcttgttgggcgaatcgccctccttgccaagccctccctcccggtctagcagttcaggggaggggacatgtgctgtctgcggagataacgcagcctgccagcattatggtgttagaacctgtgagggatgtaaagggttcttcaagagaacagtccagaaaaacgctaagtatgtctgcttagctaacaagaattgtccggttgacaaaagacgacgcaatcggtgccagtactgtcgctttcaaaagtgtctcagcgttggaatggtgaaagaagttgtgcgtactgatagtctgaaaggtcgccggggacgattacccagcaagcccaagtctcccctgcagcaggaacccagccaaccatcccccccttctcccccaatctgcatgatgaatgcactcgtgagagccttaacagattccactccccgagaccttgattactcaagggtttctttcatgatctcttgcttccagatgaacgaccagggcctttatctctggctactcgtgatacgagtgctggactcttttcacacattctccatctttttagcatcattctctaacagcgtacatcccctgcagcaaatcatcttcgccctattaaacctgtag

SEQ ID NO: 16446 - DNA, 1881 bp, Artificial Sequence
  Description of Artificial Sequence: Synthetic coding sequence
atgccctgtgtacaagcgcaatactcaccgtctccccccggaagtagctatgctgctcagacttattcttcagaatatacgacagaaatcatgaacccggattacacgaagctgaccatggatctcggatctaccgagatcaccgcaacagcgaccacgtcacttccatcaatttctacctttgtcgaaggatactcatctaactatgagctaaagccatcatgcgtgtaccagatgcagaggcctcttattaaggtcgaggagggtcgcgctccgagttatcaccatcatcaccaccaccatcaccatcatcatcaccatcatcagcaacaacaccagcagccatctataccccccgcgagctcccctgaggatgaagtgttgcccagcaccagcatgtactttaagcagtctccccccagtacgcctacgacaccggccttccccccacaggctggggccctgtgggacgaagcattaccaagcgcccccggctgtattgcgcccggcccgttgcttgacccccctatgaaagcagtacctacagtggctggggctcgtttccctctctttcacttcaagcccagccccccacatccccccgcgccttctcccgcaggcggccaccaccttggatacgacccgacggctgcggctgctttgagcttaccactgggggctgctgccgcagctgggtcacaggcagccgccctggagagtcacccttacggactgcctctggccaaaagggctgcaccactcgcctttccaccactgggcctcacccccagccccacagcctcgtccctgctgggggaatcaccaagcctgccctcccctccatcacggagttcctcatccggagagggaacttgcgcagtctgtggcgacaatgctgcttgtcagcattatggcgtgagaacatgcgaaggatgcaaagggttcttcaaaagaacagtgcaaaagaacgcaaaatatgtgtgcctggccaataagaactgtcctgtagataagcgccgcagaaatagatgtcagtattgtaggtttcagaaatgtctgagcgtgggaatggtgaaagaagtcgtgagaactgactcactcaaaggcagacgggggcggttgccctctaagccgaaatcacccctgcaacaggagcccagccagccctcacccccaagtcctcctatttgcatgatgaatgcgcttgttcgcgccctgaccgactcaaccccgagagatctggattacagcaggtactgtcccaccgatcaggccgcagctgggactgacgcggagcacgtccaacagttttacaatttgctgaccgcttcaatagacgtatcccgcagttgggccgaaaagataccagggtttactgatttacccaaggaggaccagaccttactgatcgagtcagcttttctggagctctttgtactgcggttgtctatccggtccaacaccgccgaggataaatttgtgttttgtaacggattggtgctgcaccgactccagtgtctgagggggtttggcgagtggctggattcaataaaggacttttcactaaatttgcagagtctgaatctggatatacaggctctagcctgtctgagcgccctgagcatgatcaccgagaggcatgggctgaaggaacctaaaagggtggaggagctgtgtaacaagattacaagttcactcaaagaccatcagtctaaaggacaagcccttgagcctacagaatccaaggtgctcggcgctctcgttgaacttagaaagatctgtaccctgggactgcagaggatcttctatctgaagctcgaggacctggtctctccaccgagcataatagacaagctgttcctggataccttaccattctag

SEQ ID NO: 16447 - DNA, 627 bp, Artificial Sequence
  Description of Artificial Sequence: Synthetic coding sequence
atggggaacgcccaggaaagacccagtgagactatagaccgagaaagaaaacgtctcgttgagacactgcaggcggattctggcctgttactggatgcgttactggcacgtggggtccttaccgggccggaatacgaagccctggatgcgctccctgatgctgaaaggcgagtgcgcaggttgctgctgttagtccaggggaaaggagaggcggcttgtcaggaacttctgcgctgtgctcagcgtaccgcaggcgcccccgatcccgcttgggattggcagcacgtgggacccggataccgcgatcgcagttacgatcctccatgtcctggccattggacccccgaggcaccaggtagcggcaccacctgtcctggcctcccccgggcaagcgatcccgatgaggcaggtgggccggagggaagcgaggctgtacaaagcgggacaccagaggaaccagagcccgagctcgaggcagaggcatccaaggaagccgagcctgagcctgaacctgagcccgaactggaaccagaggcagaggcagagccggaaccggaacttgagcccgagccagatcctgagccagagcctgattttgaagaaagagacgaaagcgaagatagctag

SEQ ID NO: 16448 - DNA, 627 bp, Artificial Sequence
  Description of Artificial Sequence: Synthetic coding sequence
atggggaatgctcaggagagaccttccgagacgattgacagagagcgtaagcgattggtagaaacactacaggccgactccgggctgctcctggacgccctgttggctcgtggcgtcctcactggccctgagtacgaagcattggatgctctgcccgatgccgagcgacgcgttagacggctgcttttactggtgcaaggaaaaggggaggccgcctgtcaagagctactaagatgtgctcagcgcaccgctggagcgccagatcctgcatgggactggcagcacgttggcccgggctaccgtgataggtcttatgacccgccttgccctggtcactggacccccgaagctcccggttctggaacaacctgccctggtctgcctcgagcctctgacccagacgaggcgggaggccccgagggaagcgaggcagtccagtcaggtactccagaggagccggagcccgagttagaggccgaggcaagcaaggaggccgagcccgagccggagcctgaacctgagctcgaaccagaggccgaagctgaacctgaacccgaactggaacctgagcctgaccccgaaccagaacctgacttcgaggaacgcgatgaatccgaagattcctag

SEQ ID NO: 16449 - DNA, 2133 bp, Artificial Sequence
  Description of Artificial Sequence: Synthetic coding sequence
atggtcaaacttgcaaaggcagggaaaaaccaaggggaccctaagaagatggcacctcccccgaaagaagttgaggaggatagcgaggatgaagaaatgagtgaggacgaggaggatgacagctccggggaggaggtagtaattcctcagaagaaggggaaaaaagcagctgctaccagtgctaaaaaagtggtcgtttcaccaacaaagaaggtggctgtcgctacccccgccaaaaaggccgcagttacccccggaaagaaggctgctgccacccccgccaagaaaaccgtcactccagccaaagccgtaactacccccggcaagaagggcgcgacccccggtaaggccctggtggctacaccaggcaagaagggggctgcaatcccagccaagggcgccaagaacggcaaaaacgccaagaaggaggacagcgatgaagaggaggatgatgatagcgaagaggacgaagaggatgatgaagatgaggacgaggacgaggatgagatcgagcccgccgccatgaaagccgccgccgcagccccagctagcgaggacgaggatgacgaagatgatgaagacgacgaagacgacgacgacgacgaagaggacgactccgaagaggaggcgatggagacaactccagcaaaaggtaaaaaggccgcaaaagtagtgccggtcaaagccaagaatgtagctgaagacgaagatgaggaagaggatgacgaagatgaggacgacgatgacgatgaagatgatgaggacgatgatgatgaggatgatgaagaagaagaagaggaggaggaggaagagcccgtgaaggaagctccgggaaaaaggaaaaaagaaatggccaagcagaaagcggcaccggaggcgaagaagcagaaggtcgaaggtaccgaaccaacaacggcttttaatctcttcgtggggaacctcaacttcaataagagcgctccagaattgaagaccggaatctcagacgtgtttgcaaagaatgaccttgctgtcgtggacgtgaggattggcatgactagaaagttcggctacgtggacttcgagagtgccgaagatctcgaaaaagctttggaactgaccggcctaaaagtcttcggtaatgagatcaagctggagaagcctaagggtaaggactccaagaaggagcgggacgctcgaactttgctggcaaagaacctcccttacaaagttacacaggatgagttaaaggaggtttttgaggatgcagcagagataaggctggtctcaaaggacggcaaatcaaagggaatcgcctatatcgagtttaaaacagaagctgatgcagaaaagacgtttgaagagaagcagggtaccgagatcgatggccgttcaatttctctgtattacaccggcgaaaaagggcagaaccaagattacaggggggggaagaactcaacttggagtggtgagtctaagactctggttctgtctaatctgagttactctgccacagaagagaccttacaggaagtgttcgaaaaggcaaccttcataaaggtcccccagaatcagaacggcaagtctaaggggtacgcttttatagaatttgcctcttttgaagatgctaaggaagccctcaatagctgtaataagagggagatcgaaggtcgcgctattagattggagctccagggacctagagggagccccaatgccaggtcccagccatctaagaccctgttcgttaagggcctatctgaggataccaccgaagagacattgaaggagtcttttgacggaagcgtgagagctaggattgtgactgaccgagagacaggatcttcaaaaggcttcggattcgtcgactttaactccgaggaggacgctaaagccgccaaagaggccatggaggacggcgaaatcgacgggaataaggtcacgctcgactgggcaaagccaaagggcgagggcggatttggtggaaggggaggcggcagagggggatttggcgggagaggggggggtcgaggcggacgcgggggcttcggcggcaggggcagagggggcttcggtggccgaggcggctttagaggagggcgtggtggcggcggggatcacaagccccaaggtaagaaaacgaagtttgaatag

SEQ ID NO: 16450 - DNA, 1449 bp, Artificial Sequence
  Description of Artificial Sequence: Synthetic coding sequence
atggttaaattagcaaaggctgggaagaaccagggggatcctaaaaaaatggcccctccccccaaggaagtggaggaggatagtgaggatgaggaaatgtctgaggatgaggaggatgattcgtcaggggaagaagtggtcataccacagaagaagggcaaaaaggccgcagctacatctgcgaagaaggtggtcgtgtctcctaccaaaaaggttgcagtggccacacccgctaagaaagctgctgttacacctgggaaaaaggcagccgccaccccagcgaaaaagaccgttacccctgccaaagcagtgacgactcccggtaagaagggagctactcctgggaaggctctggtcgccactcccggtaaaaaaggtgcggctatacctgccaaaggcgcaaagaacgggaagaacgcaaagaaggaggacagcgacgaagaagaggatgatgattctgaggaggatgaagaggacgatgaggacgaggacgaagacgaggatgagatcgaaccggcggcaatgaaggccgcagctgccgcccccgctagcgaggacgaagacgatgaagacgacgaagacgacgaggacggcaagtccaagggaattgcatacattgagttcaaaacagaagcggatgctgaaaaaaccttcgaagagaagcaaggcaccgaaatcgacggacgaagcatcagcctctattatacaggggaaaagggccaaaatcaagactacagaggtggtaagaacagcacttggtccggggaatccaagacactggttttatctaatctttcctactccgctacagaagagaccctgcaggaggttttcgagaaggccactttcatcaaggtgcctcagaaccagaacggtaaaagtaagggatatgcctttatcgagttcgctagttttgaggatgctaaggaagccttgaactcgtgtaataaaagggaaatcgagggtcgagccatcagactggagttgcaaggcccccgcgggtctcccaatgcccggagccagccaagcaagactctcttcgtgaaggggctttcagaggacaccaccgaagaaactcttaaggaatccttcgatgggagcgtgagagctaggattgtcacagacagagagaccggaagttctaagggtttcgggttcgtggatttcaattccgaggaagatgcaaaggccgccaaggaggccatggaggacggcgagattgacgggaacaaggttactttggactgggcgaaacccaagggtgagggaggctttggtggtcgcggcggaggacgcggtggtttcgggggcaggggcgggggccgcggaggcagaggagggttcggggggcgcggccgcggcggcttcgggggacgagggggatttcggggtggtcgcgggggtggtggggatcacaaaccacaaggcaaaaaaaccaagttcgagtag

SEQ ID NO: 16451 - DNA, 1809 bp, Artificial Sequence
  Description of Artificial Sequence: Synthetic coding sequence
atggtgaaattggccaaggcgggaaaaaaccagggcgatcctaagaagatggccccaccacctaaggaagtggaagaagactccgaagacgaagagatgtcagaggatgaggaggatgattcttcaggcgaggaattgaacgacgatttttatcaaactacaatgcacaccctttggaagaagggtaagaaggcagcagccacatccgctatacctgctaaaggcgccaaaaatggtaaaaacgcaaaaaaggaggacagcgatgaggaagaggacgatgactctgaggaagatgaggaagacgatgaggacgaagacgaggacgaggatgaaatcgagcctgcagcaatgaaggctgcagcagcagcgcctgcctccgaggatgaggatgacgaggacgacgaggatgacgaagatgatgatgatgacgaagaagacgacgacgacgatgaagacgacgaggaggaggaggaagaggaggaagaagagcctgtgaaagaagcccccgggaaaaggaaaaaggaaatggctaaacagaaagcagcacccgaagcgaaaaagcagaaagtagagggcacagaacctaccaccgcctttaacctgtttgtcggaaatcttaattttaataagtctgctcccgaactaaaaactggcatttcagacgtgttcgccaaaaacgacttggcggtggtcgacgttagaatcggtatgaccagaaaattcggctatgtggacttcgaaagcgcagaggacctcgagaaggcactggagctgaccgggctgaaggtgttcggaaatgaaataaagttggagaagcctaaaggcaaagattccaaaaaggagcgggacgcgagaacacttctagccaaaaacctgccctataaggtcacacaggatgagctcaaagaagtatttgaggatgctgcagagattcgcttagtcagtaaagatggaaaatccaaggggatcgcctacatcgagttcaagacagaggcggacgccgaaaaaacgtttgaagaaaaacagggcacagagattgatggccgaagcatttccctctactatacaggcgagaaaggtcagaaccaagactatcggggcggcaaaaattctacgtggtccggagagagcaagacgcttgtgctctcaaatctgtcctactctgcaactgaagaaacgctacaggaagttttcgagaaggccacctttataaaggtgccacaaaatcagaacggtaaaagtaagggctacgcttttatagaattcgcttcatttgaggacgctaaagaagcgctgaactcttgcaacaaacgcgagatagaaggccgggccatcaggctggaattacaagggcctagaggctcacccaatgcccggagccaaccatccaaaaccctgttcgtcaagggcctcagtgaggacacaacggaggagactctaaaagagagttttgatggaagtgtgagagccagaatcgtgactgaccgcgaaacggggagctctaagggatttggctttgtggatttcaacagcgaagaggacgcgaaggctgctaaggaagctatggaggatggggaaatcgatggtaacaaggtcaccctagactgggccaaacccaaaggcgaaggtggcttcgggggccggggtggaggaagaggaggattcggtggacggggtggcggccgggggggtagaggagggtttggcggccgaggacggggcggatttggagggagaggagggtttcgcgggggccgaggcggagggggggaccataaacctcaagggaagaagacaaagtttgagtag

SEQ ID NO: 16452 - DNA, 885 bp, Artificial Sequence
  Description of Artificial Sequence: Synthetic coding sequence
atggaggatagtatggatatggacatgtccccattgcgcccgcagaattacctttttggatgcgagctgaaggccgacaaagactatcactttaaagtggacaacgatgaaaacgaacaccagttgagcttaagaacagtgtccctcggggctggagcaaaagacgagctgcacattgtggaggccgaggcgatgaactatgaaggctccccgatcaaagtgactctcgccaccctcaagatgagtgtgcagcctacagtttcactgggagggtttgaaattactccccctgtagtcctgcgactgaagtgcggctctggaccagtccatatttccggccagcacctggttgccgtggaagaagacgccgagagcgaggacgaggaagaggaagacgtgaagctcctctctatctccggcaaacgcagcgcccctggaggaggatcgaaagtgccacaaaagaaggtgaagctggccgctgacgaggatgatgatgacgatgatgaggaggacgatgatgaggatgatgacgacgacgattttgacgacgaggaggctgaggagaaagctcccgttaagaagagcatcagggacacaccagctaaaaatgcccagaaatctaatcagaatgggaaggattccaagccttcttccacaccgagatccaagggacaggagtcctttaagaagcaggaaaaaaccccgaaaacgcctaaaggtccatcttcagtcgaggatatcaaagccaagatgcaggccagcatcgagaaggggggctctctccctaaagtggaggcaaagttcatcaactacgtgaagaactgttttcggatgactgaccaagaggcaatccaagatctgtggcaatggcgcaagagcctgtag

SEQ ID NO: 16453 - DNA, 798 bp, Artificial Sequence
  Description of Artificial Sequence: Synthetic coding sequence
atggaggactccatggacatggatatgtcgccccttaggccacagaattacctgttcgggtgtgaactcaaagccgataaggactaccacttcaaggtggataacgatgaaaatgaacatcagctgtccctgcgcactgtttctctcggcgccggagccaaagatgagctgcacattgttgaggccgaagcaatgaactatgagggctcccctatcaaggtcacactggccaccctgaagatgtcagtgcaacctactgtttcacttggaggctttgagataactccccctgttgtactgcggctgaagtgtgggtctggacccgttcacatctctgggcagcacctagtcgcagttgaggaggacgctgagagcgaagacgaagaagaagaagatgtgaagttgctgtcgataagcggcaagcggtctgccccagggggcggaagcaaggtgccacagaagaaagttaagctcgccgcggatgaggatgatgatgacgacgatgaggaagatgatgacgaagatgacgatgatgatgacttcgacgacgaggaagccgaagagaaggcccctgttaagaagggccaggagtcctttaagaagcaagagaagacgccaaagacacccaaagggcctagcagtgtcgaggacatcaaggcaaagatgcaagccagtatcgagaaagggggttccttgccaaaggtggaggcgaagttcatcaactatgtgaaaaactgctttcgaatgacagatcaggaggccatccaagatctctggcaatggcggaagagcctctag

SEQ ID NO: 16454 - DNA, 780 bp, Artificial Sequence
  Description of Artificial Sequence: Synthetic coding sequence
atggaggattccatggacatggacatgtcccctctccgaccacagaactatctgtttggatgtgagctgaaagccgacaaggactaccatttcaaagtggacaatgatgagaatgaacaccagctatcactgaggacagtcagcctgggagcgggggccaaagacgaactgcacattgtagaagccgaggctatgaactacgaagggtctcctataaaggtgaccttagccactttgaagatgtccgtgcaacccaccgtctcattgggaggattcgagattacgcctccagtggtacttcgcctgaagtgcggctccgggcccgtccacatttccggccagcacttagtggctgtcgaggaggatgccgaatcagaggatgaggaggaggaagatgtcaagttgttgtcaatctctgggaaacggtctgctcccggaggcggatcaaaagtcccacaaaaaaaggtcaagctcgcagctgatgaggacgatgacgatgacgacgaggaagacgatgacgaggacgacgacgacgacgacttcgacgatgaggaggcagaggagaaggctcccgtgaaaaagtctattagagatacaccggcaaagaatgctcagaaaagcaatcagaatgggaaagatagcaagccttcaagcacccctaggtcaaagggacaggaaagcttcaagaaacaggaaaagactcctaaaactcctaagggaccatcatcggtggaggatatcaaggccaaaatgcaagcttcaatcgagaaggctcattag

SEQ ID NO: 16455 - DNA, 885 bp, Artificial Sequence
  Description of Artificial Sequence: Synthetic coding sequence
atggaagattccatggacatggatatgagccccctccggccccagaactatctcttcggttgcgagctgaaagccgacaaggattaccattttaaagtggacaacgacgagaatgagcatcagctgtcattaaggacagtgagtctaggagccggagctaaggatgagctccacatcgtcgaggccgaggcaatgaactacgaaggctcacctattaaagtaactcttgccaccctgaagatgtccgtccagcccaccgtctctctcggcgggttcgaaatcacccctcccgtcgtgctccgcctgaagtgtggctcgggacccgtgcacatttccggacagcacttggtcgctgttgaggaggacgctgagagcgaggacgaagaggaggaagacgtaaagctgctgtctatctcggggaagagatcagcccccggcgggggatccaaggtgccccagaagaaagtgaagctggccgcggacgaggatgacgacgatgatgatgaagaggacgatgacgaagatgacgatgacgacgatttcgatgatgaagaagccgaggaaaaggcacccgttaaaaaaagcatacgggatacccctgccaaaaatgcacaaaaatccaatcagaatgggaaggacagcaagccaagtagcacccctcggagtaagggccaggagagctttaagaagcaagagaaaacccccaaaacaccaaagggcccttcgtctgtggaggacattaaggctaaaatgcaggccagcatagagaaaggggggtcacttccgaaggtcgaggcaaagtttatcaattacgtcaagaactgtttccggatgactgaccaggaggcgattcaggacttgtggcagtggcgcaagtcgctctag

SEQ ID NO: 16456 - DNA, 867 bp, Artificial Sequence
  Description of Artificial Sequence: Synthetic coding sequence
atgaaggatagaacccaagagctacggaccgcaaaagacagtgatgatgatgacgacgttgcagtgacggtggacagggaccgttttatggacgaattcttcgaacaggtagaggaaatacggggttttatcgacaagatcgctgagaatgtggaggaagtaaaacggaagcactctgccattttagcctctcccaatccagacgagaagactaaggaggagcttgaagaattgatgtcagacattaaaaagacggcgaacaaagtgcgaagcaaattgaagtccatcgaacaatctatcgaacaggaagagggtctgaaccgctcaagcgctgacctgcggattagaaaaacgcagcattccacgcttagccgcaaattcgttgaagttatgtctgaatacaatgcgacccaatctgactatagggaaaggtgtaaggggagaatccagcgacagctagagatcactggccggacaacgaccagcgaggaactggaggacatgctggagagcggcaacccagcaatctttgctagtggtattattatggactccagcatttccaagcaagccctcagtgaaattgaaacccgacactcagagattatcaagctggagaattctattagagaactgcacgacatgtttatggacatggctatgctggttgagtcccagggcgaaatgattgacagaatcgagtacaacgtcgagcacgcggtcgactatgtcgaacgagctgtctccgatacgaaaaaagctgttaagtatcagagcaaagcccgccggaaaaagataatgattatcatatgctgcgtaatcctgggcattgtgattgcatccaccgtgggcggtatctttgcttag

SEQ ID NO: 16457 - DNA, 183 bp, Artificial Sequence
  Description of Artificial Sequence: Synthetic coding sequence
atggaagagcaggggcacagcgagatggagattatcccctccgaatcccatccacatatacagctgctcaaatccaatagggagctgcttgtaactcacattaggaatacgcagtgtctggtcgacaatctgttgaagaacgactacttttctgctgaagacgctgagattgtttgcgcctag

SEQ ID NO: 16458 - DNA, 183 bp, Artificial Sequence
  Description of Artificial Sequence: Synthetic coding sequence
atggaggagcagggtcatagcgagatggagattatcccttctgagtcgcatccgcacattcagctgcttaaaagcaatcgcgagctgctggttacacacattcggaacacacagtgcttggtcgataatctcctgaagaatgactacttttctgccgaagatgccgaaatagtatgcgcatag

SEQ ID NO: 16459 - DNA, 138 bp, Artificial Sequence
  Description of Artificial Sequence: Synthetic coding sequence
atggaggagcaggggcatagtgagatggagattattcctagtgaaagtcacccacatatacagctgctcaagagcaaccgagagttgcttgtgacccacataagaaatacacaatgcctcgttgacaacttgctgtag

SEQ ID NO: 16460 - DNA, 183 bp, Artificial Sequence
  Description of Artificial Sequence: Synthetic coding sequence
atggaggagcagggccatagtgaaatggagattataccctctgaatctcacccccacatccagcttttgaaatccaatagagagttgctcgtaacccacatccgcaatacccagtgtctggtggacaaccttctcaagaatgactatttctccgcagaggacgctgaaatcgtttgcgcctag

SEQ ID NO: 16461 - DNA, 750 bp, Artificial Sequence
  Description of Artificial Sequence: Synthetic coding sequence
atggaggagcagggacattccgagatggagattattcccagtgaaagccacccacacatccaactcttgaagtcaaatcgagagctcctggtaacccatattagaaacacccagtgtcttgtggataatctgctgaagaacgattatttcagcgctgaagatgctgagatcgtttgcgcctgtccaacccaacctgataaagtgcgcaagatcctcgacctggtccagtctaaaggcgaggaagtgagcgagttttttctgtacctgttgcaacagctggcggacgcatacgtggatctcagaccctggttgctggagatcggatttagtcctagcttgctcacccaaagcaaggtggtcgtcaacacagaccctgtgtcccgctatacccaacagttacgccaccacttagggcgggacagcaagttcgtgctgtgttacgcacagaaagaagagctcctactggaagaaatttatatggataccatcatggagctcgtggggtttagcaacgaatcgttggggtcactgaactcactggcgtgtctgttggatcacacaaccggcatcctcaatgaacaagcagccagcaggaaagtgacaggttgcgtgtgccgaacatgttccagttctacgactgcaacccagtcggggacaccccgacgttgtctgccctcatgctgtgctagccctacctggcccagctctcccagcatggcttggacatcctgcacacgtacctggacctag

SEQ ID NO: 16462 - DNA, 2340 bp, Artificial Sequence
  Description of Artificial Sequence: Synthetic coding sequence
atggaggaacaggggcacagcgaaatggaaatcattccctctgaatcccatcctcatatccagttgctcaagtcgaatcgggaactgttggtgactcacatccggaacacacagtgtctggtcgacaacctgctgaaaaatgactatttcagcgccgaagacgcggaaattgtttgcgcctgcccaacccagcccgataaagtacggaagatccttgatcttgtccagtccaagggtgaggaagtttccgaatttttcctgtacctcctgcagcaactcgctgacgcatacgtcgatctaagaccatggttattggaaatcggatttagcccaagcctgttaacgcaaagtaaggtggtagtgaatactgatccggtgtcacggtacacacagcagctgcgtcaccatctcgggcgcgacagcaagtttgtgctctgctacgcacagaaggaggagctgctcctggaagaaatatatatggacacaattatggagctagttggtttttctaatgagagccttggcagcctgaacagcttggcctgtctcttggaccatacgaccggcatcttaaacgaacagggggagaccatcttcattctgggcgacgcaggcgtgggtaaatctatgctcctgcagagactgcaaagcctctgggcaactggccgactcgacgccggggtcaagtttttctttcacttccgctgccgaatgttctcatgttttaaggaatctgatagattgtgcctgcaagacctgctatttaaacattactgttatccagagagagatcccgaagaagtgttcgcctttctgctgcgatttccccacgttgcccttttcaccttcgatgggctcgacgagctgcacagcgatttggacctaagccgagttccagattcttcttgtccctgggaaccagctcacccgctggtacttctggctaacctgcttagcggcaaattgttgaaaggtgcctcgaaactgttgacagctagaacggggatagaagtgccccggcaattccttcgaaagaaggtgctcctccgggggttttctccgagccatttacgtgcctacgcaagaagaatgtttcccgagagagccctgcaggatcgcctccttagtcagttggaggctaaccctaatttatgctccctgtgttcagtcccactgttctgttggatcatctttcggtgttttcagcatttcagagcagccttcgaaggaagcccccaattaccagattgcaccatgaccctaactgatgtgttcttgcttgtcaccgaggtgcacctgaatcgcatgcaaccctctagcctggtgcaacgtaataccaggtccccagtggagaccctccacgcaggccgggacacactatgttctttgggccaggtggcacacagggggatggagaagtctctcttcgtgtttacccaggaggaagttcaagcctccggactgcaggagcgcgacatgcagctgggctttctccgagcacttcccgagttggggcctggtggcgaccagcaaagctatgagttttttcaccttactctgcaagctttctttaccgcgtttttcttagttctcgacgatcgtgtggggacccaagagttactgagattctttcaagaatggatgccacccgctggtgcggcaacaacaagttgttaccccccattcctgccctttcaatgcctgcaggggtccggcccagcgcgggaggatttattcaagaacaaggatcatttccagttcaccaatttattcctgtgcggactactgtcaaaagctaaacagaaactcctgcgccacctggtgcccgcagctgccctgagacgcaaacgcaaggctctatgggcccacctcttttcctccctgcgtggatatctaaaatcccttccaagagtgcaggtcgaaagctttaatcaggtgcaagccatgcccacgtttatatggatgctacggtgcatttacgaaacacagagccagaaggtcgggcagttagccgcaagagggatttgcgccaattacctgaagctgacttattgtaatgcgtgtagtgcggactgttctgccttgtcttttgtcctgcatcacttcccaaagcgtctggcattggacttggataacaacaacctgaacgactacggagtccgggagctgcaaccttgcttttctagactgacggtgctgcggctgtctgtgaatcaaattactgacggcggggtgaaggttctatccgaggaattgacaaagtataaaattgtgacctatctcggattatggaaaagcgtggatactatttgctttaagaaacagggcctgctgaaatag

SEQ ID NO: 16463 - DNA, 495 bp, Artificial Sequence
  Description of Artificial Sequence: Synthetic coding sequence
atgaagtgcaaaccaaatcagaccagaacctatgacccagagggattcaagaagcgagcagcttgtttgtgctttaggtccgaacgggaggacgaggtcctgcttgtttcatcttccagatatccagacagatggatcgtcccgggcggaggaatggagccagaggaggagcccggtggggcagccgtgagagaggtgtatgaggaggctggggtgaaagggaaactgggtagactactgggggtgttcgagcagaaccaggacagaaagcatagaacctacgtctatgtgctcaccgtgaccgaacttcttgaggattgggaggattccgtctccatcggccgcaagagggagtggtttaaggttgaagacgcgattaaggtccttcagtgccataaaccggttcatgccgagtatctcgaaaaactgaagctgggcgggagtccaaccaatggcaacagtatggctccatcatcgcctgactccgatccttag

SEQ ID NO: 16464 - DNA, 792 bp, Artificial Sequence
  Description of Artificial Sequence: Synthetic coding sequence
atgagtctctattgcggcattgcctgtaggagaaaatttttctggtgctacaggttgctcagcacttatgtgaccaagactaggtatttgtttgaactgaaggaggatgacgacgcctgtaagaaagcccagcaaaccggagccttctacctgtttcacagcttagcacccctgctgcaaacttcagcccaccagtatttggctccacggcactctcttcttgaactggagaggctgctgggaaagttcggccaggacgcacagagaatcgaggactctgtcctgatagggtgttctgagcagcaggaggcctggtttgcactcgatctggggttggattcctctttctcaatctccgcaagtttgcataaaccagagatggagactgagctaaagggatcattcattgaactccgtaaggccctgtttcagttgaacgcgcgagacgcgtctctgttgtccacggcccaggccctgcttcgttggcatgacgcccaccaattttgttcccgaagcgggcagcctaccaagaagaacgtggccggatccaaaagagtgtgtccttcgaacaatattatctactaccctcaaattcaggtgaatctcagagagctggagaccgcagcttggttttcacacgatgaagtggcaaccgcattgaagagaaaggggccttacacccagcagcagaacggtactttcccattttggcttcccccaaaactggctattagtcatcagctgattaaggaatgggtagaaaaacagacgtgcagctcactgccagcctag

SEQ ID NO: 16465 - DNA, 1059 bp, Artificial Sequence
  Description of Artificial Sequence: Synthetic coding sequence
atgtctttgtattgcggaatcgcatgtaggcggaaattcttttggtgttatcgcttgcttagtacctacgtgactaagacgcgttatctgtttgaactgaaagaggacgatgacgcttgcaaaaaagcacaacaaactggtgccttttatctgttccatagtcttgcacccctgctccaaacaagtgcccaccaatacttggcacctcgccactcgctgctcgagctggagcgactcctgggcaagttcggccaagacgcccagaggatagaagattccgtgctcattggctgttctgaacagcaagaagcatggtttgcgcttgatctggggttagattcgtccttctccatcagcgcatccctccacaagccagaaatggaaaccgaacttaagggatctttcatcgaactgagaaaggctctttttcagctcaatgcccgggacgcctcactgctctccacagcgcaggctcttttgcgctggcacgacgcccatcaattctgctctcgctctggccaacccacaaaaaagaatgtcgccggaagcaaaagagtgtgtccctctaacaacatcatctactacccacagatggcacctgtcgctatcacattggtctctgacggcacacgatgcctccttgcccggcagtccagttttcctaagggcatgtatagcgcacttgccggtttctgtgatattggtgaaagcgtggaggagaccatcaggagagaagtagccgaggaagtgggactggaagtagagtcactgcagtattacgccagtcagcattggccatttccgtctggaagcctcatgattgcctgccatgctaccgtgaaaccaggacagacggaaattcaggtcaacctgcgtgagctggagaccgctgcatggtttagtcatgacgaggtagcaactgcactaaaaaggaagggcccttacactcagcaacagaatggaacattccccttctggctgccacctaagctcgcgatctcacaccagctaattaaggagtgggtggagaaacagacttgttcatctctacccgcttag

SEQ ID NO: 16466 - DNA, 708 bp, Artificial Sequence
  Description of Artificial Sequence: Synthetic coding sequence
atgtccctctactgtgggatcgcctgtcgtaggaaattcttttggtgctaccgcttactctcaacttacgtgacgaagacacggtacctctttgaattaaaagaagacgatgatgcatgcaagaaggcccagcagacaggagctttctacctgttccactctctcgcacccctcctgcaaaccagcgctcatcagtatctggcaccgaggcattccctcctcgaactggagcgccttctggggaaatttggtcaggacgcacagcgtatcgaagatagtgtgctcattgggtgttcagagcagcaggaagcttggttcgctctggatctcggtcttgatagcagtttctctataagtgcatctctccacaaacctgaaatggagactgaactgaagggatcatttatcgaacttagaaaggccctatttcagcttaacgccagggatgcctccctgttgtctaccgcccaagctctgttacgttggcatgacgcccaccagttctgttcccgctcagggcagcctactaagaaaaacgttgcaggctccaagcgggtgtgtccatcgaacaacattatttactaccctcaggtaaaagtgtggaaacggccctcagcagaaaagctgcagaagcgctgggactggaggtggaaagcttgcagcacaatgcatccctcaataggcccaagcttagttgcccattcctag

SEQ ID NO: 16467 - DNA, 468 bp, Artificial Sequence
  Description of Artificial Sequence: Synthetic coding sequence
atggcccctgtagccattacgctggtgtcagatggtactaggtgcctccttgcccggcagtcttccttcccaaaaggtatgtacagtgctctggccggtttctgtgacataggggaatctgtagaagaaacgatccgtagagaagtggctgaggaggtgggattggaagtggaaagcctgcaatactacgcctctcagcattggccgttcccctctgggagcttgatgattgcttgccatgccactgtgaaacccggccagacagagattcaggtcaatctgcgtgaactggagacagctgcatggtttagccacgacgaagtggcaaccgcactcaaacgcaagggaccttacactcagcagcagaatgggaccttccctttctggctgccccctaaactagctatcagccaccaactgatcaaggagtgggtggagaagcaaacttgttcctccttgcctgcttag

SEQ ID NO: 16468 - DNA, 681 bp, Artificial Sequence
  Description of Artificial Sequence: Synthetic coding sequence
atggagaccgagttgaagggaagttttatagagctcaggaaggctctgttccagcttaacgctagagacgcctctctcctttcaactgcgcaagccctgctacggtggcacgatgcccaccagttctgctcacggtcaggccagcccaccaaaaaaaatgtagccggctccaagcgggtctgtccatcgaacaacatcatttattaccctcagatggcccctgtagccataacgctggtctccgacgggactcgctgtctgttggctagacaaagttcgtttcccaaaggtatgtacagcgctctcgctggcttctgcgacatcggcgaatcagtggaggaaactatccggcgagaggtggctgaggaagtgggactggaggtggagagtctgcaatactacgcaagccagcactggccgttcccatcaggatcccttatgatcgcgtgccatgccaccgtaaagcctggccagacagaaattcaggtgaaccttagagagttagaaacggcagcctggttcagtcacgacgaagttgccaccgccttgaaaaggaagggcccctacacacagcagcagaacgggactttcccattctggctacctcccaaattggctatttctcaccagttaataaaagagtgggtcgagaaacaaacttgctcttccttacccgcctag

SEQ ID NO: 16469 - DNA, 717 bp, Artificial Sequence
  Description of Artificial Sequence: Synthetic coding sequence
atgctgggacagccagcaccactggagagatttgccagcagaaggccccaggtcctggccgtgcgaacagtttgcgatcttgtgttagggaagatggataaggactgcgaaatgaagagaaccaccctagacagtccattgggaaagctggagcttagcggctgcgagcagggactccatgaaataaagctcctgggcaagggtaccagcgctgccgatgctgtcgaggtccctgcgcctgctgccgtgttgggcgggcctgaacccctgatgcagtgtaccgcatggctgaacgcttacttccaccagccagaggctatagaggaatttcccgtccccgcccttcatcaccccgtgtttcagcaggagagcttcactaggcaggtgctgtggaagcttctaaaggttgttaaatttggggaggtgatcagttatcagcagctcgccgccctcgccggcaaccctaaggccgctcgcgccgtaggcggggcaatgcgtggcaatcctgtgcccatcctcataccatgtcatagggtagtgtgttccagtggggctgtgggtaattacagcgggggactagccgtgaaagaatggctactggcacatgaagggcatcggcttggcaaacccgggctgggaggcagctccgggctggctggagcctggctgaaaggggccggtgcaacttcaggaagcccgccagctggccgcaactag

SEQ ID NO: 16470 - DNA, 1569 bp, Artificial Sequence
  Description of Artificial Sequence: Synthetic coding sequence
atgagcagtcggccactggagagccccccaccttataggccagacgagttcaagccaaatcactacgcccctagtaacgatatctatggcggagagatgcacgtgcggccgatgctgagtcaaccggcatattcattttacccagaagacgagatcctccacttttacaagtggacctccccccctggcgtcattcgcattcttagcatgctgatcattgtgatgtgcattgcgatctttgcttgcgtggcttcaaccctggcttgggatcgtgggtacggcacaagcttactgggtggtagcgtcgggtatccctacggaggcagcgggtttggaagttacggctcaggttatgggtatggttatggctatggatatggctatggaggatataccgacccaagggcggcaaaaggattcatgctggctatggcagctttttgttttatcgctgccttggtcatctttgttacctcggtgataagatcagaaatgagtcggacgaggaggtattacctttcggttattatcgtatccgctatcttgggtatcatggtgtttatagctacgattgtctacataatgggagtaaaccctacagcccagtccagcggttcactgtacggatctcagatatacgcactctgcaaccagttttacacccctgccgccaccggtctttacgtggatcagtacctctatcattactgtgtggttgacccccaggaggccatagctattgtcttggggtttatgattattgtggcctttgccctcattatcttttttgccgttaagactagacgcaaaatggatcgctacgataaaagtaacattctgtgggacaaagagcacatttacgatgagcagcccccaaatgtagaggaatgggtaaagaacgtgagcgccggaacccaggacgtaccatcacctccatcggactacgtggaacgagtggattcgcccatggcttactcatcaaatggaaaagtgaacgacaaacgtttttatcccgagtctagctacaagtcaacacccgtgcccgaggtcgtgcaagagctccccttgacgagtcctgtagatgactttaggcaaccccgatactccagtggcgggaattttgagacacccagtaaaagagcaccagcaaagggcagagccggtcggtccaagaggactgaacaggatcactacgagacagactacaccaccggcggggagtcttgtgatgagttggaagaggactggattcgggagtacccaccgataacatcagatcagcagagacaactgtataagcgaaactttgacacagggctgcaggagtataagagtctccagtctgaactggatgagatcaacaaagagctgtcccggctggacaaagagctggacgactatagagaggagtcagaggagtatatggcggccgccgacgagtataacagactcaagcaggtgaagggcagcgccgattacaaatcgaaaaaaaaccactgcaagcaacttaagagtaagttgagccatataaaaaagatggtgggtgattatgaccgccagaagacctag

SEQ ID NO: 16471 - DNA, 1407 bp, Artificial Sequence
  Description of Artificial Sequence: Synthetic coding sequence
atgagctcccgccccctcgaatcacccccgccataccgaccagatgagtttaaaccaaaccactacgcaccatcaaacgatatatacggcggtgaaatgcatgtcagacctatgctgagtcagcccgcctacagcttttacccagaagacgagattctgcacttttacaagtggactagtccccctggggtgatcagaatcctcagcatgctgataattgtcatgtgtatagcgatcttcgcttgtgtggcgtccacccttgcgtgggatcgggggtatggaacctccctgctgggaggcagcgttggatacccgtatggcgggagtggttttggttcgtacggatcggggtatggctatggctacggctacggctacgggtacggtggctatacagatccccgtgccgccaagggttttatgctggcgatggccgccttctgcttcattgccgctctggtcatcttcgtcacctctgttatcagatcagaaatgtcacgcacaagaagatattaccttagcgtcatcattgtttctgccattctgggaatcatggttttcattgctacaatagtctacattatgggtgtcaatcctaccgcgcaaagttccggcagtctgtatggctcccagatctatgccctctgtaaccaattttatacacccgccgccactggactgtacgtggatcagtatctctaccattactgcgtggtcgacccacaggaagtgaagaacgtgtctgcaggaacacaagatgtgcctagtccccccagcgactatgttgagcgagtcgacagcccgatggcctacagttcaaacgggaaagttaatgataagcgcttctatcccgagagctcctataaaagcactccggtacctgaggtggtgcaggagctgccacttactagtccagtggatgacttcagacagccacgttattcaagcggcggcaacttcgaaacaccaagtaagcgcgcacccgctaaaggcagggcaggtcggtcaaaaaggactgagcaagaccactatgaaactgattacaccaccggaggtgagtcctgtgacgagctggaagaggattggattagggaatacccacccatcacctccgaccagcagaggcagctctacaaacgaaattttgacactggtttgcaggagtacaaatcccttcaaagtgaacttgacgaaatcaacaaagagctatccaggcttgacaaggaactggatgattatcgcgaggagagcgaagaatacatggctgccgctgatgaatataataggctgaagcaggtcaaggggtcagcagactataaaagcaaaaagaaccactgtaagcagctcaagagcaagctgtcacatattaaaaagatggtgggagactatgatcgacagaagacttag

SEQ ID NO: 16472 - DNA, 1569 bp, Artificial Sequence
  Description of Artificial Sequence: Synthetic coding sequence
atgagcagtaggcctctggagtccccccccccttacagacccgatgaattcaaacctaatcattatgcgccttcaaacgatatttatggcggtgagatgcacgtcaggccaatgttgtctcagccggcgtactctttttaccctgaagacgaaatcctgcacttttacaagtggactagccctccgggggtgattagaattctttcaatgctgattatcgtaatgtgcatcgccatttttgcttgcgtagccagcacccttgcttgggaccggggctacggaacgtcactgctgggcggcagcgtgggctatccttatggcgggagtgggttcggcagctatggctctggctacggttacggatatggatacggatatgggtatggggggtatacagatccaagagccgctaagggcttcatgttagctatggctgccttttgttttatcgccgctttggtcattttcgtgacctctgtcattcggagcgagatgtcaaggaccagacgctattacctttcagtgataatagtgtctgccattctggggatcatggtcttcattgccacgattgtgtacatcatgggcgtgaatcctaccgcccaatcctctgggagcctttacggcagccagatctatgcactgtgtaaccagttctatacccccgccgccaccggcctgtacgtggatcaatacttgtaccactactgcgtggtggatcctcaggaagcgattgccatcgtgctggggttcatgattattgtagcttttgcccttatcattttttttgcggtgaaaacgaggcgcaagatggaccgctacgataaaagtaatatactctgggataaagaacatatttatgacgagcaaccacccaatgtggaggaatgggtgaaaaatgtgtctgccggcacccaggacgtgcctagcccgccgtcagattacgttgaacgcgtggactctcctatggcctattcaagcaacgggaaggtcaacgataagcgtttttaccctgagtcatcatacaaaagtacgccagtcccggaagtagttcaggaactcccacttacttctcctgtcgacgattttaggcaacctaggtacagcagtgggggaaattttgagacaccttcaaagagggcaccagctaaggggcgcgccgggcggagtaaacgcaccgagcaagatcattatgaaaccgactacacaactggaggggaaagttgtgacgagctggaagaagactggattcgcgagtatccacccattactagcgaccagcagaggcaactgtacaagaggaactttgatactggactgcaagaatacaagtcactgcagagcgagctggacgagatcaacaaggagctgtctaggctggataaagagttagacgattaccgagaagaatccgaggaatatatggccgctgcagacgagtacaacagactcaaacaagtaaagggttccgcagactataagtccaagaaaaaccattgcaagcagcttaaaagtaaattgagtcacatcaaaaagatggtcggggactacgatcgtcaaaaaacctag

SEQ ID NO: 16473 - DNA, 816 bp, Artificial Sequence
  Description of Artificial Sequence: Synthetic coding sequence
atgataattgtggcattcgcattgattatcttctttgccgtgaaaacgaggcgaaaaatggaccgatatgataagtcaaatatcctgtgggacaaggagcatatatacgacgaacagccccccaacgtggaggagtgggtgaagaatgtctctgccggaacacaggacgtcccgtcaccaccctcagactatgttgagcgagttgacagtcccatggcctactcttctaacggcaaagtaaacgacaagaggttctatcctgaaagcagttataagtctacacccgtccccgaggtggtgcaggagttgccactgaccagccctgtcgacgactttcgccagccgaggtactcctccggggggaatttcgagactcctagcaagagggctcccgctaaagggagggctgggcgctccaagagaacagagcaggatcactatgagacagactatacgacgggcggtgaatcatgtgacgagttagaggaggactggattcgcgagtacccacccattacgagcgaccagcaaagacagttgtacaagcgtaattttgatacaggcctccaagagtataagtccctgcagagtgagctggacgaaatcaacaaggagctctcgcggcttgataaggagcttgacgattaccgtgaggaaagcgaggagtacatggcagctgctgatgagtataataggctgaagcaagtaaagggctccgccgactataagtcaaaaaagaaccactgcaagcagctgaaatctaaattgagccacattaagaagatggtcggagattatgatagacagaaaacatag

SEQ ID NO: 16474 - DNA, 603 bp, Artificial Sequence
  Description of Artificial Sequence: Synthetic coding sequence
atggcctacagttcaaacgggaaagtgaatgacaaaaggttttaccctgaatccagctacaaatctacccccgtgccagaagtggtccaggaactcccactgacgtctcctgtagatgactttcgccaacctaggtactcgtctggcggaaatttcgagacgccatccaaacgtgctcccgctaaaggaagggctggccggtctaagcggactgagcaggaccattacgagactgactacaccacgggtggtgaatcctgcgacgagctcgaagaagattggatccgggagtatcctcccatcacctccgaccagcaaagacagttgtacaagcgaaatttcgacaccggtctgcaggaatacaaaagtctgcagagtgaactggacgagatcaacaaggagctcagtagattggataaggaactggatgattatcgtgaggaatcagaggaatacatggccgctgccgacgagtacaacaggctgaagcaggtgaagggcagtgcagattacaaatccaagaagaatcattgcaaacagctgaagtctaagctgagccacatcaagaagatggtgggagactacgaccggcaaaaaacatag

SEQ ID NO: 16475 - DNA, 3114 bp, Artificial Sequence
  Description of Artificial Sequence: Synthetic coding sequence
atgtggagatgcggcggacggcagggtctctgtgtgctcaggcgactgtcgggcggacatgctcaccaccgcgcatggagatggaactccaacagggcctgtgaaagggcactgcagtataagctcggcgataaaatacatggatttacggtcaaccaggtcacaagcgttccggagctgttcctcaccgccgtaaaactgacccacgacgacaccggggcaaggtacttgcatttagctagagaagataccaataatctcttttcagtgcagtttaggaccaccccgatggatagcacaggggtcccgcacatactcgaacatactgtcttgtgcgggtctcagaagtatccctgtcgagacccattttttaaaatgcttaatcggagccttagtacatttatgaacgcattcactgcgagcgactacacactctatcccttctcaacccaaaatccaaaggattttcagaatttactcagcgtctaccttgacgccacttttttcccatgcctgagggagctggatttttggcaggaagggtggcgattggaacacgagaatcctagtgatccccaaaccccgttggtattcaagggcgtcgtgtttaatgaaatgaagggcgcttttgtaaacaacgaacgtattttctcgcagcatctgcagaacaggctcttgccagaccacacctactctgtggttagcggcggagacccgctgtgcattcccgaacttacgtgggagcagttgaaacagttccatgctactcactaccacccaagtaacgcgcggtttttcacctatggtaatttccctctcgagcagcacctgaagcagatccatgaggaggcattgagcaaatttcagaaaatcgagccaagcacagtggtgcctgcgcagacaccatgggataagccccgagagttccagatcacctgtggccctgacagtttcgcaacggaccctagcaaacagactaccatctcggtgtcctttttactgccagatataacagacaccttcgaagcttttacgcttagtctgctgtcctcactgttgacatccggcccaaactcccctttctataaagccttgatagagtcaggcctcgggaccgacttttcaccagacgtcggttacaacggctacacacgtgaggcctacttctcagttggccttcaaggcatcgcagaaaaggacatcgagacagtacgctctctaatagatagaacaatcgatgaggtcgtggaaaaaggcttcgaagatgataggattgaggccctcttgcacaaaattgaaattcaaatgaaacaccaaagcacttctttcgggctcatgcttacgtcttacatcgctagttgttggaaccacgacggcgatccggtcgaattgctcaagcttggcaaccagctcgccaagttcaggcaatgcctgcaagagaaccccaagttcctgcaggagaaggttaaacaatactttaagaacaaccagcacaaactgaccttgagcatgagacccgacgataaataccacgagaaacaggcccaggtcgaggcaaccaaactaaaacagaaagtggaggccctctccccaggagatagacaacagatatatgaaaaaggtctggagttgcgatcccaacagagcaaacctcaggatgcgtcatgcctcccggccttgaaggtctccgacattgagccaactatccccgtgacggaactcgacgtggtgcttaccgccggtgatatccctgtgcaatattgtgcccaacctacaaacgggatggtctactttcgggcctttagtagcctcaacacactccccgaagaactgcgaccttatgtgcctctgttctgtagtgtgctcaccaagttgggctgcggcctgttggattaccgggagcaggcacagcagattgagctcaagaccggcggtatgtctgcctctcctcatgtgctgcccgacgactcacacatggacacatacgagcaaggtgtgctattctcatccctttgtctcgaccgtaatcttccggacatgatgcagctgtggtccgaaatctttaataacccatgcttcgaagaagaagagcacttcaaagtcctggtgaaaatgacagcccaggaactggcaaacgggattcccgacagtggacatctctacgccagcattcgagctggacggacgctcacacctgctggagatctacaggagacgtttagcgggatggaccaggtgcgtctgatgaaacggatcgcagagatgacagacatcaaacctattttaagaaagctccctcgcatcaaaaaacatttgctgaacggcgataacatgagatgctcagtgaacgccacgcctcagcagatgccgcagacggagaaagcagtggaagattttcttagatcaataggcaggagtaagaaggagagacgacccgttagaccccacactgtggagaaaccagtaccctcatccagcggcggggacgcgcatgtgccccatggctctcaggtcataaggaagttggtcatggagccgacctttaaaccatggcagatgaaaacgcactttctgatgccttttcccgtgaattatgtgggcgagtgcatccgaacagtcccctatacagacccagaccacgcttctcttaaaatccttgctcggctgatgacagccaagttcctgcacacagagattcgggagaagggtggtgcctatggcggtggcgccaagctgagtcacaatggaatcttcaccctatactcctatcgggacccgaacaccatagagacactgcagtcgtttgggaaagcagttgactgggcgaagtcagggaagttcactcagcaggatatcgacgaagcaaagctcagcgtgttttctaccgtggacgcccccgtggctcctagcgataaggggatggaccattttttgtacggacttagcgatgaaatgaagcaggctcaccgagaacagttattcgcagtcagccacgacaagctgctcgcagtgagtgatagatacctcggaacgggaaaaagcacacatggtctcgctattctaggccctgaaaatccgaaaatcgccaaggacccctcttggatcatacagtag

SEQ ID NO: 16476 - DNA, 1107 bp, Artificial Sequence
  Description of Artificial Sequence: Synthetic coding sequence
atgcagccaggctcatctcgctgcgaagaggagaccccttctctgctttggggcctggatcccgtcttcctggcttttgctaaactttacattagggacattcttgatatgaaagagtctcgccaggtgcccggcgtgttcctgtataacggccatccgatcaaacaggtggacgtcctggggacagtcatcggtgtgagagagagagatgcattttacagttacggtgtggacgatagtactggcgtcattaactgcatttgctggaagaagctgaatacagaatccgtaagcgctgctcctagcgccgctagagagctgtcccttaccagccagctgaagaaattgcaggagacgatagaacagaagacaaagattgagattggcgacacaatccgcgtgagagggagcataagaacctacagggaggaaagggaaattcatgccactacatactacaaggtcgacgatccagtgtggaacatccaaattgcccgcatgttagagttgccaacgatctatcggaaagtttacgatcagcccttccattcgagtgccctcgagaaggaagaggctctgtcgaaccccggtgcgctggacctcccaagcctcacatctctgctgtctgagaaggctaaggagttcctgatggaaaacagggtccagagcttttaccaacaagagctcgagatggtcgagtctctcttatcactagcaaaccaacccgtgattcatagcgcttcaagtgaccaggtgaacttcaagaaagacacaactagtaaagcgattcattctatattcaagaatgcaattcagcttctccaggagaagggcctcgtgttccagaaggatgatggcttcgataacctgtattatgtgacaagggaagataaagacctccaccgcaagatccatcggataatccagcaggattgtcagaaaccgaaccatatggaaaagggatgtcattttctccacatactggcctgtgcccgactttcaattagacctggactttctgaggcagtcttgcagcaggtgctggaattgctggaagaccagtccgacattgttagtaccatggagcactattacacggcattctag

SEQ ID NO: 16477 - DNA, 1038 bp, Artificial Sequence
  Description of Artificial Sequence: Synthetic coding sequence
atgggggtctgtggatatctgtttctgccctggaagtgccttgtggtggtttccctgcgcctattgtttctcgtgccgaccggcgttccagtgcgctccggcgacgcaaccttcccgaaggcaatggacaatgttaccgttcgacagggagagtctgccacccttaggtgcactatagacgatcgcgtgacccgtgtagcctggctgaaccggtctaccatactctatgcagggaacgataaatggagtatcgacccgcgggttatcatccttgtcaatacaccaacccaatatagcatcatgatccagaacgttgacgtttacgacgaaggcccatacacttgttccgttcagactgacaaccaccccaaaactagccgtgtgcaccttatcgtgcaggtgcccccgcagatcatgaatatctcttcagatattacagtcaatgagggcagctcagtgaccctactctgcctagcaatcgggaggcctgagcccacagtgacatggagacacctctctgtgaaggaaggacagggatttgtgtccgaagacgagtatctggagatcagcgacattaagagagatcagagcggtgagtacgagtgttcagccctcaacgacgtggcggccccagatgttcgcaaggtcaagattactgtcaattaccctccctatatttccaaagccaagaacaccggcgtttcagtggggcaaaagggaatcttgtcttgtgaggcctctgccgttcctatggcagaattccagtggttcaaagaggaaacaaggctcgccaccggcctggacggaatgcggatcgaaaacaagggaagaatgagtaccctgactttctttaatgtatcagagaaagactatgggaactacacgtgtgtggccacgaataaattgggcaatacgaacgccagtattacactgtacgggcccggtgccgtgattgacggcgtgaacagcgcaagcagggccctagcttgcctgtggctatcaggcaccctgcttgcgcacttctttattaaattttag

SEQ ID NO: 16478 - DNA, 939 bp, Artificial Sequence
  Description of Artificial Sequence: Synthetic coding sequence
atgtaccaccctgcctactgggtagtgtttagtgctactactgccttgctgttcatacccggagtgcccgtacgttccggcgatgcgacatttcctaaagccatggacaacgttaccgtccggcaaggcgaaagcgccaccctgcgctgtacaattgatgaccgagtgacaagggtggcatggctgaaccgctccacaattatgatccagaacgtcgacgtctacgatgagggcccctacacgtgttctgtacagactgataatcaccccaagacctctcgggtgcacctgattgtgcaggtgcccccccagatcatgaatatcagctccgacatcacagtaaatgaagggagtagtgtcacgctgctctgcttggctataggccgcccagagcccactgtgacatggagacacttgtccgtgaaagagggtcaggggtttgtttctgaggacgaatacttggagatttccgacattaaacgcgaccagagcggtgagtacgagtgttctgcattaaatgatgtggccgctccagacgtgcgtaaggtgaaaatcaccgtcaattatccaccttacatctctaaggcaaagaatacaggggtttccgtgggtcaaaaagggatcctcagctgcgaagcctctgctgtaccgatggccgaattccagtggttcaaagaggagaccagacttgctaccggcctggacggcatgcggattgagaacaaaggcagaatgagtaccctgacctttttcaatgtctctgaaaaggactatgggaactatacatgtgtggccacgaacaaactgggaaacactaacgcttccatcaccctgtatgggccaggtgctgtgatcgatggcgtgaattctgctagcagagccttggcttgtctctggctttcaggaactttgcttgcccacttctttatcaagttctag

SEQ ID NO: 16479 - DNA, 1017 bp, Artificial Sequence
  Description of Artificial Sequence: Synthetic coding sequence
atgtaccatcctgcctactgggtggtcttctcagctaccaccgctttactttttataccgggcgtacctgtgaggtccggagatgcaacttttccgaaggccatggataacgtgacagtgcggcagggtgaatcagcaacactgcgctgcactatagacgatagggttactcgcgtggcctggctgaacagatctaccatactctacgccggaaatgataagtggtcgattgatcccagagtgattatcttggtgaacactcccacccagtactctattatgatccagaatgtcgacgtgtacgatgaaggtccatatacctgttcagtgcaaactgataatcatcccaaaacatctagggtgcatttaatcgtgcaggtgccaccacagatcatgaacatcagctcagatataactgtcaacgaaggatcttccgtaaccctgctgtgtcttgctatcggacgtccggaacctaccgtgacctggcggcacttgtccgtgaaggaagggcaaggtttcgtaagcgaagatgagtatttggaaatcagtgacattaagagagaccaatccggtgaatatgagtgcagtgccctcaacgatgtagcagccccagacgtgagaaaagtcaaaattactgtgaactaccccccatacatctctaaagccaagaacacaggagtaagtgtcggacaaaaaggaatcctttcttgcgaagcaagcgccgtccccatggctgaattccaatggttcaaggaagaaactaggttggccacaggcctcgatggcatgcgcattgagaacaaggggcggatgagcactttaacattcttcaatgtgtccgagaaggactatggaaactatacctgtgtcgctacaaataaactcggcaacaccaacgcttccatcaccctgtatggcccaggcgctgtgattgacggggttaactccgcttctagagcattagcctgcctgtggctctccgggactctgctcgcccatttcttcatcaagttttag

SEQ ID NO: 16480 - DNA, 1065 bp, Artificial Sequence
  Description of Artificial Sequence: Synthetic coding sequence
atgggggtgtgcggctatttgtttctgccctggaagtgtcttgtcgtcgtaagcctcaggctgctgtttctggtgcccacgggagtacctgtcagaagtggggacgcaacattccccaaggccatggacaacgtgactgtgcggcagggagaaagcgcaacgctgcgttgcacaattgatgaccgggttacaagggtggcctggctgaatagatccacaattctctacgctggcaatgataagtggtctatcgacccacgcgtcatcatactcgtgaacacgcctacacaatattctatcatgatacagaatgtcgatgtgtacgatgaaggtccatacacttgttccgttcagacagacaaccacccaaaaacaagccgggtccacttgatcgtgcaggtccccccacaaattatgaacatctcctctgatatcaccgtgaacgaaggcagctcggtgaccctgctgtgtctggcaatagggagacctgaacccacagttacatggagacatttatccgtcaaggaggggcaagggttcgtcagtgaggatgaatatctggagatctctgatattaaacgcgaccagtccggggagtacgagtgctcagcgctgaatgatgtcgccgcccccgatgtgcgaaaagtaaaaattaccgtgaattatcccccctatatttctaaagcaaaaaacacaggtgtcagcgtgggccagaaaggcatactgtcttgtgaagcctccgccgtgcccatggccgagtttcaatggttcaaggaggaaactaggctggccacagggctggatggaatgagaattgagaacaaaggacgcatgtctaccctgactttctttaacgtatcagagaaagactatggtaattacacttgcgttgcaactaataagctggggaacactaatgcatctatcactctctatgagattagtccctcctccgcagtggccggccctggggcagtcattgatggagtaaacagtgcctcgcgcgctctagcttgcctatggctgtctgggacacttttggctcacttctttataaaattctag

SEQ ID NO: 16481 - DNA, 1662 bp, Artificial Sequence
  Description of Artificial Sequence: Synthetic coding sequence
atgtccaataacggccttgacattcaagataaacctcccgctccacctatgagaaacacttccaccatgatcggagccggttccaaagacgctggaaccctgaatcacggaagcaagcccttaccacctaaccccgaagaaaaaaagaagaaggatagattttataggagcattttgccgggcgataagacaaacaagaaaaaggaaaaagaacgacccgaaattagtctaccttccgactttgaacacacaatccacgtggggttcgatgcggttaccggtgagtttacaggaatgcctgagcagtgggcacggcttctgcagacctcgaatataaccaagtccgaacaaaaaaagaatcctcaggccgttttagatgttctagagttttacaattcgaaaaaaaccagcaactctcagaaatacatgtcttttaccgataaatccgccgaagactacaactccagtaacgcacttaatgtgaaggctgtgagcgagacgccagccgtgcctcccgtgtctgaagacgaagacgatgacgacgacgacgctaccccgcccccagttatagctccaaggccggagcacaccaaaagcgtgtatacccggtccgtcatcgagccattgcccgtgacccctacacgggatgtggcgaccagccctatctcccccacggagaacaacaccactccacctgatgctctgacgaggaataccgaaaaacaaaagaaaaagccaaagatgtcggacgaggaaattctggagaaactcaggagcatcgtcagtgttggtgacccaaagaagaaatatacacgattcgaaaagataggccagggcgcttcagggaccgtgtacacagccatggacgtggccacaggacaggaggtggcaattaaacagatgaatcttcagcagcagccgaaaaaagagcttattattaatgagatccttgtgatgagagaaaataaaaaccccaatatagtgaactacctcgattcttatctggttggcgatgagctgtgggtggtcatggagtatctggctggtggatcactgaccgatgtggtcacagagacttgcatggatgagggacaaatcgcggctgtgtgcagagagtgcctgcaagctcttgaattcctacatagcaaccaggttatccatcgcgacatcaagtccgataatatcttgcttggaatggatggatctgtgaaactaactgatttcggattctgcgcacaaatcaccccggagcagagtaagagatctacaatggtcgggacaccctactggatggccccagaggtggtgacccggaaggcctacggacccaaagttgatatctggagtctgggaattatggcaatcgaaatgattgaaggggaaccgccttacttgaatgagaacccactaagagcactctacttgatcgcaaccaatggcacacctgagctccagaatcccgaaaagctgtcagctatcttccgggacttcctcaatcgctgtcttgaaatggatgttgaaaagcggggctcagctaaagaattgttgcaggttaggaagctacggtttcaggttttctcaaacttcagcatgatagctgcgagcatcccagaggactgccaggcacctctccagccccacagtaccgactgctgcagttag

SEQ ID NO: 16482 - DNA, 1638 bp, Artificial Sequence
  Description of Artificial Sequence: Synthetic coding sequence
atgtcaaacaatggattggatattcaggataagcctccagcaccgcctatgcgaaatacgtcgactatgattggcgcggggtctaaggacgcggggacattaaaccacggaagtaaacctcttccaccaaacccagaagaaaagaaaaagaaggaccgtttctataggtctatacttcctggggacaaaacaaacaagaagaaggaaaaggaaagaccggaaataagcctgccttcagatttcgagcacacgatccatgtgggattcgacgcagttaccggggagttcacaggtatgccagagcaatgggccaggttgcttcagaccagtaatattactaaatctgagcagaagaagaatccccaggcagttttggacgtcctggaattctataattccaagaagacatcaaacagccaaaagtatatgagctttactgacaagtccgctgaggactacaactcttccaacgccctgaacgttaaggcagtgtcagagacccccgcagtcccccccgtgtctgaggacgaggatgacgatgacgacgacgccacccctccgcctgtgatagctccgcgtccagaacacaccaagtccgtgtatactcggagcgtgatcgagccactcccagtaaccccgactcgggacgtcgctacttccccaatcagccctaccgaaaacaatacaactcctcccgacgctctgacaaggaacactgaaaaacagaaaaaaaaaccgaagatgagcgacgaagagatcttggagaagttgcggtccattgtgagtgtgggtgaccccaagaagaagtatacacgcttcgaaaagattggtcagggagcgagtggcacggtttacacggccatggatgtcgctacgggccaggaggtcgcaattaagcagatgaacctccagcagcagccaaagaaggagctgatcatcaacgagatcctggtgatgagagaaaataagaatccaaatatcgtgaattacttggactcgtacctggtcggtgatgagctgtgggtggttatggagtacctggcaggcgggagtctgaccgacgtagtgactgaaacctgcatggacgaaggccaaatcgcagctgtctgtagagaatgtctccaggctttggagttcttgcattctaatcaggtgatccaccgcgacattaagtcagacaatatccttttgggcatggatggaagcgtgaaattgacagactttgggttctgcgcccagattactcctgaacagtccaagcgctctaccatggtaggcacaccatattggatggccccagaagtggtgaccaggaaagcctatggacccaaagtcgacatttggagtttagggattatggccatagagatgattgagggcgagccaccctatctcaatgaaaatccattgagagctctctatctgatcgccaccaatggaacaccagaactccaaaacccagaaaaactgtctgctatattccgggattttctgaatagatgccttgagatggatgtcgaaaaacggggttctgctaaggagctgctgcagcaccaattcctaaagattgcgaaaccgctcagctctcttactccactgatcgccgccgccaaggaggcaacaaaaaataatcactag

SEQ ID NO: 16483 - DNA, 300 bp, Artificial Sequence
  Description of Artificial Sequence: Synthetic coding sequence
atgtccaataatggactggatattcaggataagcctcccgcaccacccatgcggaacaccagtactatgattggggcggggagcaaggacgcagggaccctgaatcacggcagcaaaccattgccccccaaccccgaggagaagaaaaaaaaggatcggttttataggtcaatacttcccggcgacaagactaacaagaagaaggagaaggagcggcctgagatcagtctgcccagtgatttcgagcatactatccatgtgggattcgatgcagtgacgggagagttcaccgggatgtag

SEQ ID NO: 16484 - DNA, 81 bp, Artificial Sequence
  Description of Artificial Sequence: Synthetic coding sequence
atgtcaaacaatggtctggacattcaggacaagccaccagctcctccaatgagaaacacctctaccatgattggggcatag

SEQ ID NO: 16485 - DNA, 270 bp, Artificial Sequence
  Description of Artificial Sequence: Synthetic coding sequence
atgtccaacaacggcctggacatccaagacaaaccccctgctccgccgatgaggaatacaagcacgatgatcggcgccggtagcaaagacgcaggcactttaaaccacggctcgaagcctctccctcccaatcctgaggaaaagaaaaaaaaggaccgcttctaccggagcatcctgcccggagacaaaactaacaagaaaaaagagaaggagcgacccgagataagcctgcctagtgacttcgagcataccattcacgtgggcttctag

SEQ ID NO: 16486 - DNA, 192 bp, Artificial Sequence
  Description of Artificial Sequence: Synthetic coding sequence
atgtctaacaatgggctcgatatccaggataagccacctgcccccccaatgcggaatacctcaacaatgattggcgccggaagcaaggacgcgggtacgttgaaccacggctccaaacccctcccaccaaacccagaggaaaagaagaagaaagacaggttttaccggagtatactcccgggcgacaagtag

SEQ ID NO: 16487 - DNA, 321 bp, Artificial Sequence
  Description of Artificial Sequence: Synthetic coding sequence
atgtcaaacaatggattagacattcaggataaacctcctgcccctccgatgaggaacacaagcacgatgattggggccggaagcaaggacgcaggtactctcaaccacgggtcaaagcctttgcctcctaaccccgaagaaaagaaaaaaaaggatagattctaccggtccattttgccaggggacaagaccaacaaaaaaaaagaaaaagaacgccctgagatcagtcttccatctgattttgaacacacaatacacgtggggttcgatgcggtcaccggagagtttacggggatgcctgagcagtgggctcggctttag

SEQ ID NO: 16488 - DNA, 1569 bp, Artificial Sequence
  Description of Artificial Sequence: Synthetic coding sequence
atgtcaaacaacggcttggacatccaggataaacctccggcaccgcccatgcgcaataccagtacaatgatcggcgcaggctccaaggatgcgggcacactcaaccatggatcaaaacctttgccccccaatcctgaagaaaagaaaaaaaaggataggttctatcggtccatactcccaggagacaagaccaacaagaaaaaagaaaaggaacggcctgagatcagcttgccatcagacttcgagcacacgatccatgtgggttttgatgccgttaccggcgagttcaccgggatgccagagcagtgggctcggctactgcagacttccaatattaccaagagtgaacagaagaaaaatcctcaggcagttctcgatgtgttggagttttacaatagcaaaaagaccagcaattcccagaaatatatgtccttcactgacaagagcgctgaggactacaacagctccaatgcactgaatgtgaaggccgtgagcgagacccccgctgtccctcccgtgtccgaagacgaggatgacgatgatgatgacgccacgcccccaccagtgatcgccccgaggcccgaacacaccaagtccgtctatacacgatcagtcatcgagcctcttcctgtgactccaactcgcgacgtggctacttcgcccatctcacccacagagaataacaccacccccccagacgctctcaccagaaacacagagaagcagaagaaaaaacctaaaatgagcgacgaggaaattctggagaagctgaggagcattgtgagtgtgggcgatcctaagaaaaaatataccaggtttgaaaagattgggcagggcgcaagtgggaccgtgtacaccgctatggatgtggcgacagggcaggaggtggcaattaagcagatgaacctccaacagcaacccaaaaaagagctgataatcaacgaaatactggtgatgcgggagaataagaatccaaacattgtcaattacctcgactcatatcttgtgggggacgagctgtgggttgtgatggaatatttagcaggggggtcacttacggacgtcgtgacagaaacctgcatggatgagggacagatagccgccgtgtgccgcgagtgcctgcaagccctcgagtttctgcatagcaaccaagtgatccatagagacatcaaatcagacaacatcttgctgggtatggatggttccgtaaagttaaccgacttcggtttctgcgcccagattacccccgagcaaagtaagcgtagcactatggttggcaccccttattggatggctcccgaggtcgtcactagaaaagcctacggacctaaagtggacatttggtcgttaggaattatggcaatcgagatgattgagggggagccaccctatttgaacgagaatcctctgagagctctctacctgatcgctacaaatggcacccccgaactccagaaccctgaaaaactttcagccatcttccgcgacttcctgaaccgctgtcttgaaatggatgtcgaaaagagagggagtgctaaggagctcttgcagcattcctccagactgtag

SEQ ID NO: 16489 - DNA, 1317 bp, Artificial Sequence
  Description of Artificial Sequence: Synthetic coding sequence
atgttcggaaaacgcaagaaacgggtggagataagcgccccatcaaacttcgagcaccgtgtgcataccggtttcgaccaacacgagcagaaatttacagggctgcctaggcagtggcagtccttaatcgaagagagcgctcggcggcctaaaccactcgttgaccctgcctgcattacttcgattcagcccggagccccgaaaggggagccacatgatgttgcacccaatggcccctctgcaggaggcctggccatcccccagtctagctcatcaagttcacgcccaccgaccagggcaagaggtgcaccctcgcctggggtgttaggacctcatgcctccgaaccccaactggcgcctccagcctgcacgccggctgcccccgctgtgcctggacctccaggcccaagatcccctcagagggagccacaacgcgttagtcatgaacagtttagagccgcgctgcagctggtcgttgaccccggagatccgaggagttaccttgataattttattaagatcggcgaggggtcgacagggattgtatgcatcgctactgtgagatcaagcggaaagctggtggccgtgaaaaagatggacctgcgcaaacagcaacgtcgcgagctccttttcaacgaggtggtcattatgagagactatcaacatgaaaatgtggtagagatgtacaactcatatctggtcggggatgagttgtgggtcgtcatggagtttctcgaaggcggagccctcaccgacatagtgactcatactaggatgaatgaggagcagatcgcagcggtctgcctagctgtcctgcaagccctcagtgtcttgcatgcgcaaggagtgattcatcgggacatcaagagcgattccattctgctcacacacgacggcagggtcaagctatctgattttggtttctgtgcccaggtcagtaaggaggtaccccgccggaagagccttgttggtacgccatactggatggcacccgaacttatctctcgactgccttatggcccagaagtggatatctggagtctcggcataatggttatcgaaatggtcgatggcgagcctccttattttaatgagccgcctcttaaggctatgaaaatgatccgcgataatcttcccccacggcttaagaatctacataaggtgtcgccatctctgaaaggttttctggatcgcctgttggtgcgagatcccgctcaaagagccacggccgctgaactcctgaagcaccctttccttgctaaggccggcccacctgcctctattgttcccctgatgcgacagaaccgcaccagatag

SEQ ID NO: 16490 - DNA, 1776 bp, Artificial Sequence
  Description of Artificial Sequence: Synthetic coding sequence
atgtttggaaaacggaaaaaacgggtcgagattagtgccccttctaattttgaacacagagtgcacactggcttcgaccagcatgaacaaaagttcaccgggctcccgcggcagtggcagtccctgattgaggagagcgccaggagacccaagcctctggtggatcctgcgtgtatcacctccatccaacccggagcaccgaaaacgatcgtacgcgggagcaagggagccaaggatggagcccttacgctgctcctcgatgaattcgaaaacatgagtgtcactagaagcaactccctccgccgggactctcccccaccaccagctcgggcccgccaggaaaacggcatgcccgaagagcctgcaacgactgctagaggcgggcccggcaaagctgggtcaagggggcgtttcgcagggcattccgaggctggtggaggcagcggggaccgccgacgcgcaggaccggagaagagaccaaagagtagtagagagggttccggcggtccgcaggagagttcgcgtgacaagcgccccctgtcaggcccagacgtcgggactcctcagcctgcaggattagcctctggcgcaaaactggctgctggtcgacccttcaacacctacccacgggcagataccgaccatcctagtcgtggcgctcagggtgaaccccatgacgtggcaccgaacggaccctccgcaggtggcctggccatccctcagtcttcctcatcttcctcccgccccccaacacgcgctcgtggtgctccaagcccaggcgtcctaggtcctcatgcctcagaacctcagctcgccccaccggcttgtactcccgccgcccctgcagtgccgggccctccgggccctcggagtccacagcgggaaccccagagggtgtcccatgaacaattcagagctgctcttcagctggtggtcgacccaggcgatccgagaagttatctcgacaacttcatcaagattggagaaggatctaccggcatcgtatgcatcgccacagtcaggagtagcgggaaattagtggccgtcaaaaagatggacctacgtaagcagcagcgccgggaactgttatttaacgaggtcgtgatcatgagggattaccagcatgaaaatgtcgtagagatgtataactcatacttagtcggcgacgagttgtgggtggtgatggagttcttggaggggggagctctcactgacatagtgacacacactagaatgaatgaggagcagattgccgcagtttgcctggcagtcctccaggcattgtccgtgctgcatgcccaaggggtgattcatcgcgacatcaaaagtgactctatccttctgacacacgatggacgggtgaagctgagcgatttcggattctgtgcgcaggtgagcaaagaggtccctaggaggaagagcttagtggggacaccctattggatggccccggagctgatcagcaggctcccctatgggccagaggtggacatttggagcctgggaataatggtgatcgaaatggtggatggcgagcctccatacttcaacgagccacccctgaaagcaatgaaaatgatacgggacaatctgccaccaaggctgaagaatttgcacaaggtgtctcccagtctgaagggattcctggaccgcctgttagtgagggacccagcacagagagccacggccgctgagctcctgaagcaccctttcctggccaaggctggtccacccgcttccatcgtacccctgatgcgccaaaacaggacccgctag

SEQ ID NO: 16491 - DNA, 1188 bp, Artificial Sequence
  Description of Artificial Sequence: Synthetic coding sequence
atgggctgtcaacggtcccgtccattcaatacctacccaagggcagacacagatcacccttcgaggggggcccaaggcgagcctcatgatgtcgcacctaatgggccctctgcagggggactggcaattccccagtcttcaagttcgtcaagccgcccacccacccgggcccggggtgcgcccagtcctggagtcctgggccctcacgccagcgagcctcaattggcccctccagcctgcacaccagctgctcccgccgtacctgggcctcctggccctaggtcccctcagcgggagccacagcgcgtatcacacgaacagttccgggctgctctgcagctggtcgtagaccctggcgacccccggtcttatctcgacaacttcatcaagattggtgagggctcaaccggaattgtgtgcatcgctactgttagatcctccgggaaattggtcgcagtgaaaaaaatggatctgcgaaagcagcagcggcgagagcttttgtttaacgaggtcgtaatcatgcgagactatcagcacgaaaacgtcgtcgagatgtacaacagctacttggtcggcgatgagctgtgggtggttatggagttcctagaagggggggccttgaccgatattgtgacgcacaccaggatgaacgaggagcaaattgcagcagtatgccttgctgtcctccaggcattgtctgtgctgcatgcccagggtgtgatccatcgggacatcaaaagcgacagcatattgctgacacacgatggtcgggtcaagctttctgactttggcttctgcgcccaggtaagtaaggaagtcccccgccggaagtccctcgttggaaccccatactggatggccccagagttgatttccaggctgccctatggaccagaggtggacatctggtctctgggcatcatggtcatcgagatggtagatggcgaacctccttacttcaacgagccgcccctgaaggctatgaagatgattcgggataacctgccacctagactgaaaaatctgcataaggtgtctcccagcttaaagggcttcctggatcgcctgctggttcgggatcctgctcagagggccacagctgccgaacttttgaagcatcctttcctggctaaggctgggccacctgcaagcatagtcccgcttatgcggcagaatagaactagatag

SEQ ID NO: 16492 - DNA, 1776 bp, Artificial Sequence
  Description of Artificial Sequence: Synthetic coding sequence
atgttcggtaaacgtaagaagagagtcgaaatcagcgctccaagcaactttgagcaccgggtacacactggctttgatcagcacgagcagaaatttaccggactcccacgccagtggcagagtctgatcgaggagtccgcgcggcgccccaagcctttagttgacccggcttgcattacctccatacaacctggagcccctaaaactatagtgagggggagtaagggagccaaggatggggcactgactctattgctcgatgagttcgaaaacatgtctgtgactaggagtaatagcctccgtagggattccccaccccctcccgcacgtgctagacaggaaaacggtatgcccgaggaacctgcaaccacagccagaggtggaccgggcaaggctggcagcaggggcaggtttgcaggtcacagcgaagcggggggcggatctggcgatcggagaagggctggcccggagaaacggccaaagagctccagggaaggctctggcggccctcaagaatcttctcgtgataaacgaccattatctgggccggatgtggggacaccacagccagctggcctcgccagtggcgccaagctggctgccgggagaccttttaacacgtacccacgcgcggataccgatcatccaagtcgaggagcccagggcgagccccacgacgtagcacccaatggaccgagcgcaggtgggctagccattcctcaatcgtcaagttcctcatcacgtccaccaacccgggctcgaggagccccatcccctggcgtgctggggcctcacgccagtgagcctcagttagcccccccagcttgtacaccagccgcacctgccgttcccggaccgccgggtcctcgcagcccacagagggagccacagcgggtgtcacacgagcagttccgagcagccctgcagctggtggtggatccaggcgacccacggtcctatcttgataattttatcaaaattggagaggggtcaaccggcatagtgtgtatcgcgaccgtccggtcctcagggaagctggtggccgtgaagaagatggatctccggaagcagcaaaggcgggagctgttgttcaatgaggttgtcatcatgcgggattatcagcacgagaatgtggtggaaatgtataacagctatctagtgggggacgagctttgggtcgtcatggaattcctcgaggggggcgcgctaacagatatcgtgacacatacccgaatgaatgaggagcagatcgccgcggtgtgtctagctgtgctgcaggccctttctgtactgcacgctcagggcgtgattcacagggatattaagtcagactccattttacttacacatgacggcagggtgaaattgagtgacttcggattttgtgctcaggttagcaaagaggtgcctcgaagaaaatccctggtcgggactccctactggatggctccggaactgatatcacggctgccctatggccccgaggtggatatttggagcctcggcataatggtaatcgaaatggtcgatggggagccgccctattttaacgaacctcccctgaaggccatgaagatgatccgagataatctgccaccacgcctgaaaaatctgcacaaggtgagtccgagtctcaaaggctttctggataggctgctggtccgagacccagcccagcgtgcgacagctgccgagttgctgaagcaccccttcctggctaaagccggtcctccagcctcaattgtccccctgatgcggcagaaccgaacaaggtag

SEQ ID NO: 16493 - DNA, 1776 bp, Artificial Sequence
  Description of Artificial Sequence: Synthetic coding sequence
atgttcggcaagagaaagaagagagtagagatctcagccccctctaacttcgagcaccgggtccataccggttttgaccagcatgaacagaagttcaccggactgcctcggcagtggcaatctctgatagaggagtccgcccgtagacccaagcccttagtggaccctgcctgtatcaccagcatccagcccggcgcaccaaagacaatcgtccgcggatctaagggggctaaggacggcgccctcacactgctgttggacgaattcgaaaatatgtccgtgacacggtccaattctctccgtagggatagtcctccacctcccgcccgcgcgagacaggagaacggcatgcctgaggagcctgccacgaccgctcgcggaggacctggcaaggctgggagtcgggggagattcgccggccattctgaagctggcggaggcagcggtgacaggcggagggctggcccggaaaagaggccaaaatcttcgcgtgaaggttcgggcgggccacaggaaagttcacgagacaaacgacctctatccggacctgatgttggcacaccccagccggctggcttagcaagcggagcgaaactggcggcgggtcgccccttcaacacttacccaagggccgacacagatcatccttctcggggggctcagggcgagccccatgacgttgctccgaatggcccctctgcaggagggctggcaatccctcagtcatccagctcttcgtcacggcccccaacacgggcacgcggagccccttccccaggtgtactgggtcctcacgctagcgaaccgcagctagcaccacccgcctgcacccccgcggccccagccgtgcccgggcccccaggccctaggtcccctcagagggaacctcaaagggtgtcccatgaacaatttagagcagccctacagctggtcgttgatcctggcgacccaagaagttacttggacaattttattaagatcggagagggaagtacaggaattgtttgtattgcgacggtacggtcgtctggcaagctcgtagctgtgaagaaaatggatcttcgaaaacagcaacggagggaactattatttaacgaggtcgtgattatgagagactaccagcacgaaaatgtcgtggaaatgtacaatagctacctggtgggcgacgaactctgggtagtgatggagtttctcgaggggggggccttaaccgacattgtgactcacacccgcatgaatgaggagcaaattgctgcagtatgcctggccgttctgcaggcactgtccgtactccatgcacagggggtgatccacagagacattaaatccgattctatcctccttacgcacgatggaagggtaaaactatcagatttcgggttttgcgcacaagtgtctaaggaagtgccccgacgaaagtcgctggttggtaccccatactggatggccccagagctgatttcccgacttccctatggacctgaggtggacatctggagcctgggaattatggttattgaaatggttgatggggagcccccatactttaatgaaccacccttgaaagcaatgaagatgattagggataatctgcccccacgcttaaaaaatctccacaaagtgtcacccagcctgaaggggtttctggataggttgttggtccgggaccctgcacagagagctacagctgcggagctgcttaaacatccgttcctcgccaaagctggccctccagcgagcatcgtaccccttatgcgtcagaacaggacaagatag

SEQ ID NO: 16494 - DNA, 1044 bp, Artificial Sequence
  Description of Artificial Sequence: Synthetic coding sequence
atgacttggccgctcacgggtcaccaaagaggcgcctggccatccccgtctccaccaccgccgccacccggtctccccccagaaccggaagttccgccggccttggagtgctgggatcctaccccccaaagtccaaggtccccccagcgggagcctcaaagggttagccacgagcaattccgcgctgccctccagttggtcgttgatcccggagatccccgatcctacttagataacttcataaagattggcgaggggagcactgggatcgtctgcattgccaccgtcagaagcagcgggaaactggttgcagtaaaaaaaatggaccttagaaagcagcagcgccgggagcttttgttcaacgaagtggtgatcatgcgagactatcagcacgagaatgtcgtcgagatgtacaactcatatcttgtaggcgacgagctttgggtcgttatggaattcctcgaaggcggcgctttgaccgatatcgtgacccacactcgaatgaatgaggagcagatagccgccgtctgtttggctgtacttcaggccctgagtgtgctccacgcccagggagtgattcatagagatatcaagtccgattccattctgctgacccacgacggccgtgtcaaactgagcgactttggcttctgcgcgcaagtgtcgaaggaggtcccaaggcgcaagtctctggtaggtacgccctactggatggctcctgagctgataagcaggttaccatatgggccggaggtggatatctggagtctcggaattatggttatagaaatggtcgatggcgaacctccttacttcaatgagccgcccctcaaagctatgaagatgatcagggataacctgcccccaagactcaagaatttacataaggtttctccttcattgaaaggcttcctggaccggctactcgttagggatccagcacagcgtgcgactgcggcagaactgctcaagcacccttttttagcgaaggcagggcccccggcctctatcgtgccattaatgaggcagaacagaaccaggtag

SEQ ID NO: 16495 - DNA, 1776 bp, Artificial Sequence
  Description of Artificial Sequence: Synthetic coding sequence
atgttcggcaagcgtaagaaaagggttgagataagcgctcccagtaacttcgagcatcgggtgcacacaggcttcgatcagcatgaacagaagttcacaggactgcccagacagtggcagtcgctgatcgaggagagcgctcgaagacccaagccccttgttgatcctgcttgtatcaccagtatccagcccggcgcacccaagacgatcgtgaggggatcaaaaggagctaaagacggtgccttgacgttgcttcttgacgagtttgaaaatatgtcggtcactcgatccaattctctgaggcgggatagtccacccccccctgcgcgtgcaagacaggaaaacggtatgcccgaagagcccgcgaccaccgcacgagggggcccaggaaaagcaggatctcgaggaagattcgccggccacagtgaagccggagggggcagcggggatcggaggagggcaggtccagagaagcggcctaagtcgagccgcgagggcagcggtggccctcaggaaagtagccgggacaaacgtcctttaagtgggccagatgtaggaactcctcaacccgccggtcttgctagcggcgccaagctggcagcgggccgtcctttcaacacgtacccaagggccgacaccgatcatccgagtaggggtgcccaaggggagccacacgacgtcgcgccaaatggccccagcgctgggggactggcaattccccaaagttcgagtagctcctctaggccgcccaccagggccagaggtgccccgtcacccggagtgctgggaccccacgcaagcgagccacagctggcaccccctgcatgcacgcccgcagccccagctgtgccaggtcctcccgggcctcgaagcccccagcgcgaaccgcagagagtaagccatgagcagttcagggcagcgctgcagctcgtcgttgaccccggcgaccctagatcctacctggacaacttcatcaagattggcgagggatcaactggcatcgtttgcatagctacagttcggtcttctggtaagctcgttgcggtaaagaagatggatctgcggaaacagcagcggcgcgaactactattcaacgaggtcgtaatcatgagggattaccagcatgagaatgtggtggagatgtacaattcctatcttgtgggagatgagctgtgggtagttatggagttcctggaggggggcgccctgacggacattgttacccacaccaggatgaacgaggagcaaatcgccgctgtctgcctggccgtcctgcaggctctgtccgttctccatgcccaaggggttatacacagagacatcaagagtgattccattctcctgacccatgatggcagggtgaagctgagtgacttcggattctgcgcacaagtctccaaagaggtacctaggcgaaaaagtttagtcgggacaccttactggatggcgcctgagctaatcagccggctgccatacggccctgaagtcgatatatggtcccttggtatcatggtaatcgagatggtggacggtgagcccccctacttcaacgagccaccgctgaaggcaatgaaaatgatcagggacaacctgccgccgagacttaagaacctgcacaaagtttcaccatctcttaaggggttcctcgacagactgctcgtgagagatcccgcgcagagggccaccgccgcggaactgcttaagcatccgttcttagcgaaagccggcccacccgccagtatcgtgccactgatgaggcagaaccggactcggtag

SEQ ID NO: 16496 - DNA, 1317 bp, Artificial Sequence
  Description of Artificial Sequence: Synthetic coding sequence
atgttcggcaagcgaaagaagagagtcgagatttcggcaccttctaacttcgagcaccgtgtacacaccggattcgaccagcacgagcagaaattcaccgggctgccgcggcagtggcagagtcttatcgaggaatccgcccgcagacccaaacccctggtcgaccctgcctgcatcacgagtattcagccaggcgcccctaagggcgagccccatgacgtggcaccaaatggaccatccgctggcgggctggccatcccacagagcagttcatccagcagtaggcctcctacaagagctcgcggagccccgagccctggtgtcttggggccgcatgccagtgagccgcagctggcccctcctgcctgtacccctgccgccccagccgtgccaggaccgccgggccccaggtcaccgcagcgggaacctcagagagtgtctcacgaacagttccgagcggctctccagctggtggtcgacccgggggatccaaggtcctacttggacaatttcatcaaaatcggggagggatctactggcatcgtgtgcatcgccactgttcgatcatcggggaagctcgtggctgtgaagaaaatggatctgcggaaacagcagaggagggaactcttatttaatgaggtggtgataatgcgggattatcagcacgagaacgtggtggagatgtacaacagctacctcgtaggagatgagctgtgggtagttatggagtttttggaaggaggggccctcactgacatcgtcacacacaccaggatgaatgaggaacaaatagcggctgtgtgccttgcagtgctgcaggcattgtcagtcctgcatgcacaaggcgtgatccatagagacatcaaatccgattctatattactcacgcacgacggtagagttaaactcagcgactttgggttctgcgcccaagtgtcgaaggaggttccaagacgaaaaagcctagtcggcactccttactggatggcacctgaattaatcagcaggctgccatatggacctgaggtggatatttggtccttagggatcatggtgattgagatggtggacggcgagcctccctacttcaacgagcctccgctgaaggctatgaagatgatccgggataacttgcccccacgcctcaagaatttgcacaaggtgagtccaagtctaaaaggcttcctggaccgcctgttggtgagggatccagcccagagggcaactgccgcagagctcctgaagcacccctttctggctaaggcgggcccccccgcctcaatcgtgcccctgatgaggcagaacagaacaagatag

SEQ ID NO: 16497 - DNA, 1458 bp, Artificial Sequence
  Description of Artificial Sequence: Synthetic coding sequence
atggcccccacaatacagacacaggcacagcgagaagatggccacagatctggggtggtttgcagagttaagtattgtaattctctgccagacatccccttcgatcctaaatttatcacttatccattcgatcagaatcgctttgtccaatacaaagctacatctctcgagaagcagcataaacacgatttgcttaccgagcccgacttgggcgttaccatcgacctaattaacccagatacataccgcattgaccctaatgtcctgctggaccccgccgacgagaagctgctggaggaggaaatccaggcacctacaagttccaaacgcagtcagcagcatgcaaaggttgttccctggatgcggaaaaccgaatatatctcaaccgagtttaataggtacggtatcagtaatgagaagccggaagttaagataggagtaagcgtgaagcaacaatttaccgaggaagagatttacaaagaccgagattcccaaattacagccatcgagaaaacctttgaagacgcccagaagagcataagccagcactatagtaagccccgagtaacgcctgtggaggtcatgcccgtgttccccgatttcaaaatgtggatcaacccctgtgcacaggtcatctttgatagtgaccccgcccctaaggataccagcggggccgccgctttggagatgatgagccaggccatgattcggggcatgatggatgaggagggaaatcagttcgtcgcctactttctgccagttgaggagacacttaaaaaacgaaagagagaccaggaagaagagatggattatgcgcctgacgatgtatacgactacaaaatcgcgcgtgaatacaactggaatgtgaagaataaggcaagtaaaggatacgaggaaaactatttctttattttccgagagggtgacggagtctactataacgaactggagactagagtcaggctgagcaaacgccgtgctaaggcaggtgtgcaatctgggaccaacgcactgctcgtggtcaagcaccgagacatgaatgaaaaagaattggaggctcaggaggcccgaaaggctcagttggagaatcatgagcccgaagaggaggaagaggaggagatggagacggaagagaaagaggctggaggtagcgttatgcttatattaaggactatgccgaccctaatgatgcggaccgaggatcggcctaaagtggcagtgacaatgattcagacagccgcggccatgggcgtggcgagtggtgccggggcgactgccgcggcaccggttccctcccctgtagccgcatcaacacgcccaaggcggatggccgttaaactccagctgctaatccctgtgaaactgatcgtcacagtaacggagtcccagggcattcaaggttggtttcggcaccattactgcgaacagcaaagcacgttcctggtggtttgcctgtag

SEQ ID NO: 16498 - DNA, 873 bp, Artificial Sequence
  Description of Artificial Sequence: Synthetic coding sequence
atggggcacccaccactcctaccactgcttttgctcctgcatacctgtgtgccggcctcatggggattgcgttgcatgcagtgcaagactaacggagactgtagggttgaggaatgtgccctgggtcaggatctctgcagaactacaatcgtccggctatgggaagagggggaagaattggaacttgttgaaaagtcctgtactcactctgaaaagaccaataggaccttgagctatcgtacaggattaaaaatcacgtcactgaccgaagtggtttgtgggctggatctctgtaatcagggcaatagtggccgggccgtgacgtattccagatctcggtatcttgagtgcattagttgcgggagtagcgatatgtcttgtgagagaggccggcaccagtctctgcaatgtaggtcccccgaggagcaatgtttagacgtggtgacgcattggatccaagagggcgaagaagttctggagctggaaaacctcccccagaacgggagacagtgttatagctgtaaaggaaattcgacacacggctgcagcagcgaggaaactttcctaatcgattgtcgagggccaatgaatcaatgcctagtcgcgactggcacccacgaacctaagaatcagtcatatatggtcaggggttgtgcaacagccagcatgtgccagcatgcacatctcggggacgcgttctcaatgaatcacatcgacgtgagttgctgcactaagagcggatgtaatcaccccgacctagatgtccagtaccgctctggcgccgctccacagcctggcccagcccacctgtcgctcaccatcaccttgctgatgacagcccgtctctggggtggcacattgttgtggacatag

SEQ ID NO: 16499 - DNA, 1596 bp, Artificial Sequence
  Description of Artificial Sequence: Synthetic coding sequence
atggcgccaacaatccagactcaggcccagagagaagacggccacagaccaaacagccatcgtacactgcctgagcggtcaggcgttgtgtgccgcgttaaatattgtaactccctgccggatatccctttcgatccaaaattcatcacatacccctttgatcaaaaccggttcgtgcagtataaggctacaagcctggagaagcaacataagcatgacctcctcactgagcccgaccttggagtgactattgatctcattaatcccgacacctacaggattgaccccaatgttttgctggaccctgctgatgaaaagctgcttgaagaagagatccaggctccgacctccagcaagaggtcccagcagcacgcgaaggtagtgccatggatgcggaaaacagaatatatatctactgaatttaaccggtacggtatctccaatgagaaaccagaagttaaaatcggagtgagcgtgaagcaacagttcactgaggaagagatatacaaagaccgtgacagtcaaattacagcaatcgaaaagacattcgaggacgcccaaaagtccatctcgcagcactatagcaagcccagagtgacgcctgtcgaggtcatgccggtctttccagatttcaagatgtggatcaacccatgcgctcaagtgatattcgatagcgatccagccccaaaggacaccagtggagctgcagccctagaaatgatgtctcaggccatgatccgagggatgatggacgaagagggaaatcagttcgtggcttacttcttgcccgtggaggagacgctgaaaaaacgcaaaagggaccaagaagaagaaatggactatgctcctgacgatgtttatgactataagatcgccagagagtacaactggaacgtcaagaacaaagcatctaagggttacgaggagaactatttttttattttccgggaaggggatggagtttattataatgagttggaaacacgcgttcgcctttccaagcgacgagctaaagcaggagttcaatcgggaacaaacgcactgctggtggtgaagcatagggacatgaatgagaaagaattggaagctcaggaggcacggaaggcacagcttgagaaccacgagccggaggaggaggaggaggaagaaatggagactgaagagaaagaggcaggcgggtcagacgaagagcaggagaaaggatcctcaagcgaaaaagaaggatccgaggacgagcacagcgggagcgaatccgaacgtgaagaaggggaccgagatgaggcctcagacaagtccggctctggcgaagatgagagctccgaggacgaagcaagagccgctcgcgataaggaagaaatctttggctccgatgctgattctgaggatgacgccgatagtgatgatgaagacagggggcaggcgcaaggtggttccgataatgatagcgatagtggctctaacggcggaggacagcggagccgcagtcatagcagatctgccagccctttcccgtctggctccgagcactccgcacaagaggacgggagtgaggccgctgcctctgatagcagtgaagccgattccgacagcgactag

SEQ ID NO: 16500 - DNA, 867 bp, Artificial Sequence
  Description of Artificial Sequence: Synthetic coding sequence
atggctacgggacccattccaacagggctatgtctgcgtgggcttgagtggagtgccgaaagcagtaccgccatcgcctcattaatttccccttctacgccttctagtagccccacaccatcgacaagaactgttttactggaccctgcagacgaaaagctgttggaagaggagattcaggcccctaccagttctaagcggagccagcagcatgctaaggtagtgccatggatgcgcaagactgagtacattagtaccgagtttaatcgctacggcatctcaaatgaaaaaccagaagtcaagatcggagtgtcagttaagcagcaattcactgaggaggagatctacaaggacagagactcccaaattacagcaatagaaaaaactttcgaggacgcccagaaatctattagtcaacattattcaaaacctcgggtcacgccagtcgaggttatgcctgtattccctgacttcaaaatgtggattaacccctgcgcacaagtgatcttcgactctgaccctgcccctaaagacactagcggcgcggcagccctggaaatgatgagtcaggctatgatccgcggaatgatggatgaggagggcaaccaatttgtggcatatttcctccccgtagaagagactctcaagaagagaaagagagatcaggaagaggaaatggattacgcccccgatgatgtctacgattataagatagcccgggagtacaactggaacgttaagaataaagcaagcaagggctatgaggaaaactattttttcatttttcgcgaaggcgatggggtatactataacgagcttgagacctctatccaatattcccacatgctctacaacctggtggcgtag

SEQ ID NO: 16501 - DNA, 1176 bp, Artificial Sequence
  Description of Artificial Sequence: Synthetic coding sequence
atggatcttgagaagaattatcctacgccccggacttctcggacgggccacggaggagttaatcagctggggggagtgttcgtgaatggacggccactgccagacgtggtgaggcaaagaattgtcgagctggcccaccaaggagtgaggccctgtgacatttcccgtcaactgagagtctctcatggttgtgtttcaaaaatccttggacgctactacgagaccggaagcatcaagcctggcgtcatcggcggaagtaagccaaaagttgccacgccaaaggtcgtggagaaaatcgctgaatataagcgccagaatccaacaatgtttgcttgggagattcgggatcgtctgttagccgagagagtgtgtgataacgataccgtaccctcagtgagctccatcaaccgtataatcagaactaaggtgcaacagccaccaaaccaacccgtgcccgcttctagccattccatagttagtactggctccgtgacacaagtctcctccgtcagtacagacagcgccggctcctcatattctatcagcggaatccttgggatcactagcccgtccgccgataccaacaagcggaagagggacgagggcatccaagaaagccccgtgccaaacggccacagtctgccgggaagggattttcttcggaagcaaatgcggggggacctgtttacccagcagcaattagaagttctggatcgcgtctttgaacgtcagcattacagcgacatattcaccaccactgagccgatcaagcctgagcaaacaaccgaatactccgcaatggctagtcttgccggtggcctggacgacatgaaagcaaatctcgcaagccctactccagccgacatcggcagctccgtgcccggaccccagtcttaccccatcgtgacgggccgggacctcgccagcactactctgcccgggtacccgccgcatgtccctcctgctggacagggctcatactccgctcccaccctgactggaatggtccccggaagcgagtttagcgggagcccatactctcacccacagtacagttcctataatgattcctggaggttccccaatccgggacttcttggcagcccttattattactctgccgcagccagaggtgctgcacctcccgcggctgctactgcctatgatagacactag

SEQ ID NO: 16502 - DNA, 867 bp, Artificial Sequence
  Description of Artificial Sequence: Synthetic coding sequence
atggacttagaaaagaactatccaacaccgcgaacttcgaggaccggacatggcggagtgaaccaactcgggggggtgtttgtcaatggtcgacccctccctgacgtggtgcgccagaggattgtggaactggcacatcaaggggtaaggccgtgcgacatttcccgccaattgagagtgtcacacggttgtgtcagcaagattttagggaggtattacgagaccggcagcattaagcccggggtgatcggcggctctaaacccaaagtggccactcctaaggttgtcgagaaaatcgcggaatataaacgccagaacccgacgatgttcgcttgggagattagggacaggcttttagccgaacgagtgtgtgataatgacaccgtcccctccgttagttcaattaatcgtatcatacgaacgaaagtccagcagccacctaaccagcccgttcctgcctcatcccatagtatagtgtctactggctcggtcacccaggttagctcggtcagcaccgacagcgcgggctcttcttactctatttcgggcattctcggcatcacttcaccctctgctgatacaaacaaacggaagcgggacgaggggattcaagagtcgccagttccaaatggacatagtcttcctggtagagacttcctcaggaagcaaatgcgaggcgatctgttcacccagcaacaacttgaagttctcgacagggtcttcgaaaggcagcactattctgacatattcaccaccaccgagcccatcaagccggaacaggccgtaacatggcgcgcacgtcccagccccggaactctgcatacctcccccccccttgacagggccgcaacgcagcaccggcggtag

SEQ ID NO: 16503 - DNA, 987 bp, Artificial Sequence
  Description of Artificial Sequence: Synthetic coding sequence
atggatctggaaaagaactacccgactccacggacctcccgaacgggccatgggggggtgaaccagcttggcggcgtgttcgtgaatggacgcccccttcctgatgtcgtcagacagcgaatagtggagctcgcgcaccaaggagtgcggccgtgcgatattagtcgtcaactccgcgtgtcgcatgggtgtgtgtcaaagatcctgggcagatattatgagactggctctatcaaacctggcgtgatagggggcagcaagcctaaggtcgccacgccaaaggtcgtggagaagatagccgagtacaaaaggcagaaccctaccatgttcgcatgggagatccgagaccggttgctggccgaaagggtctgcgacaacgatactgtgccttccgtgagcagcattaaccgaattattcgaaccaaagtgcaacagccccccaaccagccggtgccggcaagttcacactccattgtcagcacaggctctgtcacacaggtgtcatctgtgtccactgatagtgctggaagctcttacagtatctcaggcattcttggcattactagcccaagtgccgatacaaacaagcgtaaacgcgacgaaggcattcaggagtccccagtacctaatggccacagtcttccaggccgggatttccttagaaagcagatgcgcggcgacctctttacacaacagcagctagaggtactggatagggtcttcgagcggcagcactattccgatattttcactaccactgagcctatcaagccagagcagaccacagagtattctgccatggcgagcttagctggaggcctggacgacatgaaggcaaatctggccagtcctacccctgccgatataggaagcagtgtgccaggcccacagtcttaccctattgtcacgggcagcccctattactattctgccgccgcccgaggagccgccccccccgccgcggccactgcttacgatcggcactag

SEQ ID NO: 16504 - DNA, 909 bp, Artificial Sequence
  Description of Artificial Sequence: Synthetic coding sequence
atgttcgcatgggagattcgagacagattacttgccgagagggtgtgcgacaacgatactgtcccgtcagtatcaagcatcaaccggataatcagaactaaggtccagcagccaccaaatcagcccgtgcctgcttcctcccattcaattgtgagcactgggtcggtgacccaggtgagttcggtgagcaccgactccgctggcagcagctactctattagcggaatcctcggtataacatctccgtctgccgatacaaataagcgcaagcgagatgaaggcatacaggaaagcccagttccaaacggacattccctgcctgggagggattttctgaggaaacaaatgaggggtgatctctttacacagcagcagctggaggttttggatagagtgttcgaacgccagcactattctgacatctttacgacgacagagcccataaagccagaacagtggtgtcccgtgttgatgaggcaatacctggttcaacctcaagccgtgctgtttcagactaccgagtattcagccatggcctccttggcaggagggctggacgatatgaaggcaaacctagcgtcccctactccagcagacatcgggagtagcgtcccaggacctcagagttacccgatcgtcacgggcagggatctcgcttctaccacactccccgggtacccccctcacgtacccccggccgggcagggctcctatagcgcacccaccttgactggcatggtgccagggtccgagttctctgggagcccctactctcacccccagtacagcagttacaatgacagttggagattccccaaccccggcttgctgggctctccgtactattactctgctgcggcaaggggcgccgcaccaccagccgccgcaacagcctacgatcggcattag

SEQ ID NO: 16505 - DNA, 1074 bp, Artificial Sequence
  Description of Artificial Sequence: Synthetic coding sequence
atggatcttgagaagaactatccaaccccgcgcacgtcaagaactggacacggcggcgtaaaccaacttggcggagtgtttgtaaacggacgaccactccctgacgtggttaggcaacggattgtcgaactcgctcaccagggggttcgcccatgtgacatcagccgtcagctgagggtgtcccacggatgtgtgtctaagatattagggcgatactatgaaacagggtccattaagcccggcgtaatcggggggtctaagccaaaggtcgcaacacctaaggtggtagagaaaatagcagagtacaaacggcaaaaccccactatgttcgcatgggaaattcgggaccgcctgttagcagagcgtgtgtgtgataatgacacggtaccatctgtgagcagcatcaacaggattatccggacaaaggtgcagcaaccgcctaatcaacctgtaccagctagttcgcactctatagtatcgactggatcagttacacaagttagttccgtctccactgattctgccggaagctcatatagcattagtggtatcttgggcattacctctccttctgcagacacaaacaaaaggaaaagagatgaggggatccaggagtccccagtgcccaatggtcattctttacctggccgggactttttgagaaagcaaatgcggggtgacctctttacacagcagcagctcgaagtcctggatagagtgttcgaaagacagcattattcagatatcttcacaactacggagccaattaagccagagcagactactgagtattccgccatggctagcttggcgggcggtctggatgatatgaaggccaacctagcctctccgacacccgcggacattgggagcagcgtccctgggcctcagtcctacccaatcgtgacagggagtgaattttctggatcaccgtactcacacccacagtacagctcctataatgatagctggcggtttcccaacccgggcctgctcggctcaccctattactattccgccgcggcacgcggcgctgcgccccccgctgcggccactgcatacgaccgacactag

SEQ ID NO: 16506 - DNA, 1089 bp, Artificial Sequence
  Description of Artificial Sequence: Synthetic coding sequence
atggatttagaaaaaaactaccccacgcctcgaacatcacgcaccggtcatggtggcgtcaatcaacttggcggagtgtttgtaaacggacgccccttgcccgatgttgtgcgtcaacggatcgtcgagctcgcccatcagggcgtgcggccatgtgatattagccgacagctacgagtatcgcacgggtgtgtgagtaaaatcctgggcagatactatgaaacaggttccattaagcccggagtcatcggcggatccaagccaaaagtcgccactccaaaggtggttgaaaaaatagccgagtataagagacagaatccgacaatgttcgcgtgggagattcgagatcgcctgctggccgaacgtgtgtgtgacaatgatactgtgcccagcgtcagcagcatcaaccgaattatccgcaccaaagtgcagcagccccccaatcagccagttcctgctagctcccatagcatcgtctctaccggcagcgtgacacaagtgtctagcgtcagtacagactccgctggctcctcatattcgatctccggaattctgggcatcacaagcccctctgcagacacaaataaaaggaaacgggatgaggggattcaggaatctccagtcccaaacggccactccctgcccggacgggactttctaaggaagcagatgcggggcgaccttttcacccaacagcagctggaggtgctcgatagagttttcgagcggcaacactactcagatatcttcacaacaactgaacctattaagcctgagcagactacagagtacagcgctatggcttccttggctgggggtctagatgacatgaaagcaaacctggcctcgcccacacccgctgacatcggaagcagcgtacccgggccccagagctatcccattgtcacaggaagggaccttgcaagcacaacgttgccaggttaccctccacacgtgccccccgccggtcagggcagctatagcgcccccacactcacgggaatggtgcctggcagcccttactactattcggccgccgcgagaggggccgcgccacccgcggcggccaccgcctacgacagacactag

SEQ ID NO: 16507 - DNA, 1047 bp, Artificial Sequence
  Description of Artificial Sequence: Synthetic coding sequence
atggacctggagaaaaactaccctacccccagaacatcaagaactggacacggcggcgtgaaccagctaggaggagtattcgtgaatggtcgcccgctgcccgacgtcgtgcggcagagaattgtggaactggcccaccaaggcgttcgcccttgtgacatttcccggcagttgcgtgtcagccacggctgcgtgtctaaaatcctggggagatattacgagaccggctccattaagcctggagtcattggcggctccaagcctaaggtcgctacacctaaagtggtggagaagatcgcagaatacaaacgtcagaaccccaccatgttcgcatgggagatccgcgacagattacttgctgagagggtgtgtgacaacgacaccgtgccatccgtcagttcaattaatcgcatcattagaaccaaagtgcagcaacccccaaaccaacccgtacccgcttctagtcattcaattggtattcaagagtctccagtccccaatggacattctctccccggacgtgacttcttaagaaagcagatgagaggtgacctgttcacgcagcagcagctggaagtgcttgatagggtcttcgaaagacaacactatagcgacattttcacaacaacggagccaattaaaccagagcagacgaccgaatactcagccatggcaagcctcgcgggtggactggatgatatgaaggcgaatttagcctcacccactcctgcagatataggttcgtctgtacccggccctcagtcttaccctatcgtgacaggtagggatctggcctccacgactctgccaggctatccaccacacgtcccgcccgccggacaaggctcttacagtgcccccaccttaactggaatggtgccagggagtgagttctctggttcaccttacagtcatccacagtattcctcatacaacgattcctggagatttccaaaccccggtctgctgggtagtccctattactatagcgcagcggcaagaggagccgctcccccagccgccgctacggcctatgatcgacattag

SEQ ID NO: 16508 - DNA, 876 bp, Artificial Sequence
  Description of Artificial Sequence: Synthetic coding sequence
atggatcttgagaagaattatccaacaccgcggacttcacggaccggtcacggtggagtcaaccagctagggggagtgtttgtgaacggccgtccactgccagacgtggtacggcagcgcatcgtggagcttgctcatcaaggagtgagaccatgcgacatcagtagacaactccgtgttagccacggttgcgtctccaaaattcttggaagaatcatccgaacaaaagtccagcaaccccccaaccagcccgtaccggcatcatcccacagcatagtgagcacaggctcagtgacgcaggtcagctcagtatccaccgatagcgctggttcatcctattccatctccggcatcttgggcattacgtcaccaagtgctgataccaacaaaaggaagcgcgacgagggaatccaggagtcccccgtccctaacggacatagtttgccggggagagactttctgagaaaacagatgagaggggatctcttcacacaacagcagctcgaggtgctagacagagtgtttgagcgacaacactactccgatatctttactaccaccgagccaatcaagcccgaacagaccacggaatactcagctatggcttcccttgcgggaggccttgacgatatgaaggccaacttggccagcccaactccagcagacatcgggtcttccgtccctgggcctcagtcttaccccatcgtcactggatcagagttctcgggttccccctactcccacccccagtattcctcctataacgacagttggcggttccctaatcccggattactcggcagcccctactattactctgccgcggcgcggggagcagcgccaccagctgccgctactgcctacgatcgccattag

SEQ ID NO: 16509 - DNA, 960 bp, Artificial Sequence
  Description of Artificial Sequence: Synthetic coding sequence
atggacttggaaaagaattaccccacaccccggacatccaggactggccacggcggtgtaaatcagctcgggggtgtgttcgttaatggcagacccctgccagatgtcgttaggcagcggatcgtggagctggcacaccaaggagtgagaccttgcgacatcagccggcagttgagggtcagtcacggctgtgtgtcaaaaattctcgggcggtattatgagaccgggagtataaaacctggggttattggagggtctaagccaaaagttgccacgccaaaggtggtcgagaagatcgctgagtacaagcgacaaaaccccaccatgtttgcgtgggaaatacgcgataggctactggcagaacgtgtctgcgacaatgacacggtgcccagtgtttccagtatcaaccgaattatcaggactaaagtgcagcagccacccaatcaaccagtgcccgcctcatcccattctatcggcatccaagaatccccagtcccgaacgggcactccctgcccggcagggacttcctaagaaaacaaatgagaggcgatctcttcacccagcagcagctggaggtcttggatcgcgtattcgagagacagcactattcagacatcttcactacaacagagccaatcaaaccagagcagacaactgaatacagcgccatggcttctttagcagggggtctggacgatatgaaggctaatctggctagtcccacacccgccgacatcggaagcagcgtgccgggaccacaatcatacccaatcgtgaccgggagagacctggcctcaactacactcccaggctatccaccgcacgtcccgccagcaggtcaggggagctattcggcgcctacactaaccgggatggtaccaggtagcccgtattattactctgcagcagcaagaggggctgcgccaccagctgcagcgaccgcatacgatcggcactag

SEQ ID NO: 16510 - DNA, 852 bp, Artificial Sequence
  Description of Artificial Sequence: Synthetic coding sequence
atgttcgcctgggagatcagagaccgactgctggcagagcgcgtctgcgacaacgacaccgtccccagtgtatcctcgatcaaccgtatcatccggacaaaggtgcagcagccgcctaatcagcccgtacccgcctccagccacagcattgtgagcacgggttcagtcacacaagtcagctctgtgtcaactgattccgccggctctagctattccatttcaggaattctgggaatcacctccccatcggcggacacaaataagcgaaaacgcgatgagggaatacaggagtcacccgtgcccaacggacactccttacccgggagagattttttgaggaagcagatgcgcggtgacctgtttacacagcagcaactcgaagttttagatagggtttttgagcggcaacattactcggacatttttacaaccacagagcccattaagcccgagcagaccacagagtattcagctatggcatccttggcaggaggcctggatgacatgaaggccaatttagcctctccgactcctgctgatatcggaagttccgtgccgggcccccagagttatccaatcgtaactgggagagatctcgcatctaccacactccctggttatccgcctcatgtcccgccagcaggccagggcagctattcagctcccacactgaccggaatggtcccaggcagtgagttttcgggaagcccctatagtcacccacagtactcttcttataacgactcctggcgattccccaatccagggctgctgggatctccttattactattctgctgcagcacgtggggctgctccacccgctgctgctacggcatatgataggcattag

SEQ ID NO: 16511 - DNA, 924 bp, Artificial Sequence
  Description of Artificial Sequence: Synthetic coding sequence
atggatctggaaaagaattacccaactccacgaactagccgaaccgggcatggaggggtgaaccaactcgggggcgtgttcgtaaacggtcgccccctgccagacgtagtgcgtcagaggatagtggagctggcacatcagggcgtgagaccctgcgacatcagtcgacagcttcgcgtgtcacacggctgcgtgtctaagatcctgggccggtattacgagacgggctctatcaaacctggagtcatcggtggatcaaagcctaaagtggctacccccaaagtggtagaaaagattgccgaatataagaggcagaatcctacaatgttcgcctgggagattagagatcgactgctggccgagcgcgtgtgcgacaacgacactgttcccagtgtgtcctctataaacagaattatccggaccaaggtgcaacagccacccaaccagccggtccccgccagctcacatagtatagtcagtacaggcagtgtgacccaggtctcgtcagtgtccaccgattccgccggtagcagttacagcatttccggaatactggggattacttcaccaagtgccgacacaaacaaaagaaagcgggacgaaggtattcaagaaagtccagtccccaatggccacagtctgcctgggagggatttcctgagaaaacagatgcggggcgacctgttcacccagcaacaactggaagtgttggatagagtttttgagcgtcagcactactccgacatctttacgaccaccgaaccgataaagcccgagcaatggtgccctgtgctgatgcgccagtacttagtccagccacaggcagttcttttccaggccgtcacatggagagcccggccctcccccgggacacttcacaccagtcccccattggatcgggccgccacacagcaccgcaggtag

SEQ ID NO: 16512 - DNA, 1197 bp, Artificial Sequence
  Description of Artificial Sequence: Synthetic coding sequence
atgccccacaatagcatccggagtggccacggcggcctgaaccagttgggtggggccttcgtaaacggtcgccctctccccgaggtagtgagacagagaattgtggatctggcccaccagggcgtgcgaccctgtgatatcagccgacagttgcgtgtaagccacggttgcgtgagtaagatcctgggtcgctattatgagacagggtcaatcaggcccggcgtgatcggcggctccaagcctaaagtagccacccctaaggttgttgaaaaaattggagactacaagcgacagaacccaaccatgttcgcttgggaaatcagggaccggctgctggccgagggggtatgtgataacgacactgtaccctccgtttcatctataaacaggataattcgaacaaaggtacagcagccctttaatttacctatggacagctgtgtggccaccaaaagcttatctcctgggcacaccctgatcccatcgtccgccgtaactccccctgagagtccacagtcagattccctgggctcaacatattccattaacgggctcttaggaatagcccaacccggttcagataaacgaaaaatggacgatagcgatcaagattcttgccgcttgagcatcgatagtcagtcatccagcagcgggccgcgtaagcatctgcgcaccgatgccttcagccaacaccatctggagccgctagaatgtcccttcgagaggcaacactatcccgaggcgtatgccagcccaagccacactaagggcgaacaaggactgtaccccctccctctcctcaatagcactctggacgacggaaaggccacgctgacgccaagcaacacccctctgggccgtaatctctctactcaccagacttaccctgtcgtagccgcgccccccttttggatttgcagcaagagcgcccccgggtcccggcccagcatgccatttcccatgttacccccctgcactggaagtagccgggccaggccaagcagccaaggagagaggtggtggggacctcgatgtccagatacacatccgactagccccccagcggaccgggccgctatgccacccctgccctcgcaggcatggtggcaagaagtcaatacgctggccatgccaatggcgacccctcctaccccgccaaccgcgcggcccggcgcctctccaacaccagcatgctag

SEQ ID NO: 16513 - DNA, 966 bp, Artificial Sequence
  Description of Artificial Sequence: Synthetic coding sequence
atgccccacaatagtattcggtcgggacatgggggtttgaaccagctgggaggcgctttcgtgaacggcagacctctacccgaagttgtgagacagagaatcgttgacttggcccatcaaggcgtgcgaccctgcgacatctcccgacaacttagggtcagccacggatgtgtgtccaaaattctggggcgatactatgaaactggaagcatccgtcctggtgtgatcggggggtccaagccaaaagtggctactccgaaggtggtcgaaaagattggagactataagagacagaaccccacaatgtttgcctgggagatccgcgatcgactcctggcagagggcgtgtgtgacaatgacacagtcccatctgtgagttccatcaatcgcatcatccggactaaggttcagcagccattcaatcttcccatggattcttgcgtggccacaaagtctttgagccccggccataccctgatacctagcagtgccgtgaccccacccgagagtccacagtccgatagtctgggatcgacatactctattaacggcctgcttggcattgctcaaccaggttccgataagcggaagatggacgacagtgatcaggacagttgtagactgagcattgacagtcagtcaagttctagcgggcctaggaaacatcttcgtacagacgctttctcacagcaccacctcgaacccctcgagtgtccctttgagcgacaacactacccagaagcttacgcaagcccctctcacacaaaaggcgagcagggcgagcggtggtggggtcctcggtgtccggacacccatcctaccagtccaccagccgatagagctgccatgccaccattgcccagtcaggcgtggtggcaagaggtgaacactcttgcaatgcctatggccaccccccccacaccccctacagcccggcccggcgcctcacccaccccagcttgttag

SEQ ID NO: 16514 - DNA, 1197 bp, Artificial Sequence
  Description of Artificial Sequence: Synthetic coding sequence
atgcctcataatagcattcggagcggacacggcgggcttaatcaattgggtggtgccttcgtgaatggaaggccactgcctgaggtggtgcgacaacgcatcgttgatctcgcccaccaaggtgttcggccatgcgacatttctcggcagctgagagtcagccacggctgcgtgagtaagattctgggccggtactacgagacaggctctattcgccctggcgtgatcgggggctcaaaacccaaagttgctacccccaaggtcgtcgagaagattggggattataagcgacagaaccctacgatgtttgcctgggaaatccgcgaccggcttttagcagagggagtgtgcgacaacgatacagtaccctctgtcagctcaattaatcgtatcatcagaacaaaggttcaacaacctttcaacctgccaatggactcgtgtgttgctacaaaatctctgagcccaggccacactctcatcccgtcctccgctgtgacccctcctgaatcaccgcagtcagactccctgggctccacatattctatcaatgggctgctcggcatcgcccagccaggctcagacaaaaggaagatggatgattcagatcaagacagttgccggctgagtatcgactctcagtcgtcttccagtggacccagaaaacacttaagaaccgatgcattttcccagcaccacctggagccgcttgagtgtccgtttgagagacagcactatccagaggcttatgcctcgccatcccatacaaaaggtgagcagggtctgtacccactcccccttctgaattccactcttgacgatggcaaggccaccctgaccccaagtaacacacctctgggcaggaatctctccacccaccagacttatcccgtggtggcggcccctcccttctggatttgtagtaagagtgccccagggtcacggccttccatgcccttccccatgctacccccctgtacagggtcctctagagcacgcccttcttctcagggagaaaggtggtggggacctcggtgccccgatactcacccaaccagccctcccgctgatagagcggctatgccacccctacccagtcaggcatggtggcaagaggtaaacaccctggcaatgccaatggcgaccccccctaccccacctacagccaggccgggggcgtcccccaccccggcctgctag

SEQ ID NO: 16515 - DNA, 864 bp, Artificial Sequence
  Description of Artificial Sequence: Synthetic coding sequence
atgcctcacaactctattcgcagcggacatgggggactgaaccaactgggaggagcctttgtcaatgggagacccttgccagaggtggtgaggcagcgaatcgttgatctagcgcaccaaggggtaagaccatgtgacattagtcgtcagttgagagtgtcccacggttgtgttagcaaaatcctgggcagatactatgaaaccggctcgatccgaccaggcgtcatcggtggatctaagccgaaggtggccaccccaaaggtggtggagaaaatcggggattataaacggcagaatcctaccatgtttgcctgggagattagggatcggctccttgcagagggggtctgtgacaatgataccgtaccctcagtttctagcatcaacagaatcattaggacaaaggtgcagcaaccttttaatcttcccatggattcatgtgttgcaacaaagtcactgagtccaggccacaccctcatcccgagttctgccgtcaccccacctgagtcaccacaaagcgatagcttgggttctacatattctatcaatggactgttgggcatcgcccagcctggtagcgataaaagaaagatggatgacagtgatcaggactcttgtaggctgtccattgatagccaatcctcgagttctgggcccagaaagcatctgcgcacagatgccttcagtcaacatcatttggagccccttgaatgcccctttgagcggcagcactacccggaggcctatgcatctcccagccacactaaaggcgagcaagaagtgaacacgctggctatgcctatggctacgccgcccacccctcctacagccagaccgggcgcgtccccaaccccagcctgttag

SEQ ID NO: 16516 - DNA, 1353 bp, Artificial Sequence
  Description of Artificial Sequence: Synthetic coding sequence
atgccgcacaactccatcaggtcagggcacggaggcctaaatcagttggggggcgcttttgtcaacggccgcccgctgcctgaagtggtgcgccagcggattgtcgacctggcacaccaaggagtccgcccctgcgatatttcccgtcagctgcgcgtgagccacggatgtgtgagcaagatcttggggcgatattatgagacagggagtattcggcctggtgttatcggtgggagtaagcctaaggtggcaacaccaaaggtagtcgaaaagatcggagactataaacggcagaatcctaccatgttcgcttgggagattcgcgatcgactgctggccgagggcgtgtgtgataatgataccgtcccctccgtgtcaagtatcaatcgtataatccgcaccaaagtacagcaaccgtttaacttgcccatggactcctgtgttgcaacaaagagtctgagccccgggcatacactgatacccagttctgctgtaacgccacccgagagcccacagagcgactctttaggctctacatattctatcaacggcctcctaggtattgcgcagcctggatccgacaagagaaaaatggatgacagcgaccaggactcttgtcgccttagcatcgatagccaaagctcatcgtctggtccaagaaagcaccttcggactgatgcttttagccagcatcacctggagccccttgagtgtcctttcgaacgccaacattaccctgaagcctacgctagccccagtcatactaagggagagcaggggttgtacccgttacctctcttaaactctacactcgatgacggcaaggccactctgacgccctcgaacaccccacttggacgaaacctgagtacacatcagacctaccccgtggttgcagaccctcactctccttttgctatcaagcaagaaacccctgaagtgtcctcaagttcatccactccaagcagcttgagctccagcgcttttttggaccttcagcaggtgggaagtggagttccaccttttaatgcatttccccacgctgcaagcgtttacggccagttcacagggcaagcattactgagcgggcgcgagatggtgggaccgacacttcctggctaccccccgcacatcccaacctccggccaaggttcatatgcctcaagcgcgatcgccggcatggtggcaggtagcgagtactccggtaacgcctacggtcacactccctactcctcatacagcgaggcctggcgattcccaaacagctccctcttatcgtccccatactactacagcagcactagccgcccttctgctccaccaacaactgccaccgccttcgaccacctctag

SEQ ID NO: 16517 - DNA, 570 bp, Artificial Sequence
  Description of Artificial Sequence: Synthetic coding sequence
atggcttctaaacgagctctggtgatactggccaaaggtgccgaggaaatggagactgtgattcctgtggatgtcatgcggcgggccggtataaaagtgactgttgccggactggcgggcaaggacccagttcagtgctctcgggacgtcgttatctgtccagacgcatccctagaggacgccaagaaggaagggccctatgatgtggttgttttgccaggagggaacctgggggcacagaacctcagcgaatccgctgcggtgaaggagatcctcaaggagcaagagaataggaaagggctcatagctgccatatgtgccgggcccaccgctctgctcgcacacgagattggcttcgggagtaaggtgaccacccacccactggctaaagacaagatgatgaatggcggtcattacacatattctgagaaccgcgtggaaaaagacggtctgatactgacatctaggggacctggaactagttttgagttcgcattggctatcgtggaagcattgaatgggaaagaggtggcggcccaggtaaaggccccactcgtgcttaaagattag

SEQ ID NO: 16518 - DNA, 570 bp, Artificial Sequence
  Description of Artificial Sequence: Synthetic coding sequence
atggcaagcaagcgggccctggtaatactggccaagggcgccgaagagatggagacagtcatacccgtggatgtgatgcggcgagcaggaataaaggtgacggtcgcagggctagctggcaaggatcccgtacagtgctctcgcgacgtggttatttgccctgacgcttccctcgaggacgccaaaaaagaaggtccgtacgacgtagtggtcctgcccgggggaaacctgggggctcagaacctcagtgaatcagccgcagttaaagaaatcctcaaggaacaggagaatcggaaaggcctgatcgcagccatctgcgccggccctaccgccctcttggcccacgagatcggattcggatcaaaggtgactacacacccacttgctaaagacaaaatgatgaatgggggtcattacacctacagcgagaacagagtggagaaagacggcctcatcttgacctcccggggccctggcaccagctttgagtttgctctggctatcgttgaggcattgaatggaaaggaggtggctgctcaggttaaggcgccattagtgcttaaagattag

SEQ ID NO: 16519 - DNA, 570 bp, Artificial Sequence
  Description of Artificial Sequence: Synthetic coding sequence
atggcgtccaagcgcgctctagtgattctggccaagggtgcagaggagatggaaacagttatacccgtggatgtcatgaggcgggccggcatcaaggtgaccgtggcaggactagcgggaaaggatcccgtccagtgctctagagatgtcgtcatctgtccagacgcctctctggaagacgccaagaaggaaggaccctatgatgtggtagtcctcccgggtggtaacctcggggcccagaacctctcagagtccgcagcggtcaaagagatcttaaaggaacaagaaaatagaaaaggtctgatagccgctatatgtgctggtcctactgccctgttggctcacgagataggttttggctcaaaagtgactactcacccattggccaaggacaagatgatgaatggtggacactatacttattccgagaacagggtggagaaagacggcttgattcttacctccagaggcccaggaactagctttgagttcgcgctcgccattgtggaagcactcaatggcaaggaagtggcggctcaagttaaggcccccctcgtgctcaaggattag

SEQ ID NO: 16520 - DNA, 570 bp, Artificial Sequence
  Description of Artificial Sequence: Synthetic coding sequence
atggcttcaaaacgggctctcgttattttagctaagggggcagaggagatggagaccgttattccagtggatgtgatgcggagagctggcatcaaggtaaccgtcgccggtctggccggtaaggatcctgtgcagtgctccagagacgttgtgatctgcccggatgcaagtctggaggacgctaagaaggagggaccatatgacgtggtcgtgctcccagggggaaatctgggggcacaaaacctatccgaatcagcagcagtgaaggagattctgaaggaacaggagaaccgaaaaggactaatagcggctatctgcgcaggccccaccgccctcctggctcacgaaatagggtttggatccaaagtgacaactcatcccctggcaaaggacaagatgatgaatggaggccactacacctactccgagaacagagtggagaaagacggacttatcctgactagcagagggcccggcacgagctttgagttcgccctggctatcgttgaagccctgaacggcaaggaagtagccgcacaggtgaaagctcccttggttttgaaagactag

SEQ ID NO: 16521 - DNA, 3561 bp, Artificial Sequence
  Description of Artificial Sequence: Synthetic coding sequence
atggatgagcccccaggaaaacccctgtcctgtgaggagaaggagaaactcaaagagaaactggcgtttctcaaaagggagtactctaagacacttgccaggctgcagagggcccaacgtgcagaaaaaattaaacacagcattaagaaaaccgttgaagagcaggactgtctgtctcagcaggacctgagtccccaactgaaacattcggagccgaagaacaagatttgtgtatacgataagctccacattaaaacccatctggatgaagagaccggcgagaaaactagtattaccctggatgtgggccccgagagcttcaacccaggcgacggtcccggtgggttgcctattcagcgaactgatgatactcaggagcatttcccgcatcgggtcagcgaccccagtggggagcagaaacagaagctccctagccgtcgcaaaaagcagcagaagcgcacttttataagtcaggagagagattgtgtctttggcacggatagcctgcgcctgtcaggcaagagactgaaagagcaggaggagatctcttctaagaacccggcccgctcgcccgttactgaaattcgtactcacttactatcactgaagtccgaactgccagatagcccagaaccagttactgagatcaatgaggattcagtactaatacccccgacggctcagcctgagaaaggggttgacacatttctccgccgccccaattttactcgtgcaactaccgtgccattacagaccctttctgacagtggctccagtcaacacctggaacatatccctcccaagggttctagcgagctcacaacgcacgacctgaaaaatatcagatttacttcacctgtgagtttggaagctcagggtaagaaaatgacagtgtctaccgacaacctgctcgttaataaagcgatctccaagtcaggtcagcttcctacctcatctaacctagaagccaacatttcctgctctctgaatgagctcacctataataacctcccagccaacgaaaaccagaacctaaaagaacaaaaccagacggagaaaagccttaaaagtccctcagatacactcgacggaagaaacgaaaatctgcaggaatcagagatattgagccagcccaagagcctgagcctcgaagccacaagccccttatctgcagaaaagcactcatgtaccgttccagaaggactgctttttccagccgaatactacgtcagaaccacccgctcaatgtccaattgtcaaagaaaagtggccgtggaagcagtgatacagtctcacctcgacgttaagaaaaagggattcaaaaataaaaacaaagacgccagtaagaacttgaatctttcgaacgaagaaactgatcagtctgaaatacgaatgagcggaacctgtacaggacagccctcctccaggacctctcagaagctcctgagcctaactaaggtgtcatcccccgccggaccaactgaggataatgatctctcaaggaaggctgtcgcacaagctcccggccggagatatacaggaaaaagaaaatctgcttgtactccagcctccgaccactgcgagcctttgctaccaacttccagtctgtctatcgtgaataggagtaaggaggaagttacaagccataaatatcagcacgaaaagttattcatccaggtcaaggggaaaaaatcacggcaccaaaaagaagatagcttgtcatggtccaactcagcatatctgtctctagacgatgacgctttcaccgcgccatttcatcgcgacggcatgcttagtctgaaacagctgctttctttcttgagcatcaccgacttccagttgcccgatgaagattttgggcccctgaaattagagaaagtcaagtcttgtagtgaaaagcccgtcgagcctttcgaaagcaagatgttcggcgagcgccatctgaaggaagggagctgcatctttccagaagagctgtcccctaagcgaatggacaccgagatggaggacctggaggaggacctaattgtcctgcccggcaaatcccaccctaaaaggccgaacagccagagccagcacaccaagaccggtttgtcaagctccattctcttgtatacacccctgaataccgtagcaccggacgataacgacagacccactactgacatgtgcagccccgcatttcccattctcggaacgaccccagctttcggaccccagggcagctatgagaaagcctctaccgaggtcgcgggccgcacatgttgcacccctcagctggcccacctgaaggacagcgtgtgcttagctagcgacacgaaacagtttgattctagcgggtcacccgccaaaccccataccaccctgcaagttagcggtcggcagggccagcccacatgtgattgcgactccgtccccccaggcactcccccacccatcgagagcttcacttttaaagagaatcaactgtgtaggaatacttgccaggagctgcacaagcattccgtggagcagactgaaaccgccgagctccccgcatccgactctattaaccccggcaatctgcagttagtcagtgaactgaagaatccatctgggtcctgttctgttgacgtctccgcaatgttttgggaaagggctggttgtaaggagccttgcataattacagcttgcgaggacgtagtcagtttgtggaaggcgctggacgcatggcaatgggaaaaactgtatacatggcacttcgccgaggtaccagtcctccaaatcgtcccagtgccggacgtctataatctcgtgtgtgtcgccttaggcaacctagagattcgagagatcagggctctgttttgttcctcagatgacgagagcgagaagcaggtcctccttaaatcagggaatatcaaagccgtgttaggtctaacgaaacggagactagtgtctagctcaggcacactcagtgaccagcaagtggaggtgatgaccttcgcggaagacggcggaggaaaagagaatcaattcctcatgcctcccgaggagaccattctgacctttgcagaagtgcagggcatgcaggaggctctgctggggacaaccatcatgaacaatatcgtaatctggaatctgaagacagggcagctgttgaaaaagatgcacatcgatgattcttatcaagcctcagtgtgtcataaggcctactcggagatgggactcttattcatagtcctgtcccacccctgtgccaaggaaagcgagagtctccgatcccccgtcttccagctgatcgtgatcaacccaaaaaccaccttatcagtgggcgtgatgttgtactgcctcccacccggacaggctggacggttcctagaaggagatgtcaaagaccactgcgcggccgccatattaactagcggtaccatcgcaatctgggacttgctgctgggccaatgcaccgccttgttaccacctgtctctgaccagcactggtctttcgtgaagtggtccggcaccgacagccatctactggccggtcagaaggacggcaacattttcgtctatcactattcttag

SEQ ID NO: 16522 - DNA, 4344 bp, Artificial Sequence
  Description of Artificial Sequence: Synthetic coding sequence
atggcttcagctggaaacgctgccgagcctcaggatcgaggcggcgggggtagcggatgtattggtgcccccgggagaccagctggcggaggaagaaggaggcgtactggcggcttacgcagagcagccgcccccgatcgggattatttgcaccggccctcatactgcgatgcagctttcgcgttagaacagatttctaagggtaaagctacaggacgcaaggcacccctttggctgagggccaaatttcaacgtctgctcttcaagctgggttgttacatccagaaaaactgtgggaagttcctggtcgttggcctcctgattttcggcgctttcgctgtggggctgaaggctgcaaatcttgagactaatgtcgaggaactgtgggtggaggtgggaggtcgggttagtagagagctgaattacactcgacagaagataggagaggaggcaatgtttaacccacagctaatgatccaaacgcctaaagaggaaggcgctaacgtgctgacgaccgaggcccttttgcagcacttggacagcgctctccaagcatcccgcgtgcatgtgtatatgtacaaccgccaatggaaactcgagcacctctgttataagtcaggggagttaattactgaaacgggctacatggatcagattattgaatacttatacccctgtctgataataacacctctagactgtttttgggaaggagcgaagttacaatccgggaccgcctacctgcttggtaagccacccctgagatggactaatttcgaccccttagaattcctcgaagagttgaaaaagattaattaccaggtcgattcctgggaagagatgttgaacaaagctgaggtgggccatggctacatggacagaccatgcctgaacccagccgatcctgactgtcctgctaccgctcctaacaagaactctacaaagcctctggatatggctctggtccttaatggtggttgccatggactgagtagaaagtatatgcactggcaagaggagctcattgtgggcgggaccgtcaagaacagcaccggcaaattggtgagcgcccatgctctacagacgatgttccagctgatgacacccaagcagatgtatgagcattttaagggttatgagtatgtgagccatattaactggaacgaggataaggctgctgccattttggaggcatggcagcggacttacgtagaagtcgttcaccagtccgtggcccagaattcaactcagaaggtgttgagtttcacaacaacgaccctggatgacatcctcaaatcattcagcgatgtgagtgttattcgtgtggcttctggctacctgctgatgttggcctatgcttgtttgacaatgctcaggtgggattgttcaaagtcacagggggctgtggggctcgctggcgtcctgctggtcgccctctccgtggccgcgggccttgggttgtgctcattgataggaatttctttcaacgctgcgacaacacaggtgctgccctttctcgctctgggtgtaggggtagacgacgttttcctattagcacacgctttcagtgaaacaggtcagaacaaacgaattccatttgaggacagaactggggagtgcctcaaacgcaccggcgccagcgtggccctgacaagcatcagcaatgtcacagctttttttatggccgctttgataccaattcccgcactccgggcattttccctccaggccgccgtagtggtcgtgttcaacttcgcgatggttctcctgatctttcctgcaattttgagcatggatctctacagacgagaagatcgccgtctggacattttttgttgtttcacatccccctgtgtgagtcgagtgattcaggttgagccccaggcatacaccgacactcacgataacaccaggtacagcccaccccctccgtattcatcccactctttcgcgcatgaaactcagatcacaatgcagtccacagtccagctccggacagagtacgacccccatacccacgtctattacactaccgccgagccaagatccgagatcagcgtacagcccgtgaccgtgacccaggatactctatcgtgccagtcacccgaatccactagttccaccagagatctattgtcacagttcagcgactcatctttacattgcttggaacctccgtgtacaaaatggacgcttagttccttcgccgaaaaacactacgctcccttcctcctgaagccgaaggccaaggtggtggtgatttttctgttcctcgggttgctgggtgtgtcattgtatgggactactagggtaagggatggtcttgaccttaccgacattgtccctagggaaacccgagaatatgactttatcgccgctcagttcaaatacttctcattttataatatgtatattgtgacccagaaagctgattatccaaacatccagcacctcctgtatgatctccacaggtcttttagtaacgttaagtacgtgatgctggaagagaacaaacaactgcccaagatgtggctccactactttcgggactggttacaagggctgcaggatgccttcgatagcgactgggagaccggcaaaataatgcctaacaactataaaaatggttcagacgacggagtgctggcctataagctcctcgtacagacggggtcaagagacaaaccaattgacatctcacagcttactaaacagaggctcgtagatgctgacgggataattaatccgtcggccttttacatttaccttacagcttgggtgtcaaacgatccagtagcttacgcagcatctcaggctaatatccggccgcaccggcctgagtgggtgcacgataaagctgattacatgccggaaacgagacttcgtatccctgcagctgagcctatcgagtatgcccagtttcccttctatctcaacggtctgagagataccagcgattttgtggaagcgattgagaaagtgcgtaccatttgcagcaactacacaagcctgggactgagttcctacccaaacggctatcctttcctgttctgggaacagtacatcggtctgcgccactggcttctgctctttatttcggtggtgctggcctgcacattcctcgtttgcgccgtgtttctgcttaacccttggactgccgggattatagttatggtgctggccttgatgactgttgagctgttcggcatgatgggactcataggaatcaaactcagcgctgtgcctgtggttattttaatcgcctcagtcggaattggtgtggagttcacagtgcacgtggccctagcctttctgactgctatcggcgacaagaacaggcgagctgtcctagcattggagcacatgttcgctcctgttctggatggagctgtttccaccttgctcggggttctgatgctggctggctcagagtttgacttcatcgtacggtatttcttcgcggtcctggccattctgaccatccttggtgtcctcaacggtttggtgcttcttcccgttctgcttagcttctttggcccctatccagaggtgagccctgccaatggacttaacaggctcccaaccccatctccagagccgcccccttcggtcgtgcgcttcgcaatgcccccagggcatacccattctggctccgatagttcggactcggaatacagtagccagacaaccgtgtccggactaagcgaggagctaaggcattacgaggcccagcaaggtgctggtgggccagcccaccaagtcatagtggaggccaccgaaaatccagtctttgcccattctaccgttgttcatccggaaagcaggcaccatccccccagtaatcctcgtcaacagcctcatttggattctggctccctgcctcccggccgtcaggggcagcaacctaggcgggacccccctagagagggtctatggccccccccttatcgtccaagacgagatgctttcgaaattagcaccgaaggtcacagcggcccctctaaccgggcacgttggggccctcggggggctaggtcgcacaatccgagaaaccctgcctctacagccatgggttcttctgttccaggatattgccagcctattaccaccgtgaccgcttcagcaagcgtcaccgtggctgtgcacccaccccccgtgcccggccctggacggaacccgcgagggggcctgtgccccggctaccctgaaacagatcacggcttgttcgaggacccccacgtgccattccacgttaggtgcgagcggcgcgacagcaaggttgaagttattgaactgcaggacgtcgagtgcgaagagaggccccgaggtagcagttcgaactag

SEQ ID NO: 16523 - DNA, 1059 bp, Artificial Sequence
  Description of Artificial Sequence: Synthetic coding sequence
aaggcggaagtgggccatggatacatggatagaccatgtctcaatcctgccgatcccgattgcccagctacggctccaaataagaactccacgaaacccctggacatggccctcgtattgaacggaggatgccacggtctttctagaaagtacatgcactggcaggaggaactgatcgttgggggcactgttaagaacagtactggcaaactggtgtctgcccacgccctgcagactatgtttcagctgatgacaccgaagcagatgtatgagcatttcaaggggtatgaatatgtctcacacattaactggaacgaggataaagcagccgcaatcctggaggcctggcagcgcacttacgttgaagtagttcatcagtctgtggcccagaactctacacagaaggtattgtccttcacaaccaccaccctcgatgacattttaaaaagctttagcgatgtgtcagtcatcagggtcgccagtggctacctgcttatggtcctccccttcttggccctcggggtcggagttgatgacgttttcctactcgctcatgccttttcagaaactggccaaaacaaacggatccccttcgaggaccgcacaggcgagtgcttgaaacgtaccggcgctagcgtggctcttacatctattagcaacgtgaccgcctttttcatggctgctttaatccccatccccgccctgagagcattctctttgcaggcagcagtggtagtcgtgttcaatttcgccatggtgctgctgatttttcctgccatcctgagtatggacctgtatcggagagaagatagaagattggatattttctgttgcttcacaagcccctgcgtgtcccgggtgatccaagtggagccacaggcatatactgacactcacgacaacacaaggtactccccgccacctccctactcctcgcactcctttgcgcacgagactcagatcaccatgcaatctacggttcagctgcggacagagtacgatccccacactcacgtctattataccaccgcagagccccgctcagaaatctccgtgtag

SEQ ID NO: 16524 - DNA, 4341 bp, Artificial Sequence
  Description of Artificial Sequence: Synthetic coding sequence
atggagctgcttaatcgaaaccggcttgtgatcgtcagcccaagatgtactccacccaaagcctcaggaggtccagcccggcggggattctacaccttccgcagtttctgtaaggacggcggcggcggagaggaagaagaagagaatggtggagaagaaaaggacgatcgcggcgacaaagaaactcggtcagataagggtaaggctaccggacgaaaagccccgctgtggctgagagccaagtttcagcgacttctattcaaactgggatgctacatccagaagaactgcgggaaattcctcgtggtgggtttattgatcttcggagccttcgccgtaggattgaaagccgcaaacctagaaacaaatgtggaagagctatgggtcgaggtaggcggccgggttagtcgtgaattaaattatacccgccagaagataggagaagaggccatgtttaacccccagctcatgatacagacacctaaagaggagggagcaaatgtgttaaccaccgaggccctgctccagcacttagacagcgccctccaggcctctagggtgcacgtgtacatgtacaatcgacagtggaagctggagcacctgtgttacaagtctggagagttgataactgagacgggctatatggaccaaatcattgagtacctctacccctgcctcatcatcacccccttggactgcttctgggagggagcaaagctgcagtccgggactgcctatctgttagggaagccgcccttgcgatggacgaatttcgatcccctcgagtttctggaggagctcaagaaaatcaactatcaggttgatagttgggaggaaatgttgaataaggcggaagttgggcatggatatatggatcgcccctgcttaaatccagcggatccagactgcccggcgaccgctcctaataagaacagcactaagccactcgacatggcgctcgttcttaacgggggatgtcatggactgagccggaaatacatgcactggcaggaggaactcatcgtaggggggaccgtcaagaactcgaccgggaagttggtgagcgcgcatgccctgcagacaatgttccagctgatgacccctaagcagatgtacgagcatttcaagggctacgaatatgtttcacacatcaattggaatgaagataaagctgcggccatccttgaggcttggcaaaggacctatgtggaagtggtgcatcagagtgtggcccagaatagcacgcaaaaggtgctgagttttaccaccaccactctcgatgatatactgaagtctttctccgacgtgagtgtgatcagagttgccagcggctacctactcatgctggcttacgcttgcctgaccatgctgagatgggactgcagcaagtctcagggtgccgtgggtctggccggagtgttgctggttgcactcagtgtggcagcaggcctggggttgtgtagcctgattggcatatcctttaacgcagctacaactcaggtgctcccctttcttgccttgggtgtgggcgtagacgatgtgttcctgctggcccacgcattctccgaaaccggccagaacaaacggattccgtttgaagacagaacgggtgagtgtttgaaacggactggagcttcagtggccctcaccagcatatcaaatgtgaccgctttttttatggcagcacttattccgatcccagccctccgggccttttctctgcaagccgccgtggtcgtggtgtttaattttgcaatggtccttttaatttttcctgctatcctgtccatggacttgtacagaagggaggatcgcagactagacatcttctgttgtttcacatctccatgcgtctcaagggtgatccaggtagagcctcaggcatatacggatactcatgataatactagatacagtcctcccccgccgtactcttctcatagtttcgcccacgaaacacagatcacaatgcagagcactgtgcagctgcgtaccgagtacgacccccacacccacgtttactacactacagccgaaccacgttccgagatctctgtacagcctgtcactgtgacccaggatactctgtcctgtcaatcaccagaatctacttccagcacccgggacctcttgagccaatttagcgacagcagccttcactgcttagaacctccatgtacgaagtggaccctttcatcattcgccgagaagcactacgccccttttctcctgaagccgaaggccaaggttgtagtcatctttctgtttttgggcctgctgggggtttccctatacggtacaaccagggtcagggatggtctcgacctcacagacatcgtgcccagagaaactagagagtatgatttcatcgccgctcagttcaagtatttttccttttataacatgtacatcgtgacacaaaaagctgattatcctaatattcagcatctgctgtatgacctgcataggagcttctccaatgtcaagtatgtgatgctggaggagaataagcagctcccaaagatgtggctccactactttcgagattggttacaaggattgcaggatgcattcgactcggactgggaaacaggcaaaattatgcccaacaattacaaaaatgggagtgacgacggagtcctggcctacaaactgttggtacagactggtagcagggacaaacccatagacatttcacagctgactaagcagaggctcgttgatgcagacggcataatcaatccatctgcattttacatctatttgacggcctgggtttccaatgatccagtggcctatgccgcttctcaagccaacatccgcccccataggcccgaatgggtacatgataaggcagactacatgcccgaaaccagattgcggataccagctgccgaaccaatcgagtatgctcagttcccattttatctgaacgggctgcgtgacaccagcgacttcgttgaggctattgagaaagtgagaaccatatgctcgaactacacttccttgggactgtcctcataccccaatgggtacccttttctgttttgggagcagtacattggccttcgccactggctgctgctatttatctcagtggtgcttgcttgtacattcctggtgtgtgcagtgtttctgcttaacccatggacagcgggcatcatcgttatggtgctagccctcatgacggtggagctcttcgggatgatggggctgatcggtattaaactatcagccgtcccagtcgtgatccttatagcctcagttggcatcggtgttgaatttacagtacatgtggccttggcatttttgacagccataggtgataagaatagaagagcagttctggccctggagcacatgttcgctccagtcttagacggagcggtctccaccttactgggagtcctaatgctcgcaggttcagaatttgattttatcgtccgctacttctttgctgtgcttgcaattttgaccatacttggcgtccttaatggcctggttctcttgccggtgctgctctcgttctttggaccttatccagaggtgtctccagctaatggcctcaatcgactgcctacccccagtcccgagccacccccatccgtggttagatttgccatgccccctgggcacacccactcaggatcagattcaagtgacagtgaatattcgtctcagactactgtatctggtttatccgaggaactgcgccattatgaagcgcagcaaggggccggagggcctgctcaccaggttatcgtggaagcaactgagaacccggtgttcgcacacagtacggttgttcaccctgaatcacgccaccaccccccgtccaacccccgccaacagccacacctcgacagcggatctctccctcctggtcggcaaggacagcaaccaagacgagatccaccacgagaaggactgtggcctccgccttaccgcccccgcagagacgccttcgagatctcaaccgaaggacactctggccctagcaaccgcgctcgctggggtcctcggggcgcgcgcagccacaacccacgaaaccctgccagtactgcgatggggtcttctgtacctgggtattgccagccgatcactacagtgaccgcctccgcatctgttacggtggcagtgcatccaccacctgtcccagggcctggccgaaacccacggggaggattgtgcccggggtacccagaaacagatcacggcctctttgaggaccctcacgtgcctttccatgttaggtgcgaacggcgggatagcaaggtggaggtgattgagctccaggacgtagaatgcgaagaacggcctagaggctcatcaagcaactag

SEQ ID NO: 16525 - DNA, 1758 bp, Artificial Sequence
  Description of Artificial Sequence: Synthetic coding sequence
ccatgccgaaaaagttcagccctgaacagccctaaagctgccgtggtcgtggtcttcaatttcgctatggtcctactgatttttcctgctattctctccatggatctttatcgtcgcgaagacagacgacttgacatcttctgttgcttcacatccccatgtgtctctcgggtgatccaagtggaacctcaggcctacacagacactcatgataacacgagatattctccacctccaccctatagtagccactcctttgctcatgagactcaaatcaccatgcagtccacagtgcagttgcgcacagagtacgacccacatacgcacgtttattatacaaccgccgaaccaaggagcgaaattagtgtgcagccagtgactgtgacgcaagacactctcagctgccagagcccagagagtacgtcaagcacccgcgacttactgtcccagttttccgacagctcactccattgcctcgaacccccatgcacaaaatggaccctgtccagtttcgctgagaagcactatgccccttttcttctcaaaccaaaagctaaggtggttgtaatctttctgttccttggactgctcggtgtgtccctgtatggtactacacgtgtgcgggatggcttggatctgacagacattgtccctcgtgagaccagggaatacgactttatcgcagcccagtttaagtacttttcattttacaatatgtacatagttacacagaaggcggactaccccaacatccaacaccttctgtacgatttgcataggtctttttctaacgtgaaatacgtgatgctcgaggaaaacaaacagctaccaaagatgtggctgcactatttcagggattggttgcaggggctccaggatgcctttgattcagattgggaaaccggcaagattatgcctaacaattataagaatggttccgacgatggggtcctagcgtacaagcttctagtgcagactggtagcagagataaaccaattgatattagtcagttgacaaagcagcgattagttgacgccgacggaataataaatccctctgcgttttatatctaccttactgcctgggtctcaaatgaccctgtagcatacgctgcgtcacaggcaaacatcagaccacaccgacctgagtgggtgcatgataaagcggactatatgcctgagactaggctgaggataccagcagcagaaccaatcgagtacgcccaattccccttttacctgaatggtctacgtgacacttcagattttgtggaggccattgagaaggtgaggaccatatgcagcaactacacgtcccttggcctgtccagttaccctaacggctaccccttcttattttgggaacagtatattggtctccggcattggctgctacttttcatctcagtggtactagcttgtaccttcctggtgtgcgcagtgttcctgttgaatccctggaccgccggcatcatcgttatggtgcttgccctgatgaccgttgagctgtttggcatgatgggcctcattggaattaaactaagcgccgtgcccgtggtcattttgatcgcctcagtgggaattggcgtggaattcactgtgcacgtagcactggcatttctgacagctattggcgataagaaccgccgcgccgtgctggctctcgaacatatgttcgcccctgttctcgacggcgcagtgagcaccctgctgggagtattgatgctggcaggatccgagtttgatttcattgtctag

SEQ ID NO: 16526 - DNA, 729 bp, Artificial Sequence
  Description of Artificial Sequence: Synthetic coding sequence
atgccccctggtcacacgcattcaggttcagattcttcagactccgagtactcgtctcagactaccgtctcgggattatcggaagagctgcgtcactatgaagcccagcagggcgccggcgggccagcacatcaggttatcgtggaagcaacggaaaatcccgttttcgcacatagtaccgtagtgcacccggagtcgagacatcatcccccatccaatcccaggcagcagcctcacctggacagtggatccctccctccgggccgtcaaggacagcaaccacgccgcgacccgccgcgagaaggactttggcctccaccttatcggccccgccgggacgcctttgagatatctactgagggccactctgggccatccaaccgggcacgatgggggccgaggggcgctagatctcacaaccctcgtaatcctgcttcaaccgcaatgggctccagcgtgcctggctactgccaacccattactacagttaccgcatctgcctcggtgaccgtagccgtgcatcccccgcccgttcccggccctgggaggaacccgcggggggggctctgccccggctatcctgaaacggatcacgggctgtttgaggacccaacctgtctgtcgacctcaggtgtgagaggaggaatccggcgctggaaaagcctcagctgtaggacatggaacgccaggcggggccccggagaagccgcccctaccgaaggggattag

SEQ ID NO: 16527 - DNA, 1461 bp, Artificial Sequence
  Description of Artificial Sequence: Synthetic coding sequence
ggcaaggccactgggcgcaaagcaccgctgtggctccgtgccaagtttcagcgcttactctttaaactgggttgttacatacaaaagaactgtggcaagtttctcgttgtgggacttctgatcttcggcgcattcgccgtcggcttgaaagcagcgaacctcgaaaccaatgtcgaggaactgtgggtggaggtgggcgggagagtttcacgcgagttgaattatactcgacaaaagataggggaggaggctatgtttaatcctcaattgatgatccagaccccaaaagaggagggcgccaacgtgcttactaccgaggctttgctgcaacatctggacagcgccttacaagcctcgcgcgttcacgtgtatatgtacaaccggggtaaaccccccctgcgttggaccaactttgatcctctcgagtttcttgaggaactgaagaagattaactaccaggttgactcatgggaagaaatgcttaataaggccgaggtcggacacggctacatggatcgcccctgcttgaatccagcagatcccgactgtccagctacagctccaaacaagaacagcactaaacccctcgatatggcacttgtcttgaatggtggctgccatgggctgtctagaaagtatatgcactggcaagaggagcttatcgtaggcggcactgtgaagaatagcaccggaaaacttgtgtctgcccacgccctccagaccatgtttcagctcatgactcccaagcagatgtacgaacactttaaaggttacgaatatgtgagtcacatcaactggaatgaagacaaggccgcagctatcctcgaagcttggcagcgtacctacgtggaagtggtgcaccagagcgtggcccagaattccacccaaaaagttctctctttcacgacgactacgctggacgatatcctaaagtccttttcagatgtctccgttattagggtggcctccggatacctactcatgctggcctatgcatgcctgacaatgctgaggtgggattgtagtaagtcccaaggagcagtggggttagcaggagtccttttggtggccctctcagtcgctgctggactaggtctctgtagcctgattgggatttcgttcaatgcggccactacacaggtgttaccctttttggctctcggcgtcggtgtcgacgatgtgttcctcctggcacatgcgttctctgagaccggtcagaacaaacggattcccttcgaagacagaacgggtgagtgcttgaaacgtactggagcttccgtggccctgacctcgattagcaatgtgaccgccttttttatggccgccttaataccaattccagctttgcgtgccttcagcttacaatacattctgatggcccacagaggcaggctgagtttcaatgacaccctctggtgcggaggcttgaaatcatatatgagattcccatacgaggagtag

SEQ ID NO: 16528 - DNA, 3891 bp, Artificial Sequence
  Description of Artificial Sequence: Synthetic coding sequence
atgtttaatccacagctgatgatccaaacacccaaagaggaaggtgctaacgttctgacaactgaagccctgctccagcatttggatagcgcactccaggcttccagagtgcatgtgtatatgtacaatcgccagtggaagctggaacatttgtgctataagtcaggtgagctgattactgaaacggggtatatggaccaaataatcgaatatctgtacccatgtctcatcatcacccccctcgactgcttctgggaaggggcaaagctacagtcagggacggcctacttactgggaaagccccctctcagatggacaaacttcgaccctctggaatttcttgaagagctcaaaaagatcaattatcaggtggactcatgggaagagatgctgaacaaggccgaggtgggccacggctacatggacagaccctgtttgaatcccgctgaccctgactgcccggcaactgcccctaacaaaaatagcaccaaaccactcgacatggctctggtgctgaatgggggatgtcacggcctgagccgaaaatacatgcactggcaagaagagctcatagtcggtggaactgtcaaaaacagtaccgggaagctggtttccgctcacgccctgcaaacaatgtttcagctgatgacccctaagcagatgtatgagcacttcaagggttacgagtacgtgtcccacataaattggaacgaagataaagccgcagcgatacttgaagcctggcagagaacttatgtcgaggtggtgcaccagtctgtggcgcagaattcaacgcagaaagtactgagcttcaccaccaccacccttgatgatattctgaagtcattttcagatgtgagcgttattcgagtggccagcggatacctgttgatgctggcctatgcatgccttaccatgcttaggtgggattgttcgaaatctcaaggagccgttggtctggctggcgtgctattggtcgccctgtccgttgccgcagggctcggactatgctccctgatcggcattagcttcaacgcggccacaacgcaggtccttcccttcttagcccttggtgttggcgtagacgacgtgttcctgctagcacacgctttcagcgaaacaggacagaataagaggataccctttgaagatcgtacaggggaatgcctgaaaagaaccggcgcatcagtcgccctcacttcaatttccaacgtgacggccttctttatggccgcactcatccccatcccagcacttagagctttttccctccaggccgccgtggtggtggtgttcaattttgccatggtcctactgatcttccctgcgatactatctatggacttgtaccgccgcgaggatcgtagattagacattttttgctgtttcacatcgccctgcgtgagtagagtgatacaggtcgagcctcaggcatacaccgatacgcacgataacacgagatatagcccaccgcctccatattcttcacacagcttcgcccacgagactcagattactatgcagagtacagtgcagctcagaacagagtacgatccccacacacatgtctactacacgactgccgagccccgatccgagatttcggtgcagcctgtgaccgttactcaggacactctgagctgtcagagcccagagtccaccagctctacgcgggacctcctgtcacagttttccgattcgagcctacattgcctcgagccgccctgcaccaagtggactctgagcagcttcgcagagaagcactacgcacccttcctgctgaagccaaaggctaaggtggtcgtgatctttctttttctaggcctgctgggggtgagtttatacggcacgaccagagtccgggacggcctggatctcacagacatcgtgccccgagaaacgcgcgagtacgactttatcgccgcccagtttaagtacttttccttctataacatgtacattgtaacacagaaggccgactaccccaatattcaacacctgttgtatgatttacaccgctcgttttcaaacgtcaagtacgtaatgctggaggagaataaacagctgccaaagatgtggctccattacttcagggactggctccagggactacaggatgcgtttgactcagactgggaaacagggaagataatgcccaacaattacaaaaacgggtccgacgacggagttctggcgtataagttgttagtccagacagggtctagagacaagcccatcgatatatctcagttgaccaagcagcgccttgttgacgctgatggcataattaacccatccgcattctatatttacctaacagcctgggtgtctaatgaccctgttgcttacgccgcgagccaagccaacattagacctcacagacccgaatgggtacacgacaaagctgattacatgcctgaaaccagactgcgcattcccgccgccgagcccattgaatacgctcaatttcccttctatctgaatggtctccgtgacacgtctgactttgtcgaagccattgagaaagtgcggaccatttgctccaactatacttctctcggattgtccagctaccccaatggctacccttttctgttttgggagcagtatattgggctgcgccactggctgctcctattcattagtgtcgtgctcgcttgtacattcctggtctgcgctgtgttcctactgaacccgtggaccgcgggtataatagtcatggtgctggcactcatgaccgtggagttgttcggcatgatgggcctgatcggaatcaagctttcagctgtgccggtagtgattttgatcgcttctgtgggcatcggcgtggaattcaccgtccacgtagctctggcctttcttaccgctatcggagacaaaaacaggagagcggtgctggcactagaacatatgttcgcccccgtcctcgacggtgccgtctcaacactgctgggagtgttgatgttggccggctcagagttcgatttcattgtgagatatttttttgcagttctggcaatactcactattctgggtgtcctaaacgggctcgtactgctccctgtgctcctctcattttttggtccctaccctgaggtgtccccggccaacggcttgaatagactccctacaccttctcctgaaccacctccgagcgtggtgcggtttgctatgccacctgggcatacccattcgggcagtgatagctccgactcggagtatagctctcagactacagtttctgggctgagtgaggaactgcgccattacgaagctcaacaaggtgcgggaggccctgcgcatcaagtgatagtagaggcaacagaaaatcctgtcttcgctcattcaactgtggttcatcccgaatcgcgacatcaccccccgtccaacccccgtcagcagccgcacctggacagtggtagtttacctcctggacgccagggacagcagcccagaagggaccctcccagagagggtttgtggcctcctccctaccgcccccggcgcgatgcattcgagatctccactgaggggcattccggacctagtaatcgcgcacgatggggcccacgcggtgctcgctctcacaatccccgaaatcctgcgtctactgcaatggggagcagtgtgcccgggtattgccaacccattacaactgttacagcaagtgcaagcgtcactgtagccgtgcatcccccacccgtgcctggcccagggagaaatccccgcggcggcctatgccctggataccctgaaacggaccatgggctgtttgaggacccccacgtcccttttcacgtgcgatgtgaacgtagagacagcaaggtcgaggtgatcgaactgcaagacgtggagtgtgaggagcgaccacgtggtagcagctcaaattag

SEQ ID NO: 16529 - DNA, 3891 bp, Artificial Sequence
  Description of Artificial Sequence: Synthetic coding sequence
atgtttaacccccagctaatgattcagacgcccaaggaggaaggtgcaaacgttcttacaacagaggcactcctacaacacttggacagcgctcttcaggctagcagagtgcatgtgtatatgtacaacagacagtggaaactggagcatttatgttacaaaagcggggaactgattaccgaaacaggatacatggaccagatcattgagtacttatatccctgcctgattattacaccactggattgtttttgggaaggggccaaattgcagagtggcacagcatatctgctgggcaagccgcctctgcgctggaccaactttgatccattagaatttctggaggagttgaagaaaattaattaccaggttgacagctgggaggagatgttgaataaagccgaggtgggtcacggttacatggaccggccatgtcttaatccagccgatccagattgtccagctacggcccccaataaaaacagcactaaaccactagatatggccctggttctgaacggcggctgccacggactttcaaggaagtatatgcattggcaggaagagctgatcgtcggcggcactgtcaagaactcgacaggcaagcttgtgtcagctcacgcactgcagactatgtttcagctcatgacaccgaagcaaatgtacgagcacttcaaagggtatgagtatgttagtcatatcaactggaatgaggacaaagcagctgcaattttagaggcctggcagaggacgtatgtagaagttgttcatcagagtgttgcccaaaatagcacacagaaggtattatcattcacgaccactacactcgatgatattcttaagagctttagtgatgtttctgtcatcagagtggcctccggctatcttctgatgctcgcttatgcttgcctcacaatgttacggtgggattgtagcaagagtcagggggccgtgggtctggctggggtacttttagttgcattgtcagttgccgccggcttgggcctttgttcactgatcggaatttctttcaacgctgctaccacacaagttctgccattcctggcccttggagttggtgtggatgacgtgttcctgctggctcatgcctttagcgaaacaggacagaacaagcggatccctttcgaggaccggacaggggagtgcctcaagcggaccggcgcctcagtggcactgacatcgatcagcaacgtgaccgcgttttttatggcagccctgatccctatccctgccctcagagctttttcccttcaagccgccgtggtggtggtcttcaattttgctatggtgctcctgatttttcccgcaattctctcaatggacttgtatcggcgcgaggatcgtcggctagatatcttttgctgttttaccagtccttgtgtttcccgagttatccaggtggagccacaggcatacacagacactcacgacaacacaagatattcccccccgcccccatattccagtcactctttcgctcatgaaacacagattacgatgcagagcacggtccaactgagaaccgagtacgatccccacacacacgtgtactacactactgcggagcctagatctgaaataagcgttcagcccgtgaccgtaacccaagacacgctaagctgccagtcgcctgaaagcacctcctccacgagggatctgcttagtcaattttcagactcctctctgcactgcctagaacccccatgtacaaaatggacactatcgtctttcgcagaaaagcattatgcccccttccttttgaagccgaaggccaaggttgtagtgatcttcctctttctgggcctattgggggtctccctgtacggaacaacaagagttcgcgacggtctagacctgactgatatcgtacctagagagactagagaatacgattttattgcagcccagttcaagtacttcagtttttataacatgtacatcgtgacccagaaggctgactacccgaacatacaacacttactctacgacttacaccgaagtttcagcaatgtgaagtatgtcatgctggaagaaaacaaacagctgcccaaaatgtggctccattattttcgcgattggctgcaagggctgcaggatgcctttgacagcgactgggagactggtaagattatgccgaacaattacaagaatggtagcgatgatggagtccttgcctataaactgctagtgcaaacagggtcaagagacaagccaatagatatttcgcagctcaccaaacaacggctggtggacgccgatggaatcatcaatcctagtgccttctacatttacctgacggcctgggtctcaaatgaccctgtcgcatacgcagcaagccaggcgaatatccgccctcatcgtcctgagtgggtccacgataaggcagattatatgcccgaaacacggctgcgtattcccgcagctgaaccgattgaatatgcgcagtttcccttttatttaaatggactgagagacactagtgacttcgtcgaggctatagagaaagtgaggaccatctgctccaactatacatccctgggactgtcctcctatcccaacggttatccatttctattctgggagcagtacattggcctcagacattggttactgctctttatttcagtggttctggcctgtacttttctggtctgcgctgtgtttttgcttaacccttggacggccggcattattgtgatggtgcttgccttgatgaccgtggaactattcggaatgatggggcttattgggataaagctaagtgccgttccggttgtgatcctgatcgccagtgttggcatcggcgtggagtttactgtgcatgtggccctggcgtttttgaccgcaatcggcgacaaaaacagaagagcggtgctcgctcttgagcacatgtttgccccagtcctggacggcgcagtgtccacactcctaggggtcctgatgctggctggaagcgagttcgacttcatagtgcggtatttctttgccgtactcgccattttaaccatactgggagtgctcaatgggttggtgctattgcccgtgctgctctctttctttggtccatatcctgaggtcagtcccgccaacggactaaatcgtttgcccacccccagtcctgagccccctccgagtgtggttcgatttgcaatgcccccaggccacacacatagtggatctgattcatcggattcagagtactccagccaaaccaccgtgagcggcttaagtgaagaactgaggcactatgaggcccagcagggcgcaggcggacccgcccaccaagtcatcgttgaagcgacggagaacccggtttttgcccactctaccgtggtgcaccccgagagccggcaccacccaccaagcaacccaagacagcagccccatttggactccggcagtttaccacccggcagacaggggcagcagccacgacgcgatccgccgcgcgaggggctttggcctccaccatatcggcccagaagggacgcttttgaaatatcaacagagggccactcaggaccttcgaacagggcacggtggggccccaggggtgctcggtcccataatcccaggaatccggcgagcacagccatggggtcaagcgtgcccggctactgtcaaccgatcaccaccgtaactgcatctgcatccgtaacagttgccgtgcatcccccacctgttccggggcctgggcggaatccccggggcggactgtgtcctggatatcccgagaccgatcatggcctatttgaggacccccatgtgccattccatgtgcggtgtgagcgtagggattcaaaggttgaagttatcgagctacaagacgttgagtgcgaggagagacctcggggctcatccagcaattag

SEQ ID NO: 16530 - DNA, 3891 bp, Artificial Sequence
  Description of Artificial Sequence: Synthetic coding sequence
atgttcaatccacagttgatgattcagacacctaaagaagaaggagccaatgttctcacaacggaggcgctgctgcaacatttggacagtgccctgcaggcgtccagagtgcacgtgtatatgtacaataggcagtggaaactggaacacttatgctacaagtccggggaactgatcacggaaacaggctatatggaccaaatcatagagtatctgtacccttgccttatcattacacctttggattgcttctgggagggcgctaaacttcagtccggcactgcctaccttctgggcaaacctccccttaggtggactaactttgaccctctggaattcctagaagaactgaagaagatcaactatcaggtcgatagctgggaagagatgctgaataaagccgaagtgggccatggttacatggaccgcccctgtctgaatcccgctgatcctgattgcccggctacagctcctaataaaaattccactaaaccattagacatggctcttgtattaaacggtggatgccacggtttaagccggaagtacatgcactggcaagaagaacttatagttggcggaaccgtgaagaactcaacagggaaactggtctctgcccatgctctccaaacgatgtttcagttgatgaccccgaagcagatgtacgaacattttaagggctacgaatacgtaagtcatattaattggaacgaggataaagccgctgccattctcgaagcgtggcagaggacatacgtagaagtggttcaccaaagcgtggcacagaactccacacagaaggtgcttagttttaccacaaccaccctcgacgatattcttaaaagcttctccgatgtatccgtcattcgcgtggcctcaggatacctcctgatgctcgcttacgcatgtctcacaatgctacgctgggattgcagcaagagccagggcgcagtcggtctggccggagtgctgctcgtcgccctgagcgtagcggccgggctgggtttatgctcccttatcggtattagctttaacgcagctaccacccaggtcctgccatttcttgccctgggagtgggggtagacgatgtatttttactcgcccatgcgtttagtgaaacaggccagaataagcgcatcccgtttgaagacaggaccggcgagtgtctcaagaggacaggagcaagtgtcgccttaacctcgatttcgaatgtcacagccttttttatggctgccctgattcctatccctgccctccgcgctttctccctacaagctgcagtcgtagtggtattcaattttgccatggtgctcctgatatttccagctatccttagtatggatctttaccgtcgcgaggatcggcggctcgatatcttctgttgttttacaagcccatgcgtctctagagtcatacaggttgagccccaggcatacaccgatacccacgataacaccaggtacagtcccccacccccctactcttcccactcttttgcccacgagacgcaaattacgatgcagagcaccgtacagctgcgaacagaatacgatccccacacacacgtgtactacacaacagccgagcctcgctccgaaattagcgtgcagcccgtgactgtgactcaggacaccctgtcctgtcagtctcctgaaagcacatcttccacccgggatctcctttcacagttttcagactctagcctccattgcctggagcccccgtgtaccaagtggacgctgtcttccttcgctgaaaagcactatgcaccttttttgctcaaacccaaggccaaggtggtggtgatatttttgttcttaggcctcctgggggtgtccctttacggtacaacacgcgtgagggatggactggacttgactgacattgtacctcgggagacccgggaatacgattttattgcagcccaattcaaatacttctcattttacaatatgtacatcgtaacccagaaagccgattacccgaatatccagcaccttctctatgatctacaccggtccttcagtaatgtaaagtacgtgatgcttgaagagaacaaacagctccccaagatgtggctgcattacttccgcgattggcttcagggtctgcaggatgcgtttgactctgactgggagaccggcaaaatcatgccaaataactacaagaatggtagcgacgatggagttctagcttataaacttctggtgcagacaggatcccgagacaagccgatcgatatttcacaactgacaaaacagcgcctcgtcgacgccgatggcatcatcaaccctagtgcgttttacatctaccttaccgcgtgggtgtctaacgaccctgttgcatatgctgcttcacaggcaaatatcaggccgcataggcccgagtgggtgcatgataaagctgattatatgcccgaaacccggcttagaatcccggcagcagaacctattgagtacgcacagtttcccttttacttaaacggattaagagacacatccgatttcgtcgaggccattgagaaggtccgaaccatctgctctaattacacatctctcggcctatcctcttatcctaatggctatcccttcctcttctgggagcagtatattgggcttaggcactggctgctgctattcatctccgtagtgctggcttgcacattcctcgtctgcgctgtattcctgctgaacccctggaccgcaggcatcattgtgatggtcctggctttaatgaccgtagaactatttgggatgatgggccttataggaatcaagctcagtgccgtgcctgtcgtgatcttgatcgccagtgtggggatcggggttgagtttaccgtgcacgttgccctggcatttctgacggcaattggtgataaaaaccgacgagcagtgcttgctctcgaacacatgtttgccccagtccttgacggcgctgtgagcaccctacttggtgttttaatgctggccgggagtgagtttgacttcattgtgcggtacttcttcgctgtactcgctattctgactatcctgggcgtgctcaacggcttggtattactacctgtgctgttatccttttttggcccatatcctgaagtctctcctgccaacggactgaacagactgcctaccccttccccagaaccaccaccctccgtggtgaggttcgccatgccgccgggccacactcattccggcagcgattcttctgactcagaatattcctcgcagacgacagtgtccggtctgtccgaagagctgagacactacgaggcccagcagggggcaggcgggcctgcacaccaggtgatcgtggaagcaactgaaaatcccgtattcgcacatagcaccgtggtgcatcctgaatctcgacaccatccaccttctaaccctcgccagcaaccccacctggactccggctctttgccaccgggacgacaaggccaacagccccgtcgggaccccccccgggagggtctctggccccctccctaccgcccacggcgcgatgcttttgagatctccaccgaaggtcacagcggaccatcgaatcgtgcccgctggggacccagaggcgctcgttcccacaatccaagaaacccagcctcgacagcaatgggaagttctgtccccggctactgccaaccgatcaccactgtgactgcatccgcgagcgtcacagtggccgtgcaccccccacctgtgccaggcccgggcaggaacccccgcggaggcctctgtcccgggtatccagaaactgaccacggcctgtttgaggacccccatgtgccattccacgtgagatgcgagcggcgcgactcgaaggtggaagtaatcgagctgcaggacgtagaatgtgaagaacggccgcgcggtagcagcagtaattag

SEQ ID NO: 16531 - DNA, 4146 bp, Artificial Sequence
  Description of Artificial Sequence: Synthetic coding sequence
atgggtaaggcaactggtcgcaaggcaccattgtggcttcgagccaagtttcagcgcctactcttcaagctcggatgctacatccagaaaaactgcggcaagtttcttgtcgtcggactgctgatcttcggcgcctttgctgtgggactcaaagccgctaatctcgagactaacgttgaggaactgtgggtggaagtcggagggagagtgtctcgtgagcttaactacactaggcaaaagattggggaagaagccatgttcaatccacagttaatgatccagacaccaaaagaggagggcgccaatgtgcttacaacagaagccctgctgcagcacttagactccgcgctgcaggcgagccgtgtgcatgtctatatgtataatcgccagtggaagctcgaacatctatgctacaagagtggggagctgatcaccgagaccggatacatggaccagatcatagagtatttgtatccttgtctaattatcacccccctggactgcttttgggagggcgccaaactccagtcaggtacggcgtatctactgggaaaacctcccctgcgctggactaacttcgatcctctggagtttctagaggagttgaagaaaatcaactatcaagttgatagttgggaagaaatgctgaataaggcggaggtaggccatggatacatggacaggccttgtctaaatccagcagacccggattgccccgctaccgcccccaataaaaattctacaaaaccattggacatggccctggttctaaatggaggttgccatgggctgagccgtaagtacatgcattggcaggaagaattaattgtaggaggaaccgttaaaaacagtactggaaagctggttagtgcccacgctctgcagacaatgtttcagctgatgactcccaaacagatgtacgaacatttcaagggctacgagtacgtttctcatatcaactggaacgaggacaaggctgcagccatcctggaggcatggcaaagaacctatgttgaggtcgtgcatcagtcggttgcccaaaactctacgcagaaggttctgagcttcacaaccactacgttggatgacatcttgaagtcttttagtgatgtaagcgtaattcgggtcgcatcgggctatcttctgatgctggcctacgcgtgtctcaccatgttgaggtgggactgttctaaatctcaaggcgccgtcggactggccggggtgcttctcgtcgcgctctctgtggcagctgggttaggactatgctcactcattggtattagcttcaatgctgctaccacccaggttctgccatttctggcactcggtgttggagtggatgatgtgtttttgctggcgcacgcctttagcgaaaccggccaaaataaaaggattccgttcgaagaccgaacgggtgagtgcttgaaaaggacgggggcttcggttgcgctgacttcaatctccaacgttaccgccttctttatggccgcactcattcccatccctgcacttagggcctttagcctgcaggcagccgtcgtcgtcgtgtttaatttcgccatggtcctcctgatttttcccgcgatcctttcaatggacctgtaccgtcgggaagaccgccgtctcgacatcttttgttgctttacctccccctgcgtgtcccgcgtgatacaggtggagccacaagcttatactgatacccatgataacacaaggtattcccctcctccaccatacagtagtcatagctttgcacatgaaactcagattaccatgcagagtacagttcagcttcggacggagtacgaccctcatactcacgtgtactatactactgcggaaccacgcagcgagatcagtgtgcagccagtaactgtaacgcaggacacactgtcgtgtcagtcaccagagtccacctcatctaccagggacctgctgagccagttctcagatagctccctacattgtctggaaccaccttgcaccaaatggaccctgtcttcatttgccgaaaaacattacgctccattcctcctaaagcctaaggccaaggtggtggtcattttcctgttcctgggcctgctcggcgtgtccctttacggcactactagggtaagggatggcctagatttgacagacatcgtgccacgcgaaacccgcgagtacgatttcatcgccgcacagttcaaatatttttcattctataatatgtacattgtaacccagaaagccgactacccgaatattcagcatttgctctacgaccttcacagaagttttagcaatgtcaaatatgtgatgctcgaagaaaacaagcagctgcccaagatgtggctccactacttccgagactggttgcagggcctccaggatgcattcgactccgattgggaaacaggaaagatcatgcccaataattacaagaatggttcggatgatggtgtgctcgcctacaaattgctggtgcaaactggatcgcgcgataagcccattgatatcagccagctcactaagcagcgtctggtggatgccgacggtataatcaatcccagtgctttttacatttatctcaccgcctgggtatccaatgatcctgtggcgtacgcagctagccaggctaacatcagacctcacagaccagaatgggtccatgataaagcagactatatgcccgagaccaggctgcgaatccctgccgcagagcctatcgaatatgcccaatttccattttacctgaatggactgagggatacttctgatttcgtggaggcgatcgaaaaagtgcgaacaatctgttctaactacacatctttgggtttaagcagttatccaaacggatatccttttctgttctgggagcaatacattggtcttagacattggctactgcttttcatctctgtggttcttgcgtgcacctttctcgtgtgtgccgtctttcttcttaatccttggaccgctggtatcattgtgatggtgctggcgctgatgacagtggagcttttcgggatgatgggactgattggaataaagctgtcagccgtccctgtggttatcctgattgcctccgttggaatcggcgtggaatttaccgttcacgttgccttagcttttttgaccgccatcggagataagaacaggagggctgtgcttgcacttgaacatatgtttgctcctgtgctggatggcgcagtgtcaacactcctcggcgtgctgatgctcgccggaagcgagttcgactttatcgtgcgatactttttcgccgttctggcgattctgactattctgggcgttctgaatggactcgtcttacttccagtactacttagttttttcgggccatatccagaggtgagtcctgccaacgggttgaatagacttcccaccccctctcccgagcctccaccctctgtggtgaggttcgccatgccaccaggtcacacacatagcggcagtgattcctcagactcagagtatagttcacaaacaaccgtctctggactgtccgaggagctacgccactacgaagcgcagcaaggggccggggggcctgcccatcaggtgattgtggaagcgactgagaaccctgtttttgcccattcaaccgtggtgcatccggaatcccgccatcatcctccatcaaatccacggcaacagccccacttggactctgggtcactcccacccggtcggcagggtcagcagcccaggcgcgacccgccacgagagggcctgtggcctcctccttatcgaccccggcgggatgcttttgagatctcaacagagggccattctggtccctctaacagggctcgatggggcccccggggcgcccgatcacataaccccagaaaccccgcttctacagcgatgggctcaagcgttcccggttactgtcagccaatcactacagtcactgcaagcgcctcagttactgttgccgtgcatccccccccagtcccaggccccggacgaaatcctcggggggggctctgtcccgggtaccctgaaacagaccacggtttgtttgaagacccacacgtacctttccacgtccggtgcgaaaggagagattcgaaggtggaagtgatcgagttacaggatgtcgaatgtgaagagcgtccccgcggttccagtagcaattag

SEQ ID NO: 16532 - DNA, 4146 bp, Artificial Sequence
  Description of Artificial Sequence: Synthetic coding sequence
atgggcaaagctacaggccgcaaggcacccttatggctgcgcgcaaaatttcaaaggctgctcttcaaactcgggtgttatattcagaagaactgtggcaagtttctggtggtgggtcttttaatctttggcgctttcgcggtgggcctcaaagctgccaacctggaaactaacgtcgaggaactgtgggtagaggtgggcggccgggttagtagggagctgaattacacccggcaaaaaattggggaggaggccatgttcaacccacagttaatgattcagacccccaaggaagagggggcaaatgtcttgactaccgaggcccttcttcagcacctggattcggctctccaggccagccgggtacacgtgtatatgtacaatcgacagtggaaactggaacacttgtgttacaagtctggggagctgattacggaaaccggatatatggatcagattatagagtacctttacccgtgcctcattattacgcctttggattgcttttgggagggtgcaaaactgcagtccggcacagcgtacctcctggggaaaccacccttaaggtggaccaattttgacccgctggaattcttggaggagctgaagaagatcaactatcaggtcgattcatgggaggaaatgctgaataaagctgaagtcggccacggatacatggaccgcccatgtctgaatccagcagaccctgattgtccagctacagctcctaataagaacagtacaaaacccttggacatggcccttgtgctgaacggcggctgtcatggcctgagtaggaaatacatgcattggcaggaggagctgattgtcggaggcactgttaagaattctactggaaaattggtgtcggcccacgcactgcaaacaatgttccaactaatgacgcccaagcagatgtatgaacattttaaaggttatgaatacgtcagccacatcaactggaatgaggataaagccgcagcaatcctggaggcctggcagaggacttacgtcgaagtggttcatcagagcgtcgcccagaacagcacacagaaggtcctttcatttaccaccacaactctggacgacattctcaaatcctttagtgacgtgagcgtgatcagagtcgccagtggctatcttctgatgcttgcatacgcctgtctgacaatgttgcggtgggattgctcgaagagccaaggggcagtcggcctcgctggggttcttttagtcgcgctgtccgtcgccgcagggctggggctgtgttcactgatcggtatttcattcaatgccgctacaacacaggttttaccatttttggcgctgggagtcggagttgacgacgtgtttctgctggcacatgccttttcggaaaccgggcagaacaaacggatccccttcgaggatagaaccggcgagtgtctgaagcggaccggggcatcagtcgcattgacgtcaatctctaacgtgaccgctttctttatggctgccctcattcccatccctgcccttagggccttttcactacaggctgcagttgtggttgtctttaatttcgcaatggtcctcctgatcttccccgctatccttagcatggatctttaccgccgggaagatagacgtctcgatatcttctgctgctttactagtccctgcgtcagccgcgtgatccaggtggagccccaagcatataccgatacccacgacaataccagatacagcccacctcccccttatagctcccacagctttgctcatgagacgcagattactatgcaatccaccgtgcagctaaggactgagtacgatcctcacacacacgtatactacaccactgcagagcccaggagtgagatctcagttcagcccgtcacggtcacccaggacaccctgtcttgtcagtcccccgaaagcacatcatccacgcgagatctcctgagtcagttctcagattcttccctgcattgtttagagccaccctgtaccaaatggactctctcttcattcgcagagaagcactacgcacccttcttacttaaaccaaaagcaaaggtggtcgtcatcttcctgttcttaggtctcctgggtgtctcactgtacggaaccacgcgcgtccgggacggcctcgaccttaccgacatagtgccccgggagaccagggagtacgatttcattgcggcgcagttcaagtacttctctttttacaacatgtacatcgttacacagaaagcagactaccccaacatacagcatctgctttacgacctgcataggtccttctccaatgtcaaatacgtgatgctggaagagaacaagcagctgcctaaaatgtggttgcactattttagagactggctccaggggctccaggatgctttcgactctgactgggagaccggaaagataatgccgaacaactacaaaaatggaagtgacgacggagtcctggcgtacaaactgctcgtacaaaccggatctagggataaaccaatcgatattagtcagcttacgaagcagaggctggtcgacgccgatggcattataaatccatcagctttttacatctacctgacggcctgggtgagtaacgaccccgtcgcatacgccgccagccaagcaaatattcgtccccatcgacccgagtgggtccacgataaggctgattatatgcctgagacccgcttacgaattcctgcagccgagcctatagaatacgcccagtttcctttctacctgaatgggctcagggatacttccgattttgtcgaagccattgaaaaggtgcggacaatttgctccaactacactagccttggactcagcagctatcccaacggatatccctttctgttttgggagcaatatatcggattgcgccactggctactgctcttcatctcagtagtgctggcctgcaccttccttgtttgtgctgtgtttctccttaacccttggacagccggaatcattgtgatggttctggccctgatgaccgtcgaactttttgggatgatggggctaatcggtataaaactttccgcggtaccagtcgtcattctgatcgcaagtgtgggaatcggagtggagttcacagtacacgtcgccctggccttccttacagccataggagataaaaatcggagggctgtgctggcactcgagcacatgtttgcacccgtactggatggggccgtaagtactctgctgggcgtgcttatgctggcaggctccgagttcgatttcattgtgcgctactttttcgcagtgctagcaattttgacgatcctgggggtcttgaatggactggtactcctgccagtcctgttgagcttttttgggccatatcccgaggtgtccccagcgaacggtctgaatagactccccaccccgagtccagagccacctcccagcgtcgtgcgcttcgctatgcctcctgggcatacgcactctggttccgattcatccgactcagagtatagtagccaaaccacagtgagcggactctccgaggagctgaggcactatgaagcccagcagggggctggcggaccagctcaccaggtgattgtcgaggcaactgaaaatccagtgttcgcacattcaaccgtagttcatcccgagtcccgacaccatcccccgagcaatcctagacagcagcctcatctggattccgggagtctaccaccggggagacaaggccagcagccacggcgggatccccctcgggagggcctttggccgcccccatatcggccgcgacgcgacgcttttgagataagtaccgagggtcacagtgggcctagcaatagagcacgctgggggccacgcggcgcacgcagccacaacccccgtaatcccgccagcactgcaatgggtagtagcgtcccagggtactgtcagcccatcactacagtcacggctagtgcttcagtcaccgtcgctgtgcatccaccacccgttcccggaccagggagaaatccacgaggtggcctctgcccgggatatccagagacagaccacggcctatttgaagatccccatgttccctttcatgtccggtgcgaacggcgggacagtaaggtcgaggtcatcgagctgcaagatgtagagtgtgaagaacggccccgggggagtagttccaactag

SEQ ID NO: 16533 - DNA, 255 bp, Artificial Sequence
  Description of Artificial Sequence: Synthetic coding sequence
atgggcaaggctactggcagaaaagcacctttgtggctacgcgcaaaatttcagaggctgttgttcaagctcgggtgttacattcaaaagaattgcggtaagtttctcgttgtagggttactgatcttcggagcctttgcagtggggctgaaggcagcaaacctggagacaaacgtggaagaactgtgggtcgaagaggttaatctgctgtgtggggggcagacttcgactctgtggaacagctggaagtcttag

SEQ ID NO: 16534 - DNA, 525 bp, Artificial Sequence
  Description of Artificial Sequence: Synthetic coding sequence
atgtttaacccccagttgatgattcaaacacccaaagaggaaggagccaacgtactgactacagaagctctcctgcagcatctcgacagcgccttacaggccagcagggtgcacgtgtatatgtacaaccggcagtggaagctcgaacatctgtgctacaagtccggcgaattaattactgagacaggctacatggaccagattatcgaatatctttacccatgtctgataatcacccctctggactgtttctgggaaggcgccaaattacagtcagggacggcctatctgttaggaaagccccccctccgttggacgaacttcgaccctctcgagtttctggaggagcttaaaaaaatcaactatcaggttgatagctgggaggagatgcttaacaaagctgaggtaggccatggctatatggacagaccttgtctgaatccagccgacccagattgtcctgccactgcacccaataaaaactcaaccaaacccctggacatggccctcgtactcaatgggtag

SEQ ID NO: 16535 - DNA, 525 bp, Artificial Sequence
  Description of Artificial Sequence: Synthetic coding sequence
atgttcaacccccagctgatgatccagacccccaaagaagagggcgcaaacgtcctcacaactgaggctttactccagcatctggattctgctctccaggcttctagagttcacgtttacatgtacaaccgccaatggaaattggagcacctttgttataagtctggggaattgataaccgaaaccggctacatggaccaaatcattgagtatctctacccctgtctgatcataactccgctggactgcttttgggagggcgccaagttgcagtccggcacagcctacctgctgggcaaacctcccctgaggtggaccaacttcgacccgctagaatttttagaggagcttaagaagatcaactaccaggtggactcatgggaagagatgctgaacaaagccgaggtgggtcacggatacatggatagaccttgccttaatcccgcggacccagattgccccgccactgcgcccaacaaaaatagcacaaagcctctggatatggcgctggtgctgaacgggtag

SEQ ID NO: 16536 - DNA, 279 bp, Artificial Sequence
  Description of Artificial Sequence: Synthetic coding sequence
atgttcaatccccagctgatgatacagaccccaaaggaggagggggccaacgtcctcaccacagaagcactgctccagcacctcgattcggctctacaggcgtcgcgtgtgcacgtgtatatgtataatcgacaatggaaactggagcacctgtgctacaagagtggcgagctcatcactgagacgggttacatggatcaaatcattgagtacttgtacccttgtctaatcattacaccccttgattgtttctgggagggcgccaaactccaaagttag

SEQ ID NO: 16537 - DNA, 525 bp, Artificial Sequence
  Description of Artificial Sequence: Synthetic coding sequence
atgtttaatccccagttaatgattcagacccccaaagaggaaggcgctaatgtcctgacaacggaagcgctgcttcaacacctggattctgccctgcaagctagccgagtgcatgtttacatgtataatcgacagtggaaactcgaacatctgtgttacaaatccggcgagttgattacagaaactggctatatggaccagattattgaatacttatacccctgtcttattataactcccctcgattgtttttgggaaggggcgaagttgcagagcggtactgcttacctgcttggaaagcccccactacgctggactaacttcgatcctctggagtttctggaggaactgaaaaaaatcaattaccaagttgactcttgggaggagatgctcaacaaggccgaagttggtcacggatacatggaccgaccctgcctgaaccccgctgatcctgactgcccagccacggcgcctaacaaaaactcaaccaagcctctggacatggcactcgtgctgaacggctag

SEQ ID NO: 16538 - DNA, 525 bp, Artificial Sequence
  Description of Artificial Sequence: Synthetic coding sequence
atgtttaacccccagctcatgattcagaccccaaaggaggaaggcgctaatgttcttaccacagaggctctattacagcacctagattcagcgttgcaggcctccagggtgcatgtatacatgtataaccggcagtggaagctcgaacacctgtgttacaaatccggcgaactgatcacagagaccggatatatggatcagatcatcgaatacctgtatccctgcctgattatcacacccctagactgcttttgggagggagccaagctacagagcggtaccgcttacctgctgggcaagcccccactgcgctggacaaattttgatccactcgagttccttgaagaactgaagaagataaactaccaggttgactcttgggaggaaatgctgaataaggcagaagtggggcacgggtacatggaccggccatgcctgaatcccgcggacccagattgcccagcaacggcccctaataagaacagtaccaagccactggatatggccctggtgttgaatgggtag

SEQ ID NO: 16539 - DNA, 954 bp, Artificial Sequence
  Description of Artificial Sequence: Synthetic coding sequence
atgccccgagaggaccgggctacatggaagtcgaattacttcctaaagatcattcagcttctcgatgattatcctaaatgttttatagtaggcgcagataacgtgggaagcaagcaaatgcagcaaatccggatgtcacttcggggcaaggctgtggtactgatgggaaagaatacgatgatgagaaaagccatccgcgggcacctggagaataatccggcccttgagaagctgctgccacacattagaggtaacgtgggattcgtttttacaaaagaggatttgaccgagattagggatatgctcttggcaaacaaggtgcccgctgcagccagggccggagccatcgccccttgtgaagtgaccgtacctgcacaaaataccggccttgggccggagaagacctcgttctttcaagcacttggaattaccaccaagataagccggggaaccatcgaaatccttagcgatgtgcagctgattaagacaggagacaaggtgggcgccagtgaagctaccttattaaacatgttgaatatcagccctttctcttttggcctcgtgatacagcaagtcttcgataacgggagcatatacaatccagaggtgctggatattactgaggaaactttacattcccgctttcttgagggtgtccggaatgtcgcgtctgtgtgcctccagatcggctacccaactgtcgctagcgtgccgcactccatcattaacggctacaaaagagtactggccctctctgttgaaactgattatacattcccactcgccgagaaggtgaaggcattcctggcagaccccagcgcctttgtggcggccgcccctgtcgcggcagctaccacagcggcacccgctgccgccgcggcgcctgccaaagttgaggcgaaggaagagtcggaggagtctgacgaggacatgggatttgggctgtttgattag

SEQ ID NO: 16540 - DNA, 1818 bp, Artificial Sequence
  Description of Artificial Sequence: Synthetic coding sequence
atggatgacctagacgccctgctcgctgacctggaatcaactacgtctcatatctccaagcgtcctgtattcctctctgaggagacgccatactcctaccctaccgggaatcacacctatcaggagatcgccgtacccccacccgtgcccccgcctccctcatcggaggccctgaatggaactatcttggacccactcgatcagtggcagccctccagctcccgtttcatccaccagcagcctcagtctagttccccggtgtacgggagctcagccaagacaagctccgtttccaatccccaggactcagttggatccccttgtagcagagtgggcgaggaggagcacgtgtattctttccccaacaagcagaaatctgcagaaccatcccccaccgttatgagcacgagcctcggctcgaacctgtcagaactggatcggctactgctggagctgaatgccgtacagcacaacccccccggtttccctgccgatgaggcgaattcctctccaccgctgcccggagccctgagccctctgtatggagtgccagagaccaattctccactgggcgggaaagccggacccctgactaaggagaaacccaagcgcaatgggggccgaggcctcgaggacgtccggcctagtgtggagagcttactggatgagctggagtcttccgttccatcgccggtgcccgccatcaccgtgaaccagggggagatgagctctccacagagagtgacgagcacacagcagcaaacgagaatctccgcctcttctgcgaccagagagctagacgaacttatggcctcgctaagcgattttaagggaagctggcctctggaggaagtggtgttactcgtttctattagctcctctgtgcaggagggagaaaagtatccccacccttgcgcagcccgccatcggacaccctcactccgatccccagatcagccacctccgtgcccccagtttatggcgcagggaaaaaccggatcatctagtccgcccgggggtccgccgaaacctggctctcagctggattccatgctgggttcccttcagtctgatctgaacaaactcggggtggccacagtagccaagggcgtctgcggcgcctgcaagaagcctatcgccggacaagtggtcaccgctatgggtaaaacctggcatcctgagcacttcgtgtgcacccactgtcaggaagagatcgggtctcgcaatttcttcgaacgggacggccagccttactgcgaaaaggactatcataatcttttctctcctagatgctactattgtaatggtcctattctggataaggttgttacagcactggacaggacctggcacccggagcacttcttctgtgcacagtgcggggccttttttggccctgaagggtttcacgaaaaagacggaaaggcctattgtcgaaaggattacttcgacatgttcgccccaaagtgtgggggttgcgcccgggccattctggagaattatatttctgctctgaataccctttggcatcccgaatgctttgtatgtcgcgagtgtttcacacccttcgtgaacggcagttttttcgagcatgatgggcagccctattgcgaagtccattaccacgaaaggagagggtcactttgttcaggctgtcagaagccgattacgggacgttgcattactgcaatggccaaaaagttccatcctgaacattttgtttgcgcattctgtctgaaacaacttaataaggggacttttaaagagcaaaacgataagccgtactgccagaactgttttttgaaactgttttgctag

SEQ ID NO: 16541 - DNA, 702 bp, Artificial Sequence
  Description of Artificial Sequence: Synthetic coding sequence
atgggaaaaacatggcatcctgagcattttgtgtgcactcactgtcaggaagaaataggcagtaggaatttcttcgagagagacggacagccttactgcgagaaggactatcataacctgttttcccctcgctgttattattgcaacggacctatactggataaggtagtgaccgcgctggatcggacatggcacccagaacatttcttttgcgcccaatgtggtgctttctttgggcccgagggtttccacgaaaaggacggtaaagcttactgccggaaagattacttcgacatgttcgcgccaaagtgcggggggtgcgctagagctattctggaaaactatatatctgccctgaacaccctctggcatcctgaatgttttgtgtgtcgcgagtgcttcacccctttcgtcaatgggagctttttcgaacacgacggacagccatactgtgaagtgcactatcacgagcgccggggttccctatgtagcggctgccagaagccaatcaccggccgttgcatcacggccatggcaaaaaagtttcatcctgatccttgcacctcacctcgtacaggtttggcatcgactccacattggagtcatttgttcctgatctttcaacagtgcagtcgcggggcaggcaagggcaggcaaggccttctcggctctctgtttatcctcatccccccgcccacgtag

SEQ ID NO: 16542 - DNA, 1212 bp, Artificial Sequence
  Description of Artificial Sequence: Synthetic coding sequence
atgtccgctccttccagcaccggacctcagtactgtcccggtcttccctctaggaaagaggccactcccgagggacgtccagagacctgcctcctcccatcatcgccccaagcccagcgccccatacaaggcctggagcaacgcgccgacggcgaaagatgttgggctgcagggtggccgagggacggcggccggtcctctcctgggggccaggacgaaggaggcggatcatggccacttgaggaggtggtccttttggtttctatatcttcaagcgtgcaggagggtgagaaatatcctcatccttgtgcagctaggcaccggacaccctccttgcgaagtcccgatcaacccccaccttgtccccagttcatggctcagggtaagacaggttcaagttcacctcccgggggcccccctaaacccggcagccaattggattcaatgctgggctcattacagagtgacctcaataagcttggggtggctactgttgcaaaaggcgtgtgcggagcatgcaaaaagcctatagctggccaggtggtaactgccatggggaagacatggcaccccgaacatttcgtgtgtacccattgtcaggaggaaattggcagccggaatttcttcgagcgagacggccagccttattgcgagaaggactatcacaatttatttagtccgcggtgctactattgtaatggccctatattggataaggtggtgactgctctggatcgcacttggcacccagagcactttttctgtgcccagtgtggcgcgttctttggcccagaaggatttcacgaaaaagatggaaaagcctattgcaggaaagactacttcgatatgtttgccccaaagtgcggaggatgtgctagagctattctcgaaaactacatcagcgcactaaacacactgtggcatcccgaatgttttgtctgtagagaatgcttcacaccttttgtgaacgggtccttctttgagcacgatggccagccctattgtgaagtccattaccacgaacgcagggggtcactttgctccgggtgtcaaaaacctatcaccggacgctgtatcacggccatggctaagaagttccaccccgagcactttgtgtgcgccttttgcctcaagcagcttaataaaggcacttttaaggagcagaacgacaaaccttattgtcagaattgtttcttaaaattgttttgttag

SEQ ID NO: 16543 - DNA, 1674 bp, Artificial Sequence
  Description of Artificial Sequence: Synthetic coding sequence
atggatgacttagacgcactgttagccgatttggagtcaacgacaagtcatataagcaagcgacccgtcttcctgagtgaggaaaccccatattcttaccccaccggaaaccacacataccaggagattgcagtgcccccaccggtgcctccaccacctagctcagaggcccttaacggtaccatattggatcctttggaccaatggcagccgtccagttctcgatttatacaccaacaaccccagtcctcgagccctgtctacgggtccagcgctaaaacatcatccgtatctaatccccaggacagcgtcggaagtccctgcagccgtgtgggggaggaggagcacgtatatagtttccccaacaagcagaaaagcgctgaaccctctccaacagtcatgagcacttctctggggagcaatctgtccgagctggaccggcttttgcttgaattaaacgctgtgcagcataaccctcccggatttccggcggacgaagctaacagcagccccccactccccggagcgctgtctcctctgtacggggtgcccgagacaaacagtccattgggaggaaaggccggtcccctcacaaaggagaaacccaagagaaatggaggcagaggactcgaagacgtgagaccctccgtggaatcactgctagatgaactggagagctctgtcccaagccccgttccggctatcactgtgaaccaaggcgagatgagcagcccacagcgggtcacgagtacccagcagcagactcgcatctctgccagctctgccacacgcgagttagatgagcttatggccagcctgagcgacttcaaattcatggcacagggaaaaacaggctcctcatcaccaccgggcgggcctcccaagccaggcagccagctggacagcatgctgggcagtcttcagtctgacctgaacaagctaggcgtggcgacagtggccaagggagtgtgtggcgcctgcaagaagcctatcgctggacaggttgtcaccgctatggggaaaacttggcatccagagcatttcgtttgcacacattgtcaggaagagattggctctagaaactttttcgagagggacggtcaaccttactgtgagaaagattatcataatctgtttagcccccggtgttactattgcaacggacctatcctagacaaagtggtcacagcccttgaccgaacgtggcacccagagcactttttttgcgcacaatgcggagccttttttgggccagagggtttccatgaaaaagatgggaaggcctactgcaggaaggactactttgacatgtttgctccgaagtgtggaggatgcgctagagccattctggagaactacatttcagccctaaacactctttggcaccccgagtgcttcgtgtgcagggagtgcttcactcctttcgtgaacggtagcttttttgagcacgacgggcagccatattgtgaggtgcattaccacgagaggagagggtctctgtgtagcggctgtcagaagcctatcaccggtagatgtatcactgcaatggccaaaaagtttcaccctgagcacttcgtgtgtgcgttttgtttgaagcaactgaataagggaaccttcaaggaacaaaatgataaaccttactgccagaactgttttctgaaactattttgttag

SEQ ID NO: 16544 - DNA, 1275 bp, Artificial Sequence
  Description of Artificial Sequence: Synthetic coding sequence
atgagtacgagtctagggtctaacctttctgagcttgacaggctgttactggagctcaacgccgtgcagcataaccctccgggcttccctgcagatgaggccaatagtagtccccccctgcccggagcattatctcccctatacggggtgcctgaaaccaattctcctcttggagggaaggcgggtccactgacaaaagagaaacctaagaggaatggcgggcgtggcctggaagatgtgcggccgtctgtggaaagcctgctggacgagctcgagtcatctgtgcccagcccagttcctgcaatcaccgttaaccagggcgagatgtcatcacctcagcgtgtaacttcgacccagcagcagacccgcatctctgcaagttcggccacacgcgagctggacgagctgatggcttcattgagcgacttcaaatttatggcccaaggaaaaaccggctcaagcagccctcccggtggcccaccaaagccaggaagccagctggactccatgctgggttcgctgcagtcagacctgaacaagttgggggtggccacagtggccaaaggcgtttgtggagcttgtaagaagcccattgctggtcaggttgtgactgcaatgggaaagacttggcatcccgagcactttgtgtgtacacattgccaggaagaaatcgggtccaggaatttctttgagcgcgatggccagccgtattgcgagaaggactatcataatctgttctccccacggtgctattattgcaacggccccatacttgacaaggtagtgacagccctagacagaacctggcaccctgaacattttttctgcgctcagtgcggcgcgtttttcggtcctgagggtttccacgagaaggacgggaaagcctattgccgcaaggattacttcgatatgttcgcccccaaatgtggcggctgcgccagagctattcttgaaaattacatatctgcgttaaatacactttggcacccagagtgcttcgtatgccgagaatgttttacgccctttgtgaacgggagcttcttcgaacacgatggccagccctactgtgaggttcactatcacgagagacgcgggtcgttgtgcagtggatgccagaagcccattacaggcagatgcatcaccgcgatggcaaagaagttccaccccgaacacttcgtgtgcgctttttgcctgaagcagctgaacaagggaacttttaaggagcagaacgataaaccctattgccagaattgttttctaaaactcttttgctag

SEQ ID NO: 16545 - DNA, 951 bp, Artificial Sequence
  Description of Artificial Sequence: Synthetic coding sequence
atgagctcgcctcagcgcgtgacctccacccagcaacagacgaggatctctgccagcagcgccacccgggaattggacgagcttatggcatcgctgtctgactttaaattcatggcgcagggaaaaactggatcgagttctccacccggcggcccgcccaagccgggttcgcagctggattctatgctaggaagcctgcaaagtgacttgaataagctcggcgtggccacagtggccaagggcgtgtgtggagcatgcaaaaagcccattgcaggccaggtcgtgaccgccatggggaagacgtggcatccagaacacttcgtttgcacccattgccaagaggagatcggtagtcgtaacttctttgaaagggatggacaaccttattgtgagaaagattaccacaatttattttcacctcggtgctattattgtaatggtccgattcttgataaagttgtcacagccctcgataggacttggcatccagagcactttttttgtgcccagtgtggggccttcttcgggcctgaaggatttcacgaaaaagatggaaaagcatattgccggaaggactacttcgacatgttcgcgccaaaatgtggaggttgcgctagggcaattttggagaattatattagcgcccttaacactctgtggcacccagaatgtttcgtatgcagagagtgctttacccccttcgtgaatggatccttttttgagcacgacggccaaccttattgcgaggtgcattaccatgagagacgaggatctctctgctccggatgccagaagcccatcactggtcggtgcattactgccatggcaaagaagtttcatcctgaacattttgtgtgtgccttctgtctgaaacagttgaacaagggcacctttaaagaacaaaatgacaagccctattgtcagaactgcttcttaaagctgttttgttag

SEQ ID NO: 16546 - DNA, 993 bp, Artificial Sequence
  Description of Artificial Sequence: Synthetic coding sequence
atgccacactccgtgactttgcgaggtccttctccatgggggttccgcctcgtaggaggccgcgatttttctgcccctttgacaatttctcgagtgcacgctggatcaaaggctgctctcgcagcattgtgcccaggagaccttattcaggctatcaatggtgaatcaaccgagctgatgactcatctcgaagctcaaaatcggatcaaagggtgccatgatcatctaactctgtctgtgagccgacctgaaggccggtcctggccctctgccccagacgattcaaaggcccaggctcacagaatacacattgatcccgagatccaagatggatctcccacaacaagccgaagaccctcaggcaccggcacaggaccagaagatggtcgcccatcactgggcagcccatatgggcagcccccccgctttcccgtgccacacaacggttccagcgaagcgacattgcctgcccagatgtcaacgttgcacgtgagtccgcccccttcggcggatccagcgcggggactgccgagatctagagactgtagggtcgacttaggaagcgaggtttatcgaatgctgagagaaccagctgagcccgtggctgccgagccaaaacagtccggttcattccgatatctgcagggaatgctggaagccggagaaggaggggattggccggggccaggaggccctcgcaatctgaagccaacagccagcaaactgggcgccccactttccggtctccaagggcttccagagtgcacccgctgcgggcatgggatcgtgggaaccattgtgaaagcccgggataaactgtaccacccagagtgttttatgtgcagcgattgtgggcttaacctgaagcagagaggctatttctttctggatgagaggctgtattgtgagagccacgctaaagcccgcgtgaaaccgccagagggctacgatgtggtggccgtgtatcctaacgctaaggtagagttggtgtag

SEQ ID NO: 16547 - DNA, 741 bp, Artificial Sequence
  Description of Artificial Sequence: Synthetic coding sequence
atgccccattctgtgacgctacggggtccgtcaccatgggggtttcgcctcgtgggaggcagagactttagtgcgcctttgactatcagcagagtgcacgctggaagcaaggccgctctggcggcgctgtgtcctggggatctcatccaggcaatcaatggagaatctacagagttaatgactcatcttgaggcccaaaaccgtattaagggctgtcacgaccacctgactctctccgtgtcacgcccggaaggccgatcttggcctagtgccccagacgactctaaggcccaagcccacaggattcatattgaccctgagatccaggatggcagtccaaccacttctagacgacctagcgggaccgggaccggaccggaggatggaagacccagcctgggatcaccgtatgggcagcctcctcggttcccggtcccgcacaatgggagctcagaagcgacactgccggcccagatgagcactctacacgtgtcccctcctcccagcgccgaccctgctcgcggactacctcggagcagagactgtagagtggatttaggatcagaagtgtatcggatgctcagagaaccggccgaacctgtcgccgctgaaccaaaacagtccgggtctttcagatacctgcaagggatgctggaggcgggagagggaggggcaccttcctccaggcacggaacgtcgagcacaattccctctgcttcttgtgcagttaccgcagcttag

SEQ ID NO: 16548 - DNA, 1791 bp, Artificial Sequence
  Description of Artificial Sequence: Synthetic coding sequence
atgagtaattatagcgtgagtctggtgggtcccgcgccctgggggttcaggctgcagggtggtaaagattttaatatgccactgaccatctcctcacttaaggacggaggcaaggccgcccaagccaacgtccgcatcggggatgttgtattaagtattgatggaatcaacgcacagggcatgacccatctggaagcacagaacaaaatcaagggatgtacaggatcattgaacatgaccctccagagagcaagcgctgctcctaaaccggaacccgtgcccgttcagaagggagaacccaaagaagtcgtgaaacccgtgcccatcacgagtcccgccgtgtccaaggtaacatctactaacaatatggcctataataaggccccacggcccttcggatctgtttctagcccaaaagttactagtattcccagcccgtcttcagcctttacgcctgcccacgctacaactagttcacatgcttccccatcgcctgtcgcggccgtaaccccaccgctgtttgccgctagtggcctgcacgcgaacgctaacctctcggctgatcagagcccttccgccctcagcgccgggaaaacagcggtcaatgtgcctcgacaacccactgtgacttctgtatgttctgagacatcccaggagttggccgaggggcagcgccgtggatcccagggtgactctaagcagcagaacggtcccccacgcaaacatatcgtggagagatacacagaattttatcacgtcccaacacacagcgatgcgagtaaaaaaagactaattgaagatacggaagactggaggcccagaacaggaacgacccagtctaggagttttcgaatcctggcgcaaataacaggaaccgagcacctcaaagaatctgaggctgacaacaccaaaaaggctaacaatagccaagagcccagcccacagctggcctcatccgtggcaagtacaagaagtatgcctgaaagcctggattctccaacatctggtcggcctggtgttaccagccttaccgccgccgcagcttttaagcctgtcggaagcaccggcgtcattaagagtccatcatggcagaggccaaatcaaggcgtgccctccactggcagaatctccaatagtgccacatactcaggaagcgtggccccggcaaattcagccttaggtcagacacagcccagcgaccaggatacgctggtgcagagggctgaacacatacccgcaggcaagaggacacctatgtgtgcacactgcaatcaggtaatccgcggccccttcttggtggccctgggtaagtcctggcatcctgaagaattcaattgtgcacattgcaaaaatacaatggcctatatcggatttgtcgaggagaaaggcgccctgtattgtgaattgtgctacgagaaatttttcgcccctgagtgcggccggtgccagcggaaaattctgggtgaggtcattagcgccctgaagcaaacatggcacgtttcctgcttcgtgtgcgtggcatgcgggaagcccattcggaacaatgtctttcatctggaggatggagagccctactgcgaaacagattactacgccctgttcggtaccatatgtcatggctgcgagttcccaattgaggctggagatatgtttttagaagccctcgggtacacatggcatgacacatgtttcgtatgttcggtgtgttgtgaaagcctagagggacaaaccttttttagcaagaaggataaacctctgtgtaaaaaacatgcccattcggttaacttctag

SEQ ID NO: 16549 - DNA, 645 bp, Artificial Sequence
  Description of Artificial Sequence: Synthetic coding sequence
atgtcaaactatagcgtgtctctggtgggaccagccccgtgggggttcaggcttcaggggggcaaggacttcaacatgccattaactatcagctccctgaaagacggaggcaaggcggcccaggcaaacgtgagaattggcgatgtcgtgttatctattgatgggatcaacgcccagggcatgactcatcttgaggcgcaaaataagatcaaggggtgtacaggtagcctaaatatgactctgcagcgtgcttctgcagcccctaagcccgagcctgtgcccgttcagaaaaagacacaggtaactaacaaccccggcacagtcaaaatccctccgaaacgtcccccccggaagcatattgtggagaggtatacggaattttaccacgtccctactcacagcgacgcatccaaaaaacgcctgatcgaggacacagaagactggcggcctcgtaccggaactacgcagagtaggtcctttcggatcctagcacagatcaccgggacagagcaccttaaagagtccgaggctgacaacaccaagaaagccaaagagaagatacctctgcatgtgttctcccccaaatacaccaaactgcgcgattggcatcatgaggtatcagcgagagcgcttaacgtccagtag

SEQ ID NO: 16550 - DNA, 705 bp, Artificial Sequence
  Description of Artificial Sequence: Synthetic coding sequence
atgagcaactatagtgttagcctggtggggcccgcgccctggggatttagattgcagggcggaaaggactttaacatgccactaacgatatcctccttgaaagacggtggtaaagcggctcaagcaaatgtgagaatcggagacgtcgtactctcaattgacggaattaacgcccaaggaatgacacacctggaggctcaaaacaagataaagggatgcactgggagtttgaacatgaccctccaacgagcttccgcagcacccaaacccgagcctgtaccagtccagaaacctactgtgacgagcgtgtgtagtgagacctcccaagagctcgctgagggccaacggagggggagtcagggcgacagtaagcagcaaaatggcaagattcctccaaaacgccctcctcgaaagcacatcgtcgaacgatacaccgaattttatcatgtgcccactcattccgacgcctcaaagaagcgcttgattgaggacacggaagactggagaccaagaacggggaccacacagtctcgctcatttcgcattcttgcccaaattacaggcacagagcatttaaaggaatcggaggctgacaataccaagaaggcgaaggaaaagattccgcttcacgtgttctcaccaaagtacactaaactgcgcgattggcaccacgaggtatctgcaagagccctgaatgtgcagtag

SEQ ID NO: 16551 - DNA, 1464 bp, Artificial Sequence
  Description of Artificial Sequence: Synthetic coding sequence
atgtccaactacagcgttagtctcgtggggcctgccccatgggggttcagactccagggaggaaaggattttaatatgccactgaccatttcttcattgaaggatggaggtaaggctgcccaggctaacgttaggatcggcgatgtcgttttaagcatcgacggcatcaatgctcaggggatgacccacctcgaggctcagaataaaatcaaaggttgcacaggatccttaaatatgactctccagcgagcttccgccgcacctaagccggaaccagtccccgtgcaaaaaccaacggtcaccagtgtgtgcagcgaaacttcacaggagttagccgagggtcagcgcagaggttcacagggcgatagcaagcagcagaacggaccgccgagaaagcacattgtcgaacgctacactgaattttaccatgttcccactcatagtgatgcatccaaaaagaggctaatcgaggacactgaagattggaggccacggactggcactacacagagccggagttttcgcattctcgctcaaatcacgggcactgagcacctgaaggagtcagaagcagataatacaaaaaaagcaaacaatagtcaggagccttccccccagctcgctagttccgtggcttctactcgctccatgcctgaatccctggattcccctacttctggcaggcctggagtgacatcgctgacagccgctgctgccttcaagcccgttggcagcaccggtgtgattaaatcgccatcttggcagcgaccgaatcagggcgtccctagcaccggacgtatctcaaattctgccacttattccggcagtgttgcccccgccaactccgcactgggccagacacagcccagtgatcaggacactttagtgcagcgcgcagaacatattccagccgggaaacgcactcccatgtgtgcacactgtaaccaggtcatccggggcccttttttggttgcgctgggaaagtcatggcacccggaagagttcaactgcgcgcattgtaagaatactatggcctatatcggattcgtcgaagagaagggtgccctttactgcgagctatgctacgagaaatttttcgcccccgagtgcgggaggtgccagcgcaagattctaggagaggtcatctctgcactaaagcaaacttggcatgtgagttgcttcgtgtgcgttgcctgcggaaagcctatcaggaacaacgtgttccacttggaagacggtgagccttattgtgagacagattattacgccctgttcggcacaatctgtcacggatgcgagtttccaatcgaagccggcgacatgtttttagaggccttgggctacacttggcacgacacctgtttcgtgtgttctgtgtgctgtgaaagcctggaaggccagaccttcttcagtaagaaagataagcccctctgtaaaaagcatgctcattcggtaaacttttag

SEQ ID NO: 16552 - DNA, 705 bp, Artificial Sequence
  Description of Artificial Sequence: Synthetic coding sequence
atgtccaattactccgtgagcctagtagggccagccccatggggcttcagactccaaggaggaaaagattttaatatgcctctgaccatctccagcttgaaggatggagggaaagctgctcaggccaacgtccggattggagatgtagtgctctccattgacggaatcaatgcccagggcatgacgcatctggaagcacaaaacaaaataaagggctgcaccgggtcattgaacatgactttgcaaagggctagcgccgctcccaaaccagaacccgtcccagtgcagaaacctacggtcaccagcgtgtgctcagaaacgtcgcaggaactggcagagggccagagacgcggatcccagggcgactctaaacagcagaatggcccggttccacgcaaaatacccccccgcaaacatattgtggagcgctacacagaattctaccacgtccctactcactcagacgcttctaaaaagagattgattgaggacactgaggactggcgaccacgtaccggcaccacccagagcaggagttttcgtattttggcacagattaccgggacagagcacctgaaggaatctgaagcagacaataccaagaaagctaaagaaaagatacccctacacgtgttctcacccaagtacacaaaactgagggactggcatcatgaagtgtccgccagggctctgaatgtgcagtag

SEQ ID NO: 16553 - DNA, 645 bp, Artificial Sequence
  Description of Artificial Sequence: Synthetic coding sequence
atgtcaaattatagtgtgagtctggtggggccggccccatggggctttaggctccagggggggaaggactttaacatgccactgacaatatcctcacttaaagacgggggtaaagccgctcaagccaatgtccggattggcgacgttgttctctcgattgacggcataaacgcccagggcatgacgcacttggaagcccagaataagattaaaggatgtaccgggtctctcaatatgactctccaacgagcctcagctgcaccgaagcccgagccagtgcccgtccagaaggtaacacaaaagcgcgagtcaagaagcagtcggcgaaccgcgcctggcttaccaccacggaaacatattgtcgaaagatataccgaattctaccacgttcctacacactccgatgcgtctaaaaagcggctgatagaagacacagaagattggagaccccgaacaggcaccacacagagcaggagtttccggattctggcccagattactgggaccgaacacctcaaggagtctgaggcggacaacaccaagaaagcaaaggagaagatacccctgcatgtattttcgcccaagtatacgaagctgagagactggcatcatgaagtcagcgcgagggcactgaatgtgcagtag

SEQ ID NO: 16554 - DNA, 1425 bp, Artificial Sequence
  Description of Artificial Sequence: Synthetic coding sequence
atggcctacaacaaggctcctcggcccttcggcagtgtgtcaagccccaaggtgacttccatcccaagcccatcctccgcctttacacccgcacacgccacaacctcctcacacgctagcccgagtcccgtagctgcagtcacaccccctctgttcgctgcttcagggttacatgccaatgccaacttgagcgctgatcagtctccctccgctctgagtgccggaaaaactgctgtcaacgtgccccgccagcccacggtgacttccgtgtgttctgagacatcacaagaattagcagaaggacagcgtagggggtcacagggcgactctaagcagcagaatggtcccccacgaaaacatattgtggagcgttacacagaattttatcatgtgcccacacactccgacgctagcaagaagcgtctgattgaagacactgaagactggcgacctcggactggcacaacacaaagtcgttcctttcggattctagctcagattaccggcacagaacatcttaaggaaagcgaagctgacaacaccaaaaaagcaaataacagccaggaaccctccccgcagctggccagtagtgtagcaagcacccggtccatgcctgagtcattggactcccccacttctgggaggcccggagtcacaagtctgaccgccgccgccgctttcaagccagtggggagcacgggggtgatcaagagtcccagctggcagcgtcccaatcaaggagtaccttctaccgggcgaatctctaatagcgctacatattctgggtctgtagcacccgcgaactcggctctggggcagacacagccgtcggatcaggatacactggtgcagagagccgagcatattcccgccggcaaaaggacacctatgtgtgcgcactgcaaccaagtaataaggggacccttcctcgtggccttggggaagtcctggcaccctgaggaattcaactgtgcacactgtaagaacaccatggcgtacattggtttcgtggaggagaagggggccctgtactgtgaactgtgctatgagaagtttttcgcccccgagtgtggccgatgtcagaggaagatcctgggagaagttatctctgctctgaaacagacgtggcacgtgtcatgttttgtgtgtgtggcctgtggaaagccaatccgcaacaacgtcttccatctcgaagatggcgagccctactgtgaaaccgattattatgccctttttggcaccatttgtcatgggtgtgagtttcctatcgaggccggggacatgtttctggaggcgttagggtatacctggcacgacacttgctttgtgtgttctgtttgctgcgaatccctcgaaggacaaacgtttttctcgaagaaggataaacccctgtgtaagaagcacgcacattctgtgaatttctag

SEQ ID NO: 16555 - DNA, 411 bp, Artificial Sequence
  Description of Artificial Sequence: Synthetic coding sequence
atgtccaactattccgtgtctctagtcggacctgctccttgggggttcagactgcagggtggaaaggatttcaatatgccactgactattagctctgccggggttcagtggagaaacctcgggtctcctcagccgcctagtcccgagttcaaaaggttttcttgcctgtcactgccgtccagttgggactatagacacgtgcctccaaggctggcaaacttcgtgtttttggtagagacgaagtttccatacgtcggtcaggccgggctggagctccccacatccggtgacttgcctacttcagctagccagagcgctaagataacgggcgtcagccatcgggcgtggcccactcttttttatactctgctgttttttgccaccatatatccagagatcatactgtactag

SEQ ID NO: 16556 - DNA, 669 bp, Artificial Sequence
  Description of Artificial Sequence: Synthetic coding sequence
atggacagcttcaaagtagttctggagggtccagcaccctggggttttagactgcaaggaggcaaagattttaatgtaccgctgtcgatatctcggttgacacccggcggaaaagcggcgcaggccggcgtggcggtgggcgactgggtgctgtccatagacggtgagaatgctggaagtctgacgcatatcgaagcccaaaacaaaattcgtgcgtgcggagaaagactttcccttgggctgtcccgggcacagccggtccaaagtaaacctcagaaggcttcagcacctgctgccgatcctccccggtacacattcgcgccaagtgtttcccttaacaaaaccgctaggccctttggcgctccaccacccgccgactccgcgccacagcaaaacggccagcctttgcgccctcttgttcccgatgcatctaagcagagattgatggaaaacaccgaagattggcggccaaggccaggtacaggtcagagtcggtcttttcgaattctggcgcatctgacaggtaccgagtttatgcaggatcctgatgaggaacatctgaaaaaatcacgcgagaagtacgttttggagctgcagagtccaagatacactcggctgagggactggcaccaccaacgatcagctcacgtattgaatgtgcagtcgtag

SEQ ID NO: 16557 - DNA, 1374 bp, Artificial Sequence
  Description of Artificial Sequence: Synthetic coding sequence
atggacagtttcaaagtggtgctcgagggacctgcaccttggggtttcaggctacagggaggtaaagacttcaatgtgcctctgagcatctctaggttgactcctgggggaaaagcagcccaggcaggtgtggccgtgggtgattgggtcctgagtatagacggggaaaatgcgggtagcctcactcacatcgaggctcaaaacaaaatcagagcttgtggagaacgactgtccctgggcctatctcgggctcaacctgtccagagtaagcctcagaaagcttccgcaccggctgccgacccacctcggtatacctttgcccccagcgtgagcttaaacaaaacggcccgaccgttcggcgctcctccccccgccgattccgccccacagcaaaatggtcagcccctgcgccctcttgtacctgacgcaagtaagcaaaggcttatggagaatacggaggattggcgccctcgacctgggacaggtcagtcgagaagcttccgcatcctggcccacctgactggcactgagttcatgcaggatcctgacgaggagcacctaaagaaaagtagccaagtgccaaggaccgaggcacctgcacccgcttcttccacccctcaggaaccctggcctggacccacggcaccctccccaacaagtaggcctccgtgggcagtcgatcccgcgtttgccgagcggtacgcgcctgacaaaacctccacagtgctcacccgccacagccaacccgcaaccccaacgcccctccagtctcggacatctattgtgcaagctgctgctggaggggtgcctggcgggggcagtaacaacgggaaaacccctgtgtgccaccaatgccacaaggtgattagaggcaggtacctagttgctctggggcacgcatatcacccagaagagttcgtctgctcccaatgtggcaaggtgctggaagaggggggcttctttgaagagaagggggccatcttttgcccaccttgctacgatgtccggtacgcacctagctgtgcgaaatgtaaaaaaaagatcaccggggagatcatgcacgccctcaaaatgacatggcacgtgcattgcttcacgtgtgccgcctgcaaaactcctattcggaacagagctttctacatggaagaaggagtcccttactgcgaacgcgactatgagaaaatgtttggcaccaaatgtcatgggtgtgacttcaagattgacgccggagatcgctttcttgaggctctgggattttcttggcacgatacctgctttgtttgcgctatctgtcagatcaacctggagggaaaaaccttctattcaaaaaaggaccggcctttgtgtaagtcccacgccttttctcacgtgtag

SEQ ID NO: 16558 - DNA, 864 bp, Artificial Sequence
  Description of Artificial Sequence: Synthetic coding sequence
atggattcattcaaggtcgtactggaagggccagcaccgtggggttttagactacagggcggcaaggactttaatgtaccactcagtattagccggctcacccccggaggaaaggctgcccaagcaggcgtcgccgtaggagactgggtattgtccatagacggagagaatgcaggtagcctaacacacattgaagcacagaataaaatccgcgcatgtggagaaaggctgtcgcttggcttatccagggcccaaccagtccagagcaaacctcagaaggctagcgccccggccgcagatccacctcgatacacgtttgcgccatccgtgtcactcaataagacagcaagacctttcggagcccctcccccagctgatagcgccccgcagcagaacggtcagcctctaagaccgctagttcccgatgcatccaagcagcggctgatggagaacaccgaggactggcgcccccgacccgggaccggccagagcagatctttccggatattggcgcacctgaccggaacagagttcatgcaagaccccgacgaggagcacctaaaaaagtcccgaccttacaggcctcagccttaccagcctccagcacttgggtgcgggccgtgtgtctgcagagctctttgcccagggcagaacgagcactctgcggatcccgcccagcctgctggccatgctcatgccgctgccgagcctcacttgcactgtgccggctcatgccgaaggggcgctcgtcgcggacagcaacagcgacaggacagtcgcgtctcaccagtgccacaggggcatcccggaccattacccggcggggccgggcctcgggttcctccagggggggtgtgtgtgtag

SEQ ID NO: 16559 - DNA, 1272 bp, Artificial Sequence
  Description of Artificial Sequence: Synthetic coding sequence
atggactcgtttaaggtagtcttggagggacccgccccatgggggttcagactgcagggtggcaaggactttaatgtacccctgtctatctcacgcttgacaccgggaggcaaagcggcccaggccggggtagctgttggggattgggtgctgtcaatcgacggcgagaatgcaggctcattgacccatatcgaagctcagaacaaaattcgagcgtgtggcgaacggctcagcctcggcctgagtcgcgcacagcccgtccagtcgaaaccgcagaaggtgcaaactccagacaaacagcccttgaggccgctggtccccgacgcgagtaaacagcggctgatggagaataccgaagactggcgcccaagaccaggcacagggcagagccgttccttccgcatcctggcccatcttacaggcactgagtttatgcaggacccggatgaggaacacttgaagaaaagctcccaggtgccaaggaccgaggcacccgcaccagcttcctcaacacctcaggagccttggcccgggcctaccgctccatcacctactagtagaccaccttgggctgtcgatcccgccttcgcggaacggtatgctcctgacaagacaagtaccgtcctcacaaggcattcccagcccgctacacctacaccactgcagtctcgcacttctatcgtgcaagcagcagccggcggcgtgcccggcggcggctctaataatggcaagacccccgtgtgtcaccagtgtcacaaggtgatccggggaagatacctcgtggccctcgggcacgcttatcaccccgaagaatttgtttgttcccagtgtggaaaggtcctggaggagggtggattcttcgaggaaaaaggggccatcttctgcccaccttgctatgacgttaggtacgcaccctcgtgcgccaagtgtaaaaagaaaattactggcgagattatgcatgctctgaaaatgacctggcacgtgcattgttttacctgtgcagcatgcaagactccgatccgtaaccgcgccttctatatggaagaaggggtcccatattgcgaacgtgattatgaaaaaatgttcggcacgaagtgccacggatgcgacttcaagatcgacgcgggcgaccgatttctggaggccctgggatttagctggcacgatacgtgcttcgtctgcgctatttgtcagatcaatcttgagggaaagaccttttactccaagaaagaccgaccgctatgtaaatcacacgcatttagtcacgtgtag

SEQ ID NO: 16560 - DNA, 522 bp, Artificial Sequence
  Description of Artificial Sequence: Synthetic coding sequence
atggacagctttaaagtagttctcgaaggtcctgctccctggggattccgcctgcaaggcgggaaagacttcaatgtgccccttagtatctcccggctcactcccgggggtaaggcggcacaggccggagtagctgtaggcgattgggtgctgagtatcgatggagagaacgctggcagtttaactcatatcgaggcccagaacaagatccgggcttgtggcgagcgattgtcccttggcctgtctagagcccagcccgtccagagtaaacctcagaaagccagcgcccctgctgccgatccccccaggtatacctttgctccatcggtgtctctcaataagactgccaggccttttggcgcaccgccacctgcggacagtgcacctcagcagaacgggcagcctttacgccccctggtgcctgacgcctccaagcagagattaatggagaacacagaggattggagaccaagaccggggacagggcagtcccggagcttcaggattttagcccacctctag

SEQ ID NO: 16561 - DNA, 273 bp, Artificial Sequence
  Description of Artificial Sequence: Synthetic coding sequence
atggacagcttcaaggtggtgctagaagggcctgcgccttggggtttcaggttgcagggcggaaaggacttcaacgtacccctctctatttcaagactcactcctgggggcaaagctgcccaggctggtgtagctgttggagactgggtgttgagcattgacggagaaaatgccggaagcctcacccacatcgaagcacaaaataagatcagggcttgtggcgaaaggttgagtcttggcttgtcacgggctcagcccgttcagagtaagtag

SEQ ID NO: 16562 - DNA, 492 bp, Artificial Sequence
  Description of Artificial Sequence: Synthetic coding sequence
atggccgacgaggagaagttgccacctgggtgggagaaacgaatgtctagatctagtgggagggtctattacttcaatcatattacgaatgcaagccagtgggagcggccctccggcaattccagctccgggggaaagaatggacagggtgaaccagcccgagtgaggtgtagtcatcttcttgtgaaacactctcagtcccgaaggccctcgagctggaggcaggaaaagattactagaacaaaggaagaggccctggaactgattaacggttatatccagaagataaagtctggggaagaggatttcgagtcactggcatcccagtttagtgattgctctagtgcaaaagctcgtggcgatcttggggccttcagcaggggacagatgcagaagccctttgaggatgcaagctttgcgctgagaacaggcgaaatgagcggccccgtcttcacagactcaggtatacatattattctgaggaccgaatag

SEQ ID NO: 16563 - DNA, 138 bp, Artificial Sequence
  Description of Artificial Sequence: Synthetic coding sequence
atgcagaaacctttcgaggatgcttcttttgctctgcgaacaggcgagatgtctgggccagtatttactgattcggggattcatatcatcctcaggacggagtgttggcggcagacaagaggcccgaactgtttctag

SEQ ID NO: 16564 - DNA, 438 bp, Artificial Sequence
  Description of Artificial Sequence: Synthetic coding sequence
atggcagatgaggagaagctccccccagggtgggaaaaaagaatgtcgcggtcttccgggagagtctactatttcaatcacattaccaacgcttcccagtgggagagacctagcggaaactcctcttccggaggaaagaatggccagggcgagccagcgagggtccggtgttcacatctgttggtgaagcactcccagtcccgtaggccttcttcatggcgtcaggaaaagatcacacggaccaaggaggaagccctcgagttgataaatggatatattcagaagatcaagagcggggaagaagatttcgagtccctcgccagccagttttctgactgtagcagtgccaaagcacggggagatttgggcgccttctcacgaggcgcccagggcatggggcttaccaggctaggggacccataccaccccgagggatag

SEQ ID NO: 16565 - DNA, 561 bp, Artificial Sequence
  Description of Artificial Sequence: Synthetic coding sequence
atgacgatggtggacacagaaatgcctttctggcctaccaacttcggtatcagctctgtggaccttagtgttatggaggaccactcccatagctttgatataaaaccatttaccacagtggattttagctcaataagcacaccccactatgaagacattcctttcaccagaacagaccccgtcgtggctgactacaagtacgatttaaagctccaagaataccaaagcgctataaaggtggagcccgcatccccaccctattacagtgaaaagacacagctttacaacaagccgcacgaggagccatccaacagccttatggccatcgaatgtcgtgtgtgcggcgacaaagcttcaggattccactacggcgtccatgcctgcgagggctgcaagggtttcttcagaaggacgatccggctgaagctcatctatgataggtgtgatctcaattgccgaatccacaagaagtcaagaaacaagtgccagtactgtaggtttcaaaagtgcctagctgttggtatgagtcacaatgaggagctgcagaaggatagttactag

SEQ ID NO: 16566 - DNA, 1752 bp, Artificial Sequence
  Description of Artificial Sequence: Synthetic coding sequence
atgggcgggctcgagaaaaagaagtatgaacgtgggtcagccaccaattacatcactcgcaataaagccaggaagaagttacagctcagtctggccgactttcgtcgactctgtatcttaaaaggcatatacccgcatgaacccaagcacaagaaaaaagtaaacaagggttccacagctgctcggacattttacctgataaaggacattaggttccttcttcatgaacccattgtcaacaaatttagggaatacaaggtgtttgtgagaaagctgaggaaggcctatgggaaatccgagtggaacaccgtggagcgcctcaaggacaataagccaaattacaagcttgatcatatcattaaagagaggtatccaacgtttattgacgcactgagagacctggacgatgctcttagcatgtgttttttgttctccacgttcccgcgaaccggaaaatgtcacgtgcagactatccaactatgcagacggctcactgtggagttcatgcactatatcatagcagctcgtgccctccgcaaggtgttcctttccatcaaaggcatttactaccaagccgaagtgctgggtcaacctatcgtttggattactccgtacgccttcagccatgaccatcctacagacgtagactaccgagtgatggccaccttcactgaattctataccacactactcggctttgtcaactttcgtctctaccagctattgaacttgcactacccaccaaaactggaaggccaagcgcaggccgaggcaaaagcgggggaggggacttacgccctggatagcgagagctgcatggagaaactcgccgccctgagcgcttccctggcacgggttgtagtgcctgcaacagaggaggaagcagaagtggatgaattccctaccgatggagaggaggaccgacggaaggagctggaagcacaagagaagcataagaagcttttcgaaggcctgaaatttttcctgaatagggaggtcccgcgagaagctttggcctttatcattcgctcatttggcggggaagttagctgggataagtctctctgcattggggccacctacgatgtgacagactcacggattacacaccaaatcgtagaccgcccagggcagcaaacctctgtcatcggaaggtgctacgtccagccacagtgggtgtttgattctgtcaatgctaggctgcttctgcctgtggctgagtacttttcaggcgtgcagctacccccgcacctgtcacccttcgttacagaaaaggagggggactacgttccccctgaaaaactgaaactgctggccttgcagagaggggaagatcccggcaatttgaacgagagtgaggaagaggaagaagaagatgataacaacgagggcgacggggatgaggagggggagaacgaggaggaggaagaggatgctgaagcagggtcagagaaggaagaggaagcccgactggcagccttagaagagcagcgaatggaaggcaagaagccgagggtcatggccggaacactgaagcttgaagataagcaacggctcgcccaagaagaagagtcagaagctaagcggttagctattatgatgatgaagaagcgggagaagtacctgtaccagaaaatcatgtttgggaaaagacgaaagatccgggaggcaaataaactggccgaaaagcgcaaagcccacgacgaggcggtgcgcagtgaaaagaaagcaaaaaaggccagaccagaatag

SEQ ID NO: 16567 - DNA, 1767 bp, Artificial Sequence
  Description of Artificial Sequence: Synthetic coding sequence
atgggaggtctggagaaaaagaaatacgaaagaggcagcgccacaaattatatcacccgcaataaagcgaggaagaagcttcagctcagcctggcggatttcaggcgcctctgcatcctgaagggaatctacccgcatgagcctaaacacaaaaagaaggtgaacaaaggatccacggccgcccggaccttttatttgatcaaggatatcagatttctcctccacgagccaatcgtgaataagtttcgcgaatataaagtgttcgtgcggaagctgagaaaagcttatggaaaaagcgagtggaatacagtagaacgtctgaaggataacaaacccaattataaactcgaccacattataaaggagaggtatcctaccttcatagacgcgcttagagatcttgacgacgcgctaagcatgtgttttctgttctccacattcccacgcaccggaaaatgccacgtccagaccatccagctgtgccgtcgactgacagtcgagtttatgcattacatcatcgccgcacgcgcgttgcgcaaagtgttcctctctatcaaaggtatatactaccaggcagaagtgttggggcagccaatcgtgtggattaccccctacgcattctcccatgaccacccgacggacgttgactatagagtgatggccaccttcacggagttttatacaactctgctaggattcgtgaatttcaggctgtaccaactgttgaatctgcactatccacctaagctggagggtcaagcccaggcggaggccaaagccggcgaaggaacgtatgcactcgattctgaatcctgtatggagaaactagctgcactttccgcttccctggctcgggttgtggtgcccgcaaccgaagaggaggctgaggtcgacgaatttcctacggatggggaaatgtctgcccaggaagaggataggcgcaaggagctggaggctcaggagaagcacaaaaagcttttcgaaggactgaaatttttcctgaaccgagaggtccctcgcgaggctctagcctttattatccgtagcttcggaggggaagtgtcttgggataaatcgctgtgcattggagccacatacgacgttaccgactcacggatcacacaccagatagtagatcgacccggacagcaaacctcagtaatagggcggtgctacgttcagccacagtgggtcttcgacagcgttaatgccaggcttctgctgcctgtggctgagtatttcagcggtgtgcagctccccccccatctaagtccctttgtaactgagaaggaaggagactatgttccccccgagaaattaaagctgcttgcactgcaaagaggagaggatccagggaacctcaatgagtctgaagaagaggaagaggaagacgataacaatgagggtgacggagatgaggaaggcgagaatgaagaggaggaggaggacgccgaggccggtagcgagaaggaggaagaggcgagactcgccgccttggaagaacaacgcatggaaggtaaaaaacctcgggtgatggccggcaccttaaaactcgaggataaacaacgccttgctcaagaagaagagtccgaagcaaaaagactggcgattatgatgatgaaaaaaagagaaaagtacctctaccagaagatcatgttcggtaagagacgaaagattagagaagccaacaagctggcagaaaaaagaaaagcccatgacgaagcagttcgctccgagaagaaagctaagaaggcccggccagagtag

SEQ ID NO: 16568 - DNA, 1350 bp, Artificial Sequence
  Description of Artificial Sequence: Synthetic coding sequence
atgtgtttcctctttagtacattccccagaaccggtaaatgtcacgtacagactatccagctctgtcgtagactgacggtcgaatttatgcattatatcattgccgcccgtgctctgcgaaaggtgtttttaagtataaagggcatctattatcaggccgaggtcctgggccaacctattgtctggattacaccctacgccttctcacacgatcacccaaccgatgtggattatcgcgttatggccacctttaccgaattctacaccacacttctcggctttgtgaattttcggctttatcaactcttaaacctgcactatccacctaaactggagggccaggcacaagcggaggccaaggcaggtgaaggaacctatgccttggacagtgagtcctgtatggagaaactggcagctctgtccgcctcactggcaagagtagtcgtccccgcaaccgaggaagaagctgaggtggacgaatttcctacggacggggagatgtccgctcaggaagaggatcgccggaaggagcttgaggcgcaggagaagcacaagaaactcttcgaaggcctgaaatttttcttgaatcgtgaggtgccaagggaagctctagccttcattatcaggtcatttggcggagaagtgagttgggataagagcttgtgcatcggggccacttatgacgtgacggacagccgtataactcatcagatagtggataggcccggccagcaaacatctgtaatcgggcgatgctacgttcagccgcaatgggtgttcgactccgtgaacgcccgtctgttgcttccagtggctgagtatttcagcggggtccagctccctcctcatttgagccccttcgtgaccgaaaaggagggggattacgtgcccccagagaagctgaagctactcgccctacagagaggagaggatccagggaacttgaacgaatcggaggaggaggaagaggaggacgataacaacgaaggggacggcgacgaggagggagagaatgaggaggaggaggaagacgccgaggccgggtccgaaaaagaggaagaggcgcggctcgccgccctggaagaacagcgaatggaaggaaagaaacctagagttatggctggcaccctgaaactggaggacaagcagcgtttagcccaagaggaagaatcggaggcaaaacggttagctattatgatgatgaaaaagcgcgagaagtacctgtatcagaagatcatgttcggtaagcgtaggaagatacgggaagccaacaaactcgcggagaagagaaaggctcatgacgaggcagtgcgtagcgagaaaaaggctaaaaaagccaggcccgaatag

SEQ ID NO: 16569 - DNA, 1350 bp, Artificial Sequence
  Description of Artificial Sequence: Synthetic coding sequence
atgtgttttctcttttccacatttcctagaacagggaagtgccacgttcaaaccatccagctttgtcggcgacttaccgtggaatttatgcattacattatcgcagcgcgcgccctgcgcaaggtctttttgtcaatcaaaggaatttactatcaggcagaagttcttgggcagcctatcgtttggattacaccatatgcattttcccacgatcacccaacggacgtggattacagggtcatggccaccttcaccgaattttatacaacgctcctgggtttcgttaactttcggttataccagttgctgaatctgcattaccctcccaagctggagggccaggcccaggcagaggctaaggcaggggaaggcacatatgctttagattctgagagctgcatggagaaacttgctgcactgtccgcttcattagccagggtggttgtgcctgctacagaggaagaagccgaagtggacgagttcccgactgacggcgagatgagtgcccaagaggaggatagaaggaaagagctcgaagcccaggaaaaacataagaagttgtttgaagggctgaagttcttcctgaatcgcgaggtgcctcgcgaggcactggcattcataatccggtcattcggcggtgaagtctcatgggacaagtcactgtgtatcggcgcaacttacgatgttacagacagtcggattactcaccagatagttgatagaccaggccagcaaacatcagttattgggcgctgttatgtgcaaccccagtgggtatttgacagcgtgaatgctcgattgctcctccctgtggccgaatacttttccggtgtgcagctgccaccccatttgagtcccttcgtgactgaaaaggaaggtgattatgtgccacctgaaaaactcaagctcttagcgctgcagcggggcgaggacccgggaaaccttaatgagtcagaagaggaggaggaagaggacgataacaatgaaggcgacggtgatgaggagggagaaaacgaagaggaggaagaggacgctgaagccggatccgagaaggaagaggaggcccgcttagccgcactcgaggagcaacggatggaaggaaagaagccacgtgtgatggctggcacgcttaagctggaggataaacaacgcttggcccaggaagaggaaagcgaggccaagcgcttagccatcatgatgatgaagaaaagagagaaatacctttaccagaagattatgttcggcaagcgacggaagattcgagaagccaacaagttggccgagaagcggaaggcccatgacgaagcggtaaggtcagaaaaaaaggctaaaaaagctagacccgagtag

SEQ ID NO: 16570 - DNA, 5154 bp, Artificial Sequence
  Description of Artificial Sequence: Synthetic coding sequence
atggaacctgccgctgccgcaaccgtacagcggcttccagagttaggacgcgaagacagagcctctgcccctgcagccgccgccgccgcagcagctgctgcagccgcagctgccgcggcacttgccgcggcggcgggaggaggtcggtcccctgaacccgccctgacacctgccgccccatccggcggcaacggctcagggtctggggctcgcgaagaggcccctggagaggcacctcccggacccctcccagggagggccggaggcgcagggcgtaggaggcgacgcggcgcccctcagcccatcgccggcggagcagcaccagtgcccggtgcaggaggtggcgccaattcactgctcctcaggcgaggtcgcctgaagcgcaacctaagcgctgccgccgctgcagcttcctcctcttcttccagctctgccgccgccgcttcacactctcccggagcagccggccttcctgccagctgcagcgcatcagcctcactgtgtacgcggtctctggaccgtaagaccttgcttctgaaacataggcagactctacaacttcagccaagtgaccgtgactgggttcggcatcagctgcagaggggctgtgtgcacgtctttgatagacacatggccagtacttacctgcgaccggtgctgtgcactctggatactaccgctggagaagtggccgccagactactgcagctagggcacaaagggggtggcgtggtgaaggtccttgggcaggggcccggcgccgcagcggcgcgggaaccagctgagccaccgccggaagcgggcccaagactggcccccccagagcccagagatagtgaggtgcctcccgcgcgctctgcaccaggcgcatttggcgggcctcctcgcgccccgcccgctgatctccctctcccggtgggtgggcctgggggatggagtcgcagggcatcacccgctcctagtgatagcagccctggagaacccttcgtgggggggccagtctcaagcccaagagctcctaggcccgtggtttccgatacagagagctttagcctaagcccaagcgctgagagtgtgagtgatcggctggatccctattcctcaggtggcggatcgtctagctctagcgaagagctggaagcagacgccgcctccgcccctactggagtaccgggtcagcctcggcgcccaggtcacccggctcagcctctacctctcccacagaccgctagctcaccccagccccaacagaaagcgcccagagcaattgactctccaggcggggccgttcgagaagggtcatgcgaagaaaaagcggcggctgctgtcgcacctgggggtctgcagtccacaccaggacgctctggtgtaaccgccgagaaagcccccccgcctccaccacctccaacgctgtacgtgcagctgcacggggagactaccagaagactagaggcagaagaaaagccactccagattcagaatgactacctctttcagttaggatttggtgagctatggcgggtacaggaagaaggcatggatagcgagattggatgcctgattcgcttttacgccggcaagcctcactctacaggaagttccgagcgcatacaactttcgggaatgtataacgtccgtaagggtaaaatgcagctccccgtcaatcgctggactcgcagacaagttattctgtgcggaacctgtcttatagtaagctccgtgaaagattctctcaccggcaaaatgcatgtgctccctctcattggggggaaagtggaagaggtcaagaagcaccagcactgtttggcctttagctcttccgggcctcaaagtcagacatattatatctgctttgacacatttacagaatatttacgctggctgaggcaggtgagcaaggtggcttcccagagaatctctagcgtcgacctaagctgctgttcactggaacacctgccggcaaacctattctatagtcaggatttgacgcacctgaacctgaaacagaattttctgcgtcagaacccttccctccccgcagcaaggggactaaatgaactgcagcggtttaccaagttgaaatcactgaatttgagcaacaatcacttgggggacttccccttagcggtctgctccattccgacacttgcggaacttaatgtgagctgcaatgcactgcgtagtgtgcccgccgccgttggagtgatgcacaaccttcagacttttctgctcgacggtaattttttacagtctttgcctgctgagctcgagaacatgaaacaacttagctacctcgggttgtctttcaacgaatttaccgatattcctgaagtgttagagaagctcaccgccgtggacaagctgtgcatgtctggaaattgtgtcgaaacactgcgcctacaggccctcagaaaaatgcctcatatcaaacacgtcgacctccgtttgaatgtgatccggaaactgattgccgatgaagtggattttctgcagcacgtaactcaacttgacctccgagacaataaactaggtgatcttgacgccatgatttttaataacatcgaggtgctccactgcgagcgcaaccagctggtgacccttgatatttgcggttattttctgaaagcgctgtatgcatcatcaaacgaactggtgcagcttgacgtgtaccctgtgcccaattatctcagctatatggatgtcagtaggaaccgactggaaaatgtgccagagtgggtgtgcgaatccagaaagctggaagttcttgatattggccacaatcagatctgcgaacttccggcacggctgttctgtaattcctccttgaggaagcttttagctggtcataatcagctggctagactgccggagcgcttggagcggacttccgtcgaggtgcttgacgttcagcataaccaattgctagagctgcctcccaatttattgatgaaagcagacagcctccgtttcctcaacgcctctgcaaataaactggagtcactcccaccggctacactcagcgaggaaaccaattccatcctccaggagttatatttaaccaataactccttgaccgataaatgcgtgccgctgcttacagggcatccacacctgaaaatcctccatatggcctacaataggctgcagtcttttcctgcgtccaaaatggccaaactggaggagctggaggagattgacctctccggcaataagctcaaggctatcccgaccacgattatgaattgccgacgaatgcacaccgtaattgcgcactctaattgtattgaggtattcccagaggtcatgcagctccccgaaatcaaatgtgtagacctatcatgcaacgaactttctgaggtgactctgccagagaatctgccccctaaactgcaggaattagatctgaccggaaatccacgactagttcttgaccacaaaactctagaactactcaacaacattcgctgctttaaaatcgaccagcctagtacaggcgatgcctccggggcccccgcagtctggagtcatggctacaccgaggcttcaggggtcaaaaacaaactgtgcgtcgccgccctgagcgtgaataacttttgcgataatagagaggcgttgtacggagtgtttgacggtgatagaaatgtagaggtgccttacctgctccagtgtactatgagtgacatcctagctgaagagctccagaaaaccaagaacgaggaagagtacatggtgaatacatttatcgtcatgcagcggaaactaggcaccgcaggtcagaaactaggtggtgcagctgtcttatgtcatatcaagcacgatcctgttgatccaggcggttcatttaccctgacatccgccaacgtgggtaagtgtcaaacagtgttgtgccgaaatggaaagcccctgcccttgtctcgcagttatataatgtcctgtgaggaagaactgaaacgcatcaaacagcataaggccatcatcacagaggacgggaaggtaaacggcgttacagaaagcacccggatcctcggctataccttcctgcatccatctgtggtgcccagaccacacgtgcagtccgtgcttttaactccacaggacgaatttttcatcctgggttccaagggcctttgggacagcctgtccgtcgaggaagcagtggaggcagtccgcaacgtaccagatgcactggctgcagccaaaaaactgtgtaccctggcacagagctatggatgtcacgacagcatcagtgctgtggttgtccagctgtctgtgacggaagatagcttttgctgctgcgaactttctgccgggggcgcagtccctcccccatctcccgggattttcccaccaagcgttaatatggttattaaggacaggccaagcgacgggttgggtgttccaagctcatcaagtggaatggctagcgagatcagttctgagttaagtacctctgagatgtcgtccgaagtggggagcacagcatccgatgaacctcctcctggtgcactgagcgaaaacagccccgcctacccttccgaacagcgatgtatgctgcaccccatatgcctgagcaacagcttccagaggcagttaagctccgccactttttccagtgcgttctccgataatgggttggatagcgacgatgaagagcctattgagggggtctttacaaacggatctcgagtagaggtcgaagttgacattcactgtagtagggctaaggagaaggagaagcaacagcatctactgcaagttcccgccgaagcttcagacgaaggcattgtaatttccgccaacgaagacgagcccggactgcctcggaaggcagatttcagcgcggtcggcactattggcaggaggagagcgaatggcagtgtggccccccaggagaggtcccataatgtcatagaggtagccacggacgccccattgcgaaaacccggcggttactttgcggccccagcccagcccgacccagacgatcagttcatcatcccccctgaactcgaggaggaggtgaaagagataatgaagcaccatcaggagcagcagcagcagcaacagccaccaccacccccacagttacagcctcaattacctcgccactatcagctggatcagctgcctgactattacgacaccccactttag

SEQ ID NO: 16571 - DNA, 3618 bp, Artificial Sequence
  Description of Artificial Sequence: Synthetic coding sequence
atggattcagaaatcggctgtttaattagattttacgctggtaagccccactctacaggtagtagcgagcggatccaactttccggcatgtacaacgtacgaaagggcaaaatgcagttgccagttaataggtggacccgtaggcaggttatcttgtgcggcacgtgcttgatcgtgtcgtccgtgaaggactccctgactggaaaaatgcacgtgctgccactaatcggcgggaaggtggaggaagtgaaaaaacaccaacactgtctcgcgttctctagttcaggtccccagagccagacatattacatttgttttgacacatttacagagtatctacgctggctgaggcaggttagcaaagtagcctcacagaggattagcagcgtcgatctgtcctgttgcagcctagagcatctaccggctaatctgttttacagccaggaccttacccatttgaatctgaagcaaaacttcttaaggcagaacccttcccttcccgccgcgcgcgggttaaatgaactgcagcggttcactaaactgaaaagcctgaacttaagcaataatcacctgggggatttccctttagccgtatgtagcatccccactctggccgaactgaacgtgagctgcaatgctctaagatcagtgcccgcagcggtgggagtgatgcataacctgcagacattcttactggacgggaatttcttacagtcattgccggctgaattggagaatatgaaacaattgtcctacctcggcttgagctttaacgagtttacagacatcccagaggtgctggagaaactcaccgccgtagacaagctgtgcatgagcgggaattgcgttgagaccttgagactccaagcactcaggaagatgccccatatcaagcatgtcgatctccggctcaacgtcatacgcaaactaattgcagacgaagtggatttcttacagcacgttacacaactggacctgcgagataataagttgggcgacctggacgcaatgatcttcaacaatatcgaggtgctccactgtgagcgaaaccagttggtgactcttgatatatgcggatactttctaaaggcgctctatgcctcctctaatgagctagtccagctggatgtctacccagtaccaaattatttgtcctacatggacgtttcccggaaccggctggaaaacgtgcccgagtgggtgtgtgaatcccgcaagctggaggttttagatatcggacacaatcagatctgcgagctgccagcccggctgttttgcaactcatcactgagaaagctgctggccggacacaatcagctggcccggctgccagaaagattagagcgcacatcggtggaggtgttagacgtgcagcacaaccaactgctcgaactacctcccaatcttcttatgaaagccgattccctgcggttcttgaacgcaagcgctaataagctggagtccctcccccctgccacactgtccgaggaaacgaactcaattctgcaggaactttaccttaccaataactccctcactgataaatgcgtgccacttctgaccggacatccccacttaaaaatcctccacatggcctacaatagactccagtcgtttcccgcaagcaaaatggccaaactggaggagttagaggagattgacctgagcggaaacaaactgaaagccattccaacaaccattatgaactgcagaaggatgcatacagtgattgcgcactccaactgtatcgaggtcttcccagaggtaatgcagttgcctgagataaagtgcgtggacctgtcctgcaatgagttatctgaggtcacactgcctgaaaatttaccacctaaactgcaggagcttgacctgactggaaatcctagattagtgcttgaccataagacgctcgagctgttgaataacattcgttgcttcaagattgatcagccctcaacgggggacgcgagcggggcccccgctgtgtggtcccacggctacaccgaagctagcggtgtcaagaataaattgtgtgttgccgctctctccgttaataatttttgtgataatcgggaggcactgtacggtgtcttcgacggggaccgtaacgtggaagtcccatacctgctacaatgtaccatgagtgatatcctcgccgaggagcttcagaaaacgaagaatgaagaagagtacatggtcaatacctttattgtcatgcagcggaagcttggcaccgccggacagaagcttgggggcgctgctgtattatgtcacattaagcacgaccccgtagatccagggggttcattcacgctgacctctgcaaatgtcggcaaatgtcagacagttctgtgtcgtaatggcaaacccctgcccctgagccgcagttacatcatgagctgtgaagaggaactgaagcgaatcaagcaacacaaggctattatcacagaagacgggaaagtgaatggggttacagaaagtaccaggatacttggatacacatttttacatccaagcgtggtgcctaggccccatgtgcagtcggttctgctgacccctcaggatgagttcttcatactcggcagtaaaggcctctgggatagtctctccgtggaagaggccgtggaggcagtccggaatgttcccgatgcactcgctgcagccaaaaagctttgcactctggcgcaaagctatggctgtcatgactctatcagtgctgtggttgttcaactctcagtgactgaggacagcttttgttgctgcgaactatcggccggcggtgctgtacccccccccagtccagggatcttcccaccatcagtaaacatggttatcaaggatcggccctctgatggtctgggggtgccctcttcaagtagcggcatggcgagcgagatctcctctgagctgtcaacaagtgagatgtcctccgaagtgggatctaccgcaagcgatgagccgccacctggggccctttcagaaaattctcctgcatacccctcagaacagcgatgtatgctgcaccccatctgcctcagcaatagttttcaacgacagctttctagcgccacctttagttcagctttcagcgataacggactcgactctgacgatgaagagcctattgagggcgtgttcaccaacggctcgcgagtcgaggttgaggtggacatccattgcagtcgcgctaaggagaaggaaaagcaacaacatctcctccaggtacctgccgaggcatctgatgaaggcatagttatttccgctaatgaagacgagccaggcttgccacgcaaggccgattttagtgcagtgggcacaatcggacgccggcgggccaacggtagcgtagccccccaggaacggtcgcataatgtgattgaagtagcaaccgacgctcctctgagaaagcctggcggatactttgccgccccggcgcagcctgatccagatgaccagtttattattcctcccgaactggaggaggaagtgaaagagattatgaagcatcatcaggagcaacagcagcagcagcagcctccaccacctccgcaattgcaaccgcaactaccaagacactaccagttggaccagctaccagattactacgatacccccctatag

SEQ ID NO: 16572 - DNA, 2379 bp, Artificial Sequence
  Description of Artificial Sequence: Synthetic coding sequence
atgcatatcctcccactggtcggaggaaagatcgaagaagtcaagagacgccagtacagcctagccttttcctctgctggcgcacaggcccagacctaccacgtgtcatttgaaacgctggccgagtaccaacgctggcaacgccaggcctcaaaagtagtgtcgcaacgcatatctactgtggatttgagttgctattccttggaggaagttcctgagcacctgttttacagccaggacattacatacctgaacctgaggcataatttcatgcagctcgagaggccggggggtctggataccttatataaattcagccagttgaaaggtctaaacctgtctcacaacaaactcggcctttttcctatactcttgtgtgaaatctctacgctcacggaacttaatttgagttgtaacggctttcacgatctcccctcgcagatcgggaacctgctgaacctgcagacactgtgcctggatggcaattttctgacaacactccctgaggagctaggaaacctccagcaactgtcttctttaggaatcagcttcaacaacttctctcagattccagaggtctatgagaaactaactatgttggatagggtggtcatggcaggcaattgtctcgaggtcctaaacctcggcgtactcaataggatgaatcatataaaacacgtggacctccgtatgaatcacttgaaaactatggtcatagaaaatttggaaggtaacaaacacataacccatgttgatctacgtgacaatcgtctgacggatttggacctttcctccttatgcagtcttgagcagttgcactgtgggcggaaccagctccgtgagctgactctctccggcttcagccttcgcacactgtacgctagttctaatcggcttactgcagtgaatgtgtatcccgtcccatctttgctaacattccttgacctttcacgcaatcttttagaatgcgtgcctgattgggcctgtgaggctaagaagattgaagtacttgacgtgagctataatttattaactgaggttcccgtccggatcttatcaagcctgtccctgcgcaaactgatgctgggacacaaccatgttcaaaacctcccgaccctggtggagcatatccctctcgaagtgttggaccttcagcacaacgctctgacccggctgccagacaccctgttttctaaggccttgaacctgcgttacctaaacgcttcagccaactctctggaatctctacctagcgcatgtacgggtgaggaatccttatctatgctacaactgctctatcttactaacaatctgctaaccgaccagtgtatccccgtgttggtagggcacctccacctgaggatactgcacctggctaacaatcagctccaaacttttccagcttccaagttgaacaaactggaacagctggaggagttgaatttaagcggcaataagttgaagaccattccaaccacaatagccaactgtaagcggctacatacactggtcgcccactcgaacaatatctctatttttcctgaaattctgcagcttccgcagatacagttcgtcgacctatcttgtaacgacttaaccgaaatccttatacccgaagcccttcctgctactctccaggatctggaccttactggtaacactaacctggtccttgagcataagactcttgacatttttagtcatatcaccactctgaaaatcgaccagaaacctctccccacaacggatagcaccgttacatctacgttttggtctcatgggttggcggagatggccggacagcggaataagctctgtgtaagcgcgctcgctatggatagctttgccgaaggcgttggcgcggtgtatgggatgttcgacggagataggaatgaggaattgcctcgtctcctgcaatgtactatggctgatgtgctgctcgaagaggtgcagcagagcaccaacgatacggtttttatggccaacacctttttggtcagtcaccgaaagctgggcatggctggccagaaattgggctcttccgcactgctttgctacattaggcccgacacggctgaccctgccagtagcttctcgctgacagtcgcgaacgtagggacatgtcaggctgtcctttgtagaggtggtaagcccgtccctttatctaaggttttcagccttgagcaggatcccgaggaggcccagcgtgtgaaggatcaaaaagctataatcacagaggttcctgaggatctcaaggagttccagacaacggacatccctgttcaccactgtaatttccgtgccgttttgggctgtctttgttctgccagcgtgctcggctcatacgccgggcccgcccctaggtggcggaggacctag

SEQ ID NO: 16573 - DNA, 3972 bp, Artificial Sequence
  Description of Artificial Sequence: Synthetic coding sequence
atgaaaagaaacggttccaggaattgcctgaaccggaggagcaggttcgggtcaagagaacgcgactggctgcgggaggatgtcaaacggggctgtgtttacctttatggcgccgataccaccacagcaaccactacaacaactacatcaagctccagcagctcaagttcttcgtctagtgatctccatctggtactctgtaccgtggaaactccggcaagtgagatatgtgctggggaaggcagggaaagtttgtatttacaattgcatggcgacctcgttagacgcttggaaccaacagaacgccctctgcagattgtgtacgactacctcagccggctgggtttcgacgaccccgtcagaatccaggaagaagccactaatcccgatttaggttgtatgatccggttttacggagagaaaccttgccacatggaccgtctcgatagaatactgctaagcggcatttataatgtgcggaagggaaaaacacaactccacaaatgggccgagcggctggtggtcctatgcgggacatgcctcatcgtctccagcgttaaggactgtcagactgggaagatgcacatccttcccctagtgggagggaaaattgaagaggtgaagagaagacagtattccctggcattctcatcagccggcgcccaggcccaaacctatcacgtgtccttcgaaactttggcagagtatcaaagatggcagaggcaggcgtccaaggtggtgagtcagcggatttctacagtcgacctcagctgctactcactagaagaggtcccagagcatctgttctattctcaggacattacatacttgaatctccggcataacttcatgcagctggagcggcccggtgggctggacaccctgtataaatttagccagctcaagggactcaatctctcgcataacaagctaggtctgtttcctattctgctatgcgaaatctctacactgaccgagcttaacctttcttgcaatgggtttcacgacctaccatcgcaaattggaaatctgctgaacctgcagacgttgtgtttggacgggaatttccttacaactcttcccgaggaactggggaatctacagcaactctcctccctgggaatttcattcaataacttctcccaaattccagaggtgtatgagaagttgactatgcttgaccgcgtagtgatggcgggcaactgcctagaagtgctgaacttgggagtgctcaaccgaatgaaccatatcaagcacgtcgacctgagaatgaaccacctcaagacaatggtaatagaaaatcttgaggggaataagcatatcacacatgttgatctgagagataacagactaactgacctggatttatccagcctctgctctctagagcagctccactgcggcaggaaccagcttcgggagctcactctgtccggattcagccttaggactctatatgctagtagtaatagattgactgcagttaacgtgtatcccgtcccgagtttgttgacatttctcgacctgtcacgcaatctgctcgagtgcgtcccagattgggcatgtgaggctaagaaaattgaagtgctcgacgtttcttacaacttgctgacagaggttccggtgagaatactgtcaagcttatctctgaggaaactgatgttgggccataaccatgttcagaacctgccaacgttggtcgagcacatccctcttgaggtgctggacttacagcacaacgcactgactagattgcccgacaccttattctcaaaggcactcaatttgcggtatcttaacgcttccgcaaactctcttgagagcctcccttctgcttgtactggagaggagtccctctctatgcttcagctcctttacctgaccaataatctgctgacagaccagtgcattcctgtgctggtgggtcatctccaccttagaatcctgcatcttgccaacaaccagctgcaaacgttcccagctagcaagctgaataaactggaacagctcgaagagttaaatctgtctggtaacaagcttaaaaccatcccaactaccatcgcaaattgtaaacgattgcataccctggtggcccatagcaacaatattagcattttccctgagatcctccaactgcctcagatacagtttgtcgatctttcttgtaatgatctaaccgaaatcctcattcctgaagccttgccagcaaccttgcaggacttagaccttacaggtaacacgaacctggtgttggaacataagactttagacattttttcacatatcactacacttaagatcgatcagaagcctcttccaacgactgactctactgtaacctcaacgttttggagccacggcttggccgagatggccggccagcgtaacaaactgtgcgtgtctgctctggctatggactccttcgccgaaggcgttggagcagtctacggaatgtttgatggcgaccgtaatgaggagctgccacgcctgctgcaatgcaccatggcagatgtcctactggaagaagtccagcaatccaccaatgatacagtttttatggcgaatacatttttggtgtctcacagaaagctgggcatggctggccagaagctaggaagctccgcgctgctgtgctatattcgaccagacaccgccgatcctgcatcttccttctccttgactgtggctaatgttggcacatgtcaggcggttctgtgccgcggaggaaaacccgtgccactgtccaaggtcttctctttagaacaggacccagaggaggcccagagagtcaaagatcaaaaagccattataactgaagacaataaggtgaatggcgtgacctgttgtacacgcatgttgggatgcacttatctgtacccctggatcctgcccaagccccatatctcttcaacacccctgacaatccaagatgagctgttgatactgggtaacaaggcactgtgggagcacctctcttatacagaggccgtaaacgctgttcggcatgttcaggatcccttagctgcagcaaaaaagctctgcaccctggctcagagttatggttgccaggataacgtgggggcgatggttgtgtatctgaacatcggcgaggagggctgcacttgcgaaatgaacggtctgaccttacctggcccagtgggtttcgcatctaccacaactataaaggacgccccaaagccagccacgccatcaagctcctctggcatcgccagcgagttttccagcgagatgagcacctccgaagtatccagcgaggtgggaagtacagcatccgacgaacacaacgcaggtggactggatacagccctgctgccacggcccgagaggcgatgttccctgcacccaacccccacgtctggcctgttccagcgtcaaccttcttccgctaccttcagtagtaaccagtctgataatggcctggactctgacgacgaccagcccgttgaaggggtgatcaccaatggcagcaaagtggaagtcgaagttgacattcactgttgcagagggcgcgatctggagaatagtccccctctgattgagtcctctcctacgctctgcagtgaggagcatgcccggggatcatgctttggaatacggcgtcaaaactctgtaaatagtggtatgctcctcccaatgtcgaaggaccgcatggagctccagaaatccccaagcacatcttgtctttacggcaaaaagctgtccaacggatccatcgtacctctagaagattcccttaatctgatcgaagttgcaactgaggttcccaaaagaaagacagggtatttcgcagcgccaacacagatggaaccagaggaccagttcgtggtgcctcatgacctggaggaggaggtgaaggagcaaatgaaacagcatcaagattcgcgtttagaacccgaaccgcatgaagaggaccgcactgaaccacccgaagaattcgacactgccttgtag

SEQ ID NO: 16574 - DNA, 2871 bp, Artificial Sequence
  Description of Artificial Sequence: Synthetic coding sequence
atgaagagaaatggctcacggaactgcctcaaccgtcgttcaaggttcggctccagagagcgggactggctgcgagaggacgtcaagcgggggtgcgtctatctgtacggagcagacacaacgacggccaccaccactacaacaacatcatcaagttcctcaagctccagtagctcttcggatctgcacttagttctctgcacggtggaaactcctgcctcagagatttgcgcaggagaaggcagagagagtctgtaccttcagcttcacggcgaccttgttcgccggttggagcctactgagcgcccactgcagatagtgtacgattacttgtcccggttaggcttcgatgatcccgttcgcatacaggaagaagccaccaaccctgatcttggctgtatgatacgattttacggcgagaaaccgtgccacatggatagactggaccgtatcctgctgagcggtatatataacgtgaggaaggggaaaacccagcttcataagtgggctgagcgcttagtcgtcctctgcggcacctgtctgatcgtgtcatctgtgaaggactgccaaaccggaaagatgcatattttgcctctggtcggagggaagatcgaagaggtcaagcggagacagtactctttagcctttagttcagctggtgcccaggcccaaacataccatgttagttttgagacgcttgctgagtatcagaggtggcaacggcaagccagtaaggttgtttcccagaggatcagtaccgtcgatctatcttgttactcactcgaggaagtgccagaacatctgttttacagtcaagatattacttacttaaatcttcgccacaatttcatgcagctggaacgcccgggaggccttgataccctatataaattctctcaactgaaaggactgaacctgagccacaacaagttaggtctgtttcccattctactgtgcgaaatatcaactctgacggaactgaacctgagttgcaatgggttccacgacctaccttcccagattggaaatctccttaacttacagactctgtgtctcgatgggaattttctgacaaccctcccggaggagctgggcaatttacagcagttgtcttccctgggtatctctttcaataacttctcccaaatacccgaggtgtacgagaaattaaccatgctggacagagttgtcatggcaggcaattgtctagaagtgctgaatcttggggtactgaaccgtatgaaccacatcaagcatgtcgaccttcgaatgaaccatctgaagactatggtaatcgagaatctggagggcaacaagcacatcactcacgttgacctgcgcgacaacagactgacagacttggatttgtctagcttgtgtagtctggaacaactgcattgtggccgaaatcaacttagggaactgacactctctgggttttccctgagaacgttatacgcatctagcaatcggctcaccgctgtcaatgtctatcccgtcccaagcctcctgacttttcttgacttatcccgaaatctgctcgaatgcgtgcctgattgggcatgcgaggccaaaaagatcgaggtattggacgtttcttataatctactcacagaagtgcccgtcaggatcctgtcctctctcagtctgagaaaactcatgttaggccacaatcacgtgcagaaccttccaactcttgtagaacacatccctcttgaggtgcttgatttgcagcacaatgctttgaccagactgcccgacacgctcttcagcaaggccttgaacttaaggtatctcaacgcctcagccaactcattagagagtctgccatctgcctgcactggcgaagagagtttatcgatgctgcagctcctttatctaactaacaatcttctcaccgaccagtgcataccggtcttggttggccaccttcacctgaggattttacacctggcgaacaaccagctgcagacgtttcccgcatccaaactgaacaaattagaacagctggaggagctgaatttgagtgggaataaattgaaaactatcccgactaccatcgcaaattgtaagcggcttcacactctggtcgcccattcgaacaacattagcatattcccggagatactgcagctgccacaaatccaatttgtggacttaagttgtaatgatctcacagagatactcattccggaggcgctcccagcaacattgcaggacttggacttgaccggcaacaccaacttggtgctggaacacaagacacttgatatattcagccatatcaccacactgaaaatcgaccagaagcctctcccgactaccgattctaccgtgacctccacattctggtcccacggcctcgctgagatggcaggccagcgtaataaattgtgcgtaagtgccttagcgatggattcttttgcagagggcgtgggggccgtgtatggaatgttcgacggtgaccggaatgaggagctgcctcgactcctccagtgcacaatggcagatgtgctgctggaggaggtccagcaatcgactaatgacaccgtgtttatggcgaatacctttctggtgagtcatcgaaaactggggatggcaggccaaaagttaggatcatccgctctgttatgttacatcagacccgacacagcagatccagcttccagtttttcgctaactgttgccaacgtaggaacttgccaggcagtgttgtgccgcggagggaaaccagtgcctctatccaaggttttcagtctggaacaggaccccgaggaggcccagcgggtaaaggaccagaaggcgataatcactgagaactgggtgctgaaccagaagcatttacaagacttccccggggaagataaatag

SEQ ID NO: 16575 - DNA, 3771 bp, Artificial Sequence
  Description of Artificial Sequence: Synthetic coding sequence
atgaagcggaatggctcccgcaattgccttaatcggaggtctcggttcggatcacgtgaacgcgactggctgcgtgaggatgtcaaacgtgggtgtgtttacttgtatggtgctgataccacgaccgcaaccaccactacaaccacaagctcaagtagcagctcctccagctcatcctccgacctacatcttgtcctgtgcaccgtggaaactcctgccagcgagatctgtgctggcgagggacgcgagtcactctatctccagttacatggcgatctggtgagacggctggagcccactgaacgtccgctgcagatcgtgtatgactacctgtccagacttggttttgacgatcctgtgcggatccaagaggaagcaacaaatcccgatctggggtgcatgatccgcttctacggcgagaagccatgccacatggatagacttgacaggattttgctgtcaggaatttacaatgtcagaaaggggaagactcaacttcataagtgggccgaacgattggttgttttgtgtggtacttgtctgattgttagctcggtgaaagattgccagaccggcaagatgcatatactcccacttgtcggcggaaagattgaggaggtcaagcgaaggcagtacagtctggcgttctcgagcgctggggcccaggctcagacgtatcatgtctcctttgaaactttggccgagtaccaacgttggcagagacaggcatccaaagtcgtaagccagaggatttccactgtcgatttgagttgttacagcctcgaagaagttcccgagcacttgttctattctcaggatatcacttatctgaatctgagacacaatttcatgcaactcgaacgccccggtggacttgacacgctgtacaaattctcacagttaaaagggctgaacttgtctcataacaaacttggtttgtttcccatcctattgtgtgagatcagcacgttaactgagttgaacttaagctgtaacgggtttcacgatttaccatcacagatcggtaatctgttgaatttacagacactgtgcttagacggcaattttttaactacacttccagaggaacttggaaacctacagcagctttcaagcctgggaattagctttaataacttttcacagatcccagaggtgtacgagaaattgaccatgttggatagagttgtgatggcaggaaattgtctcgaggttttgaatctgggcgtgctgaaccgaatgaaccatatcaagcacgtggatcttagaatgaatcacctgaagacaatggttatagagaacttggaaggcaacaaacacattacgcacgtggatttgcgagataacagactcaccgacctcgatctgtctagcctgtgttcccttgagcaactgcactgcggccgcaaccaactgagagaactcaccctgtccggattttccctgaggaccctctacgcttcctctaataggctgacagctgtcaatgtatacccagtcccctcattgcttacatttctggacctgtccagaaacctcttggaatgtgtgcctgattgggcctgcgaagccaagaaaattgaggtccttgatgtgagttataaccttttgactgaggtccctgtacgtattctgagcagcctgagcctgcgtaagcttatgttaggccacaaccacgttcaaaacctgccaaccctggtggagcacattcccctagaagtgttggacttgcagcacaacgctttaacccgattgccggacacactgttctcgaaagcgttgaataaactcaataagctcgaacaattagaggaactgaatctgtccggaaacaaattaaaaacaattcctacaacgatcgctaattgcaaacgcctgcatacgctggtggcacactctaataatatcagtatatttcctgagatcctccagcttcctcagatacaattcgtcgacctgtcatgtaatgatctgaccgagatcctaatccctgaggctcttcctgctacgctgcaggatttagatctgacaggcaacacgaacttggtcctcgaacataagacacttgacattttttcacacatcacaacccttaagattgaccaaaagcccctccctaccacagattctacggtgacctcaacattctggagccatggcctggctgagatggccggccagcgaaacaagctgtgcgtgagtgctttggcgatggatagcttcgcggagggcgttggtgccgtctacggcatgttcgatggtgacaggaatgaggaactaccccggctgttgcagtgtaccatggccgatgtcctgctggaggaagtgcagcagtcaaccaatgatacagttttcatggccaatacgtttctggtgtcacacaggaagctcgggatggccgggcagaagctggggtcctcggcgttgctgtgttatatacgcccggacactgcagaccctgcttcatctttttctcttactgtcgccaatgtggggacctgtcaggcagtcttatgccggggaggaaaacccgttcctttaagcaaggtcttttcactggagcaggacccggaggaggcccaacgtgtcaaggatcaaaaagctatcatcaccgaggacaacaaggtgaatggtgtaacgtgttgcaccaggatgttgggatgtacctatctatatccctggatcttgcctaagccccacatttcttctacccccctgaccattcaggacgaactcctgatcctgggcaacaaagccctgtgggagcacctgtcttacacggaagcagtgaatgccgtccggcatgtgcaagaccccctcgccgccgccaaaaagctctgcacgctggctcagagttacgggtgccaggacaatgtcggggcaatggtagtatacctgaatataggagaggaagggtgtacctgcgagatgaacggattaactctgcccggaccagtgggttttgcctctactactactataaaggatgcccctaaaccggctacccccagctcatcgagcggcattgcttccgagtttagctcagagatgagcacaagtgaggttagttcagaggtgggttccactgctagtgatgagcataatgccggcgggctggacaccgccctattgcctaggcccgagcggaggtgctctctccaccccactcctacctccggtctttttcagaggcagcccagtagtgccactttttcctccaatcagtccgataacggactcgacagtgatgacgaccaacctgtcgagggagtgatcacaaacggaagcaaggtggaggtagaggtcgacatccactgctgtcgcgggcgggatttggagaattctccgccgctcatagagtcgtcaccaaccttatgtagcgaggaacatgctagagggtcatgcttcgggatccgccgacagaactctgtgaactcagggatgctgcttccaatgtccaaagataggatggagctccagaaatcacctagcacctcttgcctgtacggaaaaaaactgtctaatggtagcatcgtacctctggaggacagccttaacctaatcgaggtcgccactgaagttcctaagcggaagactggatatttcgccgcgccaactcaaatggagcctgaagatcaattcgtggtacctcatgaccttgaagaagaggtaaaggagcagatgaaacaacaccaggacagccgcctcgaaccggaacctcacgaggaagatcgcaccgagcctcccgaagagtttgacactgctctgtag

SEQ ID NO: 16576 - DNA, 1272 bp, Artificial Sequence
  Description of Artificial Sequence: Synthetic coding sequence
atgaaacggaatgggagtcggaattgcctaaacaggagaagccggtttggttctcgcgagcgcgactggcttagagaagatgttaaaaggggctgcgtgtatttgtacggagccgacaccacgacggccaccaccacgacaaccacttcctctagctcctcaagcagctcttcctcgagcgacttacacctagtactctgcaccgttgagacccccgcctctgagatttgcgcaggggagggccgagaatcactttacctgcaacttcacggggatctggtgcggcggttggagccaactgagaggcctctacaaattgtttacgattaccttagccggttgggatttgacgatcctgtccgcatccaggaggaggctaccaaccctgacttggggtgtatgatcaggttttacggcgagaagccttgtcatatggaccgactggacaggatattgctttcgggaatttataacgtgcgcaagggcaagactcaattacacaagtgggccgagcgcttggttgttctttgcggaacttgcttaatcgtatcctccgtgaaggattgtcagacaggcaagatgcacattttaccactagtgggaggaaagattgaagaagtgaaacgcaggcagtattctcttgccttttcatccgcgggcgctcaggcgcagacataccacgtgtcttttgaaaccctggcggagtatcagcgctggcaaagacaagcttctaaagtggtttctcagcgaatcagcacggtggacttaagttgttactctcttgaggaggttccagagcacctgttctactcgcaggatattacatacctgaacttaaggcacaacttcatgcaattagaaaggcccggcggtctcgacactttgtacaagtttagtcagctgaagggccttaacttgagccacaacaaactgggcctcttcccgattctgttatgtgagattagtactctgacggagttgaatctaagttgtaatggtttccatgacctgcctagccaaatcggaaacttgctcaatcttcagacactctgtctcgacggaaatttcctaaccacccttcctgaagaactgggaaatctgcagcaattgagtagtctgggaatatcctttaataacttctcccagattcctgaagtgtacgaaaaacttacaatgctggatagagtggtgatggcaggtaattgtttggaggtccttaatcttggggtgctgaataggatgaatcacattaagcatgtcgacctaagatag

SEQ ID NO: 16577 - DNA, 501 bp, Artificial Sequence
  Description of Artificial Sequence: Synthetic coding sequence
atggccggacaacgcaacaagctctgcgtgtctgccttggcgatggactcgttcgcagagggcgtcggggcagtgtatggcatgttcgacggggacagaaacgaggagttgcccaggcttctgcaatgcaccatggcagacgtgctgctcgaggaggtgcagcagagcacgaacgataccgtgttcatggccaacacatttctcgtgagccaccggaaactcggaatggctggacagaaactgggctcctccgccctcctctgctatataagaccagacaccgccgaccccgctagctccttcagtctcacagtcgctaacgtcggtacctgtcaggctgtactctgccgaggcgggaagccagtaccactcagcaaagtgttctcactggaacaggatcctgaggaggcccagagggtgaaagatcagaaagcaattataaccgagaattgggttctgaaccaaaagcacttgcaagacttcccgggggaagacaaatag

SEQ ID NO: 16578 - DNA, 3972 bp, Artificial Sequence
  Description of Artificial Sequence: Synthetic coding sequence
atgaagcggaacggcagtaggaattgccttaatcgccgcagccggtttggctcacgggaaagggattggcttagggaggacgtgaagaggggttgtgtctatttgtacggtgcggacacaactacagctaccactaccaccactacatccagtagttcttctagctcctcatcatcttcagacttgcatttggttctgtgcactgtagaaacccctgcttccgaaatctgcgcaggtgagggtagggagtctttgtacttgcagctacatggagatctcgttcgtcggttagagcccactgaaaggccgctacaaattgtatacgactatctgtcacgcttgggattcgatgatccagtaagaattcaagaggaggccacgaatccagatctgggatgtatgatccgcttctatggtgagaaaccgtgccatatggacaggctggaccgaatcctgctaagtggcatatataatgttcgcaagggaaaaacccagctgcataaatgggccgagagacttgtggtactctgtggcacgtgtctcattgtatcctcagtgaaggattgtcagaccgggaagatgcacatactgccattggtcggcggtaagattgaagaagtcaaacgcaggcagtactcgctggctttctcatccgccggggcacaggctcagacctatcatgtgagctttgaaactttggccgagtaccagagatggcaacgccaggcctcaaaagtggtctcccagaggattagcacagtcgacctgtcctgttacagcctcgaggaagtcccggagcaccttttctatagtcaggacataacttacctaaacttgcggcacaatttcatgcagctcgagcggccaggaggcttagatactctttataagttctcccagttgaaaggccttaatctttcccataacaaacttggtctgttccccattctactctgcgagatatcaaccctgaccgagctgaacctatcgtgtaacggattccacgatctgccatcgcagattggaaaccttctgaatttgcaaaccctgtgcctggatggaaactttctcactacattacctgaagagttggggaatttgcagcagctctcaagtctcggtatctcctttaataatttcagtcaaattcctgaggtttacgagaagttaactatgcttgacagggtcgtgatggccggcaactgtttagaagtgttgaacttgggcgtactcaatcgcatgaaccacattaaacacgtagatctccgaatgaaccacctcaaaacgatggtgatagagaacttagaaggcaataaacacatcacacacgtcgatttgcgagataatcggcttacagacttggatctcagcagcctgtgctctctagaacagttacactgtggccgcaaccagctgagagagctgacgctgagtggatttagcctcagaactctgtacgcttccagtaataggttaactgccgtgaatgtttaccctgtgccctccctgctcaccttcctggacctgtctcgaaacttactcgagtgcgtgccagactgggcatgtgaggctaagaaaatcgaagtgctcgacgtgtcatacaatttgttaacagaagtacccgtccgaatcctatccagcctctccctacggaagctcatgctgggtcacaaccacgtgcagaatctgcctactctggtggaacatatcccccttgaagtgctcgacctccaacacaatgctcttacccgattgcccgataccctctttagtaaagccctgaatttgcggtatctcaacgcatccgcaaactcccttgagtcactgccctctgcctgtactggggaggagagcctgtcaatgctgcagctgctgtatttaaccaataacctgctaaccgaccaatgcattcctgtgctcgtgggccatcttcatctgcgcattctacacctggctaacaatcaactgcagacgtttcccgcctcgaaactgaacaagctggaacagctggaggagttgaatctgtcaggtaataaactaaagactataccaactacaatcgctaactgcaagcgattgcatactctcgtggctcatagtaacaatattagcatatttcccgagatcctccagctaccccagatccagtttgtcgatctttcatgtaacgatctaacagaaattttaattccggaggctctccctgctaccctgcaggaccttgacttgacaggtaacacaaacctcgtcttagagcataaaacccttgacatcttctcccatattacgacgctcaagattgaccaaaagccgctgcctacgactgacagcaccgtgacctctaccttttggtcccatggcctcgccgagatggccggccaacgcaacaaactgtgtgtctcagcgctggctatggatagcttcgccgagggggtgggtgccgtgtacgggatgtttgatggcgaccggaatgaggagctgcctcggttattgcagtgtacaatggccgacgtcctgctggaagaagtgcaacagagcactaacgatacggtgtttatggctaacacttttctagtctcgcacaggaaactcgggatggcgggtcagaaactgggatcttcagcacttctctgttacattaggcctgatacagctgatccggcttcttctttcagtctgacggtggctaatgtaggaacttgtcaggcagtgctatgcagggggggtaagccggtccccctgtccaaagtgttttcattggaacaagatccagaagaagcacagcgggtaaaagaccagaaggccataattacagaggataacaaagtgaacggagtgacatgctgcacaaggatgctcgggtgtacatacctgtatccatggattctccccaagcctcacatcagctctacaccactgactatccaggatgagttgctgattttgggcaacaaagccctctgggaacacttgtcctataccgaggccgtgaacgccgttcggcacgtccaggaccccctggcggcagccaaaaaattgtgcacattagcacaatcatatggttgccaggacaatgtgggggccatggtggtgtatctgaatattggggaagagggatgcacctgtgaaatgaatgggctaaccttaccaggaccagtcggtttcgctagcaccacaaccattaaggacgctcctaagcctgcaaccccaagctcttcttcaggcatcgcctctgagttcagttcagagatgtcaacctctgaagtgtcgagtgaagtggggagtactgcttcagatgaacataacgcaggcggcttagacacggccctactgcctcgtccagaaaggcgctgtagcttacatcctacccccacctctgggcttttccagcgacaacctagttcagcaaccttttcctcaaatcagtcagacaatgggctcgattctgacgacgatcagcctgtggagggtgtgatcactaacgggtcgaaggtcgaggtggaagtagacattcattgctgccgagggcgcgatttagagaattcaccacctttgatcgaatccagcccaacactgtgcagcgaagagcatgcacgcgggtcatgcttcggcatcagaagacagaactcggtgaacagcggaatgctcctaccgatgagtaaggatcgcatggaactgcagaagtccccttcaacctcctgcctgtatggaaaaaagttgtccaacggctccattgtgcctctggaagattctctgaatttaattgaggtagccaccgaagtgccaaagcgcaagacggggtacttcgcggcacctacccagatggaaccagaggatcagttcgtagtgccgcatgatctggaggaggaggtgaaagaacagatgaagcagcaccaggattcccgactggagcccgaacctcacgaagaagatcgcaccgaaccccctgaggaatttgataccgccctgtag

SEQ ID NO: 16579 - DNA, 1212 bp, Artificial Sequence
  Description of Artificial Sequence: Synthetic coding sequence
atgacagccattattaaggagatcgtgtcccggaataagcgccggtatcaggaggacggtttcgatctggatctaacctacatttatcccaacattatcgccatgggctttcccgcagaacgattagagggcgtataccgaaacaatatcgacgatgtcgttcgctttctggattctaagcataagaaccactacaagatatacaatctttgcgccgaacgccactatgataccgctaagttcaattgcagagtcgcacagtatccttttgaggaccacaaccctcctcaactggagttaattaaaccattttgcgaggatctagaccagtggctctctgaggacgacaatcatgtggccgccatacattgcaaggctggcaagggacgcacgggagtaatgatctgtgcgtacttgttacacaggggaaagtttttaaaagcccaggaggctttggacttttacggggaggtacgcacaagagacaagaagggggtgaccattccaagccagagaaggtatgtctactattacagctacctcctgaagaaccacctagattataggcctgtcgcccttctttttcataaaatgatgtttgagaccatcccaatgttctccggaggaacttgcaatccgcagtttgttgtatgtcaattgaaagtcaagatctatagtagcaactccggacctacacgtagagaggataagttcatgtattttgaattcccacagccgctgccagtgtgtggtgatattaaggtggaattcttccataagcagaacaaaatgttaaagaaggataagatgttccatttctgggtgaacacattcttcatccccggccctgaggaaacgagtgagaaagtcgaaaacggcagtttgtgcgaccaggaaatcgacagcatttgttcgattgagagagccgacaacgataaggagtatcttgtgctcaccttaaccaagaatgatctagataaagccaataaggataaggcgaaccggtatttctcccctaatttcaaggtgaagctgtattttacgaagaccgtagaagaaccatccaaccccgaggccagttccagtacaagcgtcacgcctgacgtatccgacaacgagcccgatcactatcgctattcggacacaactgactccgacccggagaatgagccttttgatgaagaccagcacacgcagatcacaaaagtgtag

SEQ ID NO: 16580 - DNA, 531 bp, Artificial Sequence
  Description of Artificial Sequence: Synthetic coding sequence
atggggaaagctgcagccgcagttgctttcggggccgaagtgggggtacgcctggcactctttgctgccttcttggtgacggaactcctgcccccatttcagcgcctgattcaacctgaggaaatgtggctttatcgaaatccatacgttgaggccgagtactttccgacaaagcctatgttcgtcatcgcattcctcagtcccctttcattgatttttttggcaaagttcttaaagaaagctgacactcgagattcgcggcaggcatgcctcgctgcctctttggcactcgcactgaacggggtgttcaccaatacaatcaaactaattgtgggtaggccacggcctgattttttctacagatgcttccctgatggtctcgcacactctgacctgatgtgtaccggtgataaggacgtagtgaatgaggggcggaaaagtttcccctcaggtcactcttcctgtatgaatatcatttggactctgccatatgcatgcttccacatcatcgaattcaatctggaatcctag

SEQ ID NO: 16581 - DNA, 651 bp, Artificial Sequence
  Description of Artificial Sequence: Synthetic coding sequence
atgggaaaagcagccgcggctgttgcctttggcgctgaagtgggcgtgcgactagcactttttgccgccttcctagtgacagagctcctgcctccttttcagagactgatccagcctgaggagatgtggctttacaggaatccttatgtggaagctgagtattttcccacaaagcccatgttcgtgatcgcatttctttcacccttgtcactcatcttcctggcaaagtttctgaagaaggccgacacacgcgacagcagacaagcctgtttggctgcatccctggctctggcgctcaacggagttttcaccaacaccatcaagttaatcgttggccggccgagacccgactttttctataggtgttttccagatggactcgctcactccgatctgatgtgtactggagacaaggatgtcgtcaatgaaggccgaaagtcgtttccgtccggtcattcaagttttgcttttgccggactggcattcgcgagcttttacctggccggtaagttgcactgttttaccccacaaggccgtggcaaatcatggcgattttgcgcctttctcagtcccctgctgttcgccgctgtaattgctctctccaggacctgtgattacaagcaccattggcaggggcctttcaagtggtag

SEQ ID NO: 16582 - DNA, 795 bp, Artificial Sequence
  Description of Artificial Sequence: Synthetic coding sequence
atggggaaagcggccgcagctgtggcttttggggctgaggtgggcgtgaggctggctctattcgccgctttcctcgtcaccgaattactgcccccttttcaaaggctcatccagcctgaagagatgtggctatacaggaatccctacgtcgaggctgagtacttcccaaccaagcccatgtttgtaatagcattcctgagcccacttagcctgatctttctggccaagtttttaaaaaaggccgacactagagactcacgccaggcctgcctcgccgcttctcttgccctcgccctgaacggagtgttcacgaacacaatcaagcttatcgtggggcgaccacgccctgactttttctatcgatgctttcctgacggcttggcccatagcgacctaatgtgcactggcgacaaggacgtggtgaacgagggccggaagtcattcccgagtggacattcctctttcgcctttgcgggcttggcattcgcatctttctatctggctggtaagcttcactgtttcactccacagggccgcggaaaaagctggcgcttttgtgcctttctctccccactgctgtttgcggccgtaatcgccttgtccagaacttgtgattacaagcaccattggcaggacgtgttagtggggtccatgatcggcatgaccttcgcttatgtctgctatcggcaatactatccccctctgacagacgccgagtgccataaaccttttcaagataagctggtattgtccacggcccagaaaccaggcgacagctattgcttcgatatttag

SEQ ID NO: 16583 - DNA, 1086 bp, Artificial Sequence
  Description of Artificial Sequence: Synthetic coding sequence
atgcacggagactatactctaacccttagaaagggcggtaacaataagcttattaagatatttcatcgggacggtaagtatgggtttagcgacccgttgacgttttctagcgtagtggagctgatcaatcactacagaaatgagtccttggcccaatacaatccaaagcttgacgtgaaactcctgtatcccgtgtctaagtaccagcaagaccaggttgtgaaagaggacaatattgaggctgtgggcaagaaattgcatgagtacaatacacagttccaggaaaaatcgagagagtacgatcgcttatacgaagagtacactcggacctctcaagaaattcagatgaaaagaaccgctatcgaggcctttaacgaaactattaagatcttcgaggagcagtgtcaaacgcaggagagatactcgaaggagtacatcgagaaatttaagagggaaggaaatgagaaggaaatccaacggatcatgcataactatgacaaactgaaatcccgaatttcagagattattgattcccgcaggcgattagaggaagatctgaagaagcaggccgccgaatatcgtgaaattgacaagaggatgaattccatcaagcctgacttaatccagctccggaaaactcgggatcagtacctcatgtggctcacccaaaaaggagtgagacagaaaaagctgaatgaatggctcggcaatgagaatacagaagaccagtactctctcgtagaagatgatgaggacctcccacaccacgatgaaaaaacttggaatgtgggaagctccaatagaaacaaagccgagaaccttctccgcggcaaaagggacggtactttccttgtccgggaatccagcaaacaggggtgttatgcctgcagcgtggtggttgacggcgaagtgaagcactgtgtgattaataagacagccaccgggtatggtttcgctgaaccatataacctgtattcttcactgaaagagttagtgctacattaccagcacaccagtctggtgcagcacaatgacagtctgaacgtgacactggcttaccccgtctacgctcagcagagacggtag

SEQ ID NO: 16584 - DNA, 3207 bp, Artificial Sequence
  Description of Artificial Sequence: Synthetic coding sequence
atgcctcccaggccctcttccggggagctgtggggaattcacttgatgccaccacgaattctcgtggaatgtctgctgcccaacggaatgatcgtgacgctcgagtgtctccgtgaggccaccttaatcactataaagcatgagctctttaaggaagcccggaaatatcctctgcatcagctcctgcaggacgagagttcctatatttttgtctccgttacccaggaggcggagcgagaagaattcttcgatgagacacggcgcctctgcgatctgcggctgtttcagcccttcctaaaggtaattgagccagtggggaatagagaagagaagattctgaaccgggaaatcgggtttgccatcggcatgccggtgtgtgaattcgacatggtgaaggaccccgaagtccaagatttcagacggaacatcctcaatgtgtgtaaagaggcagtggatctgagggacctgaattcgccacacagcagggccatgtacgtgtacccgcccaatgtcgaaagttcccccgagcttcctaaacatatctacaacaaactcgacaaggggcagattatcgttgtcatctgggttatagtatcaccaaacaacgacaagcagaagtatacacttaagatcaaccacgactgcgtgcctgagcaagtgatcgccgaagctatccgaaagaagacccgttctatgctgctgtccagcgaacagctgaagctctgcgtcctcgagtaccaggggaaatatattttaaaagtctgtggctgtgatgagtattttctcgagaagtaccctctttcccagtacaagtacattcggagctgtattatgttggggagaatgcccaacctgatgctgatggctaaagagagcttgtattcccaactgccaatggattgtttcacaatgcccagctattccagaaggatcagcaccgctaccccttacatgaacggcgagactagtaccaaatcactgtgggttataaatagcgccttaagaatcaagatcttatgtgcaacttacgtgaatgtcaatatccgggacatcgataaaatttacgtgcggactggcatataccatggcggggagccactctgcgataacgttaatactcagcgggttccctgcagtaatcctcgctggaatgaatggctgaactacgatatatacatcccagatctgccacgtgccgctaggctctgcttgtctatttgctcagttaagggtaggaagggcgccaaagaagagcactgtccactggcttggggcaacataaatctgttcgactacacggacactttggtcagtggtaaaatggcgctgaacctctggccggttcctcatggccttgaggatctcctgaacccaatcggcgttactggtagcaacccgaataaggagacaccttgcctcgaactcgaatttgactggttcagctctgtggtcaagtttccggatatgtccgtgatcgaggagcacgccaactggtccgtgtcacgcgaagcgggttttagctactctcacgcagggctttcgaatagactggccagagataatgagctgcgtgaaaatgacaaggagcagttgaaggcaatctctaccagagacccactgtcagagattactgagcaggagaaagacttcctgtggagccataggcactattgtgttacaattcctgagatactacctaaactgctcctcagcgtcaagtggaattcacgcgacgaggtagcgcagatgtattgcttggtaaaggactggccccctatcaagcccgagcaggcaatggagttacttgactgtaactatcccgacccaatggtccgaggcttcgccgtgagatgcctcgaaaaatacttaacagacgataagttgtctcagtatctgatacagctggtacaggtgcttaaatacgaacaatatctcgacaatctcttagtgaggttcctgctcaaaaaagctctgacgaaccagcggattgggcattttttcttctggcacctgaagagcgagatgcataataagacagtgtctcagcgcttcggccttctcctggaatcctattgtcgagcctgcgggatgtacttgaagcaccttaataggcaagtggaggcgatggagaaattaatcaacctcacggatatactgaagcaggagaagaaggatgagacccagaaggtgcaaatgaaatttctggtggagcagatgaggcggcctgatttcatggatgcactacagggatttctaagtcccctcaatccagcgcaccaattgggaaatctgcgcctggaagaatgtcgcatcatgtcaagcgcaaagcggccactctggctcaactgggagaaccctgacatcatgtcagagctcctctttcagaacaatgagatcattttcaaaaacggcgacgacctgaggcaagatatgctgaccctccagattatacgcataatggagaacatctggcagaaccaggggttggacttgagaatgcttccttacggatgtctgagcatcggagattgtgtcgggctcattgaagtcgtgcggaactctcatactattatgcagatccagtgtaaaggcggcctgaagggggctctccaattcaattcacacacactgcatcaatggctgaaggacaaaaacaagggtgagatatacgatgcggcaatagatctgttcacacggagttgtgccgggtactgcgtggcaaccttcatcctgggaatcggtgataggcacaatagtaatataatggtcaaagacgacggccaattgttccatatcgacttcggtcattttctcgatcataagaagaagaaatttgggtataagagagagagggtgccctttgtgctcacacaagactttttgatcgtgatcagcaagggggcacaggagtgtactaaaactagagagtttgagaggtttcaggaaatgtgctacaaggcctaccttgccattcgccagcatgctaatctcttcatcaacttatttagtatgatgctggggtccggcatgcctgaactccagagttttgatgatattgcttatatcagaaaaaccctggcattggacaagactgagcaggaagctctcgagtattttatgaagcagatgaacgatgctcatcacggaggctggactacgaagatggactggatcttccatacaattaagcagcacgctctgaattag

SEQ ID NO: 16585 - DNA, 357 bp, Artificial Sequence
  Description of Artificial Sequence: Synthetic coding sequence
atgccaccccggccgtcgtccggggaactgtgggggatccacttgatgcctcctaggatccttgtagagtgtctgctgccaaatggcatgatcgtgaccctagaatgtctccgggaggccaccctgatcacaataaagcatgaactgttcaaggaagctcgtaagtatccactacaccaactcctccaagatgagtcttcttacatctttgtttcagtgacgcaggaggctgagcgggaggagttttttgacgaaacgcgaaggctgtgcgatctgcgtctgtttcaacccttcctgaaggtgattgagccagtgggcaaccgcgaagagaaaatcctgaatcgcgagattgggtag

SEQ ID NO: 16586 - DNA, 66 bp, Artificial Sequence
  Description of Artificial Sequence: Synthetic coding sequence
atgccaccccgtccatcctcaggcgaactgtggggtatccacttaatgccaccgcggatactgtag

SEQ ID NO: 16587 - DNA, 3213 bp, Artificial Sequence
  Description of Artificial Sequence: Synthetic coding sequence
atgtgcttttcctttattatgccccctgcaatggccgacattttggatatttgggcagtcgattctcagatcgcatccgacgggagtatacccgtggatttcctgttgcccaccggtatttatattcaattagaggttccccgcgaggccaccatttcttacatcaagcagatgctgtggaaacaggtgcacaattatccaatgttcaacctcctgatggacattgatagttatatgttcgcatgtgtcaaccagactgccgtgtatgaggagttggaagatgagaccaggaggttgtgtgacgtcaggcccttcctgccagttcttaagctggtaactcgctcgtgcgatcccggtgaaaagctggacagcaaaatcggagtcctgatcgggaagggactgcacgaatttgactctctgaaggatccggaggttaatgagtttcgccgtaagatgcgcaaatttagcgaagaaaaaattctgtcccttgtgggcctttcttggatggattggctcaaacagacttatcctcccgagcacgaaccgtccatccccgagaatctggaggataaattgtatggcgggaagctgatcgtcgccgtgcactttgagaattgtcaggacgtgttctcttttcaggtaagccccaatatgaatcccattaaagtgaacgaactggccatccagaagcgactgaccattcatggaaaagaggatgaggtgagcccatatgactacgtccttcaggtatctggtcgtgtagagtatgtgtttggggatcatcctctcatccagtttcagtacattcggaactgtgtcatgaaccgggcactgcctcatttcattctggtcgagtgttgtaagatcaagaaaatgtatgaacaggaaatgattgctattgaggccgctatcaacagaaacagtagcaacctgcccttgccactccctccaaagaagaccagaattatctcacatgtctgggaaaacaataatcctttccagatcgtattggtgaagggtaacaaattgaacactgaagaaacggtgaaggtgcatgtccgcgcagggctgtttcatggtaccgagttactctgtaagaccattgtgtcctcggaagtctccgggaagaatgaccatatctggaatgaaccactggagttcgacatcaacatttgtgatctgccccgcatggcccgtctgtgttttgcggtatatgcggtactggataaagtgaaaaccaagaaaagcaccaagaccatcaatccctccaagtatcagacgatcagaaaagcaggaaaggtgcattaccccgtggcttgggtgaacacaatggttttcgattttaaagggcagctccggaccggggacattatactgcatagctggagcagcttcccggacgaactggaggaaatgctgaaccctatgggaactgttcagactaatccctacacagagaatgccacggcgcttcatgtgaaatttcccgagaataagaaacagccttactactacccgccattcgacaaaatcattgagaaagctgccgaaattgcaagcagtgactcagctaacgtttcgagcaggggaggtaagaaatttctgcccgtcctgaaggagattcttgatcgcgaccctctatcacagttatgtgagaacgagatggatctcatctggactctgcgccaagactgccgggagattttcccacagtccctgcccaaattgctgctgtcaatcaaatggaacaagttggaagacgtcgcccagttgcaggccctgctacagatatggcccaagctcccccccagagaggcgcttgaattactggatttcaactatcccgatcaatatgtgcgggagtatgcagtgggctgtttaaggcagatgtcggatgaagagctgagtcagtacttacttcaacttgttcaggtgttgaagtacgaacctttcctggactgcgctctctctcgctttctgctggaacgcgccctagggaatcggcgcatcggtcagttcttgttttggcacctgcggtccgaagtgcatatccccgccgtaagcgtccagttcggtgtgatccttgaggcatactgcagggggtctgtcggccatatgaaggtgctctctaagcaggttgaggcactgaacaagctgaaaacacttaatagtctaataaagttgaatgccgttaaacttaatcgggcaaaaggcaaggaggccatgcacacctgcctgaaacagtccgcgtaccgggaggcactgtctgacctgcagtctcccctgaatccatgtgttattctgtctgaactgtacgtggagaaatgtaagtatatggactccaaaatgaagcccctgtggttagtatacaacaacaaggtgttcggggaagacagtgtgggagtgatctttaaaaacggagatgatttgagacaggatatgctaacacttcagatgctgagactaatggatctgttgtggaaggaggcgggactcgacttgagaatgctgccttatgggtgccttgcgacaggagacaggagcggtcttattgaggttgtgagcacaagcgagactatcgcagacattcagctgaactccagcaatgtggccgccgccgctgcattcaataaggatgctctcctaaattggctgaaggagtacaactccggagacgatctggacagggccattgaagaattcacgttatcttgtgcaggatattgtgtcgcctcctatgtcctggggattggggacagacattctgataacattatggtaaagaagacaggccagctctttcacatcgatttcggccacattctgggcaactttaagtcgaagtttggaatcaagcgtgagcgggtgccgtttattctgacctatgactttattcacgtgatccaacagggaaaaactgggaataccgagaaatttggcagattccgccagtgttgtgaagacgcctatctgattctcagacggcatggcaacttgttcatcactctcttcgccctcatgctcacagcaggtctacctgagctgactagcgtgaaggatatccagtacctgaaagactcactcgcactggggaaaagtgaagaggaggccttaaagcagttcaaacagaagtttgacgaagccttgcgagagtcgtggaccacaaaggtaaactggatggctcatacagtgcgcaaagactatcgctcttag

SEQ ID NO: 16588 - DNA, 303 bp, Artificial Sequence
  Description of Artificial Sequence: Synthetic coding sequence
atgtgctttagttttattatgccccccgctatggcagacatattggatatctgggctgtcgattcccagatcgccagcgatgggtctatccccgtggattttctgctccctactgggatctatattcagctggaggtcccccgagaagcgaccatctcatacatcaagcagatgctatggaagcaggtgcacaactatccgatgttcaatttattaatggacattgacagctacatgttcgcttgcgtgaatcagactgccgtttacgaggagctcgaggacgaaacacgacgactgtgctag

SEQ ID NO: 16589 - DNA, 171 bp, Artificial Sequence
  Description of Artificial Sequence: Synthetic coding sequence
atgtgctttagttttatcatgccacccgccatggcagacatcctggacatctgggcggttgactctcagattgcaagcgacggatccatccctgttgattttttgctgcctactggcatttatatccagctggaagtgccaagagaagcaactatttcttacatcaaatag

SEQ ID NO: 16590 - DNA, 3213 bp, Artificial Sequence
  Description of Artificial Sequence: Synthetic coding sequence
atgtgctttagcttcattatgcccccggcgatggcagatatcctggacatctgggccgtagactctcagatcgcctcggatggaagtatccctgtggactttctcctccccactggcatctatattcaactcgaagtgccacgcgaagctaccattagctatatcaagcagatgctctggaaacaggtgcataattaccccatgtttaacctgctcatggacatcgactcttacatgttcgcttgtgtgaaccagacggccgtgtatgaggagttggaagacgagaccagacgcttgtgcgatgtaagacctttcctgcccgtgttgaagctcgtgaccagatcttgcgaccccggcgagaagcttgattcaaagatcggggtgctgatcggtaaggggctccacgaatttgatagcctcaaggaccctgaagtgaatgagtttagacgcaagatgaggaagtttagtgaggaaaagatcttatccttggttggcctgtcttggatggactggctaaaacaaacttatccgccagaacacgagccctctatcccagagaacctggaagacaagctctatggagggaaactcatcgtggctgtgcactttgaaaactgtcaagacgtttttagtttccaagtttcacctaacatgaaccccattaaggtcaatgaactggccattcaaaaacgactgacaatccatggaaaggaggatgaggtgtccccttatgactacgtgttgcaggtgtccggacgggttgagtacgtttttggcgaccaccctctgatccagtttcagtacatccgcaattgtgtgatgaatcgggctctgcctcatttcatcctcgttgagtgctgtaagattaagaaaatgtatgagcaagagatgattgccattgaggccgctatcaaccggaactccagtaacctccctctgcctctgccccccaaaaaaacacggattatctcccacgtgtgggagaacaataatcccttccagatcgtgcttgttaaggggaataagcttaatactgaggagacggtcaaagtacacgtaagggccgggctctttcacggcactgagctcctttgcaagacgatcgtctccagtgaagtctctggtaaaaacgaccacatttggaatgagcccctggaattcgacatcaatatctgcgacctcccgagaatggcacgcctttgtttcgctgtgtacgctgttcttgacaaggtgaaaaccaagaagtcaacaaagacaattaatccctcaaaataccagacaatccgaaaggcgggcaaagtgcattaccccgtggcatgggttaacaccatggtctttgatttcaaggggcagcttcggaccggagatataatcttgcattcctggagcagttttcccgatgagcttgaagaaatgctcaatcctatgggtacggtgcagactaatccatatacggagaatgccacagcactgcacgtgaagtttccagagaacaagaagcagccgtactattaccctcccttcgacaagattatcgagaaggcggctgaaatagccagtagcgactccgctaacgtctcatctcgtggcggcaaaaagttcctgcctgtgcttaaggagatcttggatcgggacccactgtcccagctctgcgagaacgagatggacctaatctggaccttaagacaggattgtagagagattttccctcagagcctgcccaagctgctgcttagtattaaatggaataaactcgaggacgtcgcgcagctgcaggctttgctgcagatctggcctaagctgccccctcgtgaggccctcgagctgctcgatttcaactatcctgaccaatatgtgcgggaatatgcagttgggtgtcttagacagatgagcgatgaagaactgagccagtaccttctgcagctggtgcaagtccttaagtatgagcccttcttagactgtgcgctatctcgttttctgctggagagggccttaggcaatagaagaatcgggcagttcctgttttggcacctcagatcagaggttcatatccctgccgtgtccgtacaatttggcgtgattctggaagcctattgccgtggctctgtaggccatatgaaagttctaagtaagcaggtggaggcattaaataagcttaagaccctgaattctttgatcaagctgaacgcagtaaaactgaaccgcgcaaagggcaaagaagctatgcacacttgccttaagcaaagtgcctatagagaggcactgagcgacttgcagagtcccttgaatccttgcgtgatactgtctgagctatatgtggagaagtgcaaatacatggactccaaaatgaagccattgtggttagtatacaataacaaagtgttcggagaggatagtgtgggcgtaatcttcaagaacggtgacgatctacgtcaggacatgctcacactgcagatgctgcggttaatggatctattgtggaaggaggcaggactagatctccggatgctgccttatggttgcctggctactggcgacaggagtggccttatagaggtcgtcagcacctccgaaaccattgctgacatccagctaaacagtagtaacgtggccgctgctgccgccttcaacaaagatgctttgctgaattggctgaaggagtacaacagcggtgacgatctggatcgtgctattgaggaattcacgctgtcatgcgccggctactgcgtcgcatcatacgtcctgggcatcggagatcgccactctgacaacattatggtgaaaaaaaccgggcaactgttccatattgattttggacacatccttggaaacttcaagtccaagtttggcattaagagggagcgggtcccttttatcctaacctatgattttattcacgtcatccagcagggcaagacgggcaatacagagaaatttggcagattccggcaatgctgtgaagatgcttacttgatcctccggaggcacggaaacctcttcatcacgcttttcgccctaatgctgacagccggacttcccgaactcactagcgtcaaggacatccaatacttaaaagattccctcgccctgggaaagtctgaagaagaagccctcaaacagtttaagcagaaatttgatgaggcacttagggaatcctggactactaaggtgaactggatggcacacacagtcaggaaagactatagatcatag

SEQ ID NO: 16591 - DNA, 396 bp, Artificial Sequence
  Description of Artificial Sequence: Synthetic coding sequence
atgtgttttagctttattatgccccccgccatggcggatatcctcgacatctgggccgtcgactctcagattgcttcagatggcagcatcccagtcgacttccttctacctacaggaatttacattcagctggaggtgccccgcgaggcaacaatcagctacattaaacagatgctgtggaagcaggtccataattatcccatgtttaatctgctgatggacatagattcatacatgttcgcttgtgttaatcagactgctgtgtatgaggagctagaggacgaaacccgacggctgtgtgacgtgcggccatttcttcctgtgctaaaattggtgactagaagctgtgaccccggagaaaagttggattcaaagatcggagttctgataggttag

SEQ ID NO: 16592 - DNA, 2109 bp, Artificial Sequence
  Description of Artificial Sequence: Synthetic coding sequence
tgagttcgcgcagggctcttccatggcaccgaactcttatgcaaaacgatcgtgtccagtgaggtttccggaaagaacgaccacatctggaacgagcctctggaattcgacattaatatctgcgacttgccccgtatggctcgtttgtgctttgccgtttatgctgtcctggacaaagtgaaaaccaagaaaagcaccaaaaccatcaacccaagcaagtatcagactattaggaaggcgggtaaagtccactacccagttgcctgggtaaacacaatggtgttcgattttaagggccaactgcggaccggcgatatcattctgcattcgtggagttctttccctgatgagctggaagagatgctgaaccctatgggcaccgttcagacgaacccatatactgagaacgctactgccttgcacgttaaatttcctgaaaataagaagcagccatattactatcccccattcgacaagagcagggggggcaagaagttcctgccggttctgaaagagatcctggaccgcgatcccctctcccagctgtgcgaaaacgagatggacctgatatggacattgcggcaagactgcagagagatttttccccagagcctgcccaagctgctgctgagcattaagtggaacaaactcgaagatgtcgcacaactgcaggcactgctgcagatttggcccaaattaccacctagagaagcactcgagctgttagactttaattatcctgatcaatatgtgcgtgagtacgccgtgggatgtcttcggcagatgtccgacgaggaactctcccagtatctgctgcaactcgtgcaggtcctgaaatacgagccttttctagactgtgcactgtccagatttctcctggagcgcgcactcggcaataggagaattggacagttcctgttttggcacctccgaagtgaggtgcatatccccgccgtcagtgtgcagtttggagtgattttggaagcctactgccgaggatctgttggacatatgaaagtcttaagtaagcaggtggaagccctcaacaaacttaagactctgaacagcctaatcaagttaaatgccgttaagctcaatcgtgcaaaaggcaaagaggccatgcatacatgccttaagcaatccgcctatcgcgaagcactctccgacctacagtctcctctgaatccctgcgtcattctgagcgaactgtatgtggaaaagtgtaagtatatggacagcaaaatgaaaccgttgtggttggtgtataataataaagtctttggagaggacagtgtgggagtcatctttaaaaacggcgatgacctaaggcaagacatgttaacactccagatgcttcgattgatggacctcctgtggaaagaggctggcttggaccttaggatgctgccctacgggtgcctggccactggagaccgcagtggcttgattgaggtcgtttcgacatcagagactatcgcagacatccagctcaactcatccaacgtggcggccgccgcggcatttaacaaggatgccctgctgaattggctaaaggagtacaattcaggcgacgatttagatagagctatagaagaattcacgctatcttgtgccggctactgcgttgcttcctacgtcttaggcatcggcgatagacactcagacaacattatggttaagaaaacaggacagcttttccatattgactttggtcatatactgggtaattttaagtcaaagttcggaattaagagggaacgtgttccattcattttaacgtatgacttcattcatgtgatccaacagggaaagaccgggaacacagaaaagtttggcagattcaggcagtgctgtgaagacgcatatctcattctgcgtcgccacggcaatctcttcattaccttgttcgctttgatgcttacagccgggctccctgagctcacatccgtgaaggacatccaatacctcaaggatagtctggcacttgggaagtccgaagaggaggccttgaagcagtttaagcagaagttcgatgaggcccttagagagtcctggacgactaaagtcaactggatggcccatacagttaggaaagattacagatcctag

SEQ ID NO: 16593 - DNA, 1566 bp, Artificial Sequence
  Description of Artificial Sequence: Synthetic coding sequence
atggatttaatctggaccttgagacaggattgccgtgaaatctttcctcaatctttgcctaagttgttattgagtattaagtggaacaaactggaggatgttgcccaacttcaagccctcctgcaaatttggcccaaactgccacccagggaagcgctggaacttctagacttcaattacccagaccagtacgtgagggagtatgcagtcggatgcttgaggcagatgtccgacgaagagctgagccagtatttgctccagctcgtccaggttctcaagtatgaacctttcctcgattgtgctttgagcagattcttattggaaagagctctcggaaatcgtcgaatcggtcagtttctcttctggcacctgaggtccgaggttcatattcccgctgtgagtgtgcaatttggcgtgattttggaagcttattgcaggggcagtgtgggccacatgaaggtcctatctaaacaagtggaggcattgaataagctgaagactctgaacagtttgatcaagctgaacgccgttaagttgaatagggctaagggcaaagaggccatgcatacatgcctgaagcagagtgcttaccgcgaggctttatccgatttacagagccccctgaacccttgcgttattcttagtgagctgtatgtggagaagtgcaaatacatggacagcaagatgaaaccattgtggctggtctataacaacaaggtttttggggaagattcagtgggggtgatcttcaaaaatggagacgtatgctttcccctagatctgcgccaggatatgctgaccctgcagatgttgcggcttatggacctcctatggaaggaggcaggcctggatcttagaatgttgccatacggctgcctcgctactggggatcggagtggtctcatcgaagtggtgtctacctctgagacaatcgcggacattcagctgaacagcagtaatgtggccgcagctgcagctttcaataaagatgcccttctgaattggctcaaggagtacaactcgggggacgacctggacagggcaatcgaggagtttactctgtcctgtgccggctattgtgtggcttcatatgtgctgggcattggggatcgacattccgataacataatggtgaaaaagacagggcagctgttccacatcgacttcggacacattttgggtaacttcaaatctaagtttggtataaagagagagagggttccgtttattctgacctacgattttatccacgtgattcaacaaggaaaaacagggaacaccgagaagtttggccgttttcgccagtgttgtgaagatgcttacctgatactaagacgccacggcaatctgtttataaccctcttcgccctcatgcttacagctggtctgccagagctcactagcgtcaaggacattcaatacttgaaggactctctcgcactggggaagagtgaagaggaggcactgaagcagttcaagcagaaattcgatgaggcactgcgtgagtcgtggaccacaaaggtcaactggatggctcatacagtgcgaaaagactacaggtcctag

SEQ ID NO: 16594 - DNA, 3207 bp, Artificial Sequence
  Description of Artificial Sequence: Synthetic coding sequence
atgcccccaggcgtcgattgcccgatggagttttggacaaaagaggaaaaccaatccgtggttgtggatttcttactgccgacaggcgtttatctcaacttccccgttagccggaacgctaatcttagtacgattaagcagctgctatggcaccgggctcagtacgagcctctgttccatatgctcagtggaccagaagcttatgtgttcacctgtataaatcagacagccgaacagcaggagctagaggacgaacagcgacggctctgcgatgttcagccattcctaccggtcctgcggctggtcgcaagggagggtgaccgcgtcaaaaagctgatcaacagtcagatatcactacttatcggtaagggactccacgaatttgatagcttgtgtgaccccgaggtgaacgatttcagggccaagatgtgccaattctgtgaagaagcggcagcacggcggcagcaactgggttgggaagcatggctgcaatactcgttccccttgcagctggaaccgtccgcccagacctgggggcccggcaccttgagactgcccaaccgcgcgctgctggtgaacgttaaattcgagggctccgaagagtccttcacatttcaagtctcaacgaaggatgtgccgttagcgcttatggcctgcgccctcaggaaaaaggcaacagtgttccggcagcccctcgtcgaacagcctgaggactacactctgcaggtgaatgggaggcacgaatatctttatggcagttatcctctgtgccagttccaagtgcagaaaccccgtgctaaacccccaccaatccctgctaaaaaaccatctagcgttagcttgtggagtctcgagcagccattccgcattgagctgatccagggctccaaagtaaacgccgacgagagaatgaagttggtcgtgcaagcaggattgttccatggcaatgagatgctgtgcaaaactgtatccagtagtgaagtgtctgtttgttcagaaccggtgtggaaacagaggctcgaattcgacattaatatttgcgatctacccagaatggccagactgtgtttcgcactatacgccgttattgagaaagctaagaaagccagaagcaccaagaagaaatccaagaaagccgactgccccatagcttgggccaacctcatgctgttcgattacaaggaccaactgaaaaccggcgaaaggtgcctatatatgtggccttctgtgcccgacgagaaaggggagctgctgaaccctactggcaccgtgcgatccaacccaaacaccgatagtgctgcagcacttctgatctgtctgccagaagtagcccctcaccctgtttattatcccgcccttgaaaagttaccgggcggtatgcttttagcctccagagagtggagacccgagcttttgtggatgaggctccatgccgaggactcagcgccaagccgaatgattggcgtcgcaatgccgggcctgggagtcctaccaggtctcgtacaagctccgggcgacgccgaatgctctcgcctgctgcaaatcctggaactaggtcgacatagcgagtgtgtgcatgtcactgaagaggaacagctgcagctgcgcgaaattttggagagaagaggaagcggcgaactctacgaacacgagaaggacttggtgtggaaactgcggcatgaagtacaagaacattttccagaagcgctcgcgcgtctgctgttggtcacaaaatggaacaaacatgaagatgtggctcaggatgctctgccggcagtcagctggccagagctgccggtgctgagtgctctggagctgctggacttttcattccccgattgccacgtcggctccttcgcaatcaagtccttgcgcaaattgaccgatgacgaactcttccaatacctactgcagttagtccaggtgctaaagtacgaaagctacttagactgcgaactcacgaaattcttgttggacagagcactggctaaccgcaagattggacacttcttgttctggcacctgagaagcgaaatgcatgtgcctagcgtggcgctgaggtttggcctcatcctagaggcttattgtcgcggcagtacccaccacatgaaagtgctaatgaagcaaggcgaggcattgtcaaagttaaaagcccttaatgactttgtcaaactctccagccagaagacccctaaaccgcagacaaaagaacttatgcatctctgtatgagacaggaagcctatcttgaggcactgagccacctgcagagccccctggacccctcaacgctcctggctgaggtgtgtgtggagcagtgtaccttcatggactcaaagatgaagccgctgtggatcatgtatagtaacgaggaagctggctccggaggttccgtcggaatcatcttcaagaatggcgatgatttgcgacaggacatgctgacactgcagatgatacagctgatggacgtgctgtggaagcaggagggtctggatctacggatgaccccgtacggatgtttgcctacaggtgatcggactggactcatagaggtcgtccttcggtctgatacaatagctaacatccagctgaacaagtctaatatggctgcgaccgccgctttcaacaaggacgcgttgctgaactggctgaagagtaagaaccctggcgaagctttagatagggcgatagaagagttcacattgtcctgtgctggttactgtgtggctacgtacgtactcgggatcggagataggcattccgataacattatgattagagagtctggacagttgttccatattgacttcggacactttttggggaactttaaaacaaagtttggcatcaacagggagcgggtgccctttatcttaacatacgacttcgtgcacgtgattcaacagggtaagaccaacaacagcgagaagttcgaaaggtttaggggttactgtgaaagggcttatacaatcctcaggcgacacggtctgttatttctgcacctgttcgccttgatgcgggccgctggactccctgagttatcttgttcgaaagacatccaatacctgaaagattctctagccctgggaaaaactgaggaggaagcgctcaaacatttccgggtcaaatttaatgaggccctccgagagtcctggaaaacgaaagtaaattggctggcacataatgtaagtaaagacaaccgccagtag

SEQ ID NO: 16595 - DNA, 3207 bp, Artificial Sequence
  Description of Artificial Sequence: Synthetic coding sequence
atgcctccgggggttgattgccccatggaattctggacaaaagaggagaaccaaagtgtggtagttgattttttgttacctactggcgtttaccttaacttccctgtatctcggaatgcaaatctgtcgacaataaaacagttgctatggcacagagcgcagtatgagcccctgtttcacatgttatctggtccagaggcatatgttttcacctgtattaatcagacagccgaacagcaagagttggaggacgaacaaaggaggttgtgtgatgtccagccctttctccccgtcctgcgtctggttgcaagggagggggatcgcgtcaaaaaattaataaatagtcagatttctttgttgattggaaagggcctgcacgagtttgacagcctgtgtgaccccgaggtgaacgattttcgggctaagatgtgccagttctgtgaagaagccgccgcccgaagacagcagcttggctgggaggcgtggctacagtatagtttccccctgcagttggaaccgagtgcccaaacatgggggcccggtacgttgcgtcttcctaatagggcactgctcgtcaacgtcaaatttgaaggctcggaagagtcattcacctttcaggtctcaaccaaggatgttccattggcactcatggcctgtgctctccgaaagaaagccaccgtcttccgccaacctctggtggaacaacctgaggattacactctgcaagttaatggaaggcacgaatatctgtacggctcttaccccctctgtcaatttcaagtacaaaagccaagggccaaacctccacctatccccgctaaaaagccttcctcagtctcgctgtggtccctagaacaaccgtttcgcatcgaattaattcagggatctaaagtaaacgccgacgagcggatgaaactcgtggtccaggccggactcttccacggcaatgaaatgctatgcaagactgttagctcttctgaggttagtgtctgcagcgaaccagtgtggaaacaaagattggagtttgatataaatatctgcgacctgccccgcatggccagactgtgtttcgctctttacgctgtaatcgagaaggccaaaaaagcccggagcactaagaaaaagtccaaaaaagccgactgccctatcgcatgggccaacttgatgttatttgactataaggaccagctgaaaacgggagaaagatgcctgtacatgtggccctccgtacccgatgaaaaaggagagcttttgaaccctacaggaaccgttcggtctaaccctaacaccgactcagccgccgcccttctgatctgccttccagaagtagccccacatccagtctactatcccgcgttagagaaacttccaggcgggatgctactggccagcagagaatggaggcctgagttgctgtggatgaggctgcacgctgaggactccgcacccagccggatgattggcgtcgcgatgccaggactgggggtcctgcctggtctggttcaggctcctggcgatgctgaatgcagtagactactacagattctggagctcggacgtcattcagagtgcgtccacgtgaccgaggaagaacagctgcagctgagagaaatcctcgagcgacgcggcagcggagaactgtacgagcatgaaaaggatctggtatggaagctgcgtcacgaggtgcaggaacactttccagaagcactggccagattattgctcgtgacgaaatggaacaaacacgaagatgtcgcccagatgttgtacctgctctgcagctggccagagctgcctgtgctcagtgccctcgaattattggattttagtttcccggattgccatgtcggctccttcgccatcaagagcctccggaaactcaccgatgatgagctgtttcagtacctcctccagttagtccaagtcctgaagtatgagtcctacctggattgtgaactgacaaagttccttctcgacagagcgcttgctaaccgaaaaattggccactttttattctggcatctaaggagcgagatgcacgtaccctcggtggcactgcgcttcgggcttattttggaggcctattgcaggggttctacccatcatatgaaggtcctgatgaagcagggagaagcgctctcgaagctgaaagcattgaacgacttcgttaagttgagcagtcagaagacacccaaaccgcagacaaaagagctgatgcacctgtgtatgagacaggaagcgtatctagaagcccttagtcacctccagtctcctcttgatccgagcactctgctcgcagaagtgtgtgtcgaacagtgcacatttatggactccaagatgaagcccctatggattatgtactcaaacgaagaagccggcagtggcggaagcgtgggcattattttcaagaacggggatgacctccggcaggacatgctgacgctacagatgatacagcttatggacgtcctttggaaacaggaagggctggaccttcgaatgactccatatgggtgcttacccactggagatcggaccggcctaatagaagtcgtgcttaggtcagacaccatcgccaacattcagctgaacaagtcaaatatggcagcaacggctgcctttaacaaagacgccctgctaaattggcttaaaagtaagaatcccggcgaggccctggaccgtgccatcgaagaatttactctgtcctgtgcgggatactgtgttgcaacctacgtgcttgggattggggacaggcactcagataatatcatgatcagggaatctgggcagttattccacattgactttggacacttcctaggtaactttaagacgaagttcgggattaatagggagcgggtgccatttatcctgacatacgatttcgtccacgtgatacagcaagggaagacgaataactccgagaaatttgaacggtttcgaggctattgtgagcgggcctataccatcctaaggcgacatggattactgtttctacacctgtttgcgctgatgagggcagccggcttacctgagctttcgtgctctaaagacattcagtacctcaaagactcactggcattgggcaaaaccgaggaagaggcactgaaacacttccgcgtaaaattcaatgaagctctaagagaaagctggaaaaccaaggtgaattggctggcccataatgtgtcaaaggacaaccgacaatag

SEQ ID NO: 16596 - DNA, 3135 bp, Artificial Sequence
  Description of Artificial Sequence: Synthetic coding sequence
atgcctccaggagtagattgccccatggagttctggacgaaggaggaaaaccagagcgtagtggtcgatttccttctcccaacgggagtgtatttgaactttcccgtcagcagaaatgcgaatctgtcaacaatcaaacagcttctctggcacagagcccagtacgagcccttgtttcacatgttgtccggacctgaggcctatgtgttcacatgcatcaatcagacagccgaacagcaggagctggaggacgagcagcgcagactgtgtgatgtacagccgttcctgccagtgctacggctggtcgcccgggaaggggacagagtgaagaaattgatcaacagccagatttctttactcatcgggaaagggctgcacgaattcgattccttatgtgatcctgaggtcaatgacttccgagcgaagatgtgccagttttgcgaggaggctgcagctcgtcgccagcagttgggatgggaggcctggttacaatatagctttcctctgcagttggagccgtccgcccagacctggggtccaggcactttgcgcttacccaaccgggcactgctggtgaacgtgaagttcgaaggtagcgaagaaagcttcacctttcaggtgagcactaaagacgtaccccttgcgctgatggcctgcgccttacggaaaaaagcaaccgtttttcggcagccgctggtcgagcagccggaggactatactctacaggtcaacggtcgacacgaatatttgtatggttcataccctttgtgtcagtttcagtatatatgctcttgcctgcattcaggtctaacgcctcatcttactatggtccatagcagctccatcctcgccatgagggatgagcagtctaaccctgcaccacaggtgcagaagcccagggcaaaaccaccgcctatacccgctaagaaaccaagttcggtctccctgtggtccctcgaacagcccttccgtattgagctgatacaaggatcaaaagtcaacgcggacgaaagaatgaagttggtagttcaggctgggctattccacggcaatgagatgctgtgtaagaccgtaagttccagcgaggtgtccgtctgtagcgagcctgtctggaagcagcgacttgaatttgacattaacatctgtgacctgcccaggatggccaggctgtgctttgcattgtatgcagtaatcgaaaaagcaaaaaaagcgcgttccactaaaaagaaaagcaagaaagctgactgccctattgcttgggccaacctcatgttattcgactacaaagatcagttaaaaactggggagcgatgcctttatatgtggccctcagtcccagatgaaaagggagagctcctgaatccaacaggaactgtacgatccaaccccaacactgactcggcggctgcactcctgatttgcctgccagaagtggccccccaccccgtctactaccctgcactcgaaaaaattttggagttgggcagacatagtgagtgcgtccacgtaactgaggaggaacagttacagctccgagagatcctggaaagacgcggctctggcgagctctatgaacacgagaaggacctggtctggaaactgcggcatgaagtacaagaacactttccagaggcccttgcgaggctacttttagtcacaaagtggaacaaacacgaagatgtggcccaaatgctgtacctgctttgtagctggccggaactgcccgtgctgtccgccttggaacttctggacttctcttttccggattgccatgtgggctctttcgcaataaaaagtctgcggaaactgaccgatgatgagctctttcaatacctgctccagctggtgcaggtgctgaaatatgagtcgtatctcgattgcgagttaacaaaattcttgcttgatcgtgccctggccaacagaaagatcggacactttttgttctggcaccttagaagtgaaatgcacgtgccttccgtggccctgcgatttggcttgatcttggaagcctattgtcgcggatcaacccatcatatgaaggtgctcatgaaacagggcgaggctttgtcaaaattgaaggctctcaatgattttgttaaactgagctcccagaaaacacccaagccacaaacaaaagaactgatgcatctctgtatgaggcaagaggcctatctggaggcactctctcatttgcagagcccactggacccaagcactttgctggccgaggtttgcgtggaacagtgcacttttatggattcgaagatgaagcctttgtggatcatgtattcaaacgaagaggccgggagcggcggctctgtaggcatcatctttaaaaatggcgatgacctgcgtcaggatatgctgaccctccaaatgatccagctaatggacgtgctctggaaacaggaaggcctggacctccggatgacaccctacgggtgtttgcctactggggatagaaccggcctgattgaggtggtacttagatccgataccatcgcaaacatccaactgaataagtccaacatggcagctactgcggccttcaacaaggatgctctcctgaactggcttaaatcgaagaacccgggcgaggcacttgacagggctatagaagaatttacactgagctgtgcaggctattgcgtcgccacctacgtgctcggcatcggagatcgccattctgataacattatgatccgcgagtcaggtcagctgttccacatcgactttggacactttctcgggaactttaagaccaagtttgggatcaatcgagagagagtgccgttcattctgacatacgactttgtccatgtgatccaacaagggaagacgaataactctgaaaagttcgaacgattcaggggttactgcgagagggcctatactattttgcgcagacacggactgctcttcctccacctgttcgcgctgatgcgtgccgccgggctccccgaactgtcttgtagcaaggacattcagtatcttaaggacagcctggctctgggaaagacggaagaggaggctcttaaacattttagggtaaagtttaacgaggcgcttcgggagagctggaaaaccaaggtcaattggctggcacacaatgtctcaaaagataacagacagtag

SEQ ID NO: 16597 - DNA, 3207 bp, Artificial Sequence
  Description of Artificial Sequence: Synthetic coding sequence
atgccccctggggtggattgcccgatggagttctggaccaaagaagagaaccagagcgtggtggtcgatttcctactccctacaggcgtctacctcaactttccagtgtcacgcaacgccaatctttcgactataaagcagctgctctggcatcgtgcccagtatgaaccgctgttccacatgttgtcaggtccagaggcgtacgtgtttacttgcatcaaccaaacggccgaacagcaggagctcgaggatgagcagaggcgcttatgtgacgtccagccctttcttccagttctgcggttagtggcacgcgagggagatcgggtgaaaaagctcatcaatagtcaaattagtctgctaatcggcaaaggattgcatgagttcgatagtctttgtgaccccgaggtgaacgacttcagggctaagatgtgccagttctgcgaggaagctgccgcgagaaggcagcagctgggctgggaggcttggctgcaatactcctttcccctacagctggaaccaagcgcccagacgtggggtcctgggactctgaggctcccaaatcgagcacttctggtaaacgtgaaattcgaaggctctgaggagtcttttacctttcaggtgtcaactaaagatgtccccttagccctgatggcctgcgccctccgcaagaaggccacggtcttccggcaaccccttgttgagcaaccagaggattacacactgcaggtgaatgggaggcacgagtatctttacggttcttatccactctgtcaattccaggtgcaaaagcccagagccaaacccccgcccatcccggcaaagaaaccctctagcgtgagtttgtggtcccttgaacagcctttccgaatcgagttgattcagggatccaaagtgaacgctgacgagagaatgaagctggtagttcaggccggactgttccacgggaacgagatgctctgcaagaccgtgtcgtcatctgaagtcagcgtctgttcagaaccggtgtggaagcagaggttggagttcgacataaatatctgtgacctgcctcgcatggcgaggctgtgtttcgccttgtatgcagttattgagaaggctaagaaagcacgcagtaccaagaaaaaatccaagaaagcggattgtcctatagcgtgggcaaacctgatgctttttgactacaaagaccagctcaagactggggaaaggtgtttgtatatgtggcccagcgtgcctgacgagaaaggtgaattactcaatccaaccggcactgtgcggtcgaatccaaacacagactccgccgccgctctgttaatttgcctgccggaggtggctccacaccctgtttactatccggctctggagaagttgccagggggcatgctgttagcatccagagaatggcgccctgaactgctgtggatgagactccacgcagaagactcagccccctccaggatgatcggagtggctatgcctggcttgggagtgctcccagggcttgtgcaggccccgggtgatgctgaatgctcccgactccttcagattctcgaacttgggagacactcagagtgcgtgcacgtcacagaggaagagcagctccaactccgggagatacttgagcgcagaggtagtggtgagctgtatgaacacgagaaggatcttgtctggaagctgagacacgaggtgcaggaacattttcccgaagcgctggcacggttgcttttggtgacaaagtggaataagcatgaagatgtagcacaaatgttatatctactctgctcatggcctgagctgccagtgctttcagccttggagctactggatttcagctttcctgactgccacgtcggttctttcgcaattaaaagcctaagaaaattaacagacgatgaactattccagtatctcctccaattagtccaggtgctcaagtacgagagctatctggattgtgaattgaccaagttcctgttggatagggctctggctaacagaaagatcgggcacttcctcttctggcacctgcgcagcgagatgcacgtgccttcagtcgccttaagattcggcctgattctcgaagcctattgcaggggttccacacatcacatgaaggtactgatgaagcagggggaagctctgagcaagctgaaggccctgaacgactttgtgaaattatcaagccagaagacgcctaaaccacagaccaaagagctgatgcacctatgtatgcgccaggaagcttacctggaagcactgagtcatttacagagtcctctagatccctccactctgttagcagaagtatgcgtggaacaatgcacgttcatggactccaaaatgaagccactatggataatgtacagcaacgaggaggccggctctggaggcagtgtcgggattatttttaaaaacggtgatgacctgaggcaggacatgctgacacttcagatgattcagctgatggatgttctgtggaagcaagagggtttagatttgagaatgaccccgtacggttgtcttcccacaggggatcgcacaggattaatcgaagtagtcctgcgtagcgacaccattgccaatatccagctgaacaagtccaacatggccgcaacagcggcatttaacaaagacgcccttcttaactggctgaaatccaagaaccctggagaggcactggacagggccatagaggagtttaccctctcatgtgcgggatattgcgttgctacttatgtgcttgggatcggcgataggcattccgataacattatgatcagagagtctggacagctttttcacattgactttggccacttcctcggaaatttcaaaacaaagtttgggataaatagggagagggtgcccttcatcttgacttacgacttcgtccacgtcatacagcagggaaaaacaaacaatagtgaaaagttcgagcggtttcgcggctactgcgagcgggcatacacaattttacgtagacatggtttgctgttcttgcacttgtttgcactcatgcgggctgcaggcctgccggagctgtcatgctctaaagatattcaatatctgaaggacagcttggcactaggtaaaaccgaggaagaagccttaaagcattttcgcgttaagtttaacgaagcactgcgtgaatcttggaaaacaaaagttaattggctcgctcacaacgtgtccaaagataacaggcagtag

SEQ ID NO: 16598 - DNA, 960 bp, Artificial Sequence
  Description of Artificial Sequence: Synthetic coding sequence
atgatccccgagtctagcgaactcgtggtgcaggccggcctatttcacgggaacgagatgctttgtaaaactgtatccagcagtgaggtaagcgtgtgctctgagcctgtgtggaagcagaggctggagttcgatataaacatctgtgacttgcccagaatggcgcgattatgcttcgccttgtacgctgtgattgagaaggctaagaaagccaggtctaccaagaaaaagtccaaaaaggcagactgccctatcgcatgggctaatctgatgcttttcgactacaaggaccagctgaagacaggagaacgctgcctctatatgtggccatccgtccccgatgaaaagggcgagctgctgaatccaacaggaaccgtaagatccaatccaaacactgattctgccgctgcccttctgatctgcctacctgaggtggcgcctcatccagtgtactatccagcactcgagaagatcttggaacttgggcgtcatagtgagtgcgttcacgttacagaggaggagcagctccagctgagggagatcctggagcggcgtggctccggggagctgtacgagcacgaaaaggacttagtctggaaactgcgccacgaggtgcaagaacatttccccgaggccctggctagactgctgctggtcaccaaatggaacaaacatgaagacgtggcccagatgctgtacctcctgtgttcatggcccgagctgcccgttttatctgccttagagctattggacttttcttttcccgattgtcatgtcggtagcttcgccatcaaatcgctcaggaagctcaccgatgatgaactcttccagtaccttcttcagctggtccaggtccttaagtatgaatcctatctcgactgtgagttgactaaattcttgttagatagggccttggcaaaccgtaagatcgggcactttctgttttggcacttaagatag

SEQ ID NO: 16599 - DNA, 3309 bp, Artificial Sequence
  Description of Artificial Sequence: Synthetic coding sequence
atggagctcgaaaactataaacagcccgtcgtgctacgggaggataattgtcggaggcgccggagaatgaagcccaggtccgccgccgccagcctcagttctatggaactgattccaatcgagttcgtgctgcctacatcacaacgcaaatgcaaatcaccagaaactgccctgcttcatgtggccgggcacggaaacgtggagcagatgaaggcccaggtgtggctcagagcccttgagacatccgttgcagctgacttctaccaccggctggggcctcatcactttttgctgttgtaccagaagaaaggccaatggtatgaaatctatgacaaataccaggtcgtccaaaccttggactgtctccgctactggaaggccacccatcgaagcccagggcagatccacttggttcaaagacatccaccaagcgaggaatcccaggcatttcagcggcagctcacagccctcatcgggtatgatgtcactgacgtctccaatgttcatgacgacgaactagagtttactcgccgcggcctggtgacaccccgcatggcagaggtggcctccagggaccccaaactgtatgcaatgcatccttgggttactagcaagccgttgcctgaatacctgtggaagaaaattgcgaacaattgtatattcatcgtgattcatcgcagcaccacttcacagaccataaaggtgtccccagacgacacccctggcgctattctgcagagcttcttcactaagatggcgaaaaaaaagtctttgatggacatcccagagtcccaatccgagcaggacttcgtcctgcgcgtatgcggaagagacgagtatctcgttggggagacgccaataaaaaactttcagtgggtgcgccattgtctgaagaacggcgaagagattcatgtagtgctggatactcccccagatccagcgctcgatgaggtccgtaaagaggagtggcccttagtagacgattgtaccggggtgaccggttaccacgagcagctgacaattcatggcaaagatcacgagtctgtctttaccgtgagcttatgggactgcgaccgaaaattccgtgtgaagataaggggcatcgacattcctgtgctccctaggaacaccgacctcacagtgtttgtggaggctaatatccagcacggacagcaagtgctctgccagagaagaactagtccaaagcccttcacagaggaggtgctgtggaacgtgtggctggaattctctatcaaaatcaaagaccttcccaagggagccctacttaatctgcagatctattgcggaaaggccccagccctctcctcgaaggcgagcgctgagtccccctcaagcgagagcaaagggaaagtgcagttgctgtattacgttaatctgctacttattgatcaccggtttcttctgcggcgaggagagtacgtgttacacatgtggcagatctcaggtaaaggcgaagatcagggcagtttcaatgccgataagctcacgtccgctacaaaccctgacaaggagaatagcatgagcatcagtatcttgctggacaattactgccaccccattgcccttcccaaacaccagcccacacccgaccccgaaggcgatcgtgtgagggcagaaatgcccaatcagcttaggaaacagctcgaggccatcattgccacagatccgttaaatccacttaccgccgaagacaaagaactgttgtggcacttcagatacgaatcactaaaacaccctaaggcctaccccaagctcttctccagcgtgaaatggggacaacaggaaattgtcgcaaaaacctaccaacttctagctcgtcgcgaagtctgggatcagtccgcactcgacgtcgggctaactatgcagctcctcgattgcaacttctctgatgagaacgtacgggctatcgcggttcagaaattggagtccctggaggatgatgatgttcttcactaccttcttcagctggtccaagctgtgaaattcgaaccgtatcacgacagcgctctggcccgtttcctgctgaagcggggactacggaataaaagaattggccacttccttttctggttcctcaggtcagagattgcacagagtcgccactaccagcaaagatttgccgtgatcctggaagcctacttgcgggggtgcggcacggctatgcttcatgattttacacagcaggtgcaagtcattgaaatgctgcagaaagttacgctggacattaagtccctgagcgccgagaagtacgacgtctccagtcaagtgataagtcagctaaaacagaaactcgagaatttacagaactctcagctgccagagtcctttcgcgtgccctacgatccaggccttaaggctggcgccttagctatcgaaaagtgcaaggtcatggcatccaaaaagaaacccttatggctggagttcaaatgcgccgatcccacagccctgtctaatgagacaatcgggattatcttcaaacatggcgacgaccttagacaggatatgctgattcttcagatactgcgaatcatggagagtatctgggaaacagaaagcctcgatctttgtctgctcccatacgggtgtattagcactggcgataagattggaatgatcgagatcgttaaagatgctaccactatagcaaaaattcagcagtccacagtgggcaacaccggggctttcaaggacgaagtcttgaaccactggctgaaggaaaaatcgcctactgaggagaagttccaggctgcagtggagagattcgtgtatagttgcgctggctactgcgtggccacgttcgtactgggcattggtgatcgccataatgataatataatgattaccgaaacaggcaacctgtttcatattgatttcggccacatactgggtaattacaagagctttctcggcatcaacaaggagagggtgcctttcgtgctgacaccagactttctgttcgtgatggggacaagcggaaaaaagacatccccccactttcagaagtttcaggatatctgtgtgaaggcctatctggccttacgccaccacactaacttgctcatcatcctcttctctatgatgttgatgaccgggatgccacaactcacgtcaaaagaggacattgagtacatacgtgatgccctcaccgttggaaaaaacgaggaggatgctaagaagtactttctggatcaaatcgaggtttgtcgggacaaaggctggacggttcagtttaattggttcctgcacttagttctcggaattaagcagggggagaaacacagtgcctag

SEQ ID NO: 16600 - DNA, 3309 bp, Artificial Sequence
  Description of Artificial Sequence: Synthetic coding sequence
atggagctggagaattataagcagccagttgtcctgagagaagacaattgccgcagacgaagacggatgaaaccccgcagtgcagccgcttccctgtcctccatggagctgatcccaatcgaatttgttctgcccacatcccagcgcaaatgcaaaagcccagagactgctctgttgcacgtggcgggacatggcaatgttgaacagatgaaagcccaagtttggctgagggccctagagaccagcgttgccgctgatttttaccaccggttaggcccacatcattttctcctcctgtaccagaagaagggccagtggtacgaaatctacgacaaataccaggtggttcagactctggattgtctcaggtattggaaagctacccatagatctcccgggcagattcacttagtgcaacggcaccctccatctgaagagagccaggcctttcagaggcaactcactgccctcatcggctatgatgtgaccgatgtatccaacgtacatgacgacgaactggagttcacacgcagagggctggtgaccccaaggatggcggaagtggcttcccgcgacccaaaactctatgccatgcacccttgggttacgagcaagccattacctgagtacctgtggaaaaagatcgctaataattgtatcttcattgtgatacaccggtctaccacatcccagacaatcaaggtcagccccgacgacacgccaggcgccattctgcagagcttttttaccaaaatggcaaagaaaaaaagccttatggatatcccggagagccagtccgaacaggacttcgttctccgcgtgtgcggccgtgatgagtacctagttggggaaactcccatcaagaacttccaatgggtgcggcactgcttgaaaaatggagaggagatccatgtcgtgcttgacacacctccagatcccgcacttgacgaggtgcgcaaggaagagtggcctctggtggatgattgcacgggagttacaggctatcatgagcagctcaccatccatggtaaagatcacgagagtgtctttaccgtatcactatgggattgtgaccgtaaattcagagtcaaaatccgaggtattgatatccccgtgttgccacgcaacacggatctcaccgtttttgtcgaagctaatatccaacacgggcaacaggtcctgtgccagcggagaactagcccaaaaccttttaccgaagaagtgttgtggaacgtttggttggagtttagcatcaagattaaagacttgccaaagggggccttgctgaatttgcagatctattgcggtaaagcccccgctcttagttcaaaagcaagcgctgagtcacccagctctgagagcaaggggaaggtgcagctgctgtactacgtcaatctgctgctgattgaccacaggttccttcttcggcgtggagagtacgtccttcacatgtggcagatttccggaaagggcgaagatcagggtagcttcaacgctgacaaattgactagcgcaactaatccggacaaagagaacagtatgagtatctcaatcctgttggataattactgccacccgatagccctccccaaacatcaacctacccccgaccctgaaggagaccgcgttcgagccgagatgcctaatcaactgagaaaacagctggaggcgatcattgccaccgaccctttgaatcctctgaccgctgaagacaaggaacttttgtggcacttccgatatgagagtctgaagcatcccaaagcctacccaaaattattcagtagcgtgaagtggggacagcaggaaattgtcgcgaagacataccaactgctcgcccgccgcgaagtttgggatcagtctgctctcgatgtgggcctcaccatgcagctactggactgcaacttttctgatgagaacgtgagggcgatcgccgtacaaaagctcgagagtctggaagacgatgatgtcctacactacctgctgcagctcgtccaggcagtgaaatttgagccctaccatgactctgccctggctcggttccttctcaaaagaggcctgcgaaataaaaggataggccactttttattttggtttttgagaagcgaaattgctcaaagtcggcactatcagcagcggttcgccgtcattttagaagcctacctaaggggttgcggtacagcaatgttgcatgatttcactcaacaggtccaagttatcgaaatgttgcaaaaagtgactctggatatcaaatcactcagcgcggagaagtatgacgtcagttctcaggtcatcagtcagctgaaacagaaactcgaaaacttgcagaatagccagctgccggagagcttccgagtcccttacgaccctgggctgaaagcaggcgcactggcaatagagaagtgcaaggtgatggcatctaagaaaaagccactgtggctggagtttaaatgcgcggatccgacggcacttagtaatgagactatcgggatcatatttaaacacggggatgacctccgacaagacatgttgattttgcagatcctgcgcattatggagtctatttgggaaacagaatccctcgacctgtgtctactcccatacggttgtatcagcacaggggacaagatcggaatgattgaaattgttaaggacgctaccacaattgccaaaatacagcaaagcactgtcggcaacactggggcattcaaggacgaagtgttgaaccattggcttaaagaaaaatccccaaccgaggaaaagttccaggctgccgtggaacggtttgtgtatagttgcgcaggatattgcgtcgcgacattcgtgctcggaatcggagatcgacataatgataacatcatgattacagaaactggaaacttatttcatatcgactttggacacatcctcgggaactacaaatcttttctgggaattaataaagagcgggttccctttgtattgactcccgactttctgttcgtgatggggaccagcggtaaaaagaccagcccccattttcagaaattccaggatatctgtgttaaggcctacttggccctgcgacatcacacaaatctactgataattttgttctccatgatgctaatgactggcatgccacagttaactagtaaggaggacatcgaatacatacgcgatgcactgaccgtggggaagaatgaagaggacgctaagaaatacttcctggaccagatcgaggtgtgccgggacaaagggtggaccgttcagttcaattggtttctccatctggtgctcggcatcaagcagggagagaaacattctgcctag

SEQ ID NO: 16601 - DNA, 3309 bp, Artificial Sequence
  Description of Artificial Sequence: Synthetic coding sequence
atggagctcgaaaactataagcagcccgtcgtactccgcgaagacaactgtcgcaggcggagacgaatgaaacccaggagtgctgccgcttcactgagttccatggagcttatccccatcgagttcgtcctgcctacatcccaacgaaaatgtaaaagccctgaaactgcccttctgcatgtggcaggccacggaaatgtcgagcaaatgaaggctcaggtttggctgcgagctctagaaaccagtgtggccgccgatttctatcacaggctgggtccccatcattttcttctcctttaccagaagaagggccaatggtatgagatctacgacaagtatcaggtcgtgcagacgttagactgtctccggtactggaaagccacgcacaggtcacccggccagattcacctggtgcaaaggcatccgcctagcgaggaaagtcaggcttttcagaggcagcttacggctttaatcggttacgacgtcactgatgtttcaaacgtgcatgacgacgagctggagtttacccggcgaggtctcgtgacccccagaatggctgaagttgctagtcgcgatccaaaactctacgcaatgcacccttgggttactagcaaacctctgcctgagtacctatggaaaaagatcgctaataattgcatcttcattgtgatacacagaagtaccacctctcaaactataaaagtctccccggatgatactcccggagcgattctccagagcttcttcaccaaaatggccaaaaaaaagagcctgatggatatacccgaatctcagagtgaacaggatttcgttttaagagtctgtggacgagatgagtatttggttggcgaaacccccattaagaacttccagtgggtgcgccactgtctaaagaacggagaagagatccatgtggtgctcgacacgcctcctgatccagccctggatgaagtcaggaaggaggaatggccgcttgtagatgactgcacgggggtaactggctatcatgaacaactgaccattcacggcaaggatcatgagtcagtcttcaccgtgtctttgtgggattgcgatcgcaaattcagagtaaaaatcagaggtattgacatcccggtgctgcctagaaacacagatcttacagttttcgtggaagccaacatccagcacggccaacaggtgctctgtcaacggcggacttcccccaaaccgttcacagaagaagttctgtggaatgtatggctggagttctccatcaagataaaagatctacctaagggggcacttctcaatcttcagatatattgcgggaaagctcctgccctatcctcgaaggccagcgcggagagtcccagctcagagagtaagggcaaagtgcagttgctgtactacgtcaatctgcttttgatcgatcaccgcttcctgctcaggagaggcgagtatgtgctccacatgtggcagatatccggtaagggggaggaccagggcagcttcaacgccgataaactgacttcggcaaccaaccccgacaaagagaactcaatgagcatttctatcctcttggataattattgtcaccctatcgccctaccaaagcatcagccaactccagatcctgagggggaccgggttagggcagagatgcccaaccagttgcgcaaacagcttgaggccatcatagccactgaccccctcaacccattgaccgcagaggacaaggaactgctgtggcacttcaggtacgagtcactcaagcacccgaaggcatacccaaaactgttttcatctgtgaagtggggccagcaagagattgtcgctaaaacataccagttacttgctcgacgagaagtctgggaccagtccgctctggatgtgggcctgaccatgcagctgctcgactgcaacttctctgacgagaatgtcagagccattgctgttcagaagttggagagcctcgaggatgatgacgtgctgcactaccttcttcagctcgtgcaggctgtaaaatttgagccctaccatgactccgccctcgccaggtttctgctaaagagggggcttcgcaacaagcgcattgggcactttttgttctggtttctgcgcagtgagatcgcccaatcccgccactatcagcagcgcttcgcggtcattctggaagcctacctaagagggtgtggtaccgcgatgctccacgatttcactcagcaagtgcaagttatagagatgctccagaaggtcactcttgacataaagtcactcagtgccgaaaagtatgatgtcagctcccaggtcatatcacagctaaaacagaagctggagaatctgcaaaactcacagctgcccgaatcattcagagtgccctatgaccctggtctgaaagctggggctctcgccattgagaagtgcaaggtgatggcctccaaaaagaaacccctgtggctagagttcaagtgcgctgatcctactgctttgtccaatgagactataggaatcattttcaaacatggggacgatctgagacaggatatgttgattttgcaaatcctcaggattatggaatctatatgggagactgagagccttgacctctgcctactcccttacggttgcatcagcactggggacaagatcggcatgatcgaaattgttaaagacgccaccactattgccaagattcaacagagcaccgttgggaataccggcgctttcaaagatgaggttttgaaccactggctaaaagagaagtcacccaccgaagaaaagtttcaagccgcagtcgaaaggttcgtttactcctgcgccggttactgtgtcgcgacctttgtcttgggaatcggagacagacataatgacaacattatgattaccgagacgggtaacttgtttcatattgacttcggtcatattctggggaactataaatcttttttgggaatcaataaggaacgggtgccattcgtgcttacgcccgattttctgttcgtgatggggacatctggcaaaaagacatccccccacttccagaagttccaggacatctgcgtgaaagcgtacttagccttgcgccaccacaccaacctgctgattatactgttctcaatgatgctcatgactgggatgcctcagctcacatccaaggaggatatcgaatatatccgggacgccctgacggttggcaaaaatgaggaggacgccaaaaaatattttctcgatcagatcgaggtttgtcgggacaaaggctggaccgtgcagtttaactggtttctacaccttgtactggggatcaagcagggggaaaagcactctgcttag

SEQ ID NO: 16602 - DNA, 5061 bp, Artificial Sequence
  Description of Artificial Sequence: Synthetic coding sequence
atggcacaaatcagctcaaattcaggctttaaagaatgcccgagcagccatcctgagcccacccgcgccaaagatgtggacaaagaggaggccctgcagatggaggccgaggcactggctaagctacagaaggaccggcaggtaactgacaaccagcgcggttttgaactctcttcatctacaagaaagaaggcccaggtgtacaataagcaggattatgacctgatggtgttccctgaatcggactcacagaaacgggcactcgatattgacgttgagaaattgacacaagcagaacttgagaaactgcttcttgatgactcttttgaaacgaagaagacccccgtgctgccggtgaccccgatcctgtcgccctctttttctgctcagttgtatttccgccccaccatccagaggggacaatggccaccggggctccctgggcctagcacgtatgccttgcccagcatttatccatctacttattcaaaacaggccgcatttcagaatggatttaatcccagaatgcctacatttccgtcaacagagcctatataccttagtctgcctggtcagtcaccgtacttctcttatcccctgacaccagctacaccatttcaccctcaggggagtttgcctatctatcggccagtggtgagcacagacatggccaaactgttcgataaaattgcatccacgtctgagttcttaaagaacggtaaggcccgcaccgatctggagatcacggattccaaggtcagcaacttacaggtctcccctaagagcgaggacatctccaagtttgactggttggaccttgaccctttgtccaaaccgaaggtcgacaacgtagaggtcctggaccacgaggaagaaaagaatgtgtcatccctgctagctaaagatccctgggacgccgttctgctggaggaacgcagtacagccaattgtcatctggaacgcaaagtgaacggtaaaagcctctctgtggccaccgtgacccgcagtcagagccttaacatccgtacaacacagctggctaaggcacaagggcatattagtcagaaagaccccaatggcacctccagcttgccgactggctcttccctcctacaggaggttgaagttcagaatgaagaaatggccgcattctgcagaagtatcactaagctgaagacaaagtttccctacactaatcaccggactaatccgggctacttgttgagtcctgtcactgcacagcgcaatatttgcggggagaacgcttccgtgaaggttagtattgatattgagggtttccagcttcccgtcaccttcacatgcgacgtgtccagcacagtcgagataatcattatgcaggcactgtgttgggtacacgatgatctgaaccaggtggacgtggggagctacgtcctgaaggtgtgcggacaggaagaggttctccaaaacaaccactgcctaggttctcatgagcacatccagaattgccggaagtgggacaccgagattcggttgcagcttctgaccttttccgcaatgtgccagaatctggctcgcactgccgaagatgatgagactccagtcgatcttaataagcatctctaccagatcgaaaaaccatgcaaggaggccatgacccgacacccagtcgaagagttacttgacagttaccacaaccaggtggagctagcactgcagattgagaatcagcatcgtgccgtggaccaggtgattaaagcagtacgcaaaatctgctctgcactggatggtgtcgagactcttgcaataaccgagtctgtgaaaaagttaaaacgtgcagtgaacttgccaagatcaaaaactgccgatgtgacctccctgtttgggggagaggacacaagtaggagcagtactcggggcagtctgaacccagaaaaccccgtgcaagtgtctatcaatcagctcaccgctgcaatttatgacctactgcggctgcatgccaactccggacgcagtccaactgactgtgcgcagagcagcaaatccgtaaaggaggcatggactaccacagagcagctccaattcaccatattcgctgcccatggaatcagttcaaactgggtaagcaattacgaaaagtactacctgatatgctctctgtcgcacaacgggaaggacctctttaagccaatacaatctaaaaaggttggcacctacaaaaactttttctatctgattaagtgggatgagctcattatctttcctattcagatctctcagctccccctggaatcagtcctacacctaaccctattcggcatcctcaaccagagctccgggagcagccccgattcaaataaacagcgcaagggccctgaggcattgggaaaggtcagcttacctctattcgattttaaacggttcttaacatgtggtaccaaactgctgtacctatggacaagtagccacaccaattctgttcccggcactgtgaccaagaaaggttatgtcatggagagaattgttctgcaggtcgactttccctcacccgcgtttgatattatatacaccaccccacaggttgatcgaagcattatccaacaacataatctcgagaccctcgagaacgatatcaagggcaagcttttggacattctgcacaaagacagctccttagggctgtccaaagaggataaagctttcttgtgggaaaagcgctactattgcttcaagcaccctaactgtcttccgaagatactggcttctgctcctaactggaaatgggtgaatctggcaaagacatatagccttttgcatcagtggcctgccttatacccactgattgctctcgaattgctggatagtaagtttgcggatcaggaggtccgcagcctggcagttacatggatcgaggcaatatctgatgatgaactgaccgatctgctcccccaatttgtgcaagctctgaagtatgaaatctacctgaatagttctcttgtgcaatttttgctgagcagggccctgggcaatatccaaatcgctcacaacctgtattggttgctcaaggatgccctgcacgatgtgcaatttagtaccagatacgaacacgtactgggtgccctgctttctgtaggaggcaaacgccttagggaagagctcttaaaacagaccaagctcgtgcaactgctcggtggagtcgcagagaaagtccggcaggcctcgggtagcgcgagacaggtggtcctacaaagaagcatggagcgggtccaaagtttctttcaaaagaacaagtgcaggctcccactgaagcctagtttggtcgcaaaggagctgaatatcaagtcgtgttccttctttagttcaaacgctgtacccctgaaggtgactatggttaatgccgaccccatgggagaagagataaacgtgatgttcaaggttggggaggatctgcgacaggatatgctggccttgcagatgattaaaatcatggacaaaatctggctaaaggaagggctggacctccgaatggttatttttaagtgcctgtcgacagggagggacagaggcatggtggaattagtgccggcgtctgataccctgcgcaaaatccaagttgaatacggggttaccggttcctttaaagataagcctttggccgaatggcttcggaaatacaacccctctgaagaagaatatgaaaaagcatcagagaattttatttatagctgcgcaggatgttgcgtcgccacctacgtcctgggaatatgcgacaggcacaacgacaacattatgctgaggtcaactgggcacatgttccacattgattttggaaagttcctgggtcatgcgcagatgtttggctcctttaagcgggatcgtgcaccatttgtcctcacttctgatatggcatatgttatcaatggcggcgagaagcctaccattagattccagctgtttgtagatctgtgttgtcaagcctacaatctgatccgtaaacagacaaacctatttcttaatctgttatccctgatgattccttccgggctgccagagttgacgtctatacaagaccttaagtacgttcgtgacgccttacagccccagacaacagatgcagaggcaacaatctttttcactcgtcttatagaaagttccctcggtagtatcgccacaaagtttaacttcttcattcacaacttggcccagctccggttctcaggcctcccgagcaatgacgaacccatcctgtcattttccccgaaaacatatagttttaggcaggatggcaggattaaggaagtgagcgtgtttacttaccacaaaaagtataacccagacaaacactacatttatgtagttcggattctgagagagggacagattgagccatcatttgtgttccgtaccttcgacgagtttcaggagctccacaataagctcagcatcatctttcccctctggaaactacccgggtttcccaaccggatggtactgggcaggacacacataaaagatgtagcagccaagagaaagatcgagttaaattcatatctccagtctctgatgaatgcttctactgacgttgccgagtgcgaccttgtttgtacttttttccaccctttactgcgggacgaaaaagctgaagggatcgcacgcagtgccgacgctgggtctttcagccctacacccggccagattggcggtgcagtgaagttgagcatcagttataggaacggcacactgttcatcatggtaatgcacattaaagatctcgtgaccgaagacggggcagaccccaacccctatgtgaaaacctatctgctgccggacaatcacaaaacctctaaacgaaagacaaagatctccaggaagacaaggaatccaactttcaacgagatgctggtgtactcgggatactcgaaggagaccctccgtcaacgtgagctccagttgtccgtcctcagtgcagagagcctgcgtgagaacttcttcctcggaggtgtgactttgccactgaaggatttcaacctctctaaggagacggtgaagtggtaccagctaactgctgccacttacctgtag

SEQ ID NO: 16603 - DNA, 393 bp, Artificial Sequence
  Description of Artificial Sequence: Synthetic coding sequence
atggcgcagatttccagcaacagcgggtttaaagagtgtccgtcctcacaccccgaacctacacgggctaaagatgttgacaaagaggaggcccttcagatggaagctgaggcactggctaaactacagaaggatcggcaggtcactgataaccagcgaggctttgagctgtctagcagcactcgaaaaaaggcacaggtgtataataagcaggattacgatttgatggtgtttcccgaaagcgatagccagaaaagggccctggacattgatgtcgaaaagctgacccaagcagagctggaaaagctgctcttggatgattcctttgagacaaaaaagacgccagtcctgcccgttacacccattctcagtcccagcttctctgcccagtag

SEQ ID NO: 16604 - DNA, 1452 bp, Artificial Sequence
  Description of Artificial Sequence: Synthetic coding sequence
atggcacagatatcctcaaattccggctttaaggagtgtccaagctcgcatcccgagccgactcgcgcaaaagatgtggacaaggaagaggcattgcagatggaagctgaggctctagccaaactgcagaaggatcgccaagtgacagacaaccagcgcggtttcgaactgtctagttccacacgaaagaaagcccaggtgtataacaagcaggattatgacttgatggtttttcctgagtccgattctcaaaagagggctctggatattgacgttgagaaactaacacaagccgagctggagaagctactcttagacgactctttcgaaaccaaaaagacacctgtcctgccggtgaccccaatcctctctcctagcttctcagctcagttatactttcgaccgactattcagcgcggccagtggcctcctgggctgccaggaccctccacctacgcactgccaagtatataccccagcacttacagcaaacaggccgccttccagaacggttttaacccccggatgcctactttcccttccaccgagcctatttacctctcactccctggacaatctccctatttttcttatccactgacgcccgcgacaccattccatccacaaggaagtttgcccatctaccggcccgtggtgagtactgacatggctaaactgttcgacaagatcgcatctaccagtgaattcttgaagaatggtaaagcacgcactgaccttgagattactgactctaaggtcagcaaccttcaggtcagccctaagtcggaagatatttcaaaattcgactggctcgacctggatcctctgagcaagcccaaggttgacaacgtggaagtgctggaccacgaggaggagaaaaacgtttcctctctgttggcaaaagatccctgggatgctgtactgcttgaagagcgtagtaccgccaattgccaccttgaaagaaaggttaatgggaaatcattgagcgtggcaaccgtaacaaggtcgcagagtctgaatattcgaaccacacagctagctaaagcccaaggacatatctctcaaaaggaccctaatgggacctcttcgcttccaactggtagctccctgttgcaggaagtggaggtgcagaatgaagaaatggcagccttttgccggtcgattacaaagctaaagacaaaatttccatacacaaaccaccgaactaatcctggctacttactctcccccgtcaccgcccaaaggaacatctgcggggaaaatgccagcgtgaaggtgtccattgacatcgagggcttccaactcccagtgacattcacctgcgacgtgtcatccacagtggaaatcattataatgcaggccctctgttgggtgcacgacgatctaaatcaggttgatgtcggtagttatgtccttaaagtctgtgggcaggaagaagtcctgcagaaatag

SEQ ID NO: 16605 - DNA, 3921 bp, Artificial Sequence
  Description of Artificial Sequence: Synthetic coding sequence
atggccgctttttgcaggagcatcaccaagctaaaaactaaatttccttacacaaatcaccgtacaaaccctgggtacctgttgagccccgtcacagcccagcgcaatatctgtggcgagaacgccagcgtgaaagtgtccattgatattgagggcttccagctacctgtgacattcacttgcgatgtctcctctactgtcgaaatcatcataatgcaggccttatgttgggttcacgacgacctgaaccaagtagacgtgggttcatacgtcctgaaggtctgcggccaagaggaagtcctccagaacaaccactgcttagggtcgcacgaacacatacaaaattgtagaaagtgggatactgagatccgtctgcaattacttaccttttcagccatgtgtcagaatctagctagaactgctgaggatgatgagactccggtcgatctaaataaacacttgtatcagatagaaaagccatgcaaggaagcgatgactcggcaccccgtagaggagctgctggactcgtatcacaaccaggtggaattggcgctgcagatcgagaatcagcatcgtgcagtggaccaggtcattaaagcagttagaaagatttgttcagccctggacggtgtggaaactctggctattaccgaatcggtgaaaaagttaaagcgtgccgtgaacttacctcggtctaaaacggcagatgtcacctctttgtttgggggagaagacacttcacggagctccacccggggatccctgaaccctgaaaacccagtgcaggtgtccatcaatcagctgacagcagccatttacgaccttctacgcctacatgcgaattcaggcaggtcaccaactgactgtgcacaatcgagcaagagtgtcaaagaagcttggacgactacggaacagctgcagtttactatcttcgctgcacatggcatctcaagcaattgggtgagcaactatgagaagtactaccttatctgttctctgtctcataatggcaaggacctttttaaaccaatacagtccaagaaggtgggcacctataagaatttcttttaccttatcaagtgggatgaactaatcattttcccgattcagatctcccaattgcccttggaatccgtgctccatttaactctgtttggaattctgaaccagtcctcagggtcatctcctgatagtaacaaacagcgcaagggacccgaggctttgggaaaggtctccctccctctgtttgatttcaaacgatttctgacctgcggaactaagctgctgtacctgtggacctcatcgcataccaactctgtcccaggcaccgtaaccaagaaaggctacgtcatggagcgcatcgtcctccaagtggactttcccagtcctgcctttgatatcatctacacaaccccccaagtcgacagaagtattatccagcagcacaatctcgaaactcttgagaacgacataaaaggcaagcttctggacatactccataaagacagctccctgggcctgtccaaagaggataaagcatttctgtgggaaaaaagatactactgcttcaagcacccaaattgtcttccaaagattctcgcgtctgcgccaaactggaaatgggtcaacctagcaaaaacgtactccctgctccaccagtggcccgcattatatccgctcatagccctcgagttgctggacagtaaattcgcagaccaggaggtccgatctctagctgtcacatggatcgaagccatctcagacgatgaactgactgatctgctgccccagtttgtacaggctctcaaatacgagatttacctgaactccagtttggttcagttcctgcttagccgagccctgggaaatatacagattgcgcacaatctgtactggctcttgaaggatgcccttcacgatgtccaattttctactcgctacgagcacgtgctgggcgctctgctgtccgtcggaggaaagaggcttcgagaggaactgctaaaacagactaaactggtgcaactgctgggaggggtagctgaaaaagtcaggcaggcatcagggagcgctcgccaggtggtgctgcagcgcagtatggagcgggttcaatcttttttccagaagaacaaatgtagactgcctctgaagccatccttggtggccaaagaactcaacatcaagtcatgctcttttttcagctccaatgccgtgcctctcaaggtcaccatggtgaacgccgatccgatgggagaggaaatcaatgtcatgtttaaggttggtgaggatctgcgacaagatatgctggccttacagatgataaagataatggacaagatctggctgaaggagggactggacctgaggatggtcattttcaaatgtctgagtaccggacgtgataggggaatggtggagttagtcccagcttcggatacactgagaaagatacaggttgagtatggcgttacagggtcattcaaggataagccgttagcggagtggttgaggaagtacaatccttctgaggaggaatacgaaaaggctagcgagaacttcatctacagttgtgccgggtgttgtgtggccacctatgtgctagggatatgcgatagacacaacgataacattatgctccgcagcaccgggcatatgtttcatattgactttggcaaatttctgggacacgcgcaaatgtttggaagctttaaacgcgatcgggcaccattcgttctgacttccgacatggcttatgtgataaacggtggcgaaaagccaacaatcagattccagctcttcgtcgacctgtgttgccaggcctataatctgattagaaagcagaccaatctgttcctgaatcttctgtccctgatgattccttctggcctgccagagctcaccagtattcaagacctaaaatacgttagggacgccctgcagccccagaccacggacgccgaagccacaatcttttttacgcgtcttatcgaaagcagtctgggctcgatcgccacgaagtttaatttctttatccataacctagctcaactccggtttagcggcttacctagcaacgacgaacccatcctaagcttcagtccgaagacatattcgtttcgacaagacggcaggataaaagaagtatccgtcttcacctatcataaaaaatataatccagacaagcattacatctatgtcgtacggatactgcgcgagggacagatcgaaccctcattcgtattcaggactttcgacgaatttcaggagctacacaacaagcttagtatcatcttccctctttggaagctgcctggcttccctaacaggatggtattgggccggacccacatcaaggatgtggccgcgaaaagaaaaatagagcttaactcctacctgcagagcctaatgaatgcatcaaccgatgtggctgaatgcgacctggtgtgcacattctttcaccccttgctgcgagatgaaaaggcagaggggattgcaaggtccgccgacgctggatcattttcccctactcccggccagattggcggcgcagtgaaactgtcaataagttacagaaatgggaccctctttattatggtgatgcacatcaaagatctcgtcacagaagacggagccgatcctaacccctatgtcaaaacttacctattgccagacaaccataagacaagtaagagaaaaacaaagatatcccggaaaacccggaatcccactttcaatgaaatgctagtgtatagcggctattcaaaggaaactctgagacaaagagagctgcagctgagcgtgctttcagccgagagccttcgagagaatttcttcctcggaggggttactctgccactgaaagattttaatcttagtaaggagaccgtcaaatggtaccagctaactgccgcaacatacctttag

SEQ ID NO: 16606 - DNA, 1947 bp, Artificial Sequence
  Description of Artificial Sequence: Synthetic coding sequence
atggcccagatctctagcaactcaggtttcaaagaatgccccagcagccacccagagcccaccagggcaaaagatgtggacaaggaagaggccctacagatggaggcggaagccctggcgaagctgcaaaaggaccggcaggtgaccgacaaccagcggggctttgagttgtcctcttcaacccggaagaaagctcaggtctacaacaaacaggactatgatctcatggtgttccccgaatccgacagtcagaaacgggctctggatattgacgtcgagaagctcacgcaggctgaattggagaagttactgctcgatgatagcttcgagacaaaaaagacgccagtgctccccgtcactcccattctctccccaagtttctccgcccaactgtacttcaggccaacaattcagcgaggccagtggccccctggtctgcccggtccttctacgtacgccctcccatctatttatccctcaacttatagcaagcaggcggcttttcagaatggctttaatccccgaatgccaaccttcccgtctacagagcctatctaccttagtctgcctggccagtccccatattttagttaccccctgaccccggccacacccttccaccctcaggggtccctgcctatctaccggcccgtagtgtccaccgatatggccaaactgtttgacaaaattgcctccacctccgagtttctcaagaatgggaaggcaaggaccgacctggaaataaccgatagtaaggtatctaatctccaggtctcaccgaagtctgaggacatctcaaagtttgactggctcgacctggaccccctgtccaaacctaaggtcgacaatgttgaggtgctggatcacgaggaagagaagaacgtgtccagcttgctggcaaaggacccgtgggatgcagtactactagaggaaagatctacagcaaactgtcacttggagcggaaggtcaacggcaagagcctgtccgtggctaccgtgacccgaagtcagagcctcaacattagaacgacccagctggccaaggcacaggggcacatctcacagaaggacccaaatggtaccagttccctgcctaccgggtcatctcttcttcaggaggtcgaggttcagaatgaggaaatggctgctttttgccggagcattacgaagcttaagaccaaattcccttacaccaatcatagaacaaaccctgggtatttacttagtcctgtaaccgcgcagaggaatatttgtggtgaaaatgcaagtgtgaaggtcagcatcgacatcgaggggttccagttgcctgttacatttacgtgcgatgtctcaagtacagtggaaattattattatgcaagcactttgctgggtgcatgacgatttgaatcaggtggatgtgggctcatatgtgctgaaagtctgtggccaggaagaagtgctgcagaacaatcattgtttaggaagtcacgaacacatccagaattgtcgtaaatgggacactgagattcgcctgcagctattgacattctccgcaatgtgccagaatctcgccaggacagccgaagatgacgagactccagtggaccttaataaacatctgtaccagattgagaaaccatgcaaggaggcaatgacaagacatcctgtggaagagctgctggacagctatcataaccaagtcgagctcgcactgcagattgaaaatcagcatcgggccgtggaccaggtgatcaaggctgtcagaaagatttgcagcgcccttgacggcgtagaaaccctcgccatcactgagagcgtgaaaaagctgaaaagggccgtcaatctaccgcgatccaaaaccgctgacgtcacatcgctttttggcggagaggacacttccagaagttctaccagagggtcgctgaacccagaaaatccggtgcaggttagcatcaaccagttgtag

SEQ ID NO: 16607 - DNA, 2664 bp, Artificial Sequence
  Description of Artificial Sequence: Synthetic coding sequence
atgggagaggccgagaaattccactacatttattcgtgcgatcttgatataaatgtacagctgaaaatcggttccctggaggggaaacgagagcagaagagctataaggcagttttggaagaccctatgttgaaattctctgggctctaccaggaaacatgcagcgacctctatgtcacctgccaggtcttcgctgaagggaaacctctggcccttcctgtgcgaacctcctataaagcgttcagcactcgctggaactggaacgagtggttaaaattacccgtcaaataccccgatctgccccggaatgcacaagtcgcactgacaatttgggacgtttacgggcctggaaaggccgttcccgtgggcggcaccactgtctcgctctttggcaaatatgggatgttcagacagggcatgcacgatctgaaagtgtggccgaacgtggaagccgatgggagcgagccgaccaagacccccggcagaacatcctctacactgtccgaggaccagatgagtagactggctaaactcactaaagcacaccggcaggggcacatggttaaagtagactggcttgacagattgacattccgcgagatcgaaatgattaatgaatccgaaaagaggtctagcaacttcatgtatttaatggtcgagttcaggtgtgtgaagtgcgacgacaaggagtacgggattgtgtactacgagaaggacggcgacgaatcctctccaatccttacatcctttgagctcgtaaaggttccagacccccagatgtcaatggaaaaccttgtggagtctaagcaccataagctcgctcggtcgctccgttccggtccatcagaccatgatctgaaaccaaacgccgcaaccagagaccagctcaacataattgtgtcctatcccccaacgaagcagctgacatatgaggaacaggatctggtgtggaaatttagatactacctcactaaccaggaaaaggccctgaccaagtttctcaaatgcgttaattgggatctcccacaggaggcaaagcaagctctcgagctgcttggtaaatggaagcctatggacgtcgaggacagcctggaactactcagttcccactacaccaatcctaccgtgcgaaggtacgccgtggccaggctgagacaggcggacgatgaagacctgttgatgtacctgctgcagttggtacaggcccttaagtatgagaatttcgatgacatcaaaaacggactagaacccacgaagaaagattcccagagcagcgtatctgagaacgtgagcaattcgggaatcaatagcgcagaaatcgattcatcccagatcattacctcacccctcccaagcgttagctctcccccaccagctagtaaaactaaagaggtgccagacggagaaaatctggaacaagacctatgtacctttctgatatctcgtgcctgtaagaatagcactttagctaattatctctattggtacgtaattgttgagtgtgaagatcaggacacacagcagagggatcccaaaacccacgagatgtacctgaacgttatgaggaggttcagtcaagctttgctgaagggcgataaaagtgtcagggtgatgagaagtcttctggctgcccagcaaaccttcgtggataggctcgttcacctgatgaaggctgtgcagagggagtcaggcaatagaaaaaaaaagaatgagaggctgcaggccctgctgggggacaatgaaaaaatgaatctcagtgacgttgagttaattcctcttcctctggaaccgcaggtaaagattaggggcattatccctgagactgcgacattgttcaaaagcgctctcatgccagcccagctgttcttcaaaacagaagacggcggcaagtacccagtaatcttcaaacacggggacgacctcaggcaagatcagttgatcttgcaaataatttcgctgatggataagctcctgcgaaaagaaaaccttgacctcaagcttaccccgtacaaggttctggcaacctctacgaagcacggtttcatgcagtttattcagagtgtccctgtggccgaagtgttagataccgaaggctccattcaaaacttctttcgtaagtacgctcccagcgaaaacggacctaatggcatctcagcagaggtgatggatacatacgtgaaatcgtgcgctggatattgtgtaatcacttacattctgggagtcggggaccgacatcttgacaatcttctgttgaccaagaccggcaaactgttccacatcgacttcgggtatattcttgggcgcgaccctaagcccttgcccccgccaatgaaactaaacaaagaaatggtcgaaggcatgggggggacccagtcagaacagtatcaagaatttcggaagcagtgctataccgcctttttacaccttagacggtattctaatctgatcctcaacctattcagtcttatggtggatgctaatattcctgacatcgcattagagcctgataagaccgtcaaaaaggttcaagataaatttcgcctggatttgagcgacgaagaagccgtacattacatgcagagccttatcgacgaaagcgttcatgctctgtttgccgctgtggtggaacagatccacaagttcgcacaatattggaggaaatag

SEQ ID NO: 16608 - DNA, 2475 bp, Artificial Sequence
  Description of Artificial Sequence: Synthetic coding sequence
atgggggaagctgaaaagttccactatatttactcatgcgacttggacataaacgttcagttaaaaatatggaatgagtggctgaaactgcctgttaaataccctgacctccctcgtaacgcgcaggtggcccttaccatctgggatgtgtatggtcctggaaaggctgttcccgtgggtggcactacggtttccctctttggaaaatatggcatgttccggcaaggaatgcatgaccttaaagtgtggcccaatgtggaagccgatgggtccgagcccaccaaaacccctggacggactagcagcacgttgtctgaagatcagatgtcacggcttgctaagcttacaaaggcacaccgacagggccacatggtgaaggtagactggctagaccgtctgacgttcagagaaatcgaaatgatcaacgagagtgaaaagaggtcctccaattttatgtatttgatggtggagtttcgttgcgttaaatgcgacgacaaggagtacggcattgtgtattacgaaaaagatggtgacgaaagcagccccatcttgacttcgtttgagctcgtgaaagtgcccgatcctcaaatgtcaatggaaaacctggtagaaagcaagcaccacaagctggctcgatcccttcggtctggcccaagtgatcatgacttgaaaccaaacgcagcaactagagatcagctgaatatcatcgtcagctatccccctaccaagcaactcacgtatgaggagcaagatctggtgtggaagttccgctattaccttaccaatcaagaaaaagccctgaccaagtttcttaagtgtgtcaactgggacctgcctcaagaggctaaacaggccctggaactcttaggcaagtggaagcccatggatgtcgaagacagccttgagctcctgtcttcccactataccaaccctaccgtccggcgatatgccgtcgcacggctccgccaagccgacgatgaggacctattgatgtatctgttacagttagtccaagcactcaaatacgagaacttcgatgacattaagaatggtctggagcccacaaagaaggactcacagtcgtctgtctccgagaatgtgtccaatagcggcatcaactcagccgagatcgatagttctcagatcatcaccagtccacttccctcggtctcatcccctcccccagcatctaaaaccaaagaggtgcctgacggggagaacttagaacaggatctgtgcacattcctcatatcccgagcctgcaagaactcgacgctggctaattacctgtactggtacgtcatcgtggagtgtgaggaccaggacacacagcagcgggaccctaagacccatgaaatgtacctgaatgtaatgcgcagattctcccaggctctattaaaaggagacaagagcgtccgagtcatgcgaagtctgctggcggcgcagcagacttttgtggaccgtctcgtgcacttgatgaaagccgtccagcgcgaatccgggaatcgaaagaaaaaaaacgagcggttacaggccctgctcggagacaacgaaaaaatgaatctgagcgacgtggagctcatccctctgccgctggagcctcaggtgaaaataagaggcattatccctgagacagcaacactcttcaagagcgctctaatgcctgcccagttgtttttcaaaacagaggacggggggaagtatcccgtgattttcaagcatggagacgatctacgccaggaccagttgatattgcagatcatatccctgatggacaaactattaaggaaggaaaatcttgatcttaaactcactccctacaaggtacttgctaccagcacaaagcacggctttatgcagttcattcagtcggtgccagtggccgaggtactggataccgaggggagcatacagaacttcttccggaaatatgctccatctgagaatggaccgaacggcattagtgccgaagtgatggatacgtacgtaaagagttgcgcaggctactgtgtgattacatatatcctcggggtgggcgatagacatctggataaccttctactcactaaaactggcaaactgtttcatattgacttcggttacatactgggtagggacccgaagcccctacccccacccatgaagttaaacaaagagatggtcgaggggatgggggggactcagtcagaacagtaccaagagttccggaagcagtgttacacagcattcttacacctacgccggtattccaacttgattctgaatctgttttccctaatggtggatgccaacattcctgacattgctttggagcccgataaaaccgtgaaaaaggtacaggacaaatttcgcctcgaccttagcgacgaagaagcggtccactatatgcagagccttatcgacgagtctgtgcatgcgctgtttgccgccgtcgtcgaacaaatccacaaattcgcccagtactggcggaagtag

SEQ ID NO: 16609 - DNA, 2175 bp, Artificial Sequence
  Description of Artificial Sequence: Synthetic coding sequence
atgagcgccgaggggtaccagtacagagcactttacgattacaaaaaagagcgagaggaagacatcgacctgcaccttggagatatattgactgttaacaaagggtctcttgtggctctgggcttcagtgacgggcaggaggctagacccgaggagataggctggttgaatggctacaatgaaacgaccggtgagcgtggagattttccaggaacttacgttgagtacattgggcgaaagaagatctcccctcctacaccgaagccgaggccccctaggccattgccggtggcccctggcagctctaagactgaagcagacgtcgaacagcaagctctgacactgccagatctggccgagcagtttgcgccaccagatatagcacctccactactgattaaactggtcgaagctattgagaaaaaaggcctggagtgctccaccctgtataggacacagtccagcagcaaccttgctgaactgcgtcaactcttggactgtgacactccaagcgtggatctggaaatgattgatgtccacgtgctggccgacgctttcaaacgatatttgctcgacttacctaatcccgttattcccgcagcagtgtactctgagatgatcagtttggctcccgaagtccaaagttccgaggagtacatacagctgctgaagaaactgatcaggtccccgagtataccccaccaatattggttgactctgcaatacttactgaagcatttttttaagctcagccagacttcaagcaagaatctcttgaacgcccgagtcctttctgagatttttagccccatgttatttcggttctcagctgcctcttcagacaataccgagaatttaataaaggtgatagagatcttaataagcaccgaatggaatgaacgacaacctgctcccgcccttccaccaaaacctcccaagcccactactgtcgcaaacaacgggatgaataataacatgagcctgcaagatgcagaatggtattggggagacatcagtcgggaagaggtgaacgagaagctgcgggacaccgctgacgggacctttttggtgcgtgacgcctctacgaaaatgcacggagattatacactcacattacggaaaggtgggaacaacaaactgattaagattttccaccgggatggcaaatatggattctccgatccattaacattcagcagcgtcgtcgagcttattaatcactatagaaacgagtctctggcccagtacaacccaaagcttgatgttaaactcttataccccgtctccaagtaccagcaggatcaggtggtgaaagaggataacattgaggcggttggtaaaaaactgcacgagtacaatacgcaatttcaggagaagtcccgggaatatgacaggctctatgaggaatacacacgcacgtctcaagaaatccagatgaagcggactgccattgaagccttcaacgagactattaaaatttttgaggagcagtgccagactcaagagcggtatagtaaagagtacatcgagaagttcaaacgcgaaggcaacgagaaggaaattcagcggatcatgcacaattacgacaaactgaagtcaagaatttctgaaattatagatagccggcggcgtttggaagaggaccttaaaaaacaggccgcagaatacagagagatcgacaaacgtatgaacagtattaagcccgacctcattcagttgaggaagacgagggatcagtacctcatgtggctgacccaaaagggggtgaggcaaaaaaaactgaatgagtggctaggcaacgaaaataccgaggaccagtattctctggtggaggacgacgaggacttaccccaccacgatgagaagacttggaacgtgggctcttctaaccgcaataaggccgagaacctgcttagaggcaagcgagacggtacattcctggtccgggaatcgtcaaagcaaggctgctatgcatgctctgtcgtggttgatggagaagttaagcactgtgtgataaacaaaacagccaccgggtacggctttgcagagccctataatctgtacagctcgctcaaggaacttgtgttgcactaccagcatacctctttggtgcaacacaacgatagccttaacgtgacactggcgtaccccgtctacgcacagcagcgtaggtag

SEQ ID NO: 16610 - DNA, 1275 bp, Artificial Sequence
  Description of Artificial Sequence: Synthetic coding sequence
atgcacaacctgcagacacttccacccaagccacctaaaccaacgactgtcgccaataatggcatgaataataatatgagcctgcaggatgccgagtggtattggggcgatatcagccgggaggaggtgaatgaaaaactgcgggataccgccgacggcaccttcctagtcagggacgccagcactaagatgcacggggactataccttgaccctgcggaagggagggaataacaaattaatcaaaatattccatcgtgacggtaagtacgggttcagtgaccccctgaccttctcctccgtggtcgaacttatcaatcactaccggaacgaatcgctggcccaatacaatccaaagctggatgtgaaattgctctaccccgtgtccaaataccaacaggatcaggtcgtgaaagaggataatatcgaggccgttggtaagaagctgcatgagtataatacacagttccaggagaaatcgcgggagtacgaccggctgtacgaggagtacacacgtacgtcccaagagattcagatgaagcgcactgctattgaagcattcaatgaaacgattaagatttttgaggaacagtgtcagacacaagagcggtactccaaggaatacatcgagaagtttaagagagagggaaatgagaaagagatccagcgcatcatgcataactatgacaaactgaagagtaggatttcagagatcatcgactcaagacggcgcctcgaagaggatcttaaaaagcaggcagctgagtatcgcgaaattgacaagcggatgaatagcatcaagccagacctcatccagctccgtaagacccgggatcaatacctcatgtggctgacccaaaagggcgttcgccaaaaaaaactgaacgaatggctcggcaacgagaatacagaggatcaatacagtcttgttgaggatgatgaggaccttcctcaccacgatgagaaaacctggaacgtgggatcgtctaatcgcaataaagccgaaaatttgttgcgcgggaaaagggatggcacattcctggtgcgggagtcgtcaaaacaggggtgctacgcatgtagtgtcgtggtcgatggcgaggtgaagcattgtgtgatcaataaaacagctaccggatatggctttgccgaaccctataatttgtactcttcccttaaagaacttgtgctccattaccagcatacttcccttgtgcagcacaatgacagccttaatgttaccttggcctaccctgtgtacgcccagcagcgtcgctag

SEQ ID NO: 16611 - DNA, 1365 bp, Artificial Sequence
  Description of Artificial Sequence: Synthetic coding sequence
atgtataatactgtatggaacatggaagacttggatctggaatacgcgaaaacagacataaactgcggcaccgacctgatgttctatattgaaatggatccacctgcccttccgccaaaacccccaaagcctactactgtggcaaacaacggaatgaacaacaacatgtcattgcaggatgctgagtggtactggggcgacataagtagagaggaagtaaacgaaaagctccgagacacagcagacgggacatttcttgtgcgcgacgcctccactaagatgcacggggattacaccctaactctgcggaagggtggcaacaacaagttgataaagatttttcatcgtgacgggaaatatggctttagcgatccacttacattttcctcagtggtcgaactgattaatcattataggaatgaatcactggctcaatacaatcccaagttggatgtgaaattgctctatcctgtctctaaatatcagcaagaccaggtcgtcaaggaggataacatagaagccgtaggcaaaaagctccacgagtataacacccagttccaggagaaatccagggagtacgacagactctacgaagagtacactcgcacttctcaagaaatccagatgaaacgaactgcaattgaagccttcaacgaaacaatcaagatcttcgaagaacagtgccaaacacaggaacgctatagcaaggagtatatcgaaaaatttaaaagagagggaaacgagaaggagatccagcggatcatgcataattacgacaagctcaaatcaagaatcagcgagatcatcgacagcagacggaggctggaggaggacctcaaaaaacaagccgccgagtaccgggaaatagacaaaagaatgaactcaatcaagccagacttaatccagttgcgaaaaacaagagatcagtatctaatgtggttaactcagaagggggtccggcagaaaaagctgaacgagtggctcggtaatgaaaatacagaagatcagtacagccttgtagaagatgacgaggatctcccccaccatgacgagaaaacatggaacgtgggttctagcaacaggaataaggctgagaacctccttcgcggcaagcgggatggaacttttcttgttcgagagagttccaagcagggctgttatgcatgttcagttgtcgtggatggcgaagtaaagcattgtgtcattaacaagactgcaactggctacggatttgcagaaccctataacctatatagctccttgaaggagcttgtgctacattaccagcacacctcactggtgcagcacaacgattctcttaacgtgactctcgcatatcctgtttacgcccagcagcgcagatag

SEQ ID NO: 16612 - DNA, 2199 bp, Artificial Sequence
  Description of Artificial Sequence: Synthetic coding sequence
atgtccgccgaaggataccaatacagagccctctatgattataaaaaagagcgggaggaagatatcgatctgcacctgggtgatatcctcaccgttaacaaggggagcctagtggccctcggattttctgacgggcaggaggccagacccgaggagattggatggctcaacggttataatgagactacaggggagaggggtgacttccctggcacatacgtggagtacatagggcggaagaagataagcccccctactcccaagccccgaccgcctcggccactgcccgtggcaccggggagcagcaagaccgaggcggatgtcgaacaacaagcgcttacactccctgacttagcagaacagtttgcccccccagatatcgcccctcctctactgataaagctcgtcgaggccatcgagaaaaagggcttggaatgctcaacattgtataggacacagtcgtctagcaacctcgccgagttaagacagctgctggactgcgacactccctctgttgatttagagatgatcgatgtgcacgttctggccgatgcttttaaacgttatcttctcgatttacctaacccagtcataccagctgcggtgtactcggaaatgatcagcctcgcgccggaagtccagtcatctgaagaatacatccagctgctgaagaaactgatccgtagtccgtctatcccacaccaatattggctgaccctacagtacctgctcaaacatttttttaaactcagtcagacctcatccaagaacctgctgaacgctagggtgctgtctgagattttctcacctatgttatttagattctccgccgcctcaagtgataatacagagaatctgataaaggtgattgaaatcctcataagcacagagtggaacgagaggcagccagcacctgcacttccaccaaagccccctaagccaactactgtggctaataacggtatgaataataacatgagcctgcaggatgccgaatggtattggggcgatatttccagagaggaagtgaatgaaaagctgagggacacggccgatggcacgttcctggtccgggacgccagtacaaagatgcatggcgattacaccttgactttgcgaaagggcgggaacaacaaactgatcaagatctttcatcgtgatggcaagtatggatttagtgatcccttgacattctccagcgtggtggagctcattaatcactatcgaaacgagtccctcgcacagtacaaccccaagcttgacgtgaagttgctctatcccgtcagcaaataccagcaggaccaggttgtcaaggaggacaacatagaggccgtaggaaagaagctgcacgaatacaatactcagttccaagaaaagtcacgagagtatgaccggctgtacgaagagtacactagaaccagccaagagatccagatgaaaaggaccgccatagaggcattcaacgagacaataaagatattcgaggagcaatgccaaacacaggaaaggtactccaaagaatacatcgaaaagttcaaaagggaggggaacgaaaaagagatccaacgcatcatgcacaactacgataaactcaagtcacgaatttccgagattatcgatagcagacgacgtctggaagaggatttaaagaaacaggccgcagaataccgggagatcgataagcgcatgaattcgattaaacccgacttgatacagctgcgaaagacacgcgaccagtaccttatgtggctaacacagaaaggagttcgccaaaaaaagttgaatgaatggttgggtaacgagaataccgaggagaacttccttagttgcctaccatctcaatatagcctggtcgaggacgacgaggatttgcctcatcacgacgagaagacgtggaatgtcggatccagtaatcgaaataaagctgagaaccttcttagggggaagagggacggaacatttctcgtaagggagtctagtaaacaggggtgttacgcttgctctgtcgtggtcgatggagaagtaaaacactgcgtgatcaacaaaacagcaaccggatatgggttcgccgagccatacaacctgtatagttctttaaaggagctcgttttgcattaccagcacacttctcttgttcagcataacgattcactgaatgttaccctggcctaccccgtctacgcccagcagcgtcggtag

SEQ ID NO: 16613 - DNA, 2175 bp, Artificial Sequence
  Description of Artificial Sequence: Synthetic coding sequence
atgagtgctgagggctatcaataccgcgcgctgtacgactacaagaaggaacgagaggaggatattgatctgcacctgggggacattctcacagtcaacaaaggaagtctggttgctctggggttttctgatggtcaggaagcacgcccggaagagataggatggctgaacggctacaacgagactactggagagcgaggtgacttccccgggacttacgtcgagtacattggaagaaagaagatctctccgccaacaccgaagcctcgacctcctaggccactccctgttgcacccggatcctctaagactgaagccgacgtcgagcagcaggcactgaccctcccggacttggcggaacagtttgccccacccgacattgctcccccattgctcatcaagttggtcgaagccattgaaaagaaggggttggaatgcagcacactctacaggacacagtctagtagcaacctggccgaactgcggcaacttttggactgcgacacaccttccgtggatctagaaatgattgacgttcacgtcctggcagacgcatttaaacgctacctcctcgatctgccaaatccagtgatcccagctgctgtgtattccgaaatgatttcccttgcacccgaggtgcaatcgagtgaggagtacattcagctgcttaaaaagctgatccgatctccatcgatcccccaccaatattggcttacactccaatatctcctcaaacattttttcaagctgtctcagactagcagcaagaatctgttgaacgcacgagtgttatcagaaatcttttcccccatgctctttaggttctccgcagcaagctctgacaacacagagaatctcatcaaggttatcgagatcttgatctcaacagagtggaatgagagacagcccgcgcctgctctgccacccaaaccacctaagcccacaacggtcgctaataacgggatgaacaataatatgtccttgcaagacgccgagtggtactggggggacatctccagagaagaggtcaacgagaagcttcgggatacagccgatggcaccttcctggtgagagacgctagcacaaagatgcatggagactatacactcacccttcggaagggtgggaacaataagcttatcaagatatttcatcgagatggcaaatacgggtttagcgatcctctaaccttttcaagtgtggtggagttaataaatcattatcgcaacgagtccctggcccaatacaatccaaagctcgatgtgaaactcctatatccagtctcaaagtatcagcaggatcaggtggtcaaggaggacaacatcgaggccgtgggcaagaaacttcacgaatataacacgcagttccaggagaagtccagagaatatgacagactctatgaggagtatacacgaaccagtcaggagatccaaatgaaacgtacggcaattgaggcatttaatgagacgataaaaatttttgaggagcagtgccagacgcaagagcgttacagcaaagagtacattgaaaagtttaaacgcgagggcaatgagaaggaaattcagagaataatgcacaactacgacaagttgaagtcccggatatccgaaattatcgactccaggagacggttagaagaggacttgaagaagcaggctgcagagtatcgagaaattgacaaacgaatgaatagcattaagccggacttaatccagctgaggaaaacacgggaccaatatctcatgtggctaacccagaagggggttcgtcagaagaagctgaatgagtggcttggcaacgaaaataccgaagatcagtatagcttggtggaggacgacgaagacttgcctcatcacgacgaaaaaacctggaacgtggggtcttcaaatcgaaataaagcggaaaacctcctgcggggtaagcgcgatggcacgttcctggttcgggagagctctaagcagggctgctacgcgtgcagcgtagtggtggacggagaagtcaagcattgtgtgatcaacaaaaccgcaaccgggtacggattcgcggaaccctataatctttacagttcgctcaaggagctggtcctccattatcagcatacatctttagttcagcataatgattcccttaacgtgacgttggcctacccagtttatgcccaacagagacgatag

SEQ ID NO: 16614 - DNA, 414 bp, Artificial Sequence
  Description of Artificial Sequence: Synthetic coding sequence
atgcacggggattatacactgactctgcgaaaaggtgggaataataaactaatcaaaatttttcacagagacgggaaatatggcttctccgatccactgacattcagttctgttgtggaactgatcaatcattatagaaacgaatctcttgctcagtacaacccaaaactggatgtaaaactgctatatcctgtatctaagtaccagcaggaccaggtggttaaagaagataatatcgaagcagtgggaaagaaacttcatgaatacaacacccagttccaggaaaagagtcgagaatacgaccggctttatgaggaatataccaggacatcccaggaaatccagatgaaacgaacggcgatcgaagcctttaacgaaaccatcaagatctttgaggagcagtgtcagacatag

SEQ ID NO: 16615 - DNA, 2175 bp, Artificial Sequence
  Description of Artificial Sequence: Synthetic coding sequence
atgtctgccgagggctaccagtatcgagccctgtacgactataagaaagaaagagaggaggacattgatttgcatctgggtgacatcctcacggttaacaaggggtccttggtggccttaggcttctccgacggccaggaagcacggccagaagagattgggtggttaaacggttataacgaaacaaccggcgagcgtggcgattttccaggtacttacgtggaatatattggacgaaagaagatctctcccccaacacccaagccaaggccccctaggcccttgcccgtcgcacctggttctagtaaaacagaagccgatgtcgagcagcaggccctgaccctgcctgacctcgcggaacaatttgccccccccgacattgccccacctctgctaattaaactggtggaggcaatcgagaagaagggactcgagtgtagcaccctgtatcggacccaaagttcctcaaatctggcagaattgagacagctgctggactgtgacacacctagcgtggatctggagatgatagatgtgcacgtgttggccgatgcgttcaagaggtacctgctcgaccttcctaatccagtaattcctgccgctgtgtattccgaaatgatctctttggcgcccgaggttcagagctctgaggagtacatccagctgctgaaaaaactgatccgatctccgagtattccccaccagtactggctaacactgcagtacctgctgaaacatttctttaagctgagtcagactagctcaaaaaacctgctgaacgcccgcgtgctgagtgagatctttagtcccatgctgtttcgcttctcggctgcctcttccgacaacaccgagaacctgatcaaggtaattgaaattttgatctccaccgagtggaacgaacggcagcccgcccccgcgctgccgcccaagccaccaaagcctactactgtggccaacaacggaatgaacaacaatatgtccctgcaggacgcggagtggtactggggcgacatttctcgagaagaggtgaacgaaaaactgcgcgatacggctgacggtacttttcttgtgagagatgccagcaccaagatgcacggcgattatactttgactctgcgaaagggcggaaacaacaagctgataaagatctttcatcgtgatggaaagtatggattctcagaccccctcacattcagcagtgtagtggagctaatcaaccattatagaaacgagagcctcgcccaatataacccaaagctagatgtgaagctcctctatcctgtatccaagtaccagcaggatcaggtcgtgaaggaagataacatcgaggctgtgggaaagaaactccatgaatacaatacacagttccaagaaaaatcacgcgagtatgacaggctttacgaggagtatacacgaacctcccaggagatccagatgaagcggacagccatcgaggcctttaacgagaccatcaagatctttgaggagcagtgtcagactcaggagagatactccaaggaatatatcgagaaattcaagagagaggggaatgagaaggagattcagaggatcatgcataattacgataaactcaagtcccgcatttcagagatcatcgactcacggagacgtctggaggaagacctgaagaagcaggccgccgagtacagagaaatcgacaagaggatgaatagcatcaagccggatctcattcaactgaggaagaccagagaccagtacctgatgtggctcacccagaaaggagtccgacagaagaagctcaacgagtggttgggcaacgagaacaccgaagaccagtattctctagtggaggatgacgaggatctcccgcatcacgacgagaaaacctggaatgtcggaagttccaaccgaaacaaggccgagaatttgcttcgggggaagagggacgggaccttcctggtcagggagagttcaaagcaaggatgctatgcctgctcggttgttgttgatggcgaggttaagcattgcgtgattaacaaaacagccactgggtacggtttcgcagagccttacaacctgtactccagccttaaagaactggtactgcattatcaacacacttccctggtccagcacaacgatagtcttaatgtcactctggcatatcctgtttacgcgcagcaacgaagatag

SEQ ID NO: 16616 - DNA, 1224 bp, Artificial Sequence
  Description of Artificial Sequence: Synthetic coding sequence
atgctattcgataaagtgaaggcattctcagtccaactggatggggccaccgccggagtggagccagttttctccggtggtcaggctgttgctgggcgagtgttgcttgaactctcaagcgccgctcgcgttggcgcactgaggctgcgtgccagggggagggcgcacgtgcactggacagagagcaggagtgccggcagctcaacagcatatacccagtcatacagtgaaagggtcgaagtggtcagtcaccgcgccacgctgctggctccagatacaggtgagacgaccactctgccacccgggcgacatgagtttttattctctttccagctcccgccaactctcgtcacctcttttgaggggaaacatggatccgtcaggtactgtatcaaggccacgttgcacagaccctgggtaccagcgcggcgggcgaggaaggtgttcaccgttatagaacccgtggacattaatacccccgccctgcttgctcctcaggctggcgctagggagaaagttgcaaggagctggtattgtaataggggcctagtgtccctttccgccaagatcgaccggaagggctatacccctggagaggtgatccccgttttcgctgaaatcgacaacggatccactagacctgtacttccgcgtgctgctgtggtgcagacccagacgttcatggcacgcggcgcccgaaaacagaagagggcggtagttgcctcactagccggagaaccagttgggcccggtcaaagggcactgtggcagggacgagctctgcggatcccccccgtagggccctccatcctgcactgtcgtgtattacacgtcgattacgcgctaaaggtgtgcgtcgacattcctgggacctcaaaactgctcctcgagcttcccctggtgattggaactataccacttcacccatttggtagccgttcgtctagtgtgggcagccacgccagcttcttgctggattggagactgggtgcgttgccagaacgccctgaggcaccacccgaatactcagaggttgtggcagataccgaggaagccgctctggggcagagcccgtttccactgccccaggatccagatatgtcgctagaaggccctttttttgcgtatatccaggagtttcgataccggccacctccattgtatagcgaagaggacccaaaccctctgctaggggacatgcgaccccggtgcatgacctgttag

SEQ ID NO: 16617 - DNA, 1386 bp, Artificial Sequence
  Description of Artificial Sequence: Synthetic coding sequence
atgtacaatactgtgtggtccatggatagagatgatgcagattggcgagaagtgatgatgccatattcaaccgagctgattttttacatagaaatggatccccccgctctcccgcctaaaccgcccaagcccatgacttcagccgtgcccaatggtatgaaggattctagcgtttccctgcaggacgccgaatggtattggggagatatttcacgggaggaagtcaatgataagctgagagatatgcctgacgggactttcctggtaagggacgcgtcgacaaaaatgcaaggagattatacattgaccttgaggaaaggcggcaataataagctgattaaaatctatcaccgagacggaaagtacggtttctctgatcccctaactttcaattccgtggtcgagcttatcaatcactaccatcatgagtcattggcgcagtacaaccctaaattagatgtgaaactaatgtatcctgttagtcggtaccaacaagaccagctcgtgaaggaagacaacattgacgctgtcgggaaaaagctgcaggaataccattcccagtaccaggagaaaagtaaagaatacgaccgactctatgaggagtatacaagaactagccaggagatccagatgaaacggacagctattgaagcatttaatgaaactattaaaatttttgaggagcaatgccacacgcaggaacagcattccaaagagtatatcgagcggttccgccgcgagggcaatgagaaggaaattgagcggatcatgatgaactatgacaagttgaaatcacgcttaggcgagatccacgactctaagatgcggcttgagcaagatttaaagaaccaggcactcgacaatagggaaattgataagaagatgaatagtattaagcctgacttgatccagctgcgcaaaattcgtgaccaacatctagtttggctgaaccacaagggcgtacgacaaaagcgcttgaatgtttggctggggattaaaaatgaggacgccgatgagaattactttatcaacgaagaagacgaaaatctgcctcactacgacgagaaaacatggtttgttgaggatatcaaccgggtgcaggcagaggacctcctgtatgggaagcctgacggggcttttcttatccgagaatcctcaaagaagggatgctatgcctgctcagtggtagccgacggtgaggtcaagcattgcgtgatatattctacagctcgaggatacggtttcgctgagccctacaacctttactcatcacttaaagagctagtgctgcactaccaacagactagtctcgtgcaacacaacgactctttgaacgttcgcctcgcataccccgttcacgctcagatgccatcattatgccgatag

SEQ ID NO: 16618 - DNA, 1101 bp, Artificial Sequence
  Description of Artificial Sequence: Synthetic coding sequence
atgtacaacaccgtctggtctatggaccgggatgatgcagattggagagaagtgatgatgccgtactcaactgaattgattttctatatcgaaatggaccccccagcagcagaagtgaatgacaagctgcgggatatgcccgacgggacattcctggtcagagacgcatcaacaaagatgcagggggactatacactaacactgagaaaggggggtaacaacaaactcatcaaaatctatcaccgcgacgggaaatatggcttttctgatcctctgacgttcaactccgtggtcgaattaatcaaccactaccatcatgagagcctggctcagtataaccccaagctggacgtcaagttgatgtaccctgtttcacggtaccagcaggaccagctcgtcaaggaagataacattgacgctgtgggaaagaagcttcaggagtaccattcacaataccaggaaaaatccaaagaatacgaccggttatacgaggaatacacacggacatctcaggagattcagatgaagagaaccgccatcgaagcgtttaatgaaacgattaagatctttgaggagcaatgccatacacaggagcagcacagcaaagaatatatcgagcgatttagaagagaggggaatgaaaaggagatcgaacggtggttgaaccacaagggagtgcggcagaaaaggttaaatgtgtggctgggcattaaaaacgaggacgcagatgagaactacttcatcaatgaagaggatgaaaacctgccacactacgacgaaaaaacatggttcgtcgaagatataaaccgagtgcaagccgaagacctcctgtatggtaagccggatggcgcattcctgattagggagtcttctaaaaagggctgctatgcctgctcggtcgtagctgacggcgaggtgaagcactgcgttatttattccaccgctcgaggatacggttttgccgagccctataacctgtactcaagcctaaaagagcttgtcttgcattatcagcagacctctctcgtgcagcacaatgattccctcaatgtgaggttagcttatccagtacacgctcaaatgccctcactttgtagatag

SEQ ID NO: 16619 - DNA, 1209 bp, Artificial Sequence
  Description of Artificial Sequence: Synthetic coding sequence
atgtataatacagtttggagcatggatcgggacgatgccgactggagggaagtcatgatgccatactccactgagcttatattttatatcgagatggatccaccagccctgccaccaaaacctccgaaaccaatgacttccgctgtacctaacggaatgaaggatagttctgtttcactgcaagacgcagagtggtattggggggacatttcaagagaggaggtgaatgacaaacttcgtgatatgccagacggaactttcttggttagggatgccagcacgaagatgcagggagattacacgctgacccttcggaaggggggtaataacaaactcatcaagatctaccatcgtgatggcaaatacggcttctccgatcccttgacttttaactcagtggtggagctgatcaatcattatcaccatgagtcactggcacagtataatcccaagctagacgtgaagctgatgtaccctgtctcgagataccaacaggaccagctcgtaaaggaggataacatcgacgctgtcggaaaaaagctgcaggaataccattcacagtatcaggagaaaagtaaagagtacgaccggctctatgaggagtatacaaggacaagtcaagagatccagatgaaaagaacggccatcgaggcattcaacgagacaatcaagatattcgaggaacaatgccatacccaagagcagcattccaaagagtacatcgagaggttccgcagagagggaaatgaaaaggagatcgagcggtggctgaaccacaaaggtgttcgacagaaaagactaaatgtgtggctcggaatcaaaaatgaggacgctgacgagaactatttcatcaacgaggaagatgagaatctgccccattacgacgaaaaaacctggttcgtggaagatatcaaccgggtgcaggccgaggatctcttatatggtaagccggacggggcctttctgattagagagtcgtcaaaaaagggatgctatgcctgttctgtcgtggctgatggcgaggtaaagcattgcgtgatctacagcactgcacgcggttatgggtttgcagagccgtacaacctgtacagctcactaaaagaattggttttgcattatcagcaaacatccctcgtgcagcacaacgacagcctaaatgtccgtctcgcctatcctgttcacgctcagatgcctagcttatgtcgctag

SEQ ID NO: 16620 - DNA, 1386 bp, Artificial Sequence
  Description of Artificial Sequence: Synthetic coding sequence
atgtacaacaccgtttggagcatggatagggacgacgccgactggcgcgaggttatgatgccttactccacagagctgatattctatatagaaatggatcctcctgctctgccaccaaagccccctaagccgatgacatctgccgtgcccaacgggatgaaggacagtagcgtctcgctgcaggacgcagagtggtactggggagatatttcccgagaagaggtgaatgacaagttgcgcgatatgcctgatgggacttttttggttagagatgccagtactaaaatgcagggcgactacaccctgacattacggaaggggggcaacaataagctcatcaagatttaccacagagatgggaaatacggcttctccgaccctcttacttttaacagcgtagtggagttaattaatcactatcatcacgaaagcttggcccagtataaccctaagctggacgtcaagctgatgtaccctgtgagccgatatcagcaggatcagttggtaaaggaggataacattgacgccgtgggtaagaagctccaagagtaccactctcaataccaggaaaagtcgaaagagtatgacaggctgtacgaggagtatactcgtacctcgcaggagatccagatgaaacggacagccatagaagcatttaacgaaacaatcaagatttttgaggaacaatgtcatacccaggaacagcattcaaaagagtacattgagcgttttaggcgcgagggaaatgagaaagaaatagaaagaattatgatgaactatgataagctgaagagcaggcttggcgaaatacatgactcaaaaatgaggctggaacaagacttgaaaaaccaggccctggacaatagggagattgacaagaagatgaattctattaagcctgacctcatacagctaaggaagattcgcgaccagcatctcgtgtggcttaatcataaaggagttcggcagaaaagactgaatgtgtggctaggaattaagaacgaggacgccgatgagaattacttcatcaatgaggaggacgaaaacttgccccactatgatgagaagacatggttcgtggaggatatcaaccgagtgcaggccgaagacctgttgtacggaaagccagatggggcctttctgataagggaaagcagtaaaaagggctgttacgcttgctctgtggtggctgacggcgaggttaagcactgcgtcatctactcaacagcccgaggctatggcttcgccgagccttataatctgtactcctccctcaaagagctggtcctgcattaccagcagacctctctcgtgcagcataacgactcattgaacgtacgtctggcatacccagtgcatgctcagatgccttccctctgcaggtag

SEQ ID NO: 16621 - DNA, 1386 bp, Artificial Sequence
  Description of Artificial Sequence: Synthetic coding sequence
atgtataacacagtgtggagtatggaccgggatgatgcggactggcgcgaagtgatgatgccttattccaccgagttgatattctacattgaaatggatccaccagctctgccacctaagccacccaagcctatgacctccgcggtgcccaacgggatgaaggattccagtgtatcccttcaggatgccgagtggtactggggagatatcagtagggaggaagtcaatgataaactacgcgatatgcccgacgggactttcctggtgagggacgcgtctacaaagatgcagggagattacaccttaactctgaggaagggcggtaataacaagttaattaaaatttatcatcgcgacggaaagtatgggtttagcgacccactcactttcaacagtgtggtggagctgatcaaccattatcatcacgaatcattggcccagtacaaccctaaactggacgtgaaactaatgtatccagtctcccggtaccagcaggaccagctggtgaaggaagacaatatagatgcggtaggtaagaaattgcaggaatatcactcccagtaccaggagaaatctaaggagtatgaccggctgtatgaagagtatacccgtacatcacaggagattcaaatgaaacgcactgccatagaggctttcaacgagaccattaagatttttgaggaacagtgtcacacacaagagcagcatagtaaagaatacatcgagaggttcaggcgggaaggtaacgagaaggaaatagagcggatcatgatgaattatgacaagctgaaatcccgcctgggagagattcacgactccaagatgcggctggagcaggacctgaaaaatcaggccctggacaatcgggaaatagacaaaaagatgaactctattaagccagatctgattcagctccggaaaatccgggatcagcatctcgtgtggctgaaccacaagggcgttaggcagaagcgcctgaatgtgtggttgggcatcaagaacgaggatgccgatgaaaactactttattaatgaggaggacgagaatctaccgcactatgacgagaagacctggtttgtggaggatattaatagagttcaagccgaagacctcttgtacggcaagcctgacggcgctttcctaatccgggaatcgtccaagaaagggtgttatgcttgctcagtcgtcgccgatggtgaggtcaagcactgtgttatttattctacagctcgaggctacggattcgctgaaccttacaacctgtatagttccctgaaagaattagtcctgcattaccagcagacctccctagtgcaacataacgacagtctgaatgtccgactcgcctacccggtccacgcgcaaatgcctagcctttgcagatag

SEQ ID NO: 16622 - DNA, 1209 bp, Artificial Sequence
  Description of Artificial Sequence: Synthetic coding sequence
atgtacaacactgtctggagcatggaccgagatgatgccgattggagggaagttatgatgccttacagcacagaactcatattctacatcgagatggatccgccagccctgccccccaaacctcctaaacccatgaccagcgccgttcccaacggaatgaaggactctagtgtgtcattacaggacgctgaatggtattggggagacataagtcgtgaagaagtcaacgacaaactgagggacatgcctgatggcacattcctcgtccgtgacgccagtactaagatgcagggtgactacaccctaaccctacgtaagggtgggaataataagttaatcaagatctaccatcgggatgggaaatatggattctctgacccactgacctttaattccgtggtcgagctaattaaccattaccatcacgagtctctcgctcaatataacccaaagctggacgttaaactcatgtatccggtatccaggtaccagcaggaccagctggtgaaggaagacaatatcgatgcagtcggtaaaaagcttcaggagtaccactcccagtatcaagagaagtcaaaggaatacgaccggctatatgaagagtacactcgcaccagccaagaaatccagatgaagcggactgccatcgaggcttttaacgagactatcaagatatttgaggaacagtgccatacacaggaacagcactccaaggagtacatcgaaaggttccgccgcgaaggcaacgaaaaagagatcgagaggtggctgaaccataaaggagtgaggcagaaaagacttaatgtgtggcttggaatcaaaaatgaggacgcggacgagaactatttcatcaacgaggaagatgaaaatttgcctcattatgatgaaaaaacatggtttgtggaggatatcaatagggtccaagccgaagatttgctctacggaaagcctgatggagccttcctgatacgggagtcatctaagaagggctgttacgcatgttcggtggttgccgacggagaagtaaaacactgcgtcatctactcgactgccaggggatacgggttcgctgaaccttacaacttgtattctagcctgaaagaactggtgctgcattaccaacaaacctccttggtgcagcacaatgattccttaaacgtgaggcttgcatacccggtccatgcacagatgccaagtctgtgtaggtag

SEQ ID NO: 16623 - DNA, 621 bp, Artificial Sequence
  Description of Artificial Sequence: Synthetic coding sequence
atgtacaataccgtctggtcaatggatcgagacgacgccgactggcgtgaagttatgatgccctatagtacagaactgatcttttacatcgaaatggacccgcccgctcttccacctaaacctcccaaacccatgacaagcgccgtgccaaacgggatgaaggactcttcagtgtcgctccaagatgcggagtggtattggggcgacatcagccgagaggaggttaacgacaagctgcgagatatgccggacggcacgttcttggttcgcgacgcgtctaccaagatgcagggcgactatactctgactctgcggaaaggagggaataacaagcttatcaagatatatcatagggatggcaaatacggtttctccgaccctctgacattcaacagtgtggtggagctcataaaccactaccatcacgaatcactggctcagtacaatcctaagctggatgttaaactgatgtaccctgtatcacgatatcagcaggaccagctggtaaaggaggacaatatagacgctgtgggcaaaaaacttcaggagtatcactcacaataccaggagaagtctaaggaatatgatcgcctctacgaagagtacactagaacaagctag

SEQ ID NO: 16624 - DNA, 1524 bp, Artificial Sequence
  Description of Artificial Sequence: Synthetic coding sequence
atgggaccaagccggttagtgagaggacccaggccccagggcatgcgctcgccctaccggcggccaggcatgggctggcccagacctagatttcctcgcatgttcaagtgctctcggcggaggtaccagcagggactcagggggcgaacggcctccagtgccgctattaacccagcaacaagggccatggggattaacaacactcacaccgatacaaccattgtctggatttttcctccccaggccctgccccctaagcctcccaagcccatgacctctgcagtcccaaacgggatgaaagacagttctgtcagcctgcaggacgcggagtggtactggggcgatattagccgcgaagaggttaacgacaaactccgagacatgcctgacggaacctttctggttagagatgcctccacaaagatgcagggagattacacacttacgcttcgcaaaggcggcaataacaagctgatcaagatctaccatcgggacgggaagtacggcttttcggatccactgacatttaattctgtggtggaactcataaatcattaccaccacgaatcactggcacagtacaaccctaagcttgatgtgaagctcatgtaccccgtgtcccgttaccagcaagaccagttagtgaaggaagataatattgacgctgtggggaaaaagttacaagaataccatagccagtatcaggagaagtcgaaagaatacgatcggctgtacgaagagtatacaagaacaagccaggagatccagatgaaacggaccgctatcgaggccttcaacgaaaccattaaaatcttcgaggaacaatgtcatactcaagaacaacactcgaaggaatatatcgagcgatttcgaagggaaggcaatgagaaggagattgagcgtataatgatgaattacgataagctaaagtcgaggcttggcgagattcacgattccaagatgcgcttagagcaggatctgaagaaccaggccctggacaaccgggaaatcgacaagaagatgaactcgatcaagcccgatttgatccaactgcggaaaatccgcgatcagcaccttgtgtggctcaaccacaagggggtacgccagaagcggctcaatgtatggctgggtattaaaaatgaggatgctgatgagaattactttataaacgaagaagacgagaatctccctcattatgatgagaaaacttggtttgttgaggacataaacagagttcaagctgaggatctcctatatggcaaacctgacggtgcatttctcattagggagtcgtctaaaaaagggtgctacgcgtgtagtgtcgttgcagatggagaggtgaaacactgcgtgatttacagcaccgcacgagggtatggctttgctgaaccttataacctgtactcaagcctgaaggagttggttttgcattaccagcaaacgagtctcgtacagcataatgacagtcttaacgttcggctcgcctacccggttcatgcgcaaatgccctctctgtgccgctag

SEQ ID NO: 16625 - DNA, 2643 bp, Artificial Sequence
  Description of Artificial Sequence: Synthetic coding sequence
atgcagcctggggccacgacctgcactgaagatcgcattcaacacgccctggagcgctgtctgcacggcctgagcctgagtcgccggtctactagctggtccgccggtttgtgtttgaattgctggagcctgcaggagctcgtgtccagagatcccggtcattttctgattttgttagagcaaatccttcaaaaaacaagagaggttcaggagaaggggacatatgatcttctcacaccgctggcactcctgttctattcgaccgtcctttgcacaccccatttcccacccgatagtgatctcttgttgaaggccgcatccacttaccacagattcttgacatggccagttccctactgttcaatatgccaggaactgcttacattcatcgacgcagaattgaaggccccaggcatttcataccagcggctggtgcgagcagaacagggtctccctatccggtctcaccgcagtagtactgttacggtcctgttgctgaaccccgttgaggtacaggccgaattcctggctgtggccaacaagctctctacgccagggcacagtccacactctgcctataccactctgctcctgcacgcatttcaggcaacctttggcgcgcactgcgacgtccctggcttgcactgcaggctgcaggcgaaaaccttggcggaattagaggacattttcaccgagaccgcagaagcccaggaactcgcatcaggcatcggagatgccgccgaggcccgccgctggcttcggacgaaactccaggccgttggcgaaaaggctggattccccggagtgctcgacacagcaaagcctggcaagctccacaccattcccatcccggtcgctaggtgttatacatatagttggtcccaggattcttttgatatcttgcaggaaattttgcttaaagagcaggaattactacagcctgggatcctcggcgatgacgaggaagaagaggaggaagaagaagaagttgaggaggatctggagaccgacggtcattgtgcggaacgagactccctgctcagcactagctccctggcgtctcatgatagcaccttgtctctggcaagtagccaggcaagtggacccgcattatcccgccacttgctaacgtcattcgtgtcaggtttatccgatgggatggatagcggctacgtagaggatagcgaagagtctagcagtgagtggccctggcgaaggggcagccaagagcgcaggggccacagacggccggggcagaagttcatcaggatctataaactgttcaagagcactagccagctggtactcagaagagacagccgcagcctggaaggcagctcagatacagcactgccattacgtcgggcaggttcattatgcagccccctcgatgagcctgtcagccccccctcacgcgcgcagaggagtagaagccttcctcagcccaaactcggaactcagttaccctcgtggctactagcgccggccagccgcccgcagcgtagacgaccgttcctgtccggagatgaggatccaaaagctagtaccctgagagttgtggtttttggctctgatagaatctcaggcaaggtcgcaagggcctacagcaacctgcgacggctggaaaacaaccgtcctctgcttactcggtttttcaagctccagtttttctatgtgccggtcaaaagaagccatggtaccagtcccggtgcctgcccgccgccacggtcccagactcccagtccaccgacagatagcccccgacacgcgtctccaggagagctgggaactaccccatgggaggagtcgactaacgacatcagccattatctcgggatgctcgacccatggtacgagcgtaacgtgcttggcctgatgcatcttccccccgaggtcctctgccagcagagcctcaaggcagaggcacaggccttggagggttctcccactcagctccccattctggcagatatgctgctgtactattgtcgattcgctgcgcgcccagtgcttctccaggtataccagaccgagctgacctttattaccggggagaagacgacagagattttcatccattcgctagagctcggtcacagtgccgctacaagagctatcaaggcaagtgggcctggttccaagcgattgggaatagatggggaccgcgaggctgttcctttgactctccagatcatctactctaagggagctatttctggcagatctcgttggtcaaatcttgagaaggtctgcacgtccgtgaacttaaataaggcctgcagaaaacaagaggaactggatagctccatggaggccttgaccctgaatttgacagaggtagtgaaacggcagaacagcaagagcaagaagggcttcaaccagatttctacttcacagattaaggttgataaagtgcagataattggctcaaactcctgtcctttcgctgtgtgcctggatcaggacgaaaggaaaatcctccagagcgttgttcggtgtgaggtgagtccttgctacaagcctgaaaaaagcgacctctcttcacctccacagacccctccagacctccccgcacaggctgcccccgatctgtgttcactgttatgtctgcccattatgaccttctctggcgctttgccctag

SEQ ID NO: 16626 - DNA, 2643 bp, Artificial Sequence
  Description of Artificial Sequence: Synthetic coding sequence
atgcagccaggcgcaaccacttgcaccgaggaccgcatccaacacgcgctggaacgctgcctgcacggcctttccctgagccgcagaagcacatcttggagcgctgggctctgtcttaattgctggagcttgcaggagctggtaagcagagatccgggtcacttccttatattactggaacagatcctacagaaaacacgggaggttcaggagaaaggaacttatgatctcctgacacccttggccctcctgttttacagcactgtgctatgcaccccacattttccacctgacagcgacctgttacttaaggctgcttcaacgtatcacagattccttacctggcccgtcccatactgcagtatctgccaggaactgttgacctttattgatgccgagctgaaagcacctggaatttcctaccagaggttggtgcgcgcagaacagggattgccaatccgatcacatagatcctctacagttacggttctcctcttaaatcccgtggaagttcaggctgagttccttgccgtcgctaataaactgtcaacccccggccattccccgcactcagcctataccacactgctgctgcatgcattccaggcaacttttggagcgcattgtgatgttccaggactgcactgtcggttgcaggccaagacactcgccgagctggaggacattttcaccgaaacagctgaggctcaggagttagccagcggtatcggggacgctgccgaggccagacgctggttacgaactaaactccaggccgtaggggagaaggctggctttcctggcgtgttagataccgctaagcctgggaagctgcacacaataccgatccctgtggcccgatgctatacatattcgtggagtcaggactcgttcgacatactccaggaaatcctgcttaaagagcaggaacttttacagcccggaatcctcggtgatgatgaagaggaagaagaggaagaggaggaggttgaggaagacttggagactgacggacactgcgctgagcgcgatagcctgctgtcgacttcgtctcttgcctcccatgatagtacattgtctcttgcatcaagccaggcgtcaggacctgcgctgtcccggcacttgcttacatcattcgtgagcggcctgagtgacgggatggattcaggctatgtagaggacagtgaggaaagcagcagcgagtggccttggaggagaggctcacaggaaagacggggccaccgcagaccagggcagaagtttatcagaatttataaactgtttaaatctacatctcagctggtgctgcgcagagactctcgctctctggaggggagcagcgatactgcattacctctgcgtcgagccggttctctctgctcaccactggatgaaccagtgtctcctcctagccgagcccagaggtcccggtcactgcctcagcccaagcttggcacgcagttgcctagctggttactagcgcccgctagtcgtccccagaggaggaggcctttcctgagcggcgatgaggaccccaaggcctccactctacgcgtcgtggttttcggatctgatcgtataagcggaaaggtggctagggcatacagtaacctgcggcgcctcgaaaataaccgccctcttttgaccagattcttcaaattgcagtttttctacgttcctgtgaagcgatcacatgggactagccctggagcctgcccacctcctaggtcccagacgccaagcccccctactgactcacctcgccatgctagcccaggcgaactgggcaccactccatgggaggagtcaaccaatgacatctctcactacctcggcatgctggatccctggtacgagagaaatgtgctcggcttgatgcacttgccgcctgaggtcctctgtcagcagtctttgaaggccgaggctcaagccctggaggggtctccaactcagctgcctatcctggccgacatgttgttgtactattgtagatttgcggccaggcctgttctactgcaggtgtatcaaacagagctgacttttattacaggtgagaagaccaccgagatctttatacacagtctggagcttggccacagcgctgccacccgggcaataaaggcctccgggccgggttccaagcgccttggcatcgacggggatcgtgaagctgtgcctctgactctccagatcatttatagcaagggtgccatctccggtcgatcccgctggagtaatttggagaaggtgtgcactagcgtgaatttgaacaaggcctgccgaaagcaggaagagctcgactctagtatggaggccctgacacttaatttgactgaagtggtaaaacgccaaaactcaaaaagcaaaaaagggttcaatcagatctccacctctcaaatcaaggtagataaggttcagatcattggctccaactcatgtccatttgccgtgtgcctggatcaagatgagagaaaaatcctgcagtcagtcgtgaggtgcgaggtttccccttgttataagcccgagaaaagcgacctatctagcccaccccagacccctcccgatttgcccgcccaggccgcacccgatctctgctcactcctctgtctccccattatgacgttcagtggagccctgccctag

SEQ ID NO: 16627 - DNA, 447 bp, Artificial Sequence
  Description of Artificial Sequence: Synthetic coding sequence
atgaaactgttggtcttggccgtgctgctgactgtggctgcagccgattcgggaatatctcccagagccgtgtggcagttcaggaagatgattaagtgtgttataccaggcagtgaccctttcttggagtacaataattacggctgttactgcggcttgggtgggtcagggacaccagtcgatgagcttgacaagtgctgccagacacatgacaactgctacgatcaggccaaaaagctggacagctgtaagttccttttggataacccatatacgcatacttatagctattcatgtagtggtagtgctataacctgctccagcaaaaacaaggagtgtgaggcctttatttgcaactgcgatcggaatgctgctatttgtttttctaaggccccatataataaggcacataaaaatctcgacacgaagaagtactgtcagtcatag

SEQ ID NO: 16628 - DNA, 435 bp, Artificial Sequence
  Description of Artificial Sequence: Synthetic coding sequence
atgaaaaccttactgctgcttgcagtgatcatgatttttggactcctccaggctcacggaaatcttgttaactttcatcggatgatcaagctgaccaccggtaaggaagcggccttaagctatggcttttacgggtgccattgtggggtaggtggcaggggcagccccaaggatgcaaccgatcggtgctgcgttactcacgattgttgctacaagcgtcttgagaaacgagggtgcggcacaaaatttctgagctacaagttttctaactctggctcgagaattacgtgtgccaaacaagactcctgtcgatctcagctgtgtgagtgcgataaggctgcggcaacctgcttcgccagaaataaaaccacatataacaaaaaatatcagtactattccaacaagcactgcaggggatcgaccccaaggtgctag

SEQ ID NO: 16629 - DNA, 435 bp, Artificial Sequence
  Description of Artificial Sequence: Synthetic coding sequence
atgaaaaccttgctgctcctcgcagtgataatgatattcgggctactccaggcccacggcaacctggtgaattttcacagaatgattaagctaaccactgggaaagaagccgctctgtcctatgggttttatggatgtcattgtggcgtgggagggagaggttcccctaaggatgccacagatagatgttgtgttacacacgactgctgttacaaacgacttgagaaacgaggttgcgggaccaaattcctttcctataagttcagcaactctggctctagaattacttgcgccaagcaggacagctgtagaagccaactgtgcgagtgcgataaagccgccgctacctgcttcgcaaggaacaaaaccacttataacaaaaagtatcagtactatagcaacaagcactgcagaggctcgactccaagatgctag

SEQ ID NO: 16630 - DNA, 438 bp, Artificial Sequence
  Description of Artificial Sequence: Synthetic coding sequence
atggagttggccttgctctgcggactagtagtgatggccggcgtcatcccaatccagggcggcatcctcaatctgaacaagatggtaaagcaggtaactggtaagatgcccattctttcctactggccctacggttgccattgcggtcttggcggaagaggacaacccaaagatgctactgactggtgctgtcagacgcatgactgttgctacgatcatctgaagacccaaggctgctccatctataaggactattacagatataacttttcacaggggaacattcactgtagcgataaaggctcatggtgcgagcagcagttatgtgcatgtgacaaggaggtcgcgttctgcctgaagcggaacctggatacctatcagaagagattgcgtttctactggcgcccacattgtcgcggacagacgccagggtgttag

SEQ ID NO: 16631 - DNA, 429 bp, Artificial Sequence
  Description of Artificial Sequence: Synthetic coding sequence
atgaaaagccctcacgtccttgttttcctgtgcctcctcgtggccctggtgactggtaacttagtgcagttcggagtcatgatcgagaagatgactggcaagtctgcattgcagtataatgactatggctgctattgtggaatcggcggctcacattggcccgtggaccagaccgattggtgctgtcacgcacacgattgttgctatggtcgacttgaaaaactgggttgcgagccaaagctcgaaaagtatctgttctccgtctctgaacggggaatattctgtgcgggacgaactacttgtcagagactgacttgcgagtgtgacaagagggcagccctgtgtttcaggcgaaacctgggcacttacaacaggaaatacgcccactatcccaacaagctgtgtaccgggcctactccaccttgctag

SEQ ID NO: 16632 - DNA, 636 bp, Artificial Sequence
  Description of Artificial Sequence: Synthetic coding sequence
atggccgatggagccaaggctaatccaaagggcttcaagaagaaagtgcttgatagatgtttttctggatggcggggtccccggttcggtgcaagctgccctagtcgcacaagtcgctcttcgctggggatgaaaaaattttttactgtcgctattctggcaggctcggtcctctcaacagcccatgggtctttgctgaacttgaaggctatggtggaggcagttactgggagatccgccattctaagttttgtggggtacggctgctactgcgggctgggaggtcgcggccagcccaaagacgaagtggattggtgctgccacgcacacgattgctgttaccaggagctgttcgaccagggatgtcacccatatgtcgaccactacgatcacaccatcgagaataacaccgagattgtgtgtagcgatcttaataagacggaatgcgacaagcagacatgcatgtgcgataaaaacatggtactctgtctaatgaaccaaacgtacagggaggaatataggggatttttaaatgtgtactgccagggccccacacccaactgtagcatctatgagccgccgcccgaggaggttacatgcagccaccagtctcccgcgccacctgctccgccttag

SEQ ID NO: 16633 - DNA, 936 bp, Artificial Sequence
  Description of Artificial Sequence: Synthetic coding sequence
atgcctgcccctcgcgccccacgggccttagctgccgcagctcctgcctccggcaaggctaaactcacgcatcccgggaaagcaattctcgccggcggcctggctggcggcattgaaatctgcatcacattccctacagagtacgtgaaaacccagctccaactcgacgaaagaagtcaccctcccagatacagagggattggtgactgcgtccgccagacggtgcgctcccacggcgtgctcgggctgtaccgggggctgtcctcactattatacggctctattcccaaggcagctgtgcggtttggcatgttcgaattcctatcaaaccacatgagagatgcccaaggcagactggatagtactaggggcctactttgcgggctgggcgctggcgtggccgaagccgttgtggtagtgtgccccatggagaccatcaaggtgaaattcatccatgatcagactagccctaatccaaagtaccgtggattcttccacggtgtgagagagattgtcagagagcagggtttaaaagggacttaccagggtctcacagccaccgttcttaaacagggaagcaaccaggccatacgatttttcgtgatgaccagcctacggaactggtatagaggtgataatcctaacaagcctatgaatccattgatcactggcgttttcggggctatagcaggtgcagcatccgtctttggaaatactccacttgacgtgataaaaacacgcatgcagggactggaagctcacaagtacaggaacacgtgggattgcgggctccagattctgaaaaaggaaggtttaaaagcattctacaaaggtacagtccctcgcttgggccgtgtctgcctggatgtagccattgtatttgttatctacgatgaggtggtcaagctccttaataaagtgtggaagactgactag

SEQ ID NO: 16634 - DNA, 2250 bp, Artificial Sequence
  Description of Artificial Sequence: Synthetic coding sequence
atgagctttatagatccttaccagcacatcattgttgaacaccaatactcacataaattcaccgtggtggttctgcgtgcaactaaagtgaccaagggcgcatttggggacatgcttgacacacctgacccatatgttgaactcttcatttccactactcccgatagtcgaaaaaggacgagacacttcaataacgatataaaccctgtgtggaatgaaactttcgagttcattttggaccccaatcaagagaatgtgctggagattactctgatggacgccaattacgttatggatgagacgctggggaccgcaacattcactgtgagcagcatgaaggtgggggagaaaaaggaggtgcccttcatcttcaaccaagttactgaaatggtgctggagatgtcactcgaggtgtgctcctgtcccgatctgaggttttcaatggcactctgcgatcaggaaaagaccttccggcagcagcggaaagaacacataagggaatccatgaaaaaactgctcggccctaaaaacagcgaagggctccacagtgcccgcgatgtgcctgttgttgctatactcgggtcaggtgggggcttcagagccatggtgggtttcagcggagtcatgaaggcactgtatgagtcaggtatcctggactgtgctacatacgtggccgggctgagtggctcaacttggtacatgtctacattgtatagtcaccccgatttccctgagaaaggcccagaagaaataaatgaggagctgatgaaaaacgtgtcccacaacccattgcttctcctaacacctcagaaagtcaaacgctacgttgagagtctctggaagaagaagtccagcggtcaaccagttacattcacggatatttttggaatgttaatcggggaaactctgattcacaacagaatgaatacaactctttctagtcttaaagaaaaggtcaacactgctcagtgtccacttcccctattcacctgcctgcatgtcaagccagacgtttctgaactcatgttcgccgattgggttgagttctccccctacgagatcggaatggccaaatacggaacattcatggctccagatctgttcgggtctaagttttttatgggaacggtggtgaagaagtacgaggagaatccgttgcattttttgatgggggtgtggggtagcgccttctctatcctgttcaaccgcgttcttggagtcagtgggagccagagtcgaggatcgaccatggaggaggagctcgagaatatcacaactaaacatatcgtttctaacgattcaagcgactccgacgacgaaagtcatgagcctaagggaacagagaacgaagatgctgggagtgattatcaaagtgacaatcaagctagctggattcacaggatgatcatggcactcgtgagcgactcagctctgttcaacacccgggaaggcagggccgggaaggtgcataacttcatgctcgggctgaatctgaacacatcgtacccattatcacctttgtcggacttcgctacgcaagattcttttgacgacgacgaattggatgccgccgtggccgatccggatgagtttgaacggatttatgaacccctggatgtaaaaagcaagaaaattcacgtcgttgactccggcctgactttcaatctgccatatccgctgattctgcggccccaacgcggagttgatctgatcatttcctttgacttcagcgccagaccgagcgatagcagtcccccattcaaggaattgttgttggccgagaaatgggctaagatgaataagctgcccttccctaagatcgacccctacgttttcgacagagagggcttaaaggagtgttacgtgtttaaaccaaagaacccagatatggaaaaggactgccctacgataatccatttcgtgttggccaatataaacttcagaaagtatagggcccctggtgtccccagagagacagaggaggaaaaggagattgctgactttgacatcttcgatgacccagaatctcctttttcgacctttaacttccagtatcctaaccaggcatttaagagactccacgatctgatgcattttaatacactcaacaatattgatgtcattaaagaggctatggtcgaatctatcgaatacaggcggcaaaacccatcccggtgcagcgtgagcctcagcaacgttgaagctcgcagatttttcaataaggagttcctctctaaacctaaggcctag

SEQ ID NO: 16635 - DNA, 150 bp, Artificial Sequence
  Description of Artificial Sequence: Synthetic coding sequence
atgagttttatcgatccttatcagcatatcattgtggagcaccagtactctcataagttcactgtggttgtgctccgagccacgaaagtgacaaaaggtgcgtttggagacatgcccaaggtcaccaaaggcgcatttggggacatgtag

SEQ ID NO: 16636 - DNA, 2070 bp, Artificial Sequence
  Description of Artificial Sequence: Synthetic coding sequence
atgagtttcattgacccataccagcacatcatagtggagcatcaatatagtcataagtttacggtggttgtgctacgggccacaaaagttactaagggcgcttttggtgatatgctggacacccccgatccttacgtcgaacttttcatctctacaacccccgactccaggaaaaggactagacatttcaacaatgacattaaccctgtgtggaacgagacgttcgagttcatcctagaccccaatcaggaaaacgtcttagagattacactgatggacgctaattatgtgatggatgagacactcggcacagccacgttcacagtctcatccatgaaagtaggcgagaagaaggaagttccttttatttttaaccaagtccccgtggtggcaattcttggcagtggcggaggatttcgggccatggttggattttctggggtcatgaaagctctgtacgaatccggaatcttggattgtgctacttacgttgccggactatcaggcagcacatggtacatgtctactctatattctcatcccgattttccagagaaggggcccgaagaaattaatgaagagttgatgaaaaacgtatcccacaatcctctcctcctcctcacaccccagaaggtcaagcggtacgtagagagcctctggaaaaagaagtcatctggccaacctgtgacctttactgatattttcggcatgttgattggagagactctgatccataatcgcatgaatacgacactcagctcgctgaaagagaaggttaatactgcccagtgcccactgcccctttttacttgcctacacgtgaagccggacgtgtccgagttgatgtttgcagactgggtcgagtttagcccttatgaaattgggatggctaagtacgggacattcatggcccctgacttgtttggcagtaaattttttatgggcacagtggtcaaaaagtatgaagaaaaccccctccattttctcatgggagtgtggggtagtgctttctccattctgttcaacagagtgttgggggttagcggcagtcagtccagaggttccacgatggaggaggaattggagaatatcaccactaagcacatcgtctctaacgattccagcgatagtgacgacgaaagccacgaaccaaagggaactgagaatgaagatgccggcagtgactaccagtcagataaccaagctagttggatacatcggatgattatggccttagtcagtgactcagctctgttcaacactagagagggccgtgcaggaaaagtgcataacttcatgcttgggctgaacttaaatacgagctacccgctctctcctctatccgacttcgccacgcaagactcctttgatgatgatgaattggatgccgcagtggccgatcccgacgaattcgaacgaatctacgaacctctggatgttaagagtaagaaaattcacgtcgtggattccggcctgacctttaacctcccctacccccttattctgcgcccacagaggggggttgacctaatcatttcctttgatttttccgcaaggccttcggactctagtcccccttttaaggagctgctgctggctgaaaagtgggccaagatgaataaacttcccttccctaagatcgacccttatgtgttcgatcgcgaaggtctgaaagagtgctatgtgttcaagcccaaaaatcccgacatggagaaagactgcccaaccattatccacttcgtgctggcgaatattaactttaggaaataccgggcccccggtgtaccgagagaaaccgaggaagagaaggagatcgcggacttcgacatatttgacgatcccgaatcccccttctccaccttcaatttccaatacccgaaccaagccttcaagcgcttacatgatttgatgcatttcaacacgctgaacaatatagatgttattaaggaggctatggttgaaagtattgagtatcgcagacagaatccaagcaggtgttctgtctctctgtccaatgtggaagccaggcggtttttcaacaaggagtttctgagcaaacccaaagcctag

SEQ ID NO: 16637 - DNA, 2346 bp, Artificial Sequence
  Description of Artificial Sequence: Synthetic coding sequence
atggcagtggctgaggtcagtaggacgtgcttgcttacagttcgggttctgcaggcacaccgcctcccttctaaagatttagtcacacccagtgactgctatgtgacgctgtggctccccactgcctgtagccatcggctccagacacggacagtgaagaattcgagcagtcccgtttggaaccaaagctttcacttccggattcatagacaactcaagaatgtaatggaactgaaggtgtttgatcaagacttggttacgggcgacgatccagtcttatctgtactgtttgatgcaggtaccctcagagccggagagttccgtagagagtccttttcgctcagcccacaaggggaggggaggctcgaggtggagttcagactacagtctctcgccgacagaggcgaatggctggtgagcaacggtgtcttagttgcaagagaactgagttgtttgcacgtgcagttggaggaaacaggggatcagaaatcctccgagcatagggtgcagctcgttgtcccaggctcgtgtgagggtccccaggaagccagtgtcggtacggggacctttagattccactgccctgcgtgttgggagcaagaattgagtatacgattacaggatgctccggaagagcagctgaaggcgcctttgtctgctttgccatccggtcaggtcgttcggctggtttttcccacatcccaggagccgttgatgagggtggagctgaaaaaagaggcaggactgcgggaattggccgtgagattgggtttcgggccatgtgcagaggaacaggcctttctgtcccggcggaagcaggtggtggccgccgccctgagacaggcactgcagctggatggtgacctgcaggaagacgaaattcctgttgtggccattatggcaactgggggtggaatccgcgctatgacgtcactgtatgggcaattggctgggttaaaggagcttggactgctggactgcgtgtcctacattacgggcgcaagtggctctacatgggccttggccaacttgtacgaagatcccgaatggagccagaaagacctcgctggccccaccgagttgttaaaaacccaagtcacaaagaacaaactcggagtgctggcccccagccagctgcagcggtatcggcaggagctggctgaaagagcacggctcggatacccaagctgttttaccaatctgtgggcactgatcaacgaggccttgctgcacgatgagccacatgatcacaaactcagtgatcagagagaagccttgtcccacggtcagaatcctctgcctatctattgcgccttgaatactaaagggcaaagcctcactacatttgagtttggcgagtggtgtgaattctcgccttacgaagttggctttcccaagtacggagcctttattccatccgagctctttggaagcgagtttttcatggggcagctcatgaaacgactacctgagtcccgcatatgtttcttagagggcatctggtccaacctgtatgctgctaacctgcaggattcactgtactgggcttctgaaccttctcaattttgggacagatgggtgcgtaatcaggctaatctggacaaagaacaggtaccactgctgaagatcgaggaaccaccgtcgacagccggccggatcgctgagtttttcacagatctgctgacatggaggccccttgcgcaggctacccacaacttcctcaggggacttcactttcacaaggactatttccagcatccacacttctcgacctggaaagcaaccaccctggacgggttgcccaaccagctcacccccagtgagccccatttatgtctgctcgatgtggggtatttgataaacacgagctgtctccccctgcttcagccaacacgcgatgtggacttgatcctcagtcttgactacaatctgcacggggcgttccagcagttgcagctcctcggcagattctgtcaggagcagggtattccgttcccacctatctcacctagccccgaagagcagctgcagcctagagaatgtcatactttcagcgatcccacctgccctggcgccccggcggtcctgcatttccccctggttagtgatagcttccgagagtactccgccccaggagtgagaaggaccccggaggaagctgccgcaggggaagtcaatttgtcatcatccgactcgccctatcactacaccaaagtcacatatagccaggaggacgtggataaattactgcacctgacacattacaacgtttgtaacaaccaagagcaattactggaggccctgagacaggccgtgcagcgtcgccgccagcgccgccctcattag

SEQ ID NO: 16638 - DNA, 417 bp, Artificial Sequence
  Description of Artificial Sequence: Synthetic coding sequence
atgaagggtttgctccccttggcctggttcttagcctgttctgttccggcggtacagggcgggcttctcgacctcaagagcatgatagagaaagttacagggaagaacgctcttactaactacggtttctatgggtgctattgtggctggggagggcggggaacccccaaagacggcactgactggtgttgttgggcccacgatcactgttatgggcgattggaggaaaaagggtgtaatatacggactcagtcctacaaataccggttcgcctggggagtagtgacctgtgagcctggaccattttgtcacgtaaacctgtgtgcatgcgataggaaactcgtgtactgtttgaagaggaatctacgatcttataacccacagtatcaatacttccccaatattctttgcagctag

SEQ ID NO: 16639 - DNA, 2421 bp, Artificial Sequence
  Description of Artificial Sequence: Synthetic coding sequence
atgcaattcttcgggagactggtgaatactttctctggggttacaaacctgtttagcaatccctttcgggtcaaagaggttgccgtggccgactacacctcttccgaccgcgtacgcgaagagggccaactgattttgtttcaaaatacgcctaaccgcacctgggactgcgtgctggtgaatcctagaaactcccaatcgggcttccggcttttccagttggagctggaagccgatgctcttgtgaatttccatcaatactcatctcagctgctacctttttacgagagctccccgcaggttcttcatacagaggtcctgcagcatctgaccgacctgatccgcaaccacccctcctggagcgtggctcatctggcagtcgagctgggtattcgagaatgcttccaccactcaagaatcatcagttgcgccaactgtgccgaaaatgaggagggctgtacccccctgcacctggcgtgcaggaagggggacggggagatcctcgtcgagttggtacagtactgtcacacgcagatggatgttaccgattataaaggtgagactgtcttccattacgccgtgcaaggcgacaatagccaggttctgcaacttttaggcagaaacgcagtggcaggcctgaaccaggtcaataatcagggtcttacacccctgcacctcgcttgtcagctgggaaagcaggaaatggttcgggtgctcctgctgtgtaacgcacgctgtaacattatggggcccaacggctaccccatacattctgctatgaaattctctcaaaaaggttgcgcagaaatgattattagcatggactcctctcagatccacagtaaggacccacgctacggggcttcacctctccattgggcaaagaacgcggagatggcccggatgctcctcaaacgcggctgcaatgtgaatagtacaagcagcgcgggaaataccgcccttcacgtggccgtaatgcgcaaccgatttgactgtgccattgtcctcctcacccacggagccaatgctgatgcccgcggtgagcacggtaatacacctttgcacctggcaatgtccaaggacaatgttgagatgatcaaagcactcatcgtcttcggcgccgaggtggacactcccaatgactttggagaaacccccacctttcttgcatccaaaatcgggcgtctggtgactaggaaggccatattgaccctgctcagaaccgtgggggccgagtactgttttcctccaattcatggcgtgcctgcagagcaggggtctgctgcccctcatcatcctttcagtctggagcgagcacaacctcctccaatctcccttaacaatctcgagctgcaggatctgatgcatattagtcgggcgaggaagcctgctttcatccttggatccatgcgagatgagaagagaacgcacgaccaccttctgtgcctggacggaggtggtgtcaagggcctgatcattatccagctcttgatagccatagagaaagccagcggtgtggcgaccaaagacctgtttgactgggtggccgggacaagcaccggcgggattctggccctggctatcctgcattccaaatccatggcttacatgcgggggatgtattttaggatgaaggatgaagtttttagggggtcccgaccgtacgaatccggtcctctggaggagttcctaaaacgggagtttggggaacacaccaaaatgacagatgtccggaagcctaaagtcatgctcaccgggacactgtcagatagacagcctgccgagcttcacttgttcagaaattatgatgcgccagaaaccgtgcgtgagccacgattcaaccagaacgtgaatctccgcccacccgctcagccctctgatcaactggtatggcgcgcagctagaagcagcggtgcagcgcctacatactttagacccaatggccggtttttggacggtggcctgcttgccaataacccaacacttgacgccatgactgaaattcatgagtacaaccaggacctgattcgcaaaggacaagccaataaggttaaaaaactttctattgtggtgtcactgggcacgggacgctccccacaggtgcccgtcacctgcgtcgatgtgttcaggccctccaatccttgggagttggctaaaactgtgttcggagcaaaagaactcgggaagatggtagtcgattgctgtacggacccggacgggcgggctgtcgaccgggctcgtgcttggtgcgagatggtgggcatacaatatttcagattgaatccgcaactcgggacagatataatgctggatgaagttagcgatactgtactggttaacgccctttgggaaacggaagtgtacatctacgagcatcgcgaggaattccagaagctgatccagctgctcttatccccatag

SEQ ID NO: 16640 - DNA, 1284 bp, Artificial Sequence
  Description of Artificial Sequence: Synthetic coding sequence
atgcagttcttcggccgcctggtgaacaccttttctggagtgacaaatttgttcagtaatccatttcgagtgaaagaagtcgccgtggcagattatacttcatccgatcgtgttagagaggaaggccagctcatcctgttccaaaacacacctaaccgcacttgggattgcgtattggtcaacccaaggaattctcagagtgggttcagatgtgctaactgcgctgagaacgaagaaggttgtactcccctgcacctggcctgtagaaagggcgacggggagatcctcgttgagcttgtgcagtattgccacactcaaatggacgtgactgactataaaggggagacagtgttccactatgcggtccagggcgacaatagtcaagtgcttcaactgctcgggaggaatgccgttgcagggctgaaccaggtgaacaatcagggcctcacacccctgcacctggcatgccaattgggtaaacaggaaatggtccgggtcctgttattgtgcaatgcccggtgcaatataatggggccaaacggatatcccattcacagcgcaatgaagtttagtcagaagggctgcgccgagatgataatcagcatggactcgagtcagatccacagtaaagaccccagatacggtgcaagcccgctgcactgggccaagaatgctgaaatggcccgtatgctgctaaaacgcggctgcaacgtaaatagcacgtcaagcgctgggaacaccgcgcttcacgtggccgtaatgcgcaaccgtttcgattgcgcaattgtgctgcttactcacggcgcaaacgcggatgctcgcggggaacatggaaatacccccctgcatctcgccatgtccaaggataacgtcgagatgatcaaggccctcatcgtattcggcgccgaggtggatacacctaacgacttcggtgaaacaccaactttcctcgcctctaaaatcggacgtctggtcactaggaaagcaatcctgacacttttgagaactgtgggtgctgaatattgtttcccaccaatacacggagttcctgcggagcagggcagtgcagccccccaccacccttttagcctggagagggcccagcccccacccatttctttaaacaacctaggtagtcacccaagtcaagcagggtggtgggcgtggggggcagcctcagacgggactacaggaagtcatgcacaccttacagggccagaggcttcggtgcaccccggtctccacgaaggacgagaggcagacagacagaatatggagagttag

SEQ ID NO: 16641 - DNA, 2259 bp, Artificial Sequence
  Description of Artificial Sequence: Synthetic coding sequence
atgcagttctttgggaggctggtgaacacctttagcggggtcacgaacctgttctctaacccctttagagtcaaagaggtggcagtcgccgattatacaagctctgacagggttagagaggaaggacaactcattctgtttcagaacactcctaacagaacctgggactgtgttctggtgaacccacgaaatagccagagtggtttcagactgttccaactggaattggaggccgatgcactcgtgaacttccatcagtacagctctcagctgctgcctttctatgagtccagcccacaggtactgcacacagaggtcctccaacacctgacagacttaatcaggaatcatccctcctggtccgtggcccatctcgccgtggaactgggtatccgggaatgttttcatcacagtaggattattagttgtgcgaattgtgctgagaacgaagagggctgtactcccctccacctggcttgtagaaagggagatggagaaattctcgtcgagctggttcagtactgtcacacccagatggacgtgaccgattacaagggagaaaccgtattccactacgccgtgcagggcgacaactcacaagttttgcagctgctgggtaggaatgctgttgctggactcaaccaggtgaataaccagggcctcacacccctgcacctggcatgtcagctgggcaagcaggagatggttcgggttctgctcctctgtaacgcgcgatgcaacatcatggggcccaatggctaccctattcacagtgctatgaagttcagtcaaaagggatgtgccgaaatgatcataagcatggactctagccaaatccacagcaaagacccccgttatggggctagtccactgcactgggcaaaaaacgccgaaatggcgcgaatgctgctcaagcggggatgcaatgtcaacagtacttcttctgcggggaacaccgccttgcatgtggcagtgatgaggaatcgatttgattgtgctatcgtcttattgacacatggggccaatgcagatgctcgcggcgagcatggaaatactccgctgcacctcgcaatgtctaaggataacgtagagatgataaaggcgctaatagtattcggtgcggaggtggacactcctaatgactttggcgagacaccgacattcctcgcctccaagattgggcgccagttacaggatctgatgcacatttctcgtgccagaaaaccggcttttatactggggagcatgagggatgaaaagcggacgcacgatcatctgttgtgcctcgatggaggaggcgttaaaggcttaattataatccagttgttgatcgctatcgagaaagctagcggagtcgcaaccaaggatctgtttgattgggtcgccggcacatctactggaggtattttagccctggctatactgcattccaagagtatggcctacatgaggggcatgtattttcgcatgaaggacgaggttttcagaggtagcaggccatatgagtccgggcccctcgaggaatttctcaagcgggagtttggagaacacactaaaatgactgacgtgagaaaacccaaggtgatgcttacaggaaccctgtctgatcgtcagcccgctgagctgcacctcttccggaactatgacgcccccgaaacagtgagagagccacggttcaatcaaaatgtaaacctccgaccccctgcgcagccaagcgaccagctggtctggcgggcggcacgttcatctggagctgcccccacctattttagacctaatggcagattcctagacggtgggttactggccaacaacccaacattggatgccatgacagagattcatgaatataatcaggacctaataagaaaaggacaggcgaacaaggtcaagaagctgagcatcgtagtcagcctcgggaccggtagaagcccacaggtccccgtgacgtgcgtggacgtcttccgccccagcaacccctgggaattggctaagacagtgtttggggcaaaggaactgggaaagatggtagtcgactgttgtacagaccctgatgggcgagccgtggaccgggcacgcgcatggtgtgaaatggtcggcatccagtacttccggttaaatccacagctcggcacagatataatgctggatgaagtgtccgataccgtactcgtgaacgccttatgggagaccgaagtctatatctatgagcacagggaggaatttcaaaagttgatccaactcctcctgtctccctag

SEQ ID NO: 16642 - DNA, 1440 bp, Artificial Sequence
  Description of Artificial Sequence: Synthetic coding sequence
atgcagttcttcgggcggcttgttaatacttttagtggagtcaccaatctcttcagtaatccatttagagtgaaggaggtggccgtcgccgattatacttctagtgatagggtgcgtgaggaaggccagctgatcttatttcagaataccccaaacagaacttgggactgtgtgctggtgaacccacgaaactcgcagagtggtttccgacttttccaattagaactcgaagccgatgctctcgtcaattttcaccagtatagcagtcagctccttcctttttatgaatcctcaccacaggtgctgcacacagaggtactacaacatctaactgatctgatcaggaaccatccatcctggtcagtggcacatttagccgtggaattggggatcagagaatgcttccatcactctcgcataattagctgtgccaattgcgctgaaaatgaggaggggtgcactccactccacctggcctgcagaaaaggagacggagagatcctcgtggagctcgtgcagtattgccacacccagatggatgtaaccgactataaaggtgaaactgtcttccactacgctgtgcagggggataacagccaagtgctacagctgctgggccggaacgccgtcgccggacttaatcaggtgaataatcagggcctgactccgctgcacttggcatgtcagctgggcaaacaggagatggtgcgggtcttactgctatgtaatgctaggtgcaatatcatgggtcccaatggctatcccatccatagtgcaatgaagtttagtcagaaaggatgcgccgagatgatcattagtatggactctagccagatacatagtaaggaccccaggtacggagcttcgcctttgcattgggctaagaatgccgagatggctcgaatgctgctcaagcgagggtgcaacgtcaattcaacttcatctgctggcaatactgctctgcatgttgccgtgatgagaaaccgattcgattgtgcaatagtgctgcttactcacggcgcgaatgccgatgcccgtggggagcacggcaatactcccttgcatctcgcgatgtccaaggacaacgtcgaaatgatcaaggctctgattgtgttcggggcagaagtggacaccccaaatgattttggagagacaccaacattcttggcctctaagatcggtagactcgttactaggaaggccatcctgacactcctgcgaacagtgggagctgagtattgttttcctccaatacacggcgtgcccgcagaacagggcagcgccgccccccaccatcccttttcattggagcgggcacagccacccccaatctccctgaacaaccttgaattgcaagatttaatgcatatctctcgtgctaggaaaccagcttttatcctaggttccatgcgcgacgagaaaaggacggacagaacgtag

SEQ ID NO: 16643 - DNA, 2259 bp, Artificial Sequence
  Description of Artificial Sequence: Synthetic coding sequence
atgcagttttttggacgactggttaatactttttctggtgtgacaaacttgttctccaatcccttcagggtcaaagaggtcgctgtagcggactatactagtagtgacagagtcagggaagaaggccaactgatcctgttccagaatactccaaaccgaacctgggactgcgtgcttgtcaatccaaggaactctcagagtggttttaggctgtttcagcttgaactcgaggccgatgcgctggttaacttccaccagtactcttcccagctactccccttttacgagtccagtccacaggttttacacaccgaagttctacagcacttaacggaccttatcagaaaccacccgtcctggtccgtagcacatctggccgtggagctcggcatcagggagtgcttccaccacagtcgcataatcagctgtgcaaactgcgccgaaaacgaggagggatgcaccccgctgcatctcgcttgccggaagggggacggcgagatcctcgttgagctggtgcaatactgccatacccaaatggatgtcacagactacaagggtgaaaccgtcttccattacgccgtgcagggagataattcccaggtcctgcaactgttgggccgcaatgcggttgccggcttaaatcaggtgaataaccaagggcttacaccattacacctcgcctgccaactgggaaagcaggagatggtacgggttctgttactgtgtaatgcccgttgcaacataatgggaccaaatggctatcccatccactccgccatgaagttctcacagaagggttgcgcagagatgattatatctatggatagcagccagattcatagtaaagacccccgctatggggcatcccctctgcattgggccaaaaacgcagagatggctcgcatgctgctcaagagaggatgcaatgttaacagcacttcttcagctggcaatactgctctccatgttgctgttatgcgcaatcgctttgactgtgccatcgttctgttgacacatggtgccaatgcagacgccaggggagaacacggaaacacacctctgcacctcgcaatgtctaaagacaatgttgaaatgatcaaggcccttattgtatttggagccgaggtggacacaccaaacgattttggggagaccccgaccttcttagctagcaaaattggccgccagttacaggacctcatgcacattagccgggccaggaagcccgccttcatccttggctctatgcgcgatgagaagaggacccacgaccatttactctgcctcgatgggggtggggtcaagggtcttattatcatccaactgctcatcgccatagaaaaggcctccggagtggctacaaaggacctgttcgattgggtggcgggaaccagcacaggcggaatccttgctcttgccatcctgcattctaagtctatggcatacatgcgcggcatgtattttcgcatgaaggacgaggttttcaggggctcacggccatacgaaagcggcccactggaagagttcttgaaaagagagttcggcgaacatactaagatgaccgatgtccgcaagcccaaggtcatgcttaccggtactctgagcgacaggcaacctgcggagctgcatctgttcagaaactatgatgcgccagagaccgtccgagagcctcgcttcaatcagaatgtgaatctaaggcctcctgcccagcctagtgatcagttagtgtggcgtgccgctcgctcatcaggcgcagcccctacttactttcgccccaatggtcgctttctggatggcggactgctggctaataatcccacactcgacgctatgaccgagatccatgagtataaccaggatctgattaggaaaggtcaggcgaataaagtgaaaaaactgagtattgtagtcagcctggggactggccgttcaccccaggtacctgtgacttgtgtggacgtgttccgaccttcaaacccatgggagttggccaaaacggtgtttggagctaaagaactgggcaaaatggttgtggactgttgcacggatcctgacgggcgagccgtggatcgagcacgtgcctggtgcgagatggtaggcattcaatatttccgattgaacccccagctgggcacggatatcatgttggacgaggtgtccgacactgtcttagtaaacgcactctgggagaccgaggtctatatatacgagcatcgagaggagttccagaagctgatccaacttcttttgagcccctag

SEQ ID NO: 16644 - DNA, 2004 bp, Artificial Sequence
  Description of Artificial Sequence: Synthetic coding sequence
atgcaattctttggacgcctggtaaataccttcagtggagtcacgaacttattttcaaaccctttccgggttaaagaggtagccgtcgcggattacacttcctcagatagagtcagagaagaaggtcagctcatcttgttccagaacacaccaaataggacttgggattgtgtattggtaaaccctaggaacagtcaaagcggttttagactgtttcaacttgaactagaagccgatgcattagtaaactttcaccagtactcttcccagcttggtaagcaagaaatggtccgggtgctgctcttgtgcaatgcccggtgcaacattatggggccaaacggctaccctatacattccgctatgaagttctcccaaaaaggatgcgcagagatgattatctccatggactcctcccagatccattctaaggacccaaggtacggagcaagtccactgcattgggcgaaaaacgctgagatggccagaatgctgctcaaacgcgggtgcaacgttaactccactagttccgctggcaatacagctttgcacgttgcagtgatgcgaaacaggttcgattgcgccatcgttctcctcactcacggagccaacgctgacgcacggggtgagcacggaaacacacccttgcatctggctatgagcaaagataatgtcgagatgataaaggctttgattgtgtttggagctgaggttgatacgccaaacgatttcggcgagacccctacgttcttggcgagcaagataggcaggttagtaacccgaaaggctattctgaccctgcttaggacagtcggcgcggaatactgcttcccccccatccacggtgttcccgcggagcagggaagcgccgcccctcatcacccattctctctggaacgcgcccagccacccccgatatcactcaacaatttagaactacaagatctgatgcacatttccagagcacgaaagcccgccttcatcctcggcagtatgcgggatgagaagaggacccacgaccacctgctgtgtttggatggggggggggtgaaaggcctcatcatcatccaactgctgatcgccattgaaaaggcgtcaggcgtagccacgaaggaccttttcgactgggtcgccgggactagcacaggaggaatcttagctctagctatcctgcactcaaagtccatggcctatatgcgcggcatgtactttcgtatgaaagatgaagtatttaggggctccagaccatatgagtccgggcctttagaagagttcctcaaaagggagttcggggaacacactaagatgactgacgttagaaagccaaaagtaatgttaacaggcactttaagcgaccggcagccagccgaactgcacctctttcggaactacgacgcccccgagaccgtcagagagccgagattcaaccagaacgtgaacctgcgccctcccgcccagccttcagatcagctggtgtggagagctgcccggagtagtggtgcggctcccacctacttcaggcctaacggtcgttttctggatggaggtttattagccaacaatcccacgttggatgccatgacagagatacacgaatataaccaggacctgatccggaaggggcaagctaacaaagtcaaaaagctgtcaatcgtggttagtcttggaactggcaggtccccgcaggtgcctgttacctgtgttgatgtcttccggccaagcaatccttgggagctggcaaagaccgtctttggagccaaggaactcgggaaaatggtcgtcgactgttgtacagatccggatggcagggcggtggaccgggccagagcctggtgcgagatggtcggcatacagtacttccgtttgaatcctcagctgggaaccgatatcatgctagatgaggtttcagataccgttctcgtcaacgccctctgggagacggaggtatatatctacgagcacagggaggaattccagaaacttatacagctcttgctgtctccatag

SEQ ID NO: 16645 - DNA, 501 bp, Artificial Sequence
  Description of Artificial Sequence: Synthetic coding sequence
atgcaattctttggacgactagtcaacactttttccggcgtgacaaatctgttttctaaccccttcagggtaaaggaagtggccgtggcagattacacctcatccgacagagtacgggaagaaggacagctgatcctgttccaaaatacgcctaaccgtacctgggactgtgttctcgtcaaccccagaaattcccagtctggcttccggtgcgccaattgcgcagagaacgaggaagggtgtacaccattgcacttggcatgccgcaaaggggatggcgagatcttggtggagctggttcaatactgtcatacacagatggatgtgaccgattataaaggcgagactgtgttccactatgccgttcaaggtgacaatagtcaggtgttacagttgctgggacgcaacgccgtggccgggctgaaccaggtcaacaaccagggactgactcctctgcatttagcgtgtcaactaggcaagcaggaaatggtgcgagtgtag

SEQ ID NO: 16646 - DNA, 1299 bp, Artificial Sequence
  Description of Artificial Sequence: Synthetic coding sequence
atgcaattcttcggtcggttggtaaacacattcagtggtgtcacaaacctgttcagtaaccccttccgggtgaaggaagttgccgtggccgactatacctcctccgaccgggtacgcgaggagggtcagctgatcctatttcagaacacaccgaaccgaacgtgggattgcgtgttggtgaaccctagaaatagccagtctggcttcaggctcttccaactcgagctggaggctgacgctctggtcaactttcatcagtatagtagccagctgcttcctttttatgaatctagtcctcaggtgctgcacacagaggtgctgcagcatctgacggacctgatccgcaatcacccaagctggtctgtggctcacctggcagttgaactaggcatccgcgagtgtttccatcactctcgaatcattagggtgcggtcagcccatcaagtgccaggcctgtgggaactgataagtactcaccacgagatagagttttcacagcctcctcaggctgtgcccattgccaggcgtaccaggagagctgcacatccatgcacctggcctgccgctcgcgtaatgggccgaagttggtggagttggtgtagcacagccacactacggtggatgtctcccacaacccgcgagaggccgagctccataatgctgagtagggtcacaattctgcgatgctgtcggtgtgcggagatgatcatttctatggatagctcccagattcatagtaaggacccgcggtacggggctagtcccctccactgggccaaaaatgctgaaatggccaggatgctgttgaaaaggggctgtaatgtgaactccacctcaagcgccgggaataccgccctccatgtggctgtgatgcgcaaccgttttgattgcgcgatcgtgctgctgacccatggggccaacgcagatgccaggggcgaacacggcaacaccccgctgcatctcgccatgtcgaaggataacgtagagatgatcaaagcactcatcgtgttcggcgctgaggtcgacacccctaatgactttggcgagacccctacgttccttgcaagcaagatcggtcgtctggtcacgagaaaagctattctaaccctactgagaacagtcggggccgagtattgcttcccccctattcatggcgttccagcagaacaggggagcgccgccccccatcacccatttagtcttgagagggcccagcctcccccaatatcgctgaacaatctcggatctcatcctagccaagccgggtggtgggcgtggggagcagcctcagacggctag

SEQ ID NO: 16647 - DNA, 243 bp, Artificial Sequence
  Description of Artificial Sequence: Synthetic coding sequence
atgcagtttttcggacggctggtaaatactttctctggagtcaccaaccttttttccaatcctttcagggtcaaagaagtggccgtggccgactacacctcaagtgatagggtccgcgaggagggccagcttatcctgttccagaacacgccaaacagaacatgggactgtgtcctggttaatcccaggaattctcaatccggctttaggctgtttcagctagaactggaagctgatgcctag

SEQ ID NO: 16648 - DNA, 498 bp, Artificial Sequence
  Description of Artificial Sequence: Synthetic coding sequence
atgggtccgctccctgtttgcttacccatcatgttattactcctgctgccatctctattacttcttttgttgctccccggcccagggagcggagaagcctctagaattctaagggttcaccgccggggcattcttgaattagccgggacagtgggctgcgtcgggcctcggactccgatcgcctatatgaagtacgggtgtttttgtggtctaggagggcatgggcaaccccgggatgcaatagactggtgctgtcatggccatgactgctgttatacgcgcgcggaggaagctgggtgttcccccaaaacagaaagatattcatggcagtgcgtgaaccaatccgtattatgcgggccagctgagaacaaatgtcaggagcttctttgcaagtgcgatcaggagatcgctaattgcctcgcacagacagagtacaacttgaagtacttgttttatccgcagtttctgtgcgagccagactctcccaagtgtgattag

SEQ ID NO: 16649 - DNA, 498 bp, Artificial Sequence
  Description of Artificial Sequence: Synthetic coding sequence
atgggacccctcccagtctgtcttcccatcatgctacttctcctattgccgtccctgctacttctgctgctgcttccagggcccggctcaggagaagcgagccgaatactgcgagtacaccggcgggggattctggaactggccggcactgttggatgcgtcgggccacggacccctattgcatacatgaagtacgggtgcttctgcggcctgggcggtcatggacaaccgcgggacgctattgattggtgctgccacgggcatgattgctgttacactagagccgaggaagccggttgtagccccaaaaccgaacgttactcatggcagtgtgtcaaccagtctgttctatgtggacctgccgagaacaagtgtcaggagctcctctgcaagtgtgatcaggaaattgctaactgtcttgcccaaactgagtataacctgaagtatctgttttatccccagtttctttgtgaacccgactccccaaagtgtgattag

SEQ ID NO: 16650 - DNA, 570 bp, Artificial Sequence
  Description of Artificial Sequence: Synthetic coding sequence
atggcgcttctgagtaggcccgctctgacactgttacttcttttaatggccgctgtcgtgcggtgtcaagaacaggcccagacaacagattggagagcgaccttgaagactattcgaaacggagtgcataagattgatacgtatctgaatgctgccctggatctcctggggggtgaggacggactgtgccagtataaatgttctgacggatccaagccctttcctcggtatggttacaaaccctccccgcctaacggatgtggctcacccctctttggcgtgcaccttaacattggcataccgagcttgaccaagtgctgtaatcagcatgataggtgctatgagacttgtggtaaatccaagaacgactgcgatgaggagttccagtattgcctatctaagatatgccgggatgtgcaaaaaacactgggtctcactcagcacgtccaggcatgcgaaacaaccgtggagttgctattcgatagtgtgatccacctgggctgcaagccctatctggactcacaacgtgcagcctgtagatgccattacgaagaaaaaacagatttatag

SEQ ID NO: 16651 - DNA, 213 bp, Artificial Sequence
  Description of Artificial Sequence: Synthetic coding sequence
atggccctactgtcgcgtcccgctcttacattgcttttgctgctgatggccgcggtggtgaggtgccaggaacaggcccaaaccacagattggcgagcgaccctgaagactatccggaatggcgttcataagatcgatacctacttgaatgcagcattagacctcttgggcggggaagatgggctgtgccagtataagtgcagtgacgcatag

SEQ ID NO: 16652 - DNA, 588 bp, Artificial Sequence
  Description of Artificial Sequence: Synthetic coding sequence
atgaaactggcttcaggtttcctcgtgctgtggctaagcctcggaggtgggttggcacagtctgataccagccccgatactgaggagtcgtactcggattggggcctccgccaccttagagggagtttcgaatctgttaatagctattttgacagctttctggagctgctcggtggaaagaatggcgtctgccagtacaggtgtcgctacggcaaggctcctatgcctcgccccggttacaaaccccaggagcccaacggatgcggatcttattttctcggtctgaaggtacctgagtctatggacttgggcatcccggccatgactaagtgttgcaatcagcttgacgtgtgttacgacacatgcggagcaaacaagtaccgttgtgacgccaagtttcggtggtgtcttcattcaatctgttcagatctgaagagatccctcggatttgtgagtaaggttgaggccgcatgcgactccctggtggacacggtgtttaataccgtgtggactttggggtgtaggcccttcatgaatagtcagagagccgcctgcatttgcgctgaggaggagaaagaggagttgtag

SEQ ID NO: 16653 - DNA, 3876 bp, Artificial Sequence
  Description of Artificial Sequence: Synthetic coding sequence
atggccggagccgcttcaccatgcgccaacggatgtggtcctggcgcaccgagcgatgccgaggtgttgcacctgtgccgatcattggaggtgggtaccgttatgaccttgttctattcaaagaagtcccagagacctgaacgtaaaacatttcaggtgaaactggaaactcggcaaattacgtggagtcgtggggcagataagattgaaggcgctattgatattagggagattaaggaaattagaccaggcaagacctcccgagacttcgatcgctatcaggaagacccggctttccgcccagaccagagtcattgctttgtcattttatacggcatggaatttaggttaaaaactctcagcctgcaggctacatcagaggatgaagttaatatgtggatcaagggactgacttggctaatggaagacaccctgcaggcccctacccctttacagatcgagaggtggctgcggaagcagttctactcagtggacaggaacagggaagacaggatctccgctaaggatctcaaaaacatgttaagccaagtcaactacagggttcccaacatgcgctttctgcgcgagcggctgactgatctcgaacagcgaagcggagatatcacctacggacagtttgcgcagctttataggtctctcatgtacagcgcacagaagactatggacctgccctttctggaggcgagcaccctgagggcaggtgaacgtcccgagctctgccgcgtgtctctgccagagtttcaacagttcctacttgactaccagggagaactgtgggccgtggaccgcctgcaggtgcaggagttcatgttgagcttcctccgtgatcccctgcgcgaaatagaggagccttactttttcctcgacgaatttgtaactttcctcttttccaaagagaactccgtgtggaacagtcaactcgatgctgtgtgccccgatactatgaataaccctctgtcccactactggatcagttccagtcataatacctacctcaccggggaccagttcagctctgagagcagccttgaggcatatgcacgctgcctgaggatgggttgtcgatgtatcgagttggattgttgggatggacccgacgggatgccagtcatataccacgggcacacactaaccacaaaaattaaatttagtgacgtacttcataccattaaggaacacgcgtttgttgcgagcgagtaccccgtgatcctctcaattgaagaccattgtagtatcgcacagcagcgcaacatggctcagtacttcaagaaggttcttggcgatactcttctaactaaaccagtggagatcagcgccgacgggttaccatcccccaatcaactaaagcgcaaaatcctgatcaaacacaagaaactggccgagggctctgcatatgaagaggtgcctaccagcatgatgtactcagaaaatgacatttcgaacagcattaagaacggcatactgtacctcgaggatccagtcaaccacgaatggtacccccactactttgtgctcacgtccagtaagatttactatagcgaggagacctcctctgaccagggtaacgaagacgaagaggaaccaaaagaggtatcgtcttccaccgagttacacagtaatgaaaagtggtttcatggcaaactgggcgccggccgcgacggcagacacattgcagagcgactcctgacagagtattgcatcgagacaggcgccccggacggcagttttctggtaagggagtctgaaaccttcgttggggactataccctctcattttggcggaacggcaaagtgcaacactgcagaattcattcacggcaggatgctgggaccccaaaattctttctgaccgacaacctagtgtttgactccctgtacgatctcataacgcactatcaacaggtgcccttgaggtgcaatgagttcgagatgagattatcagaaccagtaccccaaactaacgcacacgaatccaaagagtggtatcacgcttcgctgacaagagcacaggcagagcatatgctgatgcgggtaccaagggacggggctttcctggtcagaaaacgaaatgaacccaactcatatgctataagctttagggctgagggcaagatcaaacactgccgagtacagcaagaaggtcagaccgttatgctgggcaactccgaatttgactcactcgtcgatctaatcagctactatgagaagcaccccctgtatagaaaaatgaagctgcgatacccaatcaacgaggaggctctggagaagatcggcacagcagagcctgactatggtgcactgtacgaggggaggaaccccggattctatgtggaggccaatcctatgcccacattcaagtgtgccgtgaaagccctctttgactacaaagcccagagggaggatgagctaaccttcatcaaatccgcaatcattcagaatgtggagaagcaagagggaggatggtggcgcggcgactacggtggaaaaaagcagttgtggttcccctccaattacgtcgaagagatggtcaatccggtggccctggaacccgagagggagcacctggacgagaactctccgctgggcgacttactcaggggtgtgttggacgtcccagcctgccagattgctattcgtcccgagggtaagaacaaccgtctctttgtcttctccatctccatggccagcgtggcacattggtccctagatgtcgcggctgattctcaggaggagcttcaagattgggttaagaaaattcgagaagtagctcagactgccgatgctcgccttacagaaggcaaaatcatggaaagacgtaaaaagatcgctctagaattatcggagttggttgtctactgccgccctgtgcctttcgatgaagagaagatcgggactgagcgagcctgttacagagacatgtcaagtttcccggagactaaagctgaaaaatacgtgaacaaggcgaaaggaaagaaatttcttcagtataataggttacaactgagtcgcatctatcccaagggccagcggctagattcttccaactatgaccctctcccgatgtggatttgtgggtctcaactcgtcgccctgaatttccagacccctgacaagccaatgcaaatgaatcaggcactgtttatgactggacggcattgtggatatgtgcttcaaccttccaccatgcgagatgaagcgttcgatccattcgataagtcatccctgcggggactggaaccctgcgcaatcagcatagaggtcctcggggcccgccacctgcctaagaacggcagaggcatcgtttgcccattcgtcgaaatcgaggtagccggcgccgaatacgattccaccaagcagaaaacggaattcgtagtggataacgggctcaatccagtgtggcctgcaaagcccttccatttccagatctccaatcccgagttcgcctttctgcggtttgttgtgtatgaggaagacatgttctctgatcagaactttctcgcccaagccaccttccctgtcaagggcctgaagaccggttacagagccgtgccactaaagaataactattcagaagacctggaactggcatcgctccttataaaaatagatatctttccagctaaacaggaaaatggtgacctcagccccttctccgggacctcactcagagagcgggggtcagacgcttcaggccagctctttcacggtcgagcacgggagggttcattcgaatctaggtatcagcagccatttgaggattttaggatatcccaggagcacctagctgaccattttgactcaagagagagacgagccccccggcggacacgggtgaacggtgacaatcgcctgtag

SEQ ID NO: 16654 - DNA, 3873 bp, Artificial Sequence
  Description of Artificial Sequence: Synthetic coding sequence
atggcaggagccgcctcaccatgtgcaaatggatgtggcccaggcgcaccaagcgacgcagaggttctgcatctgtgccgcagtttggaggtgggtaccgtgatgacactgttttacagtaaaaaatcgcagcggccagaacggaagacattccaggtgaaactggagaccaggcaaattacatggagccggggtgccgataaaatcgagggggccatcgatattagagagatcaaagagattcggcccggaaaaacctcccgggatttcgataggtatcaggaagaccccgcatttcggcccgaccaatctcactgcttcgtaattctgtacggaatggaattccggcttaaaacactgagccttcaagctacaagcgaagacgaagtgaacatgtggattaagggactgacatggctgatggaggacactcttcaggcacccactcctttacagattgagcggtggcttcggaaacaattctacagcgtggacaggaacagggaagacagaattagcgccaaagacctcaaaaatatgctgtctcaggtcaactaccgggtgccgaacatgaggtttctgcgtgagaggttgaccgacttggaacaacgatccggcgacattacctacggacagtttgctcagctctataggtctctcatgtactctgcacaaaagacaatggacttgccttttctagaggccagcaccttgcgcgccggcgagagacctgaactgtgccgcgtcagtctgcccgagttccagcaatttctcctggactaccagggggagctgtgggccgtagatagactccaggtgcaggagttcatgttatcattcctgcgtgatcctctgagggagatcgaagaaccatacttcttcctcgatgaattcgtcaccttcttattttccaaggagaacagtgtgtggaattcgcagctagacgccgtgtgccccgacacaatgaataatccactgtcccattactggatatcctccagccacaatacttatttaacaggagaccagttttctagtgagtctagtcttgaagcatacgccaggtgtctacggatgggctgtcgctgtatagagcttgactgctgggatggacctgatgggatgcctgtaatttatcatgggcataccttgacaacgaagataaagttttcagatgtacttcacaccattaaggagcatgcgttcgtggcgagtgaatacccagtgatcctgagcattgaggatcactgtagtattgcccagcagcgaaacatggctcagtatttcaagaaggtgctgggcgacacactcctgaccaagccagttgaaatttcagccgatggcctgccctcaccaaatcagctcaagaggaaaattctcattaagcacaagaagttggccgaaggttctgcttacgaagaggtcccaacctcaatgatgtactcggaaaatgacatcagcaatagcatcaaaaatggcatactatacctggaggatcccgtgaaccacgaatggtatcctcactactttgtgctaacatcttcgaagatctattactcagaagaaacaagtagtgatcaaggcaatgaggatgaagaggaacccaaggaggtcagcagtagcactgagctgcattctaatgagaaatggtttcacggcaagctcggagccggacgagatgggcggcatatcgcggaacgcctgttaacagaatattgtattgaaaccggcgcccctgacggctcgttcctggtacgggagtctgagacttttgtgggagactacaccctctccttctggcgtaacgggaaagttcagcactgcaggattcatagtcgtcaggacgcggggacacctaagttcttcctgactgacaaccttgtcttcgattccttatacgacctaattactcactatcagcaggtgcccctcagatgcaacgagtttgagatgcggctaagtgagccggtgccacagacaaatgcacacgagtccaaagaatggtaccatgcttcccttacaagggcacaagccgagcatatgttgatgcgggtcccacgagacggcgccttcctggttagaaaaagaaatgagccgaattcctacgctattagcttccgcgccgagggcaaaattaagcactgtcgggtgcagcaggaaggccagaccgtcatgctggggaactctgaatttgattctctcgtagatctgatttcctactacgagaaacacccgttgtatcgtaagatgaagctacgttacccaatcaatgaagaagcgctggagaagatagggactgccgagccggactatggagcactctacgagggccgaaacccaggcttttatgtcgaggcgaacccaatgccaacattcaagtgtgccgtgaaggcattgttcgactacaaagcacaacgcgaagacgagctgaccttcatcaaaagcgcgatcattcagaacgtcgagaaacaggaaggaggttggtggcgaggtgattacgggggtaagaagcagctgtggtttcccagcaattacgtcgaagagatggtgaacccagtggcccttgagccggagagagagcacttggacgagaactcccctctgggcgaccttctgcggggtgtccttgatgtgccagcctgtcagattgccattcggcccgagggtaagaacaatcgcctatttgtcttttccatttcaatggcctcggtcgcccattggagcctcgacgtggcggccgattcccaggaagagttgcaggattgggtcaagaagattagggaagtcgcccagactgctgacgctcgcctgacagaaggtaaaatcatggagcgccggaagaaaatcgctctggagctgtcggagctcgtggtttactgtagacctgtgccttttgatgaagagaagataggcacagagagggcttgctatagagacatgagcagttttcccgaaaccaaggccgagaaatatgtgaataaagcaaagggaaagaaattcctccagtacaatcggctgcagctttcccgtatctaccccaaggggcagcgtctggacagctctaactatgaccccctgccaatgtggatatgcggcagccagctggtggctcttaatttccaaacgcccgacaagccaatgcaaatgaatcaggccctgttcatgaccggtcgccactgtggatatgtgctgcagccaagtaccatgagagacgaagcattcgatcctttcgacaaatcgtcactaagaggtctcgagccctgcgctataagcattgaggtgctcggagcaagacacttgcctaagaacggtcgggggatcgtgtgcccgttcgtagagatcgaagttgcgggtgccgaatacgactctaccaagcaaaagactgaatttgtcgtagataacggactgaatcccgtctggcctgccaaaccttttcactttcaaatcagcaatccagagttcgcttttctgagattcgttgtatacgaggaggatatgttcagcgaccaaaatttcctggctcaggcaacctttcccgttaagggactcaaaacaggctaccgcgcggtgcccctgaaaaacaactacagcgaggatttggagctcgcttccctgctgattaagatcgatatcttccctgccaaagaaaacggagatctgtctcccttttctggaacctcccttagagaaaggggctctgacgcctctggacagctgtttcacgggcgtgctagagaaggttcttttgagtcaagataccagcagcccttcgaggatttcagaatctctcaggagcatcttgcagatcacttcgactctcgcgaaagacgcgccccccggcgaacccgcgtcaacggagacaaccggctgtag

SEQ ID NO: 16655 - DNA, 3876 bp, Artificial Sequence
  Description of Artificial Sequence: Synthetic coding sequence
atggcaggtgccgcctcgccgtgcgctaacggatgcggaccgggggccccctccgatgccgaggtgctgcacctctgcaggtccttagaggtgggcactgttatgacattgttttattccaagaagtcacaacggcccgagaggaaaaccttccaggtgaagttggaaacccgacagatcacgtggagccgaggcgccgacaaaattgagggcgctattgatatcagagaaatcaaagagatccgaccagggaagacaagccgagatttcgatcgctatcaggaagaccctgctttcaggcccgaccagtcccattgctttgtgatcctatacggcatggagtttagacttaaaacgttgtccctccaggctacctctgaggatgaggtcaacatgtggatcaaaggtctaacatggctgatggaagataccttgcaggcccctactcccttgcagattgagaggtggctgaggaagcagttttactcggttgacagaaacagagaggacagaatctccgccaaggatttgaagaatatgttatctcaagtgaattaccgtgtccctaatatgagatttctgcgcgagcggctgacagacctggagcaaagaagcggagacatcacctatggccaattcgctcagctctaccggtctttaatgtacagcgctcagaagacaatggatctaccatttttagaagccagcactctgcgcgccggcgaacgcccagaactatgtagagtgtcgctgccagagtttcagcagttcctgctggactatcagggggaactgtgggcagtagaccgacttcaggtacaggagtttatgctctcatttctgcgcgaccccctccgggagattgaggaaccatacttctttctagatgagttcgttaccttccttttttctaaagaaaattcagtgtggaacagccaactggatgcagtctgccctgacactatgaacaatccgctgagccactactggatctcctcctcgcacaacacttaccttaccggggatcaattctcatcagagtcatctctagaggcctacgcaaggtgtctccggatgggatgcagatgcatcgaactcgactgctgggatggccctgacggcatgcccgtgatctaccacggacacacactgaccactaaaattaaattctccgatgtgttacacaccataaaagagcacgcttttgtggccagcgaatatcctgtaatcttaagtattgaggaccattgctcaatcgctcagcaacgcaacatggcccagtatttcaaaaaggtactgggcgatactttactgacaaaacctgtggagatctcggcagacggtctgcctagccccaaccaactgaaacgaaaaatactcatcaaacataaaaagctcgcagaaggcagtgcgtacgaagaggtccctacttcgatgatgtacagcgagaatgacatttccaactcaatcaagaacgggatcttatacctcgaagatccagtgaatcatgaatggtacccccactattttgtgctgaccagtagcaagatctattatagtgaggagacaagttcagatcaaggcaatgaagacgaagaagaaccaaaagaagtgagctcatccactgagctccatagtaatgagaagtggtttcacgggaagctcggcgcggggcgggacggccgccacattgcagaacgactgcttacagagtactgcattgagacaggcgctccagacggctcattccttgtgcgcgaatccgaaacattcgtgggcgactacacgctcagtttctggagaaatgggaaagtccagcattgccgaatacactctcggcaggacgctggaacaccaaagttttttctcaccgataatctggtcttcgattcgctgtacgacctcattacccactaccaacaggtccctcttcgttgtaacgaattcgaaatgcgcctatccgagccggtcccccaaaccaatgctcacgagtcaaaggaatggtaccatgccagtctgacccgagcgcaggctgagcacatgctcatgcgtgtcccccgcgacggcgcctttctggtcagaaagcgtaatgagcccaattcatacgctataagcttcagggccgaagggaagattaaacactgcagagttcagcaggaaggccagacagtgatgcttggcaattccgagtttgattcattggtagacctcatctcctattatgaaaaacatcccctctatcgtaagatgaagctccgctaccccattaacgaggaggcgctggaaaagattggcacagctgaaccggactacggagctctgtatgagggcagaaacccaggtttttatgtggaggctaacccaatgcctacctttaagtgtgccgtaaaagcgttgtttgattataaagctcagcgggaagatgagttaacatttatcaagtcggcaattatccagaacgtcgagaagcaagaagggggctggtggcggggagattatgggggtaagaaacaactgtggtttccatctaactacgtggaggagatggtgaacccagtagctttggagccagagagggagcacctggatgagaattcaccgttgggagatctactgagaggcgtgctggatgtgcccgcttgccaaattgcgatcaggcctgagggaaaaaacaaccgcttgtttgtcttttccatctctatggcttccgttgcccactggagtctggatgtcgcagccgattctcaagaggaactgcaggactgggtcaagaaaataagggaggtcgctcagactgccgatgccaggctgaccgagggaaaaatcatggaacgaagaaaaaaaatcgctctggagttgtctgagctcgtcgtctattgtcgacctgtgcccttcgatgaggagaagatcggcactgaaagggcttgttaccgcgatatgtcctctttcccagagactaaggcagagaagtacgtgaacaaggcaaagggaaaaaagttcctccagtacaatagactccagctgagtcgaatctaccccaaagggcagcgcttagacagtagcaattacgaccccctcccaatgtggatctgcggctctcaattggtggcgctcaattttcagacaccagataaaccaatgcagatgaatcaagctctgttcatgaccggccggcattgcggatacgttctacaaccctccacaatgcgcgacgaagccttcgatccattcgataaatcatccttaaggggattagagccctgtgcaatttccatcgaggtactgggagcgcgccacttgcccaagaacggacgaggcattgtgtgcccatttgtcgagatcgaagtagccggggccgagtacgattctacaaaacagaagacggagttcgttgttgacaacggcctgaacccagtgtggcctgccaagcctttccacttccagatcagcaatccggaattcgctttcctccgattcgtcgtgtatgaagaagatatgttcagtgaccagaacttcctggcacaggctactttccctgtgaaaggcctgaagaccggctacagagccgtcccccttaagaataattatagcgaagatctcgaactcgcctcactgctcataaaaattgacattttcccggctaagcaagagaatggggatttgtcaccattctcagggacgtccttgcgagagagaggatcagatgcatccgggcagctgtttcatggcagagcccgtgagggatcattcgaatcccgctatcagcagccctttgaggactttcgaatctcccaggagcacctggcagatcactttgactctcgcgagcgccgcgccccccgaagaaccagggttaacggcgacaatagactgtag

SEQ ID NO: 16656 - DNA, 3798 bp, Artificial Sequence
  Description of Artificial Sequence: Synthetic coding sequence
atgtcaaccaccgttaatgtggatagtctcgccgaatacgaaaaaagtcagatcaagagggccttggagcttggcacagtaatgacagtcttcagttttagaaaatctacccctgaacggcggactgtgcaggtgataatggagactcgccaggttgcttggagcaagacggcggacaagatcgaagggttcttagatatcatggaaatcaaggagatccggccaggaaaaaactcgaaggactttgaacgggcaaaggctgtcagacagaaggaggactgttgctttacgattctttacgggacacagttcgttctatccacgttatcccttgccgcagatagtaaagaagatgcggtgaactggctctcgggactgaaaatattgcatcaggaagcaatgaatgccagcacccccaccatcatagaatcttggttgcggaaacaaatttattcggtggatcaaacgaggcgcaacagcatctcactcagggagttaaagactattcttcccctgatcaatttcaaggtatcgagtgccaaatttttaaaggacaagtttgtggaaatcggggcccacaaagatgagctatccttcgaacaattccatctgttttataagaagctgatgttcgagcagcaaaagagcatcctcgacgagtttaagaaagacagttctgtgtttattctgggaaacacggaccggccagacgcctcggcggtctacctccatgacttccagaggtttctaatccacgaacaacaggaacattgggcccaggacttgaacaaagtgagagagagaatgacgaagttcattgatgatacaatgcgcgagacagcagagcccttcctgtttgtggacgagttccttacctatctgttctcccgggaaaattccatctgggacgaaaagtacgacgccgtggacatgcaggatatgaacaatccgctgtcacactactggatcagttcgagccacaacacttacctcaccggcgatcagctcagatcagaatctagcccggaggcctatatacgttgcctgcgcatggggtgcagatgtattgagctggattgctgggacgggccggatggcaagcccgttatctaccacggatggaccagaactactaagatcaaatttgacgatgtcgtgcaagctattaaggatcatgcatttgtgacatccagcttcccagtcatactgtctatcgaggaacactgttctgtggagcaacagcgacatatggctaaagccttcaaggaagtgtttggagatctgctgctcaccaaacctacagaagcatccgctgaccagctcccatcaccgtcacaactcagggagaaaatcattattaagcacaagaaactggggccccgaggcgatgtcgacgttaacatggaagacaaaaaagatgagcataaacagcagggcgagttgtatatgtgggactcaatcgaccagaagtggacgcgtcattactgcgccatcgccgacgccaaactgtctttttcagacgacatcgagcaaactatggaggaagaagtgcctcaggatattccacccacagagttgcacttcggagagaaatggtttcacaagaaggtggaaaaacgcactagcgctgagaagctcttgcaggaatattgtatggagaccgggggtaaggacggcacattcctggtgcgggaatcggaaactttccctaatgattatacactcagcttttggcgttcaggcagagtgcagcattgcaggattaggagtacaatggagggaggaaccctgaagtattatttgactgacaatcttaccttctcatctatctatgccctcattcagcattatagggagacacacttgagatgtgccgagtttgagctgcgcctgaccgatcctgtccccaaccctaatccgcatgaatcgaagccatggtactatgatagcctgtcccgtggagaggccgaggatatgctgatgagaatcccccgtgatggggcctttctcatccggaagagggaaggaagcgactcttatgccattaccttccgagcaagaggaaaggtgaaacactgccggattaaccgtgacgggcggcatttcgtcctgggtaccagcgcctattttgaatccctcgtggaactggttagctactacgagaaacattccctgtacagaaaaatgcggctgcggtaccccgtgaccccagagctgctcgagaggtacaatatggagagagacatcaattctctttacgacgtgtcaaggatgtacgtcgatcccagcgagattaacccttcaatgccacagaggacagtgaaggccctctatgactacaaggccaaacgatctgacgagttatctttctgtagaggcgccctcattcataatgtgagcaaagagccaggggggtggtggaagggggattatgggacccgaatacagcagtattttccatcgaattacgtggaggacatctctacagctgatttcgaagaactcgagaaacagatcatagaggacaatcctctgggctcactgtgtcggggaatccttgatctgaacacctataacgtagtgaaggctccacaggggaagaaccagaagagctttgtctttatcttggagcctaaacagcagggcgacccacccgtcgaattcgcaacagacagggtagaggaattgtttgaatggtttcaatccatcagagagataacatggaagattgataccaaggaaaacaacatgaagtactgggagaagaaccagtctattgccattgaactctctgacctagttgtgtattgtaaacctacctctaagactaaggacaacctcgaaaaccctgactttcgcgagatcaggagctttgttgagaccaaagctgacagcataattagacaaaagcctgtggacctgctgaaatataatcagaagggtttgacgagagtgtaccccaagggtcagcgtgtcgatagttcaaactacgacccattcagactttggctatgtggatctcagatggtcgccttaaattttcagacggcagataaatatatgcagatgaaccatgccctgtttagtctgaacggccgcaccgggtacgtgctgcagccagaaagcatgcgcacagagaagtatgatccaatgcctccagagtcgcagaggaaaatcttgatgaccctgaccgtaaaagtactgggggccagacacttgcccaagctaggcaggagtatagcctgcccatttgtcgaggtggagatatgcggggctgaatacgataataataagtttaagactaccgttgttaatgacaatggcctgagcccaatatgggcccctacccaggaaaaagtcaccttcgagatctatgatccaaacctggcttttcttcgcttcgtcgtgtacgaagaggacatgttctcagaccccaatttcctggcccacgccacgtacccaatcaaggccgtcaagtcaggttttcggtccgtgccactgaaaaatggctattccgaggatatcgagcttgcatctttgttagttttttgcgaaatgcgcccagttctagagagtgaggaggagttgtattcttcctgccggcagttacgcaggagacaggaagagctgaataatcagttattcctatacgatacgcaccagaacttgagaaatgctaaccgggatgcactcgtgaaggagtttagcgtcaacgagaatcagttgcaactgtatcaggaaaaatgcaataaacgcctcagagagaaacgtgtgtcaaactccaagttctatagctag

SEQ ID NO: 16657 - DNA, 2916 bp, Artificial Sequence
  Description of Artificial Sequence: Synthetic coding sequence
atgagcttgaagaatgagcctcgcgttaacacaagtgcgcttcagaagatcgcggccgatatgagtaatattatagaaaacctggacactcgggagctccacttcgagggcgaagaagtggattacgatgtgagccccagtgaccccaagatccaggaggtgtatattcctttttcagctatatataatacacaggggttcaaagagcccaacatccagacgtacctgtctggctgtcccatcaaagcacaagtcctcgaagtggaacgtttcacctctaccacacgggttccatcaattaatctttacacaatcgagttaacccacggcgaattcaagtggcaagtgaagagaaagtttaaacacttccaggagtttcacagagagctgctgaaatacaaggcctttattcggattcccattcctacgcgtcggcataccttcagacgccagaacgtgcgcgaagagccacgcgagatgccaagtctgcccaggtcttctgaaaatatgattagagaggaacaatttctggggagacgcaagcagttagaagattatttaaccaaaatcttgaaaatgcccatgtataggaattatcacgccactaccgagttccttgacatatcacagctcagttttatccacgatctcggacccaagggaatagaggggatgattatgaaacgaagtggtggccaccgtattcctggcttgaactgttgtggacaggggagggcctgctataggtggtctaaacgctggctcatcgtgaaagactccttcctgctgtatatgaaaccagattcaggagccatagcgtttgtcttgctggtggacaaagagttcaaaatcaaagtcggcaagaaggagactgagacgaaatatggcattaggatcgataatctgtcccggacactgattctgaagtgcaactcttaccggcacgcccgctggtgggggggggccattgaggaattcatacaaaagcacggtacaaatttcttgaaggaccaccgcttcgggtcgtacgcggccatccaggaaaatgccctcgctaagtggtatgtgaatgcgaagggatattttgaggacgtggcgaacgcgatggaggaggccaacgaagagatcttcattacagactggtggttgtcccctgaaatatttctaaagagacccgtcgtcgaaggaaataggtggagactggactgtattctcaagagaaaggctcaacaaggtgtcagaatcttcatcatgctctacaaggaggtggaactcgctctgggcatcaatagtgagtacaccaagcgcactctgatgagactgcacccaaacattaaagtcatgcgtcacccagaccatgtgagcagcacagtttacctttgggcacatcacgagaagctggtgattattgaccagtcagtggctttcgtgggcggcattgacctcgcttatggccggtgggacgacaatgagcatcggctcactgatgttggatcagtaaagcgggttacgtcaggcccaagtcttggtagcctcccacccgccgccatggaaagcatggaatcacttagactaaaagacaagaatgagccagtgcagaacctccctatacaaaagagcatcgacgacgttgatagcaagttaaagggtatcggtaaacctcgaaagttcagcaagtttagcctgtataaacagctccatcgtcatcacctgcatgacgccgattctatctcctctattgactcgacttccagctacttcaaccattatcgaagtcaccacaatctgattcatgggctgaagccccactttaaactgttccatcccagctctgagtctgagcagggtctgacccggccacacgccgataccggcagcatccggagcttacaaactggcgtgggggagctgcatggcgagaccaggttttggcacggtaaggactattgtaactttgtgttcaaggattgggttcagctggacaagccctttgctgacttcatcgatcgctactcaacccccagaatgccttggcacgatatcgccagcgccgtgcatggcaaggcagcccgtgatgtggcacggcatttcattcagaggtggaactttacaaagatcatgaaaagcaaatatagatcactatcttatccattcctactgcctaaaagccagacaaccgcacatgagttgcgctaccaggtgccgggtagtgttcatgcgaacgtgcagctgctacgatctgcagctgactggagcgctggtatcaaataccacgaggagtctatccatgctgcctacgttcatgtgatcgaaaactcgcgccattatatctatattgaaaatcagttctttatttcgtgcgcagacgataaagtggtattcaataagatcggggacgctatcgcacagagaatcctgaaagctcacagagagaaccagaagtaccgcgtgtacgtagtgattcctctattacctggtttcgagggagatatctcaacaggtgggggaaatgccctgcaggctattatgcatttcaattacaggaccatgtgtcgaggggagaactcaatcctaggacaattgaaagccgaattaggaaaccaatggatcaactacatctctttttgcgggctccggacacacgccgagctcgagggaaacctggtgaccgagctcatctatgtccattcgaagctgctgatagcagatgacaacaccgtaattatcgggtcggccaatataaatgacagaagtatgctcggtaaaagagactctgagatggctgtgattgtgcaggacacagagaccgtgccatctgtcatggatggaaaggagtaccaggctggccgatttgccagaggactacggttgcagtgctttcgaagtaagatgacaccaggagtcgaagacccttag

SEQ ID NO: 16658 - DNA, 1794 bp, Artificial Sequence
  Description of Artificial Sequence: Synthetic coding sequence
atgtctttaaagaatgagcctagggtgaacacatctgctctgcagaaaatcgccgcggatatgagtaatatcattgaaaatttggacactcgcgagttacatttcgagggggaagaggttgattacgatgtgagcccctcagatcccaagatccaggaagtctacattcctttcagtgctatctataacacccaggggttcaaagaaccaaatattcaaacttatttatccggctgtcctattaaggcccaggtcctggaagtggagaggttcaccagcactactcgtgtgccatccataaatttatacacgattgaactcactcacggtgagtttaagtggcaggtgaagaggaagttcaagcattttcaggaatttcacagggaattactcaagtacaaagcgttcatcaggatacctatccctacacggcgtcacacattccggcggcagaatgtgcgcgaagagccacgcgagatgcctagccttccacggtcatctgaaaacatgatccgggaagaacaatttttgggcaggaggaaacaactggaagactatctcactaaaattctgaaaatgccaatgtatcgcaattaccacgccaccaccgagtttcttgacatatcccagctgtctttcattcacgacctgggcccaaagggaattgaaggaatgatcatgaagcggagcgggggccaccggatccccggacttaattgttgcggacaggggcgtgcatgttacaggtggtctaaaagatggttgatcgtgaaggactcattcctcctgtatatgaagcctgactccggcgcgatagcgtttgttctgctggtggacaaagagttcaagataaaagtaggaaagaaagagactgagacaaaatatgggatacggatcgacaatctgtccaggacactgattctgaagtgcaattcataccggcatgccagatggtggggcggagccattgaagagttcatacaaaagcacggtacgaactttcttaaagaccaccgatttggatcttacgctgcaatacaagagaacgcacttgctaagtggtacgtcaatgccaagggatattttgaagacgtggcaaatgcaatggaggaagccaatgaagaaatctttataaccgattggtggttgtccccggagatttttctcaagcgaccggtggtggagggtaacaggtggcggctcgattgcattttaaagagaaaagctcagcagggcgtccgcattttcattatgttgtacaaagaggttgagttagctctgggcatcaattcagagtatactaaacgtaccttaatgcgtctgcatcctaacattaaggtcatgagacatccagaccacgtttcctccacagtgtatctttgggcccaccacgagaaactagtgataatcgatcagtctgtcgccttcgtgggagggatagatcttgcatatggtcggtgggatgacaacgaacatagactgacagacgtcggctctgtaaagcgcgtgacctcaggtcccagcctgggctccctgccgatacccggacccagtgttgtgtataggcaggtttgggagagctgtatggggaagcctgatagtggaatggaacggacaacagccattagtagtagtaagacaggttttaaccttatcaatctgttgctcatcagcctcactggaacccccagacctggctgccctgggatgaccctgcctctccagtccactggaaggcgcctggtaatgtggcacgtcactagctcttccgccgggacctcccagaaattgtag

SEQ ID NO: 16659 - DNA, 3225 bp, Artificial Sequence
  Description of Artificial Sequence: Synthetic coding sequence
atgagccttaaaaatgaacccagggtaaatacttcagcactgcagaaaatcgctgccgatatgtccaatattattgaaaacttggacactagggagctgcacttcgagggcgaggaagtcgactacgatgtttctcctagtgatcccaagatccaggaggtgtatatcccattcagcgctatatacaacacccagggctttaaggaacctaatatacaaacctatctgtcagggtgtcctattaaggctcaggtgctggaagttgaaagatttacatccactacaagagtccccagcatcaacttatatactatagagcttacacatggggagtttaaatggcaggtaaagcggaagttcaaacactttcaggagtttcatagagaactgcttaagtataaagcatttatccggatacccatcccaacacggaggcacaccttccgtaggcagaacgtccgggaggaacctagggagatgccctcattgcctcgtagttctgagaacatgattagggaagagcagttcctgggccgccgcaagcagttggaagactaccttaccaagatccttaaaatgccgatgtaccggaactatcacgcaactactgagtttttggacatctctcagctgagtttcatccatgatcttgggcccaaaggcatagaggggatgatcatgaagcgctccggaggccacaggattccagggctcaactgttgcgggcaggggcgggcttgctaccgctggtctaagcggtggctgatcgtgaaggactcttttctgctctacatgaagccagactccggggccattgcctttgtattgctcgtggacaaagaatttaagattaaagtggggaagaaggagactgagactaagtacgggattagaatcgacaatctgtctaggacgctgattctgaagtgcaattcctacaggcatgccagatggtggggtggtgcaattgaggaatttattcagaaacatggtaccaactttctgaaagaccataggtttggctcttatgctgcaatacaggaaaatgccctggctaaatggtatgtaaatgcgaagggttacttcgaagatgtggccaatgccatggaggaagcaaacgaggagattttcattactgactggtggctgtctcctgaaatatttttgaagcggcccgtcgtcgaaggcaacaggtggagactggactgtatcttaaaaagaaaagcccagcagggagttagaattttcatcatgctgtacaaggaagttgaattggcactcgggatcaacagtgagtacacaaagcggaccctcatgagactacatcccaatataaaggtaatgcggcaccctgaccatgtgagctccacagtctatttatgggcccatcacgaaaagctagtgataatcgaccagagcgtggcctttgtgggaggcattgatctggcctatggcaggtgggatgacaacgagcacagactcactgacgtgggctctgtcaagcgcgtgaccagtgggcctagcttgggcagtctgccacccgcagctatggaatcaatggaatcactgaggctcaaagacaaaaatgaacccgtgcagaatcttccgattcaaaagagcatcgatgatgttgacagcaagctgaagggaataggaaagccccggaaattttctaagttcagcctgtacaagcagttgcaccggcaccatctacacgatgctgactccatctcttctatcgattctacatccagctattttaatcattaccggagccaccacaatctgatccatgggctcaaaccacacttcaagctttttcacccctcttccgaatcagaacagggtctcactaggcctcacgctgacactggctcaatacgtagcctccagaccggggtcggggaactacacggtgaaactcggttctggcacggcaaggattattgtaatttcgtgttcaaggactgggtacaactggacaaacccttcgcagacttcatcgatcggtattctaccccaaggatgccatggcatgacattgcaagcgcagtccacggcaaggcagcccgagatgttgcacgtcattttatccagaggtggaatttcaccaagatcatgaaaagcaaatataggagcttatcctatccgttcctgctacctaaatctcagacaactgcacatgagctgcgttaccaggtacccggctcagttcatgccaacgttcagctgctgcggtcggctgctgattggagcgctgggatcaagtatcatgaagaatctatacacgctgcctacgtccatgtaattgagaactccaggcactacatttatatcgagaaccaattttttatatcttgcgctgacgacaaggtagtgtttaataaaatcggcgacgcgatcgcccagagaatcttaaaggctcacagagaaaatcagaaatatagagtgtatgtggtgattccactgctgccaggctttgaaggggatatctctaccggcgggggaaatgcactacaggcaatcatgcacttcaactaccgcacaatgtgtcggggtgagaactctattcttgggcagctgaaggcagaactgggaaatcaatggatcaattatatctccttctgtggactcagaacgcatgccgagctcgagggtaatttagtcacagaattgatttacgtccactcaaagcttttgattgcagacgacaacacagtaatcatcgggagcgcaaatattaacgacagatccatgctgggcaaaagagacagcgagatggccgttattgtccaggataccgagaccgtgccatcagtgatggacggcaaggaataccaggctggccgattcgccagggggctgcgcctccagtgtttccgcgttgtgctggggtacttagacgatccaagcgaggacattcaggatcccgtgtcagataagttcttcaaggaggtgtgggtttctactgctgctcgaaatgcaaccatttacgataaagtctttcgatgtttgcccaacgacgaggtacataacctaattcaactgagggacttcatcaacaaacccgttctagccaaagaagaccccattcgagccgaagaggaattaaagaagatccgaggatttctcgtacaattcccattctatttcctgagcgaggaaagcctcctgcccagcgttgggactaaggaggcgatcgtgccaatggaagtgtggacctag

SEQ ID NO: 16660 - DNA, 3111 bp, Artificial Sequence
  Description of Artificial Sequence: Synthetic coding sequence
atgtcactcaagaacgagcccagggtgaatacctcagctctgcaaaaaatcgctgcagatatgagcaatattattgagaatctagacacccgagaactgcatttcgagggtgaggaggtggactacgacgtgtctcctagcgacccaaaaattcaggaggtctatatcccattctccgccatttataatacacaggggttcaaggagccgaacattcaaacctacctttctggctgcccaatcaaggctcaagttcttgaagtggagaggttcacaagcactacacgcgtccccagtattaatctatacacaatcgagctcactcatggagagttcaagtggcaagtgaagagaaagtttaaacattttcaggagtttcaccgcgaattgctgaagtataaggcgttcatcaggattccgatcccaacccgaagacacaccttccggcggcagaacgttcgtgaggagcctcgggagatgccttctctccctcgcagctccgagaatatgatcagagaggaacagtttctcggtcgcaggaagcagttggaagactaccttaccaagattctcaagatgcctatgtaccggaactaccatgcgactacagagtttttggacatcagccagctgagctttatccatgatcttggccctaagggaatcgaagggatgatcatgaagcgctccggggggcacaggatacccgggcttaactgttgcggtcaagggcgggcctgctaccgttggagtaaaaggtggttgatagtaaaggactccttcttactttacatgaagcctgatagcggcgcgatagcgtttgtattgcttgtggataaggagtttaagataaaagtgggaaagaaggaaacagagacaaaatacggtattaggatcgataacctgtccaggactctgattctgaaatgtaactcctaccgacacgcccgctggtgggggggggccatcgaagagttcatccaaaaacatgggacgaactttctcaaggaccatcggttcgggagctacgccgcgatccaagaaaatgccctggcgaagtggtacgtcaacgccaagggctatttcgaagatgtagcaaacgctatggaggaggctaacgaagaaatctttattactgattggtggttgagccccgaaatctttttaaaacgccctgtcgtagaggggaacaggtggaggctggattgcatactgaagcgaaaagcacagcagggagtccgcattttcatcatgctttacaaggaggttgaacttgccctcggcatcaattcggaatacacgaaacggactctgatgcgcctccacccaaacatcaaagtaatgcggcaccccgaccacgtgagtagtactgtctacttgtgggcccaccacgaaaagctcgtcatcatcgatcagtctgtcgccttcgtgggcggcatagatctagcctatgggaggtgggatgacaacgagcatcgcctgactgatgttggcagcgtcaagagagtcacgtccgggccttctttgggatccctgccgcctgcagccatggaatccatggagtcactccgcctcaaagacaagaatgagcccgtgcaaaatttgcccatccaaaaatcaattgacgatgtcgactctaagcttaaaggaattggtaagcccagaaaattttcaaaattttccctgtacaagcaactgcaccgccaccatctacatgatgccgatagtatttcatccatcgatagtacctccaatacgggctcgattcgtagccttcagacaggggtgggcgagctgcacggggaaacccgattctggcacggcaaggactattgtaactttgttttcaaagattgggtgcaactagacaagccgttcgccgatttcattgacaggtattctaccccacggatgccctggcacgacattgcttctgccgtgcacggaaaggctgcacgcgatgtggctagacattttatccagagatggaacttcacaaagattatgaagtccaaatacaggtctttgtcttacccttttttgcttcccaagagccagactacagcccacgagctacgataccaggtaccaggatcggtgcatgccaatgtgcagctgctcagatcagcggcggactggtcagctgggattaaataccatgaagaaagtatccacgcagcctacgttcacgtcatagaaaattctcgccactatatttatattgagaatcaattttttatatcgtgtgctgatgacaaggtcgtctttaataagatcggagatgctatcgctcagagaatactcaaggcccacagggaaaaccagaagtatcgggtgtacgtggtgatacccctgcttcctggattcgagggcgatatctctacaggcggcggtaacgcccttcaggctatcatgcatttcaactatagaacaatgtgccgaggggaaaactccatcctggggcaactgaaggccgagctgggaaaccagtggatcaattacatctctttctgtggcctgcgcacccatgctgaattggagggaaatctcgtgactgagctgatttacgtccatagcaaactcctgatcgccgacgataacacagtgattatcgggtccgccaacatcaatgatcgctctatgctcggaaagcgggactccgaaatggccgtgattgtgcaggatacagagaccgtgccatcggtgatggatggcaaagagtaccaggcgggccggtttgcccgcggtctgaggttgcaatgtttccgggttgtgctgggatacctcgatgatccttccgaggacatccaagatccagtcagtgacaagttttttaaggaggtgtgggtatcaaccgctgcacgcaatgcaactatatacgacaaggtattccggtgcctgcccaatgatgaggtgcacaatctgatccagctgcgcgactttatcaataaaccagtcttggcgaaggaggatcccatcagggccgaggaggaactgaagaaaatcagggggtttctcgtccagttcccattttatttcttatcagaggaatccctcttaccatccgtcgggaccaaagaggctatcgtgcccatggaggtgtggacatag

SEQ ID NO: 16661 - DNA, 429 bp, Artificial Sequence
  Description of Artificial Sequence: Synthetic coding sequence
atgagcctgaaaaatgagccaagggtcaacacgtccgccctccagaaaatagctgctgacatgagtaacatcatagagaacctagataccagggagctgcattttgagggcgaggaagtcgactacgatgtctccccttcagatcccaaaattcaagaggtgtacattccctttagcgctatttataacactcaaggtttcaaggaaccgaatatacagacctacctttctgggtgcccaattaaagcccaggtgctcgaggtggaacggttcacatctaccaccagagtgccaagcatcaacctctacacaatcgaactgacacacggggagttcaaatggcaagtgaagaggaagtttaagcatttccaggaattccaccgagaactcctaaaatataaagcctttataaggatcccgatcccctag

SEQ ID NO: 16662 - DNA, 2580 bp, Artificial Sequence
  Description of Artificial Sequence: Synthetic coding sequence
atgtactccggtgcagggcctgctcttgccccacctgctcccccaccccccatccagggctatgcttttaagccaccaccccgccctgattttggcacatctggcagaacaatcaagttgcaggccaatttcttcgaaatggatattcctaagatagatatctaccattacgagcttgatatcaaacccgagaagtgcccaagacgcgttaatcgagaaatagtggaacacatggtccaacatttcaagactcaaatttttggtgaccgaaaacccgtgtttgacggccgaaagaacttgtataccgccatgccattgccaatcggcagggataaagtcgaactagaagtgaccctccctggcgaggggaaggatcggatcttcaaggtgtccattaagtgggtgtcatgtgtgagccttcaggctctacatgatgctttgagtggccgtctccctagcgtgcccttcgagacaatccaggccctggatgtggttatgcgtcacttgccctccatgcgatatactcccgtgggaagatcttttttcaccgctagcgaaggctgctcgaatcccctaggcggtggccgggaggtgtggtttgggttccaccaatctgtgagaccctcgctgtggaagatgatgcttaacatcgacgtctctgcaactgccttctataaggcccagcctgtcattgaatttgtgtgtgaggtgttggattttaagtcaattgaggaacaacagaagccactgacggatagccagcgcgtgaagtttaccaaggaaataaaggggctaaaggtggagattacccactgtgggcaaatgaaaagaaaataccgagtatgcaatgttacccggaggcctgcctcccatcaaacatttcctctgcagcaggaaagcggccaaacggtagaatgtactgttgcccaatactttaaagacagacataaactcgtgctccgataccctcacctgccgtgccttcaggtgggtcaggaacagaaacatacctacctccctctcgaggtgtgcaacatcgtcgcagggcaacgatgtatcaagaaacttaccgataaccagacatctactatgatccgggctacggcccgcagcgcacccgatagacaggaggagattagcaaattgatgagatcggcctcttttaacactgacccttacgtgcgggaattcgggataatggtcaaggacgagatgactgatgtgaccgggagggtgctgcagcccccatctatcttgtacggggggagaaataaggccatcgctacacccgtccagggagtgtgggatatgaggaataaacagttccatacggggattgagattaaagtctgggcgatcgcctgcttcgcccctcagcgtcaatgcactgaggtccacctgaagtccttcaccgagcagcttaggaagatctctcgggacgcgggtatgcccatccagggtcaaccttgtttctgcaagtacgctcagggggcagatagtgtggaacccatgttccgtcacctgaaaaatacctacgcgggtctccagttggtggtcgttatcctgccaggcaaaactcccgtgtacgccgaggttaagcgtgttggcgatacagtcctggggatggctactcagtgtgtccagatgaagaatgtccaacgcacaactccacagaccttgtccaacctctgccttaagattaacgtgaagcttggcggagtaaacaatatcctgctgccccagggtcgacctcccgtgtttcagcaacccgttatatttttgggagctgatgtcacacaccctcccgcaggggacggcaagaaaccttccattgccgcggtggtcggctcaatggatgcccatccgaaccgctactgcgccacagtgagagtccaacagcaccgccaagagattattcaggacctggcggccatggtgagggagctgctgatacagttctacaaatccaccaggttcaaacctacacgtatcatcttttatcgagatggcgtctccgagggccagttccagcaggtgttgcatcatgaactgctggccatcagagaagcatgcataaagctggaaaaggactaccaaccgggcatcacttttatagtcgtgcaaaagcgacaccatactcgcttgttctgtactgacaaaaatgaaagagtcggaaaatcggggaatatccctgccggcacgactgtcgacacaaagatcacccaccctacggagtttgacttttatctgtgttcccacgcggggatccaggggacttcccgcccctcccattaccacgtgctctgggatgataacagatttagttccgacgaactccagatcctgacgtatcaattatgccacacttatgtgagatgcacccggtcagtgtcaatccctgccccagcatattatgctcacctcgtggcctttcgcgcacgctaccacctggtagataaagaacacgactcagccgagggatcgcatacctccggacaatctaacggccgagaccaccaggccctcgctaaggcagtgcaggttcaccaggatacgctcaggactatgtattttgcttag

SEQ ID NO: 16663 - DNA, 1926 bp, Artificial Sequence
  Description of Artificial Sequence: Synthetic coding sequence
atgctgtccggaatcgaagccgctgccggcgaatatgaggattctgagttgagatgtagagtcgcagtcgaagaactgtcaccaggagggcagcctcgcagacggcaggccctcaggaccgcggaactgtctctgggcaggaacgagcggagggaactgatgctcagattacaagcacctggacccgcagggaggccccggtgttttcctctccgcgccgcccgattgttcactcggttcgcagaggctggaaggtcaaccctacggttgcccgctcatgacacacctggggctggagcagtccaacttctgctgagcgactgtccacccgatcgactgcgccgctttctgaggaccctgcgacttaagctcgccgccgcccccgggcctggccctgcatccgcccgtgctcaacttctggggccaaggccacgagatttcgtcactatctcaccggtgcagcctgaagagcggcgtctgagagccgcgacccgagtgccggatacaacgttagtgaaaaggccagtcgagccacaggccggagcagaacccagtaccgaggctccccgctggccactgcccgtgaagcgcctgtccttacctagtacgaagccacagctgtctgaggagcaggccgctgtgctgcgcgcagtacttaaaggccagagcatcttttttacaggctccgcaggaacaggaaagagctatctgttaaagaggattctaggcagcctccctcctactggaaccgtcgcaaccgcgagtacaggggtcgccgcctgccacatcggggggactaccttgcacgccttcgcaggaatcggctcagggcaggcgccgctagcacaatgtgtagctttggctcaacggcccggggtgaggcagggttggctgaactgtcagcggcttgtcatcgatgaaatcagcatggtcgaagcggatctcttcgacaagttggaagctgtagctagggctgtccgccagcagaataaacccttcgggggtatccagcttattatatgcggcgatttcctgcaactcccacccgttaccaaggggtcccaaccacctcgattttgttttcagagcaagtcctggaagcgctgtgtgccagtgactctagaattaacaaaggtctggagacaagcagaccaaaccttcatctccctgctccaggcagtgaggttgggcagatgcagcgacgaggtgacccgtcagcttcaagccaccgcatctcacaaagtaggacgggacgggatcgtcgcgactcggctgtgcacccatcaggacgacgtagcccttacaaatgaaagacggctccaggaactgccgggtaaggtgcatagattcgaagcaatggattctaatcctgagctcgccagtactctggacgcccaatgtcccgtcagccagctactccagttgaaactaggagctcaggtgatgctggttaagaacctttccgtgtctcggggcctggttaacggagcccgaggagtggtagttgggttcgaggctgagggccgcgggctcccgcaggtgaggttcctctgcggagtaactgaggtcatacacgcagatcgttggacagtgcaggcgactggaggtcagctgcttagtcggcagcaattgcctttgcaactagcttgggccatgtcgattcacaagtcccagggtatgacactggattgtgtggagattagcctcggcagagtatttgcctccggtcaagcctatgttgccttatctcgggccaggtcgttgcagggtcttcgcgtattggacttcgaccccatggccgtgcgttgtgatccgcgggttctgcatttttatgcaacgttgcggcggggacgcagcctgagtctggagtctcctgacgacgatgaggcagctagcgaccaggaaaatatggatccaattttatag

SEQ ID NO: 16664 - DNA, 2124 bp, Artificial Sequence
  Description of Artificial Sequence: Synthetic coding sequence
atgttgagcggtatcgaggccgcggccggggagtatgaggattcagagctccgctgtcgggtggctgtagaagagctctctcccggcggccagcccagaagacgtcaggccctacgtactgctgagctgtctctgggccgcaacgagcgcagggagctaatgcttcggttgcaggctcctggaccagcaggaagacccaggtgcttcccgttaagggcggcccgccttttcacccggtttgccgaggccggcaggagtacactcagacttcccgcacatgacacacccggagctggggccgtgcagctgctgctctccgattgtcctcccgatagactgaggagattcctaagaaccttgagattgaaacttgccgccgctccaggcccaggacctgcaagtgcccgcgctcagttattggggcccaggccccgcgattttgtgactattagccccgtccagccagaggagcgcaggctgagagcagccacaagggtgccagatactacattggtgaaaagacctgtcgaaccccaggccggcgccgagccttctactgaagccccaaggtggccactacccgtgaagcggctgagcctcccctctacgaaacctcaactatccgaagaacaggcagcagttctgcgcgcagtgctcaaagggcagagtatcttttttaccggttccgcgggaaccggcaagagctacctcctcaagagaatcctcggaagtctgcctcctactggcacagtggctaccgcgtcaaccggggtggctgcatgtcatatcggaggtacgacactgcacgctttcgctggaatagggtctggccaagcgcctctggctcagtgtgtggctctagctcaaagaccgggcgttaggcagggctggctgaattgtcagagattggtaatcgatgaaattagcatggttgaggccgacctatttgacaaactggaagctgtggcacgcgcagtaaggcagcagaataaaccctttggagggattcagctaatcatctgcggggacttcctccagctcccacctgtcactaagggatcccagccacctcggttctgctttcaatctaaatcctggaagcgctgtgtgccagtcactctcgagctaaccaaagtttggaggcaagccgatcaaacattcatttccctgctacaggccgtgcgactgggccgctgcagcgacgaggtgactagacaactgcaagctaccgcctcccacaaggtcggacgtgatgggattgttgcaactagactgtgcactcatcaggacgacgtcgcattgaccaacgagaggagactgcaggagctacctgggaaggtgcacagatttgaagccatggacagcaaccctgagttagctagtacactagacgcacagtgcccggtttcccaattgctgcagctgaagctcggggcccaggtgatgctggtgaagaacctaagtgtgtccagagggttggtgaatggtgccagaggggttgtggttgggtttgaggccgagggacgaggcctgccgcaggtgagattcctatgcggtgtcaccgaggtcatccacgccgaccggtggactgtccaggctacggggggccaactgctgtcccgccagcagttaccgctgcagctggcatgggccatgtccattcacaagagtcaaggcatgacactcgactgcgtagagatttcgctgggccgagttttcgcgtccggacaagcttatgtagctctttcacgagctcgctccttacagggactgagagtgttggacttcgacccaatggccgtgcggtgcgacccgagagtgcttcatttttatgccacactacggcgtggtcgcagcctgtctctggcggctgaggggcgcgggaacgaggacaggtgcagcggtagctccatacgagcccttggaggggattggtggggattgagactcggggctgctagcaagcagaggaccgaattgaggtgtgtctcaaccgccagaccttctctggcgcagcccagaactaacactctccagtccctgacaaaggaacacaagctgcagaatgtccacccttattttaaactactctttcaggggataaactctgtctggggtcactag

SEQ ID NO: 16665 - DNA, 1926 bp, Artificial Sequence
  Description of Artificial Sequence: Synthetic coding sequence
atgctctccggcattgaagcagcagctggggaatatgaggattccgagttgcgctgcagggtggccgtggaagagctctcccctggtggacaacccagacggcgccaggctctgcgaactgcagaactttccttaggacgtaacgaaaggcgcgagttaatgttgcgcctgcaggctcctgggccagccggcaggcctcgctgctttccattgcgcgccgcccgactgttcacgaggttcgctgaggcaggaaggtcaaccttgagactcccagcccatgacacacctggcgctggcgctgtgcaactgctcctgtctgactgtcctccagacaggctccgaaggtttttgcggaccctccgcctcaaactagccgcagcgccaggccccggcccggcgtccgcacgggcacaactcctggggccccggccacgggacttcgtcacaatatccccagtgcaacccgaagaacggcggctccgggcagcgacccgtgtccctgatacaacgctggtgaagcggcctgtagaaccccaggcgggcgcagaacctagcaccgaggctccacggtggccactgccggtgaaaaggctgtctttaccaagcacaaaaccgcaactgtccgaagaacaggctgcggttctcagggctgtgttgaaggggcagtccatcttcttcacgggctccgccggcacgggcaagtcttacctgttgaagcgcatcttaggcagcctccctcctaccggaacagtggcgacagcgtccacaggcgtcgcagcttgccacataggaggaacaacactgcacgcctttgctggcatcgggtccggacaggcccccctggcccagtgtgtcgcacttgcgcagcgccctggagtgcgccagggatggctgaattgccaaagactcgtaatagacgaaattagcatggttgaagcagatcttttcgataaattggaagccgtggccagagcagttagacaacagaataaaccattcggcgggatccaactcatcatctgcggagactttttacagctaccccccgtaacaaagggcagtcagcctccacggttttgttttcagtcgaaaagctggaagcgatgtgtccccgtcactctggaactcactaaagtctggaggcaggcggaccagacattcataagcttgctgcaggcagtacggttgggacgctgctcagatgaggtgaccaggcagctacaggcaactgcctcccataaggtcgggagagacgggatcgttgcaacacgcctgtgcacacatcaggacgacgtcgccttgacaaacgaacgccgccttcaggaattaccagggaaggttcaccgattcgaggccatggattctaaccccgagctcgcatcgacactcgatgctcagtgccctgttagtcagttgttacaacttaaattgggggctcaggtcatgcttgtcaagaatctgagtgtatcccggggtttggttaatggtgctcgcggcgtcgtcgttggctttgaggctgagggcagggggctaccacaggtgcgcttcttgtgcggggtaacggaagtaatccacgcggacagatggactgttcaagcaactggtggccagctgctgtcgagacagcaactgcctctgcagttggcttgggcaatgtcgatccataagtcacagggcatgacactggattgtgttgaaatatctctgggtcgagtcttcgcaagtgggcaagcttacgttgccctttcccgggctcgaagcctgcaaggcctcagagtgctggatttcgaccccatggctgtccgttgtgatcctcgtgttctgcacttctatgccactctccgtaggggtcgctccttaagtctggagtccccagatgacgacgaggcagcttcagaccaggagaatatggatcccattctgtag

SEQ ID NO: 16666 - DNA, 801 bp, Artificial Sequence
  Description of Artificial Sequence: Synthetic coding sequence
atgctgtccggcattgaagctgccgccggggagtacgaagatagtgaactgcgttgccgtgtcgccgtggaagaactgtcccctggcggacagccaaggcgcaggcaagctcttcgtactgccgaattgagtctgggtaggaatgagaggcgggaactgatgctgaggctccaggctcccgggcccgcggggagacctaggtgctttccgcttagagctgcacgcttgttcacaagatttgcggaagccggtcgcagtacccttcgattgcccgcccacgacacacccggggctggcgcagttcaactcttgttatccgattgccccccagatagacttagaaggtttttacgcactttacgcttgaagcttgctgccgcacctggaccgggcccagcctctgcgcgtgcccagttgctcggtccgcggcccagggatttcgttacaatcagtccagttcagcctgaggaaagacggttgcgcgcggccacaagagtcccggatactacactggttaaacgtccggtggaaccccaggccggtgccgagccctccacagaggctcccagatggcctttacctgtgaagcggctttccttaccctccacaaagccacagctttctgaagaacaggctgccgtactccgggctgtgctgaaggggcaaagcattttctttactggatcagctggctctggaggtagagaagaagtgggaggacagtggtgggggggtatcgaagagcaaggtgacctgtccaatttcgccccagtgcaggagcaaggcagccatatctgctag

SEQ ID NO: 16667 - DNA, 987 bp, Artificial Sequence
  Description of Artificial Sequence: Synthetic coding sequence
atgagcatgctagctgagagaaggcgaaaacaaaaatgggctgtcgacccccaaaacaccgcctggtcgaatgacgacagtaagtttgggcagcggatgctggaaaagatgggttggagcaaaggaaaagggctgggcgcccaggaacaaggcgcaactgatcacattaaggttcaggtcaaaaataatcatctgggcctgggcgctaccatcaataacgaagataattggatcgctcatcaggacgattttaatcagttgcttgctgaattgaatacttgtcacgggcaagagaccaccgacagtagcgacaagaaggagaagaagagcttcagcctggaggagaagagtaagatcagcaaaaatagggtccactatatgaagtttacaaaggggaaggatctgtcctcccgctcgaagaccgatttggattgcatctttggcaagcgtcagagcaagaagacccccgagggtgatgcgtctccttccactccggaggaaaatgagacaaccacaaccagtgcattcactatacaggaatactttgccaagaggatggcagctcttaaaaacaagccacaggtgccggtcccaggaagtgatatatctgagactcaagtcgagcggaaacgcggaaaaaaacggaataaagaggccaccggtaaagacgtggagtcgtacctgcagcctaaagccaagcgacataccgaggggaagcccgagcgggctgaagcccaagagcgagtggcgaaaaaaaaatccgcgccagcggaggaacagctgcggggaccttgttgggaccagagctccaaggcctctgctcaggacgcgggggaccacgtccagcctcctgaaggccgggacttcactttgaagccgaaaaagaggaggggaaaaaagaagctgcagaaacccgttgagatcgctgaagatgcaacccttgaggaaactttggttaagaagaagaagaagaaggactctaagtag

SEQ ID NO: 16668 - DNA, 519 bp, Artificial Sequence
  Description of Artificial Sequence: Synthetic coding sequence
atgctggcagagcggcggagaaaacagaaatgggctgtggacccccagaacacagcatggtccaacgacgattccaagttcggtcagagaatgctcgaaaagatgggctggtctaagggcaaaggactgggtgctcaggagcagggagcaactgatcatattaaagtccaggtgaagaacaatcacctgggccttggcgctaccataaataacgaggataactggatagctcaccaagacgatttcaaccaactgctggcggaattaaatacctgtcacggccaagaaaccactgacagcagtgataaaaaggagaagaaatcgttcagcctcgaagagaaatcaaagatctcaaagaatcgtgtgcattatatgaagttcactaaaggtcggtgtcagtctctgcattccaggggggaaaggaatcacgataatcagcggttgcaccatcccggggtgctttgccaggccgatggcagcactgaggaacaagccccagggtcctctagtcgcgtgtag

SEQ ID NO: 16669 - DNA, 525 bp, Artificial Sequence
  Description of Artificial Sequence: Synthetic coding sequence
atgagtatgctcgcagagaggagacgaaagcagaaatgggccgttgatccgcagaacaccgcttggagcaatgacgatagcaaattcgggcagagaatgctcgagaagatgggctggtcaaaaggtaaggggctgggcgctcaagagcagggtgctaccgaccacatcaaggtacaagtgaagaacaaccatctgggccttggggctacgatcaataacgaagacaattggatcgctcaccaagatgactttaatcagcttctggcagagctcaatacatgccacgggcaggaaaccaccgattctagtgacaagaaggagaaaaaatcttttagcctggaggagaagtccaaaattagtaagaacagagtgcactacatgaaattcactaaagggcgctgtcagagcctgcactccaggggggagagaaaccacgacaaccagaggctccatcatccaggagttctctgtcaggccgatggtagcactgaagagcaggcccctggctctagtagcagagtctag

SEQ ID NO: 16670 - DNA, 972 bp, Artificial Sequence
  Description of Artificial Sequence: Synthetic coding sequence
atgcccgttcattcccgcggggataagaaggagactaatcaccacgacgaaatggaggtggactacgccgagaatgaaggttcttcatccgaggacgaggatactgaatcctcctcggtctccgaggatggggattctagtgagatggatgacgaggactgtgaaagacggaggatggagtgcctagatgaaatgagcaatctcgagaaacagttcactgatcttaaggaccagttgtacaaggaaagactgagccaggtggacgcaaaactgcaggaagtaatagccggcaaggccccagagtatctggaaccgttagccactttacaggagaacatgcagatcaggacaaaggtagccggtatctatagggagttgtgcctcgagagtgtgaagaacaagtatgaatgcgagattcaagctagtagacagcactgcgaatccgaaaaactcctgctgtatgatactgtccagtctgaactcgaagagaagataagacgcctagaggaagacaggcatagtatagacatcactagtgaactgtggaacgatgagctacagagtcgtaaaaagcggaaagacccatttagtcctgataaaaagaagccagtagtggtgtctggaccatacatcgtgtacatgctccaagacctcgacatccttgaggactggacaactatacgaaaagcaatggccactctgggacctcaccgggtgaaaaccgaaccaccggtgaagcttgagaaacatttgcatagtgcaagaagtgaggagggccgtctgtactacgatggtgaatggtatatcagaggccagacaatttgcatcgataagaaggatgagtgtccgacgtccgccgtcattactacaattaatcatgatgaagtgtggtttaaacggccagacggttctaagtcaaagctctacatctcccagctgcagaaggggaagtattcaatcaagcactcgtag

SEQ ID NO: 16671 - DNA, 666 bp, Artificial Sequence
  Description of Artificial Sequence: Synthetic coding sequence
atgccagtgatgaggttgtttccttgtttcctgcagctcttggcagggcttgccctgcctgccgtccctccacaacaatgggcgttaagtgccggcaacggaagctcagaggtggaggtagtgcctttccaagaggtgtggggcagaagctactgccgggccctagaacggctcgtggatgtagtctccgaatatcccagtgaagtcgagcatatgtttagtcccagttgcgtttctctcctgaggtgcaccggctgttgtggagacgaaaatcttcactgcgtcccagtggaaactgctaatgttacaatgcaactgctcaagattcgttccggggatagaccgagttacgttgaactaaccttttcccagcacgtgagatgcgaatgccggcactctcccggacgacagagtccggatatgcccggggattttcgggccgatgccccatcatttctgccacctcgccgttcactacctatgctcttccgcatggaatggggatgtgccctgaccgggagccagagtgcagtgtggccctctagcccagtcccagaggagatcccgcgcatgcaccccggacgaaacggaaaaaagcagcaacggaaacctcttcgcgaaaagatgaagcctgagagatgtggagatgctgtacctagaaggtag

SEQ ID NO: 16672 - DNA, 450 bp, Artificial Sequence
  Description of Artificial Sequence: Synthetic coding sequence
atgcctgtaatgcgcctgtttccctgctttttacagctactggccggcttggctctgccagctgtgccccctcagcagtgggccctatctgcaggtaatggcagtagtgaagtggaagttgtaccctttcaggaagtgtggggtcgctcttattgtcgagcattggagcgcctggtggacgtcgtaagtgagtacccatctgaagtcgagcacatgttctctccatcatgcgtgagcctgctaagatgcaccggttgctgcggcgatgagaatctgcactgcgtcccggtggaaacagcgaacgtgacgatgcagctgctgaaaatacgtagtggcgaccgcccatcctacgtggaactaaccttctcacagcacgtgcgttgtgagtgtaggcccctgagagaaaagatgaagccagagcggtgtggagacgctgtgcctcgtagatag

SEQ ID NO: 16673 - DNA, 513 bp, Artificial Sequence
  Description of Artificial Sequence: Synthetic coding sequence
atgccagttatgcgactcttcccgtgctttctccaactgcttgctggtctggcactccctgccgtgcctccacagcagtgggcactaagcgccggtaacgggagctcagaggtggaggtagtgcccttccaagaagtgtggggcagatcttactgtagagctctggaacggttagtcgatgtcgtctccgagtaccctagcgaggtcgagcacatgttcagcccgtcttgtgtgagtctgctcagatgcacgggatgttgtggagacgaaaacctccattgtgtcccagtcgaaactgctaacgtcaccatgcagctacttaagataagatccggtgatcgaccttcatacgttgagctcaccttctctcagcacgtgcgatgtgagtgtcgacctttgagggaaaagatgaaacctgagcgacgcagaccgaagggccggggaaagcgtagacgggaaaagcaacggccaaccgattgccacctctgtggagatgccgtccctaggaggtag

SEQ ID NO: 16674 - DNA, 477 bp, Artificial Sequence
  Description of Artificial Sequence: Synthetic coding sequence
atggccctcgaggtcctgatgctcttggccgtcctgatttggaccggggccgagaatctccatgtaaaaatttcatgcagtcttgattggctaatggtgagcgtgattcctgttgcagagtctcgcaacctgtacattttcgcagatgagctacacttggggatgggttgtccggcgaaccgcatccacacctacgtgtatgagtttatctatctcgtaagagactgtggaattagaacccgggtcgtgtcagaagagaccttattgttccagacagaactgtacttcacaccacggaacatagaccatgatccccaggaaatacatctcgagtgttctacctcaagaaagagtgtatggctgaccccggttagcaccgaaaatgaaatcaagctggacccttcacccttcatagccgattttcagacaacagcagaggagcttggcctgctgtcttctagccccaacctgctctag

SEQ ID NO: 16675 - DNA, 1188 bp, Artificial Sequence
  Description of Artificial Sequence: Synthetic coding sequence
atgcgggccctccttgctagattgcttctatgcgtgttggtggtctccgacagcaaaggaagcaacgagctccatcaggtgccatataagagtaaaacttgctatgaggggaatggtcatttttatagaggcaaggcaagcactgataccatggggcggccttgtcttccatggaacagcgctacagtgctccagcagacttatcacgcccatagatctgatgccctccagctcggactcggcaaacacaactattgccgcaaccccgacaaccgccgacgcccttggtgctatgtgcaggtcggcttaaagctcttagtgcaggagtgtatggttcatgactgcgccgacggcaaaaagcctagctccccccccgaagagctgaagttccaatgcggccagaaaacactgaggccgcggtttaagataataggaggagagttcaccactattgaaaatcagccctggttcgccgctatttataggcgccaccgtggcggctctgtgacatacgtatgtggtgggtcactgattagtccctgttgggtaataagtgcaacacattgtttcatcgactatccaaagaaagaagactatatcgtctaccttggtcggtcccgactaaatagcaacacgcagggcgagatgaagtttgaggtggagaatctgattctgcacaaggattattccgcagacactctagcccatcataacgacatcgctctgctgaaaatcaggtcaaaggagggccggtgtgctcagccctcccgaactattcagacgatatgcttaccttcgatgtacaacgacccgcagttcgggaccagttgtgagataactggctttggaaaagagaactcaacggactacctgtatcctgagcaacttaagatgacagtggtcaaattaatctctcacagggagtgccagcagccccattattacgggagtgaggtcaccacaaagatgctctgcgctgccgatccgcagtggaagaccgactcatgccagggagacagcggcggacccctagtgtgttctttgcagggaagaatgaccctgactggaattgtttcctggggccggggatgtgccctcaaagataagcccggagtgtacacaagagtgagccattttttaccctggatcaggtcgcatactaaagaagaaaacgggcttgcgctgtag

SEQ ID NO: 16676 - DNA, 1188 bp, Artificial Sequence
  Description of Artificial Sequence: Synthetic coding sequence
atgcgcgccctccttgcgaggctgttgttgtgtgtattagtggtctccgacagcaaggggagcaatgagctgcatcaggtgccttacaaaagtaaaacctgttacgagggcaacggtcacttttatcgcggcaaagcaagcactgacacgatgggccggccctgtttaccgtggaattccgctacagtgttgcagcagacctatcacgcgcaccgcagcgatgcactgcagttggggctcggcaagcacaattactgtagaaatccagacaaccgcagaaggccttggtgttacgtgcaggtcgggctaaaattgttggtacaggagtgcatggtgcacgattgcgctgatggcaagaagccttcttccccccccgaggagctgaaatttcaatgtggacagaaaacactgcggcctcgcttcaagattatcggcggggagtttacaacgattgagaaccaaccctggtttgctgccatctatcgaagacataggggaggcagcgtgacttatgtgtgtggcggtagcctcatcagtccgtgttgggtcatcagcgccactcattgctttatcgattatcctaagaaggaagattacattgtgtaccttgggaggtctcggctcaactctaacactcagggagagatgaaattcgaagttgaaaacctcatccttcacaaggattatagcgctgacactctcgctcatcataatgatatcgcactcttaaaaatccggtcaaaagagggaaggtgcgcccagcccagccggaccatacagacgatctgtcttccctctatgtacaatgatccccagttcggaacttcctgtgagattaccggctttgggaaggagaattcaaccgactatttatatcctgagcaattgaagatgacggtcgtgaaacttatttcacaccgcgaatgccagcaaccacactactatggcagcgaggtgactactaaaatgctgtgtgccgccgacccccagtggaagaccgattcctgtcagggagacagcggagggccactagtgtgtagtctgcagggccgtatgactctcacgggcattgtctcctggggaagggggtgtgcacttaaagataagcctggggtatatactcgggtttcgcatttcctgccctggattcggagccataccaaggaagagaatggactcgctctgtag

SEQ ID NO: 16677 - DNA, 1296 bp, Artificial Sequence
  Description of Artificial Sequence: Synthetic coding sequence
atgcgggcccttctggctcggctattgctctgtgtgctggtggtgtctgattctaaaggcagcaacgagttacaccaggtccccagcaattgcgattgtctgaatggagggacgtgcgtatcgaacaaatatttcagcaatattcattggtgtaattgtcccaagaaatttggcggacaacactgtgagattgacaaatccaaaacctgttatgaagggaatgggcacttctatcgagggaaagcaagcacggataccatgggtagaccttgtctcccatggaattctgcgaccgttctgcagcaaacatatcatgctcatcggtctgatgcattgcaattgggtctcggcaaacataattactgccgcaatcctgacaacagacgaagaccctggtgctatgtccaggttggacttaagcttcttgtccaagagtgcatggtccacgattgtgctgacggtaagaagccctcatcacctccagaggagttaaagtttcagtgcgggcagaaaactctaaggcctagattcaagatcatcggcggggagttcaccactattgagaatcagccttggtttgctgccatatataggaggcacaggggcggctcggtgacatacgtctgtggcggtagcttgatatcaccctgctgggttatttccgccacacactgctttattgattaccctaagaaggaggattacatcgtgtaccttggaaggagtagattgaatagcaacacacaaggagagatgaaatttgaggtggagaacctcattctgcacaaggattatagcgccgatacgctggcccaccacaatgatattgccctgttgaaaatccggtcaaaggagggtagatgcgcacagccgagccgcactattcagactatctgcttgccgagcatgtacaacgatccgcaattcggcacgagctgcgaaatcacaggcttcggcaaggaaaactctaccgattatctctatccggagcagcttaagatgaccgtggtcaaactcatctcccaccgggagtgccagcaaccgcactattacggctccgaagtcacaaccaaaatgctctgcgcggctgacccccagtggaaaaccgattcttgtcagggagactccgggggccccctggtgtgctcactccagggcagaatgaccctgaccggaatcgtgtcatggggaaggggctgtgcactaaaggacaaacccggagtgtatactagagtaagccatttcttaccatggattagatcacacactaaagaagaaaatggccttgccctttag

SEQ ID NO: 16678 - DNA, 1245 bp, Artificial Sequence
  Description of Artificial Sequence: Synthetic coding sequence
atggttttccatctgcggacccggtacgagcaagctaactgcgactgcctgaacgggggcacctgcgttagtaacaagtacttctcaaatattcattggtgcaactgccctaagaagttcgggggacagcactgcgagatcgacaagagtaaaacatgctacgagggtaacgggcatttttaccgaggtaaggccagtacagacaccatgggacgcccgtgcttaccatggaatagtgccaccgtcctgcagcaaacgtatcacgcacatagatctgatgctttacaactcggactcggcaagcacaactattgtagaaaccccgataacagacgcagaccgtggtgctacgttcaggtcggtctgaaacttcttgtgcaggagtgtatggtccatgactgtgcagatgggaagaagccttcctcacctccggaagagctaaaattccaatgcggacagaagaccctccgcccccggttcaaaataatcggcggggaatttaccactattgaaaatcagccttggtttgccgctatttatagacggcaccggggaggaagtgtcacatacgtttgcggcggcagcctcatcagcccgtgttgggttatctcggccactcactgcttcatagattatcccaaaaaagaggactacattgtctacctcggccggtcaaggctcaattccaacacacagggtgagatgaagtttgaggtggagaatctgattctccacaaggactactccgccgacaccctagcgcaccataatgacatagcactgttgaaaatccgttcgaaggagggcaggtgtgctcagccttctcgtaccattcaaacaatatgtctgccttccatgtacaatgaccctcaattcggtacctcttgtgaaataaccggatttggcaaggagaactcaaccgattacctgtacccagagcagctgaagatgacagtggtaaaactcatctcccatcgggagtgtcagcagccccactattatggaagcgaggtcaccactaaaatgctatgcgcagccgatccacagtggaagacggattcttgtcagggggactccggagggccactggtttgcagcctccagggacggatgacccttacaggcatagtgagctggggccgaggctgcgccctgaaggataagcccggcgtgtacacccgggtatctcactttctgccctggatcagaagccacacaaaagaggagaacggcctggcattgtag

SEQ ID NO: 16679 - DNA, 3984 bp, Artificial Sequence
  Description of Artificial Sequence: Synthetic coding sequence
atggaggctccattgcaaacaggtatggtgcttggtgtcatgatcggcgcgggcgtcgcggtcgtagtgacagcagtgctgatcctgctggtggtgcgtcgactgagagtgcccaagacccctgcacctgacggtcccaggtaccgctttaggaaacgggacaaggtccttttctatggtcggaagattatgagaaaagtatctcagtccacaagctcactggtggacacaagtgtttccgcaacttcgcggccgagaatgaggaagaagctgaaaatgctaaatattgccaagaagatactcagaattcagaaggaaactcctactctgcagagaaaagagcctcccccagccgtgttggaagctgatcttaccgaaggcgacctggccaattctcacctaccgtctgaggttctctacatgctgaagaatgtgcgagtgcttggccatttcgagaaaccactgttccttgaactgtgccggcacatggtgttccagcgtttagggcagggcgactacgtatttagacctgggcaaccggatgcctccatatatgtggtccaggacggcctgctggaactctgcctgccaggtcccgacgggaaggagtgtgtggtgaaagaggtagtgcctggtgacagtgttaatagcctgcttagtatcctggacgtgatcactggccaccaacatccccagcgcactgtgtcggcccgggcggctagggacagtaccgtgctgcggctgcccgtggaggccttcagcgcggtgttcactaaatatccggaatcactcgtgcgcgtggtacaaatcatcatggtccggctgcagcgggtaacattcttggcgcttcacaattacctcgggctgactaacgaattgttcagtcacgagatccaaccactgcgcctgtttccctcgccagggttgccgacacgaacctcaccagtcagaggctcgaaaaggatggttagcacatctgccaccgatgagccaagggagactcctggccgcccacctgacccaactggtgctccactgcctggccctaccggggaccctgttaagcctacctccctggaaactcctagtgcccccctgcttagccggtgtgtgtcgatgcccggcgatatttcaggtctgcagggcggaccacgttccgactttgacatggcatatgaacggggccgaatcagtgtgagtttgcaggaggaggcatctgggggctccttggccgcccccgcaagaaccccaacacaggagccaagagaacaacccgctggtgcctgtgaatacagctattgtgaagacgagtctgctacaggagggtgcccgttcggcccctaccaagggcgccagacctcctcaatttttgaggctgcaaaacaggagttagcaaagttgatgagaattgaagatcccagcctgctcaacagccgcgtgctgctgcaccacgctaaggcaggtactatcatcgcccgtcagggagaccaggatgtctccctgcactttgtgttgtgggggtgtctgcatgtgtaccagcggatgatagataaagctgaggatgtttgtctgtttgtggcgcaaccaggcgagctggtggggcagctggcggtacttacaggagaaccattgatatttacactgcgggcccagcgggactgcacattcctgcgaattagcaaatcagacttctatgaaatcatgcgcgcccagccgtcagtcgttttatccgctgcacatactgtcgccgcgcgaatgtcgcccttcgtcaggcaaatggactttgccatcgattggacggcagtggaagccggtcgtgccttgtatcgccagggtgaccggagtgattgtacatatatagtgctcaacggacgtcttaggagcgtaatccagaggggctccggaaaaaaagagttggtgggcgaatacggacgtggtgacctgatcggagtagttgaggcccttacgcgtcagccgcgggccactactgtgcatgccgtgcgggatactgaactggccaagttgcccgagggtaccctgggtcatatcaagagaaggtacccgcaggtggtgacgagattgattcatctcctgtcccagaaaatcctcggcaaccttcaacaattgcaaggcccgtttcctgcaggctccgggctcggagtgcccccgcactcagagctcacaaatccagcctcaaatctagccaccgtggccattctccccgtgtgtgccgaagtcccgatggtggccttcaccctggagctgcagcatgccctccaagcaatcggaccaacccttctgttgaactcggacataatccgggcacggctgggtgcttcggccctggacagcatccaggagtttcgtcttagtggttggctagctcagcaagaagacgctcacaggatagttctgtaccaaaccgatgcttctctcacaccttggaccgttagatgcttgagacaggccgattgtatcttaatcgttggcctcggcgaccaggaacccacccttggccagttggagcaaatgctcgagaacaccgcagtgagggcactcaagcaacttgtgttgctccatcgcgaagagggagcgggccctacccgcactgtagaatggttgaacatgaggagctggtgttcaggacacctgcaccttaggtgcccacgtcggctcttctctcgccggtccccggccaagctccacgaactgtacgagaaagttttctcaaggcgtgcagatagacatagcgatttctctaggctcgctcgggtgcttaccgggaacaccatcgccctagtactggggggaggcggagccaggggctgttcacatattggcgtactgaaagccttagaggaagctggcgtgcccgtggacctagttggcggcacaagcatcggatcatttatcggggctttgtacgcagaagagcgtagcgcttcccggacgaagcagcgggcgagagagtgggctaaaagtatgacaagcgtgctggaacctgtcctggatctgacctaccccgtaacttccatgtttacagggagcgcctttaatcgctccatccatagagtgttccaggataaacagatcgaagatctgtggctgccctactttaacgtgacaacggatattactgcatcggcgatgagagtccacaaggatgggagcctctggcgctacgtccgggcctctatgaccctgtccggctatcttccgcccctttgtgatcccaaggacggtcatcttctgatggacggggggtacattaacaacctaccagccgatattgcccgcagcatgggtgcaaagacggtgatcgcgatcgatgtgggttctcaggatgagacagacctgagcacctacggggacagtctttcagggtggtggctgttgtggaagcgtctcaatccctgggccgacaaagtgaaggttcccgacatggctgaaattcaatctcgcctcgcctacgtctcttgcgtcagacagctggaggttgtgaagtcttcctcgtattgtgagtacctgcgcccaccaattgactgttttaaaactatggactttggtaagtttgaccagatttacgatgtgggttatcagtacgggaaagctgtgttcgggggttggtcgagagggaatgtcatcgagaagatgttgaccgatagaaggtctacggacctcaacgagagtagaagggccgatgtgctggcttttccaagctctggatttaccgacctggcagagatcgttagtcggatcgagccaccaacctcgtacgtttctgacggctgtgcggatggggaagaaagcgactgcctcaccgaatacgaagaagacgcaggcccagattgctccagagacgagggaggaagcccagaaggcgcttcaccatcaactgcctccgagatggaggaggagaaatccatcctgcgccaaaggcgctgtcttccgcaggaacccccaggcagtgcaaccgatgcatag

SEQ ID NO: 16680 - DNA, 846 bp, Artificial Sequence
  Description of Artificial Sequence: Synthetic coding sequence
atggggcatcctccactgttgcccttactgctgctcctccacacttgtgttccggccagctgggggctgagatgtatgcaatgtaagacgaacggcgactgtagagtggaggaatgcgccttgggccaggatctctgtcgtactacaatcgttagactatgggaagagggagaagagctcgagctggtagaaaagtcatgcacccactccgagaaaactaacaggaccctgtcatacaggactggtctcaagattacctcgctaacagaagtggtttgtgggctcgacctctgtaatcagggtaacagtggacgtgctgtcacctattccagatccagatacctggagtgcatctcttgtggaagctccgacatgtcatgcgagagaggccggcaccaaagtctgcagtgccgctcccctgaagaacagtgtctggacgttgtgacgcactggattcaagaaggtgaagagggtcggcccaaagacgaccggcacctgcgcggatgcggataccttccaggttgtcctggcagtaacggattccataataatgacacttttcattttctgaagtgctgtaacacaacaaagtgtaacgaaggccctatcttagagttggaaaatctgccccaaaatggcagacagtgttacagctgtaagggcaacagcacacatggttgctccagcgaggagacctttttaattgattgcaggggccccatgaatcagtgcctggtggcgaccggtacccacgaacggtctctgtggggtagctggctcccatgcaagagcactacagccctgcgacctccttgctgcgaggaggcgcaggctacccacgtatag

SEQ ID NO: 16681 - DNA, 1008 bp, Artificial Sequence
  Description of Artificial Sequence: Synthetic coding sequence
atgggacaccctcctctgctgccactcctgctcttgctacacacctgcgtaccggcctcttggggtctccgctgcatgcagtgcaaaaccaacggagactgccgcgtcgaagagtgtgcactcggccaagatctatgtcgcactaccatagtgcggctgtgggaagagggagaggaattagaactggtagaaaaaagctgtacccattcggagaaaaccaatcgtacactgagctatagaactgggcttaaaataacatccctcaccgaggtggtctgtggcctggacctctgcaaccagggcaactcaggacgcgccgtgacatactccagatcccggtatctggagtgcatcagttgcggcagttccgacatgagctgcgagaggggccgacatcagtctcttcagtgtcggtcccccgaagaacagtgtctggatgtggtcacccattggattcaagaaggagaggagggccggcctaaagacgataggcatctgcgtgggtgtggatatttgcccggatgtccaggatcgaacggttttcacaataacgatacattccatttcctgaagtgctgcaatactaccaagtgcaatgaggggcccatcctggagctcgagaatctaccacagaatgggagacagtgctatagttgcaaagggaactctacacacggctgctcctcggaagagacttttctcattgactgtaggggaccaatgaaccagtgcctggtagctaccgggacccacgagccgaagaatcaatcatatatggtgcggggatgcgcaacggctagcatgtgtcagcatgcccacctaggagacgccttttccatgaaccacatcgatgtgtcgtgctgcactaaatctgggtgcaatcatcctgatctcgatgtccaatatcgctcgggcgccgcccctcagcccgggccagcccacctatcactcaccatcacgcttctgatgactgctcgcctttggggaggcacactgctctggacatag

SEQ ID NO: 16682 - DNA, 1038 bp, Artificial Sequence
  Description of Artificial Sequence: Synthetic coding sequence
atgtccctgttcggactcctgctgctgaccagcgcacttgccggacagcgacagggcacgcaagccgagtcaaatctgtccagtaaatttcagtttagctctaacaaagagcagaacggagttcaggatcctcagcatgagcggattataacagtaagcaccaatggatcaattcatagcccacggtttcctcatacatatccacggaacacggtcctcgtgtggcggctggtagcggtggaggaaaatgtatggattcaactgacgttcgatgagcgtttcggcctagaagacccagaagacgacatttgtaagtacgacttcgtcgaagtcgaggagccctcggatggaactattctgggcaggtggtgcgggagcggcacagtacctggaaaacaaattagcaagggcaatcagatccggatcaggtttgtgtccgacgagtacttcccctctgaacctggcttctgcatccactataatatcgtcatgccccaattcacagaagcggtgagcccctcagttctgcctccgtccgcccttcctctcgacctcttgaataatgcaatcacagccttttcgacactcgaagaccttattagataccttgagccagagcgttggcagctggatttagaggatctgtacaggcctacatggcagctactgggaaaggctttcgtcttcggaagaaagagccgggtggtggatctgaacctcttgaccgaagaagtcaggttatacagttgcaccccgaggaatttctccgtgagcattcgggaggagctgaaaaggacagataccattttctggcccgggtgccttcttgtgaaacggtgtggtgggaactgtgcttgttgtttacataattgcaacgagtgccaatgcgtacctagcaaggtaactaagaagtaccatgaggtactacagttgcgaccaaaaactggcgtgcgcggcctacacaagagcttgaccgatgttgccttagagcaccacgaagaatgcgattgtgtgtgccgcggatccacaggcggttag

SEQ ID NO: 16683 - DNA, 549 bp, Artificial Sequence
  Description of Artificial Sequence: Synthetic coding sequence
atgcctcaattcaccgaggcagttagcccctctgtgctgcctcctagtgcgctgcctttagatttgctaaataatgccatcactgctttcagcaccctcgaagacctcatcaggtacctcgaacccgagcggtggcagttagacttggaagacctgtatcgccctacctggcagctcctgggaaaggctttcgtgttcggccggaagagtagggtcgtggacctcaacctactgacagaggaagtccggttatatagctgcacccctaggaacttttccgtaagtattcgggaggagctgaaaagaacagacaccattttttggcccggttgtctgctggtgaagcgttgtggcgggaattgcgcctgttgcctgcataattgcaatgagtgtcagtgtgttcccagcaaagtgacgaaaaaataccacgaagtcctgcagctgcgaccaaagaccggagtccgggggctacataagagcctcacagatgtggcacttgaacaccacgaagaatgcgattgtgtctgcaggggatcaacaggaggttag

SEQ ID NO: 16684 - DNA, 573 bp, Artificial Sequence
  Description of Artificial Sequence: Synthetic coding sequence
atgatgcagtacacctggctgcttacgaaacagttcaccgaggcagtgagccccagcgtgttgccaccatcagctctgcctctggacctattgaacaatgccatcaccgcttttagcacgctggaggacttaattagatatttggagccagagagatggcaactggatctcgaagacctgtaccggcctacgtggcagttgcttggtaaggcttttgtctttggcagaaagagcagggtggtggacctcaatctcctgaccgaggaggtgagattgtacagctgcacccctcgcaacttctcagttagcatcagagaggaacttaagcgtaccgacacaatcttttggccaggctgtttgctggtgaagagatgcgggggtaattgcgcctgttgcctgcacaactgcaatgagtgccagtgcgtgccctcgaaggtgactaaaaaataccacgaagtgctgcagctaaggcccaagaccggcgtccgcggtctgcacaagtcactgacagacgtagccctggaacaccacgaagagtgcgattgcgtgtgcagggggagcaccggtggctag

SEQ ID NO: 16685 - DNA, 504 bp, Artificial Sequence
  Description of Artificial Sequence: Synthetic coding sequence
atgagtctttttggactattattactcacaagtgctttggcaggtcagagacagggtacccaagctgaaagtaatctgtcctctaaatttcagttctcaagcaataaggagcaaaatggggttcaggatccacagcatgaaaggattattaccgtgagcaccaacgggtcaatacatagcccaaggtttccgcatacctatccccggaacactgtgctcgtgtggagactcgttgccgttgaggaaaacgtgtggatccagcttacattcgacgagcggttcggattagaggatccggaggacgatatctgtaaatacgatttcgttgaggtggaggagccttccgacgggacaattctgggacggtggtgtgggagcggcacggtaccaggaaaacagatctcaaagggcaatcagattcgtatcagattcgtctcagatgaatacttcccatcggaaccatcaaatcggggcggcaagattattcagttgcacacgagctag

SEQ ID NO: 16686 - DNA, 2217 bp, Artificial Sequence
  Description of Artificial Sequence: Synthetic coding sequence
atgcagccacgatgggctcaaggcgcaacaatgtggcttggtgtgttgctgacgctgctcttgtgctcatctctagaaggtcaggagaactcattcaccatcaattccgtggacatgaaatcactgcccgattggactgtccagaatggtaagaatcttaccctccaatgcttcgccgacgtgagtactacctctcacgtaaaaccacagcatcagatgctgttttataaggacgacgtgctcttctacaatatcagctccatgaagtccaccgagtcttactttattccagaagtccggatctatgactcaggaacctacaaatgcactgtgatcgtgaacaacaaggaaaagacgactgctgagtaccaggttctggtggagggtgtcccctcgccccgcgtcacactggataaaaaggaggcgatccagggcggcattgtgcgcgtcaactgtagtgtcccggaggagaaagctcccatccattttacaattgaaaaattggagttgaatgaaaaaatggtcaaactgaagcgtgagaaaaattcaagagatcagaacttcgtgattttggaattccccgtggaggagcaggatagagtcctcagctttcgttgccaggcgcggattatctccggtatccatatgcagacgagcgagtccacaaagtcagagttggtcacagtgacagagtctttctcaactcctaagttccatatcagccctactggtatgattatggaaggagcccagctgcatatcaaatgcaccattcaagtgacccacttggcacaggagttccccgaaattatcatccagaaagataaagctattgtggcacataatcgccacgggaacaaagccgtttatagcgtcatggcgatggtggagcattcaggcaactacacgtgtaaagttgagtcaagcaggatatctaaggtgtcctccatcgtggttaacatcacagagttatttagcaaaccggaactcgaatctagcttcactcatctagatcagggcgagagacttaacctctcttgttccatccctggggccccacccgcaaacttcactattcagaaagaggataccatcgtgagccaaacgcaggacttcactaagatagccagtaagtctgactctgggacctatatctgtactgccggtatcgataaggtggtaaaaaaaagcaataccgtgcaaattgtggtttgcgaaatgctttcacaacccaggatatcttatgacgctcaatttgaggtaataaaggggcagacaattgaggtgcgttgcgaatcgatatctggtactctgccaattagttaccagctgctgaaaacatccaaggtgctggagaattcgactaagaattctaacgaccccgccgtgtttaaggacaatccgacagaggatgtggaataccagtgcgtggcggacaattgtcatagtcacgctaagatgctgtcagaggtgctgcgggtgaaggttattgctcccgttgatgaggtccaaatttcaatcctgtcttccaaggtggtggaatctggggaggatattgtactgcaatgcgcggttaatgagggttctggccccattacatacaagttctatcgagaaaaagagggaaagcctttctaccagatgacgtctaatgccacacaggccttttggactaagcagaaggcttcaaaggaacaggagggcgagtactattgcacggcctttaatcgtgctaaccacgccagcagcgtccctaggtccaaaatcctgaccgttcgggtaattttggccccttggaagaagggactcatagcagtggtgatcataggagtgatcatagcgctattaatcatcgctgccaagtgttactttttgcggaaggcaaaagccaagcagatgcccgtggagatgagccgccccgcggtccctttactaaactccaataatgagaaaatgagtgacccaaacatggaggccaactctcactacggccacaatgatgacgtgcggaatcacgccatgaaacccatcaacgacaacaaggaacccctgaactctgatgtgcaatacacagaggtgcaggttagctccgctgagagtcacaaggacctcggaaagaaagacacggaaacagtctactccgaggtccgcaaggcagttcccgacgcggtggagagcaggtatagccgcacagaggggtcccttgacggtacctag

SEQ ID NO: 16687 - DNA, 636 bp, Artificial Sequence
  Description of Artificial Sequence: Synthetic coding sequence
atgcggaccttggcttgcctcctgttgcttggatgtggttacttggctcacgttctcgccgaggaagctgaaattcctagggaggtgatagagcggctggctcgctcccaaattcactctattagggatctgcaacgtctgctggagattgattcggttggcagcgaggacagtctggatacctctcttcgggcccacggagttcatgccaccaagcatgtgcccgaaaagcggccacttccaattagaagaaaacggagcatcgaggaagccgtaccagccgtctgtaaaacaagaacagttatctatgaaattcccaggagccaagtggacccaacctcagccaactttctgatctggcccccgtgtgttgaggtaaagcgatgcactggttgttgcaataccagctccgtgaaatgccagcccagcagggtgcaccaccgaagcgtcaaggtcgcgaaggtggaatacgtcaggaagaagcccaagttgaaggaagtccaggtgcggctcgaagagcacttggagtgtgcctgcgccacaaccagccttaatcctgactatagagaggaggataccggtaggccccgtgagagcgggaagaaacgcaagaggaaaaggcttaagccgacttag

SEQ ID NO: 16688 - DNA, 591 bp, Artificial Sequence
  Description of Artificial Sequence: Synthetic coding sequence
atgagaacgctggcctgtcttctcctgctgggttgtgggtatttagcacatgttcttgcggaggaagcagagattcccagagaagtcatcgagcgcttggcgcggtctcagattcattccattagagacttacaacggttgctggaaatcgactcagtgggcagcgaagactctctggatacaagtcttagggcccacggcgttcatgcaacgaagcatgtcccggaaaagagacctctccctattcggcgcaaacggagcatcgaagaagctgtgcctgctgtgtgcaagacccggaccgtaatctatgaaatcccaagaagccaggttgatcccaccagcgcaaacttcctgatctggccaccatgtgtggaagtgaagcgctgcacaggatgttgtaacacaagcagcgtgaagtgccaaccttcaagggtgcatcaccgcagtgttaaggtggctaaagtggaatatgtgcggaagaagccgaaactgaaagaggttcaggtgcgactagaggagcatctcgagtgcgcctgcgcaacgacgagcctcaatcctgactacagagaggaggacaccgacgtgcggtag

SEQ ID NO: 16689 - DNA, 162 bp, Artificial Sequence
  Description of Artificial Sequence: Synthetic coding sequence
atgagaacgctagcttgtctgctcctgctgggttgcggatacctggcccatgtgctcgcagaggaggccgagataccaagggaggtgattgagcgtctggccagaagccagatccatagcatccgcgacctgcagcgcctccttgaaatcgactccgtgtag

SEQ ID NO: 16690 - DNA, 3270 bp, Artificial Sequence
  Description of Artificial Sequence: Synthetic coding sequence
atgggtacttcccaccctgccttcttagtgttggggtgtctgctgacaggtctctccttgattctgtgccagcttagcttgccttcaattctgcctaatgaaaacgagaaagtggtacagctgaactctagcttctcacttcggtgtttcggtgaatccgaagtctcctggcagtatcccatgagcgaagaggaatcttccgacgtggagattagaaacgaggaaaataactctggtctgttcgttactgtgctggaggttagtagtgcgtcagccgctcacaccggtctgtacacatgttactacaatcacactcagactgaggagaacgagttagagggccgacacatatacatctatgttcctgatcccgacgttgcctttgtccctctgggtatgaccgactacctcgtgattgtagaagacgacgacagtgccatcattccttgtaggacaacggatccagaaactcccgtgacactgcacaatagcgagggagttgttcccgcctcctacgattccagacaaggtttcaacggtaccttcacagtgggcccttacatttgcgaagcaacggtaaaagggaaaaagttccagactattcccttcaatgtttatgctctgaaggccacaagcgagctggacctcgagatggaagccctgaagactgtttacaagagcggtgaaaccatagtcgtgacatgtgctgtgttcaacaatgaagtcgttgacttgcagtggacatacccgggggaagttaaaggcaaagggattacaatgcttgaagagatcaaggttcccagcatcaagctggtgtacaccctaaccgtaccagaagctaccgttaaggacagcggcgactacgagtgtgctgcaaggcaggcgactagggaagttaaggagatgaagaaggtaacaatcagtgttcacgagaagggattcatagagatcaaacctacattcagccaattggaggcagtgaacttacatgaggtgaagcacttcgtcgttgaagtaagggcatacccccctcctaggatttcatggttgaagaataatctgacactgattgaaaatctcaccgagattacgactgacgttgagaagatccaagaaatcaggtatcgctcgaaactgaaactgattagagctaaggaagaggatagtggacattataccatagttgcacagaatgaagatgctgttaagagttacacgtttgaattgctaacccaggttccgagctcaattctggaccttgttgacgatcatcatgggtcgaccgggggacagaccgtaagatgcacagctgagggaacaccacttcccgacatcgagtggatgatttgcaaggatattaagaaatgtaacaatgaaacgagttggacaatcctcgccaacaatgtatcaaatatcattaccgaaattcattcccgggaccgctccacagtggaggggcgcgtaacattcgccaaggtagaggagacgattgctgtgcgctgccttgccaagaatctgttaggcgccgagaacagagagttgaagcttgtggcccccaccttacgcagtgagctcacggtggcagccgctgtgctggttttactcgtaatcgttattattagcctcattgtcttggtcgtgatttggaagcaaaaacccaggtatgaaattaggtggagagtcatcgaaagtattagtccagacggccatgagtacatttacgtggacccaatgcaactgccctacgatagtagatgggagtttcccagggatggcctggtgcttggcagggtgctcggctcgggagccttcggcaaagtggtcgaagggaccgcttacgggttgtctaggagccagcccgttatgaaggtagcagtcaagatgctgaagccgactgcccgcagcagtgaaaaacaggcactcatgtctgagctgaagataatgacccacctaggtcctcaccttaacattgtgaatctactgggcgcttgcacaaaatctggccctatatacatcatcactgaatattgtttctatggggatcttgttaactacctgcacaagaaccgtgatagctttctgtcacatcacccagagaaacccaaaaaagagttggatatattcggtttgaatcccgctgacgaatcaactaggtcttacgtcatcctgtctttcgagaataacggggactatatggacatgaagcaagccgatacaacgcaatatgtgcccatgttggaacgcaaggaggtgtccaagtattccgacattcagagaagcctttatgatcgcccagcctcctacaagaagaagagcatgttagactctgaggtgaagaatctcctgagcgatgacaattccgaaggcttgacgttgttagacttacttagttttacctaccaggttgccaggggcatggagttccttgcatctaaaaattgcgtccatcgagacctggccgctagaaacgtcctccttgcccagggaaagatcgtcaaaatctgcgatttcggcttggccagagacatcatgcatgactcaaattacgtctccaagggcagcacctttctgcctgtgaaatggatggcaccggaaagcatattcgacaacctgtacaccacactgagtgacgtgtggagttatgggatccttctgtgggaaatcttcagtctcggcggaactccatacccaggtatgatggtcgatagcaccttttacaataaaatcaagtcggggtaccgtatggctaagcccgaccatgcaacttcagaagtctatgaaatcatggtgaagtgctggaattctgaacctgaaaaacgtccttccttttaccacctgagcgaaatagtggaaaacctgctccctggccaatacaagaagtcatatgagaagattcatttggattttttgaaatccgatcatcccgccgtagcccggatgagggtggatagcgacaatgcttacatcggtgtgacatataaaaatgaagaagacaaactaaaagactgggaaggaggcctagacgagcaacgtctctccgccgattcaggttatattatcccactgcctgatatagacccagtgccagaggaagaagatcttgggaaaagaaatcggcatagttctcagaccagtgaggaaagcgccatcgaaacaggtagtagcagtagcacattcatcaagcgagaagacgagaccatcgaagatattgatatgatggatgatatcgggattgattcttccgacctggttgaggacagttttctttag

SEQ ID NO: 16691 - DNA, 480 bp, Artificial Sequence
  Description of Artificial Sequence: Synthetic coding sequence
atgggcaccagtcatcccgcctttctcgtgttaggttgtttgttgacagggctgagtctaattttgtgccagctgtcactgcctagcattctcccaaacgaaaatgaaaaggtggttcagctgaattcctcattctccttacgttgtttcggagagtctgaggtatcatggcagtatcccatgagcgaggaagagtctagcgatgtcgagattagaaatgaggaaaacaattccggtctttttgtgactgtacttgaagtgtccagcgcatccgccgcccatacaggcctctatacctgctactacaaccatactcagacagaggagaacgaactggagggacggcatatttacatctacgtgcccgacccggacgtggctttcgtgccccttggaatgacggactacctggtcatagtggaggatgacgatagcgctataattccttgcaggactaccgatcctgaaacccctgtgtag

SEQ ID NO: 16692 - DNA, 477 bp, Artificial Sequence
  Description of Artificial Sequence: Synthetic coding sequence
atgggtaccagtcatcctgccttcctcgtgttggggtgcctgctgacgggcttgtccctgattctatgtcagctatcgttaccaagcattctgccaaacgagaacgaaaaagtggtgcagttgaatagtagcttcagcttacgctgtttcggcgaaagtgaagtgagttggcagtatccaatgtctgaagaggagtccagcgacgttgagatcaggaatgaggaaaataattctgggctctttgtgactgtacttgaggtatcgagtgcctctgccgcccacaccggactgtatacttgttactacaatcatacccagacggaggagaacgaactggagggaagacacatttacatctacgtgcccgatcccgacgtagcctttgttccactcggtatgaccgactacttggtgatagtggaagatgacgattccgccatcattccctgtcgcaccaccgaccccgaaaccccctag

SEQ ID NO: 16693 - DNA, 657 bp, Artificial Sequence
  Description of Artificial Sequence: Synthetic coding sequence
atgggtacttcccacccggctttcctcgtccttgggtgtctgttgaccgggctgtctcttatcctctgtcagctttccctgccaagtatcttgcccaacgagaatgagaaagtggtgcagttgaattcaagtttttcactaagatgcttcggggagtctgaggtttcatggcagtatccaatgtctgaggaggagagttctgacgttgagattcggaacgaagagaataacagcgggctgtttgtgaccgtattggaagtcagcagcgccagcgccgcacacaccgggctgtacacatgttattacaatcacacccagaccgaagaaaacgaactggagggtcgtcatatctacatctacgtgcctgatccagacgtagccttcgtgcccctgggaatgactgattatcttgtgattgtagaggatgatgacagtgcgattattccttgtcgtacaaccgacccggagactcccgtgacactgcacaattctgagggcgtcgtgccggccagctatgacagtcggcagggcttcaatggcactttcacggtcggtccatacatttgcgaagcaaccgtaaaggggaagaagtttcagaccataccattcaatgtgtacgccctgaagggcacctgcatcataagcttcttgttgtag

SEQ ID NO: 16694 - DNA, 465 bp, Artificial Sequence
  Description of Artificial Sequence: Synthetic coding sequence
atgggaacgagccatcccgcattcttggtgctgggctgtctattgactggtctctctttgatactatgccagttaagcttgccctcaatactgcctaacgagaacgagaaagtcgttcaactgaattcctcctttagcctgaggtgcttcggtgagagcgaggtgtcatggcagtaccctatgagtgaagaagagtcctctgacgtggagattcggaacgaagaaaataactccgggttatttgtcactgttctggaggtcagctccgcatccgccgcccacacaggactgtacacatgttattataaccacacacaaacagaggaaaacgagttagagggacgccacatctacatatacgtaccggacccggacgtggcttttgttccactgggtatgacggactacctcgtgatcgtagaagacgacgactccgcgatcataccatgcagaacaacagattag

SEQ ID NO: 16695 - DNA, 3321 bp, Artificial Sequence
  Description of Artificial Sequence: Synthetic coding sequence
atgagactccccggagctatgcctgccttggcattgaagggggagctgctgttgctgtcattgctcctgttgctcgagcctcaaattagccagggccttgtggttaccccccccggacccgagttggtgttgaatgtctcttctacgtttgtcttgacatgttccgggtccgctcccgtggtttgggaacggatgagccaggaaccaccccaagagatggcaaaagctcaggacggaacattttcaagcgtgctgacactgaccaaccttaccggcttagatactggcgaatatttctgtacgcacaatgattcacgcggccttgagacggatgagcgcaagcgactgtacatcttcgtgcctgaccccactgtgggcttccttcccaacgacgctgaagagcttttcatcttcctgactgagatcaccgagattacaattccatgcagggttacagatcctcaattggtagtgacgttacatgaaaagaagggtgacgtcgctctcccggtgccgtatgaccaccagagaggattcagtggcatattcgaggaccgtagctatatatgcaaaacaacaatcggcgatcgggaggttgattctgacgcttactacgtttatagactgcaggtgtcaagtatcaatgtgagtgtgaacgccgtgcagacagtggtgcggcaaggagagaatatcacactgatgtgtatcgttatcgggaacgaagtggtgaattttgagtggacctacccgcgtaaggagtccggtagactcgtcgagccagtcacagacttcctcttggacatgccttaccatatacgcagcatactacatataccaagcgctgagctggaagattcaggcacctatacttgtaacgtgactgagagcgtgaatgaccatcaggatgaaaaggcaataaacatcacagtagttgagagtggctacgtaagactgttgggagaggtaggtactctgcagtttgccgagctgcatagaagccggacactgcaggttgtgttcgaggcatatcccccgcccaccgttctgtggttcaaggataaccgcactttgggagacagtagtgccggggagatagcccttagcactcgcaacgtttcagagactagatacgtctctgagctgacattggtccgcgttaaggtagcggaggctgggcactacacaatgcgtgcattccatgaagacgctgaagtccagttgagcttccagctgcaaataaacgtccctgtgcgtgtacttgagttatccgagagtcacccggactcgggagagcaaacagtgcggtgcagaggtcgcgggatgccgcagccaaacataatctggagcgcttgcagggatctcaagaggtgtcctagagagctccctccaacactccttgggaacagctctgaagaggaatcgcagttggagaccaatgtcacttactgggaggaagagcaggaatttgaggtcgttagtaccctgcgactccagcatgttgacaggcccttgtcagttaggtgcactctccggaatgcagtgggacaggacacacaagaggtcattgttgtcccccatagtctcccattcaaagtcgtggtgattagcgctattctcgcgcttgtggtcttgactattatttcccttatcatcttgatcatgctgtggcagaaaaagccgaggtacgagatccgatggaaagttattgagagcgtgagctccgacggccacgaatacatttacgtcgatcctatgcagctcccgtatgatagcacatgggagctgcccagggaccagctagtgctgggtaggactctggggtcaggcgctttcgggcaggttgtcgaggcgaccgcccatggcctatcccactcccaagcaaccatgaaagtcgccgtaaagatgttgaagagcactgccagatctagcgagaagcaggcccttatgtccgaactgaagatcatgtctcacctgggaccgcacctgaacgtcgtcaatttgcttggcgcatgcactaagggcggtcctatatatataatcacggaatattgtcgctacggcgacctggtcgactaccttcacagaaataagcatacctttttgcaacaccactcagataaacgccgtcccccatccgccgagctgtattccaacgcactccctgtcggcctgcccctgccttcgcatgttagcctaactggggagtctgatggcgggtatatggacatgtccaaggacgaaagcgttgattatgtgcctatgttggacatgaaaggggatgttaaatatgccgatatcgaatcaagcaattatatggctccttatgataactatgttccctcggccccagaaaggacatgtagggccaccttgatcaacgaaagcccagtgctctcatacatggatttagtgggattcagctatcaggttgctaacggtatggaatttttggcatcaaaaaactgcgtgcacagggatctggctgcccgcaacgtcctcatttgtgaaggcaagctcgttaaaatttgcgatttcgggttagcacgggatattatgagggattcaaactatatatcgaagggctccacatttctgccactgaagtggatggctcccgagtccatcttcaacagcctttacacaactctgagcgacgtatggagctttggaatcctgctgtgggagattttcaccctgggtggcacaccgtatcctgaactgccaatgaatgaacaattctataacgccattaagcgcggttataggatggcccagcccgcccatgcaagcgatgagatctacgagatcatgcagaaatgctgggaagaaaagtttgagattagaccaccgttctcccagctcgtgctgctattggaacggctactgggggagggatacaagaagaaatatcagcaggtagacgaagaattcttgaggagcgaccatcccgccattttgcgctcccaggctcgtttgccgggattccacggattaagaagccctctcgatacctcctccgtgctgtacaccgccgtccaaccaaatgaaggcgataacgactacattatccctttacccgatcccaaaccagaggtggccgatgaggggccacttgagggcagcccctccctagctagcagcactctgaatgaggtgaacacgagtagtaccatctcttgtgattccccacttgaaccacaggatgagccagaacccgaacctcagctcgaactacaggtggaacccgagcccgagctagagcagcttcccgacagtggctgccccgcgccgcgggccgaggcagaggactcattcttgtag

SEQ ID NO: 16696 - DNA, 525 bp, Artificial Sequence
  Description of Artificial Sequence: Synthetic coding sequence
atgaggcttccgggagccatgccagccctggcgctcaagggcgagctgttgcttctgtctcttctcctcctactggaaccccagatttcacagggtctggttgtaacaccaccagggcccgagctggtcttaaacgtgtccagtacgtttgtactgacctgctctggctctgctccagtagtgtgggaaagaatgagtcaagagccaccccaggaaatggccaaagctcaagacggcactttctcatcagtgctgacccttactaacctgacaggactggatactggcgagtatttttgcacccataacgactctcgaggtctggagacagacgaacggaagagattgtacatattcgttcccgacccgacggtggggtttctacctaacgacgcggaggagcttttcatttttctgactgagatcacggagatcacaataccctgtcgggtgactgacccacagttggtagtcacactgcacgagaagaagggcgatgtggctctgcccgtcccatacgactag

SEQ ID NO: 16697 - DNA, 2331 bp, Artificial Sequence
  Description of Artificial Sequence: Synthetic coding sequence
gctgccagcgaacccgacaccgccggaagcgttcgaggtctgccaactgctcactgtcccgttgtggacaaccgaaccctcggcgacagctcggcgggcgagatcgctctttcaactcgcaacgtgagtgaaacgcgttatgtctcagagctcactctggtaagggtcaaagttgcggaggcaggccactacacgatgcgcgcctttcatgaagacgcggaagtgcaactgtcattccagctccaaatcaatgtgcctgtccgcgtcctggaattgagcgaatcacatccagactccggcgaacagacagtccgatgtcgcgggaggggcatgcctcaaccgaacattatctggtcagcctgtagagatctgaagcggtgtccacgagaactaccacccactctactggggaattcgtcagaggaagaaagccagctagaaaccaatgtgacttattgggaggaagaacaggaatttgaggtcgtgtccactctcagactccaacacgtggaccggccattgagcgtgcggtgcaccctgcgcaatgcggtgggacaggacacacaggaggtgattgtggtcccccactcactgccattcaaggttgtggttatctctgccattctggccttggtggtcctcaccatcataagtttaattattctgataatgctctggcaaaaaaagccacgttatgagataagatggaaagtgattgagagtgtaagttcagacggccatgagtatatttatgttgatcccatgcaattgccgtatgattccacgtgggagctaccacgcgaccaactcgtgctcggtaggacccttggctcaggcgccttcggacaagtggtggaggctaccgcgcacggtctgagtcacagccaagcgaccatgaaggtcgccgttaagatgctgaagagcacagcccgttcctcagaaaagcaggcactcatgtccgaactgaaaatcatgagtcatttgggcccgcacctgaatgtcgtcaatctgttgggcgcgtgcactaaaggggggcccatatacataattactgaatactgccgctacggcgatctcgtagactatctgcaccggaataagcatacctttttgcagcaccattcggacaagcgacggccaccctcagctgagctgtactccaatgcactccccgtgggattaccacttccaagccatgtgagccttactggcgaatcagacggggggtatatggacatgtccaaggacgaatctgttgattatgttcccatgctggacatgaaaggcgacgtgaagtatgcagatatcgagtcttcgaattacatggctccttatgacaattacgtaccttcggcacccgagcgaacctgccgcgcaaccctcattaatgagtctccggtcttaagttacatggacctggtaggtttcagttaccaggtcgctaatggcatggaatttctggcaagcaagaattgcgtccaccgggacttagcagctagaaatgtgctaatctgcgaaggcaagttagtgaagatatgcgatttcggcctggcgagggatatcatgcgggacagcaactatatcagcaagggctccactttcctgcctctgaaatggatggcccccgaatccatcttcaacagtctctatactactctcagcgatgtatggagcttcggcatacttctgtgggagattttcaccttgggcggcactccatacccggaactaccaatgaatgagcagttttacaacgcaataaaacgggggtacaggatggcccagcccgcccacgctagcgacgaaatctacgaaattatgcagaagtgttgggaggagaaattcgaaatacggcctcccttctcacaactcgtgctgctgctggaaaggctcttaggagaaggatacaaaaaaaagtatcagcaggtggatgaggagtttctgcggtccgatcatccagctatactgagaagccaggcccgcttgccaggttttcacggtctgagatctccccttgacacaagctccgtcctgtacacagccgtgcagccaaacgaaggtgataatgattacatcatccctctcccagatcctaagccagaggttgctgacgagggccctcttgagggttcaccaagtttagcatcatcaaccctcaatgaagtgaacacttcttcaacaatttcttgtgatagtcccttggagcctcaggatgaacccgagcccgagcctcagctggaacttcaggtcgaacctgagcccgagttggaacaactgccggattctggatgtcccgctcctagggcagaagctgaggattctttcctctag

SEQ ID NO: 16698 - DNA, 891 bp, Artificial Sequence
  Description of Artificial Sequence: Synthetic coding sequence
atggggctgtcccactctaagacccacctcagggttattaaagtggccccgctacagaataaagaagtggagactccttccgccggcagagtggattttgctttcaaccaaaatctggaggaaaagacatcttattctctcgcaagattgcaagatcagaacaaagccctggaaggccagctacctcccctacaagaaaattggtacggccgttattcaacagcaagcagggacatgtattttgatattccactggagcacagagaaacctccattataaagagacacccacctcagaggctccagaaattggaaccgatcgacctgcctcgcgtgattacctcaggtaggctccttagccaacgagaagctcgcaccatgcacaaggccaagcaggtgctggagaagaaaatgcagactcccatgtacaccagcgagaaccgtcagtatcttcacaaaatgcaggtcctagagatgatccggaagagacaagaggctcagatggaattaaagaaatctctccatggcgaggcaagaatcaacaagcagtctcctagagatcacaaggcgaaaaagactctccaatccaccccccgaaacgatgaccatgacctgcttaccatgctgcccgacgagatcttgaataggggcccaggcaatagcaagaacactgagtttctcaagcaccaggctgtgaataactactgcccctggaagattggcaaaatggaaacgtggttacacgaacaggaagctcagggtcaactcctctgggatagtagtagtagcgatagtgacgaacaaggcaaggatgaaaagaaacctcgggcactggtccggactcgaaccgagaggatccctctgtttgacgagttctttgatcaagagtag

SEQ ID NO: 16699 - DNA, 1734 bp, Artificial Sequence
  Description of Artificial Sequence: Synthetic coding sequence
atgcccgagggcgcccaggggctctcattatccaagccctccccttcgttagggtgcggacggcggggtgaggtctgcgactgtggtactgtttgtgagacccgaaccgctcccgccgcccctactatggccagtcctcgcggaagcgggtctagcacctctctcagcaccgttggctcagagggcgatcccgctcccggcccgacgcccgcctgttcggcctcgcgacccgagcctcttcccggaccccccattcggcttcatttatcacctgtcggcatcccaggctcagcccggccatcacgtctcgagagagtcgctcgagagatcgtggagaccgagagggcctacgttagggacctcagatcaatcgtggaagattatttgggtcccctactcgacggcggcgtgctgggcctttccgtcgaacaggtggggacacttttcgcgaatattgaggatatttacgaattttcatccgagctgttagaggacctggaaaattcctccagcgcgggaggcatagccgaatgtttcgtgcagagatccgaggattttgatatctacacactgtattgtatgaattaccccagctctctggccctgcttcgtgaactgagcctgtcacctccagccgctctgtggctgcaggagcgacaggcccaactgcggcactctttacctctccaaagctttcttcttaaaccggtccagcgcattctgaaatatcatctgctcctccaggaactcggcaagcattgggccgagggcccgggaactgggggacgggaaatggtggaggaagccattgtttcaatgacagcagtcgcctggtatattaatgacatgaaaagaaagcaggagcacgcagctcggctccaggaagttcagcggagactcgggggctggacaggtcctgaactaagtgctttcggggaactcgtgttagagggtgcattccgtgggggtggaggcggggggccacgcctgagagggggcgaaaggttactgttcttattttctcggatgctactagtcgccaaacggcgggggctggagtacacgtacaagggacacatcttttgctgtaacctctctgtatccgagagtccacgcgaccccctgggcttcaaggtgagtgacctcaccatcccaaagcacagacacctgctgcaggctaagaatcaagaggaaaaacgtctatggattcattgcctgcagcgactgtttttcgagaaccatccagcatctattccagccaaggcaaagcaagtgttgcttgagaactctctgcattgtgccccaaagagtaaacctgttttggagccactcacgcctccgctcggtagtccacgcccccgggatgctcgttccttcactccgggtcggcgtaatacagcaccctctcccggcccttctgtgattagacgagggcggaggcagtctgagcctgtgaaagacccgtacgtgatgtttcctcagaatgcaaagcccggattcaaacatgctggttccgagggggagctatatcctccagaaagccagccacctgtttcaggctccgccccccctgaagacctggaagatgcaggcccaccgactctggacccgagtggcaccagcatcaccgaggagatcttggagctgctcaatcagcgggggctgcgagaccctggagaatccatgggtttgcaccgcgcgcaaggcgctcctgacgcccccttccacatgtag

SEQ ID NO: 16700 - DNA, 4161 bp, Artificial Sequence
  Description of Artificial Sequence: Synthetic coding sequence
atgcctgaaggcgcccagggcctatccctgtcaaaacccagcccttctcttggatgtggacgccggggtgaggtttgtgactgtggtacggtgtgcgaaactaggactgcgcccgccgcccccactatggcctcgccaaggggctccggctccagcacttcactaagcacagttggtagcgagggcgacccggctccaggccccaccccagcttgctctgccagccgccctgagccattaccaggacctcccatccgcttacacttgagccccgtaggcattccgggtagcgcaagaccctccaggctggagcgcgtggcacgggagatcgtagagaccgaaagagcttacgttagggatctgcggtcaatagtggaagattacttaggacccctcttagacggcggcgtgttgggcctatcggtggagcaggtgggcactctgtttgcaaacatcgaagacatctacgaattttctagtgagctactcgaagatctggaaaattcgagtagcgccgggggcatcgcagaatgctttgtgcagcggtctgaagatttcgatatatacaccctgtattgtatgaattatccttcctccctcgctctgctgcgcgagctctcacttagtcccccagctgctctgtggctccaggagaggcaggcacagttgcggcatagcttaccactgcagtcattcctgctcaagcctgttcagaggatcctaaagtaccacctgctgttgcaggagctaggcaaacattgggccgaggggcccgggaccggcggtcgggagatggtggaagaggcgattgtgagcatgactgccgtggcatggtacattaacgacatgaagcgcaaacaggaacacgctgccaggttacaggaggtgcaacgtcgattgggcgggtggactggccccgagctctcagcttttggcgagcttgttttagagggggcctttcggggagggggcggaggcggacccagactccggggaggtgagcgactgctcttcctatttagcagaatgcttctcgtggctaagcggagggggctggagtacacatataaaggccacatcttctgctgcaacctgagtgtgtctgagtcaccaagagacccactgggctttaaagtgagtgacctgacaatccctaagcacagacatctgctacaggctaagaatcaagaggagaaacggctctggatccactgcctccagaggctgttctttgagaatcacccggctagtatcccagccaaggcaaagcaagtcttactggagaatagtttacattgcgccccaaagtctaaaccagtgttggagcccctcaccccgcccttgggcagcccaagacccagggacgcccggagcttcacgcctggacgccgcaacaccgcaccctcacccggcccctccgtgatccggagaggtcgcaggcagtccgagccggtgaaagacccatatgtcatgttcccccagaatgcgaaacctggtttcaagcacgccgggtctgagggggagctttacccccctgagtctcagcccccagtctctggaagtgctccacctgaggatctggaggatgcaggcccgcccacactggacccatccgggacctctataacagaggaaattctggagcttctcaatcagcggggcctgcgggatcctggtccatcaacccacgacattccaaagtttcctggggacagccaagtccccggagactccgagacactgacattccaagcactaccctctcgtgattctagcgaagaggaagaagaagaagaagagggcctagaaatggatgagcggggtcccagccctctgcatgtcctggaaggccttgagtccagcatcgccgcagaaatgccgagtatcccatgccttactaaaatcccagacgtccccaacttgcccgagataccatcaagatgcgagatacctgagggcagtcgattgccaagtctttcggatatttctgatgtattcgagatgccttgcttacctgcaatcccctccgttcccaatactccaagtttgtcatctacaccaaccctctcctgcgacagctggctgcagggccctctgcaggaaccagctgaggctcctgctaccagacgtgaactgttttcaggtagtaaccctggtaagctgggtgaacctccatccgggggcaaggcaggacccgaggaggacgaagagggtgtgtccttcaccgactttcaacctcaggatgttacgcaacatcagggcttcccagatgaactggcttttcgatcgtgcagcgaaattcggtctgcctggcaggccctggaacagggacaattagcccgcccagggttccccgaaccactgcttatcttagaagactctgacctggggggcgactcagggtctggaaaggcgggcgctccctctagtgaacgtacggcaagcagagttagggaactggctaggctctacagcgagcgcattcagcaaatgcagagggccgaaactcgcgcaagcgctaacgcacctcgtagaagacctagagtcttggcgcaaccacaaccctccccctgcctccctcaggaacaggccgagcctgggctcttacccgcttttggtcatgttttggtctgcgagctagcttttcccctgacgtgcgcgcaggaatcagttcctctggggccagcagtgtgggtccaggccgctattcccctctctaaacaggggggatcgcccgatggccagggtttgcatgtgtcaaacttgcctaaacaagatctgcctggtattcacgtgtccgcagcgacactcctgcccgaacagggggggtcccgccatgtccaagctccagcagccactcctcttccaaagcaagagggtcctctccaccttcaggttcccgccctgactactttctccgatcaagggcacccagaaattcaggtgccagcaactaccccgctacctgagcatagatcgcatatggtgatcccagctcccagcaccgcattttgtcccgagcaggggcactgcgcggacatccacgttcccacaacccctgcccttcccaaggaaatctgcagcgacttcacagtgtctgtaaccacccctgtgcctaagcaggagggccatttagattcagagagtccgaccaatatcccacttactaaacagggggggtcccgggatgtgcaggggcccgatcctgtttgtagtcagcctattcagccactaagttggcatggaagctccctggaccctcaggggcctggagatactctgccccccctgccatgtcatctgcccgatctacagatacctggtacatctccactgcccgctcatgggtcccacctcgaccatcgcatcccagctaatgcgccactaagtctgagccaggaattgccagatacacaagttcctgcgactacacccctccccctccctcaggtactaaccgatatttgggtgcaggctcttcctacgagcccgaaacagggcagcttgcccgacatccaaggacccgccgcagctcccccactccccgagcccagtctaacagatacccaagtccagaaacttacccctagcctggagcagaagtcattaatcgacgctcatgtgcctgctgcaacccccctacctgaaagagggggctccctagacatccaagggctgtcaccaactccagttcagacaactatggtgctaagtaaacccggtggatctctcgcctcacacgtagcaagattagaaagcagtgatctcacgccccctcactcacctcctccatcttctcgccagcttctcggacccaacgccgccgcattgtcccgctatctggccgcctcctacatctcacagtccctggccagacgacagggccccggcgggggcgcgccagctgccagccgcggctcttggtcctcagctccaacctcccgggcttctagtccacctcctcagccacagcctccaccacctcccgctagacggctttcttatgctactacagtcaatatccacgtgggcggcggggggaggttgcggcccgcaaaggcccaggtaaggctcaaccaccctgctttgctcgcttcgacccaggagtccatggggctccaccgggctcagggcgcacctgacgctccattccatatgtag

SEQ ID NO: 16701 - DNA, 1734 bp, Artificial Sequence
  Description of Artificial Sequence: Synthetic coding sequence
atgcccgaaggagcccaggggttatctctttcaaaaccctctccttcccttggttgtgggcggcgcggagaagtttgtgactgcggtacggtttgtgagacacgcaccgcgcccgccgcccccacaatggctagccctaggggatcaggatctagtacatccctgagtaccgtggggagcgagggagatccagccccaggccccacacctgcctgttccgcttcccggcctgagccgctgcctggcccccctataaggctccacctttcacccgtgggaatacccggctccgcccggccgagccgacttgaaagggtggcacgggaaattgtggaaactgaacgagcctacgttcgcgatctccggtccatcgtcgaggattaccttgggcccctacttgatggcggagtcctgggattatctgttgaacaggtaggaaccctgtttgcaaatattgaggacatatatgagttttcttctgagctcttagaagaccttgaaaactcttcttctgccggaggtattgcagagtgctttgtgcaacgtagtgaagactttgacatctacacgctctattgtatgaactatccctccagcctggccttgctgcgtgagttatcactgagtcctccggctgctctctggctccaggaacggcaggcccaactgcgacacagcctccctctgcagagcttcctgctcaagccagtgcaacgtatcctcaagtatcatctgttgctgcaggaactcgggaagcattgggctgaggggcccggaaccggtggacgtgagatggtagaggaggctatagtctccatgaccgccgttgcctggtacatcaacgatatgaaacgaaaacaggaacacgcggcaagactgcaagaagtacagagaaggctgggaggatggacgggtccagaattgtctgctttcggggaattagtgttagaaggcgctttccggggtggcggcggcggtggccccaggctgagagggggagaaaggcttttattcctcttttcgcggatgttgctcgtggctaagcgcaggggtttggagtacacttataaaggccatattttttgttgcaacctgtcggtctctgaatccccccgtgaccctctgggcttcaaggtgagcgatctcaccatccccaagcatcgccacttactccaggcaaagaatcaagaggagaagcgcctgtggatacattgccttcagcggctctttttcgagaaccatccggccagcatccctgctaaggctaaacaggttcttttagaaaatagcttgcactgcgcacccaagtcgaagccggttctggagccgttgactccccctttaggctcccctcgcccacgtgatgctaggagcttcacacctgggcgacggaatacagccccaagcccaggtccttcggtcatacggcgggggcgccgccagtcggagcccgtcaaagacccgtacgtaatgttccctcagaatgccaaaccgggattcaagcacgctggatctgagggagaactctaccctcccgaatcgcagccccctgtgagcggatctgcacctcctgaagatctggaagacgccggaccacctaccctagatccttcaggaacctcgattacagaagagatcctcgaactactcaaccagcgcggcctgcgcgatcccggtgagtccatgggcctccatcgagcacagggtgctcctgatgcaccattccacatgtag

SEQ ID NO: 16702 - DNA, 4074 bp, Artificial Sequence
  Description of Artificial Sequence: Synthetic coding sequence
atgccagagggagctcaaggcctgagtctgtcgaagccatcaccttcattgggatgtggcagacggggggaagtttgtgattgtggtactgtttgcgaaacacgcactgccccagctgccccgactatggcgtcccctcgaggcagcgggagcagcacaagcttgtccaccgtagggtcagagggtgatcccgcaccaggtcctacacctgcttgtagtgcgtcgcgccccgagcccctgcccggacctcctattagactgcacctgtcacccgtgggtatacctgggtccgctaggccctcacgtcttgagagagtggccagggagattgtcgaaaccgaaagagcttatgtacgagatttgcgcagtatagtcgaagattacctgggacccctgctcgatggcggggtgctcgggttgtctgtcgagcaagtgggaactttattcgccaacatagaggatatttatgagttcagcagtgaactgctggaagaccttgaaaattcatcatccgccggcggcatcgccgagtgtttcgtacaaagatcagaggacttcgatatctatacactctactgtatgaattatcctagtagcctggccctgctgcgggagctgtccttatcaccccctgccgctctgtggctgcaggagcggcaagcccagctgcgtcatagtctgcccttgcaatctttcttgttgaaacctgttcagcgcatactaaaataccatttgctgttgcaggagcttgggaaacattgggccgaagggccaggaaccggaggaagagaaatggtcgaggaagctatcgtgtcaatgaccgcggtggcttggtacattaacgatatgaaacggaaacaagagcatgctgctcggctccaggaggtacagcggaggctgggtggatggaccggacctgagctttccgctttcggcgaattggtccttgagggagcttttcgcggaggtggaggaggcggacccaggctgcgcgggggagaacggctcctcttcctgttcagtcgaatgctgctcgtggcaaagaggagaggcttggaatatacttataaagggcacatcttctgctgcaacttgtctgtgtcagaatccccccgcgatcccctgggtttcaaagtgagcgatttaaccattccaaagcacagacatctgctgcaggccaaaaaccaggaagagaagagactctggatccattgcctgcagcgactcttctttgaaaatcatcctgcttctattcctgctaaagcgaaacaggttctgctggaaaattccctacactgcgcccccaagagtaagcccgtcctcgagccccttaccccacccctgggcagccctcgtccccgggatgcacgcagctttactcccggacggcgaaatactgcaaaaccgggctttaaacacgccggttctgaaggtgaactgtaccccccggagtcacagccacctgttagtgggagtgccccaccagaagatttagaagacgcagggccgcccactctagacccaagcggtacctctataacagaggagattctggagctgctcaatcagcgtggactaagggatccaggtccgtccactcacgatattcccaagtttcccggggatagccaagtccctggtgacagcgagacactgactttccaagccctcccatcgagagatagcagcgaagaggaggaagaagaggaagaggggttagagatggacgaacgggggccttccccactgcacgtgctggagggattagagtctagtatagccgctgaaatgcctagcattccgtgtctcacgaagataccagatgtgcccaatcttcctgagattcccagccggtgcgagatccccgagggcagccggttgccctctctgtccgacatctctgatgtgttcgaaatgccatgcctgccagcaatcccatcagtgccgaacaccccatctttatccagcacccccaccctgtcatgtgattcttggcttcaagggccactccaggagcctgctgaggcccccgctacgaggcgggaactgttttctgggtccaatccgggtaaactgggagaaccgccttccggagggaaggctggtcctgaggaagatgaggagggtgtttccttcactgactttcaaccccaagatgtgacccaacaccaaggctttccagacgaattagcctttaggtcttgctctgagatccgcagtgcgtggcaggctctggagcaaggacagctcgctagaccgggcttccccgagccactcctgatcttggaagactcggatctgggaggcgacagcggatccggcaaggctggggccccaagctcagagcgtaccgcaagccgggtcagagagttggctagattatacagcgaacggattcaacagatgcaaagagcggaaaccagggccagtgccaatgctcctaggcgccgcccccgcgtgttagcccagccccagccatcaccctgcttgcctcaggaacaggccgagcccggtctcctccctgcttttgggcatgtcctagtgtgcgagttagccttccctctgacttgtgctcaggaatcggtgcccctagggcctgctgtttgggttcaagcagcgataccactaagcaaacagggaggaagccctgatggccagggtttgcatgtaagcaacctccctaagcaggatttacccggtattcacgtgtcagccgctactctgctgccagaacaggggggttccagacacgttcaggcacctgctgcaactcctctccccaagcaggaggggcccctacaccttcaggtgccagccctgactacattttcagaccaagggcatcctgaaattcaagtacctgccactacacccctgccagagcaccgtagccacatggtgatcccagcgccatccacggctttttgccctgagcaagggcattgcgcggacattcacgtcccaacaacgcctgcactgccaaaggaaatctgcagcgatttcaccgtgagtgtgacaacgcccgtgcctaaacaggaaggccatctcgactcagaaagccccaccaacattcctctgactaagcagggcgggagccgagatgttcagggtccagatcccgtctgcagccaacctatccaacccctgagctggcacggaagcagtctggatccccagggaccaggcgatacgctgccacctctgccttgccatctgcctgatctgcaaatcccggggactagccctctccctgcccacgggtcacacttggaccaccggattccagccaacgcgccactctcactatcacaggaactccccgatacgcaggtgccagcaactacccccctgcctctgccccaggtgctgaccgacatttgggtccaggctctccctacctcgccaaagcagggatccctgcccgatatccagggcccggccgcagcgcccccgctgcctgagccatcacttactgacacacaggtgcagaagctgaccccttccttagagcaaaagtctctgattgatgctcacgtacctgccgcaaccccattaccagaaagaggtggatcactcgatatccagggcctctcgccaacaccagtgcaaactacaatggtactttctaaacctggtggcagcctcgccagtcacgtcgctcgtctagagagtagcgacctgactcctccccatagcccaccgccttcatcccgacagctgctgggtcctaatgctgccgctctgagcagatacttagccgccagctatatcagtcagtctctcgctcgtcggcaaggacctggcggtggagctccagcagccagtcgcggatcatggagctccgcgccgacctcacgggcaagttccccccccccacagcctcagccaccacccccgccagcgcgcaggttgtcctacgctactactgttaatattcatgtggggggcgggggtaggctgcgtcccgcgaaggcgcaggtgcggctgaatcatccggccttattagcgagcacacaggaatcaatggggctgcaccgggcacagggcgctcctgatgccccctttcatatgtag

SEQ ID NO: 16703 - DNA, 597 bp, Artificial Sequence
  Description of Artificial Sequence: Synthetic coding sequence
atgcccgaaggcgcacagggcttgtcacttagcaagcccagtccctccctggggtgcgggagacggggggaagtctgcgattgtggcactgtgtgcgaaacccgcaccgccgctccagccgcccctacaatggctagcccccgggggtctggaagcagcacctccctgtctaccgtgggttctgagggtgacccagcccctggacctacacctgcgtgctccgcttctcggccagaaccgttgcctggtccacccatccgcctccatctttctcctgtcggcattccaggcagtgctcggcctagcaggctggaacgcgtcgccagggaaattgtagaaactgaaagggcttacgtgcgcgacctgagatctatcgttgaggattatctcgggcccctgctcgacggaggcgtcctcggcctgtccgtggagcaggtcgggacgctgtttgccaatattgaggacatttatgagttctcctccgagcttctagaggacctagagaacagttcttctgctggtggaattgccgaatgttttgtccagagatccgaagacttcgatatttacaccctgtattgtatgaactacccatag

SEQ ID NO: 16704 - DNA, 3714 bp, Artificial Sequence
  Description of Artificial Sequence: Synthetic coding sequence
atgccggagggggcacaaggcctgagtcttagcaaaccaagtccatctctcggatgtggaagaagaggtgaggtttgcgattgcggtaccgtgtgtgaaaccagaactgggagcgccagacctagccggttagaaagggtggcgagggagatagtagaaactgagagagcttatgtgagggatcttcggtccatcgtcgaagactacctgggtccactgctggatgggggcgtcctcggcctcagcgtcgaacaagttggcacgctcttcgccaatatagaagacatttatgaatttagtagtgaactgttagaggatctggagaactcatcatcagctggtggcattgctgaatgctttgtgcagagaagtgaggattttgatatatacaccttgtattgtatgaattacccatctagcctggcgttgttgcgagagctaagtctgtcccccccagcagcattgtggcttcaggaacggcaggcccagttgaggcacagtctaccgttgcaatcttttctgctgaagcctgtccagcggattctgaaataccaccttcttcttcaggaactaggaaaacattgggcagaggggcccggaaccggaggacgcgaaatggtggaagaggccattgtgtcgatgactgctgtcgcttggtatatcaacgatatgaaacggaagcaagaacacgcggcccggcttcaggaggtgcagcggaggttgggcggctggacgggcccagaactgagcgccttcggggaactggtgctggagggcgcttttagaggtgggggtgggggagggcccaggcttcgtggcggggagagactgctgtttctgttctctcgaatgctccttgtggctaaacggaggggcttggaatacacatataaaggacacatattttgctgcaatctgagcgtctctgagtccccgagagacccactgggattcaaggtctcagatctgaccatccctaagcacaggcatctgctccaggccaagaatcaggaggagaaacgcttgtggatacattgccttcagagactgttttttgaaaaccacccagcctccatccccgccaaagcaaagcaggtgctgctcgaaaatagccttcactgtgctccaaaaagcaaaccagtcctggaaccactgaccccacctctgggcagtcctcggccgcgggacgccagatcatttactcccggacgccggaacacggcccccagccccggcccatcagtgatacgtcggggcaggagacagtccgaacctgtgaaggacccctatgtgatgttcccacaaaatgcaaagcctggcttcaaacatgccgggtctgagggcgaattatacccgcctgaatctcaacctcctgtatcaggtagtgccccaccagaggacttagaggatgccggaccccccacactggacccttctggtacctctatcacagaagagatcctcgaactgctgaaccagcgtggtttgagggacccaggtccaagcactcacgatatccctaaattcccaggagacagccaggtgccgggcgactctgagaccttgacgtttcaggcgctgccaagcagggattcatccgaggaagaggaggaggaggaagaggggctggaaatggatgagagaggtccatctccgctgcatgtcttggagggcctggagtcatcaatcgctgccgagatgccctctatcccctgcttgaccaagattcccgacgtgccaaatttgcctgagattccttctcgctgtgagatccctgaaggctcacgactaccatccttgtctgatatcagcgatgttttcgaaatgccttgcttaccagctattccaagcgttcctaatactccttcactctcatctacgcctacacttagttgcgacagttggctccagggccccctccaggaacctgcggaagcacccgctacccggcgggaacttttcagtggatccaatcctgggaaactcggggagccgccctcaggcggaaaagccggccctgaggaagatgaagagggtgtgtccttcacggactttcagccacaagacgtcacgcagcaccagggctttcccgatgagctggcgtttcggagctgctccgaaatccgctctgcttggcaagcacttgagcagggccagctggcgcgtccaggctttccagaacccctattaattcttgaagacagtgatcttggcggagactccgggagcggcaaggccggcgctccttcaagcgagcgtactgcttcccgggtgagggagctcgcaagactgtattctgagaggatccaacagatgcagcgagcagagacccgggcaagtgctaacgctccacgcaggcgtcctagggtcctcgcacagccacagccttccccttgtcttcctcaggaacaggctgagccgggcctactccctgcatttggtcacgtgttagtgtgcgaactggcgttccctttaacatgtgctcaggaatccgttccattgggtccagccgtctgggtgcaggcagcaatccccttatccaagcaaggcgggagtccagatggacaggggctccatgtgtcaaacctccctaagcaggacctgccaggtattcatgtatcagccgcgaccttgttaccagagcagggaggctctcgccatgtacaagcacccgccgccactccgttgcccaagcaggaagggccactgcacttacaggtgcctgctttgactacattcagcgatcaggggcacccagaaatacaggtcccagcgactactccactccccgagcatcggagccacatggtgattcctgcaccctctacagcattctgccccgagcagggacactgtgctgacatacatgttccgaccactcctgccctcccaaaggaaatttgcagcgacttcactgtttctgtgactaccccggttcctaagcaagaagggcacctggattctgagtcacccactaatattccacttactaaacagggaggctccagagatgtacagggccccgaccctgtctgcagccaaccgattcagcccctgagctggcacgggtcttcactcgacccccagggcccgggggataccctgcctcctttgccctgccacctgccggacctgcagattccagggacttctcctctgccggcccatggcagtcaccttgatcatcggattccggctaatgctcccttgtcgttgtcacaggaactgcctgatacgcaggtgccagccactacccctctccctttgccccaggtcttgactgatatttgggtccaggccctccccactagcccgaagcagggaagcctgcccgacatccagggtcctgccgccgccccaccactccctgagcccagtttgacagacacccaggttcagaaactcacaccctctctggagcagaaaagtctgatagacgcccacgtccccgccgcaacgcctctgccagagagggggggctctttggacatccaaggactgtctcccacgcctgtgcagacaacgatggtgttgtccaaaccaggtggctcgctggcctctcacgtggcccgcaatttatgggcttttaccgggcctcgaggattgctgatgcccccttctacgtgtgagcccgggcatgaagcctctctaaagcagggtttccagccagacgccatcgacccccaaaacctgacatggaagtcacgccactag

SEQ ID NO: 16705 - DNA, 1128 bp, Artificial Sequence
  Description of Artificial Sequence: Synthetic coding sequence
atgatgaagaagaataattcggccaaaaggggcccacaagacggcaatcagcagccagcacctcccgaaaaggtcggctgggtgaggaagttctgtggaaagggaatctttcgtgagatctggaaaaatagatacgtggtgttgaagggagatcagctgtatatttctgagaaggaggtgaaagatgagaaaaacattcaggaggtctttgacctctccgattatgaaaaatgtgaggaattgagaaaatccaagagtcgttccaaaaaaaaccacagcaagtttaccctggcacatagcaagcagcccggaaacactgctccaaacctcatctttctggcagtctctccagaagaaaaagagtcctggatcaacgctctcaattctgcaatcacgagggccaaaaaccgaatcctggatgaggcatctacgagcacatctgacggaatgcttacccttgacctgattcaggaagaggaccctagcccagaggaacccacaagttgtgctgaatctttcagggtagacctggataaatccgttgcccagctggctgggtcccgacgcagggcagactcagataggatccagccaagcgccgatagagcgagtagtctgagtaggccgtgggagaagaccgataagggcgccacttatactccgcaggcgcctaagaagctgacccctaccgaaaagggaagatgtgcctccctcgaagagatcttgtcccagcgagatgccgcatcagctagaacgcttcagctaagggcagaagagcccccaacccctgcattgcccaaccctggccagctatctcggatccaggatctagtggcccggaagctcgaagagacccaggaactccttgccgaagttcaaggcctcggtgacggtaaacgtaaggcaaaggacccacctcgcagccccccagatagcgagtcagaacagctcttgctcgagaccgagagacttctgggggaagcttcctctaactggtctcaggcaaagagggtcttgcaagaagtgagagaactaagggacctgtacagacagatggaccttcagacccccgactctcacctccggcagaccactccgcattctcagtatcgcaagagtttaatgtag

SEQ ID NO: 16706 - DNA, 1230 bp, Artificial Sequence
  Description of Artificial Sequence: Synthetic coding sequence
atgatgaagaaaaacaactctgcaaaacggggtccacaggacggtaaccaacaacccgccccacccgaaaaggtgggctgggtgcggaagttttgtgggaagggtatctttcgagaaatttggaagaatcggtatgtggtgctgaaaggcgaccagctctacattagtgaaaaagaagttaaagatgaaaagaacatccaggaagtcttcgacctaagcgattatgaaaaatgtgaggagctcagaaagtcaaagtctcgcagcaagaagaaccattccaagtttaccctggcacacagcaaacagccgggcaatacagctcccaacctcatctttttggctgtcagccccgaggagaaggagagctggataaacgcactcaattcagccatcactcgtgccaagaaccggatcttggacgaggttactgtggaggaagatagttaccttgcccaccctaccagagaccgagctaagatacaacacagtcggcggcctccaaccagggggcacctcatggcagtagccagtaccagtacaagcgacggcatgcttactttagatcttatccaggaagaggatccctcccccgaggaacctactagctgcgccgagtcattccgagtcgatctcgacaaaagcgtggcgcaacttgctggtagcaggagaagggcagatagtgaccgaatccagccgagtgccgatcgcgcctctagcctaagccggccttgggagaagacagacaaaggcgcgacatatactccccaggcacctaagaagttaacccccactgagaagggccgatgtgcgagcctggaggaaatcctgtcccagagagacgccgctagtgccaggaccttgcagctgagggcagaggaaccccccacacccgctctccctaaccctgggcagctctctaggatccaggacctcgttgcccgcaagctggaggagacccaagaacttctggcagaagtccaaggactgggagatggaaaacggaaggcaaaagatcctccgagatccccccctgatagtgaaagcgagcagctgctccttgaaaccgaacggttgctgggagaagcatctagtaattggtcccaggcaaagcgcgttctccaggaagttagggaactcagagatctgtatcgccaaatggacctccagacgcccgatagccatctgcgccagaccactccgcatagtcaatatcgaaagtccctgatgtag

SEQ ID NO: 16707 - DNA, 681 bp, Artificial Sequence
  Description of Artificial Sequence: Synthetic coding sequence
atgttgacacttgacctgatccaggaagaagacccctcccccgaagaacccaccagctgcgcagaaagtttcagggtagatttggacaagtctgtagcccagctcgctggatcaaggagacgagccgacagcgacagaattcagccttctgcggaccgagcatctagtctctcacggccctgggagaaaaccgacaagggtgcgacctacaccccccaggcacccaagaaactgactccaaccgaaaaaggccgctgtgcatcactggaggagatcctgtcccagagagatgctgcttccgcacgcaccttgcagttaagggccgaggagccacccacgccagctttgcctaatcccggccagctgagtcgcatccaggaccttgttgcacgcaagctggaggaaactcaagaacttctggctgaagtccagggccttggagacggcaaacggaaagccaaggacccacctcggagccctcctgattctgagtccgagcagctgctcttggaaacggaacgtctgcttggagaagcctcttcaaattggagtcaggcgaagcgggtgctgcaagaggtgagagagctccgcgatctgtatagacagatggatctccagaccccagattctcatctgcggcaaaccacaccgcactcccagtaccgaaaatccctgatgtag

SEQ ID NO: 16708 - DNA, 675 bp, Artificial Sequence
  Description of Artificial Sequence: Synthetic coding sequence
atgccaagtactctgccctcccccgaaccacgcaccgtctcctggatgagcacgtcactccaagtgactgttgaggaagattcctacctggctcacccaacacgcgatagagccaaaattcagcactccagacggccccccaccagagggcacctcatggcagttgccagcaccagcaccagtgacggcatgcttaccctagacctgattcaggaagaagacccctcacccgaagagcctacatcatgcgcagaaagtttcagagttgatctcgacaagagcgtggcacagctggctggctccagacgaagggccgactccgacagaattcaaccctccgcagacagggcctcaagtttgagcagaccatgggaaaaaacagacaagggagcaacctatacaccccaggcccccaagaagttgacacctactgaaaaaggccggtgcgccagcctcgaggaaattctctctcagagagatgccgccagtgcaaggaccttacagcttagagctgaggaaccccccactccagcactgcccaaccctgggcaactgagtcgcattcaggacctcgtcgctcgaaagctggaggagacccaagaattactagccgaggtccaggggctcggggacgggaagaggaaagccaaagacccgcccaggtctcctccgtag

SEQ ID NO: 16709 - DNA, 384 bp, Artificial Sequence
  Description of Artificial Sequence: Synthetic coding sequence
atgaccgcagcagcaaccgcaaccgtgctgaaggaaggggtgttggagaagcgctcaggcgggcttctgcagctctggaagaggaagcggtgcgtgctcactgaaaggggtctccagctcttcgaagctaagggcacaggggggaggcctaaagagctgtcttttgcgcgaatcaaagcagtcgagtgcgtagaatcaactggccgccatatctactttaccctggtgacggaggggggcggcgagattgatttccgttgtcccctagaggaccccgggtggaatgcacagatcacactgggcctggtgaagttcaagaatcagcaggcgatccagacggtgcgggcccgccagtcactcggtacaggtacactggttagttag

SEQ ID NO: 16710 - DNA, 384 bp, Artificial Sequence
  Description of Artificial Sequence: Synthetic coding sequence
atgacggcagccgcaactgccactgttcttaaggaaggagtcttggagaagcgatcgggaggcctgctccagctctggaaaagaaaacgctgtgtgctcacagaacggggtctccaactgtttgaggcaaaaggaaccggaggtcgtccaaaggagctgtcttttgcaaggatcaaggccgtggagtgtgtggagtctactggaagacacatttattttacactggttacggaaggcgggggtgaaatagactttcggtgccctctagaggatcccgggtggaacgcacagatcaccctgggcctggtcaagtttaagaatcagcaggcgatccaaactgtgcgggcccggcagtccttgggaaccggaaccctagtttcttag

SEQ ID NO: 16711 - DNA, 1710 bp, Artificial Sequence
  Description of Artificial Sequence: Synthetic coding sequence
atgtcgttcggaatcctcaagcccgacctgcgcattgtgttcgtccacaataaggcggtcatttggcaaaagtcccgggtgtctgatcacaaaatggctctcatgtccgttctgggcaccgccgttatgaacaatatggaaagtttccagtaccactctgaagagagccaaatctatctgagcggctttctgccaaaatgtgacgcagaccacagctttaccagtctgtccaccccagagcgcagctttatctttattaatagtaggcccgtgcaccagaaggacattctcaaactcattcgccaccactacaatcttaagtgcttaaaggaatcaactcggctctaccccgtgttcttcctgaagatcgatgtgcccaccgcagacgtggacgtaaatctgacgcccgataagagtcaagtgctgttgcaaaacaaggaatctgtcctcattgctctggagaatctgatgactacctgctacggacccctgcctagcacaaattcttacgaaaataataagaccgacgtgagtgctgcggatattgtcctgtccaagactgccgaaaccgatgtgttgttcaacaaagtggagtcttcgggaaagaattattctaatgtagacacttctgtgataccttttcaaaacgacatgcacaacgacgagagtgggaagaacacggacgactgtctgaaccaccaaatttccattggcgatttcggctacggccactgctccagtgagatttctaacattgacaaaaataccaaaaatgcatttcaggacataagcatgagcaatgtctcttgggaaaattcccagaccgagtacagcaagacctgtttcatctcctccgttaagcatacccagtccgagaacggaaataaggaccacatcgacgagagcggggaaaatgaagaagaagccgggctggaaaacagctctgagattagcgccgatgaatggtcgagagggaatattctcaaaaattcagtgggagaaaacattgaacccgttaagatcctggtgcccgagaaatcccttccctgcaaagtcagcaacaataattatccgatccccgagcagatgaatctaaacgaggacagttgtaacaagaagagcaatgtgatcgataacaagtccggcaaggtgaccgcctacgacttgctgagcaatcgtgtgatcaagaagcccatgagcgcttctgcactctttgtgcaagaccacagaccacagttcctgattgagaacccaaaaacctccctggaagatgccacccttcagattgaggagctatggaagacgctctccgaagaggagaaactgaaatatgaggaaaaggccaccaaagacttggaaagatacaattcacagatgaagagggcaatcgaacaggagtctcagatgagtctaaaagacggccgcaaaaaaattaaaccgacatcagcttggaatctggcgcagaaacataaattgaaaacctcactgtcaaatcagcccaaattggatgagctcctacagtcccagatcgaaaaacgcaggagtcagaatatcaagatggttcagattccattttctatgaaaaatctcaagattaacttcaagaagcagaataaggtggacttagaagaaaaagacgagccatgcctaattcacaacttgaggtttcccgatgcttggttaatgacctcaaagacagaatctttttag

SEQ ID NO: 16712 - DNA, 2271 bp, Artificial Sequence
  Description of Artificial Sequence: Synthetic coding sequence
atgtcctttggcattttgaaacccgatttacggatcgtctttgtacacaataaagccgtgatctggcagaaatctcgcgtgtctgaccataagatggctttaatgagtgtgctcggtactgccgtgatgaacaacatggaaagcttccagtatcacagtgaagaatcacagatctacttaagtggattcctgcctaagtgtgacgcggaccattcctttaccagcctctctacccctgagcgaagctttattttcattaactcacggcctgtgcaccagaaggatatactcaagctaatacgccaccattataaccttaagtgccttaaagaaagcacccgcctgtatcccgtgttcttcctgaagatcgacgtacctaccgctgacgtggatgtcaatctgactcctgacaaatcacaagtgttgctgcagaacaaagaatcagtgctgattgccctcgagaatctgatgacaacctgctacggtccattaccgtccactaatagctacgagaacaacaagacggatgtgtccgccgccgatattgtgctgagcaaaactgccgaaactgatgttctattcaataaagtggagagctcagggaaaaattactccaacgtggatacctctgtcatcccattccagaacgatatgcacaatgatgaatcagggaaaaacactgacgactgcctgaaccatcagatatcgatcggagatttcggttatggccattgctcaagtgaaatctctaatatcgacaaaaacaccaagaacgccttccaggatatttccatgagcaacgtctcctgggaaaacagccaaacagagtactccaagacctgttttatctcatccgtgaaacatacacagtcagagaacggtaacaaagaccacattgacgaatctggcgagaacgaagaagaagccggactggaaaacagcagcgagattagcgcggacgaatggagtaggggcaacattctaaagaactcagtgggggagaatatcgaacctgtgaagatactggtgcccgaaaaatccctgccctgcaaggtgtccaataacaattacccaatcccggagcagatgaacctcaacgaagatagttgtaacaaaaaatccaatgtcattgataataaaagtgggaaggtgactgcttacgatttgctgtccaacagagtgatcaagaagccaatgagtgcaagtgccctgtttgtgcaggaccacagaccccagttccttattgaaaatcccaagacttcactcgaggacgcaacattgcagattgaagaactgtggaagacactgagcgaagaggaaaagctcaaatatgaggagaaagcaactaaggacctcgagcgttacaacagccaaatgaaaagggcaatcgagcaagagtcacagatgtcgctgaaagatggccgaaagaagattaagcctacctcggcttggaatctcgcccagaaacacaagctgaagactagcctaagtaatcagccaaaattggatgaactgctacagtcccagatagagaagaggcgatctcagaatattaaaatggtgcagattcctttctctatgaagaaccttaagatcaattttaaaaaacagaataaggtcgacttggaggagaaagacgaaccgtgtcttattcataacttgcgcttcccagatgcatggcttatgacctccaaaacagaggtgatgctgttaaacccctatcgcgtcgaagaagccctattgtttaagcggctgctggaaaaccacaagttgcccgcggagccactggagaaaccgataatgctcactgagtccttatttaatggctcccattacctagatgtgctgtataaaatgacagctgatgatcagcggtatagcggcagcacgtacctgagtgacccaaggcttactgcaaacggattcaaaataaaactcatccccggcgtatcaataaccgaaaactacctggagatcgaaggcatggcaaattgcctccctttctacggagtggccgacctcaaggagatcctgaatgccatactcaacagaaatgccaaggaggtctatgaatgtagaccacgcaaggtcatcagctatctcgaaggggaagctgtacgcctgagccggcagctgcccatgtacctgtccaaggaggacattcaggacataatctaccgaatgaagcatcagtttggcaatgagattaaggagtgtgtccatggtcgccccttcttccaccatctcacgtatttgcctgaaacgacatag

SEQ ID NO: 16713 - DNA, 222 bp, Artificial Sequence
  Description of Artificial Sequence: Synthetic coding sequence
atgaaacagctgcccgctgcaaccgtgaggttattgagctcttcccagatcattacttcagtcgtcagcgttgtgaaggagctgatcgaaaattctctggatgctggagctactagcgtagatgtgaagctggagaattatgggtttgacaaaattgaagtgcgtgataacggagaagggatcaaggctgtagacgcgcctgtgatggctatgaagtattag

SEQ ID NO: 16714 - DNA, 585 bp, Artificial Sequence
  Description of Artificial Sequence: Synthetic coding sequence
atgaagcagcttcctgctgccaccgtccgcttactgtctagctcgcagataattacaagcgtggtgtctgtagtgaaggaactgatcgagaacagcttagatgccggcgcaacctccgtagatgtgaagctggagaactatggctttgataaaattgaagtaagggataatggggaaggtattaaggctgtggacgctccagtcatggccatgaagtattatacctcgaagataaattctcatgaagatctggagaatctgaccacttacggatttcggggtgaggctctgggctccatttgttgcattgcagaggttctgattactacaagaaccgccgctgataacttttcgacacaatatgtccttgacggctctggacacatactgtcacagaaaccctcccacctgggccagggtactacagtgactgcactgcggttattcaagaatctacctgttagaaagcagttttacagcaccgccaaaaagtgtaaggacgaaatcaagaagattcaggacctcctgatgagttttgggattctgaaacccgatctgaggattgtctttgtgcataataagtag

SEQ ID NO: 16715 - DNA, 2271 bp, Artificial Sequence
  Description of Artificial Sequence: Synthetic coding sequence
atgtctttcggcatcctgaagcccgacttgcgcatcgtcttcgtccacaacaaagccgtgatttggcagaaatcacgtgtcagcgaccacaagatggcgttgatgagtgtgctgggcaccgccgtcatgaataatatggaatccttccaataccattctgaggaatcgcagatttacttgtctggctttttaccaaagtgtgacgcagaccacagctttacatctctgtccaccccagagcgatccttcattttcattaactctcgccccgttcatcagaaagatatcctgaagctgattcgccatcactataatctaaagtgtttaaaagagtcgactcgactgtacccggtgttcttcctgaagatcgatgttccgactgccgacgtggatgtaaacttaacccccgataaatcacaggtgcttctacagaacaaagagtccgtcctgatcgccctggaaaacttgatgaccacatgctacggacctcttcctagcactaattcttatgagaataataaaacagacgtttccgcggccgacatagtgttgtcaaagactgcagagactgatgtcttattcaacaaagttgaaagtagtggaaaaaactattccaatgtggatacaagcgtgattccatttcagaacgacatgcataatgacgagagtggtaagaataccgacgactgcctgaatcatcagatttcaatcggtgacttcggctatggccactgttcatcagagatcagcaacatcgacaagaacacaaaaaacgccttccaagatatttctatgtcaaatgtgagctgggagaactcgcagacagaatactccaagacctgcttcatttcaagtgtgaaacacacccagagcgagaatggcaataaggatcatatcgacgagtctggcgagaacgaggaagaagctggcctggaaaatagtagcgaaattagtgcagatgaatggtccaggggaaacatcctgaaaaatagcgtgggggagaacatcgaacctgtaaaaatcctggtacccgaaaaatcactcccatgcaaagtgagtaataacaactaccctatccctgagcagatgaacctaaatgaagactcttgcaataagaagtctaatgtcattgacaacaagagcggtaaggtgactgcttatgatctgctgagcaacagagtgataaagaagcctatgtcagcaagtgctctgttcgtccaggatcacaggcctcagttcctgattgagaacccgaaaacaagtttggaagatgctaccttgcaaatcgaagagttatggaaaaccctttcagaggaagagaagttgaaatacgaagaaaaggcaacaaaggacctggagaggtacaattcccagatgaagcgcgcaatcgaacaggagtctcagatgagtctcaaagatggcaggaaaaaaataaaacccacctcggcctggaacctcgcccaaaagcacaagctcaagacctctttgagtaaccagcccaagttagatgaacttctgcagtcgcagatagagaagaggcgcagccaaaatattaaaatggtacagattcccttttctatgaagaatttgaagatcaactttaagaagcaaaataaagtggatcttgaggaaaaggacgagccttgcctgattcataatttgagatttccagatgcttggttgatgacatcgaaaacagaagtcatgcttcttaacccatacagggtggaggaagctctgctgtttaaaaggctgttggagaatcacaagctgcctgccgagccactggagaaacccatcatgcttacagagtccttatttaatggatcccactatctcgatgtgctatacaagatgaccgcggacgaccaacgatatagcggttccacatacttgtccgatccccgcctgaccgcaaatggcttcaagatcaagctcatcccgggcgtctccatcactgagaactacctcgaaatcgaagggatggcaaactgtctgcctttttacggagtggccgacctgaaagagattctgaatgccatactgaatcgaaatgcgaaggaggtatatgagtgtcgcccacgaaaggttattagctacctggagggggaagccgtcagactgtccagacagttgcccatgtatctgagcaaggaggatatccaggacatcatttatagaatgaagcatcagttcgggaatgagattaaagaatgcgtacatgggcgtcccttctttcaccacctcacctacctgccagaaaccacgtag

SEQ ID NO: 16716 - DNA, 2799 bp, Artificial Sequence
  Description of Artificial Sequence: Synthetic coding sequence
atgaagcagctcccagccgcaaccgttaggcttctttcttcatcccaaatcatcaccagcgttgtttctgtggtcaaggagctcatagaaaatagcctggatgccggagcgacttctgttgatgtgaaattagaaaactacggatttgataagattgaggtgcgggataatggtgaaggcattaaggccgtggatgcacccgtgatggctatgaaatattatacttccaaaatcaatagtcacgaggacttagaaaacttaacaacttacgggtttaggggggaagccctcggttctatttgctgtatcgctgaggtgctcataactacaaggacagccgcagataatttctccacacaatacgtcctggacggatctggccatatcttatctcaaaaaccatcccacctcggacaagggacgaccgtgactgctctgagactgtttaaaaatcttcccgttcgcaagcagttctactcaactgctaaaaaatgtaaggatgagatcaagaagatccaggatttgctaatgtcttttgggatccttaaacctgacttgaggatcgtcttcgtgcacaacaaagcagttatctggcaaaagagccgggtgtcagaccataagatggcgctgatgtcggtgctggggacagccgtgatgaataacatggaaagttttcagtaccatagcgaggagtcacaaatatacctctcaggtttccttcctaagtgcgatgccgatcatagtttcaccagcctgagcacccccgagaggagctttatcttcataaactccaggcccgtccaccagaaagacatcctaaaactgattagacaccattacaacctgaaatgtttgaaggaaagtacacgtctgtatccagtgttctttttgaaaatcgacgtccccactgccgacgtcgatgtcaatctaaccccagacaagtcccaggttctgctgcagaataaggaatctgtgctgattgccctcgagaatctgatgaccacttgttatggcccactcccctccaccaactcttatgaaaacaataaaaccgacgtctcagctgccgacatcgtcctcagcaaaaccgcagaaacagacgtcttattcaataaggtcgagagttcagggaagaactattctaatgttgacacctccgtcatcccattccagaacgacatgcacaatgatgagtcggggaagaacaccgatgattgccttaaccaccagatctccatcggagacttcggctatggacactgttcaagcgaaatctcaaatatcgacaaaaacacaaagaatgcttttcaggatatctccatgagtaatgtcagctgggagaactcacagaccgaatattcgaaaacgtgtttcattagtagtgtcaaacacacgcagtctgagaatggtaataaggatcatatcgacgagtctggggagaacgaagaagaagcagggcttgagaatagctcagagattagtgcagacgagtggtccagggggaacattttaaaaaattctgtgggggaaaacatcgagccagtaaagatccttgtcccggaaaaaagtctgccatgcaaggtgtcaaacaataactacccgatccctgaacaaatgaatctgaatgaagatagttgcaacaaaaaaagcaacgtgattgacaataaaagtggaaaagttaccgcgtacgatctgctgtctaaccgtgtgattaagaagcctatgtccgcaagtgcactgtttgtccaggaccatagaccgcagttcctgatagaaaacccaaaaacctcactcgaagacgccaccctccagatcgaggagctgtggaagacactttcagaggaggaaaagctgaagtacgaagagaaggctacgaaagatctggaacgctataattcacaaatgaaaagggctatcgagcaggagtcacaaatgtcactgaaggatggaagaaagaagattaaacccacctcagcctggaacctggctcaaaagcataaactgaagacgtccttgagcaaccagcctaagctggatgaattgctgcagagccagatcgagaagcgtagaagccagaatatcaaaatggtgcaaatacctttcagtatgaagaatctcaagattaactttaagaagcagaataaagtcgacctggaggagaaagacgagccttgcctgatacataatctccgattccccgacgcctggctgatgacaagcaagactgaggtgatgctactgaacccgtacagagttgaagaggcacttctcttcaagcgactgttggagaaccacaagctgcctgctgagcctttggagaagcccataatgctcactgaaagtctttttaatggaagtcactacctggatgttctctataagatgacagctgacgatcaacgatacagcggctcaacctacttaagcgatcctaggcttacagccaacggctttaagatcaagcttatacccggcgtgtcaatcactgaaaactacttggaaattgagggcatggctaactgcctgcccttctatggggtagccgaccttaaggagatcctaaatgcaatattgaacaggaatgcaaaagaggtctacgagtgccgtccccgcaaagtgatttcgtacttggagggagaggccgtgcgccttagcaggcagctcccgatgtacctatctaaggaggatattcaggatataatttatcggatgaaacatcagtttggcaacgaaataaaagaatgtgtgcacgggagaccattctttcaccacctgacctacttgcctgaaaccacatag

SEQ ID NO: 16717 - DNA, 135 bp, Artificial Sequence
  Description of Artificial Sequence: Synthetic coding sequence
atgaaacagctgcccgccgctaccgtcagactgctttctagtagtcagattataacgtcagttgtaagcgtcgtaaaggaactcatcgagaactccctggatgccggggccactagcgttgatgtgaagctgtag

SEQ ID NO: 16718 - DNA, 2313 bp, Artificial Sequence
  Description of Artificial Sequence: Synthetic coding sequence
atgaaacagcttccagccgctaccgtgcggctcctgagttcttctcagataatcacatctgtcgtctcggtggtgaaagaactgattgagaactctctggacgctggagccaccagcgtagacgttaaactcgaaaactatggattcgataaaatagaggtcagggataacggtgaaggtatcaaggcagtggatgctcctgtgatggcaatgaaatattacaccagtaagatcaactctcacgaagatctggagaacctgacgacctatggcttccgcggagaggctctcgggtccatttgttgcattgcagaggtgttaataacgaccagaaccgccgccgataacttctcgactcagtacgtgctcgatgggtcgggccacatcctgagccagaagccgtctcacttagggcagggcactactgtcactgcgctccggcttttcaagaacctgccggtccgcaaacagttctacagcaccgcaaagaagtgcaaggacgaaattaagaagatccaggatctcctcatgagcttcggcatactaaaaccagacctgaggatcgtgtttgttcataacaaagcagtgatctggcagaaaagtagggtaagcgaccacaagatggccctgatgtctgtgctcgggacagccgtgatgaataatatggaatcgtttcagtaccattcggaggagagtcagatttacctctctggattcttgcccaaatgcgacgcagaccacagcttcaccagcctaagtactcccgaacgatcattcatttttattaatagcaggccggtccatcagaaggatattctaaagctgattagacatcactacaatctgaagtgtctgaaagaatctactagactgtaccctgtgttctttttgaaaattgacgtccccacagcagatgtggacgtgaacctcactcccgataagtctcaggtgcttctgcagaataaggagtctgtcctgatcgcgctagagaatcttatgaccacgtgttatggcccgctgccttctactaactcttacgagaacaacaaaaccgacgtgagcgccgctgacatcgtcttgagcaaaactgcagaaacagacgtgctgtttaataaagtcgaatctagcggcaaaaattactccaatgtggatacttctgtgatcccgttccagaacgatatgcataacgacgaatccggtaagaacaccgatgattgcctgaatcaccagatctccataggcgatttcgggtatgggcattgcagctcagagatcagcaacatcgacaagaacactaagaacgcctttcaggatattagcatgtctaacgtgagctgggaaaatagtcagacagagtacagcaaaacttgctttatttctagcgtcaaacacacacagagtgaaaatgggaataaggaccacattgacgagtctggcgaaaacgaggaggaagccggactcgaaaattcctcggagatatctgcagatgaatggagccgcggtaatatcctgaaaaactcagtgggagagaatatcgaaccagtgaagatccttgtgcccgagaaaagcctgccgtgcaaggtgtccaataataactacccgattccggagcagatgaacctgaacgaagattcctgtaacaagaagtccaacgtcattgataataagagtgggaaagtcacggcctacgaccttttgtcaaaccgtgtgatcaaaaaacctatgtcggcttctgcgttgtttgtgcaggatcaccggccccagttcttaattgagaatccaaagacatccctcgaggacgccactctccagattgaggagttgtggaagaccctgagtgaggaggagaaactcaacctgtttaacggcagccactatctcgatgtcctgtataaaatgacggcggacgaccagcggtattctggaagtacttatctgtctgacccccgcctgaccgccaacggctttaagataaaactgattcctggtgtgtcaataacagagaactacctagaaatcgaggggatggcaaactgcctcccgttctatggagtggccgatctaaaagagatcttgaacgccattctgaaccggaacgccaaagaagtgtacgagtgccgccccagaaaagtgatctcttacctggagggagaggccgtccgactgagtagacaattacctatgtatctatccaaggaggatatccaggatatcatctaccgaatgaaacatcagtttggtaatgagatcaaggagtgcgtccacggtcggccattctttcatcacctgacgtacctccctgaaacaacatag

SEQ ID NO: 16719 - DNA, 2682 bp, Artificial Sequence
  Description of Artificial Sequence: Synthetic coding sequence
atgaaacagttaccagccgctacagtgagactcttgtcatcatcccagataatcacctcagtcgtgtcagtggtgaaggagctgattgagaactctctcgatgccggggccaccagcgttgacgtgaagctcgagaactatgggtttgacaaaattgaagttcgcgacaacggtgaaggaattaaagcagtcgatgcaccagtgatggctatgaaatactatacgagtaagatcaatagccacgaggatttggaaaacctgaccacttacgggttccgcggggaagccctgggctccatctgctgcattgctgaagtactgattactacgaggaccgccgcagataatttttctacacagtacgtgctggacggctccggccatattcttagtcagaaacccagccacttagggcaaggtaccaccgtgacagctttacgactgttcaagaacctccccgtgcgcaagcagttctattcaacggcaaagaagtgtaaagacgagatcaagaagattcaagacctgcttatgagttttggcatactaaaacctgatttgcgaattgtgtttgtccataacaagatttacctgagtggctttcttccgaaatgtgatgcagaccactcgttcacctccttatctacccccgagcggagtttcatctttattaactcaaggccagttcaccagaaagacatccttaagctgattcgacaccactacaacttaaaatgtctgaaggagtctacacgactatatccagtgttcttcttgaagattgacgtcccgactgccgatgtggacgtaaacctgacccctgataaatcccaggtcctgttgcaaaacaaggagagtgtgctgatcgcccttgagaatctcatgactacttgttacgggcccctaccctctactaattcatatgagaacaacaagaccgatgttagtgccgcggatattgtgctgtctaagacagccgaaactgacgtgctcttcaataaagtggaaagctccggaaagaattactccaacgtggatacatcagtcattccttttcagaatgatatgcacaacgacgagagtggcaaaaacaccgacgactgtctcaaccatcagattagcattggggactttgggtacgggcattgttcatctgagatatcaaatatcgacaagaatactaagaacgcattccaggacatttccatgtctaacgtctcctgggagaatagccagactgaatactcaaaaacgtgcttcatatcctccgtcaaacatactcagtccgagaatgggaataaggaccatatcgatgagagcggagaaaatgaagaagaagcaggattagagaactcgagcgagatctcggctgatgaatggtcacgtggcaacattctcaagaactcagtcggagagaacatcgaacctgtgaaaattctggtcccagaaaaaagcttgccatgtaaggtatccaacaataactacccaatacccgagcagatgaacttaaatgaggactcctgtaacaaaaaaagcaacgtgattgacaataagtcaggcaaagtcactgcctacgacctgctcagcaaccgtgtgatcaaaaaacctatgagcgccagtgcgctgtttgtgcaggatcaccggccacagtttctgattgagaatcccaagacaagcctggaggatgcaacactgcagattgaggaactgtggaaaaccttgtccgaggaggagaagctgaaatacgaagagaaagcaactaaggacttggaacgatataattcccagatgaaaagagccattgagcaggagtcgcagatgtctctgaaggatggcaggaagaagatcaagccaactagcgcttggaaccttgctcagaaacacaagcttaagacctccctctctaatcagcccaagctggacgaactgctgcaatcgcagattgagaaacggagatctcagaatatcaaaatggtccagatccccttcagcatgaaaaatctcaagatcaattttaagaagcaaaacaaggttgacctggaagaaaaggacgaaccgtgcttgattcacaacctacgattcccagacgcatggctcatgacatctaagactgaggtgatgttgcttaacccataccgcgttgaggaagctctcctgttcaagcgtctgctcgagaaccacaaactaccagcagagcctctggagaagcctatcatgcttaccgaaagtctttttaacgggagtcactatcttgatgtcctgtataaaatgacagcagatgatcagcgctatagtgggtccacttaccttagcgaccctcgcttaacagccaacggattcaaaatcaagttaatccctggcgtaagcataaccgaaaattacctggagatcgagggcatggcaaactgcctgcccttctacggagtagctgacctgaaagaaatcctgaacgcaatcctgaatcggaatgccaaagaggtgtacgagtgccgtccaagaaaagtgattagttacctcgagggtgaagcagtgagactgagccgccaactcccaatgtatctcagtaaggaggatattcaagacatcatatatcgtatgaaacaccaatttggcaatgagattaaggaatgcgtgcatggcaggcccttctttcaccacctgacgtacctccccgaaaccacctag

SEQ ID NO: 16720 - DNA, 2589 bp, Artificial Sequence
  Description of Artificial Sequence: Synthetic coding sequence
atggagcgagccgagagttccagtaccgagccagctaaggcgattaaacctattgaccggaaatccgtgcatcaaatttgctccggacaagtagttctgagcttgagcaccgcagttaaagagctcgtggaaaattcactggatgctggcgccactaacattgatttgaagctaaaggactatggagtcgacttgatcgaggtgtcggacaacgggtgcggcgtggaggaggaaaactttgaaggactaactctcaagcaccatacttctaaaatccaggagtttgccgatctcacacaggtggaaacgtttggttttcgcggagaagctctgagctctctatgcgcattatccgacgttaccatctcgacttgccatgcaagcgccaaggttggcaccaggctgatgttcgatcacaacggcaagatcatccagaaaaccccgtatcccagaccaagagggacaactgtgagtgtgcagcaactcttttccaccctgcccgtgagacataaggagttccagagaaatatcaagaaggaatatgctaagatggtgcaggtcctccatgcctattgtatcatctcagcagggatcagagtgtcttgtactaaccagctgggacagggcaaacggcaaccagtggtctgcactggtggttccccttctatcaaggagaatattggatcagtgtttgggcagaagcagttgcaatccctcatcccctttgtgcaacttcccccatccgattctgtctgtgaggagtatggactctcttgttctgacgcgcttcacaacttgttctatatctccggattcatcagtcagtgcacccatggcgtgggccgttcatcgactgacaggcagtttttcttcatcaacagacgaccatgcgacccagcgaaggtctgtaggctcgtgaatgaggtctatcacatgtataacagacaccaatatcctttcgtggtgctgaacatttcagtcgacagcgagtgtgtggatatcaacgttacccctgacaagagacagatactgctccaggaggagaagcttctgctggccgttctgaagacttccctcatagggatgttcgattcagatgttaacaaactcaacgtgtctcagcaacctctgttagatgttgagggcaacttaatcaagatgcacgccgccgaccttgaaaaaccgatggttgaaaagcaagatcaatctccctctctccggactggggaggaaaagaaagacgtgagcatcagcagactgagagaggccttcagcctgcgacatacaacggagaacaagccgcattcccccaaaaccccagaaccccgcaggagcccactgggacagaaaagaggtatgttgagttcgagtacgagtggggccatttccgataagggcgtgctccgcccacagaaggaggccgtcagttctagccacggaccttctgatcctaccgaccgtgccgaggtggagaaagactctggtcatgggagcacttccgttgattctgaggggtttagtatccctgatactggctctcactgttcctcagagtatgccgcaagctctcctggtgatcgtgggagccaggagcacgtcgatagccaggaaaaggcccccaagacagatgattcgttctcagacgtggattgccactcgaatcaagaggacaccgggtgcaaatttagagtgctgccacagcccaccaacctggcaacgcccaacacaaagagatttaaaaaggaggagattctgagcagttccgatatttgccagaagctggttaacacccaggacatgtctgcctctcaggtcgacgtggctgtgaagatcaacaagaaagttgttccgctggacttctccatgtcttctttggcgaaaaggattaaacagctacaccatgaggcacagcagagtgaaggcgagcagaattacaggaaatttcgtgctaagatctgcccaggggaaaaccaagctgcggaggacgagcttaggaaagagatcagtaaaactatgtttgccgagatggagattatcggccagtttaaccttggattcatcatcactaaactgaatgaagacatattcattgtggatcagcacgcaacagatgagaaatataacttcgagatgctgcaacagcataccgtattacagggacagagactaatcgctccacaaacattaaatcttactgccgtgaatgaggcggtgctgatcgagaacttggagatctttcgtaagaacggctttgacttcgtcatcgatgagaacgctcccgtgaccgagcgggcaaagttaattagtctgccaacatctaaaaattggacgtttggaccgcaggacgtggatgaactgatcttcatgttaagcgactctcccggagtaatgtgtagaccatcgagggtgaagcaaatgttcgctagcagggcctgtcgtaaaagcgttatgattggcacagctttgaacacgtccgagatgaagaagctgattacgcacatgggtgagatggatcacccctggaactgtccccatggccggcctaccatgcggcatatcgcgaacctgggagtgatcagccaaaactag

SEQ ID NO: 16721 - DNA, 1386 bp, Artificial Sequence
  Description of Artificial Sequence: Synthetic coding sequence
atggagcgggccgagagcagttccacggaacctgctaaggctatcaagccaattgataggaaatcagtccatcagatatgctccggccaagtcgtgttgtccctctctaccgcggtgaaggagctggtggagaactcactggacgctggagccacgaacatcgacctcaaacttaaggattacggagtggacctgatcgaggtgagcgataatggatgcggagttgaagaagaaaactttgaggggcttactttgaagcatcatacctcaaagatccaggagtttgcagacctcacacaggtggaaactttcgggttccgtggcgaggctctgagttccctatgtgctctttccgacgtcaccataagcacatgccacgccagtgcaaaagtgggaacgaggctgatgtttgaccataacgggaaaattatccaaaagaccccctacccaagaccccgcggtactaccgtcagcgtacagcaactgtttagcactctgcctgtccgccataaagaatttcagcgtaacataaagaaggaatacgccaaaatggtccaggtgttacatgcttactgtattatttcagctggcattcgggtatcctgtacaaatcaactcgggcagggcaagcggcagccagtagtttgtacggggggaagccccagcattaaggagaacattgggagcgtattcgggcagaagcagctgcagagcctcatcccattcgtacagctgcccccctccgatagcgtttgtgaagagtatggactgtcatgttcggacgcgctgcacaaccttttctacaagacaatgtttgccgaaatggagataataggccagtttaatctgggatttatcattaccaagctgaatgaagacatattcatcgtcgaccagcacgccactgacgaaaagtacaattttgagatgctgcagcagcacactgtgctgcagggtcagcggttaattgccccccagacactgaacttgacagcagtgaacgaagctgtgctaatcgaaaatctcgagatttttcgcaaaaacgggtttgattttgtaatagacgagaatgcgccagtcaccgagcgagccaaattaatttctcttccgacttcaaagaattggacgttcggacctcaggacgttgacgaactgatctttatgctaagcgactccccgggtgtcatgtgtcggccatcccgggtgaagcagatgtttgcatccagggcttgccgcaaaagtgtcatgatcggaacagctctcaatacatccgagatgaagaagcttatcacgcacatgggtgagatggaccacccctggaactgcccgcacgggcgtccaaccatgagacatatcgccaatctgggcgtcatctctcaaaactag

SEQ ID NO: 16722 - DNA, 2448 bp, Artificial Sequence
  Description of Artificial Sequence: Synthetic coding sequence
atggaacgggctgaatcttctaggtcaaagctcaaagactacggcgtggacttgattgaggtgtccgacaacggatgtggggttgaggaagagaacttcgagggcctgaccctgaaacaccacactagcaaaatccaggaattcgctgacctaacacaggtcgagacattcgggttcagaggggaggccctgtccagcctgtgcgcgctatcagatgtgacaatttcaacatgtcatgccagtgctaaagtagggacgcgcctgatgttcgatcataatggcaagatcatccagaaaacaccctaccccagacccagaggcactacggtaagcgtgcagcagctgtttagcacgctgccagtgaggcacaaggagttccagcggaacatcaaaaaagagtatgccaagatggttcaggtcctccacgcctactgcattatttcggccggaatccgcgtatcctgcaccaaccaactgggacagggcaagaggcagcctgtggtgtgcacaggaggctctccctcaattaaggagaacattgggtctgtctttggccagaagcaattacagagtctgattccctttgtccagctccctccctctgattcagtgtgcgaggagtacggattgagttgtagcgacgcccttcataacctgttctacatttctggatttatttcacagtgtactcatggagtgggcaggtctagtactgatcgccagttttttttcatcaatcgcagaccttgcgaccctgccaaggtctgcaggctggtgaacgaagtttaccatatgtacaacagacatcagtatcccttcgttgtgttgaacatttccgtcgattcggaatgcgtggatattaacgttacacctgacaagcgacaaattcttcttcaggaggagaagctgctgctggccgtcttaaagacttcactcataggcatgttcgatagcgatgtaaataaactcaacgtgtctcaacagcccctcctggacgtggaagggaacctcatcaaaatgcatgccgcagatttagaaaaaccaatggtcgaaaagcaggaccagtctccgtcactgcggacgggagaggaaaagaaggacgtcagcatctccaggctgcgagaagccttcagcttgaggcacaccactgagaacaagccacactccccaaagactcccgaacccagacggtcacccctggggcaaaagcgcggcatgctatcctctagtacttcaggggccatctcagacaaaggagtgctgcggccacaaaaggaagcagtgtcatcttcgcacggaccaagcgacccgactgatagggcagaggttgaaaaggacagtgggcacggtagtacctcagtggatagcgagggattctccatccctgatactgggtcacactgcagtagtgaatatgcagccagttcacccggagaccggggttctcaggagcatgtggattcccaggagaaggccccaaagaccgacgactccttctctgatgtagattgtcactccaaccaggaggacaccggttgtaaattcagggtcctgccacagccaaccaacttagcaacacccaacactaaacggtttaaaaaagaggagattctctctagtagtgacatatgccagaagctggtgaacacgcaggatatgagtgcctctcaggtggatgtcgccgtgaagatcaacaagaaggtggttcccttagacttcagtatgtcctcattggctaagaggattaagcagctccatcacgaggcccagcagtcagagggtgaacagaactaccgtaaattcagagccaaaatctgtcccggagaaaatcaggccgccgaggacgaacttaggaaggagatctcaaaaactatgttcgcagaaatggaaattatcggtcagttcaacctggggtttatcattacgaagcttaatgaagatatattcatcgtggaccagcacgccacagacgagaaatacaactttgaaatgcttcaacagcatactgtgctgcagggacagagattgattgcaccacagactcttaacctgactgctgttaacgaagccgtgctgattgaaaacctagagattttccggaagaatggctttgattttgtgatcgatgagaacgcacccgttaccgagcgcgcaaagttgatcagtttgccaacctcaaagaattggactttcggccctcaagacgtcgatgaactgatcttcatgctgagcgacagtccaggggtcatgtgcaggccaagccgggtcaagcagatgtttgctagccgcgcatgtcgaaagtctgttatgatcggcacagcgttaaatacctcggaaatgaagaaactgattacacatatgggcgaaatggatcacccctggaattgccctcatggacgccccacaatgcggcacattgcgaacctgggggtgatatctcaaaactag

SEQ ID NO: 16723 - DNA, 1719 bp, Artificial Sequence
  Description of Artificial Sequence: Synthetic coding sequence
atggaaagagcagagtcttctagcaccgagcctgctaaggctatcaagcctattgatcgcaagtctgtccatcagatttgtagtggccaagtagtgctatccctgtccacagctgtgaaggaactggtagagaacagcctcgatgcgggagctacaaacattgatttgaaactgaaggattatggagtggaccttatcgaggtttcagacaatggatgcggagtagaagaagagaacttcgaaggactcacattgaagcatcacacatctaaaatccaggaatttgccgatctcacacaggtggaaacttttggtttcaggggagaggctctatctagcctgtgcgctctttctgacgttaccatttctacttgccacgcatcagcaaaggttggaactaggttaatgtttgatcataacggaaagattatccagaaaaccccatacccaaggccgcggggcacaaccgtgagtgtacagcaattattctcaactctgcccgtcaggcacaaggaattccagcggaatataaagaaagagtatgctaaaatggtccaggtactgcatgcatattgcattatctcggctggtataagagtctcgtgtacaaaccagctggggcagggtaagcggcagcctgtggtctgcacggggggctcacccagcattaaagagaacatcggtagtgtctttggtcagaaacagctccagtcccttatccctttcgttcagctgcccccaagcgacagtgtgtgtgaggaatacggcctgagttgctccgacgctctacataatttattttatatctccggcttcatctctcaatgtactcacggtgtgggtcgctctagtacagataggcagttcttcttcatcaatcgaaggccctgcgaccctgccaaagtgtgccggctggtaaatgaggtataccacatgtacaataggcaccaatatccttttgtcgtactgaacattagtgtggattcagaatgtgtcgacatcaacgtcacacccgataaaagacaaattctgttgcaggaagagaagctgcttttagcagtgctgaagacttctctgattggaatgttcgactccgatgttaacaagctgaatgtatctcagcaacctctgctcgatgtggaaggaaacctaatcaagatgcatgccgctgacctcgagaagcctatggttgaaaagcaggaccagtctccaagcttgagaacgggcgaggagaagaaggacgtctccattagtcgcctgagggaagccttttctctgcgccatactaccgaaaacaaaccacattcaccaaaaactccggagcccaggcggagcccacttggccagaagagaggtatgctcagctcttcgacctcaggggcaattagcgataaaggagtgctgcggccccagaaagaagctgtcagcagcagccatgggccttctgatcccaccgaccgggccgaggttgagaaggactctggacacggctctacatctgtcgattccgaaggtttcagcattccggacactgggtcccattgttccagtgagtatgccgccagcagcccgggagacagaggctctcaggagcatgtagactcgcaggagaaagcaccaaaaaccgacgattctttcagtgatgtggattgccattccaatcaagaagatacgggtctgaaaaccggcccctccgacccccgcacgtccatgaattag

SEQ ID NO: 16724 - DNA, 2271 bp, Artificial Sequence
  Description of Artificial Sequence: Synthetic coding sequence
atgtggggaagaaggcggaagctgcgccggctgaatgacgtgactatctctacctgtcacgcaagtgcaaaggttggtacccgattgatgttcgaccataatgggaaaatcatccagaagaccccatacccaagaccccggggaactaccgtgtcagtccagcagcttttcagtacgttgcccgtgcggcacaaagagttccagagaaatatcaagaaagagtacgcgaagatggtgcaggtactccacgcttattgcataatcagcgctgggatccgggtgtcgtgtacaaatcagctaggccaaggaaagcggcagccagtggtgtgcacgggaggaagtcccagtatcaaggaaaacattggctctgtgttcggacagaagcagttgcagtctctgattcctttcgtccaacttcccccttctgattcagtgtgcgaggagtacggccttagctgctcagatgctcttcataacctgttttacatttcaggctttatctcacagtgcacacacggggtgggcaggagtagcacagatagacaattcttcttcatcaataggagaccatgcgatcccgcaaaggtctgcagactcgtcaatgaggtttaccacatgtacaatcgacaccagtatccattcgtcgtcctgaatatcagcgtggattctgaatgcgtcgatattaacgtgacacccgataaacgacagattttgcttcaggaggagaagctcttgcttgctgtcttaaagaccagcctaatcggaatgtttgactctgatgtcaataagctaaacgtgtcccagcaaccattgttggatgtggagggcaatttgatcaaaatgcacgcggcagatttagaaaaacctatggtcgaaaagcaggatcaaagcccctcgctaagaactggagaggaaaaaaaggatgtgagcatttctcggctcagagaagcgttctctctacgccacactactgagaataagccccactcccccaaaacacccgagcctagacgcagtccgttgggacagaaacgtggaatgttgtcttcttcaacgtctggcgctatatctgataaaggagtcctccggccccaaaaggaggcggtgtcatcatcccatgggcctagcgacccaaccgaccgggctgaggttgaaaaggacagtgggcatggatcaacttccgttgattctgaggggttctcgatccccgacacaggtagccattgttcatcagagtatgctgcgtcttccccgggagacagggggagccaggagcatgtcgatagtcaggaaaaagcccccaagactgacgactctttctcagatgtcgactgtcacagtaaccaggaagatacgggctgtaagtttcgagtattacctcaaccaaccaacctggctacaccaaatacaaagcgtttcaagaaggaggagatcctttcctcatctgacatttgccagaagctcgtgaatacacaagacatgtccgcgagccaggtcgatgtggccgttaaaattaataaaaaagtagtgcctttggacttctcgatgagctctctggccaagaggatcaagcaacttcatcatgaagcacaacagtccgagggggagcaaaactaccggaagtttcgggccaagatctgtcccggcgagaaccaggctgcggaggacgaattgagaaaagaaatatccaagaccatgttcgccgagatggagatcattggccaatttaatctcggcttcatcataaccaagctcaacgaggacatcttcatagtggatcagcatgccaccgatgaaaagtataattttgaaatgctgcaacaacacacggtattgcaaggccaacgactaattgcacctcaaactctgaatctaaccgcagttaacgaagcagttctcatagagaacctggagattttcagaaaaaatggatttgattttgtaattgacgagaatgccccggtgaccgagagagccaaacttatcagcctgcccaccagcaagaattggactttcgggccacaggatgtcgacgagctcatatttatgctctcagactcccccggcgtcatgtgtcggcccagcagagttaagcaaatgttcgcgtctagagcctgccggaaatccgtgatgattgggacagccctgaatacaagcgagatgaaaaaattgattacccacatgggagagatggaccatccctggaattgtccccatggtaggccaaccatgagacacatcgcaaaccttggcgtaatctcccagaactag

SEQ ID NO: 16725 - DNA, 1812 bp, Artificial Sequence
  Description of Artificial Sequence: Synthetic coding sequence
atgtccgccgcggtaaccgcaggcaaattagcccgggcaccagcagaccccggaaaggctggagtgcctggcgttgccgctccgggagcaccggcagcagcaccccctgccaaagagatccctgaagtcttagtagacccgcgatcccgccgaagatacgtccgtggacgatttttgggcaaagggggatttgctaagtgtttcgaaatcagcgatgccgacacgaaagaagtgtttgccggcaaaatcgttcccaagtctctcctgctgaaaccccaccagcgggaaaagatgtccatggagatttcaattcataggtccctggctcatcagcatgtggtgggcttccacgggttctttgaagataacgatttcgtcttcgtagtgttggagctgtgtagaaggcgttccctcctggagctgcacaaaagaagaaaagcacttactgaaccagaagctcgctattatttgagacagatcgtcctgggctgtcagtacctgcatcggaatagagttatccatcgggacctgaagttgggcaatctgttccttaatgaggatctggaagtcaaaattggcgacttcggactggccacgaaggtggaatacgatggcgaacgaaagaagaccctgtgcggtacccctaattatatcgctcctgaggtcctgtctaagaaggggcacagtttcgaagtggacgtgtggagcatcgggtgcatcatgtacacgctcctggtcggcaagccgccgtttgagacaagttgtttaaaggagacgtacctgcgaatcaagaagaacgagtactccattccaaagcatattaacccggtagcagcatctctgatacagaagatgctgcaaaccgatcctacagcaagacccactattaatgaacttttgaacgatgaattctttacatccggctatatccccgcaaggctccctattacctgtttgactatccccccccgttttagcatagctccttcatccctcgaccctagtaataggaaacctctcacagtgctgaacaaaggattggagaaccccctccctgagagaccacgcgaaaaagaggaaccagtggtcagggagacaggtgaagttgtcgactgtcatctaagtgacatgctgcaacagcttcacagcgtaaacgcttccaaaccgagtgagcgggggttggtgcggcaagaggaggctgaagatccagcttgcatcccgattttctgggtgtcaaagtgggtggactattccgacaagtatggcttaggctaccaactatgcgataactctgtgggcgtactcttcaatgacagcacccgcctgatcctttataatgacggcgattctctccagtacatcgagagagacggcacggagagctatttgaccgtttcttcacatccgaactccttaatgaagaaaatcaccctccttaagtacttccgcaattacatgagtgaacacttgctgaaagcaggagctaatatcactccccgggagggcgacgaactggcgcggttgccttacctgcgaacttggtttcgtactcggagcgcaatcatcctgcatctgtccaatggatccgtccagattaatttttttcaggatcacactaaactcatattgtgccctcttatggcagcagttacctacatcgacgaaaaacgcgatttccgtacatacaggctatctcttctggaggagtatggatgttgcaaagagctcgcgtctaggctgcggtatgcccgcaccatggtggataagctgctgtcctctaggtccgcctctaaccggcttaaggcatcctag

SEQ ID NO: 16726 - DNA, 744 bp, Artificial Sequence
  Description of Artificial Sequence: Synthetic coding sequence
atgtcagcggcagtgaccgccgggaagctggctcgcgcccccgctgatcctggcaaggcaggggtgccgggagtggctgcccccggcgccccagccgccgcgcctcccgcaaaggagatcccagaggtcctggtggatcccagatctaggagaaggtacgtgcggggcaggttcttgggtaaaggaggattcgccaagtgttttgagatcagtgacgcagacaccaaagaggtttttgctggaaagatcgtgcctaagtctctactactgaaaccccaccaaagggagaagatgagcatggagatctcaatccatcgctcattagcgcaccagcatgtagtagggttccacggcttttttgaggacaacgactttgtcttcgttgtactggaactatgtcggcggcggtcactcttagagctgcacaaaagacggaaggccctgacagaacccgaagcaagatactatctgcgccagatcgtgcttggttgccagtacctacacagaaaccgcgtcatccatagggacctgaagcttggcaacctctttctgaacgaggatctggaggtaaagataggcgattttggattggccacaaaggttgaatatgatggtgaacgtaagaaaaccctgtgtgggacaccaaattatatagcccctgcggtcccttgcttacagtgcgcgccacagcctcgatggcttggaagggcagcgtcttcccttcaagtgggcgtcgccgtatag

SEQ ID NO: 16727 - DNA, 1521 bp, Artificial Sequence
  Description of Artificial Sequence: Synthetic coding sequence
atgtccatggaaatctcaatccatcgaagcctcgctcaccagcatgtggtggggttccatggcttctttgaagacaatgacttcgtgttcgtcgtgctagagctatgccggcggcggtctttgttggaactgcacaagagacggaaagcactgacagagccagaggcacgatactacctgagacagattgtgctgggatgtcagtatctacatcggaatcgtgtgattcaccgggatttaaaactaggcaacctgtttctcaacgaagatctcgaagtaaaaattggggacttcgggctggccacaaaggtcgaatacgacggcgaaaggaagaaaacactctgcggcacacctaactatattgctcctgaagtcctgagcaagaaagggcactctttcgaagtggatgtttggtccatagggtgcattatgtatacgctgcttgtgggaaaacctccatttgagacatcgtgcctgaaagagacctacctgcgcatcaagaagaatgaatacagcataccaaaacacataaaccctgtggcagcctcgttaatacagaagatgctccagacggatccgaccgcccgaccaaccattaatgaattactcaatgacgagtttttcacgagcggatatattcccgcgcgtctgcccattacttgtctaacgatacctcctcgtttcagcattgccccatctagccttgacccatctaatcgcaaacctctcaccgtgcttaacaagggcctggagaacccccttcctgaaagacctcgcgaaaaagaggagccagtggttcgggaaacgggggaggtggtcgactgtcacctgtctgatatgctgcaacaactccacagtgtcaatgccagcaaaccatccgaacgggggttggttcgccaggaagaggctgaggaccccgcgtgtatccccattttctgggtgagcaagtgggtcgactacagcgacaagtacggactgggataccagttgtgcgacaacagcgtgggggtgctgttcaatgacagcacccggcttattctttataatgacggtgatagcctacagtacattgagcgggatggcactgagtcttatctaacagtgtcttctcatcccaattccctgatgaagaaaattaccctacttaagtacttccggaactacatgtctgaacacctgttgaaagccggcgctaatattaccccaagagagggcgacgaattggctagattaccatacctgaggacatggtttaggaccaggtcagctataatcctacatttgtccaacggaagtgttcaaatcaatttcttccaagatcacaccaagctcattctgtgcccactgatggcagcggtgacatacattgacgagaagcgtgattttcgtacctaccggttaagcttattagaagaatacggatgctgcaaagagttagcatccaggttacggtacgctcggacgatggtggataaactgttgtcgagccgaagcgccagtaaccgattgaaagcttcctag

SEQ ID NO: 16728 - DNA, 1941 bp, Artificial Sequence
  Description of Artificial Sequence: Synthetic coding sequence
atggagcccgccgcaggcttcctctccccgagacctttccaacgtgccgccgcagcccccgccccaccagcaggccccgggcctccgcccagcgcgctcagaggaccagagctggaaatgctggcaggacttcctacaagcgacccaggacggctaatcacagatccgcggtcagggcgcacctatctgaagggcagactgttggggaaagggggattcgcaagatgctatgaagcaacagatactgagaccggcagtgcttatgcagtcaaggtgattccccagtcccgtgtggcaaagccccaccagcgcgaaaaaattctaaacgagatcgagctgcacagagacttgcagcatcggcacatcgtgcggttcagtcatcactttgaggacgccgataacatctatatctttctggaactgtgcagcaggaagagtttagctcacatctggaaggctcgacacactctcctggaacctgaagtgcgatattacctccggcaaattttgagcggattaaaatatctccaccagcgggggatcctgcaccgggatctaaagttggggaactttttcatcacagagaacatggaacttaaagtgggtgattttgggctcgcagccaggttagagccacctgagcagcggaaaaagaccatctgtggcacacctaactatgtggcccctgaggtcctgctccgacaaggccatggccccgaagctgacgtttggagcctgggctgcgtaatgtataccctgctgtgcggatccccgccctttgaaactgctgaccttaaagagacttaccgatgcattaagcaggtccactataccttgcctgcttctctcagtctccccgctagacagcttctcgcagccatcttgagggcatccccgcgggaccgcccctccatagatcaaatcctccggcacgacttcttcacaaagggctatactcccgatcggctgccaataagtagctgcgtcaccgtgcccgacttgacgccccctaacccagctcgaagcttgttcgctaaggtgaccaagtccctgtttggccgcaagaagaaatctaaaaaccatgctcaggaacgagacgaggtgagtggacttgtgtcaggccttatgcggacttctgtcgggcatcaagacgcccgtcctgaggcaccggctgcgtctggcccagcccccgtatcactcgtggaaacagctccagaagattcttcccctcgcggcaccctggctagttcaggggatggatttgaggagggccttaccgtggcaactgttgtagagagtgcactctgtgccttacgcaactgcatcgcattcatgccaccagcagagcagaatcccgccccattggctcagccggaacccttagtgtgggttagtaagtgggtcgactatagtaacaaattcggcttcgggtatcagttgagttctcgacgcgttgctgtgctgttcaatgatggcacacatatggcactgagcgctaacaggaagactgttcattataacccaacgagcacaaaacacttttcgttcagcgtgggagcggtccccagggcccttcagcctcaactgggaattttgaggtatttcgcctcatatatggaacaacacttgatgaaaggcggagatttgcctagcgtggaagaagtcgaggtgccagcccctccactgcttctgcagtgggtgaaaacagatcaggctttactgatgctgttcagtgatggaacagtccaggtcaacttttacggcgatcatactaagctcatcttgagtggctgggagccacttcttgttacgttcgttgcacgcaaccgctcagcctgtacgtacctggctagccatttgagacaattgggatgcagccccgacctgcgacagagactccgctatgctctcaggcttctgcgggatcgctcccctgcctag

SEQ ID NO: 16729 - DNA, 1866 bp, Artificial Sequence
  Description of Artificial Sequence: Synthetic coding sequence
agccggcagaggcacgcacggcctgggcctggaggaaccgaaaagcccggccccagatgtgacgcaccagccgcctggagcttgcccccggtgtcctgcctgaggacatacctgaagggacgcttgctgggtaaggggggtttcgcccgctgttatgaggctaccgacacagagaccggaagcgcatatgccgtgaaggtgatccctcagagtcgggtggccaagccacaccagcgcgaaaaaatcctcaacgaaatcgagctgcaccgcgacctgcaacaccggcacatcgtaagattttcccaccactttgaggatgcagacaacatctatatattcttggagctgtgttcacggaagtctcttgctcatatctggaaggctcgtcacacactcctggaacctgaggtgagatactacctccgacagatcctgtctggacttaagtaccttcatcagcgcggaatcctgcaccgcgacttgaaactgggtaatttcttcataacagagaatatggagctgaaagtaggggactttggtttggccgcacggctagagccccctgaacagaggaagaagacaatctgcgggacgcccaattatgtagccccagaagttctgcttcgccagggccacggtcccgaagcggacgtctggagcctggggtgtgttatgtacacgttgctttgcggcagcccaccatttgaaaccgcggacctgaaagaaacctacagatgtattaaacaggtgcactatactctgcctgccagccttagcctgcccgccaggcagctgctggctgccatactccgcgcttctcctcgagataggccttcaattgatcagattctgcgccacgatttcttcactaaagggtacactcccgatcgcttacccatatctagctgtgtaacagtgcccgacctgaccccacccaatcctgcccggtccctgttcgctaaagtcaccaaaagtctgttcggacggaaaaaaaagagtaagaaccatgcacaagaacgggacgaggtgagcggtttggttagtgggttaatgcgcaccagcgtgggtcaccaggacgctcgacccgaagccccagcggcttccggccccgctcccgtctccttagtcgagaccgctccagaggatagctctccaagaggtacgcttgcctcttcgggggacggtttcgaagaaggcctgacggtggccacggtggtggagtccgctttgtgtgctctgaggaattgcatcgcttttatgcccccggctgagcagaaccctgctcccttagcgcagcctgagcccctagtttgggtctcgaaatgggtagactattccaacaagttcgggtttggctaccagctctcttctcggcgcgtagctgtactgttcaatgatggcacccacatggcattaagtgcaaacaggaaaactgttcactacaaccccacctccaccaagcatttcagcttctccgttggagctgtccctagagccttgcagccacagctaggcattctccgctacttcgcaagctacatggagcaacacttgatgaaaggcggagaccttccttctgtagaagaggtggaggtgcccgcaccgccactgctgctccaatgggtaaagacggatcaggcgcttctaatgctgttttccgatggcacagtccaggtgaacttctacggagaccacacaaaactgattctgtccgggtgggagcctcttcttgtcacttttgtggccagaaataggagcgcctgcacttacctcgccagccatctgcgccagttgggctgctctccggacctccggcagcgcctgcgatatgcgctgcgattgctgagggacagatctccagcatag

SEQ ID NO: 16730 - DNA, 2913 bp, Artificial Sequence
  Description of Artificial Sequence: Synthetic coding sequence
atggcaacctgcattggagaaaaaatcgaggattttaaggtggggaacctcctgggaaaagggtcctttgcaggcgtatacagagccgagtccatccacaccgggctagaggtcgccatcaagatgattgataaaaaagcgatgtacaaggccggcatggttcaaagagtacagaacgaggtcaagattcattgtcagcttaagcaccccagtatcctggagctgtataactatttcgaggactcgaactacgtgtacttggtgcttgagatgtgccacaacggggaaatgaatcggtatctgaagaatcgcgtcaagccttttagcgaaaacgaggctcgtcactttatgcaccaaattataactgggatgctgtacctccattcccacggcattctgcacagggacttgaccctctcaaacctgctcctgaccaggaatatgaatatcaaaatcgccgacttcggacttgcgactcagctgaaaatgccacatgagaaacactacaccctctgcgggacgcctaactacatttcacctgaaatcgcaacaagatctgctcacggtttggagtcagatgtgtggtccctggggtgtatgttctatactctgcttatcggccggcctccttttgacactgacactgtgaagaataccctcaacaaggtggtgttggcagattatgaaatgccaagtttcctgagcattgaggctaaggacctaatacatcagctcctgaggaggaacccggccgaccgactctcgctcagttcagtactggatcatccatttatgtctaggaactcatctacaaagtctaaggacctaggcaccgtggaagatagcattgattccggacacgcaactataagcaccgccatcaccgcctctagttccacctccatcagtggcagtctgtttgataaacgccggctcctgattggacaacccttgccaaataagatgaccgtcttcccgaaaaataaatcaagcacagatttctcttcaagtggcgacgggaattccttctatacgcagtggggcaaccaggaaacttccaactctgggcgaggacgcgtgatccaagatgccgaggaacgcccacactcccggtaccttcgcagagcatactcatccgatcgttccggaacttctaacagccaaagtcaagctaagacttataccatggaacgatgtcattccgcagaaatgctctctgtctccaaaagatccggagggggcgagaacgaggaaagatattctccgaccgacaataatgctaacatttttaattttttcaaggaaaagacctcttcatccagtgggtcctttgagcgccctgacaataaccaagccttatctaaccacctctgccctggaaagactcctttcccttttgctgatcctactccccagaccgagactgtgcagcagtggttcggtaacctccaaataaacgctcacctgagaaaaaccaccgagtacgacagcatctccccaaatagagacttccaggggcacccggacctgcagaaggacacctccaagaacgcatggacagatacaaaagttaagaaaaattcggatgcctccgataacgcacatagcgtgaaacagcagaacacaatgaagtacatgactgcgctgcacagcaaaccagagattattcagcaggagtgtgtgtttggttccgaccccctctcagaacagagcaagacgcgtggaatggaaccaccatgggggtatcaaaaccgaaccctccggtcaatcaccagccctctagttgcccatcgcctaaaaccgatccgccaaaagacaaagaaagctgtggtcagcatactggattctgaggaggtctgtgtggagctggttaaggagtacgcctcccaggagtatgttaaggaagtcctgcaaatatcaagcgatggtaatacaatcacaatttactaccccaacgggggacgcgggttcccacttgctgaccggccaccgtcaccaaccgacaacatctctcgatactcgtttgataaccttcccgagaaatattggaggaagtatcagtacgcaagccgttttgtacagctggttcgcagcaagagcccaaaaattacctacttcacaagatacgccaaatgcattttaatggagaacagtcctggtgccgatttcgaggtatggttttatgacggtgttaagatccataagaccgaggatttcatacaggttattgagaaaaccggtaaaagctacaccctcaagtccgaatccgaagtgaattcactaaaggaggagattaaaatgtacatggaccatgctaacgagggacataggatctgtctggcactcgagagtataatctccgaagaggaaagaaagacacgcagcgctccttttttccctatcattatagggagaaagcctggatcgaccagctctccaaaggccctgagcccccccccatccgtagactctaattatcccacccgtgaacgcgcgtcctttaatcggatggttatgcattctgccgcctccccgacacaggctcctatactgaacccctctatggttacaaatgagggtctgggtctgactacaaccgcatccggtactgatatttcttccaactccctgaaagattgtctgcctaaatccgctcaacttctgaagtctgtcttcgtcaagaatgtggggtgggcgactcagctcacaagtggtgctgtctgggttcagttcaacgacggatcccagctggttgtgcaggccggggtgtcttcaatctcttacaccagtcccaatggacagacaaccagatatggtgagaatgagaagctccctgactacattaagcaaaaactgcagtgtttgtcatccattctcctgatgttttccaaccccaccccaaacttccactag

SEQ ID NO: 16731 - DNA, 2817 bp, Artificial Sequence
  Description of Artificial Sequence: Synthetic coding sequence
atggccacctgtataggggagaagattgaggactttaaagtgggtaatcttctgggaaagggaagttttgcaggcgtctatcgcgcggaaagtatccatacaggcttggaggtggccatcaagatgctttacaattactttgaagactctaactatgtatacctcgttctggaaatgtgccacaatggggaaatgaaccgatacctgaagaacagggtgaaacccttcagcgagaacgaagctcggcacttcatgcaccaaatcataacgggaatgctatatctgcattcccacggcattctgcatagagacctgaccctttcaaatctgctcctgacacgcaacatgaacattaagatcgcagattttggcctggcaacccagcttaagatgccccacgagaaacactacacattatgcggcacccctaattacatctccccggagatcgccacacggagcgctcacggactcgagtctgatgtgtggtcactggggtgtatgttctacaccctgctgattgggcggcctcccttcgacactgacactgtcaaaaacaccttaaacaaggtcgtcctggccgactacgaaatgcccagcttcctgtcaattgaagcaaaggatctgatccaccagctgctgcgaagaaaccctgctgataggttatccctctcgtcggttctggatcatccgtttatgtctagaaattctagcacaaagagcaaagatctgggcactgtggaggatagtatcgacagcggccacgccacgattagtacagctatcaccgcctcctcctctacatccatttctgggtccctgttcgataagaggcgattactaatagggcagccactgccaaacaagatgaccgtctttcccaaaaataaatcgtctacagactttagctcctccggagacgggaattctttttatactcagtggggaaatcaagagacctccaattccgggcgcggccgggtaatccaggatgcggaagaacgcccgcactctcggtacctgagacgggcctacagtagtgataggtctggcacctctaattctcagtcccaggcgaagacttacacaatggaaagatgccacagtgcagagatgcttagtgtgtctaaacggtcaggagggggcgagaacgaggagaggtatagtccaaccgacaataacgcaaacatatttaacttcttcaaagagaagacatcgtccagtagcggaagcttcgaacgccccgataataatcaggctctctctaatcatttgtgccctggaaaaacgccctttccatttgcggacccaacccctcagacagagaccgtgcagcagtggtttggcaacctccagattaacgcccaccttagaaagacgactgagtacgatagcatttcccctaacagagattttcagggtcacccggatctccagaaggatacctctaaaaacgcgtggaccgacacaaaggtgaaaaagaattccgatgcctcagacaatgctcattctgtcaagcaacagaacactatgaaatatatgacagccttacatagcaagcctgaaattatccagcaggagtgcgtttttggaagtgaccccctgagtgagcagagcaaaacccgcggcatggaacccccctggggctaccagaatcgaacactcagaagcatcaccagtcccctcgtcgcccatcgactgaaacctatcagacagaaaaccaagaaagcagttgtgtctatactcgacagcgaagaagtatgcgtggaactagttaaagagtacgcctcccaggagtacgtcaaagaagtacttcaaataagctcagacggcaacactataacgatttattaccccaacggaggccgcgggttccccctcgctgatagaccaccctctccaacagataacataagtagatactcgttcgacaatctccccgaaaagtattggcgcaagtatcaatatgcgtcccgtttcgtgcaactggtgaggtcaaagtcacccaaaatcacttactttactaggtatgcaaagtgcatactgatggaaaacagccctggcgctgatttcgaagtctggttttacgacggcgtgaaaatccacaaaacagaagattttattcaggtgattgagaagacagggaaaagctacactctgaagtccgaaagcgaggttaactccctaaaggaggagatcaagatgtatatggaccacgcaaatgaaggacaccgtatctgcttagctctggaaagtatcattagtgaagaagagaggaagacacgtagtgccccattctttcctatcataatcggacggaaacccgggtcaacttcctccccgaaggccttgtctcccccaccttctgtggacagtaattacccaactagggagcgcgcttccttcaacagaatggtgatgcatagtgcagcatcaccaacccaggcccccattctcaacccctccatggtgaccaacgaggggctaggattgaccaccacagccagtggaacagatatctctagcaatagtctcaaggactgtctgccaaagtccgcacaactcttgaaatcagtgttcgtaaaaaatgtgggatgggcgacccagctgacatccggggctgtttgggtgcagttcaatgatggaagccaattggttgtccaggcaggggtttcctctattagctatacttcacccaacgggcagaccactcgttatggtgagaatgaaaagctgcccgattacatcaagcagaagctccagtgcctgagtagcatattactgatgtttagcaatcctactccaaactttcactag

SEQ ID NO: 16732 - DNA, 2790 bp, Artificial Sequence
  Description of Artificial Sequence: Synthetic coding sequence
atgattgacaaaaaagctatgtataaagctgggatggtccagcgagttcagaatgaggtgaagattcactgtcagcttaagcatccctccattctggaattgtataattattttgaggattcaaactacgtataccttgtcctcgagatgtgccacaatggagaaatgaaccggtaccttaagaatagggtgaaaccgttcagcgagaatgaagctcgtcactttatgcaccagatcattacagggatgttatatctgcatagccatggaatccttcaccgcgacctaacattaagtaacctcctgcttacgcgcaatatgaatataaaaatcgcggacttcggcttggccacacagcttaagatgccccatgaaaagcactatacactttgtggaacccccaactacatttctccagagattgcgacaagaagcgcacatggtctggaatcagacgtctggagcctaggctgtatgttttacacactactaatcggaaggcctccttttgacaccgatacggtgaagaacactttaaataaagttgtgctggccgactacgagatgccctccttcctgtctatagaagccaaagacctgattcaccaactgctacgccgcaatcccgctgacagactctcgttgtcctctgttctcgatcacccctttatgagtcgcaacagttccaccaaaagcaaggatctggggactgtggaggacagtatcgactctggtcacgctacaatcagcacagccataaccgcatcgtcttctaccagcatttcaggctctctgttcgacaaaaggcgcctgctaattggccagccacttccaaacaaaatgacggtgttccccaaaaacaagtcttccaccgacttttcgtccagcggcgatggcaattctttttacacgcagtggggtaaccaggaaacctccaattctggcagggggcgtgtcatacaggatgcggaagagcgcccgcactctagatacctcagacgagcatactcaagcgatagatcagggacatctaactcccagtcgcaggccaaaacatatacaatggaacggtgccactcagcggagatgttgagcgtgtccaagaggtcagggggcggcgaaaacgaggagcgttactcaccaactgacaacaatgctaatattttcaattttttcaaggaaaaaacgtcctcttcaagcgggtccttcgaacggccagacaacaatcaggctctctcgaaccacctgtgtcccggtaagactccctttccttttgccgacccgactccgcagaccgagacagtgcagcaatggtttggcaacctgcagatcaatgcccacctgcggaaaaccactgagtacgattccatttcgcccaaccgggattttcaaggacatcctgacctacagaaggacacatcaaagaatgcctggaccgacaccaaggtcaaaaaaaattcggatgcgtctgacaacgcacactcagtgaaacagcaaaacaccatgaaatacatgactgctttacattccaagccagagatcattcagcaggagtgcgtatttgggagcgaccccctcagcgagcagagcaagacccgcggcatggaaccaccctggggctatcagaataggaccctgcgatcgattacctctccactggttgctcaccggcttaaaccgataagacagaagactaaaaaggccgtggtctccatactggatagtgaggaggtatgcgtggagctggttaaagagtacgcctcccaggaatacgtgaaagaagttctccagatcagctctgatggtaacacaatcaccatttattatcccaacggcggacggggttttcctctcgctgaccgaccaccttcacctactgacaacatcagccgttattcctttgacaatctgcccgaaaaatattggcggaaatatcagtatgcgagtcgttttgttcagctcgtgagatctaagtctccaaaaataacatactttacgcgctatgcaaagtgtatcctcatggaaaattcacccggggcagatttcgaagtctggttctatgacggggtaaagatacataaaacagaggattttattcaggtcatagagaagaccgggaagtcctacactctgaaaagcgaatccgaggtgaactctctgaaagaagaaattaagatgtacatggaccacgctaacgaagggcatagaatctgccttgctcttgaaagcattatctccgaagaagaaagaaaaacaagatctgccccttttttcccgattattatcggaaggaagcccggcagtacctctagcccaaaagcgctgagcccacctccctcagtagactcaaactaccccacacgagaacgtgcatccttcaaccgcatggtgatgcatagtgccgcaagtcccacgcaagcccctatactcaatccgagtatggtgacaaacgagggactcggtctgactaccacagcaagcgggactgacatttcctccaactcactgaaggactgcctcccaaaaagcgcccagctcctcaaaagcgtgtttgtgaagaacgtggggtgggccacccagctgacatccggagctgtttgggtgcagttcaatgatggttctcagctcgtcgtgcaagcaggtgtcagttccatatcttataccagtccaaacgggcagacgacgcggtatggtgaaaacgaaaagctgcctgattacattaagcagaagctgcagtgtctgtcgagcattctgctgatgttctctaaccctacacctaacttccactag

SEQ ID NO: 16733 - DNA, 1752 bp, Artificial Sequence
  Description of Artificial Sequence: Synthetic coding sequence
atggcagctaggcggcggcgaagcacgggggggggacgtgctagagccctcaatgaaagtaagagagtaaacaacggtaataccgctccagaggattccagccccgctaaaaagacaagaagatgccagcgtcaggagtctaagaagatgcctgtcgccggcggcaaggccaacaaagatcgaaccgaggataaacaggacggaatgcctggcaggtcttgggccagtaaacgggtctcagagtcagtgaaagccctgcttcttaagggaaaggccccggtcgatcctgaatgtacagcgaaagtcgggaaagcccacgtctattgcgaggggaacgacgtttatgacgtcatgctgaatcagactaacctgcaattcaataacaataaatactacctgatccaactcctggaggacgacgcacagaggaactttagtgtgtggatgagatggggaagggtgggcaaaatgggacagcatagcctggtggcatgctccggcaatttgaataaggctaaggaaatttttcagaagaaatttcttgacaagactaagaacaactgggaggaccgcgagaagtttgaaaaagttcccggtaaatatgacatgctccagatggattatgcgactaatacacaggacgaagaggaaaccaaaaaagaggaatccctcaaaagcccactgaaacctgagtctcagttggatctccgggtccaggaactcattaaactgatttgcaacgtccaggctatggaagagatgatgatggagatgaaatataatacaaagaaggcgcccttagggaaattgaccgtggcccagatcaaagccggctaccaaagcttgaagaagatcgaggattgcatccgtgccgggcaacacggtagggcactgatggaagcctgtaatgaattttacacgcgtatccctcacgattttgggctgcggacaccacccctgattcggacacagaaggaactctcagagaagattcagcttctggaggctctaggcgacatagaaattgctatcaagctggttaagacagaactgcagagccccgagcacccgctcgatcagcattataggaatctccattgtgcattgagacctcttgatcacgaaagttacgagtttaaggtaataagtcaatatctgcagtccacgcatgccccaacccactccgactatacaatgactctgctagacctttttgaggtggagaaggacggggagaaggaagcatttcgggaggacctgcacaatagaatgctcctgtggcatggttctagaatgagcaactgggtcggcattctcagtcatggtctgagaatcgctccaccagaggccccaatcacgggatatatgttcgggaagggaatttatttcgccgacatgtccagtaagtctgccaattattgcttcgcatccaggctgaaaaatacaggtctgctgctgttgagcgaggtcgctctcggccagtgtaatgagctgctggaagctaaccccaaagcagagggcctcctacagggcaagcattccactaaaggattaggcaaaatggctccaagtagcgcacacttcgtcaccttgaatggtagcacggtgccactgggccctgcctcagataccggcatcctgaatcccgacggctatacccttaattacaacgaatatattgtgtacaatccaaaccaagtaagaatgcgatatttactcaaggttcagttcaattttctccaattgtggtag

SEQ ID NO: 16734 - DNA, 1713 bp, Artificial Sequence
  Description of Artificial Sequence: Synthetic coding sequence
atggctgctcggcggcgacgaagtacagggggcggaagagctcgcgctctaaacgaatccaaacgagtcaataacggaaatacagccccagaggactcttctcctgccaaaaaaacaaggaggtgccagcggcaggagtcgaagaaaatgcccgtggcagggggcaaagctaataaagaccgcactgaagataaacaagacgaatctgttaaggccctgctactcaaagggaaggctcccgtggaccccgagtgcaccgcgaaggtggggaaggcgcacgtgtactgtgaagggaacgatgtctatgacgtaatgctgaatcagactaacttgcagtttaataataataagtactacctcatccaacttctagaggatgacgcccagagaaatttctctgtttggatgcggtgggggagggtaggtaagatgggacagcactccttagtggcctgtagtggcaacctcaacaaagcaaaggagatctttcagaagaagttcctagataagacaaaaaataactgggaagatcgtgagaaattcgagaaagtcccgggcaaatacgacatgctgcaaatggactatgccacaaacacccaggacgaggaggaaactaagaaggaagaaagcctgaaaagccccctcaagccagaaagtcagctggatctgcgggtgcaggagctaatcaaactgatctgtaatgttcaggcaatggaagagatgatgatggagatgaagtacaataccaagaaagctccattgggtaaacttacagttgcccagatcaaggcgggatatcaatccttaaaaaaaatcgaggattgcatccgggcaggtcagcacgggcgcgccttgatggaggcttgcaatgagttctatactaggataccccatgacttcggccttcggacccctccactcatccgaacacagaaggagctgtccgaaaaaatacaactgctagaagccctgggagacatcgaaatagctatcaaactcgtcaagaccgagctccagtcccccgagcaccccttagatcagcattacaggaacctccactgcgccctgagacccctggaccacgagtcatatgagttcaaagttatttcccagtaccttcagtctacacacgccccgacacactctgattacacaatgaccctactggacttatttgaagttgagaaagacggtgaaaaggaggctttccgcgaggacctgcacaatcgcatgctcctgtggcatggttctaggatgagcaattgggtgggcattctgtctcatggactcaggattgccccaccagaggcccccatcacggggtacatgtttggtaagggcatttattttgcagatatgagcagtaaaagcgctaactactgttttgcctctcggctgaagaacacgggactgctcctgttgagtgaggtcgcacttggccagtgcaatgaactgctggaagctaaccctaaagccgaaggcctcttgcagggaaaacatagtacaaaaggcctgggtaagatggcccccagcagtgctcattttgtgacacttaatggcagcactgtccctctgggacccgcctcagacacaggaatcttgaatcccgacggctataccctcaattataatgaatacatcgtttataacccaaaccaagtccgtatgcggtatcttctgaaagtgcagtttaacttcttgcagctctggtag

SEQ ID NO: 16735 - DNA, 1623 bp, Artificial Sequence
  Description of Artificial Sequence: Synthetic coding sequence
atgtcgctccttttccttgcaatggccccaaagccaaaaccttgggtgcagaccgaaggaccagagaagaaaaaaggtagacaggcagggcgggaagaagaccctttccggtccacggctgaagccctgaaagccattccagcagagaaaaggattatacgggtggaccccacttgtcctctgtcctccaaccccggtacgcaggtgtacgaggactacaattgcacccttaatcagaccaacattgaaaataacaacaataagttctacataatccaactcctgcaggacagtaatcgtttttttacctgttggaaccattggggacgggtcggtgaagtgggccagtctaaaataaatcatttcacaagactggaggatgcaaagaaggatttcgagaagaagtttagagagaagacaaaaaacaattgggccgagcgggatcatttcgtcagtcatcccggtaagtacacgttaatcgaagtccaggcagaagatgaagctcaggaagccgtagtcaaggttgaccgggggccagtgcggacggtcacgaagagggtgcagccatgctccttagaccctgccacccagaagcttattacaaacattttttctaaagaaatgttcaaaaataccatggccttaatggacctggacgtgaaaaagatgccgcttgggaagctgtctaaacagcagattgcgcgtggatttgaagccctggaggctctggaggaggctttgaaagggccaacagatggcggccagtccctggaagagctgtcatcacacttttataccgtgattccccacaactttggtcacagccaacctcctcctatcaacagccctgaactgcttcaggcgaagaaggacatgcttttagtgcttgcggatatcgagctggcccaggccctgcaagccgtttctgagcaagagaagacggtggaggaggtcccacacccgctcgatagagactatcagcttctgaaatgccagcttcagctgttggactctggcgcgccggagtataaggttatccagacctacctggagcagacagggtctaatcaccggtgcccaactctgcaacatatttggaaagtcaaccaggagggtgaagaagacaggtttcaggcgcactcgaagctcggcaacagaaaactcttgtggcatggtactaatatggccgtggtggcagcaatcctcacttccgggctaaggattatgcctcacagtggtgggagggttggcaagggcatttactttgcatctgaaaacagtaaatcggctggctatgttattggcatgaagtgcggcgcacatcatgttgggtacatgttccttggcgaggttgccttagggcgcgaacaccatatcaacaccgataacccctccctcaaaagtccaccaccaggttttgactcagtcatcgccaggggacacactgagccagatccgacgcaggacacagagcttgagctggatggccagcaggtagtggtgccacaggggcagcctgtcccatgcccagagttcagctcttcaacattttcccaatccgagtatctgatctatcaggagtcccagtgtaggctccggtacctgctggaggtgcatctctag

SEQ ID NO: 16736 - DNA, 1602 bp, Artificial Sequence
  Description of Artificial Sequence: Synthetic coding sequence
atggcgccgaaaccgaagccctgggtgcagactgagggacctgagaagaagaagggcagacaggcaggccgagaggaggatcctttccgttccaccgctgaggccctgaaggcgatccccgctgagaagcgtatcatccgtgtggatcccacgtgccctttgtcaagcaaccccggaacccaggtgtacgaggactataactgtactctgaaccagactaatattgaaaataataacaacaaattctatatcatccaactgttacaagacagtaacaggtttttcacctgctggaatcactgggggcgagtcggtgaggttggtcagtcaaagatcaatcacttcacccgactggaagacgctaagaaggatttcgagaaaaagtttcgagaaaagaccaagaacaactgggccgagcgggatcactttgtgagccatcccgggaaatataccctgatcgaggtgcaggctgaggacgaggctcaagaagccgtagtcaaagtcgatcgggggccagtgcgtactgtgaccaagcgcgtgcaaccttgttcgctcgatcccgcgacccagaaactgattaccaatatcttttccaaggagatgttcaagaatacaatggccttaatggatctagacgtgaaaaaaatgccactggggaagctgtcaaaacagcagatagcacgtggatttgaagctcttgaggctctggaggaggcactgaagggtccgacggacggtggacagtctctagaggagctctcaagccacttctacaccgtgatacctcacaattttggacacagtcaacccccacctatcaattccccagaattgcttcaggcgaaaaaggatatgttgctcgtcctggctgatatagagctggctcaggctctgcaggccgttagcgaacaggagaaaacagtggaggaagtccctcacccactggacagagattatcaactccttaagtgccagctgcagctgctcgactcaggagcacccgagtacaaggttattcagacatatctcgaacagactggcagtaaccaccggtgtccaactttacagcacatatggaaagtgaaccaggagggtgaagaggatcggttccaggcccatagcaaactcggcaaccggaagctactatggcacggcaccaatatggccgttgttgccgccattctcacctccggcctccgcattatgcctcacagcggcggccgggttggcaaaggaatctacttcgcgtcagagaacagcaaatcagccggatatgtcattggcatgaaatgcggtgcccatcacgtcggctatatgttcctgggggaggttgctctcgggagggaacaccacatcaacacagacaatccctctctgaaaagccctcccccaggcttcgactcagtgatcgcacgtgggcacaccgagccagaccccactcaggacacggagctggagctggatgggcagcaagtggtggttccccaaggtcagcccgttccatgcccagagttcagcagtagcacattttcccaatcagagtacctgatttatcaggagagccagtgcagactccgataccttttagaagtgcatctctag

SEQ ID NO: 16737 - DNA, 1602 bp, Artificial Sequence
  Description of Artificial Sequence: Synthetic coding sequence
atggcaccaaaacctaagccgtgggtgcagacagagggcccagagaaaaagaaaggcagacaggccgggcgggaggaagatccattccgctcaacggctgaagccctcaaagctattcccgctgagaagcgaatcatccgtgtcgatcccacgtgcccactaagcagcaatccaggtacccaggtgtatgaagattataattgcactctcaaccaaaccaacatcgaaaataataacaataaattctatataatccagctgctgcaagatagtaaccggttctttacttgttggaatcactgggggcgcgtgggtgaagttggacagtctaaaatcaaccactttacaaggctagaggatgccaagaaggacttcgagaaaaagttcagagagaagactaagaacaactgggcagagcgagaccacttcgttagccacccaggtaagtacacgctgattgaagtgcaagctgaggacgaggctcaggaggcagtggtgaaggtggaccgaggccctgtacgcactgtgacaaaaagggtgcagccgtgtagcctcgatcctgctactcaaaagctgattacaaatattttctccaaggagatgtttaagaatacaatggcccttatggatctggacgtcaaaaagatgcctttgggcaagctgagcaagcagcaaattgcgagaggcttcgaggctctagaagccctggaagaggccttgaaggggcccacagacggtggacagtccctggaagagctgtcaagtcatttctacacggtcatcccacacaacttcgggcatagccagcccccccccataaattctcccgagctgctgcaggccaaaaaagacatgctgctggtccttgcggatatcgaactagcacaggccctgcaggcagtatctgagcaggagaagactgtcgaagaggtgccacaccctctggaccgtgactatcagctgctgaagtgtcagttgcagttgctggattccggtgcacctgaatacaaagtgatccagacttatcttgaacagaccgggtcaaaccacaggtgtcccactttgcagcatatctggaaagttaaccaggaaggtgaagaggaccgtttccaagcccactcaaagctgggtaaccgaaaacttctgtggcatgggaccaacatggcagtcgttgccgccatccttacgagtggcctccgaattatgccacactcaggcggccgcgtgggcaagggaatatattttgcttccgaaaatagcaagtcagcgggctacgttattggcatgaagtgtggcgcccaccatgttggctacatgttcctcggcgaggtagccctcggaagggagcatcatatcaatacagacaatcccagcttgaagtctccaccaccggggttcgacagcgtgatcgctagaggacatacagaacctgaccctacccaggacactgagctcgagctcgacggccaacaggtcgtggtgccccagggtcagcccgtgccgtgcccagaattctcctcttcgactttcagccaaagtgaatacctcatttaccaagagtcgcaatgccgcttaaggtacctcttagaagtccacttgtag

SEQ ID NO: 16738 - DNA, 999 bp, Artificial Sequence
  Description of Artificial Sequence: Synthetic coding sequence
atggcaccaaaacccaaaccatgggtgcagaccgagggaccagagaaaaagaagggtcggcaggcgggaagggaagaggatcccttcaggagcactgcagaagcattgaaggccataccagcagaaaaaagaattattagggtggaccccacctgccccctgtcttccaatccaggtactcaggtgtacgaggactacaactgcacacttaatcagactaatatagaaaacaacaataacaaattctacattatccagctgctccaggactcaaatcgattctttacatgctggaatcactggggcagggtaggggaggttggacagagtaaaataaaccatttcacccgccttgaagatgcaaaaaaagatttcgagaaaaaattccgagagaagaccaagaataattgggcagaaagggatcattttgtgtctcacccaggcaagtatacactgatcgaggtgcaggccgaagatgaagcccaggaggcggtggtaaaggttgatcgcgggcccgtgagaacagtcaccaagagggttcagccgtgctccctggacccagctacacagaagctcattaccaatattttttccaaggaaatgttcaaaaatactatggctttaatggatttggacgttaaaaagatgcctctggggaaactgtccaagcagcaaattgctcgaggctttgaagctctggaggcactggaagaggctctgaaggggccgactgacgggggccagagtctggaagaactctcgtcccatttctataccgtgattccccacaactttggtcattcacaacctccccccatcaactcgccggaactccttcaggcaaagaaagacatgctcctcgtgctggctgacattgagttggctcaggcgctccaggcggtaagcgaacaggagaaaactgtcgaggaggtgccccatcccctggatagggactaccagctattgaagtgccagctgcagctcctggacagcggctag

SEQ ID NO: 16739 - DNA, 5175 bp, Artificial Sequence
  Description of Artificial Sequence: Synthetic coding sequence
atggtgatggggatttttgccaactgtattttctgcctaaaggtcaagtacctcccacagcaacagaagaagaagctccagactgatatcaaagaaaacggtgggaaattttccttttcattgaacccgcagtgcacacatatcattctggataacgcggacgttctgtctcagtaccagctcaactctatccagaagaatcatgtccacatcgcgaacccagatttcatctggaaatctatacgtgaaaaacgtcttctggatgtgaaaaactatgatccctacaaaccactggacataactccccctcctgaccagaaggcctcttcctcggaggtgaagaccgaaggactctgccctgatagcgccaccgaggaggaagacacagtcgagttgaccgagtttgggatgcaaaatgtagaaattccacacttaccccaggattttgaggtggctaagtacaatactctggagaaagtgggcatggagggcggacaggaggccgtcgtcgtggaactgcagtgctctagggatagccgtgactgcccattcctgatctcaagccatttccttctcgatgacgggatggagacacgcaggcagttcgccattaaaaagaccagcgaagatgcttccgaatatttcgaaaactatatcgaggagctaaaaaaacagggtttcttgctgcgcgagcacttcacacccgaggccactcaacttgcttcagaacagttacaggcactgttacttgaagaggtgatgaactcctccaccttgtctcaggaggtcagtgacctggtggaaatgatctgggccgaagccctgggccacctggagcatatgttattgaaaccggttaataggataagtctaaatgacgtgagcaaagctgagggcatcctcctcctggtgaaagcggctctcaaaaacggtgagaccgctgagcagcttcagaaaatgatgaccgagttctataggctaatcccccataaggggaccatgcccaaggaagtgaacttgggattactggcaaagaaggcagacctctgtcagctaattcgcgacatggtgaatgtctgcgagaccaatctcagtaaacctaatccacccagtctggccaaatatagagccctcaggtgtaagattgaacatgtggaacagaacacggaggagtttttaagagtgcgcaaggaggtgttacagaaccaccattcaaagtctccggtcgatgtgctgcagatctttcgtgtcggccgagtcaatgagaccaccgagttcctgagcaagttaggcaatgtgagacctttgctccatgggtctcctgttcagaacatagtggggatcttatgccgaggtttgttactccctaaagtcgtggaagatcgtggcgttcagaggaccgacgttggcaacctggggtctgggatttatttttctgattccctgagcacctccatcaaatattctcaccctggcgagacagatgggactaggttactcttgatctgcgatgtcgcattgggcaagtgcatggatctgcacgaaaaggatttcagtcttactgaggccccaccaggatatgatagcgtgcacggggtctcacagaccgccagcgtgacgacagatttcgaggatgatgagtttgtggtgtacaaaacaaatcaggttaaaatgaagtatattataaagttttcaatgccaggggaccaaataaaagactttcacccaagcgaccacactgagcttgaggagtataggccggaattctccaacttttctaaagttgaagactatcaattgccagatgccaagactagttccagcaccaaagctgggctgcaggacgccagcggcaacctcgtgccactggaagatgttcacatcaagggcagaatcatagacactgtcgctcaggtgatagtgttccagacctacaccaacaaatcccacgtcccaattgaggcaaaatatatctttccactcgacgataaggccgccgtttgtggcttcgaggctttcattaatgggaaacatatagtaggggaaatcaaagaaaaagaagaagctcagcaagagtacctcgaagccgtgactcagggacatggagcttatctaatgagtcaggacgctcctgacgtgtttacagtgtcagtgggaaatcttccccctaaagcgaaggtcctgataaagatcacatacattaccgagctttctatcctgggcacagtcggggtgtttttcatgcctgccacagtcgcgccctggcagcaggataaggccctgaacgaaaacctccaagataccgtcgaaaaaatctgcatcaaggagattgggacaaagcagagctttagcctcactatgtccattgaaatgccatacgtaatcgagtttatattctccgacacccatgagctcaagcaaaaacgaactgactgtaaggcggtgatctctacaatggaaggatctagtctggacagcagtggcttcagcctgcacattgggctgtccgcagcttacttgcctagaatgtgggtagaaaagcatccagagaaggagagtgaggcctgtatgttggttttccagcctgatctcgacgtcgaccttccagatcttgcaagcgaatctgaagtgattatctgcttggattgcagcagcagtatggagggtgtaacctttctgcaggctaaacagatcgctctgcacgctctctctctggtcggcgaaaaacagaaagtcaacattatccagtttggcactggatacaaggagcttttttcatacccaaagcacattacatccaacacgatggccgccgaattcataatgtccgccacccctaccatgggtaataccgacttctggaaaactctgaggtatctgtcgctcttgtacccagctaggggctctcgaaacatattgcttgtgagtgacggccaccttcaagatgagtcccttactctccagctagtgaagagaagcagacctcatactcggttgttcgcttgcgggattggatctactgctaaccgacacgtgctccgcattctgtcccagtgcggcgcgggagtattcgagtatttcaacgcgaaaagtaaacattcctggcgaaagcagatcgaggaccagatgacacgcctctgcagtccatcatgccacagtgtcagcgtgaagtggcagcaactgaatccagacgtccccgaggcactccaggcccctgcccaggtaccctccttgttcctgaatgataggctgctggtttatggctttattccacactgcacccaggccacactttgtgcccttatccaggagaaagaatttcgcaccatggtgtctacgaccgagctgcagaagacgaccgggaccatgattcacaaactggccgctagggctctaatacgggactacgaggatggcatactgcatgagaacgaaacttctcacgagatgaagaaacagacattgaagtcccttatcattaaacttagcaaagaaaacagcctgattacacagtttacgagcttcgttgccgtggagaagagagatgagaacgagtctccctttcccgacattcccaaggtttcagaactgatagcaaaggaggacgtggactttcttccctatatgagctggcagggggagcctcaggaagccgttaggaaccagagcttgttggcctcctccgagtggccagaactcaggttgagtaaaaggaagcataggaagataccctttagcaagcggaaaatggagctcagtcagcctgaagtctcagaagacttcgaagaagatgggctgggggtactccccgcattcaccagtaacctggagaggggtggcgtggaaaaactgcttgatttaagctggacagagagctgtaagcctaccgctacagaacctctgtttaaaaaggtgtcgccatgggagaccagtacatcctcgttttttcctatcctggcgccggccgtgggctcttacctacctccgaccgcccgggcacatagtcccgccagccttagcttcgctagttataggcaagtagccagctttggttcggcggcaccaccacgccagttcgacgcgtcccagttcagtcaaggaccagtgccaggaacctgcgcagactggattcctcagtcggcgtcatgcccaaccggacctccgcaaaaccccccaagcagtccatactgtggaatcgtcttttcagggtcctccctgtcatccgcacagtcagcccccctacaacacccaggtgggttcacaacaagaccaagcgccggcaccttccctgagctcgattctccgcagttgcacttcagtctgcccaccgatccggatccaattagggggttcggctcataccacccaagcgcttcaagtcccttccattttcaaccctcagctgcctctcttaccgccaacctgcggctgcccatggcctccgctttacccgaggctttgtgctctcagtcacgaactacaccggtggacttgtgccttttagaagagtctgtgggctctttagaaggatccaggtgccccgtattcgcttttcagtccagcgatactgagagcgacgaactgtctgaggttcttcaggactcctgttttctccagattaaatgtgataccaaggatgatagtatcttgtgctttctggaggtcaaggaagaagacgagatcgtatgtatccagcactggcaggacgctgtgccttggaccgagctgttgtctctccagaccgaggacgggttctggaaacttacacccgagttaggactgattttaaacctgaacactaacggcttgcattccttcctgaaacagaaaggcattcaatcattgggcgtcaagggaagagagtgcctgctggatctgatagcaaccatgctagtcctgcagtttatacggaccagacttgagaaagaagggattgtgtttaagtctcttatgaaaatggatgacgcttctatcagtcggaatatcccttgggctttcgaagccatcaaacaggcgtcagagtgggtccgacgaacagagggacagtacccatcaatctgccccaggctggaactaggaaatgattgggattctgctaccaagcagcttctggggctgcagccaatatccaccgtgtcgccactacacagggtgttgcattactctcaagggtag

SEQ ID NO: 16740 - DNA, 1911 bp, Artificial Sequence
  Description of Artificial Sequence: Synthetic coding sequence
atgaaccctagtgctccgtcctatccgatggctagtctgtacgttggggacctccaccctgacgtgacagaggccatgctctacgaaaaattttctcccgctggccctatcttgagtattcgagtctgtagggacatgataacccgccggagcctaggatacgcttatgtgaattttcagcaacccgcagatgcggaaagggctctggatactatgaactttgacgtgatcaaggggaaacccgtcagaatcatgtggagtcagcgtgatccgagcctgcgtaagagtggggtcggcaatatcttcattaagaacttggataagagcattgacaacaaggccctgtacgacacattttcagcgtttggtaacattttgtcttgcaaagtcgtgtgcgacgaaaatgggtcgaaggggtacggatttgtgcatttcgagacccaagaggcagctgagagggcaatcgagaagatgaacggcatgcttcttaacgaccggaaagtattcgtgggacgattcaagtcccgcaaagagagggaggccgaactgggcgctagggccaaagagtttacgaatgtgtatattaagaatttcggcgaagatatggatgatgagaggttgaaagacttatttggtaagtttggccccgccctgtctgtgaaggtaatgactgacgaatccggcaaatccaaaggttttggatttgtgagcttcgagcggcatgaggacgctcaaaaagctgtggatgagatgaatgggaaagagctcaatggaaagcagatctacgtggggcgggcccagaagaaagtcgagcggcaaacggagctaaaaaggaagtttgagcagatgaagcaagataggattaccaggtaccagggtgtcaacctgtatgtgaaaaacctggacgatggcatcgacgacgaaagactccggaaagaattcagcccattcgggactataacttccgcaaaggtgatgatggaaggtggccggtccaaaggcttcggattcgtgtgtttctcttcgcctgaagaagccaccaaggcagttaccgagatgaacggtcgtatcgtcgctacaaaacccttgtacgtcgcactcgcccagaggaaggaggagaggcaggcacacctcacaaatcagtatatgcagagaatggctagtgtgagggccgttccaaacccagtgatcaacccttatcagccagcccccccgtccgggtacttcatggcggccatcccccagacccaaaaccgtgccgcctactaccccccgtctcagatcgcacaactgcggccttcaccacggtggaccgcacaaggtgcacgcccacacccatttcagaacatgcccggtgccattagaccagcagcccctcgcccacctttctccaccatgagaccagcgagctctcaggtgcccagagtcatgtccactcagagagtggcgaacacctccacacaaaccatggggccacgtcccgctgcggcggctgccgcagcgacccctgcagtcagaaccgttcctcagtacaagtacgccgccggtgttcggaaccctcagcagcatctgaacgcacagcctcaggtgactatgcagcagccagccgtgcacgttcagggacaggaacccctcacggcttccatgctggctagcgctccacctcaggagcagaaacaaatgctgggggagcgtctattccctctgattcaggctatgcatcccactcttgccggtaagataacgggtatgctcctggaaatagataattcagagcttttgcacatgcttgagagtcctgagtctctgcgttccaaagtagatgaagccgtggcagtgctacaggcgcatcaggcaaaggaagcagcacagaaagctgtgaatagcgctactggggtccctacagtatag

SEQ ID NO: 16741 - DNA, 1644 bp, Artificial Sequence
  Description of Artificial Sequence: Synthetic coding sequence
atgaatccaagcgctcctagttatccaatggcctcattatatgtgggcgacctccaccccgatgtgacggaggcgatgctctatgagaagtttagtccggcaggccctatcttatccatccgagtatgcagggacatgatcaccagaagatcactgggctacgcctacgtaaatttccagcaacccgctgacgcagagagggctttggatacgatgaacttcgacgtgattaaggggaagcccgttagaatcatgtggagccaacgtgatccatcactgagaaaatcaggggtgggcaatattttcattaagaacctggacaagagtatcgacaataaagctttgtatgacaccttctccgctttcgggaacatccttagttgtaaggtagtttgtgacgagaatgggtcaaaaggctacggctttgtccacttcgagacccaggaagctgccgagagggccatagaaaaaatgaatgggatgctgctgaacgataggaaggtttttgttggaagattcaagtctcgcaaagaacgtgaagctgaactcggcgccagggcaaaggaattcaccaacgtttatatcaaaaacttcggcgaagacatggatgacgagagactcaaagacctatttggaaaatttgggcccgcactttctgtgaaggtcatgacggacgaatccggtaaatcaaaaggattcggctttgtgagcttcgaacgacatgaagacgcccagaaggctgtagatgagatgaacggaaaggagctcaatggcaaacagatttatgtgggcagggcccagaagaaggtcgaacgacagactgaattgaagcgtaagttcgaacagatgaaacaggataggatcacacggtaccagggagttaacctgtatgtgaagaatctcgatgatggaatagacgatgagaggctgcgcaaggagttctcaccattcggaacaatcacctcagccaaggtgatgatggaaggcgggcggtcgaaaggttttgggtttgtgtgcttcagcagtccagaggaggcaactaaggccgtaactgagatgaatggcaggattgtggcaacaaaaccattgtacgttgcactggcgcagcgtaaagaggaaagacaagcccatctgacaaaccaatacatgcagcgcatggcttccgtgagggctgttcccaacccagtcattaatccctatcagcctgccccaccaagcggctactttatggccgccattccgcaaactcaaaatagagcagcctattatcccccctcacaaatcgctcagctgcgcccatcgccaagatggactgcccagggggctagaccccaccctgcagtacacgtccagggccaggaaccactgacggcaagcatgctggcgtcagctcctcctcaggagcaaaaacagatgttgggtgaacgcctcttccctctgatccaggccatgcacccgacactcgctggcaagatcacgggaatgcttttagagattgacaacagcgaattattgcacatgcttgagagccccgagagcctcagatcaaaagtggatgaagcagtcgccgttctacaagcacaccaggctaaagaggctgcccagaaagcagtgaacagcgccaccggcgtgcccacggtctag

SEQ ID NO: 16742 - DNA, 129 bp, Artificial Sequence
  Description of Artificial Sequence: Synthetic coding sequence
tagatgttagagtccccagagagcttgagatccaaggtagacgaagctgttgctgttctgcaggcccaccaagccaaggaagcagcacagaaagctgtcaatagcgcaaccggtgtgcctacagtgtag

SEQ ID NO: 16743 - DNA, 117 bp, Artificial Sequence
  Description of Artificial Sequence: Synthetic coding sequence
atgaatccttccgccccatcttaccccatggccagcctctatgtcggcgatctgcatcctgatgtgacagaggctatgctgtacgaaaaattctcccccgctggcccgatcttatag

SEQ ID NO: 16744 - DNA, 357 bp, Artificial Sequence
  Description of Artificial Sequence: Synthetic coding sequence
atgaatccatctgcaccatcgtatcccatggcaagcctctatgtgggcgacctgcacccagacgtcactgaagccatgctttatgagaagttctcaccggctggccctattctttccattcgcgtgtgtagggatatgattacaaggcggagcttggggtatgcatatgtgaactttcaacaacccgcagacgcagagcgggccctggacactatgaactttgacgtcatcaagggcaaaccggtccgcataatgtggagccagagagaccctagtctccgcaaatctggggtcggtaatatatttatcaaaaatctcgacaagtcgatagataacaaagcactttatgatacatag

SEQ ID NO: 16745 - DNA, 132 bp, Artificial Sequence
  Description of Artificial Sequence: Synthetic coding sequence
atgaatccgtccgctccatcgtatcccatggcctccctgtacgtgggggatctgcacccggacgttaccgaagccatgttgtatgagaagttttcgccagctggcccgatattatctattcgtgtctgctag

SEQ ID NO: 16746 - DNA, 510 bp, Artificial Sequence
  Description of Artificial Sequence: Synthetic coding sequence
taggcgtcctctcaggtgccccgggtgatgtccactcagcgtgtagccaacacatctacacagacaatggggcctagacccgctgctgctgccgccgccgccactcccgcagtcaggactgtgccacagtacaaatacgccgcaggcgtacgcaacccgcagcagcatttgaacgcacaaccgcaggtgaccatgcagcagccggctgtgcacgtgcagggccaggaaccactgaccgccagcatgttagcatccgcccctccacaggagcaaaaacagatgctcggtgaacgcctcttcccgctcatccaggcgatgcatccaacactggccggaaaaatcactggaatgctcctggagatagataattcggagctgctgcatatgctggagtccccggaaagcctgagaagcaaggtagatgaagcagtcgctgtattacaagcacatcaggcaaaagaagccgcccagaaagcagtcaatagcgcaactggggttccgactgtctag

SEQ ID NO: 16747 - DNA, 186 bp, Artificial Sequence
  Description of Artificial Sequence: Synthetic coding sequence
atgaacccgtccgcaccaagttaccccatggcttccctgtatgtaggcgatctgcatcccgatgtgaccgaggccatgctgtatgagaagttttccccagcgggacccatcctctctatcagggtgtgtcgagacatgatcacccgcaggagtctaggttacgcatacgtcaattttcaacagtag

SEQ ID NO: 16748 - DNA, 390 bp, Artificial Sequence
  Description of Artificial Sequence: Synthetic coding sequence
atgaacccaagcgcaccttcatatcctatggcttctctgtacgtgggtgaccttcacccagacgtgaccgaggccatgttgtacgagaaatttagtccggcgggtcccatcttgagtatacgtgtgtgccgcgatatgattacacgcagaagcctgggctatgcatacgtaaattttcagcaaccagcagacgccgagcgcgctctggacacaatgaacttcgatgtgattaaaggaaagccggttagaattatgtggtcccagcgggaccctagcttacgcaagtccggagtgggcaatatatttatcaaaaatctggataagtctattgacaataaagctctctacgatacgttttccgcattcggaaatattctcagctgtaaatag

SEQ ID NO: 16749 - DNA, 552 bp, Artificial Sequence
  Description of Artificial Sequence: Synthetic coding sequence
atcagacccgctgcacctcgcccacccttctctaccatgagaccagcatccagccaggtgccccgagtaatgagcacacaaagagttgcgaatactagcactcaaaccatgggacctaggcccgcggctgctgctgccgctgccacaccggccgttcggaccgttccacaatacaaatacgctgccggagttagaaacccccagcagcatctgaatgcgcaacctcaggtgaccatgcaacaacctgcagttcacgtccagggccaagaaccattgaccgcatctatgcttgccagcgctccaccacaggaacaaaagcagatgttgggcgagaggctgttccccctgattcaggctatgcaccccactctggcaggcaagataacaggaatgctgctcgagatcgacaactcagagcttctccatatgttagaaagccccgaatctcttcggagcaaagtcgacgaagcggtcgccgtgcttcaggcccaccaggccaaagaggccgctcagaaagccgtcaacagcgcaactggcgtgcctaccgtgtag

SEQ ID NO: 16750 - DNA, 228 bp, Artificial Sequence
  Description of Artificial Sequence: Synthetic coding sequence
atgaacccctctgcacctagttatcccatggcttccctgtatgtgggcgacctgcacccagatgtgacagaggctatgctatacgagaagtttagcccggccggcccaatcctgtcaatcagagtatgcagggacatgatcactaggcgtagcctcggatacgcttacgtaaatttccaacagcccgccgatgctgagagggccctcgataccatgaactttgattag

SEQ ID NO: 16751 - DNA, 1008 bp, Artificial Sequence
  Description of Artificial Sequence: Synthetic coding sequence
atgagcaaacggaaggccccacaggaaaccctgaacgggggtattaccgatatgctgaccgagctagccaattttgagaaaaacgtgtcacaggccattcacaagtacaacgcttatagaaaggcggcttctgtgatagccaagtaccctcacaaaatcaagtccggtgctgaggcaaagaaacttccaggtgttggcaccaaaatcgctgagaaaattgacgaatttctggctaccggtaaacttcgaaagctggagaaaataaggcaggacgatacaagtagctcaatcaacttcctcactcgagtgagcggcatcgggccctcagccgcccgcaagttcgtggacgaaggtataaagaccctggaggatctccggaagaacgaggacaagctcaatcatcatcagcggattgggctcaaatatttcggcgacttcgagaagagaatcccaagggaggagatgcttcaaatgcaggatatcgtactgaacgaagtcaagaaagtcgacagtgaatacatcgctaccgtgtgcggaagcttccggcgtggtgccgagtccagcggggatatggacgtcctgctaacccaccccagtttcacgagtgagagcactaagcagcccaagctgcttcatcaggtggtggaacagctccagaaagtgcattttattactgacacccttagtaaaggtgaaaccaaatttatgggcgtatgccaactacctagtaagaacgacgaaaaggaatacccgcacaggcgcattgatattagactgatcccgaaagaccagtactactgcggggtactgtactttactggaagcgatattttcaataaaaatatgcgggcccacgccctggaaaaggggttcaccatcaacgagtataccattagacctttgggagtgaccggagtggccggggagccactcccagtcgactcggagaaggacattttcgattatatccagtggaaataccgcgaaccgaaggatcgcagtgagtag

SEQ ID NO: 16752 - DNA, 720 bp, Artificial Sequence
  Description of Artificial Sequence: Synthetic coding sequence
tgaggggactttgagaagcgcattccccgcgaggagatgctgcagatgcaagacattgtgcttaacgaagttaaaaaggttgacagtgagtacatcgctacagtttgtggtagcttcagaagaggcgcagagagctccggcgatatggatgtcttgctcacccacccaagttttacctctgaatctactaaacagccgaagttgctgcatcaagtcgtagagcagctgcaaaaagttcatttcataaccgacacattatccaagggggaaacgaagtttatgggcgtctgccagctcccatctaagaatgatgagaaggagtacccccaccgtaggatcgatataaggctgatccccaaagatcagtactactgtggcgtgttgtattttactggctccgatatatttaacaaaaatatgcgagcccacgcattagaaaaaggctttactatcaacgagtatacaatacgtccattaggcgttactgtcctccaggccacccgcgaggacctgatgcacaatatgctgttagggccacagctaaaggcgatcaaagaattgcaggagaatccttgccagtggatcgtgaagaagacaagtctcatcactagcagtggcaatacgggaaaccccaggactggtgctaacgaggcatgtatcctacccggaaggcacaatcctatcggcgtcctgatatattttctgacttttgcaatgtag

SEQ ID NO: 16753 - DNA, 843 bp, Artificial Sequence
  Description of Artificial Sequence: Synthetic coding sequence
atgtcgaagcggaaagctcctcaagagacactcaacggaggaattaccgacatgctgacagaacttgccaatttcgagaagaacgtgtcccaggcaatccacaaatataacgcttaccggaaggccgccagcgtcattgccaagtatccacacaaaattaagtctggggcggaagctaagaagcttccaggtgtggggaccaaaatcgcggaaaaaatcgacgaatttctcgctaccggcaaactcaggaagttggaaaagatcaggcaggacgacacctcctcctccattaattttctgaccagggtgtccgggatcgggccctctgcagccagaaaattcgtggatgaaggaataaagaccctggaaggttcccagcttgatagctgccctgtcaagggccacctgaatggcactgagtcccttctggatctgatctgggacgtgatgacaattctgaaacttaaaaatgctgatcttcgcaaaaatgaggacaagctgaatcaccatcaaagaattggcttaaagtacttcggagactttgagaagcgtatcccacgggaagagatgctgcagatgcaggatatagttctgaatgaggtgaagaaggtggacagcgaatacatcgcgaccgtgtgtggctcattcaggagaggcgccgagtcatcgggggacatggatgtccttttgactcatcccagttttacctcagagtcgaccaaacagcctaaactccttcaccaggttgtggagcagctgcagaaagtacacttcataacggacactttaagcaaaggcgagactaagtttatgggggtgtgtcagctccccagcaagaactag

SEQ ID NO: 16754 - DNA, 714 bp, Artificial Sequence
  Description of Artificial Sequence: Synthetic coding sequence
taggagaagattgacgagttcctcgccacagggaagttgcgtaaacttgaaaagattaggcaggacgatacctcttccagcatcaatttcctaacaagggtctccggtatcgggccatcggccgcacggaaatttgtcgatgaaggcatcaaaactttggaagacctacggaagaacgaagacaaactcaaccatcaccaacgcatcgggttaaaatacttcggagacttcgagaaaagaattcctagagaggagatgcttcaaatgcaagacatcgtgctgaatgaggtgaaaaaggtggacagcgagtacattgctacggtttgtggaagcttccgccgcggggccgagtcaagcggggatatggatgtgctgttgactcacccgtcatttacgtcagagagtaccaaacaaggggtctgccagctgccttctaaaaacgacgaaaaggaatatccccaccggcggattgatatacggttgatcccaaaagatcagtactactgcggcgtcctctatttcactgggtccgatatcttcaacaagaacatgagagcccacgctctggagaaaggcttcactatcaacgagtataccattagacctctgggagtgacgggggttgccggagagcccctcccagtagatagtgagaaggacatctttgattatatccagtggaagtatcgagagcctaaggatcgtagcgaatag

SEQ ID NO: 16755 - DNA, 546 bp, Artificial Sequence
  Description of Artificial Sequence: Synthetic coding sequence
atgctccaaatgcaggatattgtgctcaacgaggtcaaaaaggtagatagcgaatacatcgccacagtttgtggctcattccgacgaggcgcggaatcatctggcgatatggatgtgctcctgactcacccatcgttcacctcagagtccaccaaacagccaaaactcctccatcaggttgtggagcagctccaaaaggtccatttcatcactgacactctgagtaaaggagagacaaaattcatgggggtgtgtcagctgcccagcaagaatgatgagaaagaatatccccatcgacgcatcgacatacgactgatcccaaaggaccaatattattgtggagtgctctactttacaggttccgacattttcaacaagaacatgcgcgcgcatgcccttgaaaagggattcacaatcaatgagtataccattcggccacttggagtcacaggcgtggcgggcgaacccttaccggtagactctgaaaaggacatattcgactacatccagtggaagtacagagagcccaaagaccgcagcgagtag

SEQ ID NO: 16756 - DNA, 1728 bp, Artificial Sequence
  Description of Artificial Sequence: Synthetic coding sequence
atggatccccgcggaattctaaaagcttttcctaaaagacagaaaattcacgccgacgcctccagcaaggtcctggctaaaatccctagaagggaggagggtgaagaggccgaggaatggctctcctcactgcgagcccacgttgttcggactggtattggccgtgcgagagcagaactgttcgagaagcaaatcgttcaacacggcggccaactgtgccccgcccaaggcccaggcgtgacccacatagtggtcgacgaaggaatggattacgagagagccttgcgcttgctgcggctgccccaactgcctcccggcgcccagctggtgaaaagtgcatggctgagtctgtgtttacaggagcgtagattagttgacgtagccggcttttccatttttatcccttcgcggtacctggaccatccacaaccttcaaaagccgagcaggatgcctccattcctcccggcactcatgaagcacttttgcagacagcactttcaccacctccacctccgacccgtcctgttagccctccccaaaaagcgaaggaggcgcccaacacacaggcgcagcctatcagtgacgatgaggcctctgacggcgaagagacacaagtgagtgctgctgatctcgaggccttgatcagtggacattaccctaccagcctcgagggagattgcgaaccgagtcccgctcccgctgtactggacaagtgggtgtgtgcccaaccgtcatcccaaaaagccaccaatcataacttacatatcacagagaagctggaggttctggctaaggcttacagcgttcaaggtgacaagtggagggctttgggttatgctaaagccataaatgcccttaagagtttccataagccagtgacttcataccaggaagcttgttctatacctggaattggaaaaaggatggctgagaagatcatcgaaatcctggaaagcggccatctccggaagttggaccacatctccgagtccgtcccggtgttggaactgttttctaatatctggggtgctggcacgaaaaccgcgcagatgtggtaccaacagggctttaggagcttggaagacatacggtcccaggccagtcttactactcaacaggcaattggtttgaaacattactctgacttcctggagcgcatgccccgcgaggaggccaccgagattgaacagacggtgcagaaagccgcacaggcctttaattccgggctgctttgcgtggcttgcgggagttatagacgaggcaaggcaacgtgcggcgacgtggatgtcctgattactcatcctgacggcaggtcgcatagaggaatcttttctcggctcctcgattctttacgccaggaaggctttctgaccgatgatctggtgtcacaagaagaaaatggccagcagcagaaatatttgggtgtctgccggctgcccgggcccggtaggagacaccggcggctggacataattgtggtgccttactctgagttcgcttgcgctctgctgtatttcaccggcagtgcccacttcaatagaagcatgagggccctggctaagaccaagggaatgtcattatcagaacatgccctgtccacagctgtcgtgcggaatacgcacggatgcaaagttgggccagggagagtgctccccacacctacggagaaagatgtattccgcctgcttggcctgccatatcgcgagccggctgaaagggattggtag

SEQ ID NO: 16757 - DNA, 897 bp, Artificial Sequence
  Description of Artificial Sequence: Synthetic coding sequence
atgcaccatcagaaatatctacagaggttcctcgggggcaagagggaaaagaagcaaaaagaggcttgcagcatcccgggcattgggaagagaatggccgaaaaaataatcgagattttggaatctgggcatctcagaaagctggatcacatttcagagtccgtccccgtgctggaactgtttagtaacatctggggggctggtaccaagacagcccagatgtggtatcagcagggtttcagatccctcgaggatataagatctcaggccagtctgactactcagcaggccattggcttgaaacactactctgatttcctcgagcggatgccgcgcgaagaggccaccgagatcgagcagaccgtccagaaagcggcccaggcattcaactcaggcctcctgtgtgttgcctgtggtagttatcggaggggcaaggctacctgcggcgacgtcgacgtcctgatcacgcacccagatggccgctcacatagaggaattttttctagactgctggattccctgcggcaggaaggcttcttgacagatgacctggtatcccaagaggaaaacgggcagcagcagaagtatctgggggtgtgtcgactgccgggccctggaaggaggcaccgacgcctggacattatagtggttccgtatagcgaattcgcttgtgccctgctctactttaccggatccgcacacttcaaccgatctatgagggctttagcaaaaacgaaaggcatgtcactgtcggaacacgcgctatctaccgccgtggtgagaaatacacatgggtgcaaggtcggacccggccgggtactccctacgcccacagagaaggatgtctttaggctgctgggactcccttatcgcgaacccgcagagagagattggtag

SEQ ID NO: 16758 - DNA, 1548 bp, Artificial Sequence
  Description of Artificial Sequence: Synthetic coding sequence
atggatcctcgaggcatactgaaggccttccccaaacgccagaagattcatgcagacgcttcctcaaaggtgctggccaagattcctcggagggaggagggcgaggaggctgaggaatggttgagtagcctgcgcgcccatgtggttcggaccggaataggacgagccagagccgaactctttgaaaagcagatcgtgcagcatggaggccagctgtgccctgcccagggacccggagtcacccacattgtcgttgatgaggggatggactatgagcgagccttacgcctgttacgtttgccgcagctccctcccggcgcacagctggtgaagtccgcttggctctccctatgtcttcaagaacgccgccttgtcgatgtggctggtttttctattttcatccctagtcgttatttagatcacccacagcctagtaaagccgagcaagacgcctccatcccgcctggcacccacgaagccctacttcagacagccttgagtccgccaccccccccaaccagacccgtgtcccctcctcagaaagccaaagaggcaccaaatacacaggcccaacctatttccgatgatgaggctagtgatggagaagaaacacaagtgtctgccgccgacctagaagcactgatatcgggacactacccgactagtctggaaggtgactgtgaaccatcccccgcgccggcagtacttgacaagtgggtgtgtgcacagcccagctcgcagaaagcgacaaaccacaaccttcatattaccgagaagctggaagtcctggccaaagcgtatagtgttcagggagataaatggcgagcactcggatacgctaaagcaataaatgccctcaaaagctttcataagcccgtgacatcgtaccaggaggcttgctcgatcccaggcatcgggaaacgtatggcagaaaagataattgagatccttgaatctgggcacctcaggaaactagatcacatcagtgagtccgtcccagtgcttgaactatttagtaatatttggggggcaggcacgaagactgcccagatgtggtaccagcagggatttcgttcgctggaggatatccggtcccaggctagccttacaacccagcaggcaattggcttgaagcattattccgacttcctagagcgcatgccgagagaggaggccacggaaatcgagcagacggtccagaaggcggcccaggcatttaactcaggactgttatgcgtcgcctgtggatcctataggcgaggaaaggcgacatgcggggacgtggacgtcttgataacccacccagacggcagatcacaccgtggcattttctcaagactccttgacagtttgaggcaggaagggttcctgaccgacgacctggtgtctcaagaggagaatgggcaacaacagaaatatctcggcgtatgtcggctcccaggaccaggccggaggcatcgcaggctcgatattatcgtggtcccatactctgagtttgcttgcgccttgcaaggaggagcctggcccagcgctgcacattctcattag

SEQ ID NO: 16759 - DNA, 903 bp, Artificial Sequence
  Description of Artificial Sequence: Synthetic coding sequence
atgctgatgcatcaccaaaagtacttgcagagattcctgggaggcaaaagggagaaaaaacagaaggaggcttgctccatcccaggtattgggaaacgcatggcagagaagatcatagagattttggagtcgggccaccttaggaagctggaccatatcagtgaatcagtgccagtgctcgaactgtttagcaatatatggggcgccggaacgaaaactgcacaaatgtggtaccaacagggctttcggtccctggaagatatccgctctcaggcatctttgactacacagcaggccattggtctgaagcattactctgatttcctagaacgaatgcctcgcgaagaggcgactgagatcgaacaaactgtacagaaggccgcccaggcgttcaacagtgggctgctgtgcgtggcatgtggctcataccgccgaggcaaggccacctgcggcgatgtcgacgtcctgattacacaccctgatggtcgctctcaccgaggtatcttttctcgactcttagattctctgagacaagagggttttcttaccgacgacttggtcagccaggaggaaaacggacaacaacagaaatacctcggcgtctgcagactccctggccctgggcgccggcatcgaagactcgacattatagtggtgccatattcagaatttgcctgcgctctgttgtatttcacaggatctgcacattttaacagaagtatgcgggcactcgccaaaaccaaaggtatgagtcttagcgaacacgctctgtccaccgccgtggtgagaaacacccacggatgtaaggtcggtcccggcagggtgcttccaacacctacagagaaggatgtgttcaggctcctgggactgccttatcgggaacctgcggagcgagattggtag

SEQ ID NO: 16760 - DNA, 1728 bp, Artificial Sequence
  Description of Artificial Sequence: Synthetic coding sequence
atggatcccaggggcatcttaaaggcattccctaagagacagaagatccacgccgacgcgtcttctaaagtattggccaagataccaagacgagaagaaggggaggaagccgaggagtggttgtcaagcttgcgcgctcacgtagtacgcacggggatcggaagagcccgggcagagcttttcgagaaacagattgtgcagcatggcggtcagctctgtccggcccagggcccaggcgtgacgcacatcgttgtggacgagggcatggattacgaacgcgccttacgtctcctgcggctccctcagctgccacccggcgctcagctggtgaagagtgcttggctgtccctctgcctgcaggaaaggcgcctagttgacgtggctggctttagtatctttatccccagtcgttatctggatcaccctcagccctctaaggccgaacaggatgcgtcaatcccacctgggacacacgaagcgctcctccagacggcactgtctcctccgccccctcctactaggcctgtgtcccctccgcagaaggcaaaggaggcaccaaatacccaggctcagcccatcagcgacgatgaagcaagcgacggggaggaaacacaggtgagtgccgcagatctcgaagcccttatcagcgggcactacccaacatcactggaaggtgattgtgaaccttcccccgctccagcagtgctggacaagtgggtttgtgcacagccttcaagccagaaggcaactaatcacaacttacatataactgaaaaactggaggtgttagctaaggcttacagcgtgcagggcgataagtggcgggcccttgggtacgctaaggccataaacgctctcaagtcttttcataagcctgttacttcttaccaggaggcatgttctattcccgggattggcaaaaggatggccgaaaagattatcgaaattctggagagtggacacctgcgcaagctggaccatattagcgaatcggttccagtgctcgagctcttctctaacatctggggagcaggcacaaaaacagcccaaatgtggtatcagcagggctttagaagcctcgaagacatccgaagtcaggcctccttaactactcaacaagcaatcggtctgaagcactacagtgattttctcgaacggatgcctagagaagaagccactgagattgaacagacagtccagaaagctgcacaggcattcaatagtggattactttgtgtcgcctgcggaagttacaggagggggaaggcaacgtgcggagatgtggacgtcctgataacgcacccagatggccggtcccacaggggaatcttcagcagactcctggattcccttcgtcaagagggctttctgactgacgaccttgtgagtcaggaggaaaacgggcagcaacaaaaatatcttggggtgtgtcgcttgccgggccccggtcggcggcacaggagactggatattatcgttgtcccttactccgagtttgcctgtgctctgctgtacttcactgggtcagcacatttcaaccggtccatgcgagcattagccaagacgaaagggatgtccctcagcgagcacgccctgtcaaccgcagtggtgagaaacactcatggctgtaaggttggtcccgggagagtcctgcctaccccaaccgagaaggacgtgtttcggctgcttggattgccctatagagaacccgcggagcgtgactggtag

SEQ ID NO: 16761 - DNA, 516 bp, Artificial Sequence
  Description of Artificial Sequence: Synthetic coding sequence
atggattacgagagagcactgagactgttgcgacttccacagcttccgcccggcgctcaattggtgaagtctgcctggctttcactctgtctgcaagaaaggagactggtggacgttgccggattctcaatattcatcccttccagcccaagcctgatgatgaaacctgtgatgggtaagaaaccccgtctagtccagctgatctggaagccttcttctgtggccaccacccctcccccgctgagagaaatagtctccctggcgcagccactgctttcttggatctccggaagcgtgcattctccacaggcacggagaagacccatcacaacttctatctctcagagatcctggaaattttggcctaagcctaccgtgttccgcgagacgtcggggggcccatgggcaatgccacgtcccagtatgccctctcgtgcctctatcagtctctccccgcggactagacggcccgcagtgtccctgggcctgggctccggatggctgaggaagtcctag

SEQ ID NO: 16762 - DNA, 747 bp, Artificial Sequence
  Description of Artificial Sequence: Synthetic coding sequence
atggaagcactctgtgtttgctctctaatgcccctacactggtcctggatactcaccgcatcccatctcgccgccttctttcagggttttcgttcacttgaagatatcagatctcaggcctccctgaccacacagcaggccattgggcttaaacattattccgatttcctcgagaggatgcccagggaggaagccacggaaatcgagcaaaccgttcagaaggccgcccaggcctttaactccgggctgttgtgtgtcgcttgcgggtcctatcgcaggggcaaggccacctgcggagatgttgacgtgctgatcacacacccagacggccggtcacacagggggattttcagcaggctgctggattcgctgcgccaggagggcttcctgacagacgacctggtgtctcaggaagagaacggacagcagcaaaagtacttgggtgtgtgtcgcctccccgggccaggaagacgccaccggcggctagatataatcgtcgttccctactcggagtttgcctgtgctctgctgtactttaccgggtctgcccactttaaccgctcgatgcgcgccctagccaaaactaagggtatgagcctctccgagcacgcgcttagcacggctgtcgtccgaaatacccatggatgcaaggtggggcccgggcgagtactgcccacccctaccgaaaaagacgtcttcaggctactgggactaccctatcgcgagcctgccgaaagagactggtag

SEQ ID NO: 16763 - DNA, 1728 bp, Artificial Sequence
  Description of Artificial Sequence: Synthetic coding sequence
atggaccctagggggatcctcaaagcgtttccaaagagacagaagatacacgctgatgcttcaagtaaagtccttgcgaaaatcccacgtcgagaagagggagaggaagctgaggagtggctatccagcctgcgagcccatgttgtgaggaccggcattggcagggccagagctgagttattcgaaaagcagatcgttcagcacggtggccaactctgtcctgctcagggacccggagtgactcacatagtcgttgacgaaggcatggactacgaaagggccctgagactcctccggctgcctcagctcccacctggtgctcaattagtgaagtctgcatggctaagcttgtgtttacaagaacgaagattggtggacgtggcgggatttagcattttcataccttccagatacctcgatcacccccagccctcaaaggcggaacaggatgccagtataccacccgggacacacgaagctcttctgcagactgccctgagcccacctcctcctcctacccggccggtgtcccctccccagaaggctaaagaggcaccgaatacccaggcacagcctatcagcgatgatgaggcctcagacggcgaggaaacgcaggtgtccgccgccgacctggaggctctgattagcggacattaccctacaagcctcgaaggagattgtgagcccagcccagctccggctgttcttgataagtgggtctgcgcccagccatcctctcagaaggctaccaaccataacttacacatcacagaaaagttagaggtcctggctaaggcctattccgtacagggggataagtggcgagcactgggctacgctaaggccattaatgctctgaagtcgtttcacaagcccgtcaccagttaccaagaggcctgttctatcccgggtatcggcaaacgaatggcggagaaaattattgaaattttagaaagcggacatctgcgcaaacttgatcatatttcggagtctgtacccgtcctcgagctgttttcaaatatctggggtgccggcacaaaaaccgcccaaatgtggtatcagcagggctttcggagtctggaggacattaggtcacaagcgagcctcacgactcaacaagcaattggtttgaagcactattcagatttcttagaacggatgcccagagaggaggccacagagatcgagcagacagtgcagaaggcggcccaggcttttaattcaggcctcctgtgcgttgcatgcggctcttatcgcaggggcaaagctacctgcggagacgtggatgtgcttatcacccacccagacggccgcagtcataggggcattttctcccgcttgctggatagcctgcggcaagaggggtttctgacggatgacctcgtcagtcaggaagagaacggacagcagcagaagtaccttggtgtgtgccgactccccggacccggccggaggcacaggagactcgacattatcgtggtgccctactcagagttcgcgtgtgccctgctgtactttaccggttctgcgcattttaacaggagtatgcgggcccttgccaagaccaagggtatgagcctctctgaacacgccttatcaacggccgtagtaagaaatacacacgggtgcaaagtgggccccggacgcgtgttgcccacgcccacagagaaggatgtcttccgcctgctggggctcccttatagggagcctgccgaaagggattggtag

SEQ ID NO: 16764 - DNA, 1464 bp, Artificial Sequence
  Description of Artificial Sequence: Synthetic coding sequence
atggattacgagcgagccctcagactgttgcggctcccgcagttgcccccaggtgctcagctggtgaaatctgcttggctgtccctctgtctgcaggagaggcgcctggtagacgttgcgggcttttccatttttatcccttctcggtacctggatcaccctcaaccctctaaggccgaacaggacgcttcaataccacccgggactcatgaggcattgctgcagaccgctctctcccccccgcccccacccacccgtcccgtgagtccgccccagaaggcaaaagaagcgcctaacacccaagctcagcccatatcagatgacgaggccagtgacggcgaggagacacaggtaagtgctgccgacctggaagccctaatttctggtcactatcccaccagccttgaaggcgactgtgaaccatctcctgctcctgcggtgctcgacaaatgggtctgtgcacagccatcctctcagaaggccaccaatcacaacctccacatcactgaaaagctcgaggtactcgccaaggcttactccgttcagggtgacaaatggcgagccctgggatacgccaaagcgattaacgctttaaagtcatttcataaaccagtgacctcctatcaggaggcctgtagtatccctggcattggcaagaggatggctgaaaaaattatagagattctggagagtggacatctgcggaagctggatcatattagtgagtctgtgcccgtgctcgagttgttttcaaacatctggggcgcaggcactaaaactgcacaaatgtggtatcaacagggatttagatccctggaagacattcggagtcaggcaagtctgaccacccagcaggctattgggctgaagcactattccgattttctggaaagaatgcctcgcgaggaagccactgagattgagcagacagtgcagaaggctgcgcaggccttcaatagcggactactgtgtgttgcttgcgggagttaccgaagaggcaaggcaacctgtggcgatgttgatgttctcatcactcatccggatggtcggtctcaccgcggcatcttttcacggttattggactctctgcgccaagaagggtttctgacagatgaccttgtgtcccaagaggagaatggacagcagcaaaaatatctgggcgtctgccgcctaccgggacccggacgccgacatagaaggctcgatattattgtggtcccctactccgagtttgcctgcgctctcttatatttcacaggttccgcacattttaaccgttccatgagggctctcgctaagacaaaagggatgtccttgagcgaacatgccttgagcaccgcagtggtaaggaacactcacggctgtaaggtggggcccgggcgggttctacccacccctacagagaaagacgtgttccgcttgctcgggttaccctatcgtgaacccgccgagagggactggtag

SEQ ID NO: 16765 - DNA, 1548 bp, Artificial Sequence
  Description of Artificial Sequence: Synthetic coding sequence
atggatcccagaggtattctgaaggcctttccgaagcgccagaagatccatgccgacgccagttcgaaagttctcgccaagatccctagaagggaggaaggcgaagaagctgaagagtggttaagctcccttcgtgcacacgtcgtcaggaccggaatcggcagggcccgcgctgagctctttgaaaaacagatcgtccaacacgggggacagctctgccctgcacaggggcctggcgtcactcacatcgtggtagatgaggggatggactacgaaagggctttaaggctcttgagactaccccagctgcctccgggagctcagctggtcaagagcgcatggttgtccctgtgtctgcaggagaggagacttgtggacgtcgcgggtttctccattttcattccctctagatatctggaccaccctcagccatcaaaggccgagcaagacgcttctataccccctggtacgcacgaagccctactgcaaaccgccctgagccccccccctccgcccacaagacccgtgtcccctccccagaaggccaaggaggcccccaacacccaggcccagccaatctccgacgatgaagcatccgatggagaggaaacccaggtctccgccgccgacttggaggcccttataagcggccattaccccactagtttggagggtgactgcgagccgtcccctgcgcccgcagtgctggataaatgggtttgcgctcagccctctagccaaaaggccacaaatcacaatctccacatcactgaaaaactggaagttctggccaaagcctacagtgttcagggcgacaagtggcgcgccttgggttatgccaaggctattaacgccctcaagtctttccacaaacctgtcaccagttaccaagaggcatgttcgattcccgggattggaaagaggatggccgaaaaaatcatcgagatcctagaatcagggcatctgagaaaactggaccacatcagcgagtcagtgccagtgctggagttgttctccaacatatggggcgctggcaccaagactgcacaaatgtggtatcaacagggctttagaagcctggaggatatccgatcgcaggctagtcttacaacccagcaggcaatcggcttgaaacattattctgactttctggagcgcatgcccagagaggaggctacagaaatcgaacaaaccgtgcagaaggctgcgcaggcctttaattccggattactgtgtgtggcctgtggaagctaccgcagggggaaagccacgtgcggcgacgtggacgtgctaatcacccatcctgatggccggagtcatcgagggatcttctcaagactcctggactcattgcggcaagaaggctttttaactgatgatctggtgtcacaagaggagaatggtcaacagcagaagtacctgggcgtgtgtcgcctgcccggtccgggtcggcgacacaggcgcttggatattattgtcgtcccctactctgagttcgcatgtgctttgcagggaggggcctggccttcagcagctcacagccactag

SEQ ID NO: 16766 - DNA, 810 bp, Artificial Sequence
  Description of Artificial Sequence: Synthetic coding sequence
atggatccgcgtggcatcctgaaagcttttccgaagaggcagaagatccacgctgatgcatcaagcaaggtgttagccaaaatcccgcggagggaggagggcgaagaggctgaggaatggttgtcctccctccgggctcacgtggttaggaccgggatcgggcgggcccgcgccgagttgtttgagaaacaaatagtgcaacacggtggtcaactctgtcctgctcaaggcccaggggttacccacatcgtcgtggacgagggcatggattacgaaagagcattgagattgcttcgtctgccgcaattgccaccaggggcccagttggtgaaatccgcatggctgagcctctgcctacaggagcgccgacttgtcgatgttgctgggttcagcatctttatcccctcaaggtacctagaccatccccagccctccaaggccgagcaggacgctagcatcccaccaggaacgcacgaggccctgttgcaaacggctctctcccctcctcctccaccgacccgccctgtcagcccaccacaaaaggctaaggaggctccgaacacccaggctcagcctatttccgatgacgaggcgtctgatggggaagagacacaggtttccgccgctgacttggaagctctgataagtggccactaccccaccagcctggagggcgactgcgaaccatcccccgcccccgcagtcctggataaatgggtgtgtgctcagccgtcctctcagaaggccacaaaccataatttgcacataaccgaaaagctggaagtcttggccaaggcatattccgtttag

SEQ ID NO: 16767 - DNA, 1413 bp, Artificial Sequence
  Description of Artificial Sequence: Synthetic coding sequence
atggaccctcgaggcatactgaaggctttcccaaagcgccagaagattcatgctgatgcctcttctaaagtgctggccaaaatcccaagaagggaggagggcgaagaagcggaggagtggctgtccagtcttcgtgcccatgtcgtgagaactgggatcgggcgagcccgtgcagagctttttgagaagcaaattgttcagcacggaggtcagctgtgtcccgcgcagggccctggcgtcacccatatagtcgtggacgaggggatggactatgaaagggctctgcgtctgttgagattaccgcagctgccccccggcgcacagctggtgaagtccgcctggcttagtctgtgcttgcaagagcggcgactggtcgatgtagccggcttttctatctttattcccagccgctacctggaccatccccagccttctaaagcagagcaggatgcctccattcccccaggaactcacgaggctctcctgcagacagctctgtcgcctcctccaccaccgacgaggccggtatctccccctcagaaagcgaaagaagcccctaacactcaagctcagcctattagcgatgacgaggcctcagacggggaagaaacgcaggaggcctgtagtattcccggaatcggcaagaggatggccgagaagattatcgaaatcctagagtctgggcatcttaggaagctggaccatatcagcgaaagtgtgcccgtcctcgagctgttcagcaatatttggggagccggcacgaaaactgctcagatgtggtaccagcagggatttcgctcactggaggacatacgtagtcaggcctccttaactactcagcaggccataggattgaagcactatagcgactttttggagaggatgcccagagaggaagcgactgaaattgagcagaccgtacagaaagcggcccaagcattcaattcaggactcttgtgtgtggcttgtggtagctaccgcagaggaaaagccacttgcggagacgtggatgtattgattacacaccctgacggccgatctcaccgcgggattttctctaggctcctcgatagtctgcggcaggaggccgtgccttctgtgggccctggattcttgacggacgatcttgtgagtcaagaggaaaatgggcagcagcaaaaatatctgggagtttgtcgccttccgggacctggaaggcggcatcggcgtctggacataatcgtggtcccctacagcgagttcgcctgcgcgctattgtactttacaggctccgcccacttcaatcgctcgatgcgcgctctagccaagacaaagggaatgtccctttccgagcacgctctgagcacagcggtggtacggaatacccacggttgcaaagtcggaccaggaagggtattgcctacgccaacatag

SEQ ID NO: 16768 - DNA, 1005 bp, Artificial Sequence
  Description of Artificial Sequence: Synthetic coding sequence
atggatccaagaggcatactgaaggcgttccctaaaaggcaaaagatccatgcggacgcttctagcaagccctcttgcgcaagtgccctgcgctgtctatgcccagagtcagatatcggagccgacagcgcctgtccaggacctgccgaatggctgagcagtttgagagcacacgtcgttaggacaggcatcgggcgggccagggccgagctcttcgaaaaacaaattgtacaacatggaggccaactctgccctgcgcagggaccaggagtgactcacattgttgtggacgaagggatggattacgagagggctcttcggttactgcgcctgccccagcttccgcctggagcccaactagtgaaaagcgcctggttgtccctttgccttcaagaacgccggctcgtcgatgtcgctggcttttccatctttatcccatcaagatatctggaccatcctcagccctccaaagcagaacaggatgcatccatcccccccggtacgcatgaggcgctcctgcaaacagccctcagtccgcctccacctcccactcgaccagtttctcccccccagaaggcgaaggaggccccaaatactcaagcacaaccaatttctgatgatgaggcgtctgatggggaggaaacgcaggtctccgctgcagatctggaagccctcattagtggccattaccctaccagcttggagggcgactgcgagccttcacctgcgccagcagtactggacaaatgggtctgcgcgcagcccagttcccagaaggccacaaatcacaacctccacatcaccgagaagctggaggtgcttgcgaaggcgtatagtgtgcagggagataaatggagagccctgggatatgctaaagcaatcaacgcactcaagagctttcacaaacccgttactagctatcaagaggcgtgcagcattcccggcatcggcaagcgaatggccgagaagattatcgagatactggaatcaggtcatctccgctag

SEQ ID NO: 16769 - DNA, 657 bp, Artificial Sequence
  Description of Artificial Sequence: Synthetic coding sequence
atgcaccatcagaagtacctgcaacggtttcttggtggaaagagggaaaagaagcagaaggaagcatgtagcattccaggaattggaaagcgtatggcggagaaaattatcgagatactggaatctgggcatctgaggaagcttgaccatatatcagagagtgtcccagtgctggaattgttctccaacatctggggagctgggaccaaaaccgctcagatgtggtaccaacaaggcttccggtccctggaggacatccgttcgcaggcaagcctgacaacacagcaggccatcggacttaaacattattctgattttctggaacgcatgcctagggaggaggccaccgagatcgaacagacagtccagaaagccgcccaggccttcaacagcgggctgttgtgtgtggcctgcggttcctacaggagaggaaaggctacctgcggggacgtggacgtgttgattacacaccccgacggtcgctcccaccgtggtatcttttccagacttttggatagcttacggcaggaaggattcctgactgatgacctggtcagtcaggaggagaacgggcaacagcaaaagtacttgggggtgtgtaggctgcccggtccgggtcggagacatagacggctggatattatcgtggtgccctag

SEQ ID NO: 16770 - DNA, 567 bp, Artificial Sequence
  Description of Artificial Sequence: Synthetic coding sequence
atggacccacgagggattctgaaggcgtttccaaagcgacagaaaattcacgccgatgctagctcaaaagtcctggccaagatccccaggagggaggagggggaggaagctgaggagtggctgtcttctctgagagctcacgtggttaggacaggcatcggacgcgcgcgggcggagctcttcgagaagcagatcgtgcaacacgggggccaactttgtcccgctcaaggacctggggtgacgcacatcgtagtggatgaaggcatggactatgagagggccctgcgcctgcttcgactgccccagctcccgccaggagcccagctggtgaaatcagcttggctgagcctttgtctgcaggagcgccgactggtggatgtggcagggttctccatttttatacctagccgctatctcgatcacccgcagccctcgaaggcagaacaggacgcttccattcctcctggcacgcatgaggccttgctccaaacagccctctctcctccgccgcctcccacaaggccagtttcccccccccagaaagcaaaggaagcacccaatacatag

SEQ ID NO: 16771 - DNA, 516 bp, Artificial Sequence
  Description of Artificial Sequence: Synthetic coding sequence
atggactacgagagggctctgaggctgctgcggttaccccagctaccgcctggcgctcagctggtgaaatctgcctggctgagcttgtgccttcaggagcgacgtctggtagacgttgcggggttcagcatctttatcccgtcttctccaagtctgatgatgaaaccagtgatggggaagaaaccccgtttagtgcagctaatctggaaaccatcctcagtagccaccacacccccccccctgagggagatcgtgagtctggcccagccacttctgagttggatatctgggtccgtgcacagcccccaggcgcgtaggcggcctattacaacaagcatttcacagcgttcatggaagttttggcctaagccaactgtatttcgtgagacatccggtggcccttgggcaatgccccggccatcaatgcctagtcgcgcctctattagcctttcaccgaggacgaggcgtccagccgtctctttgggactgggctctggatggttgagaaaatcttag

SEQ ID NO: 16772 - DNA, 459 bp, Artificial Sequence
  Description of Artificial Sequence: Synthetic coding sequence
atggattatgaaagggccctcagactgttgcgcctgccacagctcccccctggagctcagttagtgaagagtgcctggctgtccctttgtctgcaggaaagacgcctcgtggatgtggcaggatttagcatcttcatcccttcatcccccagcctcatgatgaagcctgtgatgggcaaaaaaccgcgtttggtgcagctcatttggaagccttcatctgtggctaccacacctccgcctttacgtgagatcgtctcactggcccagccactgctttcctggatctcaggtagtgtgcactccccccaggctagacggcgaccgatcactacatctatctcgcagcgaagctggaagttctggcctaaacccacagtgtttcgagaaacctccgggggaccctgggcaatgccacggccctcaatgccatctcgggcctcaatctcgctcagcccctag

SEQ ID NO: 16773 - DNA, 939 bp, Artificial Sequence
  Description of Artificial Sequence: Synthetic coding sequence
atgcaccatcagaaatacctccaaaggtttcttggggggaagcgagagaagaagcagaagcctatcagtgacgacgaggctagcgacggggaggagactcaggaggcctgcagtattccaggcattggaaaaagaatggccgaaaagattattgagatcctggagtctgggcaccttcgcaaactggaccatatcagcgaatcagtgccagtacttgaactcttcagcaacatctggggggctggtacgaaaaccgcgcagatgtggtatcagcagggttttagaagcctcgaggacattcgaagtcaggcgtcactgactacacagcaggctattggcctgaagcattacagcgacttcttagagcgcatgcctcgtgaagaggcgaccgagatcgagcagactgtccaaaaagcagctcaagcattcaacagcgggctcttgtgcgttgcctgcggcagttatagacggggtaaggctacatgcggggatgttgacgttttgatcacacaccccgatggaagaagccatcgtgggattttttcccgcctgcttgatagcctgaggcaagagggtttcttgacggatgatctcgtaagtcaagaagagaatgggcagcaacaaaagtatcttggggtctgtcgcttaccgggccctgggcgacgacaccgccggctggatattatagtggtaccctacagcgagtttgcctgtgcgctgctgtacttcacgggctccgcgcactttaaccgatctatgagagctctggctaaaacaaaaggcatgtccctgtcagagcatgctctcagcaccgccgttgttcgcaatacccacgggtgcaaggtaggtccagggagagttcttcccacaccaacagagaaagatgttttccgactgttgggtttgccttacagagagccagcagagagggactggtag

SEQ ID NO: 16774 - DNA, 1401 bp, Artificial Sequence
  Description of Artificial Sequence: Synthetic coding sequence
atggctgaccagctctacttagaaaatatcgacgaattcgtaaccgatcagaataagatcgtcacctacaagtggctgtcatacacactcggggtacatgtgaatcaagccaagcagatgctctacgactatgtagaaaggaagagaaaagagaattctggcgcccaactccacgtgacctatctcgttagcggatcactcattcagaacggacatagttgtcataaagtcgctgtagtccgagaggacaaactggaggccgttaagtccaaattagcggtgacagcctcaattcacgtctattctattcaaaaggccatgttaaaagattctggacctctctttaatacggattatgacattctgaagtccaacctacagaattgctctaagttcagcgctatacagtgtgcggccgccgtcccccgagctcccgctgaatcaagcagttcctccaagaagtttgagcagtctcacttgcacatgagctctgagacccaagctaacaacgagttaactacgaacggccatggaccaccagcatccaagcaggtgtctcagcaacctaagggtataatgggaatgttcgccagtaaagccgctgctaaaacccaggagaccaacaaggaaaccaagacagaggccaaagaagtgacgaacgcctctgccgctgggaataaggcacctggtaagggaaacatgatgagcaatttcttcggaaaagccgctatgaataagttcaaggtgaacctggacagcgagcaggcagtcaaggaggagaagattgtcgagcaaccaaccgtgagcgtgactgagcctaaactagccacccccgctggtctgaagaaaagctccaaaaaggcagaaccagtgaaggtgttacagaaagaaaaaaaaagaggaaagagagtagctctgagcgacgatgaaacaaaagaaactgagaatatgcgtaaaaaaaggcgtaggataaagctgcccgagagtgattcatcagaagacgaagtgtttcctgactccccgggtgcctacgaggcagagagcccgtctcccccccccccaccgtctcctcctctggagccggtacccaaaacagagccagagccaccatctgtaaagagttcttccggcgaaaataagcgaaagagaaagagggtgctcaagtcaaagacgtatctggatggcgaggggtgcatcgtcaccgagaaggtgtacgagtctgaaagctgcacggatagcgaggaagaactaaacatgaagacatccagcgtccataggcctcctgcgatgaccgttaagaaggaaccgagagaggaaagaaaaggacctaagaagggaacagctgccctgggcaaagccaacagacaggtctcaattaccggcttttttcaacgtaagtag

SEQ ID NO: 16775 - DNA, 1284 bp, Artificial Sequence
  Description of Artificial Sequence: Synthetic coding sequence
atgctctacgactatgtggagaggaaaaggaaagaaaactccggtgctcagctgcatgtgacatatctcgtatctgggtcccttattcagaatggccactcatgccacaaagtggccgtcgtccgggaagacaagttggaagccgtcaaatctaaactcgccgtgaccgcaagcatccatgtctattcaatccagaaagccatgctcaaagatagtggacctttgtttaataccgactacgacatccttaagagtaatttgcagaattgctctaagttttcagcaattcaatgcgccgctgcggttcccagagcacccgctgaaagctctagctcctcgaagaagttcgaacaatcacacttacacatgtcttccgaaacacaggccaacaatgagttgacaaccaacgggcacggccccccggctagtaagcaggtgagtcagcagcccaaagggattatgggtatgtttgcaagcaaggccgcagccaaaacgcaagagacgaataaggaaaccaaaaccgaagctaaggaagtgactaacgcaagtgccgccggtaacaaggcaccaggaaaggggaacatgatgtctaacttttttggaaaggcagccatgaacaaattcaaagtaaatctggacagtgagcaggctgtgaaggaagagaagatcgtggaacagccaacagtgtcagtaaccgagcctaaacttgcaaccccagcaggattgaagaagtcctccaagaaggcagaaccagtcaaagtcttacagaaggaaaagaagcgaggtaaacgtgtggcactgagtgacgatgagaccaaagagacggagaacatgaggaagaaacgacgccgcatcaagctccctgaatccgattctagcgaggatgaagtgttccctgacagtcctggagcctacgaggccgagtcccccagcccccctcctcccccgagcccgcccctggagcctgtgcccaaaacagagccggaacccccaagcgttaagtctagctccggggagaataagcggaagcgcaagcgcgttctgaaatcaaagacatacctcgacggcgaaggctgtatagtgacagagaaagtgtacgagagcgagtcctgcacagattcagaagaggagctgaacatgaaaacgtccagcgtgcaccgccctccagctatgaccgtcaagaaggagccgagggaagagaggaagggtcctaagaaggggactgcagccctgggcaaagccaatcgacaggtgagcatcaccggtttcttccagagaaaatag

SEQ ID NO: 16776 - DNA, 1083 bp, Artificial Sequence
  Description of Artificial Sequence: Synthetic coding sequence
atgctgaaggatagcggccccttgttcaataccgattacgatattttgaagtctaatttgcagaattgttccaaattctcagctatccaatgcgctgcagcagtgccccgtgcaccggccgaaagtagcagttcgagtaagaagttcgaacagagccatctccacatgtcctctgaaacacaggctaataatgaactgacaaccaatggacacggccctcccgccagtaagcaggtgtcccagcagccaaaaggtattatggggatgttcgccagcaaagcggcggctaagacccaggagaccaacaaggaaacaaagactgaggctaaagaggtgaccaacgcaagtgcagcagggaacaaggcacccgggaaaggaaatatgatgagtaactttttcggcaaggccgctatgaacaagtttaaggtgaatctggattccgagcaggccgtgaaagaggagaaaatcgtggaacagcctacggtttccgtgactgagccaaagctcgctacccctgcgggcctgaaaaaatcatctaagaaggcggaacctgtaaaagtcctacagaaggaaaaaaaacgagggaaacgggtcgccctgagcgatgacgaaacaaaggagactgagaatatgagaaaaaagcgacgccgtataaaactgcctgaatctgattcatcagaggatgaagtgttccccgacagccccggtgcttacgaggcagagtcccccagtccccctcctcccccttcgccaccgttggagcctgtgccaaagacagagcctgagccaccctcggtaaagagcagctcaggagagaataagcggaaacggaaaagagttctcaaaagtaagacgtatcttgacggtgaaggttgtatcgtcaccgagaaagtgtacgagagtgagagctgtacagacagtgaggaagaactgaatatgaaaacgtccagcgtccacaggcccccagcgatgaccgtgaaaaaggaacctagagaagagcgcaagggtcccaagaagggcacggctgctctcggcaaggccaacaggcaggtaagtatcaccggcttcttccagaggaagtag

SEQ ID NO: 16777 - DNA, 804 bp, Artificial Sequence
  Description of Artificial Sequence: Synthetic coding sequence
atggctgatcagctttacttggaaaacatcgatgagtttgtcacggatcagaataagatagtgacctacaagtggctgtcgtatacacttggcgtccacgtgaatcaagcaaaacagatgctgtatgactatgtcgagagaaagagaaaggagaattcaggggcacagctacatgtgacgtacctcgtatcgggctccctcatacagaatggccattcttgtcataaagttgccgtggtgagggaggacaaactagaggcagtgaaaagtaagctagcagtaaccgcgtcaatacatgtctatagcatccagaaagctatgctcaaggactccggcccgctcttcaacactgattatgacatcttaaagagcaatctccagaactgctccaagttctccgctatccagtgcgcagctgctgttccccgagccccggccgagagctcttcgagctccaagaaatttgagcagtctcacttgcatatgagctctgaaacgcaggccaataatgagctcacaacaaacgggcacggcccacccgcctcaaagcaggttagccagcaacccaagggcatcatgggcatgttcgcctccaaggcagccgctaagactcaggagactaataaagagactaaaacggaggccaaagaggtgacgaacgcctcagcagcgggcaataaggcccctgggaagggtaatatgatgtctaacttctttgggaaagcagccatgaacaagtttaaggtcaaccttgatagtgaacaagccgttaaggaagagaaaatcaaagaaaagaagcgctag

SEQ ID NO: 16778 - DNA, 1566 bp, Artificial Sequence
  Description of Artificial Sequence: Synthetic coding sequence
atgggagaggtggaagcgcctggtaggctatggctggagtccccccctggtggagctcccccaatctttctgccctctgacgggcaggctctggtgctggggcggggcccattgacccaggttaccgaccgcaagtgctcacgcacacaggtagaacttgtcgctgatcctgagactagaacagtggcagtcaagcaactgggcgttaatcctagtacaactgggactcaagagttaaagccaggcttagagggctccttaggcgtgggggatactctgtatctggtgaatggacttcatcctctgaccctgcgctgggaggagacgcgtacccccgagtctcagccagatacccctcctggcacaccacttgtcagccaggacgagaagcgcgacgccgaacttcccaagaaaaggatgcggaaatctaatcctggctgggagaatttggagaagctgctcgtcttcacagccgcaggagtcaaaccgcaaggcaaggtggcggggttcgacctggacggtaccttaatcacgaccaggtcaggcaaggtgttcccaaccggcccttctgactggagaattttgtacccggagatccccagaaagttaagggagctggaagccgagggctacaagctcgtcatcttcacaaatcaaatgagcatcgggaggggtaaactgccagctgaggagtttaaggcaaaggtggaggccgtggtagaaaaactcggggtgcccttccaggttttggttgccacacacgctgggctatataggaagcctgtgaccggcatgtgggaccatcttcaagaacaggctaacgatggtacgcccatctcgataggcgacagcatctttgttggggatgcggctggaaggccagctaactgggctccgggccggaaaaagaaagatttcagctgcgctgacagactgttcgccctcaacctcgggctaccgttcgccacccctgaagagttcttcctcaagtggccagctgcgggcttcgaactgccagcatttgacccccggacagtgtcacgaagcggccccttatgcctcccagaaagcagagcattgctgagcgcatctccagaggttgttgtggctgtggggttcccaggagctggcaagagtaccttcctcaagaagcatctagttagcgccggctatgtgcacgtgaatcgggacacgcttggctcttggcagaggtgtgttacgacatgcgagacagccttgaaacagggcaaaagagtagcgatcgataataccaaccctgacgcagccagtagagcacgatatgtccagtgcgcccgggccgcaggcgtcccttgtagatgttttctgtttaccgcgacactcgagcaggcaaggcacaacaataggtttcgtgaaatgactgactcatctcacatacctgtcagcgacatggtaatgtacggatataggaagcaattcgaggccccgacgctggccgagggcttcagcgcaatactcgagattccctttagactgtgggtggagccaaggctgggtcggctgtattgtcagtttagtgaaggctag

SEQ ID NO: 16779 - DNA, 699 bp, Artificial Sequence
  Description of Artificial Sequence: Synthetic coding sequence
atgctgggcgcgatgttccgagccggcacccctatgccgcccaacctgaactcccagggaggaggccactactttattgaccgtgatggcaaagcttttagacacatcctcaacttcctgaggctcggacggttggacttgccccgtggttatggagagactgcccttctccgggctgaggctgatttctatcagatccgccctctgctggacgccttaagagagctagaagccagccagggaacccctgcgccaacagccgcgcttcttcatgctgacgtggacgtgagtcctcggctcgttcatttttctgcaaggcggggcccccaccattacgagttgagcagcgtgcaggtagacaccttccgggccaatctgttttgcactgattcagaatgtctaggcgccctcagagcacggttcggcgtcgcatcaggagatcgggctgaaggttcccctcatttccaccttgagtgggcaccccgcccggtagagctgccagaggtggaatatggccggctaggtctgcagcccctctggacaggcggacctggcgagaggcgcgaggtcgtcggaacacctagctttctggaagaagtgctgcgcgtggcccttgagcatggatttaggttggacagcgtattccccgatcctgaagacctgctcaattcccggagccttagatttgtccggcactag

SEQ ID NO: 16780 - DNA, 5157 bp, Artificial Sequence
  Description of Artificial Sequence: Synthetic coding sequence
atgaaccagaatactacggaaccagtggccgcaaccgagaccctcgcagaggtgccggagcatgttctgagaggactgccggaggaagtaagattgttcccatccgcagtcgacaagacaagaatcggagtctgggctactaaaccaattctgaagggcaaaaagttcggcccttttgtgggggataaaaagaagaggtcacaagtgaagaacaatgtctatatgtgggaggtttactatccaaacttgggctggatgtgtatcgatgccaccgatcccgaaaaaggaaattggctgaggtatgtgaattgggcctgcagtggcgaggaacagaaccttttccctctggaaattaaccgcgccatttattataagacgttgaagcctatcgccccaggggaggagctgttggtctggtataacggcgaagataatccggaaattgctgcagcaatcgaagaggaaagagcatccgctaggtctaagaggtcctccccaaagagtcgaaaaggcaaaaagaagtcacaggaaaacaagaataagggcaacaaaatccaggacatccagctgaagaccagtgagcctgacttcacaagtgctaacatgagagactcagccgagggccccaaggaagatgaggaaaagccttcggcatccgccctggagcaacctgctacccttcaggaagtggcctcacaggaggttccgcccgaattagccactcccgctccagcctgggagccacagcctgagcccgacgagagattagaggctgccgcttgtgaagtgaacgacctgggagaggaggaggaggaggaagaggaagaggatgaagaggaagaagaagacgacgacgatgacgagctggaagacgaaggtgaggaagaagcatccatgccaaatgaaaactccgttaaagaacctgagatacgttgtgacgaaaagcccgaggacttgttagaggaacccaagaccacttccgaagagactcttgaggactgcagcgaagtaacaccagcaatgcaaattcctcggaccaaagaagaagccaatggcgatgtctttgagacttttatgttcccctgccaacattgcgagcgaaaattcacaaccaaacaaggcttagaaaggcacatgcacatacatatctctaccgtgaatcacgccttcaaatgtaaatactgcggcaaagccttcgggacgcaaattaacagacgaagacatgaacgtcgccacgaggccggtctcaagagaaagcctagccagactcttcagccatccgaagatctggccgatggtaaggctagtggagaaaacgtagcctccaaggatgattcttcaccgcctagtctcggtccagattgtctgattatgaactctgaaaaggcatcacaggatacgataaatagtagcgttgtggaggagaatggggaggtcaaggaactgcacccctgtaagtactgcaaaaaggtattcggaactcataccaacatgcgacgacatcagaggagagtacacgagcggcatctgatacccaagggggtgaggagaaagggcggtctggaggaaccccagcctccagctgagcaagcacaggccacacagaacgtttacgtgccctcaacagagcctgaagaggaaggggaggccgatgacgtttacattatggatatttctagtaatataagcgaaaatctcaactactatattgatggcaagatccagaccaataataacacctcaaactgtgatgtgatcgaaatggagtccgcgtctgccgatctgtacggcattaactgtttacttacgcccgttaccgtcgaaatcacccagaatattaagacaacacaggtgcccgtcactgaggacctgcccaaagagcccctcgggagtaccaacagcgaagcaaaaaaacgcagaaccgcatctccaccagcgctcccaaaaatcaaggcggaaacagactctgacccaatggttccctcctgctccctgtcactgcccctgagtatctccacaaccgaagcagtgagtttccacaaggaaaaaagcgtctacttgagctctaagttgaaacagcttctgcagacccaggataaactcacccccgctgggatctcagctacagaaattgccaaactaggccccgtatgcgtttcagcgcctgcgtctatgctcccggtgacctcctccaggtttaagcgaagaacatctagtcccccgagcagtcctcaacatagtcctgccctgcgagacttcgggaaaccttccgacgggaaagcagcctggacagacgccgggttgacatccaagaagagcaagttggaatcccattctgatagcccagcttggtccctgagcgggagggatgagcgtgagaccgtcagcccaccttgctttgatgaatacaagatgtcaaaggaatggacagcaagcagcgcgttctcttctgtttgcaaccagcaacccctcgacctctcttctggagtgaagcagaaagctgagggaacaggaaagacaccagtgcaatgggagtcagtgcttgacctcagtgtgcacaaaaaacattgctccgacagcgaagggaaggaattcaaggagagccactcagtgcaacctacctgtagcgctgtgaagaagaggaaaccaaccacatgtatgctgcagaaggtccttttaaacgagtacaatggcatcgaccttcccgtggaaaacccagctgacgggacccggtcacctagtccttgtaagtcgttggaggcccagccggaccccgatctgggtccaggcagtgggttccccgcccccactgtcgaatctactcccgatgtgtgcccgagctcaccagctctgcaaacgcccagcctgtcttccggtcagctaccccctctgctgatacctacagatccatctagcccccccccatgccccccagtgcttactgttgccaccccccctccccctctgctaccgacagtaccactgccggccccaagttcctcagcatctcctcacccgtgcccttctccactgtccaatgccacagcacagtcccccctgcccatacttagtcctactgtgtccccaagcccttcaccaatcccccccgtggaaccactcatgtcagccgcttcaccaggccctcccacactgtctagttctagttccagtagctcatcctcgagttccttttcaagctcctccagctcttcttcccccagtccgcccccgcttagcgccatttcttccgtcgtcagctcaggggacaatctggaagcatcccttcccatgatcagtttcaaacaggaagaattagagaacgaggggctgaaacctcgggaggaaccgcagagcgccgccgagcaggatgtagtggtacaggaaacctttaacaagaacttcgtatgcaacgtctgcgagagtccattcctgtctattaaggatctgaccaaacatttgtcaattcacgcggaagagtggccctttaaatgtgagttttgtgtgcagcttttcaaagataaaacagacttgtccgaacacagatttctactgcatggtgttggcaatattttcgtttgctctgtctgtaagaaagagttcgcctttctttgcaacctgcagcagcaccagagggatctccacccagataaagtgtgcactcatcacgaattcgaatcaggcacattaagaccccagaatttcacggatccatccaaggcacacgtggagcatatgcagtctcttccagaggatccgcttgaaacttcaaaagaggaagaagaattgaacgattctagcgaggagttgtatacaacaatcaagatcatggccagcggaataaagaccaaagaccctgacgtcaggctggggcttaatcaacactacccaagttttaagcccccccctttccagtaccaccaccgtaacccgatgggcattggagttaccgcaaccaactttactacccataatattccccaaacattcacaaccgctattagatgcaccaagtgcgggaaaggcgtggacaatatgcccgagctgcacaaacacatcttggcctgtgcaagtgccagtgataagaagaggtacacaccaaaaaaaaatccagtaccgctgaagcagaccgtacagcccaagaacggtgtggtggttttagacaattccgggaagaacgcctttaggcggatggggcaacctaagagactgaacttcagtgtcgagttatcaaaaatgagctccaacaaattgaaattaaacgctctcaaaaagaagaatcagctcgttcagaaagctattctccagaagaacaaatctgccaagcagaaagcagacctgaagaacgcttgcgaatcatcctcacatatatgcccctactgtaaccgtgagttcacctatatcggatcactgaataagcacgcagcctttagctgccccaagaagccactttcaccacctaagaagaaagtgtctcacagtagcaaaaagggaggtcacagctcccctgccagtagtgataaaaactcaaacagtaatcatcgtaggagaacagctgatgcagaaattaaaatgcagtccatgcaaaccccccttggtaagacccgcgctcggagcagcggcccaacacaggtacccctgccaagctcctcctttaggtccaagcagaacgtgaaattcgctgcgtctgtgaaatcaaagaaaccatcctctagttctctgcgaaactcaagcccaatccgtatggccaagattacccacgtggagggaaagaaaccgaaggccgttgctaagaaccactcagcccagctgagcagtaagaccagcagaagcctccacgtacgggtacaaaaatcgaaggctgtcttgcagtccaagagcaccctggcctccaaaaagaggactgaccgcttcaatattaagagccgggagagatctggaggacctgttacccgctcacttcagctggctgccgccgctgatctgtctgagaataaaagagaagacggaagtgcaaaacaggagctgaaagatttctcatattctctgcggctcgctagtaggtgttctcctcctgcagctccttacatcactcgacagtatcggaaagtgaaggcccccgccgcggcccagttccagggtcccttctttaaagaatag

SEQ ID NO: 16781 - DNA, 5049 bp, Artificial Sequence
  Description of Artificial Sequence: Synthetic coding sequence
atgaaccagaatactacggaaccagtcgccgccacagaaactctggctgaggtgcccgagcacgtgctgcgcggactcccggaggaggtcaggctgttccccagcgcagtggataagactcggattggggtatgggcaaccaagccaattttgaaagggaagaagtttggtccctttgttggcgacaagaagaagcgtagccaggttaagaacaatgtctacatgtgggaggtatattacccaaatctggggtggatgtgcatagacgccacagaccccgagaagggcaactggctgcgctacgttaattgggcctgctcaggcgaggagcaaaatcttttcccactcgaaattaacagggctatttactacaaaaccctcaaacctattgctcccggtgaggaactcttggtgtggtacaacggggaagacaaccccgagattgctgccgctattgaggaagagagagcctctgcgagaagtaaacgctcgtcacccaagtcaagaaaaggcaagaaaaagtctcaagaaaacaagaataaaggtaacaagatccaggatatacagcttaaaacatctgagcccgatttcacaagcgccaatatgcgagacagcgcggagggtcctaaggaggacgaagagaaaccctcggcaagtgctctagagcagccagcaacactgcaggaggtcgcatctcaagaggtgcctcccgaactggctacgcctgctccagcctgggaacctcagccagaacccgacgagcgactcgaggccgccgcttgcgaagtgaatgatctgggcgaagaggaagaagaagaagaggaagaagacgaagaagaggaagaggacgacgatgatgacgaactggaagatgagggagaagaagaggcttccatgccaaatgaaaatagcgtgaaggaacccgagatccgttgtgacgagaagccagaagatttgttagaggagcccaaaaccacaagcgaggaaactcttgaggactgctccgaggtgacaccagccatgcagattccccgcaccaaagaggaagccaacggagacgtgttcgagacctttatgtttccctgtcagcactgcgagaggaagtttactaccaaacaaggtcttgaacgccatatgcatatccacatctctaccgtcaatcatgcctttaaatgtaaatactgtggcaaagcatttgggactcagatcaaccgccgacgccacgagaggcggcacgaggcaggtctaaagcgtaaaccctcacagaccctgcaaccttcagaagacttagctgatggtaaagcgtccggcgagaatgtggcgagtaaggacgacagttctccaccctctcttggccccgattgcctgataatgaactccgagaaagctagccaggacacaattaattccagcgtcgtagaggaaaacggcgaggtcaaggagttacacccatgcaagtattgcaagaaggtgtttggaactcacactaatatgcggaggcaccagagacgcgtgcatgaaagacacctgatccccaagggtgttagacggaaaggaggattggaggagcctcaaccgcccgctgagcaagctcaggcgacacagaacgtgtacgtcccctctaccgagccagaagaagaaggagaggcagacgatgtatatataatggatatttcatctaacatatctgagaatctgaattactatattgacggcaaaattcagacgaacaacaatacttctaattgtgacgtgatcgagatggagagcgcctccgctgacctctatgggatcaactgccttctaactccagttaccgtggaaatcacccagaatattaaaactacacaggtgcctgttacagaagacctccccaaggagcctcttggaagcaccaacagcgaagctaagaagcggaggaccgctagccccccggcactccctaagataaaagccgaaactgattcggaccccatggtcccttcttgttcactgtctctacccctgtctataagcacaacagaggctgtgtcctttcataaggaaaaatcagtgtatctaagctcgaaactgaaacaactcctgcaaacgcaggataagctgacacccgctgggatctcggccaccgagattgcaaaactgggcccagtatgcgtctcggcacccgccagcatgctcccggtaacgagttccagatttaaaagaaggacttcttcaccccccagctcccctcaacactcccccgctctgcgtgactttggaaagccctccgacggcaaggcggcttggacagacgctggcttgacatctaagaaatccaaattagagagccacagcgatagtccagcctggtcgctgagcggcagagacgagagggagacagtgagccccccatgttttgatgaatacaagatgtcaaaagaatggacagctagcagcgcgttttcctcagtttgtaaccaacaacccctggatctgtctagcggagtgaagcaaaaggctgaggggactggaaaaaccccagtgcagtgggagagtgtccttgatttaagcgtgcacaagaaacactgtagtgattcagaaggcaaggaattcaaggaaagccattcagtccagcccacctgtagcgcagttaaaaaaaggaaacccactacatgtatgctccagaaggttttgttgaacgaatacaatggaatcgacctgcccgtggagaaccccgccgacggtacaagatctcccagtccctgtaagtctctagaggctcagcctgatcctgatctagggccaggctcgggattccctgcacccacagtggagtcaacgcccgatgtgtgcccaagtagccctgcactccagacgcctagtctatccagtggtcagttaccgccactgctgatcccgacggatccaagttctcctcctccatgcccccctgttctgaccgttgctacacctccccctcctttgctacccacagtaccactgcctgcaccatcgtcatccgcgagtccgcacccatgcccttcccccttatcaaatgcgaccgcacaatcccctctgcccattctcagtcctaccgtcagcccgtcaccgtccccaatcccacccgtcgagccactgatgagcgcggcatcacctggtccccctacgctttctagctcttcgagcagttcgtcttcaagcagctctttctctagctccagctcttccagctctccttctcctcccccactgtcagcaatatcctccgtggtgagttcaggtgataatctggaggcctcattgccaatgataagctttaaacaggaggaactggagaacgaaggactgaagccaagagaagaaccccagtccgctgctgagcaagacgtcgtggtacaggaaacgtttaacaaaaactttgtgtgtaatgtgtgcgagtctccgtttctctctattaaagacctcaccaaacacttatctatccatgccgaagagtggccattcaagtgcgagttctgtgtgcaacttttcaaagacaaaaccgacctctccgagcatcggtttcttctccatggcgtcggcaatatctttgtgtgctctgtttgtaaaaaggaatttgcctttctgtgcaatcttcaacagcaccaacgcgacctacatccagataaggtgtgcacccaccacgaatttgagtccggtactctccgacctcaaaattttacagatccaagcaaggcacacgtcgaacatatgcagtccctccctgaggatcctctcgagacatccaaggaggaggaggagctgaacgactcttctgaggagctgtatactaccattaagattatggcttctggcatcaaaacgaaagatccagatgtgcgcctcggtctgaaccagcactacccatctttcaagcctcctccttttcagtaccatcatcggaacccaatggggataggcgtgaccgccaccaattttactactcacaatatccctcaaacttttaccacagctattcgttgtactaagtgcggcaagggggtggacaacatgcccgagctccataagcatatcctcgcctgcgcgtcagcttccgataagaaaagatacacccccaagaaaaatccagtaccactgaaacaaaccgtgcagcccaaaaacggggtagtcgtcctcgataactctgggaagaatgcatttaggagaatgggacagccgaaaaggcttaacttcagtgtggagttaagcaagatgagctcaaacaagcttaagctgaatgctttgaagaaaaaaaaccagttggtgcagaaggccatcctgcagaagaataagagcgcaaaacagaaggctgacctgaaaaacgcctgcgagtcatctagtcacatctgcccatactgtaatagagaatttacgtatataggctctctgaacaaacatgcagcctttagttgccctaagaaacctctaagtccacctaagaaaaaggtgagccatagctccaagaaaggggggcattcatctcctgcgagcagcgacaaaaactccaacagcaaccaccggaggcgaacagcagacgccgaaattaaaatgcagagcatgcagaccccgttggggaagacccgcgcaaggtctagtgggccaacacaggtcccattgccatccagctctttccgatcgaaacagaatgtcaagttcgcagcttctgtgaaatcaaaaaaacccagttctagttcacttcgaaacagttcacctattagaatggctaagattacacacgtcgaaggaaagaagccgaaagctgtagctaagaaccactccgcgcagctgtcttccaagacctcacggtccctgcacgtcagagttcagaaaagcaaggcggtcctccagtccaaaagcacactcgcttcaaagaaacggacagatcgatttaatatcaaatcccgcgagcgttccggtggccctgtgacgcgatcccttcagcttgcagcggcagctgaccttagcgagaataagcgggaggacgggagtgccaagcaggagctcaaggatttcagaaattttctctag

SEQ ID NO: 16782 - DNA, 4446 bp, Artificial Sequence
  Description of Artificial Sequence: Synthetic coding sequence
atgcgggactccgccgaagggcctaaggaagatgaggagaagcccagcgccagtgcactggaacaaccggccacactgcaggaagtagcttcccaggaggtgccgcctgagctggcgacccctgcacccgcctgggagccccaaccagagcctgatgaaagactcgaagcagctgcttgtgaagtcaatgacctgggcgaagaagaggaagaggaggaggaggaagatgaggaagaagaggaagacgacgacgacgacgagttagaagatgaaggagaggaagaagcgtctatgcctaacgagaattccgtgaaggaacccgaaatcagatgtgacgagaagccggaggatctcctggaagaaccaaagaccaccagtgaggagacattagaggactgcagcgaggttacacctgcgatgcaaatacctcgtactaaagaggaggccaacggagacgtatttgagacattcatgtttccctgtcaacattgtgaacgcaagttcacaacgaagcaaggtctggaaagacatatgcacatccacattagtacggtgaaccatgcctttaagtgtaaatactgtgggaaggctttcgggacccagatcaaccggcgcagacatgagcgccgacacgaggccggtctgaagagaaagccctctcagactttgcagccatctgaagatttagcagacggtaaagcctccggcgaaaacgtggcctccaaggacgactcttcccctcctagcctaggcccagattgcttaatcatgaactcagagaaggcctcccaggacaccattaatagcagcgtggtagaagagaacggggaagtgaaggagctgcacccatgtaagtattgcaagaaggtatttgggacccataccaatatgcggcgtcatcagcgaagggtccatgagcgacacctgatcccaaaaggcgtcagacgaaagggcggtctggaggagccccaacctcccgctgaacaagcacaggccacgcagaacgtatacgttcccagtaccgagccggaagaagagggagaggctgacgatgtctatattatggatatttcatctaatatctctgaaaacctcaattattatattgatggaaagatccagacaaacaacaataccagcaactgtgatgttatcgagatggagtcagcttcggcagatctgtacggcattaattgcctgttgacaccggtcactgtggagatcacccagaacattaaaaccacccaggtacccgtgaccgaagacctgcccaaggagcccctagggtctaccaactctgaagcaaagaaacggaggaccgcctcccctcctgccctgcccaagatcaaagccgaaacagacagtgatcccatggtcccatcttgttctctgtcgttgccactgagcatctccactactgaggccgttagttttcataaggaaaagtctgtatacctttcttccaagctcaaacaactgctgcagacacaggacaagctgactcccgcaggcatttctgcaaccgaaatagccaagttgggaccggtctgtgttagtgcccccgcttcaatgctgcccgtgacaagctctaggtttaagaggcggactagctcaccccccagcagtccccagcatagccccgcgctccgggacttcgggaagccctctgacggtaaggcggcgtggactgatgctggccttacgtctaaaaaatcaaaactggaatctcatagcgattcaccagcttggagtttgtctggtagggacgagagagaaactgtgagccccccatgcttcgatgagtataagatgagcaaggaatggacagcctcatccgccttcagtagcgtttgcaaccagcagcctctggatctgtcttcaggcgtgaaacagaaggccgagggaaccggcaagactcccgtgcagtgggaatccgtgttagacctgagtgtacacaagaagcattgttccgacagtgaaggcaaggaatttaaggaatctcattctgtccagccgacctgtagtgccgtcaaaaaaagaaaacccaccacatgcatgttgcagaaggtactcttgaatgagtataacggcattgacctgccagtggagaaccccgcagacggcacgagatccccctcaccctgtaaaagtctagaggctcagcccgaccctgatctgggacctggctctgggtttccagcacctactgtcgaaagtacacctgatgtatgcccctcaagtccggcgctccagacgcccagcctgtcgtctggtcaactcccaccactattgattcctactgacccttcatccccccccccatgccccccggtgttaacagttgcaacccctcctccccccctcctgccaacggtccctctgcctgcccctagctcttctgcaagccctcacccctgtccgagccctttgagcaacgccacagcacagtctccactccctattctgagcccaacggtttccccttctccgtcgcctatcccgcccgtggagccattgatgtctgcagcctctcctggccctccgactctgagttcatcaagttcatcgtccagctcctcttcctccttcagtagctcatcttccagctcctcccccagccccccacccctttccgcgattagctccgttgtcagttctggcgataatctggaggcttccctacctatgatttcattcaagcaggaggaattggagaacgagggcctcaagccaagggaggaacctcaatcagccgcagaacaggacgttgttgtgcaggaaacatttaacaagaacttcgtgtgcaacgtttgtgaatcgcctttcttatctatcaaggatctgactaagcacctgtctatacacgccgaggaatggcctttcaagtgcgaattctgcgtgcaactttttaaagataaaacagacctttccgaacatcgtttcctgttacacggggttggtaacatttttgtgtgctcagtttgtaaaaaagaatttgcatttctctgtaacctgcagcagcatcagagggacctgcaccccgacaaagtgtgtacccatcatgagttcgaaagtggtacactccgccctcagaacttcaccgatccaagtaaggcccacgtggaacacatgcagagcctgcccgaagatcccttagagaccagtaaggaagaggaagagcttaacgatagttctgaggagctgtatactaccattaagattatggcttcggggatcaaaacgaaagatcctgatgtgcggttaggactaaatcagcactacccctcctttaagccaccacccttccagtatcaccacaggaacccaatgggaattggagtgactgccaccaatttcaccacacataatataccacagacgttcaccactgccattcgttgtaccaaatgcggcaagggcgtcgacaacatgcctgagttacacaaacatatcctagcgtgcgccagcgcatccgacaaaaagaggtatacaccgaagaaaaaccccgtgcccctcaaacagacggttcagcccaagaatggcgtcgtcgttctggacaactcggggaagaacgctttcaggcgtatggggcagccaaagaggctaaatttctctgtagagctgtctaagatgtctagtaataagttgaagttgaacgccttgaagaaaaaaaaccaactggtccaaaaggctatccttcagaagaataaatcggccaagcagaaggccgaccttaagaacgcctgcgaaagtagcagccatatctgcccatactgtaatcgggagttcacttacattgggagtctcaacaagcacgccgccttctcgtgtcctaagaaaccgctgtcacctcctaagaagaaagtctctcacagttcaaaaaaggggggacactcctcccctgcttccagcgataagaattctaactctaatcaccgaaggagaaccgccgacgcagaaatcaagatgcagtctatgcaaacaccactcggtaaaacccgcgccaggagctctgggccaacgcaagtgccactaccatcatcctcatttcgaagtaagcagaacgttaagttcgctgcatcagtgaaaagcaaaaaaccctcatcttcatcccttcgtaacagttcacccatccggatggctaagatcacccacgtggaggggaaaaagccaaaggccgtggccaaaaatcatagcgcccagctcagtagcaagacaagccggagtcttcatgtgcgagtgcagaaaagtaaggccgtgctacaatctaaatccacactggccagcaagaagcggacagacaggtttaatatcaaaagcagggaacgttcaggaggccccgtaactcgctcactccagctggccgctgctgccgatctgtcagagaacaaaagagaggatggttctgccaagcaagagttaaaggacttccgcaattttctgtag

SEQ ID NO: 16783 - DNA, 681 bp, Artificial Sequence
  Description of Artificial Sequence: Synthetic coding sequence
atgaaccagaataccacagagcctgtggccgctacagaaaccttggccgaagtgccagagcacgtgctgagaggactgccggaggaggtgcgcctgttcccatccgccgtggacaagacaaggatcggcgtttgggctaccaaacccatcctgaaaggcaaaaagtttgggccattcgtgggagataaaaagaaacgatcccaggtcaagaataatgtgtatatgtgggaggtgtactacccgaacctcggctggatgtgcatagatgcaactgatcctgagaagggcaattggttgaggtacgtgaactgggcttgcagcggcgaagagcagaacctgttccccctggagatcaaccgggcaatttactataaaaccttgaaaccgatcgcacctggcgaggagctcctggtctggtataacggggaggataaccccgaaattgccgccgcaatcgaggaggagagggctagcgctaggtcaaagaggagctcgcccaagagcaggaaggctactgcgtcagcctggcggcccgatgccctacatcaaagaccaagaactagccctggtagtatcgggcgttcgaaactccagctgcaaccaagctcccgggaccacagctccaagtcgcgccattctgggtgctccttgaccgcccccgaagtgacatggaatcagtag

SEQ ID NO: 16784 - DNA, 5049 bp, Artificial Sequence
  Description of Artificial Sequence: Synthetic coding sequence
atgaaccagaacactactgagccggtagctgctaccgagaccctggctgaggtgccggaacacgtcttgcgaggactgccggaggaggtgcgcctgtttccctccgctgtggacaaaactcggatcggtgtctgggccactaaaccgatcctgaagggaaaaaaatttgggcccttcgtaggagataaaaagaagcggagtcaagtcaagaataatgtctacatgtgggaggtgtattatcccaacttgggatggatgtgcatcgacgcgaccgacccagagaaaggcaattggttgagatacgtgaactgggcctgttcaggcgaagagcagaacctgttccctttggagataaacagggccatttattacaaaacgctgaaaccaatcgctcccggggaggagctgctggtttggtacaacggagaggacaaccctgaaatcgcggctgcaattgaggaagagcgcgcaagcgcgcggtctaagagatcaagcccaaaatccagaaagggtaaaaagaagagccaagaaaacaaaaataagggaaataagatccaggatattcaactgaaaacgtccgaacctgactttacgtccgccaacatgcgcgacagcgcagaggggcctaaggaggacgaagaaaagcctagtgcgagcgcccttgagcaaccagcaaccttgcaagaggtagcttcccaggaagtaccaccagagctcgccacccccgctccagcttgggagccccagcccgaacccgatgagcgcctggaggccgctgcatgcgaagtgaacgatcttggcgaggaggaagaagaggaagaggaagaagacgaggaggaagaagaggatgatgacgatgacgaactggaggatgagggcgaagaagaggcaagcatgcctaatgagaatagtgtcaaagaacccgagattaggtgcgacgaaaagccagaagatctgctggaggagcctaagacaacaagcgaagaaactctggaggattgtagcgaggtgacgcccgcaatgcagattcctcgtaccaaggaggaagctaatggcgacgtgttcgagacatttatgttcccatgtcagcactgtgagagaaagtttacgacaaaacagggtctagagcggcacatgcatatacatatctccaccgttaaccacgcctttaagtgcaaatactgcggcaaggcattcggaacacagattaaccgccggcggcacgaacggagacatgaggccgggctcaaacgcaaaccctcacaaacgcttcaaccctcggaagacctggccgatggtaaggcgagtggcgagaacgtagcctcaaaggacgattcttcacctccttcactggggccggattgcctaattatgaatagcgagaaagccagccaagatactatcaacagctccgtagtggaagaaaacggagaagtgaaggagcttcatccctgcaagtattgtaagaaggtgtttggcacacatacaaacatgaggaggcatcagagacgcgtgcatgaaaggcacctcattcccaaaggagtgcggagaaagggcgggctcgaggaaccacagccccctgcagaacaggcccaagcgacgcagaacgtgtacgtgccttccacagagcccgaggaggagggggaggccgatgatgtctacatcatggacatcagttccaatattagcgaaaacctgaactattacatagacgggaagattcagaccaacaacaacaccagcaattgtgacgtcatcgagatggagtctgcatcagccgatctttacggcatcaattgcttgctcaccccagtgactgtggaaattacccagaatatcaaaacaacccaggtcccagtcaccgaggatctcccgaaggaacccctcgggagcacaaattctgaagcaaagaaaagaaggacagcctctccccctgcgctccccaaaataaaagctgagaccgatagcgatccaatggttccttcctgctctttatccctaccactatctatcagcaccaccgaagctgtttcctttcataaagaaaaatcagtatatctatcatcaaagctgaaacaattgctacagacacaagacaaacttacaccggcaggcatctccgcaacagagatcgccaaactgggccccgtatgcgtatccgcccctgcaagcatgctgccggtcacatctagtcgctttaaaagacgcactagtagtcctccttcatctccccaacattcacctgccctgcgcgatttcggcaaaccaagtgatggaaaggctgcatggaccgacgcagggcttactagtaagaaatctaaactggagagccacagtgattcccccgcctggagtctgtcaggcagagacgagagggaaacagtttccccgccctgtttcgacgaatataaaatgtcaaaggagtggactgctagcagcgccttcagttctgtctgtaaccagcaacccctggacctgagcagcggcgtgaaacagaaggccgaggggacagggaaaacccccgtccagtgggagtccgtgctggatctgagcgtccacaaaaagcactgctcggacagcgagggcaaggagttcaaagagtctcattctgtgcagccaacctgttcagctgtgaagaaacgcaaacccacaacatgtatgttgcaaaaagtgctgcttaatgagtacaatgggattgacctgccagtggaaaatcccgcggacggcacccggtccccctccccgtgtaagtctttggaggcgcagcccgatcccgatttagggcctggcagtggcttccctgcacccacagtggagtctaccccagacgtttgtccttcaagtcccgctcttcagacacctagcctgtcttcagggcagcttcctccgctgcttatccctacagaccctagttcccccccgccctgccctcctgtacttacggtggcgacaccgccaccacccctactccctaccgtcccccttccagccccctcaagcagcgcaagcccccacccttgcccctctcccctctccaatgctactgcacagtcaccactgcccattttatcgccaactgttagtccgagcccgagcccgattccccctgtcgaacccttgatgtctgctgcgtcgcctggtccaccgacactcagttctagttctagttctagctcaagtagctcctccttcagttcatcatcctcctcatcgtcaccttcgccacctcccctcagcgcaatttcctccgttgtgagtagcggagacaacttggaggcatctctgcccatgatttcctttaaacaggaagagctcgagaacgagggactgaagcctagggaggaacctcagagcgccgctgaacaggacgtggtggtgcaggaaacgttcaacaagaatttcgtgtgcaatgtgtgtgagagccccttcctgagcattaaggatctgactaagcacctctccatccatgctgaggagtggccgtttaagtgcgaattttgtgtgcagcttttcaaagacaagactgatctgtccgagcaccgatttctactgcacggcgtgggcaacatctttgtgtgttcggtttgtaaaaaagagtttgccttcctatgtaacctgcaacagcaccagagagatctgcaccccgacaaagtgtgtacgcatcacgagtttgaaagcggcactttacggccacagaactttactgaccccagcaaagcacacgtggaacacatgcagagtctgccagaggaccctctggaaacaagcaaggaagaggaagagttgaatgatagtagcgaagagttatacacaactatcaaaattatggcaagcggcattaagactaaggacccagacgtgcggctgggcctgaatcagcactacccctcgtttaaaccacctcccttccagtatcaccatcgcaatccgatgggaattggtgtgactgccacgaactttacaacgcataatattcctcagacatttaccaccgccattcgctgcactaagtgtggcaagggcgtcgacaacatgcctgaactccacaagcacattctggcctgtgctagcgcctccgataagaaaaggtacactcccaaaaaaaatccggtaccgctgaaacagactgtgcaaccaaaaaacggcgtggtggtcctggacaacagcggtaagaacgcgttccgacggatggggcagcctaagcgtctgaatttctctgtggagctctccaagatgtccagtaacaaactcaaactgaacgccctcaaaaaaaagaaccagttagtacagaaggccattctgcagaagaacaaatcagcgaagcagaaggcagatctcaaaaatgcctgcgagagctcatcacatatatgcccctactgcaaccgcgagtttacctacataggatctctgaataagcacgcggcgttcagttgccctaaaaaaccactgagtcctcccaaaaagaaagtgtctcattcttccaaaaaaggtggccattccagccccgccagttccgataaaaactcaaacagcaatcatcgccgccggaccgctgatgcggaaatcaaaatgcagagcatgcagaccccgctcggcaaaacacgcgctcggagctcagggccaacccaggttccactaccaagttcaagctttaggtcgaagcagaacgtgaaattcgctgcaagtgtgaagtccaaaaagccatcctcgtcctcgctccgtaactctagccccatcaggatggccaaaatcacacacgtagagggcaagaagccaaaggccgttgctaaaaaccattctgcacagctctcaagtaagacctctaggtcactgcatgtccgggtacagaagtcgaaggcggtactccaatcaaagagcaccctggcctctaagaaacgcacagatcgcttcaatataaaatcgcgggaacgatcagggggaccagttacaagaagtctccaattggcagctgccgccgacctgagcgaaaacaagcgtgaagatggcagtgcaaaacaggagctgaaggattttcgatgtttcctttag

SEQ ID NO: 16785 - DNA, 237 bp, Artificial Sequence
  Description of Artificial Sequence: Synthetic coding sequence
atgcgggacagcgccgaaggaccaaaggaggatgaagaaaaaccttccgcatccgccctagaacaacctgctacacttcaggaggtggccagccaggaggtgcctccagagcttgcgacgcccgcccccgcctgggaacctcagcctgagcctgatgaaagacttgaagcagctgcttgtgaggtgaatgacctcggggaagaggaagaggaggaggaagaggaggatgaagagtag

SEQ ID NO: 16786 - DNA, 4446 bp, Artificial Sequence
  Description of Artificial Sequence: Synthetic coding sequence
atgcgggactcagccgagggaccaaaggaggatgaggaaaaaccctctgctagtgcgctggagcaaccagctacactgcaagaggtcgcgtcacaagaagtgccaccagagctggctacaccagcccctgcgtgggaaccacagcctgaacccgacgaacgattggaagccgccgcctgtgaggtgaatgacctgggtgaggaggaggaagaggaggaagaggaggacgaggaggaagaagaggacgacgacgatgatgagctcgaggacgagggagaggaagaggcatccatgccaaacgagaattccgtgaaggagcccgaaatcaggtgcgacgaaaaaccagaagatctattagaggaacctaaaacgacatctgaggagacgctggaggattgttccgaagtgacccccgcaatgcagattcccaggacgaaggaggaagccaatggagacgtcttcgagacgtttatgttcccgtgtcagcactgcgagcgcaaatttaccacgaaacaaggcctggagcggcacatgcatatccatattagcacagtgaaccatgcttttaagtgcaagtattgtggaaaagccttcggtacacagatcaatagacgccgccacgagcggaggcacgaggccgggctcaagcgcaagccgtctcagacccttcagcccagtgaagacttggcggatggtaaggcaagcggagaaaatgtggcctccaaagacgactcatccccgccttcattgggaccagattgcctcatcatgaattctgagaaagcgtctcaggataccatcaattcctctgtggttgaagagaatggcgaagtcaaggaactacatccatgtaagtattgtaagaaggtgttcggtacccataccaatatgcgccgtcatcagaggagggttcatgaaaggcacctaatcccgaaaggagtcaggcgcaaaggcggcctggaggagccacaacccccagccgagcaggcacaagccacacagaacgtgtatgtgcccagcacagaacccgaggaagagggagaggccgacgatgtgtatattatggatataagttcaaatatctcagaaaacctcaactattacatcgacggtaagatccagacaaacaacaataccagcaactgcgacgtcatagagatggaatctgcctcagcagacctgtacggaatcaattgccttctcacacccgtaaccgtggaaataacccaaaatattaagaccacccaggtgccagtcacggaggacctccccaaggagcctctcggcagcacaaactcagaagccaagaaaagaagaacagcaagccctccagccctgcctaagatcaaagcagagaccgacagcgatcccatggttccatcttgtagcttgtctctgccactgtcaattagcacgacagaggcagtttcttttcacaaagaaaagagcgtatatttaagttcaaaactgaaacagctcctgcagacccaagacaagttgactccagcaggaatcagcgcaaccgagatagcaaagttggggccggtctgcgtgtctgctccggcaagtatgctcccagttacctcttccagattcaaacgcaggacatcctcccctccatcatctccccaacactctcccgcccttcgcgacttcggaaagcccagcgatggcaaagcagcgtggaccgacgcaggcctgactagtaagaagtctaagctcgaatcacactctgactctccagcttggagtctctccggtcgcgacgaaagagagacagtgagccccccctgctttgacgagtacaaaatgtccaaagaatggacagccagctcagcgttcagctccgtgtgcaaccagcaaccacttgacctgtcgtccggagtgaagcaaaaggcagaaggcaccggtaagactcccgtgcaatgggaatcagttctggacctttctgtgcacaagaaacattgtagcgactcggaggggaaggagttcaaagaatcccactctgtgcagcctacatgctcagccgtaaagaaaagaaagcccacaacttgcatgctgcagaaagtcctgctgaacgaatataatggaatcgacctccccgtcgaaaatcccgccgatggcacgcgaagccccagtccttgcaagtcccttgaggcacagcccgacccagatctgggaccagggtctggctttcctgcacctacggtggaaagtacacccgacgtttgcccaagtagccccgctctccagacaccgagcttaagcagtggtcagctgccccccctgctgatcccaacagatccctctagtccaccaccttgtccacccgttctgaccgtcgctactcctccaccaccccttctgccaactgttccactccccgctccttcctcctctgctagtcctcatccatgtcccagcccactgagcaacgccaccgcacagagtcctttgcccatcctgtcgcccacagttagcccaagtccaagcccaatacctcctgtggaaccactgatgtcagccgccagccccggcccacccactcttagttcctcatcgtcttccagcagctccagttctagtttcagttcaagtagttcatcctcaagcccaagtcctcctccactcagtgctatttcttcggtggtctcaagcggcgacaacctcgaggcttcactgcccatgataagcttcaagcaggaggagctggagaatgaaggcctgaaaccacgcgaagagccacagtcagctgctgaacaagacgtcgtcgtacaggagacatttaataagaattttgtctgcaatgtgtgcgagagcccgttccttagtattaaagatttaactaagcacctttctatacacgccgaagagtggccctttaagtgcgagttctgtgtgcagctctttaaggacaaaaccgacctctccgagcaccggtttctgctccatggggttggaaacatcttcgtgtgttccgtgtgcaagaaggaattcgcatttttgtgcaacctgcaacagcatcagagggaccttcatcccgataaagtatgtacccatcacgagttcgaaagtggcaccctcaggccacagaatttcactgatccctctaaggcccacgtcgagcacatgcagtccctgccggaggatccactggagacgagcaaagaggaagaggagctcaatgattcttctgaggagctgtatacaaccatcaaaataatggcctcaggcattaagacaaaggacccggatgtgcggctgggtctgaaccagcattacccgtccttcaagcctcctcctttccagtatcaccacaggaatccaatgggcatcggcgtgacagcaactaatttcacaacccacaacatccctcagacattcacaactgctatccggtgcaccaaatgtggaaagggagtggataacatgccagaacttcacaagcacattcttgcatgcgcgtcggcatcggacaagaaaaggtacacccctaagaagaatcccgtgcccctgaagcagacagtccaacctaaaaacggggtcgttgttcttgataacagtggaaagaacgccttcagacgaatgggacagcccaagcgccttaacttcagtgtcgagctcagtaagatgtcctctaacaagttgaagctgaatgctctgaaaaagaaaaaccaactggtgcagaaggccattctgcagaaaaataaaagcgcaaaacagaaagcagatctcaagaacgcttgcgaaagcagctcccacatttgcccttactgcaatcgggagttcacgtatattggatctctgaacaagcacgccgccttctcctgccccaaaaagccactgagcccgcccaagaaaaaggtgagccactcctccaagaaaggtggccattctagtcccgcgtcctcagacaagaacagtaattccaaccatagaagacgaacagccgatgccgagatcaagatgcagtctatgcagacacctctgggtaagacacgcgctaggtctagtggcccaactcaggtgcccttgccaagttcttcattccgaagtaaacaaaatgtgaaatttgcggcaagcgtaaagtctaaaaagcctagctcatccagtcttcgtaacagctcccctatcaggatggccaagataactcatgtggagggcaagaagcccaaggcggtggccaagaaccactcagcacagctgagctccaagacatctagaagtctgcatgttcgagttcagaaaagcaaagctgtgctgcagagcaagagtaccctggccagtaaaaagcggactgatcggttcaatattaagagtcgagaacgatcaggaggcccagtgactagatccctgcagctcgccgccgctgcggacctgtccgaaaacaagcgcgaggacgggtctgccaagcaggagctgaaggatttccggaattttttatag

SEQ ID NO: 16787 - DNA, 675 bp, Artificial Sequence
  Description of Artificial Sequence: Synthetic coding sequence
atgtcctcttactttgtcaattccacctttccagtcactctcgcttccgggcaggaatctttcttggggcaactcccattatattcatccggttatgcagacccacttcgccactatccagccccctacggccctggacccggtcaggataagggattcgctacctccagttactaccctccagctggaggaggctatggcagggctgccccttgtgactatggccccgcacccgcattttatcgggagaaggagtctgcttgtgccctgtcgggcgcagatgaacagccacccttccaccctgagcctcggaagtccgactgtgcacaggacaagagtgtcttcggcgagaccgaggaacaaaaatgttcgacaccggtgtacccttggatgcagcgtatgaactcgtgtaatagctcgtccttcggcccaagtggacggaggggcaggcagacttacaccaggtaccagaccctcgagctcgaaaaggaatttcactataaccgctacttgacccgtagacggcgaatcgaaattgcacacgccctgtgcctgacagagcgtcagattaaaatttggtttcagaatcgccgcatgaagtggaaaaaggagagcaagctgctgtctgcatcacagctgtctgctgaggaagaagaggagaaacaagcagagtag

SEQ ID NO: 16788 - DNA, 2496 bp, Artificial Sequence
  Description of Artificial Sequence: Synthetic coding sequence
atgactgagctgaaggccaaaggcccaagggcaccccatgtggccggtggtccccctagtcctgaggtgggaagccctcttctgtgtcggcccgcagccgggcccttccctggatcacagacgtccgacaccctcccggaagtgtccgcgattcccatctcattggatggcctgctgttcccgcgaccttgccaggggcaggatccttctgacgagaagacgcaagatcaacagagcttgtccgatgtcgagggagcttactcccgggcagaggccactaggggagccggaggttctagcagtagtcccccagagaaagattccgggctgttggactcagtgcttgacactcttctggctccttccggcccagggcagtctcaacctagtccccctgcgtgcgaagtgacaagtagctggtgtctttttggccccgaactcccagaagacccccccgccgctcctgcaactcaacgcgtcctttctcccctcatgtcacggtctggatgcaaggtcggcgacagtagtgggacagcggcggcgcataaagtgttaccacgcggcctcagccctgctaggcagctccttctgcccgcctccgaatctccccattggagtggagcccccgtcaaaccctccccacaagccgcggctgtggaggttgaggaggaggacgggagcgaatccgaagagtccgcggggcctctgctgaaaggtaaacctcgcgccctcggaggtgccgccgccggggggggagccgctgcagtgcctccaggtgcggccgccggaggcgtggcgctggtacccaaggaggactccagattctcggctccgagggtggccttggtcgaacaggatgcgccgatggcacccggccgaagccctctggcaacaactgtgatggactttatccatgtgcctatcttgccattgaaccacgcactgttagcagcccggacaaggcaactgttagaggacgaaagctatgatggcggcgccggcgccgcctccgcattcgcaccccccaggtcttccccttgcgcctcaagtacccctgtggccgtgggagattttccagattgcgcttaccctccagacgccgaacccaaggatgacgcctatcccttatattcggactttcaaccccctgccctgaaaattaaggaggaggaagagggggcggaggcatccgcccgcagtccaagatcgtaccttgttgcaggagctaaccccgctgcctttcctgactttcctctcggtcccccaccacctctgcctccccgggccactcctagccgcccgggggaggccgccgtgacggcagctcccgcttccgctagcgtatcaagtgcgtcttctagcgggagcacattggaatgtatcctttacaaagctgagggtgcccctccccaacagggtccattcgccccccctccatgcaaagcccctggggcttcaggatgcttacttccaagagacggtcttccttccacatccgcatctgctgcggcggccggggcggccccggccctctacccggccttgggtttaaatggcctgcctcagctgggctaccaagctgcagtgttgaaggagggattgccccaggtctatcctccctatctgaattatcttaggccagactcagaagccagtcaaagcccgcagtatagcttcgagagtctgccgcaaaaaatctgtcttatttgtggagacgaagccagtggttgccactatggggtgctgacgtgtggctcctgcaaagtcttttttaaaagggccatggagggtcagcataactacctatgcgcgggaagaaatgattgcatagttgacaagattaggaggaagaattgtccagcctgcagactgaggaaatgttgtcaggccggcatggtgcttggtgggttccgtaatctgcacattgatgaccagattaccttaatccagtactcatggatgagcctcatggtgttcggtctcggctggcgcagttataaacacgtctcaggccaaatgttgtatttcgcacccgacttgattctgaatgagcagagaatgaaggagtcttctttttacagcttatgcctgaccatgtggcaaataccccaggagttcgtcaagctgcaggtctctcaggaggagtttctgtgcatgaaggtgctgctcctgctgaacacaatacctctggagggcctgcgatcacagactcagtttgaggagatgcgatcttcatacattcgggagctgataaaggccatcgggctaagacaaaaaggggtcgtgagcagttcccaacggttttatcagctcacaaaattgctggacaatctccacgacctagtaaaacagctgcacctgtattgtctgaacacattcattcagagcagagctctgtcggttgagtttcctgaaatgatgtcagaggtgattgctgctcagctccccaagatcttggctgggatggtgaagcctctactctttcacaagaagtag

SEQ ID NO: 16789 - DNA, 2802 bp, Artificial Sequence
  Description of Artificial Sequence: Synthetic coding sequence
atgacagagctgaaagctaaagggccgagggctccccacgtggccggcggacccccaagtcctgaagtggggtcacctctattatgccgacccgcagccggcccctttcccggctcccagacctccgacaccctaccggaggtaagtgcgatccctatctccttagacggccttctgttcccgcgtccctgtcaggggcaagaccctagtgatgaaaaaacccaggatcagcagagtctgagtgacgtggagggtgcctattcccgagctgaggctactcggggcgctggaggctcatcatcaagcccacctgaaaaagactccggactactggatagcgtgctggatacgctgctcgccccttcaggaccaggacagtcccagccctctcctcccgcctgcgaggttacttcctcctggtgtttgttcggtcccgagttgccagaggaccctccggccgcccctgccactcagagagttttgtcgcccctcatgagtcgatctggttgcaaggttggagacagcagcggaaccgccgccgcgcacaaagtcttgccccggggcctgtccccagcccggcagttgctgctgcccgcatccgagagcccgcattggagcggggcacctgtgaaacccagccctcaagcagccgcggttgaagtggaggaggaggacgggtctgaatctgaagaatctgcgggacctctactgaagggcaaaccccgcgcgttgggcggtgccgcagctggaggaggagccgccgccgtcccacccggcgccgccgcgggtggggttgctctggtgccaaaagaggactctcgatttagtgcccctcgggtggcactcgttgaacaagatgccccgatggccccgggcagaagccccctggcgacgacggtgatggattttatccacgtccctatccttccgctcaatcacgcactgttggccgccagaactcgacaacttctcgaggacgaaagttacgatgggggagccggcgctgcctcagcttttgcccctccccgttcttctccatgtgcatcctctacaccggtggccgtgggggactttccagattgtgcatacccccccgatgctgagcctaaagacgatgcatatccactgtactcagattttcagccccctgcgcttaagattaaagaagaggaggagggggctgaagccagtgctagatctcctcggagttacctcgtcgcaggcgcgaaccctgcagcattccctgatttcccgctcgggccaccaccgcctctaccacctagggccaccccaagtcgcccaggtgaagcagccgtgacagcagctccggcaagtgcatcggtgtctagcgctagcagcagtggttccactctggaatgtatcctgtacaaggctgagggcgctcctcctcagcaaggcccctttgcacctcccccatgcaaggcacccggcgccagcggatgtctccttccccgtgacggccttccctccaccagcgcatctgcagccgcagctggtgccgccccagctctctatcctgcgctggggctgaatgggctgcctcagctgggataccaggcggcagtcctaaaagaagggttaccccaggtgtatccaccctacttgaactatctgcgtccagacagcgaagctagccaatccccccagtacagcttcgagtccctaccccagaagatatgtctcatttgtggggacgaggcaagcgggtgccactacggtgttcttacctgtggaagctgcaaggtcttctttaaacgcgctatggaaggtcagcataactacctatgcgctgggcgcaacgactgtatcgtggacaaaatacgtaggaagaattgcccggcctgtagactcaggaaatgctgccaagctggcatggtactgggaggacgcaaattcaagaaatttaataaggttagggtggtaagggccctggatgcagtggctctcccccagcccgtgggagtgccaaatgagagccaggcgctgtcacagagattcacatttagccccggtcaggacatacaattgatcccacctctgataaacttattaatgtcgattgaacccgatgttatctatgctggccacgataatacaaaacccgatacctcctcttcactcctcacaagtttgaaccagctgggcgagcggcagctactcagcgtggtaaagtggagtaagagtttgcccgggtttcgcaaccttcacatcgacgaccagattacactgatacagtacagttggatgtccttaatggtatttggccttggttggagatcatacaagcacgtttcgggacaaatgttatactttgcgcccgacttaattctcaacgaacaacgcatgaaagagagcagcttttatagtctgtgcttgacgatgtggcaaataccacaggagttcgttaagctacaggtgtcccaggaagagttcctctgtatgaaagttctccttctgctgaacactattcctttggaggggctccgctcgcagacacaatttgaggagatgagaagttcttacattagagagctgattaaggctattggactcaggcagaagggggtggtgagcagttcacagcggttctatcagctgacgaaactgctggataatctgcatgacctagtcaagcagcttcatctctactgcctcaatacattcatccagtcacgcgccctcagcgtagagttcccggaaatgatgtccgaggtgatcgcggcgcaactgcccaagatcctcgcaggaatggtcaaaccactactgtttcacaagaaatag

SEQ ID NO: 16790 - DNA, 2088 bp, Artificial Sequence
  Description of Artificial Sequence: Synthetic coding sequence
atgacggagctcaaagctaaaggaccacgagcacctcatgtcgccggaggacccccttcgcccgaggtaggaagtcctctgctgtgtcggccagcagccggtccgtttccgggaagccagacttccgacacactcccagaggtgtccgctatacccatttctctggatggacttctttttccaagaccctgtcaaggtcaagatccttcagatgagaagacacaagaccagcaaagtctgtccgacgtcgaaggcgcttactcccgagcggaagccacccggggcgcaggagggagtagctcatcacctcctgagaaggactctgggctacttgacagcgtgctggacacccttctggcccctagcggtccaggacagtcacagccttccccaccagcatgcgaagtgacctcctcttggtgtctgttcgggcccgaattgcccgaagatccaccagccgcgccagctacccagagggtcctgagccccctgatgagccgcagtggctgtaaggttggcgacagttctggcactgcagctgcacataaagtcctaccacggggtctgtctcctgccaggcagctgctgctgccagcctccgagagccctcactggtcaggagcccctgtgaagccaagtccacaggctgccgcagttgaggtggaggaggaggatggcagtgagagcgaagagtccgccggtcctctcctgaaaggtaagcctcgagccctgggcggagctgccgccggtggaggggctgcggcggtcccaccgggagccgcagcagggggggtggcccttgtcccaaaggaggattctcggttcagcgcccctcgtgtagcacttgtcgaacaggatgctcctatggcgccaggccgatccccactcgctacgactgtgatggacttcattcatgtcccaatcttgcctttaaatcacgcactcctcgcagccagaaccagacagcttcttgaagatgaaagctatgacgggggggccggagctgcaagcgcattcgcgcccccaagaagtagcccgtgcgcttcttccacccccgtcgcagttggggattttccagattgcgcatatcctcccgacgccgagccaaaagatgatgcctaccccctctattctgattttcagccacctgccctgaagataaaggaagaagaagaaggcgccgaagccagcgctcggtctccaagaagctatcttgtagctggggcgaatccggcagcatttccagactttcctctggggcctcctccccctctgccccctcgggcaacaccttcccggcctggtgaagcagccgtgacagccgctccagccagcgcatccgtttcgagcgccagctcttccggaagcactcttgaatgcatcctctataaggccgaaggagccccccctcagcagggaccatttgctcctccgccttgcaaggcccccggagccagtggctgccttctcccacgcgacggcttgccaagcacctccgcctcggcggcggctgctggggcagcacccgcgctttaccctgcattgggcctgaatggtctgccacaactgggctatcaggcagctgtcttgaaggaaggcctgccccaagtgtatcccccatacctcaattacctgaggccggactctgaggcctcacagtccccccagtacagctttgaaagtctgcctcagaaaatttgcctgatttgtggcgacgaggcctcaggttgtcattacggtgtgctgacttgtggctcctgtaaggtctttttcaagagggccatggagggtcagcataattacctgtgcgccgggaggaatgattgcattgtagacaaaattcgcaggaaaaattgtcccgcttgccgactgaggaagtgttgtcaggcgggaatggtgctgggtgggttccgcaacctgcacatcgatgatcagattaccctaatccagtattcttggatgtcccttatggttttcggactgggctggagatcgtataaacacgtgtccggacaaatgctgtactttgcccccgacctaattctgaacgattcatttgggcgggcaactaaaagcaatcccgtgtag

SEQ ID NO: 16791 - DNA, 2295 bp, Artificial Sequence
  Description of Artificial Sequence: Synthetic coding sequence
atgaccgagctaaaggctaagggtcccagggctccacatgtggccgggggtcccccatctccggaggttggaagcccccttctgtgccggcctgcagcagggccgtttcccggtagccagaccagcgacaccttacccgaggtcagtgcaattccaatctcactggacggtttacttttcccaagaccctgtcaaggacaggacccttccgacgagaagactcaggatcagcagtcattgtcagacgtggagggcgcttactcacgagctgaggccacccggggtgcagggggctcctcctcgtctccgccggagaaggactcaggtctcttggacagcgttctcgacacattgctggccccatccggacctggccagagccagcccagtccaccagcatgcgaagtgactagctcctggtgcctctttggacccgaactgccagaagacccacctgccgcacctgcaactcaacgggtcctcagtccactcatgagtagatctggctgtaaggtaggcgattcctcaggcactgctgccgcacataaggtactgccaagggggttgtcaccagccaggcaattactactccccgcatctgagtcccctcactggtccggggctcccgtgaagccttccccacaggctgccgctgttgaagtcgaggaggaagacgggagcgaaagcgaggagtccgcgggaccccttctgaaaggcaaacccagagcattgggcggcgccgcagctggcggtggcgctgctgcggtgcctccaggagcagcagcaggtggagtggccctggtgcctaaggaagattcccgcttctccgcgcccagggtggcgctcgtggagcaggatgcgcccatggcgcctggcaggtcccctcttgccacaacagtgatggactttatccacgttcctatactgcccctcaaccacgcccttctcgctgcacgcacaagacagctcctggaggatgagtcttacgacggtggcgccggggcagctagcgcttttgcccctcctaggtcctcgccatgtgcgtcctcaacgcctgtcgcagtcggagatttcccagactgcgcatacccgcctgacgcagaacccaaggacgacgcctaccccctatacagcgacttccagccaccagcactgaaaatcaaggaagaagaggagggcgcagaggcttccgctcgttccccacggagctaccttgtcgctggagctaatccagctgctttccctgactttcctctggggccgcctccccccctgccaccacgcgccacaccttcccgtcccggcgaggccgctgtgacagctgcccccgcctcggcctcagtcagcagcgccagcagctcagggtccaccctagagtgcatactatacaaggctgaaggtgcccccccccaacaaggccccttcgcgcctcccccctgtaaagcccccggagccagtgggtgcttgctgcctcgggacggactaccttcaacaagcgcaagcgcagctgccgctggtgcagcaccggcgttgtatccggctcttggactgaacggtcttccacagcttggataccaggcagcagttctcaaagaaggcttgccccaggtataccctccctatcttaattacctgaggcctgattccgaagcttcacaaagcccacagtattctttcgagtctctacctcaaaaaatctgcctgatttgtggagacgaggccagcgggtgtcattacggcgtgctaacatgtggatcttgcaaagtctttttcaagagggccatggaggggcgcaagttcaagaaattcaacaaagtccgcgtggtcagggctttggacgccgtcgccctgccacagccagttggggtgcctaacgaaagtcaggccctctctcaacggtttacatttagtcccggccaagatattcagttgatcccgccccttattaatctgctgatgtccatcgaaccagacgtaatctacgccggacatgacaatactaaacccgacacctcttctagtctcctgacctcactcaatcagcttggcgagagacagcttctgtcggtggtgaaatggagtaagtcattacccgggtttagaaacttgcacattgatgatcagatcaccttgatccagtacagttggatgagtctaatggttttcggactggggtggagatcttacaagcatgtttccgggcagatgctctattttgccccagacttgatcctgaatgagtcgcacagaagtctatcctctttcaaactggcgaaaaagtcatcatctgtctag

SEQ ID NO: 16792 - DNA, 1020 bp, Artificial Sequence
  Description of Artificial Sequence: Synthetic coding sequence
atggaagggcaacacaactacctctgcgcgggtcggaatgactgtatcgtggacaagatcaggagaaagaactgccccgcctgtcgcctcaggaaatgttgccaagcaggaatggtcctagggggccgcaagtttaaaaaattcaacaaagtccgggttgtcagggcactcgacgccgttgctctacctcagccggttggggttccaaacgaaagtcaagccctatctcagcggttcaccttcagccctggccaagatattcaactgatccctcccctcatcaatctactgatgtctatcgaaccagatgtgatctacgctggtcacgacaacacaaagccggatacttcaagttctctgctgacgtcactcaaccagctgggggagaggcagctgttatctgttgtgaaatggagtaaatcgttgcccggcttccgtaacttacatatcgacgaccagataacattgattcagtactcctggatgtccttgatggtgtttggtctcggctggagaagctataaacacgtgtcaggccaaatgctttactttgccccggacctaattcttaatgagcagagaatgaaggaatccagcttctactccctatgcctgacaatgtggcagatcccccaggaatttgtgaaactgcaggtttcacaggaagaatttctttgcatgaaagtgctgctgctgctcaatactatcccactggaagggttgcgcagccagacccagttcgaagagatgcggtcctcatacatcagggagctgatcaaagcaattggtttaaggcagaaaggcgttgtatcctcctctcagcgcttctaccagctcactaagctgcttgataatctgcacgatctcgtgaaacagctacatttgtattgcttgaacactttcatacaatcgagagcgctttcggtggagttcccggaaatgatgagcgaggtgattgccgcacagctgcctaaaattcttgccggaatggtaaaaccactgctgttccataaaaagtag

SEQ ID NO: 16793 - DNA, 2412 bp, Artificial Sequence
  Description of Artificial Sequence: Synthetic coding sequence
atgaccgaactgaaggccaaaggcccccgcgcacctcacgtggccggcgggccaccctcccctgaggtaggatcgccattactgtgcagacccgccgcgggcccgttccccggctctcagacaagtgacacactgccagaagtctcagcaattcctatctcgttggatgggcttctgttcccgagaccatgccagggccaagatcccagcgatgaaaaaacacaggaccaacaatccctcagcgatgtggagggtgcctactctcgagccgaggcgactcggggcgcaggcggcagctcttctagccctccagagaaagactccggattgctggatagtgtgctggacacactcttggccccatcaggccctggccaaagccagccatctccccctgcctgcgaagtgacctcgagttggtgcctctttggccctgaactgcccgaggatccccccgcggctcctgccactcagagggtacttagtccactcatgtccaggtccggctgtaaagttggtgattccagcggaaccgccgcggcacataaagtgctgcctaggggcctcagcccggcacgccaattgctgctgcccgcatcagaatctcctcattggtcaggggcaccagttaagcccagtccccaggctgccgctgtcgaagtcgaagaggaagatggtagtgaaagcgaagagtctgccggccctttgctcaagggcaaacctagggctctaggcggcgccgccgccggggggggcgccgctgcagtccctcctggcgcagctgcaggtggagttgctctagtgcctaaggaagatagtaggttttcagctcctagagtagcgttagtggagcaagacgcacccatggcaccgggacgttcaccattagcaacaactgtaatggacttcattcatgtgcccattctacctctgaaccatgcgttgctagccgccaggactagacagctgttagaagatgagtcatacgatgggggagccggtgccgctagcgccttcgctcctccaagaagcagcccctgtgcaagcagcactccggtagctgtgggagattttccagattgtgcatacccaccggatgccgagcctaaggacgatgcctatcccctgtactcagattttcagcctcccgctttgaaaatcaaggaggaagaagagggagcagaggcatccgcgagatcaccaagatcatacttggtggcaggcgctaatccagccgctttccccgactttcccttggggccacccccaccgctgccccctagggccaccccgagtcggccaggcgaggccgctgtgacggccgcccccgctagcgcctccgtttctagtgcatcaagtagtggtagtacacttgaatgtattctgtacaaagccgagggggcacccccccagcaaggccccttcgcccctcccccatgcaaggcccctggtgcgtcagggtgtctgctgcctcgggacgggctacccagtacatctgcatcagccgcagccgccggggccgccccagctctgtatccagcactgggcctgaatggactaccccagttgggataccaggccgccgtcctgaaagaagggctaccccaggtctacccgccttaccttaactacctgagacctgactctgaagcctcacagtccccgcagtactcattcgaaagtctcccacagaagatttgccttatctgcggcgacgaggcttctgggtgtcactacggtgtccttacgtgtggttcctgtaaggtgttcttcaaaagagccatggagggacagcacaactacctgtgcgccggcagaaatgactgcattgttgataagataaggcgcaagaactgtcctgcttgccggctccggaagtgctgccaggccggcatggttctgggaggcaggaagttcaagaagttcaacaaagtgcgggtcgttagagctctggacgcagtggccttgccacaacctgtcggtgtgccaaacgaaagccaggcccttagccagcgatttaccttcagtcctggccaagacatacaactgatcccgcctctgataaatctgcttatgagtattgagcctgatgtaatttacgctggccatgacaataccaaacccgataccagttctagcctgttaacgtctctgaatcaactgggtgagcgacagctcctctctgtggtcaaatggtccaagtcattacccgggttccggaatctgcacattgacgaccagatcactctcatccagtactcctggatgtcactgatggtgttcggcctgggttggaggagctataaacacgtcagtggccagatgctttatttcgccccagatctaatattaaacgagtctcaccggtcactgtcttcctttaagttggccaagaaaagttcatctgtgtag

SEQ ID NO: 16794 - DNA, 2073 bp, Artificial Sequence
  Description of Artificial Sequence: Synthetic coding sequence
atgactgaactcaaggccaaaggaccgcgggccccacacgtcgcgggcggccctccctccccagaagtgggctcccctttactgtgtcggcccgccgccggcccatttccgggctcccagacaagcgataccctcccagaggtaagcgccatccctatctccttggatgggcttttgttcccaaggccgtgccagggccaagacccttctgatgaaaaaacccaggatcagcagtctctcagtgacgtggaaggggcctacagcagggccgaggccacccgcggggcagggggaagcagctcgtcacctccagagaaggattcaggcctgcttgatagcgtactggacactctgcttgcccccagcggacccggtcagtcccagccttcccctccagcatgtgaagtgacctcctcttggtgtctgtttggcccagaactgccagaagatcccccagctgctccagcgacacagagagttctgtcaccactgatgtcaagatccggctgtaaagtcggggactcatctggtacggccgccgcccataaggtactgcctagaggcctcagcccggccagacagttgctgctgccagcctcagaaagcccacactggagtggagcccccgtaaagccttctccccaagctgctgccgtggaagtcgaggaggaagacggaagcgagagcgaagaaagtgccggaccccttttgaaaggaaagccccgcgcccttggcggagccgcagccggcggcggcgctgccgctgttccccccggcgccgcagccggcggagtggccctggtgccaaaggaggactcccggttcagtgcgcctcgggttgctctcgtggaacaggatgccccgatggctcctggccggtccccactggcaacaactgttatggatttcattcatgtgccaattctgccactgaaccacgccctacttgccgctcggacaagacagctcttggaagatgagtcctatgacggcggggcaggcgcagcctccgcttttgcacctcctcggagctcgccttgcgcttcaagtactcccgtggccgtgggggacttccccgattgcgcctatccaccagatgcggagcccaaagatgacgcttacccgttgtatagtgattttcaacctcccgcactgaaaatcaaggaagaggaggaaggagccgaggcctctgctagatcaccccggtcctacctcgtcgctggtgctaaccccgctgccttccctgactttccgcttggcccacctccgcccctgccacctcgcgctactccctcaagacccggcgaagccgccgtcaccgcagccccagcttccgccagcgtgtcgagcgctagttcatccggctccacgttagaatgcattctttacaaggccgagggcgccccacctcagcagggacccttcgcaccccctccgtgcaaagctccgggggcgtctggctgcctgctgccacgggatggacttccttcaactagtgcgtcagccgcggccgccggcgcggctccagccttgtatcccgccctcggccttaacggcttgccccagctgggctaccaggcggccgtactgaaggaaggtctgccacaggtctatcctccctatctgaactacctccggcccgacagcgaggcaagccagtccccccagtacagcttcgagagtctgccccagaagatctgtctcatttgcggagatgaggcttctggatgccactatggagtccttacttgtggctcgtgtaaggtatttttcaaacgtgcaatggagggtcagcacaattatctgtgcgcaggtagaaacgattgtatcgtggataaaatacggcgcaaaaactgcccagcctgtcgcctgcgaaagtgttgccaagcggggatggtgctggggggcttcagaaacctgcacatcgatgaccagattacacttattcagtattcgtggatgagtcttatggtgtttgggttaggttggcgcagctacaagcacgtgagcgggcaaatgttatactttgcccctgacctcatcctgaatgaggaatccatcgtgactagctag

SEQ ID NO: 16795 - DNA, 1410 bp, Artificial Sequence
  Description of Artificial Sequence: Synthetic coding sequence
atggatgtcgaaaatgaacagatcctcaatgtaaatcctgcggacccagataatctgtccgactcactcttcagcggcgatgaggagaacgccggcaccgaggagatcaaaaatgaaattaatggcaattggatcagcgccagttccatcaacgaagctagaatcaacgctaaagccaagagacgcctacgcaagaatagctcccgggatagcggtcgcggcgacagtgtctccgactctgggagtgacgctctccgctctggcctgaccgttccaacctcgcctaagggcaggctgctggaccgccgatctaggtccggaaagggcagaggccttccaaagaaggggggtgcaggaggcaagggggtgtggggaacacctggccaggtttacgatgtggaggaagtagatgtgaaagatcccaattacgacgacgatcaagaaaactgtgtgtatgagacggtggtgctccccctggacgagcgcgccttcgagaagacacttacacctattatccaagagtacttcgagcacggagacactaatgaggtagcggaaatgttacgcgacctgaatctaggagagatgaagtctggggtaccagtactggctgtgtcgctggctctggagggaaaagcaagccacagagagatgaccagtaaattgctgagcgatctgtgtggcaccgtgatgagtactaccgacgtcgaaaagtcttttgacaagttgttgaaagacctgcctgagctggccctcgacactccccgggccccccaactggtgggccaattcatagcaagagctgtaggagacggtattctctgcaacacctacatcgatagttacaagggtaccgtcgactgcgtacaagcgcgggctgcgctcgacaaggcaactgtcctgttgtccatgtcaaaaggtggaaaaaggaaagatagtgtgtggggcagcggtggaggtcaacagtctgtgaaccacctcgtaaaggagattgatatgcttctgaaggagtacctgttgtcgggggatatctcagaagccgaacactgtttaaaggaacttgaagtgccccacttccaccatgagctcgtctatgaggccatcataatggtgctcgaaagcacaggcgaaagtacctttaaaatgatcctggacttactgaagagcctctggaagagttcgaccattaccgtcgaccagatgaaaagaggttacgagcgcatttataacgagatcccagatataaacctagatgtaccccatagctactctgttctcgagaggtttgtggaggaatgttttcaagcgggtatcatatctaaacagctcagagacctgtgtcccagcagagggcgcaagcgattcgttagtgagggagacggcgggagactgaaacctgaaagttactag

SEQ ID NO: 16796 - DNA, 1377 bp, Artificial Sequence
  Description of Artificial Sequence: Synthetic coding sequence
atgacaaaatatcccgacaatctgtccgattctctgttctcaggggacgaagagaacgccgggacagaagagattaaaaacgaaataaatgggaactggatatccgcctcttcaatcaatgaagcaagaatcaatgccaaggccaaaagaaggctgaggaaaaattcttctcgtgacagtgggcgcggggatagtgtaagtgattcagggtcagacgccctgcggtctggactgactgtgccgacctcaccgaagggcagattattggacagacgtagtaggagtgggaaaggacgcgggcttcccaagaaagggggagccggcggaaaaggggtgtggggtactcctggtcaggtctatgacgtcgaagaagtcgatgtgaaggaccccaattatgatgatgatcaggagaattgtgtctacgagacggtggtgctccctctcgacgaacgggcctttgaaaaaactctcacaccaatcatacaagagtattttgagcatggggatactaacgaggtggcagagatgctcagagaccttaacctcggagaaatgaaaagtggcgttcccgtgttagctgtgtccctggctttagagggtaaggcatcacacagagaaatgacctctaagctcctttctgacctgtgcggcaccgttatgagtaccacagacgtagagaagtcattcgacaaactgctgaaagatctgccggagctggcactggatactccacgcgctccacaactggtgggccaatttattgcccgtgctgtcggtgacggcatcttatgtaacacctatatcgactcatacaagggcaccgtagattgcgtgcaggcccgggccgccctggacaaggctactgtgcttctgagtatgtcaaaagggggaaagaggaaggacagcgtttggggctcagggggcgggcagcagtcagtaaaccacctggttaaggagatcgacatgctgctaaaggaatatttactctctggagacatctcggaagctgaacactgtctaaaggaactggaggtgccgcacttccatcacgagctggtgtatgaagccattataatggtgctggaatctaccggagagtccacctttaagatgattctcgacttgctgaaaagtctgtggaagtcgtcaaccatcacagtggaccagatgaaaaggggctacgagagaatttataacgaaatccccgatatcaaccttgatgtgccccactcctacagcgtcctggagcggttcgttgaggagtgcttccaggccggcattatctccaagcagctcagagacctgtgtccctcaaggggccgaaaacgattcgtgagtgaaggtgacggcggtcgtctgaagcccgagtcatattag

SEQ ID NO: 16797 - DNA, 696 bp, Artificial Sequence
  Description of Artificial Sequence: Synthetic coding sequence
atggatgtggagaatgagcaaattcttaacgtcaaccccgcggagaatgccggcaccgaagagattaaaaacgagattaatgggaactggatcagtgcctcatccatcaacgaagcacgcattaatgccaaggctaaacggcggctgaggaagaactcctccagggattcaggccggggcgattccgttagtgattctgggtccgacgctctccgctccggactgacggtgccgacaagtcccaagggtcgccttctggatagaagatcccggagcggtaaaggcagaggactgcccaagaaagggggggccggggggaaaggcgtctgggggacccctggacaggtgtatgatgtggaggaggtggacgtgaaggatcccaactacgacgatgatcaagagaattgcgtgtacgagacagtagttctgccattggacgagcgcgcctttgagaaaacattgacccccatcatccaagaatactttgaacacggggacaccaacgaggtggcggaaatgttacgagacctgaacctcggagaaatgaagagcggcgtcccagtgcttgccgtctccttggctctggaaggtaaagcctctcaccgcgagatgacatccaaattattgagcgatctgtgcggaacagtgatgagtaccacagatgtggagaagagttttgacaagctactcaaatag

SEQ ID NO: 16798 - DNA, 786 bp, Artificial Sequence
  Description of Artificial Sequence: Synthetic coding sequence
atgttcgaggcccgcctcgtccagggctctatcctcaagaaggttctggaagcccttaaagatttaattaatgaggcttgttgggacatctcatcaagtggggtgaacctgcagtcgatggactcttcacacgtttcactggtccagctgacattgagatctgaaggcttcgacacctatagatgcgatcgaaacctcgctatgggagttaacctgacttcgatgagcaagatattgaaatgtgccggtaacgaggatattatcactttacgggccgaagacaatgctgatacactagccctcgtatttgaagctcctaaccaggagaaagtgtccgactacgaaatgaagcttatggacctggacgtcgagcagttagggatcccagaacaagaatactcatgcgtcgtgaaaatgccttcaggagaattcgccaggatatgcagggatttgtcgcacattggtgacgccgtggtcatctcgtgtgccaaggatggtgtaaagtttagcgccagtggggagttgggcaacgggaatatcaagctctcccagacctccaacgttgataaagaagaagaagcagtcaccatcgaaatgaacgaaccagtgcagttgacttttgcgttgagatacctcaatttcttcaccaaggcaactccgctctcgagtacagtgaccctgtcaatgtctgctgacgtgccattggttgtagaatacaaaatagccgatatgggccatctgaagtactatcttgctccgaagatcgaggatgaggagggcagctag

SEQ ID NO: 16799 - DNA, 786 bp, Artificial Sequence
  Description of Artificial Sequence: Synthetic coding sequence
atgtttgaggcacgcctcgtccaagggtccatcctgaaaaaagtgctcgaggcgttaaaggacctgattaacgaggcatgctgggacatttcttcttcaggtgtgaacctgcagtcaatggatagctcccacgtgtctctggtgcagctcactcttcgctccgaaggattcgacacgtataggtgtgaccgaaacttggccatgggcgtgaacctgactagcatgagcaaaattctgaagtgtgctggcaatgaggatatcatcactctgcgcgccgaggataacgctgatacacttgcgctggtgtttgaagctccaaatcaggagaaagtatcggattatgagatgaaactgatggatctggatgtagagcagctgggaatcccagagcaggagtacagctgtgtagtgaagatgccttctggcgagttcgcgagaatttgcagggatctcagccacattggagacgcagttgtgatttcctgtgctaaagatggagtcaagttttccgctagcggagaattgggcaatggtaacatcaagctgtctcagacatcaaatgtggataaggaggaagaagccgttaccattgaaatgaacgaacctgttcaacttactttcgctctccgatacctcaacttcttcaccaaagcgaccccactgtcttccacagtgaccctgtcaatgagcgccgacgtaccattggttgtcgaatacaagatcgcggacatgggccacctgaaatattacctcgctcctaagattgaagatgaagagggcagttag

SEQ ID NO: 16800 - DNA, 1140 bp, Artificial Sequence
  Description of Artificial Sequence: Synthetic coding sequence
atgtcctcaccgtctctctccgatctaggaaagcgggaacccgcagctgctgccgacgaaagaggtacacagcagaggcgggcttgtgctaatgccacatggaatagtattcacaacggagtgatcgctgtcttccagcggaaaggcttacccgatcaagaactgttctcattaaacgaaggggtccgccagttactcaagacagaactcggatcttttttcaccgagtacctgcagaaccagctgttgaccaagggaatggtcattctgcgcgacaagattaggttctatgaggggcagaaactcctcgactccttggccgaaacgtgggacttcttcttctcagatgtgctgcccatgcttcaggccatcttctatcctgtgcagggtaaggaaccatctgtacggcaacttgcgctactccactttaggaacgcaataacgctgtccgtgaagctcgaggacgccttagcacgtgctcatgcccgcgtaccaccggcaattgtgcaaatgctgcttgtgctgcagggcgtccacgagagcaggggggtgactgaggactatttgaggctcgaaaccctggtacaaaaagtggtgagcccatacctgggaacctacggcttgcattcctctgaaggcccatttactcattcttgtatactggagaaacgactgttgagaaggagtaggtctggcgacgtgctggccaagaaccctgtggtgaggtcgaaatcctataacactcccctgttgaatcctgttcaggagcacgaggccgagggtgctgccgccggcgggacctccatacggcgacacagtgtgtccgagatgacatcttgcccagaaccccagggattctctgatcctccaggacagggtcccacaggtacattcagatcttctccggcccctcattctgggccatgcccctcacgtctctatcctacaacccaacctcccgaacagggcttagaccccacgcgctccagcttgcctcgctccagtcccgagaacttagtcgatcagatcctcgagagcgttgatagcgacagtgaaggtatttttatcgacttcggccgcggcaggggcagcgggatgtccgatttggagggatcagggggccgccagtctgtggtttag

SEQ ID NO: 16801 - DNA, 1167 bp, Artificial Sequence
  Description of Artificial Sequence: Synthetic coding sequence
atgagaacacttcggagactcaagtttatgtcatctccaagcctgtccgacctgggcaaaagagagcccgcagctgcagcggatgaacgcggcactcaacagcgccgggcatgtgctaatgctacttggaattctatccacaacggcgtgatcgctgtatttcagagaaagggcctgcccgatcaggagctattctctctgaacgaaggcgtcaggcagctactgaaaaccgagctgggatctttctttaccgaatacctccagaatcagctccttactaagggcatggtcatccttagagacaaaatcagattctacgagggccagaaactgctcgactccctcgccgagacatgggatttctttttctcagatgttttgcctatgctgcaagccatcttttaccccgtgcaaggcaaagaaccatccgtgaggcagctcgccctgctccatttcagaaacgcaatcactctgagtgtaaaactagaggacgcactggcaagggcccatgccagggtgccccccgctattgtgcaaatgctgctggttctgcagggagtccacgaatcgcggggcgtgaccgaagactacttgcggctggagaccttagtacagaaggttgtgtccccatacctaggcacttatgggctccatagcagcgaaggcccattcactcatagctgtattctcgagaagaggctacttaggaggtcaagatccggcgatgtgctggcaaaaaaccctgtagtgcgttcaaaaagctacaacacacccctactaaacccggttcaggagcacgaagccgaaggtgccgccgccgggggcacatcaataagacgccattcagtcagcgagatgaccagctgcccagagcctcaggggtttagcgaccctcccggacagggtcccactggaacatttaggagcagccctgcccctcactccggtccttgtccctcccgtctctacccaacaactcagcctccggagcagggacttgatccgaccagatcctccttgccgcgctctagccctgagaaccttgtcgatcaaatcctggagagcgtggactcagactccgagggcatatttatagacttcggtcgcggcagagggagtggaatgagcgatttagaggggtctggagggagacaatctgttgtgtag

SEQ ID NO: 16802 - DNA, 804 bp, Artificial Sequence
  Description of Artificial Sequence: Synthetic coding sequence
atgagctccccctcactgagcgatcttggaaagcgcgaaccagcagctgctgccgacgagagaggcacacagcaaagaagggcctgtgccaacgccacatggaatagcattcataatggcgttatagctgtctttcagaggaagggtctcccggatcaggagctcttttcattaaacgagggggtcaggcagctactgaaaactgaactgggctcattctttactgagtatctgcaaaatcagcttctgaccaaaggaatggtaatcctgagagataagatccggttttatgagggtcagaagctcctcgactcccttgcagagacctgggattttttcttcagcgatgtgctgcctatgctccaagccatattttaccctgttcaaggaaaagaacccagtgtacgccagctcgccttgctccacttcagaaacgccatcacactgagtgtgaagctggaagacgcactggcgagagcccatgctcgagtgcctcccgccatagtgcagatgctgttggtgctgcagggagtccacgagtcaaggggcgttactgaggactacctgcgactggagactctcgtgcagaaggtcgtcagtccctaccttgggacctacggcttacacagctcggagggcccgtttacccactcttgtatactcgagaaaaggctgctgagacggtcaaggtccggtgacgttctagctaaaaatcctgttgtccggtccaagagctacaatacgccactcttgaatccggttcaggagcatgaagccgaaggtgcagcggccgggggcacttag

SEQ ID NO: 16803 - DNA, 681 bp, Artificial Sequence
  Description of Artificial Sequence: Synthetic coding sequence
atgagcagcccttctctttctgatctaggaaagcgtgagcccgccgctgccgctgatgagcgaggcactcagcaacggcgcgcgtgtgccaacgccacttggaacagcatccacaacggcgttattgccgtgttccagcggaagggtctccccgatcaagagcttttcagtctgaatgaaggggtcaggcagttgctgaaaacagaacttgggtccttttttactgagtatttacagaaccaactacttaccaaaggcatggttatcctccgcgataagatcaggttctatgagggacaaaaactactggactcactcgctgagacttgggacttcttcttctcagacgtgctgcccatgctccaggccatcttttaccctgtacagggaaaagaaccctctgtgagacagctcgctcttcttcacttcaggaatgcaatcactctgtccgtgaaactggaagatgcgctcgcacgggcccatgccagagtgcccccggctatcgttcaaatgttgctggtcctgcagggcgtccacgagtccaggggtgtgaccgaagactacctgcggttggagactttggtgcaaaaagtggtaagcccctacctggggacatacggcctgcactcctctgaagggccatttacccattcttgcattttggaaaagcgcctcctgtag

SEQ ID NO: 16804 - DNA, 1236 bp, Artificial Sequence
  Description of Artificial Sequence: Synthetic coding sequence
atggtttgtctcgagctctctcagcgggaggcgtgggggtccggcagccctgaaaagatgccagcccagccggaagggctctatcgccttaaattcatgagtagcccaagtttaagcgacctcggaaagcgagagcctgccgcagccgcggacgaaaggggaacacagcagaggagagcatgtgctaatgcgacgtggaacagcatccacaacggcgtgatcgctgtctttcagcgtaaagggctccccgatcaggagctgtttagtctcaacgagggggtaagacaacttctgaagacagagctgggctctttttttactgagtacctgcagaatcagctgctaaccaagggcatggtgatcctgcgagataagatccgtttttacgaaggccagaaactgctcgactcacttgctgaaacttgggatttctttttctccgacgtcttaccaatgctgcaggcaatcttttatccagtccagggaaaagaaccctcagtgaggcaactagccctcctgcattttagaaatgctatcacgcttagcgtgaagctggaggatgctctggcgcgcgcccacgcccgggtgccccccgcgatcgtgcagatgctgctagttctgcaaggtgttcatgagagcagaggtgtgaccgaggactatctacgcttggagacactggtgcaaaaagtggtctctccatatttagggacttacgggctgcattcttccgaagggccctttacacattcttgcatcctggagaaacgcctgctgaggaggtccagaagcggagatgtgctggcgaagaatccagtagtgcggtcgaagagctacaatacaccactgttgaatcccgtacaggagcacgaggccgagggcgcagctgccggtggaacctctatacgaaggcactctgtctctgagatgacgtcttgtcctgagccccaaggtttctctgaccccccaggtcaggggccaaccggcacattccggagtagtcctgctcctcactcaggcccttgcccaagccggctgtaccccaccacccagccacccgaacagggcctggaccccacacgtagttcactccctaggtccagtcccgaaaacctggtcgaccagattctcgagagtgtagactcggactctgagggaatttttatcgatttcggacggggccgtggaagcggcatgtcagatttggaaggatctggggggaggcagtccgtggtctag

SEQ ID NO: 16805 - DNA, 2649 bp, Artificial Sequence
  Description of Artificial Sequence: Synthetic coding sequence
atggagcctgctcctgcaaggtcccctcgcccccagcaggaccccgccagaccacaggagcccactatgcctccgcctgaaactccttcggaaggtcgccagccctcaccgtccccatcacccaccgagcgcgctcctgcgtctgaagaggaatttcagtttctacggtgccagcagtgtcaggccgaggcaaagtgcccaaaactgctgccctgcttgcatactctttgcagcggctgtcttgaggcttccggaatgcagtgccccatctgtcaagccccttggcccctgggcgcagatactcccgctctcgacaatgtgttttttgagtccctgcagcgcagacttagcgtgtataggcagatagtcgatgcccaggccgtgtgtactcgatgtaaagaatccgcagatttttggtgttttgaatgtgagcagcttctgtgtgcgaagtgttttgaggcacaccaatggttccttaagcacgaggcacggccactggccgaactgcgaaatcagtctgtccgagagtttctagatgggacgagaaaaacaaacaatattttctgtagtaaccccaatcaccggacgcctactctgaccagcatttactgtagagggtgttccaaacctctctgctgcagttgcgcgctcctggattcatcccatagcgaactgaaatgtgatatttccgcagagattcagcagcgacaggaagagctggacgcaatgacacaggcgctccaggagcaggactctgccttcggcgctgtccatgcccagatgcacgctgcagtgggtcaactgggtcgtgcccgcgccgaaaccgaggagctgattcgtgagcgggtgcgacaagtcgtcgcccatgtccgtgctcaagaaagagaactgctggaggcggtggacgcgcggtaccagcgcgattatgaagaaatggctagcagattgggcaggcttgatgccgtactacaacgaattaggaccggctctgcccttgtgcagaggatgaagtgctacgcctcagatcaggaggtgctggacatgcatgggtttttgagacaggccctgtgccgattaagacaggaagagccccagtccctgcaggccgccgtcagaaccgatggcttcgatgagttcaaagtcagactgcaggacttatcttcttgcattactcagggaaaggatgctgccgtgagcaaaaaggctagcccggaggctgctagtacgcctagggatccaatagacgtcgatttgcccgaagaggccgagcgcgtaaaggctcaggttcaggccctcgggttggctgaggctcagccaatggccgtggtgcagtcagtgcctggggctcacccagtgcctgtgtacgctttttccatcaagggtcccagctatggagaagacgtctctaatacgactacagctcagaaacgaaagtgctcacagacccaatgccctcggaaggtaatcaaaatggaatcagaggaaggaaaagaggcccgattagcaagatcatcccctgaacaacccaggcccagcacttcaaaggctgtttcaccaccccatctggatggcccacctagtccccggagccctgtcatcggttccgaggtgtttctgcctaatagcaatcacgttgctagtggggccggcgaagccgaggaaagggtggtggtgatcagcagttcagaagattccgatgccgagaattcatcctccagggagctggatgacagtagttccgagtcctcagatttacagctggagggcccctccacactgcgggttctggacgaaaacttggccgatccgcaagcggaagatcgcccacttgttttcttcgaccttaagatcgataatgagacacagaagatcagtcagttggccgcggtaaaccgagaatccaaatttcgggtggtgatccagcctgaagcctttttctccatctactcaaaggctgtatcacttgaggttggcctccagcacttcctttccttcctgagttcaatgcggcggcctattttggcatgctataaactctggggccccggcctgccgaactttttcagggcattagaggatatcaacaggctatgggagttccaagaagctattagtggttttctcgccgctctccctttaatccgcgaacgcgttcccggtgcctctagtttcaaattgaaaaatctggcccagacatatttggcgagaaacatgtccgaaagatccgcaatggctgccgttctggccatgagggacctgtgccggctgctggaagtctctcccggaccacagctggcccagcacgtctacccgtttagctcactgcagtgctttgcctctttacaacctctggtgcaggctgccgtgttaccccgagcggaggcaagactgctcgctttgcacaacgtgagcttcatggagttgctgtctgcccaccgaagagatcgtcaagggggcctcaaaaagtatagtagatacctgtctctgcagacaactacactccctcccgctcagcctgcgttcaatttgcaggcgttaggcacttactttgaaggtttgctggaaggtccagccctggcccgagctgaaggagtttccacccctcttgcaggccggggcctcgcagagcgggcctcacagcagtcatag

SEQ ID NO: 16806 - DNA, 2490 bp, Artificial Sequence
  Description of Artificial Sequence: Synthetic coding sequence
atggagcccgctcctgccagaagcccccggccgcagcaggatccagcccggcctcaggagcccaccatgcctcctccagagactccatccgaggggcgccagccgtccccctccccctctcccaccgaacgagctcctgctagcgaagaggaatttcagttcttgcggtgccagcaatgccaggctgaggccaaatgccccaagctcctgccttgcctgcacacgctctgctctggctgcttggaagcctcgggcatgcaatgccccatctgtcaggcgccctggccactgggagccgacactcctgcacttgacaacgtgttcttcgagtcactccaaagacgactgagcgtttaccgccagatagtggacgcacaggctgtgtgtaccaggtgtaaagaatctgcagatttttggtgtttcgagtgcgaacagctgctctgtgcaaaatgttttgaggcccaccagtggttccttaagcacgaagctcgcccacttgcagaactcagaaaccagagtgttagggaatttttagatggcactcggaaaactaataacattttctgttctaacccaaatcatagaacaccaaccctcacttctatctattgcaggggctgctctaaacctctgtgttgtagttgtgcattgctggactcctcgcacagcgaactcaaatgcgacattagcgccgaaatccagcaaaggcaggaagagctggatgcaatgacccaagccctccaggagcaggatagtgccttcggcgctgtccacgctcagatgcatgcggccgttgggcaactcggtagggccagagcagagacggaggagctaattcgcgagagagtgagacaggttgtggcgcacgtcagggcccaggagcgcgaacttttggaggctgtggatgccaggtatcagcgtgactacgaagagatggcatcgaggctgggacggctcgatgccgtgttgcagaggatcaggaccggctccgctcttgtgcaaaggatgaagtgctatgcctccgatcaagaagtgctagatatgcatggatttcttaggcaggccctgtgtcggctgaggcaggaagagccccagtcattgcaggctgcagtccggaccgatggctttgacgagttcaaggttcgcttacaagatttgagctcgtgtatcacgcagggcaaggatgccgccgtatcaaaaaaagcctcccctgaagcagcaagcacccctcgcgatccgattgacgtagatttaccagaggaagcagaacgggtgaaggcccaggtgcaagccttgggcctcgccgaagcccagccgatggccgtcgtccagtcggttcccggagcacacccagtccccgtctatgcattctctatcaaagggccctcttacggcgaagatgtcagtaatacaacaaccgcccaaaaacgaaaatgctcccagacacaatgcccaagaaaggtaataaaaatggagagcgaggaaggaaaggaggctaggttggccagatcatcgccggagcagccacgtcctagtaccagtaaagcggtgagtcctccccatctggacggacctccaagccctcgaagccccgtgattggcagcgaagtatttttacctaatagcaatcatgtcgcctccggcgccggtgaagcagaagaacgagtggtcgtgatttcaagttcagaagatagcgacgccgaaaatagttgtatggaaccaatggagaccgctgaaccacaatcctcaccagcgcactcctccccagcccacagctcaccggcacactcatcaccagtgcagtcacttctgagggctcagggtgcatcgtcattgccatgcgggacctaccatcctcccgcctggcctccccatcagcccgccgaacaagctgccacacctgacgcagaaccacactctgagcctcctgatcatcaagagaggccagctgtgcacagaggcattcgctacctgctctatagggcccagcgggccattcggctgcgccatgccttgagactgcacccacagctacaccgggccccgatacgcacatggtcaccccacgtcgtccaggccagcactcccgccattactgggcccctgaaccaccccgctaacgcacaggagcaccccgcacaactgcagagaggaatcagcccaccccaccgcattaggggagcagttcgcagtcgctcccgctcacttaggggatcctctcacctctcccaatggttaaataattttttcgcacttccatttagttccatggccagtcagctggatatgtctagcgtggtgggcgcgggggaaagtagggcccagacattgggggccggcgtccccccaggcgactcagtccgcggcagcatggaggctagtcaagtccaggtcccactggaagcctcccccataacctttcctccaccatgcgctcccgaacgaccaccaattagtcccgttcctggcgctcgccaggccggactttag

SEQ ID NO: 16807 - DNA, 2346 bp, Artificial Sequence
  Description of Artificial Sequence: Synthetic coding sequence
atggagcctgcacccgcgcggtcccctcgaccccagcaggatcctgccaggcctcaggaaccaacaatgccccccccagagaccccatcagagggtcggcagcctagtccatcacctagtccgacagaaagggctcctgcgtctgaagaggagtttcagtttctgcgctgtcagcaatgtcaagcagaagctaaatgccctaagctgctcccgtgccttcatacactgtgcagtggatgcctcgaagcgagcggaatgcaatgcccgatttgccaggccccttggcccttgggcgctgacacaccagcgctggacaatgtcttttttgagagtctccagaggcgtctgtccgtgtatcggcagatagtagacgctcaagcagtttgcactcggtgcaaagagagcgccgacttttggtgctttgaatgtgagcagctgctgtgcgcaaaatgcttcgaggcccatcaatggtttctaaaacatgaggcccgccccctggccgagctcagaaaccaatcagtccgggagttcttagacggcacccggaaaaccaataatattttttgcagtaatcctaaccaccgaactccaaccttaacttctatttactgccgtggctgctccaaacccctgtgctgtagttgtgctctgcttgactcatctcactcagaactgaagtgcgacatcagcgcagagatccaacaacgacaggaggagctggacgcaatgacacaggccctgcaggaacaggacagcgcattcggcgcagtgcatgcccagatgcacgccgctgtgggtcaactcggccgagctcgtgccgagacagaggagttaatacgtgagcgcgtgcgccaggtcgttgctcatgtccgggcccaggagcgggaactcctcgaggccgtggatgctcggtatcagcgcgattacgaagagatggcctcccgcctgggcaggttggatgctgtgctgcagcgtattcgtaccgggtcagcgctggtgcagcggatgaagtgttacgcatcagatcaggaggtcctagacatgcatggctttcttaggcaggccctgtgtcgcctccgacaagaagaaccgcaatctttgcaggctgccgttcgtaccgacggcttcgatgaattcaaagtgaggcttcaggatctgtctagctgcattacacaagggaaggacgccgcggtttcgaaaaaagcttctcccgaagctgcaagtactccgagggacccaatcgacgtcgatctggacgtgagcaatactaccacagcccaaaaacgaaagtgtagtcagacccagtgcccccggaaggtgataaaaatggagagcgaagaaggaaaggaggccagactcgcccgctcatctccagagcagccgaggcctagtacaagcaaagcagtctcgcccccccatcttgatggaccaccttctcccaggtctcctgtgatcggctctgaggtgtttctgcccaactctaaccacgtggccagcggcgctggggaagcggaagagcgagtagtagtgatcagctccagcgaagactctgacgctgaaaacagctgtatggagcccatggaaaccgcagagccacagagctcccctgctcactcgagtcctgcccactcatctccagcccatagttctcctgtccaatccctgttgcgcgctcaaggtgcatcatctttgccttgcggtacttaccacccaccagcttggccaccgcatcaacctgcagagcaggcagccactcctgatgcggaaccacactcggagccccccgaccaccaggagcgacctgcagtgcacaggggcattcgttatcttctgtatcgggcacagcgggccatccgactccggcacgcacttcggctacatcctcagctgcatcgggcacccattagaacgtggagcccccatgtggtccaggcctcaacccctgctattacaggacctctcaaccatcccgctaatgcccaggagcaccctgcccagctccagagaggcatatccccccctcatcgcattcgtggtgcagtccgttcccggtcaaggtccctccgcggatcaagccatttgtcacagtggctgaacaatttcttcgctcttcccttctcctctatggcatcccagctggacatgagcagcgtggtgggggctggcgagtcccgagctcaaaccttaggagcaggagtgcctcccggagacagtgttagaggctccatggaggcaagccaagtgcaggtgcctctagaggcctccccgattacatttcctcccccctgtgccccagagagaccccctatctctccagtacctggggccagacaagcaggcctgtag

SEQ ID NO: 16808 - DNA, 1272 bp, Artificial Sequence
  Description of Artificial Sequence: Synthetic coding sequence
atggaacccgcccctgcccggtccccccggccccagcaggatccagcacgcccccaagagcctaccatgccacccccagaaaccccttcagaagggagacagccatcgccttcccccagtcccaccgagagagcaccggcttccgaggaagaattccagtttctccggtgtcagcagtgtcaagccgaagcaaagtgccctaagttgctcccctgcctccataccctttgttcgggctgcctggaggcaagcgggatgcaatgtcctatttgccaggccccatggccactaggggccgataccccggctcttgacaacgtgttctttgaatccctccaacggcgcctctctgtatacagacagattgtggatgcacaagccgtgtgtacccggtgcaaggagtcagccgatttctggtgcttcgagtgtgagcagctactgtgcgcgaaatgcttcgaggcacaccagtggtttctgaaacatgaagcccgcccactggccgaattacgcaaccagtcagtgcgcgagtttttggatggcacccgcaagactaacaacatcttctgttccaatcctaatcacaggacacctactctgaccagtatctactgtcggggatgttcaaagccactctgctgttcctgtgctctcctggattcctcccattctgaactgaaatgcgacattagcgcagagatccaacagcgacaggaagagttagacgcaatgactcaggctttgcaggaacaggactcagcattcggggccgtccatgcccagatgcacgccgcagtcgggcaactgggacgtgcacgagccgagacggaagaactcatcagggaaagggtgaggcaggtcgtggcccacgtgagggctcaggagagggagctcctggaggcagtcgatgccaggtaccagcgcgactatgaagagatggccagcagattgggtagattagacgcagtcctgcagaggattcgaacaggctcagcactcgtccagaggatgaagtgttatgcctccgatcaggaagtgctggacatgcacggattccttcgccaggcactttgtcgtctgaggcaagaagagccacagtcactgcaggctgccgttagaaccgatggctttgacgagtttaaggtacgcctacaagatctgagctcgtgtatcacccaaggtaaagacgccgccgtttctaagaaagcctcacctgaggccgctagtacgcccagagaccccatcgatgttgatttaaggaacgctctctggtag

SEQ ID NO: 16809 - DNA, 1308 bp, Artificial Sequence
  Description of Artificial Sequence: Synthetic coding sequence
atggaacctgcccctgcaagatccccaaggcctcagcaggaccccgctagaccacaagagcccactatgccaccaccggagactccctccgaggggcggcagcccagtccctccccatcaccaaccgaacgcgccccggccagcgaggaggagttccagtttctaaggtgccagcaatgccaggctgaagccaagtgccccaaattactcccatgtttacataccctgtgtagcggctgcctggaagcctccgggatgcaatgtccaatttgccaggctccatggcctcttggagctgacactccagccttggataatgtttttttcgaatctttacaaaggcggctgagcgtataccgacagatcgtagatgcacaggccgtgtgcactagatgtaaggaatccgccgatttctggtgcttcgaatgtgagcagctcctatgtgcaaagtgtttcgaggcccaccagtggttcttgaagcacgaggccaggcccttggcagaacttcgtaaccagtcagtgagagaattccttgatggcacacgtaaaaccaataatatattttgtagcaaccctaatcaccggacgcctaccctgacaagcatctactgtcgcggctgtagcaagcccctgtgttgcagttgtgctctacttgatagctcacattcggagttaaaatgcgatatatctgccgaaattcagcaaagacaggaggagttagatgccatgactcaggctcttcaggagcaggactctgcattcggagccgtccatgcgcagatgcatgccgccgttgggcagttaggccgggccagagctgagactgaagaacttattcgcgaacgcgtgaggcaagtcgtagcccacgtgagggctcaggaacgagaactacttgaggctgttgacgcaaggtatcaaagggattacgaggagatggcgagtagacttggaagactcgatgctgtattgcagagaatcagaaccggcagcgcgctagttcagagaatgaaatgctacgcaagtgaccaggaggtgttggacatgcacggatttcttcggcaggccctgtgtagactcaggcaggaggaacctcagtcactccaagccgccgtccgcaccgatgggtttgatgaatttaaagtgcgcctccaggatctctcaagctgtatcacacagggcaaggatgctgctgtgtcaaaaaaggcctccccggaagctgcaagcacaccacgtgaccccatcgatgtggacctgctgcccccacctgctcacgcgttgacagggcccgcgcaatcgtccactcactag

SEQ ID NO: 16810 - DNA, 1902 bp, Artificial Sequence
  Description of Artificial Sequence: Synthetic coding sequence
atggagccagctccagccaggtccccacgcccgcagcaggaccctgcacgccctcaggagcctaccatgccgccccccgagactccatccgaaggtcgacagccatccccatcaccctcccctactgagagggcccccgcctcagaggaggaattccagttcctgcggtgccagcagtgtcaagctgaggccaagtgccccaaactgctgccatgcctgcataccctatgttcagggtgccttgaggccagcgggatgcagtgccccatctgtcaagcgccctggcccctaggcgccgatacccctgctctggataacgtgttcttcgaaagtttgcagagacgtctatcagtctacaggcagattgtggacgcccaggcagtttgcacaaggtgcaaggagtccgcggatttttggtgtttcgagtgtgagcagctgttgtgtgccaaatgtttcgaagctcaccagtggttccttaaacatgaggcgcgcccactggccgagctcagaaaccagtcagtgagagaatttttagacggcacacggaagaccaataatatcttttgtagtaacccaaatcaccgaacaccgacgcttacaagtatatactgccgaggatgctctaagcctctgtgctgcagctgcgctctgctggacagttctcactctgagctgaaatgtgacatttcggccgagattcagcaacgccaggaggaacttgatgctatgacgcaggccctgcaagagcaggactctgccttcggagctgtgcacgcgcagatgcacgctgcagtggggcagcttggtagagcccgcgctgagacagaggagttgatccgtgaacgagttagacaagtggtggcccacgtgcgtgcacaggaacgagagctgcttgaagctgtcgatgctcgataccaacgggactacgaggaaatggcctcacggcttggcaggttggatgcagttttgcagagaatccgaaccggatctgcactagtgcaaaggatgaaatgttatgcctctgatcaggaggtgctggatatgcatggctttctcaggcaggcgttgtgtaggctgcgccaggaggaaccgcaaagcctacaggcagctgtccggaccgacggcttcgacgagtttaaggtccggctgcaggacctctcttcctgtattacccaggggaaggatgctgccgtgtccaagaaggcttcacccgaggccgcttccacccctagagacccgattgacgtcgatttgccagaagaagctgagcgcgtgaaggcccaggtgcaagccctgggacttgctgaggcccagcccatggcggtcgttcaatctgtacctggcgctcatccagtccctgtctatgccttttcaatcaaaggaccatcctacggtgaagatgtttcaaacactacgactgctcaaaaacgcaagtgcagccaaacccagtgtcctaggaaggtgataaaaatggagagtgaggagggcaaagaagcccgcctcgcgaggtccagtccagagcaaccgagacctagcactagcaaagccgtctctcccccccatttggatggccccccatcaccacggtctcccgtgatcggttcagaggtgtttctcccaaactctaatcatgtagcatctggcgccggtgaggccgaagagcgagtggttgttatctcttcctccgaggatagtgacgcagaaaactccagctctcgcgagcttgatgactcaagctctgaaagcagcgacctgcagctagaggggccttctacactgcgcgtgcttgatgagaacttagctgatccccaggccgaagaccggccattagtcttttttgatcttaaaattgataatgaatctggtttcagctggggctatccacaccccttcttgatatag

SEQ ID NO: 16811 - DNA, 1332 bp, Artificial Sequence
  Description of Artificial Sequence: Synthetic coding sequence
atggccgtggtgcagtcagtcccaggagcccatccagtgcccgtctacgccttttcaattaagggtccctcctatggcgaagacgtttctaacaccactacagcacagaaacggaagtgtagccaaactcagtgcccgcgcaaggttattaaaatggagtccgaggaggggaaggaagcacgcttggcaagatcttctcccgaacaacctagacccagcacatccaaggcagtgtcaccgccgcatctagatggtccccctagcccccggtcgcccgttatcggctccgaagttttccttccgaatagcaatcatgtggcttcaggagccggggaggccgaggagcgggtcgtggtaatctcctcaagtgaggactcagacgccgaaaactcaagttctcgggaactggacgactcaagcagtgagagctcagacctccagctcgagggtccctccactttgcgggttctggacgaaaacctcgccgacccccaggcggaagatagaccattggtctttttcgacctgaagattgacaacgagacgcagaaaatctcccagcttgctgctgtgaatagagaaagtaagttccgcgtcgtcattcagccagaagcattttttagtatctactccaaggccgttagtttggaagtggggttgcagcactttctctcatttctgagctctatgcggcgcccaatcttggcttgctacaagctgtggggccccgggctcccgaacttctttcgcgctttagaagatatcaataggctgtgggaatttcaagaggctatcagcggattcctcgcggcattacctttgatacgagagcgcgttccaggggcctcttcgtttaagcttaagaaccttgctcagacatatctggcccgtaacatgagtgaacgatccgctatggctgcggtgctggcaatgagggacctttgtaggctgttagaagtgtcacccggacctcagctcgcccagcacgtgtacccgttttctagcctgcagtgctttgcctccctccaacctttagtgcaagctgccgtccttccaagggcggaggcccgtcttctagcattacacaacgtcagcttcatggagctgctcagcgctcacaggagggacagacaaggaggacttaagaagtacagtcggtacctttcactacagaccaccaccttgccaccagcccaacccgcatttaacctccaggccctggggacctacttcgagggcctacttgaggggcccgccctggcgagggcagaaggggtatccacgcccctggctggcaggggtttggctgaacgcgcgtcccaacaaagctag

SEQ ID NO: 16812 - DNA, 2598 bp, Artificial Sequence
  Description of Artificial Sequence: Synthetic coding sequence
atggagccagcacctgctaggagccctcgaccacagcaggaccccgcacgacctcaggaacctactatgcccccacccgagacccctagtgaagggaggcagccaagcccctctcctagcccgaccgaacgggctcctgcaagtgaggaggaattccagttcctgcggtgccagcagtgccaggcagaagccaagtgcccgaaattgctcccatgcttgcacactctgtgttctggctgtctggaggcctcaggcatgcagtgtcccatctgtcaggccccgtggcccttaggtgccgataccccagcgctagataacgtcttctttgaatcactgcagcgtcgcttgtcagtgtatcggcagatcgttgacgcacaggccgtgtgcacacgatgcaaagagagcgccgatttttggtgcttcgaatgcgagcagctactttgtgctaagtgttttgaagcccaccagtggttcctgaaacatgaggcccgcccgctcgccgagttgcgtaaccagtctgtacgcgagtttttggatggaacccgcaagacgaacaacatcttctgttctaatcctaaccacagaacccccactctgacctccatctattgccgcggctgttccaagcctctgtgttgctcttgcgcccttctggactcatcccacagcgagttaaaatgcgacatcagcgccgaaattcagcaacggcaggaggaactggatgccatgacccaggccctgcaagaacaggacagtgctttcggagcagttcacgctcagatgcatgccgcagtgggacagctgggtagggctagggccgaaaccgaagagttaattagggagcgcgtgcgccaggtggtggcccatgtccgggctcaggaaagagagctgttggaagccgtggacgccaggtaccagcgggattacgaagaaatggcttcgagactgggcagactcgatgccgtcttgcagagaatccgtacaggatcagctttagtccagcgcatgaaatgctacgcctctgatcaggaagtccttgacatgcatggcttccttaggcaggccttgtgcagactgcgacaggaggagcctcagagcctgcaggccgccgttagaacagacggtttcgacgagttcaaggtcagactgcaggatctgtcatcttgtatcacccaggggaaagatgcggccgtctcaaagaaagcaagcccggaggccgcttcgactccacgggaccctattgacgtggacctgcccgaggaggctgagagagttaaggcgcaggtccaggctctgggcttggccgaagcacagccaatggccgtggtacagagcgttccgggcgctcaccctgtccccgtgtacgcattctcaatcaagggcccctcgtacggcgaggacgtgtcgaatacgaccaccgcgcagaaacggaaatgttcccagacccagtgtccacggaaagtcattaagatggagagtgaagaaggcaaggaagctagactcgcacgcagctctcccgaacaaccaagaccaagcaccagcaaagccgtctctcccccccaccttgacgggcccccaagtccacggtcacccgtgatcggaagcgaggtgtttctccctaatagtaaccacgtggcgtccggagcaggagaggcagaggagcgtgtggtggtcatatcttcaagcgaggattctgacgctgagaatagcagtagcagagagctggatgactcaagctctgaaagttccgatctgcagctcgagggcccatccacactacgcgtactggacgaaaatctcgcagatcctcaggccgaagatcggcccctagtatttttcgatcttaaaattgacaacgagacccagaaaatctcacaactggcggctgttaaccgggagtctaagtttcgggttgtgatccaacccgaggctttcttttcgttcctgagcagtatgagacggcccattctggcatgctataagctttgggggcctggtctacctaatttttttcgagccctggaagacattaaccgcctgtgggaatttcaggaagctattagcggcttcctggctgccctgcccctgattcgggagagagttcctggagcatctagcttcaaattgaagaatttggcccagacttacctagcccgtaacatgtctgaaagatctgccatggccgccgtgctggccatgcgcgatttgtgcaggctcctggaagttagcccaggaccacagctggctcagcatgtgtatcctttttcatccctccagtgcttcgctagtcttcagccacttgtgcaggcagccgttctcccaagagcggaggcccggctccttgcactgcacaacgtttcatttatggaattactgtctgctcaccggcgggatcgccaaggtggcctgaaaaagtatagccgctacctatccttacaaaccaccaccttacccccagcacagcctgcgtttaacttacaggcattgggtacctacttcgagggactgttggaaggccctgctctagcacgcgccgagggtgtgtctacccctctggcaggacggggccttgccgagagggcctctcagcagtcctag

SEQ ID NO: 16813 - DNA, 1836 bp, Artificial Sequence
  Description of Artificial Sequence: Synthetic coding sequence
atggagcctgcaccagccaggtcgcctcgcccacagcaggatccagctcggccccaggagcctacaatgcctccccccgagactcctagtgaaggtagacaaccaagtcccagcccatccccgactgaaagagctccggcatctgaagaagagttccagttcctgcgatgtcaacagtgtcaagcagaggcaaagtgcccaaaattgctcccatgtctccataccttgtgcagcggctgcctggaggcaagcggcatgcagtgccctatatgtcaagcaccctggcctctcggagcggacacacctgcactggacaacgtgttctttgagagtttgcagaggcgcctgtctgtgtatcgacaaattgtggacgcgcaggcagtctgcactagatgcaaagagtcagctgacttttggtgcttcgaatgtgaacagttgctttgtgctaaatgcttcgaagcacaccagtggttcctgaagcacgaagcccggcctctggccgagctgagaaaccaatcagtgcgcgagttcctcgatggcacaaggaaaactaataacattttctgttctaaccccaatcatcgaacgcccaccctaacctcaatctattgtagaggctgttccaaacctctctgttgtagctgtgctctgctcgattccagtcattccgagcttaaatgtgacatcagcgctgagatacagcagagacaggaagagctggatgcaatgacgcaggccctgcaagagcaagactcagccttcggggctgtgcatgcgcagatgcatgcggccgttggccagctgggacgcgcccgggctgagactgaagagctcatcagggaaagagtgaggcaagtggtggcccacgtgcgagcacaggaaagggaactgctcgaagcagtggatgcccgttaccagcgcgactacgaagagatggcgtctcgattggggcggctggatgccgtgctgcagcgcatcaggaccgggagcgcgctggtacaacggatgaaatgctacgcaagtgaccaggaggtgctggatatgcatggcttcctaaggcaggctctgtgtcggttgaggcaggaggagccgcaatcactgcaggccgcagtccgaacggacggcttcgatgagttcaaggtgagacttcaagatttgtcctcatgtattactcagggcaaggacgcggccgtgtccaagaaagccagccctgaagcagcgagcacaccgcgcgatcctatagacgtggacctcccagaggaggctgagagagtgaaagcacaggtgcaagccctaggcttggctgaggcccagcctatggctgttgttcagtcagtgcctggtgctcaccctgtccctgtgtatgctttctcgatcaaaggtccctcttatggcgaggacgtctccaatacgaccaccgcacagaagcgaaagtgcagccaaactcaatgtcctcgaaaggtcattaagatggagagcgaggaggggaaggaagctcgactcgcaagaagttctcccgaacagccaaggccttcgacatcaaaggctgtgtcacccccacacctcgacggcccgccatcccctcgttctcctgtcattgggtcagaggtattcctccctaactccaaccatgttgcaagcggggccggcgaggccgaggaacgggtggtggtgatctctagttcggaagactctgatgccgagaactccgtctcagggcccgaggtacagccccgcactcccgcctcgccacactttagaagtcagggagctcagccccagcaggttacactccgtctcgccttaagactcggtaacttccccgtgcgccattag

SEQ ID NO: 16814 - DNA, 1683 bp, Artificial Sequence
  Description of Artificial Sequence: Synthetic coding sequence
atggaacccgcgccagcacggagtcctcggccccagcaggatccagctaggccacaggagcctaccatgcctcctcccgagacgccaagtgaaggaagacagccatccccttctccctcgccaacagaaagggcccctgcaagcgaggaggagtttcagttcttgcgctgtcagcagtgccaggctgaagcaaaatgcccaaagctcttgccatgtctccacaccttgtgctccggatgcctagaagcatccggaatgcagtgcccaatctgccaggctccttggcccctgggcgcggatacccccgccctcgataatgtgtttttcgagagtctccaaaggagactgtctgtttacagacagattgtagatgcccaggcggtttgtacccgatgcaaagaatccgcagacttctggtgtttcgagtgtgaacagttgctgtgcgccaagtgcttcgaggcccaccaatggttcctgaagcatgaggccagacctctggctgaactgcgcaatcagtcggtgcgcgaattcctcgatggcacccggaaaaccaataacattttctgtagcaatccaaaccatcggacccccacactgacatctatctattgtaggggatgttctaaaccactctgttgcagctgtgccctgttggattcttcacatagtgagttgaagtgcgacatttcggcagagatacaacagagacaggaagaattggacgcaatgactcaggctttacaggaacaggattccgcctttggcgctgtgcatgctcagatgcacgccgcagtgggacagctcggaagggccagagcggaaaccgaagagctgatacgagagagggtgcgtcaggttgtcgcccatgtcagagcacaagaacgggagctactagaagccgttgatgctcgctaccaacgtgactacgaggagatggcgtccagactgggacggctcgacgccgtgcttcagcgaattcgcactggcagtgccctcgttcagcgcatgaagtgttacgcctccgaccaggaggtgctagatatgcacggatttctgagacaggcactgtgcagactgcggcaggaagagcctcaaagcttgcaagctgccgtgcgcaccgatggattcgatgaattcaaagtacggctgcaggatttgtccagctgcataacgcagggcaaagacgctgctgttagcaagaaggcctcccctgaagcggccagtacacctagagatcctattgacgtagatctgcctgaggaagctgaacgcgttaaggctcaagttcaggccctcggactcgccgaggcccagccaatggctgtagtccagtcagtccccggggcgcacccagttcccgtgtatgcgttctccatcaaaggccccagttacggagaagacgtttctaacactacaacggcccagaaacggaaatgttcccagacccagtgtccccgtaaggtgattaaaatggaaagtgaggagggcaaagaagctcgtcttgcacgtagcagccctgagcagccccggccctccaccagcaaggcagtgagtccaccgcacttagatggcccaccatcacctcgaagtcctgtgataggctcggaggtctttctgccgaattccaaccatgtggcctccggagctggggaagcgggtcgcgagaggaacgcactctggtag

SEQ ID NO: 16815 - DNA, 1758 bp, Artificial Sequence
  Description of Artificial Sequence: Synthetic coding sequence
atggaacccgcacctgcacgctctccaaggcctcagcaagatccagcaagaccacaggagccaactatgcctcctcccgagactccaagtgaaggccggcagccctccccctcaccctctcccactgagcgggcccccgcttcagaagaggaattccagttcctccggtgtcagcagtgccaggcagaagccaagtgccccaaactgttaccctgcctccacaccctttgttctggctgcctggaagcatcgggcatgcaatgccccatctgccaggcgccttggccactcggcgctgacacacccgctctagacaacgttttctttgagtcactgcaacgcagactcagcgtgtaccgtcaaatcgtcgatgcgcaagccgtgtgtaccaggtgcaaggagtctgccgatttctggtgctttgaatgtgaacagctgctgtgtgcaaaatgcttcgaagcacaccagtggttcctcaaacatgaagcgaggccccttgcagagctcaggaaccaatccgtccgggaatttctcgatgggacccgtaagacgaataacattttttgctcaaaccctaaccacaggacccctactcttacttcaatctattgccggggatgcagtaagcccctgtgttgttcatgtgcactgctagacagctcccacagcgagttgaagtgcgacattagcgccgagatccaacaacgccaggaggagctcgatgccatgacacaggcattgcaggagcaggactctgccttcggggcagtacacgcgcagatgcacgccgcagtggggcagctcggaagagctcgcgccgagacagaggagttgatccgagagcgagtgcgccaggttgtcgctcatgtgcgcgcccaggagagggagctcctcgaagccgtagatgctaggtaccagagggactacgaggaaatggcttcaagactcgggcgccttgacgccgttctgcagagaatacgcacagggtcagccctcgtccaaaggatgaaatgttacgcatctgatcaggaggtgctcgacatgcacggtttcctccggcaggccctctgtcgtctgcgccaggaagaaccccagtccctgcaggctgctgtcaggactgacggttttgatgagttcaaggtgcggttgcaggatctatcatcctgtataacccagggaaaagacgcagccgtatccaagaaggcatcccccgaagccgctagcacgccacgtgatcctatcgatgttgacctagacgtatcgaacacgacaactgctcagaagcgaaaatgcagtcagacacagtgcccccggaaggtcatcaaaatggagagtgaagagggaaaggaggccagactggcaagatcatcccccgaacagccacggccatccacttcgaaggcggtttccccgcctcacttagatgggcctccctctcccaggtcacccgtcataggttcggaagtgtttttgcctaactcgaaccacgtcgcctcgggagcaggggaagccgaagaaagggtagttgtgatatcgagctctgaggatagcgacgccgagaattcctcatcccgggaactagatgatagtagcagtgaaagtagcgacctgcagctggagggtccttctacactgagagttctcgatgaaaacttggccgacccccaggccgaggataggccactggtattctttgatctgaagattgataatgaaagcgggtttagttggggttatcctcacccattcctcatatag

SEQ ID NO: 16816 - DNA, 483 bp, Artificial Sequence
  Description of Artificial Sequence: Synthetic coding sequence
atgcagcctgctagtgctaagtggtacgatcggcgcgattacgtctttattgaattctgcgtggaagactcaaaggatgtgaatgtgaattttgagaagagcaaactgaccttctcttgcttgggcgggtccgataactttaaacatctgaacgaaattgatctgttccactgcatcgatcccaatgactcaaagcacaaaagaacggacagatctatcctgtgttgtctgagaaaaggagaaagtgggcagtcatggcccagactgacaaaagaaagggctaaactgaattggttatctgtggacttcaataattggaaagactgggaagacgattctgacgaggacatgtccaatttcgacagattttcggaaatgatgaacaacatgggaggcgacgaagatgtggacttgccggaggttgatggagcagacgatgacagccaggattcagatgacgagaagatgcctgatttggagtag

SEQ ID NO: 16817 - DNA, 3141 bp, Artificial Sequence
  Description of Artificial Sequence: Synthetic coding sequence
atgcagaaaccgagtggcttaaagccacctggacgcggaggaaagcactcctctcctatggggcgaactagcaccgggtcggcctcaagttctgctgccgtggccgcctcatccaaggagggctctcccctgcataagcaatcctccggaccctccagctcccctgccgcagctgcagcgcccgagaagcccggtccaaaagcagctgaggttggcgatgactttctgggggacttcgtagttggagaacgtgtgtgggtgaacggggtgaagcctggagtagttcagtacctgggggaaacccagttcgctcccggacagtgggccggagtagtccttgatgacccagttggaaaaaacgacggcgcagtcggaggcgtgcgatacttcgagtgccctgccctgcaagggatttttacccgaccgtctaagctgacaaggcagccaaccgcggaaggctccgggtccgacgcccactctgtggagtccctaaccgcccaaaacctcagcctgcactccggcaccgccactccgccattaactagtcgtgtgattcccctacgagagtctgtacttaacagtagcgtgaagacaggaaatgaatccggttcgaacttatccgactccggatccgttaagcggggtgaaaaggatctccggctgggcgacagagtgcttgtcggaggcacaaaaactggcgtggtcaggtatgtgggagagaccgattttgccaagggggagtggtgtggggtggagctggacgaaccactcgggaaaaacgacggagccgtggctgggacgagatatttccagtgtccgcccaaatttggtctgtttgcgcctatccacaaggtcattagaattggattccccagtacttctcccgctaaggctaagaaaacaaagcggatggccatgggggtgagcgccctgactcattctccatcttcaagcagtatttcctccgtttccagtgtagccagctctgtgggcggacgccctagcaggtctggactgcttaccgagactagcagcagatatgcacgtaaaataagcggcaccacagccctgcaggaggccctgaaagaaaaacagcaacacattgagcagctgttagctgagagggatctggagcgggccgaggtcgccaaagcaacatcacacatatgcgaggtcgaaaaggagattgccctactgaaggctcagcacgaacagtacgtcgcggaggccgaggagaagcttcagcgcgctcgactgctggtcgagtctgtcaggaaggaaaaggttgatctctcgaatcagcttgaagaagaacggagaaaagtggaagacctgcagttcagagttgaagaagaaagcatcacaaagggtgacttggagactcaaacccagctggaacacgcacgcattggagagctggagcagagcctcctcctcgaaaaagctcaggccgaacgtttgctgagggaattggcggataatcgattgaccacagtcgcagagaagtcgagagtgctccaattagaggaggaattaactctgagacggggcgaaatcgaagaactgcagcaatgcctgctgcacagcgggccaccaccgccagaccatccagacgctgccgaaatcttacgactcagagaacgactgctatctgcttccaaagaacaccagcgcgagagtggagtactccgtgacaagtacgaaaaggcgctcaaggcctaccaggccgaggtagataagctgcgagccgccaatgaaaaatacgctcaggaagtcgcagggttgaaggacaaagtgcaacaagctacctcagaaaacatggggctcatggataactggaaaagtaagctagattctctggcatccgaccatcaaaagtcgctcgaggacctcaaagccactctgaactctggtcctggagcccaacagaaagaaatcggagaattaaaagccgtgatggagggaatcaagatggaacatcagttggaactaggaaacttgcaggcgaagcatgacctggaaactgcaatgcacgtgaaggaaaaggaagccctgcgtgagaagttgcaagaggcccaggaggaactggctggcctgcaacgccattggagagcgcaactcgaggttcaggctagccagcacagactagaattgcaggaggcccaagatcagaggcgggacgcagagctgcgcgttcacgaactggaaaaactagatgtggagtatcgcggacaggcacaggccattgaatttctcaaagagcagatcagtctggccgagaagaaaatgctggattacgaacgcctccagagggccgaggcccagggaaagcaagaggtagagagcttgagagaaaagctccttgtggccgaaaaccgtctccaggcggtggaagccctgtgcagctctcagcacactcacatgattgagtcaaatgatatctctgaggaaactatccgcacaaaggagaccgtggaaggcctacaggacaagctgaataagagggataaagaggttacagccttaaccagtcaaacagagatgttgcgagcccaggtcagcgcgttggaaagtaagtgtaagagtggggagaagaaggtggatgccttactcaaagagaaacggaggttagaagccgaacttgagactgtttccagaaaaacccacgacgcctccgggcagctagttctgatctctcaagaactgctgagaaaagagcgatctttaaacgaactcagagtgttgctcctggaagccaatcggcactctcctggccctgagcgggaccttagccgggaagttcacaaggcagagtggagaatcaaagaacaaaaactcaaggacgatattcggggcctccgtgagaagctgactgggctagacaaagagaaaagtctgagcgatcagcggcggtactccctcattgatcgctcatctgcccccgagctgttacggctgcagcaccagttaatgtcaactgaagacgcactgcgagacgcactggaccaggcccagcaggtggagaagttaatggaggccatgcgatcctgtccagacaaagcccagaccatcggcaactcagggagcgctaatgggattcatcagcaggataaggcccagaagcaagaggataagcattag

SEQ ID NO: 16818 - DNA, 1800 bp, Artificial Sequence
  Description of Artificial Sequence: Synthetic coding sequence
atgtcaaggagtttgcttttgtggttcctcctgtttttgctactcctgcctccattgcccgtattgctggccgatcccggcgcgccgacgccggtaaatccgtgttgctactacccttgccagcatcagggcatttgtgtaagattcggactcgatcgttaccagtgtgactgtacaagaacaggatacagcggtcccaactgcacaatacccggcctgtggacatggttgcggaactccctgcgtccatcccctagttttactcacttcctgttaacccatggtcggtggttctgggagttcgtgaacgcgacttttatccgagaaatgttgatgaggttggtcttaacagtcaggtccaatctgatccctagccctccgacatataattcagctcatgactatataagttgggagtccttcagtaacgtgtcttactacacccggattcttccatctgtccctaaggactgtcccacaccaatggggactaaaggtaaaaaacaacttcctgatgcacagctgcttgcccggcggtttctactgaggcgaaagttcatacctgacccccaaggcaccaacttgatgtttgcgttctttgcacaacacttcacgcaccaatttttcaaaacatcaggaaaaatggggcccgggttcaccaaggcactcggccacggggtggacctggggcacatctacggagacaacctagagcggcagtaccagctcaggcttttcaaagacggaaaactaaagtaccaggtgttggacggggaaatgtatccccctagtgttgaagaggcgccggtattaatgcactatccaaggggaatcccccctcagtcacagatggccgttggccaggaggtctttggactccttccgggcctcatgctctacgccacactctggttgagagagcacaacagagtatgtgacctgctcaaggcggagcatcctacatggggggacgagcaattattccagacaactcggcttattctaatcggagagacaatcaaaatagtgatcgaagaatacgttcagcagctgagcggctactttctgcaactgaaattcgatcctgaactgctctttggagtacagttccaataccgtaatagaattgctatggaatttaaccacctgtatcactggcatccactgatgcccgactccttcaaagtcggaagccaagaatactcatacgagcaatttctgttcaatacttccatgttggttgattacggagttgaagccctggtggatgcctttagcaggcagattgccgggaggattgggggcggacgcaatatggaccaccacattctgcacgtcgccgtcgacgtgatcagggagtcaagggagatgcggctgcagccattcaatgagtaccggaaacgtttcggcatgaaaccttacactagctttcaggagttggtgggcgagaaagaaatggcagcggaactcgaggagctgtacggggacatcgatgctttggaattctatcccggactcctgctggagaaatgtcacccaaacagtatctttggagagagcatgatcgagatcggtgctccgttttcactcaagggtctactcggtaatcccatttgtagtcccgaatactggaaaccctccacatttggtggtgaggtcggattcaatattgtcaagacagccactctgaaaaagttggtgtgcttaaatactaagacatgcccctatgtgagctttcgcgtcccagacgcgtctcaggatgatggacccgctgttgagagaccttcaacagagctctag

SEQ ID NO: 16819 - DNA, 1473 bp, Artificial Sequence
  Description of Artificial Sequence: Synthetic coding sequence
atgctgatgcgcttagtgttaacggtccgtagcaatctcatcccaagccctcccacctataactctgcccacgactacatctcctgggagtcttttagcaatgtctcctattacacgaggatattgccctcagtacccaaagactgccctacacccatggggactaaaggcaagaaacagctgcccgacgcgcagctgctcgcacggaggttcttactcagacgcaagttcatcccggatccccaggggacaaatctcatgttcgcatttttcgcacagcatttcacgcatcagtttttcaagaccagcggcaaaatgggtccaggcttcactaaagccttaggtcacggcgtggacttggggcacatttacggagacaatctggagcggcagtaccagctgagattgttcaaagacgggaagcttaagtaccaagtgctcgacggggagatgtatccaccctccgtcgaggaggcccctgtacttatgcactaccctcgtggtatccccccacagtcgcaaatggctgtcgggcaggaggtgttcggcctgctgcccggcctgatgctctacgccactctgtggctgagggagcataacagggtctgcgatctgcttaaagccgagcaccccacttggggtgatgaacagcttttccagactacccgcctcattctgatcggggagaccattaagattgtgatcgaggagtatgtgcagcagctctctggatactttctgcaactgaaatttgacccagaactcttattcggggtccagttccagtataggaatcgcatcgccatggagttcaaccacctgtaccactggcaccccctgatgccagactcctttaaggtcggttcccaggagtacagttatgagcagtttctctttaacacgtccatgctggtcgattacggcgttgaggcgcttgtggacgctttctcaagacagattgctggcagaatcggcggtggccgcaacatggatcatcatatcctccatgtggccgtggacgtgatccgggagtccagagaaatgcgacttcagcctttcaatgagtataggaaaaggttcggcatgaaaccatatacctcttttcaggagctggtcggcgaaaaggaaatggcagctgagctagaagagctgtatggggacatcgacgcactggagttttacccgggactgctgttagagaagtgccatccgaactccattttcggagagtctatgattgaaatcggggcaccattttctctcaagggactgctcggtaaccccatctgcagccctgagtattggaaaccttcaacattcggaggtgaggtcggtttcaacatcgtcaagactgcgaccctgaagaaactggtatgcttgaacaccaagacctgtccgtacgttagctttagagttcctgacgcctcacaggacgacggacccgccgtcgagcgaccttctacagaattgtag

SEQ ID NO: 16820 - DNA, 471 bp, Artificial Sequence
  Description of Artificial Sequence: Synthetic coding sequence
agccttcttctgtggtttttgctgttcctgctactcttgccccctctccccgtcctactggcagatcccggagcgcccacaccagcgggcctgtggacgtggcttcgaaatagtctgaggccatctccgtcttttacgcattttctcctgactcatgggcggtggttttgggagtttgttaacgcaacctttatcagagaaatgctgatgcggctcgttttgactgtgaggagcaaccttatcccttccccacccacatataatagcgctcacgattacatttcatgggaaagcttttcaaatttcttcaaaaccagcggcaagatgggtcccggctttacaaaggcccttggccacggggttgacctcggccatatttatggggacaacttggaacgccagtaccagctgaggctgtttaaggatgggaagctcaagtaccaggtccttgatggggagatgtatccttag

SEQ ID NO: 16821 - DNA, 1614 bp, Artificial Sequence
  Description of Artificial Sequence: Synthetic coding sequence
atgaggaagccccgactgatgaatccctgctgctactacccctgtcagcatcagggcatctgtgtgagattcggtttagatcggtatcaatgcgattgtactcgtactggctatagtggcccaaactgcacaatcccaggcctctggacatggctacgcaactctctgcgccccagtccttctttcacccactttctccttacacacggccggtggttctgggaatttgtcaatgctacctttataagggaaatgctgatgaggttggtgctgactgtgcgatcgaaccttatacccagtccccccacatacaattccgctcacgactacatctcatgggagagcttttctaacgtgagctactacaccaggattctgccctccgtgcctaaggattgtcccaccccaatgggcactaaaggcaaaaaacagctgcccgacgcccaattgctcgcacggaggttccttctccggcggaagttcatcccagatccgcaggggactaacctgatgttcgcgttcttcgcgcaacatttcacacaccaattctttaaaacttctggtaagatgggacctggttttaccaaagccttgggtcacggcgtcgatctaggtcatatctatggagacaatctggagaggcaataccagcttcgcctgttcaaagatggtaagcttaaatatcaggtgttagatggcgagatgtaccccccctccgtggaagaagcccctgtgttaatgcactaccctagaggtataccgcctcaatctcagatggctgtgggacaggaggtgttcggcctcctcccaggactgatgctgtacgctacactctggttgagggagcataaccgcgtgtgtgacttgctcaaggctgaacatcccacttggggtgatgagcaacttttccaaactacacgccttatactaatcggcgagaccattaagattgtcattgaggagtacgtacaacagctgagcgggtactttctccagcttaaatttgatccagaattactattcggcgtccaattccaatatagaaatagaatcgctatggagttcaaccatctgtatcactggcatccactgatgccggatagcttcaagataggcggcggcaggaacatggaccaccatatccttcacgtcgcggtggacgtcatccgggaaagtagagaaatgaggctacaacccttcaacgagtacagaaaaaggtttggaatgaagccttacacctcattccaggagctggtgggggaaaaggagatggcagctgaactggaagagttgtacggggacatcgacgcactggaattctacccaggcttgctcctcgagaaatgtcatcccaacagcatttttggtgagtcaatgattgagatcggagctcctttcagcctgaagggcctcctgggcaaccctatctgctcaccagagtactggaagccaagtacctttggcggggaggtaggattcaatatcgtcaagaccgctactctcaaaaagctcgtgtgtctgaatacaaagacctgtccatacgtgtcattccgcgtgcctgacgcctcacaggacgacggcccggccgtagaacgaccatctactgaattatag

SEQ ID NO: 16822 - DNA, 1815 bp, Artificial Sequence
  Description of Artificial Sequence: Synthetic coding sequence
atgcttgctagagctttgttattgtgtgctgtactggctctgagccataccgccaacccatgttgcagtcacccatgtcagaaccggggagtgtgcatgtctgttggctttgatcagtacaagtgtgattgtactagaactggcttttacggggagaattgcagcacccccgagttcctgacccgcataaagctgttcttgaaacctacacctaacacggttcattatattttgacacatttcaaaggcttctggaacgtggtcaacaacattcccttcttacggaacgcaattatgagctacgtgcttacatccaggagtcacctgattgactctccacccacgtataatgccgactacgggtacaaatcttgggaagcattttcaaatctgagctactatactagagctctgcctcccgtcccggacgattgcccgaccccccttggagtgaagggaaaaaagcagctccctgactccaatgagatcgtagagaagctactgctccggcgcaaattcattcccgatcctcaagggtctaatatgatgttcgcattttttgcccagcacttcacccaccagtttttcaaaacagaccataagagaggccctgccttcactaacggtttaggtcatggtgtggacttgaaccacatctacggcgagactcttgcccgccagcgcaagctccgcctgttcaaagacgggaaaatgaaatatcagattatcgacggggaaatgtaccctcccactgtaaaagacactcaggccgagatgatctatccccctcaggtgccagagcacctgcggtttgctgtgggtcaggaggtctttggattagtcccgggactcatgatgtatgctacaatatggttgagagaacataaccgggtctgtgacgtattaaagcaggagcacccagaatggggtgacgagcagctcttccagacctcacggctaatcttgataggcgaaacaattaagatcgtaatcgaagactacgttcagcatttgagtggctaccacttcaagctgaagtttgatcctgaacttctattcaacaagcagttccagtaccagaatcgcatcgccgcagagtttaatacactgtaccattggcatccccttctgccagatactttccagatacacgaccagaaatacaattaccagcaatttatctataacaattccatcttgcttgaacacggaattacccagtttgtggagagcttcaccagacaaatcgccggcagggtggccggcggccgtaacgttcctcctgccgttcagaaagtctcacaggcctcgatcgaccagagccgacagatgaagtaccagagtttcaatgaatatcggaagcggttcatgctcaagccctatgaaagttttgaggagttgacaggtgagaaggagatgagcgccgagctggaagccctgtacggcgatattgatgctgtggagctgtatcctgctctgcttgtggagaaaccccggccagatgcaatcttcggcgaaacgatggttgaggttggcgctcccttcagcctgaaaggtctgatggggaacgtcatctgcagtccagcatactggaagccctctacctttggcggggaagtgggcttccaaatcatcaataccgcctctattcagtctcttatctgcaataacgttaaaggctgcccattcactagcttcagcgtacctgatcccgaattgattaaaacagtcacgatcaacgcgagttcctctcggtccggtctagacgatataaaccctacggtgcttctcaaagaaagatcaacagagttgtag

SEQ ID NO: 16823 - DNA, 1614 bp, Artificial Sequence
  Description of Artificial Sequence: Synthetic coding sequence
agtctggtgcccgctacaaactatatctacacacccctgaatcagttgaagggcgggacaattgtcaacgtctatggagttgtgaaattcttcaagccaccctatctttcaaaagggaccgactactgctctgtggttaccatcgtggaccagactaacgtgaagttaacttgcctgctgttttcaggcaattatgaagcgttaccaatcatctacaaaaatggagatatcgtccgcttccacaggcttaagatccaggtgtataagaaggaaacacagggcattacctcgtctgggttcgccagcttaacctttgaaggaacactgggagctcccataataccccggactagtagtaagtattttaatttcaccacagaggatcacaaaatggttgaggcccttcgcgtttgggcgtccacacatatgtctcctagctggacactgttaaaattgtgcgacgtacagccaatgcagtatttcgaccttacctgtcagttgctggggaaagccgaggttgacggtgcctcgttcctcttgaaggtgtgggacggcacgcgcacgccctttccatcttggcgtgttttaattcaggaccttgtcctcgagggagacctgagtcacattcataggctccaaaatctgaccatcgatattctcgtctacgacaaccatgtgcacgtcgcgcggtctttgaaggttgggtcctttctccgaatctactcccttcacaccaaattgcagtccatgaattctgaaaaccaaacaatgctgagcctggagttccatttgcatgggggcactagctacggtcggggcattagggtcctgccggagtctaattccgacgtcgatcaactgaaaaaggacttggagtccgcaaatttaacagccaaccagcactccgacgttatttgccagtccgaaccagatgacagtttcccttcatccgggtccgtgagtttgtacgaggtcgaacgatgccagcagttatctgctactattttgacggaccatcagtatctcgaacgcacacccctttgcgcaattctgaaacagaaagccccccagcagtaccgcatacgagccaagctccgctcttataagcctaggcgcctgtttcagtccgttaagttgcactgcccaaaatgccatctcctgcaggaggtccctcacgagggggaccttgatattatttttcaagatggcgctacaaaaacccccgacgtcaaactgcaaaacacctcactgtatgattcaaaaatttggaccacaaaaaaccaaaaaggcagaaaggtcgccgtgcactttgtgaagaataatggcattctccccctgtccaatgaatgtcttctcctgattgagggtggcacattgtccgagatctgcaaactctcaaataagttcaactccgtaattccagttcggtcgggacatgaggaccttgagctcctggacctctccgcaccctttctcattcaggggaccatccaccactacgggtgtaagcagtgctcttcccttagaagcattcagaacctgaattccttggtggacaagacaagttggataccctcatccgtggccgaggaactggacatcgtgttgcaatag

SEQ ID NO: 16824 - DNA, 1905 bp, Artificial Sequence
  Description of Artificial Sequence: Synthetic coding sequence
atgagcctcgttccagcaaccaactatatatacaccccactgaaccaacttaagggaggaaccattgtcaacgtgtacggggttgtgaaatttttcaagcccccctacttgagtaaggggaccgactattgttctgttgtcaccatcgtagatcagactaacgtcaaactcacttgtctgctgtttagcgggaattacgaggcactccccatcatttataaaaacggcgatattgttcggtttcatcgtctcaaaattcaggtgtacaaaaaagagacccagggaattacaagctcaggttttgcatctctgacgtttgagggcacactcggggcccctattatcccacgtacatcaagtaagtactttaactttactacagaagaccacaagatggtggaagctctcagagtctgggcatctactcacatgagtccttcttggactcttctgaagttatgcgacgttcagcccatgcagtactttgacctcacctgccagctgctgggcaaagctgaggtggatggagctagctttctgctgaaagtgtgggacggtaccaggaccccctttccaagctggagggtgcttatccaggatctggtgttggaaggagatttaagccacatccaccgcctgcagaacctcaccatcgatatccttgtttacgacaaccacgttcatgtcgcgcggagcttgaaggtcggaagttttctgcggatctactcgctgcacactaagttgcaatccatgaacagcgaaaaccagacaatgctgtccctcgaattccatctacatggaggcacctcttacggacgcgggatccgggtgttaccggagtcgaacagcgacgtggatcaactaaagaaggaccttgagtccgcgaatctgactgcgaatcaacattccgatgttatctgtcagtcagagcccgatgatagtttcccttcctctggtagcgtctccctctacgaggttgagcgctgtcaacagctgagcgccaccattcttactgaccaccaatatctggaacgcactcctctgtgcgccatcctaaaacagaaagcgccacagcagtacagaattagggccaagctcaggagttataaaccacgaaggctctttcagtccgtgaaattgcattgccccaagtgtcatctgcttcaggaggtacctcacgagggtgatctggacattatttttcaggacggcgcaacgaaaacacctgacgtcaagctgcaaaatacctccctctacgatagtaaaatctggaccactaagaaccagaagggacggaaggtggcagttcactttgtgaaaaacaatggcatcctgcccctgtctaatgagtgcctgctgctgatcgaaggcggaacactttccgagatctgcaagctgtccaacaagtttaactccgtcatccctgtcaggtcaggtcacgaggatctggaactacttgatctctctgctccatttctgatacaggggacgatccatcactatggatgcaaacaatgctcctcactgcgatcaattcagaatctgaactccctggtggataagacttcctggatacctagtagcgtggctgaggcacttggcatcgtgcctctgcagtatgtgttcgttatgacattcacactggacgatggaaccggtgtcttagaagcatatctcatggatagcgacaaattttttcagattcccgcctcggaggtgctcatggatgacgacctgcagaaatcagtggacatgatcatggacatgttctgcccaccgggaattaaaatagatgcttacccttggcttgagtgcttcatcaagagttataacgttacgaacggtaccgacaaccagatatgttatcagatctttgacacaacagtagctgaggacgttatttag

SEQ ID NO: 16825 - DNA, 1023 bp, Artificial Sequence
  Description of Artificial Sequence: Synthetic coding sequence
ctgagcttggtgcctgccacaaactacatttatacgcccctgaaccagctgaagggcggtactatcgtgaacgtgtatggcgtagtgaagttttttaaacccccttatctgtctaagggaactgattactgctccgttgtaactattgtagaccagaccaatgtgaagctgacctgtctgcttttctctggaaattacgaggccctacccattatatataagaacggcgacattgtgcgctttcacaggttaaagatacaggtctacaagaaggagacccagggaattaccagctcggggttcgcaagtttgacatttgagggcaccctgggcgccccgattatccctaggacttcctccaagtacttcaacttcaccactgaggatcacaagatggttgaagccctgcgtgtgtgggcttctacccatatgagcccaagctggacactgctgaaactttgcgatgtacaaccaatgcagtattttgatctcacctgccagctcctgggaaaggccgaggtcgacggcgcatcttttctgctgaaggtctgggacggtactagaactccctttcctagctggagagtcctgatacaggatcttgtgctcgagggcgacctgagccatattcataggctgcaaaacctgactatcgacatcttagtttatgataaccatgtacacgtcgcccgatcactgaaggttggatcattcctcaggatatattctttgcataccaaactccaaagcatgaatagtgagaaccagaccatgctgagcctggagttccatctgcatggcggcacttcctatgggagaggcataagggttcttccagagtccaacagtgatgtagaccagttgaagaaggacctcgagtccgccaacttaaccgcgaatcaacatagcgacgtgatctgccagtccgaaccagacgactcctttccaaatggcgtatcgctgcgtcctcctggctggtcctccgtggcccgctcccggttgattgccgcctccacatcctag

SEQ ID NO: 16826 - DNA, 1512 bp, Artificial Sequence
  Description of Artificial Sequence: Synthetic coding sequence
atggttgaggccctgcgggtgtgggcttctacacacatgagccctagctggacccttctcaagctgtgcgacgtgcaaccgatgcaatactttgaccttacttgccaactcctcgggaaagcagaggtcgatggtgcctcctttctgctgaaggtttgggacgggaccagaacaccttttccatcttggagggtactgatccaggacttggtgcttgagggcgatctgagtcacatccacaggttacaaaacttgaccattgacattctggtatacgataaccatgtgcacgtggccaggtccctgaaagttggcagcttcctgcgcatctactctttgcacacaaagctgcaatctatgaattctgaaaaccagacaatgctgtccctggagtttcacctacacgggggcaccagttatggacgaggcataagagttctcccagaaagtaacagcgacgtggatcagctcaagaaggaccttgaatcggccaacctcacagcaaatcagcattcagacgtgatctgtcaatccgagccggacgacagttttccttccagtgggtctgtctccttgtatgaagtggagcgctgccagcagctgagcgcaacgatactaactgatcatcagtacctggaacggactcccttgtgcgcaattctaaagcaaaaggctccacaacagtataggatacgagcaaagctacgctcatacaagcctagacggctcttccagagcgtgaagctgcattgccctaaatgccatttgttacaggaggtcccccatgagggtgatcttgacataatcttccaggacggggcgactaaaacacccgacgtgaaacttcaaaacacaagcttgtacgactccaaaatttggactacaaagaatcagaaggggcgcaaggttgctgttcactttgtcaaaaataacggcatcctaccacttagcaacgaatgtctcctcctcatcgagggcggaaccctttccgaaatttgtaagctgagcaacaaatttaatagcgtcattccagtccgatcaggacacgaggacctggagcttcttgacctgagcgcccctttcctgatccagggaacgatccaccactatggctgcaagcagtgttcaagcctgcgctcaattcagaatttgaactccctggtggataaaacctcctggatccccagcagcgtagccgaagcgctcggaattgtgcctctccaatatgtattcgtgatgactttcacactcgatgatgggacaggggtgctggaagcatacctgatggacagcgataagtttttccagatcccagcctctgaagttctaatggacgatgatctgcagaagtccgttgacatgatcatggatatgttttgtcccccaggcatcaaaattgacgcttatccttggctggagtgcttcattaagtcctacaacgtgactaacggaactgataaccaaatttgctaccagatctttgacactaccgttgcggaagacgtaatatag

SEQ ID NO: 16827 - DNA, 1380 bp, Artificial Sequence
  Description of Artificial Sequence: Synthetic coding sequence
ttgtctttagtgccggcaaccaattacatctatacgccactaaatcagctcaagggtggcactattgtgaatgtctatggagttgtgaagtttttcaagccaccctatctaagtaagggcaccgactactgctcagttgtcaccatcgtggaccagacgaacgtaaagctgacctgcctattgttcagcggaaattatgaggcgctccctatcatttataagaatggggatatcgtccgtttccatagattgaagatccaggtgtacaagaaggaaactcagggtatcacatcttccggattcgcaagcctgactttcgaaggcacgctgggcgccccaattatcccaaggaccagctctaagtatttcaacttcactacagaggaccataaaatggtggaagccttgcgggtgtgggccagcacccacatgtccccttcctggaccttgctgaagttatgcgacgtgcagcctatgcagtattttgatctgacctgtcagcttttaggcaaggccgaggtcgatggcgcgagcttcttgctgaaggtgtgggacgggactagaacaccatttccctcctggcgggtgctcatccaggacctggtccttgagggagacctgtcgcacattcaccgcttgcagaacctaaccatcgacattttggtgtatgataaccacgtgcatgtggcgcgttccctgaaggttggttcttttttgcgcatttattctctgcataccaaattacagagtatgaacagtgagaatcagacgatgctttctttagagttccatttgcatgggggcacaagttacggcaggggcatcagagtacttccggagagcaattccgacgtggatcagctgaagaaagacctcgagtcagctaaccttacagctaaccaacacagcgacgttatctgtcaatcggaacccgacgactcgttcccatccagcggcagtgtcagcttatacgaagtggagcgatgtcagcagctctccgcgaccattctaacagatcaccaatacttggaacgtacacctctgtgcgctatcctcaaacagaaggctcctcaacagtatcggattcgcgctaagttaagaagttacaaacctagacgcctgttccaatctgttaagctgcattgtcctaagtgccatctgctccaggaagtcccacacgagggcgatctggatatcatcttccaagacggggcgactaagacccccgatgtcaagctgcagaatacaagcctgtatgattccaaaatttggaccacgaaaaaccagaaaggccgaaaagtggccgtacactttgtgaaaaacaatggcattttacccctgtctaatgagtgcctcctcctgattgaagtcctactgtag

SEQ ID NO: 16828 - DNA, 249 bp, Artificial Sequence
  Description of Artificial Sequence: Synthetic coding sequence
atgtccctagtgccagctactaattatatctacacccccttaaaccaacttaagggtggaactatagtgaatgtttacggagtcgtgaaattcttcaagccaccatatttgagcaagggaaccgattactgtagcgtcgtgacgatcgtagatcaaacaaacgtgaagctgacatgcctgttgttcagcggtaattacgaggcactccccatcatctacaagaacggcgacatagttcggttccactag

SEQ ID NO: 16829 - DNA, 1557 bp, Artificial Sequence
  Description of Artificial Sequence: Synthetic coding sequence
ctgtctctcgttcccgctaccaactacatctacactccactgaaccagctgaagggaggtaccatcgtcaacgtctatggagtggtaaaattcttcaaaccaccttatctcagcaaaggcaccgactattgttctgtcgtaacaattgtagaccagaccaacgttaaactcacatgtctgctgtttagcggaaattacgaggcactgcctattatctataagaatggcgacattgtgcggtttcaccggcttaagatccaggtctacaagaaggagacacaaggcatcactagcagcggcttcgcttctctgaccttcgagggcacccttggggccccaataattccgagaacctcatctaagtactttaacttcacaactgaggaccataaaatggtagaagccctacgcgtttgggcttctacccacatgagtcccagctggactctgctgaagctttgcgatgtgcagcccatgcagtacttcgatctgacatgccaactgctgggtaaggcggaagtcgacggtgcaagtttcctcctcaaggtgtgggatggcacccgcaccccattcccctcgtggcgagtacttatccaggatcttgttctggaaggcgacctcagtcatatccaccggctacagaatttgaccatcgacatactggtgtacgacaaccacgtgcatgtggctcgctctttgaaggtaggttcatttctgcgcatctattccttacataccaaactgcaaagtatgaattccgagaaccagaccatgctgagtctggagttccaccttcacgggggcacgagctatggccgaggcatccgtgtgctgccggagagtaactccgacgttgatcagctgaaaaaagacctggagagcgctaatctaacagccaatcaacatagcgatgtgatttgccaaagcgaaccagacgactcattcccgtctagcggatctgtctctctatatgaagtggaacggtgccagcagttgtctgccactattctaactgaccaccagtacctagagcgaactccgctctgtgccatactgaaacagaaggcaccccagcaataccgaatcagggctaaactgcggtcttataaacccaggcgcctcttccagagcgtgaaactccactgcccgaaatgtcatttattacaggaagtcccacacgagggtgacttggatattatcttccaggacggcgctaccaaaacccctgacgtcaaactgcaaaatacgtcactgtacgatagtaaaatatggacaacgaagaaccagaaaggccgaaaggtagcagtgcacttcgtgaaaaacaacggtatactcccactgagcaatgagtgcctactcctcatagagggcgggacccttagtgaaatttgtaaacttagtaataagttcaattccgtaataccagtcaggtccgggcatgaggacctcgagctcttggaccttagcgcgcccttccttatccaaggcaccattcaccactatggcacaggctactgcacacctcctatctgcgtctgttatgatctctatacttag

SEQ ID NO: 16830 - DNA, 1374 bp, Artificial Sequence
  Description of Artificial Sequence: Synthetic coding sequence
agccctgaggacccaaggtccaaacataaatttaagattcacacctacggctcccccaccttctgtgaccactgcggatcacttctgtatgggctgatccaccaaggaatgaaatgtgatacttgtgatatgaatgtgcacaagcagtgtgttatcaatgtcccctccctatgcggaatggatcatacagagaagcgcggccgcatctacttgaaggctgaagtggctgatgagaagctgcacgtaacagtgagagatgcgaaaaacctcattcctatggaccccaatggcctgtccgacccttatgtaaaactcaagttaattccagatcccaagaatgagtctaagcagaaaacaaagacaatcagatccactctgaatccacagtggaatgaatctttcacctttaaattaaaacccagtgacaaagacaggcggctatccgttgaaatttgggattgggaccgcaccacccgcaacgatttcatgggttcactaagcttcggcgtctcagagctcatgaaaatgccagcgtccggatggtacaagctccttaatcaagaggaaggcgagtattataatgtgccgatccctgaaggcgacgaagaggggaacatggagctccgccaaaaatttgagaaggcaaagctgggacccgctgggaataaggtcattagtcctagtgaggaccggaagcagccatctaataacctggacagggtgaaactcaccgacttcaatttcctcatggtgctgggcaagggttcttttggaaaggtgatgttagctgatcgcaaaggcactgaggagctttatgccattaaaattctcaaaaaggacgttgtgatacaggatgatgacgttgagtgtaccatggtcgaaaaaagagtgttggccctcctggataagccaccctttcttactcagctgcattcctgttttcagactgtcgacagactgtatttcgttatggagtatgtgaacggaggagatctcatgtaccacatccagcaggttggaaaatttaaggagccacaggccgtgttttatgccgccgagatctccatcggtctatttttcctccataagcggggaattatctaccgtgacttgaagctggataacgtgatgttggacagtgagggacacataaagatcgcagatttcgggatgtgcaaggaacacatgatggatggggtgactactcggacattctgcggtaccccagattacatcgcacccgaaattattgcctatcagccgtacggaaaaagcgttgattggtgggcttacggcgtactgctatatgagatgttagctggacaggtaatgttttgctacatatttatgttcgtctattgctgcgtgatgtag

SEQ ID NO: 16831 - DNA, 2019 bp, Artificial Sequence
  Description of Artificial Sequence: Synthetic coding sequence
atggcggacgtcttccccggcaatgatagtaccgcaagccaggacgtggcaaatcgttttgccagaaagggcgcgctgcggcaaaaaaacgtgcacgaggtcaaagaccacaaattcatcgcgcgtttcttcaagcaaccaaccttttgtagccattgcacagatttcatttggggttttggcaagcaggggtttcaatgccaggtgtgctgctttgtggttcacaaacggtgccacgagttcgtgaccttttcgtgtccaggggctgataaaggacccgatacagatgatccacgttctaagcacaaattcaagatccatacttacggttctccaaccttctgtgaccattgcggctcactgttgtatggcttgattcatcagggcatgaagtgcgacacttgcgatatgaatgtgcacaaacagtgcgtgatcaacgtcccatctctgtgtggtatggatcacaccgagaaacgcggaagaatatatctgaaggccgaggttgccgacgaaaaactgcatgtaacagttagggacgcaaagaatctaatcccgatggatcccaatggactgtctgacccctatgtgaaactgaagttaatcccggaccctaagaacgaatccaagcaaaagacaaaaaccattagatcgaccctgaacccgcagtggaatgagtccttcacctttaagctgaagccatccgacaaggataggcggctcagtgtggaaatttgggactgggatcgaacaacacgcaatgattttatggggagcttatctttcggcgttagcgagctcatgaagatgcccgcctccgggtggtacaagctgcttaatcaggaagaaggcgagtattataacgtgccaattcctgagggtgacgaggagggtaacatggagctgcgacagaagttcgaaaaagctaaattgggcccagctggtaataaggtgatctctccatcagaggacaggaaacagccgagcaacaacctggaccgggtgaaactgactgacttcaatttccttatggttctgggtaaaggatctttcggcaaggtgatgttggctgatagaaagggaactgaggaactgtacgccatcaagatcctcaagaaagacgtggtgatccaagacgatgacgttgagtgtacaatggttgagaaacgagtgctggctctgcttgacaagccacctttcctgacccagctccattcatgttttcagacagtagacagactgtacttcgtgatggaatatgtaaatggcggagacctcatgtatcacatccaacaagtgggtaaatttaaggagcctcaggcagtgttctatgccgctgaaatctccatcggactgtttttcctgcacaagcggggcattatctaccgggacctcaagctggataatgttatgctggattcagagggtcacatcaaaatcgctgacttcggcatgtgcaaagaacacatgatggatggggtgaccacgcggaccttttgcgggacaccagactacattgctccggaaattattgcataccaaccctacgggaagagcgtggattggtgggcctacggagtcctcctctatgagatgctcgccgggcagccaccattcgatggtgaagacgaagacgagctgttccaaagcattatggagcataacgtctcataccccaaatccttgtctaaagaagctgtaagcgtgtgcaaaggcctaatgactaagcaccccgctaagcgattgggatgtggtcccgagggagagcgcgatgtcagggagcatgccttcttcaggagaatcgactgggagaagctggagaatcgagaaattcagccgccgttcaaacccaaggtgtgtggcaagggagctgagaacttcgacaagttttttacacggggtcagccggtgttgactccccccgaccaattagtcatcgctaatatcgatcagagcgactttgagggcttcagctatgtcaatccacagtttgtgcaccctatattgcaatcagcagtctag

SEQ ID NO: 16832 - DNA, 2022 bp, Artificial Sequence
  Description of Artificial Sequence: Synthetic coding sequence
atggcagacccggctgcgggtcccccaccaagcgagggggaggaaagtaccgtgagattcgctcgaaagggcgcacttcggcagaagaatgttcatgaggtgaaaaaccataagttcacagcaaggttcttcaaacagccgaccttctgtagccattgtaccgactttatatggggctttggcaagcaagggttccagtgtcaagtgtgttgctttgtggtgcataaaaggtgtcacgagtttgttacattcagttgcccaggggccgataaagggcccgccagtgacgatccccgctccaaacacaagtttaagatccacacctactcctctccgaccttctgcgatcactgcggctcccttttgtatggcctgatccatcaggggatgaagtgtgacacgtgcatgatgaacgtacataagcgctgcgtcatgaatgtccctagcctgtgcggcactgaccatacagagcgtaggggaagaatttacatccaggcccacattgatcgcgatgtccttatcgtgctggtaagagacgcaaaaaacctcgtacctatggatcctaacggcctctctgacccctacgtgaagcttaaactgattcctgatcctaagtccgaaagcaaacaaaaaaccaaaactatcaagtgttctctgaatcccgaatggaacgagacattcagattccagctcaaggaatccgacaaagatagaaggctgagcgtagagatctgggattgggacctaacctctaggaacgatttcatgggttctttgtctttcggcatctccgaattgcagaaagctagcgtggacggttggttcaagctgttgtctcaggaagagggagagtattttaacgtgccggtgccccccgaggggagtgaggccaacgaagagcttaggcagaagtttgagcgtgcaaaaattagccaggggactaaggtccctgaagaaaaaacgaccaataccgtgtctaagttcgacaacaacggaaaccgtgatcggatgaagttgaccgacttcaacttcctcatggtgctcggtaaaggcagctttggcaaggtcatgctctccgaacggaagggcacagacgagctgtacgcagtaaaaatactgaagaaggacgtggtaatccaagatgacgatgtggaatgtaccatggtggaaaaacgcgtgcttgccctgcccgggaaacccccttttctgacacaattgcatagctgttttcagacaatggaccgactgtattttgtgatggaatacgttaatggcggtgacctgatgtaccatattcagcaggttggacggttcaaggagcctcatgccgtcttttatgcagcagaaatcgctatcggccttttctttttgcagtcaaagggcatcatttacagagacctcaaactggataacgtgatgttagactctgagggccatattaaaattgccgattttggcatgtgtaaagagaacatctgggatggcgtgaccacaaagacattctgcggtacgccagattacatcgctccagaaattatcgcctaccaaccatatggcaaatctgtggattggtgggcgttcggcgtcttattatatgagatgctcgcgggccaagctccctttgagggtgaggatgaggacgagttatttcagtctattatggagcacaacgtcgcatatccaaaatccatgagcaaagaggctgtcgctatctgcaaaggactcatgaccaagcatcccggaaaacgcctcggttgcggaccagagggggagcgtgatatcaaggaacatgccttcttccggtacattgattgggagaaactggagagaaaagagatacagccaccctataaaccaaaggcttgcgggaggaacgcggagaatttcgacagattctttactcgccatccacccgtgctgactcctcctgatcaagaggtgataaggaatatagaccaatccgagtttgaagggttctcctttgtgaatagcgaattcctgaagccagaagtcaaatcttag

SEQ ID NO: 16833 - DNA, 2016 bp, Artificial Sequence
  Description of Artificial Sequence: Synthetic coding sequence
atggcagatccggccgccggccccccgcccagtgagggtgaggaatccacagtcaggtttgctcggaagggtgccctcaggcagaaaaacgtccatgaggtaaagaaccataagttcaccgccaggtttttcaaacaaccaaccttctgttctcactgtactgacttcatctgggggttcggcaaacagggattccagtgccaggtctgctgctttgtggttcataagcgctgtcacgagttcgtgacattctcttgtccaggggcagacaagggacccgccagtgatgaccctcggagcaagcacaagttcaaaatccatacatatagctctcccactttttgtgatcactgtgggagcttattatatgggctcatccaccaaggtatgaaatgcgacacatgcatgatgaatgtgcacaaacggtgcgtgatgaatgtgccctctctgtgcggcactgatcatacagagcgacgcgggaggatctatattcaagcacatatagatagggacgtgctcatagtgctcgtacgcgatgccaaaaacctcgttccaatggatcccaatgggctgtccgatccatacgtcaaactgaagttaattcccgatccaaaatcagaaagcaagcaaaaaaccaagactattaagtgctcactgaacccagaatggaatgagaccttcagatttcagctcaaggaatccgacaaggatcgacgcctctccgtcgagatttgggattgggatcttacatcccgcaatgactttatggggtctttatcattcgggatcagcgagctacagaaggcatcagtggacggatggttcaaactcctgagtcaggaagagggggaatacttcaacgtgcccgtccctccagaaggctccgaggccaatgaggaactgcgccagaaatttgaacgagctaagatctcccagggcaccaaagtgccggaggaaaaaacaactaatactgtctccaaattcgacaataacgggaaccgcgacagaatgaaactcacggatttcaactttttgatggtcctcggtaaaggcagtttcggtaaggtcatgctctcagaacggaagggaaccgacgaactgtacgcggtgaaaatcctgaaaaaggatgttgtgatccaggacgacgacgtcgagtgcactatggtcgaaaagagagtacttgctctgcctggaaagcccccatttctcacgcaactccacagctgttttcagacgatggatcgtctgtacttcgtgatggagtacgtcaacggcggggatttaatgtatcatatccagcaggtggggcgttttaaggaaccacacgcggttttttacgctgccgagattgcaatagggctatttttcttacagtctaaaggaattatctatcgagatctgaaactggacaacgtgatgctcgactcagaaggtcatattaagatcgcagacttcggtatgtgcaaggagaacatttgggatggtgtaacaacaaagacgttttgcgggacacctgattatatcgcaccagaaattatagcctatcagccttatggtaaatctgtggactggtgggcatttggcgtgctcctttatgaaatgctagcggggcaggctccatttgagggtgaggacgaagatgagttattccagagcattatggagcataacgtcgcataccctaagagtatgtccaaggaggccgtcgccatatgcaaggggctgatgacaaagcacccaggaaagaggcttggatgcgggcccgagggtgaaagggacataaaagaacacgcgttttttcgctacatcgactgggagaaattggagagaaaagagatccagccaccatataaacctaaggccagagacaaacgcgacacaagcaatttcgacaaggagtttaccaggcagcccgtcgagctcactcccacggacaaattattcattatgaacctggaccagaatgagtttgctggctttagttataccaaccccgaattcgtaatcaatgtatag

SEQ ID NO: 16834 - DNA, 786 bp, Artificial Sequence
  Description of Artificial Sequence: Synthetic coding sequence
atgagagagagcgcacttgaacgggggccagtccctgaagcgccagccgggggcccagtgcatgccgtgacagtagtgacgctgctcgagaagctggccagtatgcttgagacacttcgcgagaggcaggggggattggcgcgccggcaaggcggtttagcgggcagcgtgcggcgcatccagtctgggctcggggccctgagtcggagtcatgatactaccagtaacaccttagctcagcttctagccaaagcagagagagtttctagtcatgcgaacgccgcacaggaacgggctgtacggcgcgccgcccaggtgcagaggttggaggccaaccacgggctattggtggcacgaggcaaactgcacgtcctgctctttaaagaagagggagaagtccctgccagcgccttccagaaggcccccgagccactgggacccgcagaccagagtgagctagggccggagcaacttgaagccgaggtaggggagagctcagatgaggagccggtggagagtcgagcccaacgtttgagaagaaccggcctacagaaagtgcagtcacttagacgagccttatccggtcggaagggccccgctgccccaccacccacccccgtaaaacctccacggttgggaccgggcaggtctgccgaagcacaacccgaggcccagcctgccctggaacccaccctcgaaccggagcccccacaggacactgaagaagacccggggcgaccaggggccgccgaggaagccctgctgcagatggagtcagttgcttag

SEQ ID NO: 16835 - DNA, 2214 bp, Artificial Sequence
  Description of Artificial Sequence: Synthetic coding sequence
atggtggttttcaatggtcttctcaagatcaagatctgtgaggccgtgagtttgaagcctaccgcatggtccctgcgccatgccgttgggcccagaccacagacatttctgcttgatccatatatcgctctcaatgttgatgactccagaatcggccaaacagctacgaaacagaagacaaactctccagcgtggcatgatgagttcgttaccgacgtctgtaatggaaggaagatcgaactggctgtctttcacgacgcacccatcggatacgacgatttcgtagctaattgtacaatccagtttgaggaactactacagaacggaagccgccattttgaggactggatcgacttagaaccagaagggcgggtctacgttatcatagatctgtccgggtcatcaggagaggccccgaaggacaacgaagagagggtgttccgcgagcgcatgaggccaaggaagagacagggcgcagtgcggagaagggtgcatcaggtgaacggtcacaagttcatggcaacatatttgaggcagcctacgtactgtagccactgtcgagatttcatttggggggtaatcggcaagcagggctatcagtgccaggtctgcacatgcgtggtgcataaaaggtgccacgagctcatcattacaaaatgcgcagggctgaaaaagcaggaaacgcctgatcaggttggcagtcagcgcttctctgtgaacatgccgcataagtttgggatccacaattacaaagtcccaactttttgcgatcactgtggcagtctactctggggcctgcttaggcagggtcttcagtgtaaggtgtgtaagatgaacgttcaccgtcgctgtgagaccaacgtggcaccaaattgcggtgtggatgcgagagggattgccaaagtactggccgacttaggtgtaacgccagataagatcacaaacagcggtcagcggcgcaaaaagttaatcgctggggccgaatctccccagcctgcctctggatcatccccaagtgaagaggatagatctaagtctgcccctacttcaccatgtgatcaagagattaaggagcttgaaaacaacatccgcaaagcactgtcattcgacaatagaggggaggagcacagagccgcttctagtcccgacggacagctcatgtcccctggcgagaacggtgaggttcgccagggacaggccaaaaggcttggccttgatgaatttaacttcatcaaggtcctaggaaagggttcgttcggaaaggtgatgctggccgagctgaaagggaaggatgaagtatacgctgtcaaggttcttaagaaggacgtgatacttcaggatgacgatgtcgattgcaccatgaccgagaagaggattctggctctcgctcgcaaacatccatacttgacccagctctactgctgttttcagacgaaggaccgattatttttcgtcatggaatacgtaaacggcggagacctcatgttccagatacagcggtcccggaagttcgacgaacctagaagccgattttacgccgctgaggtgacaagtgccttgatgttccttcaccaacatggcgtaatctaccgcgaccttaaactggacaacatactcttagacgcagagggccattgtaaattagcagacttcggaatgtgcaaagaaggcatcttaaacggtgtaacgacaactacattttgtggaaccccagattacatagctccagagatcctgcaggagctggaatacgggccctcagtggattggtgggccctgggcgttctgatgtacgaaatgatggctggccagccgccattcgaggcagacaatgaagacgaccttttcgaatctatactgcacgacgacgtgctgtatcccgtatggctgtccaaggaggctgtgtcaatcctgaaagcgttcatgacaaaaaaccctcataaacgcttgggctgcgtggcctctcaaaatggcgaggacgcaatcaagcagcacccatttttcaaggagatcgactgggtactcctggaacagaagaagattaagcctcctttcaaacccaggattaagaccaagcgagacgtaaataatttcgaccaggacttcactcgtgaagagccagtattaactctggtggacgaggctattgtaaaacagattaatcaggaagagttcaaaggcttcagctacttcggggaggatcttatgccttag

SEQ ID NO: 16836 - DNA, 384 bp, Artificial Sequence
  Description of Artificial Sequence: Synthetic coding sequence
atggtggtctttaacggcctgctaaaaattaagatttgcgaggccgtctcccttaagcccaccgcgtggtcacttcgacacgctgtcgggcctaggccacagacgtttctccttgatccttacatcgctctcaatgtcgatgactcgaggattgggcagaccgccacgaaacagaagaccaactctccggcctggcacgatgagtttgtcacagatgtgtgtaatggtcgaaaaatagaactcgcggtattccacgatgcccctattggctacgacgattttgtcgccaactgcacaatccagttcgaagaattgttacagaacgggtcgcggcactttgaagattggattgatctcgaaccagagggccgtgtgtacgtttag

SEQ ID NO: 16837 - DNA, 2094 bp, Artificial Sequence
  Description of Artificial Sequence: Synthetic coding sequence
atggccggtcttgggcccggagtaggcgactccgaaggcgggccacggcctttattttgtcgaaagggagctttgcgtcagaaggtagtccacgaagtaaaatcacacaagttcacggctcgatttttcaaacagccaacattctgtagccactgtaccgacttcatctgggggatcggcaagcagggattgcaatgccaggtttgttccttcgtggtgcatagacgttgccatgaattcgtcactttcgagtgtcctggggcggggaaggggccacagaccgatgaccctagaaataaacacaaattcagactccactcctattctagccctaccttttgtgaccactgcggctcactgctgtatggactggtgcatcagggaatgaaatgctcctgctgcgagatgaacgtccacagaaggtgtgtgagaagcgtaccaagcctgtgcggggtggatcacactgagcgacgaggacggctgcagctagaaatacgcgctccaacagccgatgagatacacgttaccgttggcgaggctcgtaacttgataccaatggatcctaacggcttatcagacccatatgtgaaactcaaactcattcccgaccctcggaacctgaccaagcagaagactagaaccgtgaaagctacccttaaccctgtttggaacgaaacattcgtgttcaatctcaaacccggcgacgtagagaggcggttgagcgtagaagtctgggattgggatcgtacctctcgtaatgactttatgggggctatgtcttttggagttagcgagttactgaaagcccctgtggatgggtggtataagctgctgaatcaggaggaaggcgagtactacaacgtccctgtggcagacgcagacaattgtagccttctccagaagtttgaagcttgcaactaccccctggagctttacgagcgggtccgaatgggaccatcaagttccccaataccgtctcctagcccttcccccacagacccgaagcgctgcttcttcggcgcctctccaggccggcttcacatcagtgactttagcttcctcatggtgctgggtaagggtagctttggcaaagtgatgttggccgagcgccgtggttctgacgagctgtatgcaatcaagatacttaaaaaggatgtgatcgttcaggatgatgacgttgattgtactttagttgagaagagagttctggctctgggcggccgaggtccaggcggtaggccccatttcctcactcagctgcatagcacattccagacccccgatcgcttatacttcgtgatggagtacgtgacagggggcgatctcatgtaccatatccagcagctcggaaagttcaaagaacctcacgccgccttctacgcagccgaaattgccatcggattattctttctacataatcagggcataatctatagggatctgaaactggataacgtcatgctggatgctgagggacatatcaagattacagatttcgggatgtgcaaagagaacgtgttccccggcacaaccacgagaacattttgcggcacgcctgattacattgcacccgaaattattgcttatcagccgtacggaaaaagtgtcgattggtggagctttggggtcctgctgtatgagatgcttgccggtcagccaccctttgacggcgaggatgaagaggagttgttccaggccataatggagcagactgtcacgtatcccaaatccctcagtagggaggctgtcgccatttgtaaaggttttctgacaaagcaccccggcaaacggcttggctctgggcccgatggagagcccactatccgcgctcacgggttcttcaggtggattgactgggaacggctggagagattggagattccacccccattcagaccaaggccctgcgggaggtcaggagaaaactttgacaagtttttcacccgagccgcccctgcactcactcctccagaccggctcgtcttagccagtatagaccaggccgatttccaggggttcacatacgtgaatccagattttgttcacccggacgctcgatcccccacttctcccgtgcctgtccccgtgatgtag

SEQ ID NO: 16838 - DNA, 984 bp, Artificial Sequence
  Description of Artificial Sequence: Synthetic coding sequence
atggcagggcttggtcccggcgtaggagattcagagggtggtccgaggcctctcttttgccgcaaaggagcgttgaggcagaaagttgtacacgaagtaaaaagtcacaagttcacagctcgttttttcaagcagcccaccttttgttcccattgcactgatttcatctggggtattggaaagcaggggctccagtgtcaggtgtgcagttttgttgtccacagaaggtgtcacgagttcgtcacctttgagtgccccggcgccgggaaagggccacagacagacgacccgcgtaacaagcataagttccgcctgcattcatacagttcaccgaccttctgtgatcactgtgggagcctactgtacggcctggtgcaccaaggcatgaagtgttcatgctgcgaaatgaacgtgcaccgaaggtgcgtgcgaagcgttccttctctttgtggcgtcgatcataccgaaaggagggggcggctgcagctggagatccgcgcgcccaccgctgacgaaattcatgtcactgtgggagaagccagaaatttaatccccatggacccaaatggcctctcagacccatacgtaaagctgaagctcataccagatccgaggaacctgaccaaacaaaagacacgcactgtgaaggcaacactgaaccctgtttggaatgagacctttgtgttcaatcttaaaccgggagacgttgaaaggcggctgtccgtagaggtgtgggactgggataggaccagcagaaacgactttatgggagctatgagcttcggagtgtcagagctgttaaaggccccagtcgacggttggctggtgaccacaccttggaactgtatgtccgggtgcggatgggccccattacctctgcctagtcccccactccctctggtgccaccgacgcctagcgccgcatcctccggccgggtgcaggacgcctgcactagcccaacctctgcatcctcttggttctag

SEQ ID NO: 16839 - DNA, 2133 bp, Artificial Sequence
  Description of Artificial Sequence: Synthetic coding sequence
atggctgggttaggtcccggggtgggggacagtgagggaggaccaaggcctttgttttgtcgtaagggggccctgcgacagaaggtcgtgcacgaagttaagtcacacaaatttaccgcaaggtttttcaagcagccaaccttctgttctcattgcactgactttatatgggggatcggtaaacagggattacagtgccaagtgtgttccttcgtcgtgcataggcgctgccatgaatttgttacatttgaatgcccgggagccgggaagggaccacagacggacgatcctcgaaacaaacacaaattcaggctgcacagttattcaagccctacattttgcgaccattgcggaagcctcctttatgggcttgtacaccagggaatgaagtgttcttgctgcgaaatgaacgttcaccgtcgttgcgtaagaagtgttccaagcctgtgcggcgttgatcacaccgaacgtcgcggcagactgcagctcgagattagagccccaactgctgatgaaattcatgtgacagtaggagaggctcggaatctaatccctatggaccctaacggcctgtctgatccctatgtgaagctgaagctgattccagaccccaggaacctgaccaagcaaaagactaggaccgtgaaagctaccctaaatccggtatggaatgagacgtttgtattcaaccttaaacccggtgatgtcgagcgcagactgagcgtcgaagtatgggattgggatcgcacatcccgaaacgatttcatgggtgccatgagctttggggtgagtgaattgttgaaggcccctgtggacggctggtataaacttttaaaccaggaagaaggcgaatattacaacgtccccgtggccgatgccgataattgttctctgctgcaaaaatttgaagcctgcaattaccctctggaattgtacgagagggtgcgcatgggaccgagttcttctcccattccaagcccttccccttcaccaactgacccaaagcggtgctttttcggggcctccccagggagactgcacatatccgatttcagttttctcatggtcctcggaaagggaagcttcggcaaagtgatgctggcagagcgaagaggttcagacgagttgtacgccatcaaaatcctgaagaaagacgttatcgtccaggatgatgacgttgattgcacactggtcgagaagagagttcttgccctcggcggccgaggaccaggggggaggcctcacttcttgacacagctccactcgactttccagacgcctgatagattgtacttcgtcatggagtacgtcacaggcggcgatctgatgtatcacatacagcagctgggcaagtttaaagagccccacgcagctttctatgccgcggaaatcgcaattggactcttttttctgcataatcaaggaattatttatagagacctgaaactggacaatgtgatgctagacgctgaaggccatatcaaaatcaccgatttcggtatgtgcaaggaaaacgtgttccccggcacaaccactaggactttttgcggaacccccgattacatcgcaccagagattattgcctatcaaccatacggcaagagtgtcgactggtggagcttcggcgtgcttctgtacgaaatgctagctggccagcccccctttgatggagaagatgaggaagaactcttccaggccattatggagcagaccgtgacatatcccaaatccttatccagggaagcagtggctatttgtaaagggttcctgacaaagcatcctggaaagaggctcggcagcggacctgatggagagccaactatcagggctcacggattcttccgctggatcgattgggagagactggaacggctcgagattccaccaccctttagaccccggccttgcggtaggagcggagaaaatttcgataagttttttaccagagcagcacctgcactcactcccccagatcgcctcgtgttagccagcatcgatcaagcggacttccagggtttcacttacgtgaaccccgatttcgtccaccctgatgcacgtagtcccacttctcctgtccctgtccctgtcataagctgcactcctgcatttcagctttgcccaagaggcttctag

SEQ ID NO: 16840 - DNA, 1647 bp, Artificial Sequence
  Description of Artificial Sequence: Synthetic coding sequence
atgccccggatctgtgatctccgcgtatctaggagatgggaaggacccccagacggacggtgcgagatgaacgtgcaccgccgctgtgtgcgctcggtaccgagtttgtgtggtgtggaccatacagaaagaagaggacgtcttcaactggagatcagggcccccactgcagacgaaatacacgtcactgttggagaggccaggaacttgatcccgatggatcccaatggtctgagcgacccatacgtaaagctcaagctgattccagatcccagaaatttaacgaaacagaagacaaggactgtgaaggccacgttgaatccagtgtggaacgagacattcgtgtttaacctcaagcctggggatgtggaaagaagactgtcagtcgaggtctgggattgggatcgaacaagtagaaatgacttcatgggtgcgatgtcattcggagtctccgagctcttaaaagcgccagtagacggatggtacaagctactgaatcaggaagagggcgaatattacaacgtgcccgtcgccgatgccgataactgtagcttactgcagaaatttgaggcctgtaattaccctcttgagctctacgagcgagtgagaatggggccatccagctccccaatcccctcaccgagcccctcacctaccgaccccaaacgatgtttttttggagcttcacccgggcgactacacatctctgatttctcattcttaatggtgctggggaaagggtctttcggcaaggttatgttggctgaacgcagaggaagcgacgaactttatgcgattaaaatattgaaaaaagatgtgatcgtccaagatgatgatgttgattgtacactggtagagaagagggtgttagctctgggtggaagaggcccaggcggtaggccccacttcctgacccaactgcattctacatttcaaacccccgataggctgtatttcgtaatggaatatgttacaggcggggatttaatgtaccacatacagcaactgggaaagtttaaagagccccatgctgcattttacgccgccgaaatcgccatcggattatttttcttacataaccagggcataatttacagagatctcaaacttgacaatgttatgctggatgccgaaggacacattaaaattacggatttcggcatgtgcaaagagaacgtgtttcctggtacaaccacacggacgttctgcgggaccccagactatatcgcacctgagattatagcataccagccctacggaaagtcggtggactggtggagcttcggtgtgctgctgtacgagatgttggcaggtcagttcctaactaaacatccaggcaagcgcctgggttctggacctgatggggagcctacaattagggcccatggttttttccgatggattgactgggaacgcctggagcgactggagataccccccccattcaggccccggccatgcggacggtctggcgaaaacttcgataagtttttcactcgagctgctcctgccctcacaccaccagatagattggtactggcgtccatcgatcaggcagacttccagggctttacttacgtgaatccagacttcgtgcacccggatgcacgctcaccaacttcccccgtaccggtgccagtgatgtag

SEQ ID NO: 16841 - DNA, 1779 bp, Artificial Sequence
  Description of Artificial Sequence: Synthetic coding sequence
atgcccagtaggaccggccccaaaatggagggctccggtggacgcgtgaggctgaaagcgcactacggcggagacatttttataaccagtgtggacgctgctacgacgttcgaggaactgtgcgaggaagtgcgcgatatgtgtcgcctacaccagcagcaccccctgaccttgaaatgggttgactctgaaggagacccttgcacagtgtccagccagatggagctcgaggaagcattcagacttgcacgtcaatgtcgagacgaagggctgattattcacgtgttcccctcaactcctgagcaacccgggttgccatgtccaggggaggataagagtatctataggcggggcgcacgccgctggagaaaactctacagagccaatggtcatttattccaggcgaagagatttaacaggagggcgtactgcggacagtgttcagagaggatctggggactggcaaggcagggctataggtgtatcaattgcaaactgctggtgcataaacggtgccatggactcgtcccactgacctgtcggaaacacatggactctgtcatgcctagtcaggagccaccagtggatgacaaaaacgaagacgctgaccttcccagcgaagagacagacggcatcgcctacatatcctcgtcaaggaaacacgactctattaaggacgattcggaggacctgaagccagtcatcgacggaatggatgggattaagatttcgcaggggttggggctccaggactttgacctcatccgtgttattggacgcgggtcttacgctaaagtgctgctggtacgcctcaagaaaaacgaccagatatatgctatgaaagtcgtcaaaaaggaattggtgcatgacgatgaggacattgattgggtccaaacggaaaaacatgtgttcgagcaagcaagcagtaatccgtttctcgtgggtttgcactcctgcttccagactacttcccggctgtttctggttattgagtatgtgaacggaggggacctaatgtttcacatgcagcgccagagaaaactcccagaggaacatgcaaggttctacgccgccgaaatctgtatcgctttaaatttcctccacgaaagagggataatctaccgcgatttgaagcttgacaatgtgctgctggatgcagacggacacatcaagttaaccgactacgggatgtgtaaggaaggtctcggcccgggcgacacaaccagcactttttgcggcacacccaattacatcgctcccgagatcctcaggggcgaagaatacggcttcagcgtggattggtgggcactgggggttctcatgtttgagatgatggcgggaaggtcaccattcgatatcataacggacaaccccgacatgaatacagaggattacctgtttcaggttatcttagagaagcctatccgcatcccaaggtttctgtccgtcaaagcctcccacgtcctcaaggggtttctaaacaaagatcctaaggaaaggctcggatgtagaccccagactggattttcagacatcaaatctcacgccttctttcgatccattgactgggatctgcttgaaaagaaacaggccctccctcccttccagccccagatcaccgacgactacgggctcgataacttcgatactcagttcacatcagagccagtgcagctgactccagatgacgaagacgctatcaagcgcatcgaccagagcgagtttgagggtttcgagtacattaatcctctgctcttatcgacagaagagagtgtgtag

SEQ ID NO: 16842 - DNA, 1230 bp, Artificial Sequence
  Description of Artificial Sequence: Synthetic coding sequence
atggactcagtgatgccatcacaggagcctcctgtggatgacaagaacgaagacgctgatctgcccagcgaggagactgacgggatagcgtacatcagcagctcacgcaagcatgactctattaaggacgattctgaagacctaaagccagttattgacgggatggatgggattaagattagccaaggactgggactgcaggactttgacttgatcagagtcattgggagggggtcctacgctaaggtcctgttggtgcgcttgaagaagaacgaccagatttatgccatgaaggttgtgaaaaaggaactggttcatgatgacgaggatattgactgggtgcaaaccgaaaagcatgtgtttgagcaagcttcctccaaccccttcctcgtcgggctccattcctgcttccagactactagtcgtctctttctggttatcgaatacgtgaatgggggtgatctgatgtttcatatgcagaggcagcgaaagcttcccgaggagcacgcccggttctacgctgccgaaatttgtattgcactgaatttcctgcacgagagaggcataatttatagagatcttaagctggataacgtgctgctcgacgcagacggacatattaaactgactgattacggaatgtgcaaagaaggcctgggtccgggcgatacgacttccacattttgcggtacccctaactatatcgcacctgagatcctgcggggggaggagtacgggtttagcgttgactggtgggccttgggggttttaatgtttgagatgatggctggccgaagtccttttgacattatcactgataatcctgacatgaatacagaggactatctgtttcaggttattctggaaaaacctatcagaatcccccgttttttgagtgtgaaagcaagccatgtcctcaagggctttttgaacaaggacccgaaagagagattgggttgtcgccctcaaactggattttccgatattaagagtcacgctttctttaggtcaatagactgggacctgctggagaagaagcaggctcttcctcctttccagccccagatcacagacgactatggtctcgacaactttgacacgcagtttacgtcagaacccgttcaactgaccccagatgacgaagacgccatcaagaggatcgaccaaagtgaattcgaaggttttgaatacatcaatcccctgttattatctactgaagagagtgtctag

SEQ ID NO: 16843 - DNA, 1230 bp, Artificial Sequence
  Description of Artificial Sequence: Synthetic coding sequence
atggattccgtcatgcctagccaggagccaccagtagacgacaagaacgaagatgccgatctcccttctgaagagacagacggcattgcttatataagctcctcgcggaagcacgatagtatcaaggacgacagcgaggacctgaagcctgttatagatggtatggatggaatcaagatatctcagggcctgggtctgcaggatttcgatctcatccgggttattggaagaggcagctatgccaaggtccttctggtgcggttaaaaaaaaacgaccagatctacgcaatgaaggttgtcaaaaaagaacttgtccacgatgatgaggatattgattgggtacagactgagaagcatgtgtttgagcaggcatcctcaaatcccttcttggtgggactgcactcctgcttccaaactacttcccgactgtttctggtaatagagtatgttaacggaggagatttgatgttccacatgcagcgacagcgcaagttacctgaagagcacgctcgattttacgctgccgagatatgtatcgcactcaactttctccacgagagaggaattatatatcgagatctcaaactcgataacgtactcttggacgccgatggtcacatcaagttaactgactacggaatgtgcaaggagggtctgggtcctggggacacgacatcgacattctgcggaacacccaattacatcgctccagaaatactgaggggtgaggagtatggtttctctgtcgattggtgggctctcggtgtccttatgttcgagatgatggccgggagatcgccatttgatatcattacagacaacccagatatgaacacggaagattacttatttcaggtaatcttggaaaagcccattaggatccctagatttttatcagtgaaagcctcgcacgtgctcaaaggttttctgaataaagaccccaaagagcggttagggtgccgcccccagaccggattctctgacataaagagccacgccttttttcgctctatcgactgggatctcctcgaaaaaaagcaagctctgcctccgttccagcctcagatcacagacgattatggcctcgacaacttcgatacccagttcacaagcgagcccgtgcaactaactcccgacgacgaggacgcaataaaacggattgaccagagcgaatttgaaggctttgagtatatcaatcctctgctgctttcaaccgaagagtccgtgtag

SEQ ID NO: 16844 - DNA, 1467 bp, Artificial Sequence
  Description of Artificial Sequence: Synthetic coding sequence
atgctcactcctaggaccgatgagagcatttacaggcgcggcgcccgcaggtggcgtaagctttaccgggcaaacgggcaccttttccaagctaagaggttcaatcggagggcctactgcgggcaatgttccgagcggatatggggcttggctaggcaaggctacaggtgtattaactgcaagttactggtccacaaaaggtgtcacggcctggtcccgttgacatgcaggaaacacatggattccgttatgcctagtcaggagcctcctgtcgacgacaagaacgaggacgctgacctaccctcggaggaaacggatggcatcgcctatattagttcctccaggaaacacgacagcatcaaggatgatagcgaggaccttaaacccgtgattgatggaatggacggaatcaagatttcacagggtttggggttacaggattttgatctgatacgcgtgattgggcgtggatcgtatgcaaaggtactgttagtgaggcttaagaaaaatgatcaaatatatgctatgaaggtagtgaagaaggagctggtccatgatgacgaggatatcgattgggtgcaaacggaaaagcacgtatttgaacaggctagtagcaaccccttcttagtgggactacactcttgttttcagacaacatctcggcttttcctggtcattgaatatgtaaacggtggggatctgatgttccacatgcagagacagcggaaattacctgaggagcacgcccgattttacgcagccgagatctgcatcgccctgaatttcctgcacgaaagaggcataatctatcgggatctcaagctggataacgtgctgctggatgcagatggacacatcaagctcacagactatggcatgtgcaaggaggggctcggccctggggataccacttccacattctgtggcaccccgaattacattgctcccgaaatcctgcgcggggaagaatatggcttcagcgttgattggtgggccctgggggtgctgatgttcgagatgatggccggaagatccccattcgatattattaccgacaacccagatatgaacaccgaggactacctctttcaggtgattctggaaaagcctatccgaattccacggtttttgagtgttaaggcctcccacgtgttaaagggctttttaaataaggatccaaaagaacgcctgggatgccgtcctcagacagggtttagcgatattaagtctcatgctttttttcgctccatagactgggatctgctggagaaaaagcaggccctgccccccttccaacctcagattaccgatgattacgggcttgataattttgacacacagtttacctccgaaccggttcagctcacgcccgatgatgaggatgccattaagcgaatcgatcaaagcgagttcgagggtttcgagtacatcaaccccctactgctttcaaccgaagaatccgtgtag

SEQ ID NO: 16845 - DNA, 78 bp, Artificial Sequence
  Description of Artificial Sequence: Synthetic coding sequence
atggatagtgtgatgccctcccaggagcccccagtggatgataaaaacgaggacgctgacctgccctcggaagagtag

SEQ ID NO: 16846 - DNA, 249 bp, Artificial Sequence
  Description of Artificial Sequence: Synthetic coding sequence
atggactctgtcatgcctagccaggaaccccctgtagatgataaaaatgaggacgccgacctgccgtctgaggaaacagacggcatagcttatatcagctccagccgcaagcatgattctatcaaagatgacagtgaagaccttaagcccgttattgacggaatggatggcatcaagatctcccaggggttaggtctacaagactttgacctaatcagggtcatagggcgcggaagttatgcaaaatag

SEQ ID NO: 16847 - DNA, 297 bp, Artificial Sequence
  Description of Artificial Sequence: Synthetic coding sequence
atggattcggtgatgccgtctcaggagcctcccgtagacgacaagaacgaggatgctgatctgccgagtgaggagactgacggaatagcctatatctcctcgtctagaaaacatgacagcatcaaggatgacagtgaggacctcaagccggtgatcgacggcatggatggcataaagataagccaaggactgggcctccaggacttcgacttaataagagtgattgggagaggaagctacgccaaagtgctattggtgcggctaaagaaaaacgaccagatttacgcaatgaaatag

SEQ ID NO: 16848 - DNA, 330 bp, Artificial Sequence
  Description of Artificial Sequence: Synthetic coding sequence
atggactctgtgatgccctcacaggagccccccgtcgatgacaagaatgaggacgctgatctgccgagtgaagagactgatggtattgcgtacatctcatcctctcgaaagcacgacagcataaaggacgattctgaggaccttaaaccagtaattgacgggatggacggtatcaaaattagtcagggcctgggacttcaggattttgatctgatcagagtcataggcaggggatcttatgccaaggttctcttggtgagactgaaaaagaatgaccagatttacgccatgaaggtggtcaaaaaggaactggttcacgacgatgaatag

SEQ ID NO: 16849 - DNA, 141 bp, Artificial Sequence
  Description of Artificial Sequence: Synthetic coding sequence
atggactctgtcatgccaagtcaagaaccacccgtcgacgacaagaatgaagacgcagacctgccaagtgaggagactgacgggattgcatacatttcgtcctctcgaaagcacgacagtattaaggatgactctgaatag

SEQ ID NO: 16850 - DNA, 222 bp, Artificial Sequence
  Description of Artificial Sequence: Synthetic coding sequence
atggactccgttatgccttctcaagagccaccagtggatgataaaaacgaggatgccgatttaccctccgaggagactgacggcatcgcttacatctccagttccagaaaacatgacagcatcaaagacgacagcgaggatctcaagcccgtgatcgatggaatggacggcattaaaatttctcagggactgggactgcaggactttgatttaatacggtag

SEQ ID NO: 16851 - DNA, 66 bp, Artificial Sequence
  Description of Artificial Sequence: Synthetic coding sequence
atggacagcgtgatgccctcccaggagccaccagtggatgataagaatgaagacgccgatctgtag

SEQ ID NO: 16852 - DNA, 216 bp, Artificial Sequence
  Description of Artificial Sequence: Synthetic coding sequence
atggacagcgtgatgccatcacaggagccgccggtggacgacaagaacgaagatgctgatctcccttccgaagagactgatggtattgcatatattagctctagcaggaagcatgactccattaaggatgacagtgaggatctgaagccagttatcgacgggatggacggcatcaagatctcacaaggcctggggctccaagactttgacctttag

SEQ ID NO: 16853 - DNA, 417 bp, Artificial Sequence
  Description of Artificial Sequence: Synthetic coding sequence
atgatcagtctgactgacacacagaagatcgggatgggcctgacaggattcggggtcttcttcctctttttcggcatgatcctgttctttgataaggccttattggcgattggtaatgtcctctttgtggctggtctcgcattcgtgatagggctggagcggacctttagatttttttttcagaagcataaaatgaaggctaccggcttcttcctgggcggtgtttttgtggttctgatagggtggccactgatcgggatgatttttgaaatctacggcttctttctcctgtttaggggattctttcccgtggtggtgggctttatcaggagggtgccggtcctcggaagtttgctgaacctgccggggattcggtcattcgtggataaggttggggagtctaacaatatggtatag

SEQ ID NO: 16854 - DNA, 702 bp, Artificial Sequence
  Description of Artificial Sequence: Synthetic coding sequence
atggactcaccagaggacgcggacctgttccacagcgaggagatcaaggcgccggaaaaagaggagttcctagcctggcagcacgaccttgaagtgaacgataaagctcctgcccaggccaggccaactgtcttcagatggacaggcggcggaaaagaggtatatctgtcaggttcgttcaataactggagcaaactccccctgacccgcagtcataacaattttgtggccatactggatctgcccgagggcgaacatcagtataaattctttgtcgacggacagtggacccatgatccttcagagcccatcgtgacgagtcagttgggtacagtaaacaatattatacaagtgaaaaaaaccgattttgaggtgttcgatgccctgatggtggattcccagaagtgctccgacgtatccgaattgtcctccagcccccctggcccttatcatcaggagccgtatgtgtgtaaacccgaggaacgattccgcgcaccacctatactcccaccccacctgctgcaggtaattctgaataaggacacgggaatctcatgcgatccggccctcctacctgagccaaaccatgttatgctgaaccacctgtatgcgctgtccataaaagatggtgttatggtgctgagcgctacgcaccgctataaaaagaagtacgttacaactctattgtacaagccaatctag

SEQ ID NO: 16855 - DNA, 813 bp, Artificial Sequence
  Description of Artificial Sequence: Synthetic coding sequence
atgggcaacacttcgtcagaaagagccgcgctggagagacacggcggacacaagaccccacgacgggattcgtccggcggaaccaaagacggtgaccgccccaagatcctgatggactctccggaggatgcggacttgttccacagcgaagagattaaggcacccgaaaaggaagagttcctcgcctggcagcacgacctagaagtaaacgataaggctccggcccaggccaggccgacggttttccgctggacaggcgggggaaaagaagtctacctctcaggatcttttaacaactggtccaagctgccactaactcgaagtcataataactttgttgcgatattggaccttccagagggtgaacaccaatataagtttttcgtggacggccagtggactcacgacccgtccgaacccatcgttacatcccaactgggcactgtgaataatatcatacaggtcaaaaaaactgatttcgaagtctttgatgccttaatggtggactctcagaagtgtagtgacgtgtccgagctctccagttcgcccccaggcccttaccaccaggagccttatgtctgcaaacctgaagaacgattccgtgcccctcctatcttaccccctcacctgctgcaggtgatcctgaataaagatacgggtatcagctgcgacccggccctgcttcccgaaccaaaccacgttatgctcaatcacctgtatgccttgtccatcaaggacggcgtgatggtcctttctgcaacacatcgctacaaaaaaaagtacgtcaccactctcctctacaagcctatttag

SEQ ID NO: 16856 - DNA, 12384 bp, Artificial Sequence
  Description of Artificial Sequence: Synthetic coding sequence
atggctggctcaggagcaggcgtccgatgctctctcctcagactgcaggagactctcagtgctgcagaccgctgcggcgcggccctggcggggcaccagttaatccggggcctgggccaggaatgcgttctttctagcagccccgcagtcttagcccttcagacatctctcgtgttttcccgcgacttcgggttactcgtgtttgtgcgtaaatcgttgaactctatcgaattccgagaatgccgagaggagatcctaaagtttctgtgtatctttcttgagaagatgggtcagaaaattgcaccatacagtgtcgagatcaaaaatacttgtacatcagtttataccaaggatagggcggccaagtgcaagattcccgccctcgatttactgattaaactgctgcagacgttcagatcctccagactgatggatgagttcaaaatcggtgagctgttctctaagttttacggcgaactcgctctaaaaaaaaagatccccgataccgttctggaaaaagtctatgaactgttgggtctgctcggggaggtccatcctagtgagatgattaacaatgctgagaacctcttcagggcctttctgggcgagctgaaaacccagatgacctccgctgtgcgtgaaccaaaactgcctgtcctcgccgggtgtctgaagggcctatcttctctactctgtaactttaccaagagcatggaggaggacccccaaacgtccagggaaattttcaattttgtgctgaaagccatcagaccacaaatcgatctcaagaggtatgccgtgccttccgcaggtttacgcctgttcgccctgcacgcttcgcagttcagcacctgcctgctggacaactacgtcagtctttttgaggtgctgctaaagtggtgcgcccatactaatgttgagttaaaaaaggcggccctgtctgccctggaatccttcttgaaacaggtatctaacatggttgcaaagaatgccgagatgcataagaataaactccaatactttatggagcaattttacggaattatccggaacgttgacagtaataacaaagaattgtctattgctatacgaggctacggtctgtttgcaggtccctgcaaggtcattaatgccaaggatgtggactttatgtacgtggagctgatacagcggtgcaagcagatgtttctgacacagaccgacacaggcgacgatagggtttaccagatgccaagctttttacagtccgtcgcttcagtactgctgtatctcgataccgtccccgaggtgtatacgcccgtcctggaacatttagtcgttatgcagattgattccttcccccaatactctcctaagatgcagctggtgtgctgcagggctatcgttaaagtgtttctcgctttggccgctaagggccccgtgctaagaaattgtatctccacggtagtgcaccagggattaatacgtatttgctcaaaaccagtggtcctgcccaaaggtcccgaaagcgaatctgaagatcacagagcgtccggtgaggtacgaacgggaaaatggaaggttccaacttacaaggattacgtggatctgtttaggcatctgctctcttccgaccagatgatggattcaatccttgccgacgaggcctttttcagtgtgaactctagctccgagtcactgaatcacctactttacgatgaattcgtcaagtccgtccttaaaatagtcgaaaaactggatttgaccctggagattcagacagtcggggagcaggagaatggtgatgaagcgccaggggtgtggatgatcccaacaagtgaccccgctgctaacctgcatcctgcgaagcctaaggatttcagcgcgtttatcaatctcgttgagttttgcagggaaatactgcccgaaaaacaagctgaatttttcgagccctgggtgtatagcttctcttacgaattgatactccagagcacacgcctaccgctgatttccggattctataaactcctgtcaattactgttcggaatgcaaagaagatcaaatattttgaaggggtctcccctaaatccctcaaacattcccccgaggaccccgaaaagtacagctgttttgcgttatttgttaaatttggcaaagaggttgctgttaagatgaaacagtacaaggatgaactcctagctagttgtctgacattcctcttgtcattgccccacaatattattgagctcgatgtcagagcctatgtgcctgctctgcagatggcttttaagctgggcctctcatacaccccactggctgaggtcggcttgaacgcgctagaggagtggagcatctacattgaccgtcacgtgatgcagccatactacaaggatatcctcccatgcctggacggctacctcaaaacatctgcactgtccgatgagacaaagaataattgggaagttagcgctctgagccgagcagcccagaagggattcaataaggttgtcctgaaacacttgaaaaagacgaagaacctatcctcaaatgaggctatatcactggaagagatccgaatccgcgtggttcagatgctgggttctttgggcgggcagatcaacaagaatttattaaccgttacctcaagcgatgagatgatgaaaagctacgtagcttgggacagggagaaacgactgtccttcgctgtgccttttcgcgaaatgaagcccgtcattttccttgatgtattcttaccacgtgttacggagcttgccctgactgccagtgaccgtcagactaaagtggcagcctgcgagttgctacacagtatggtgatgtttatgttgggaaaagctacccaaatgccggagggggggcagggagcaccaccaatgtaccagctttacaaaaggactttccccgttttactgagactggcatgtgatgtcgatcaagtaacccggcagctatatgaacctctcgtgatgcaactgatacactggtttactaataacaagaagttcgagagtcaggatactgtcgccttgctggaggcaattctagacgggattgtggaccccgttgattctaccttacgtgatttctgcggcagatgcatacgagagttcttgaaatggtccatcaagcagattacccctcagcagcaggagaagtccccagtcaatacgaaaagtctgttcaaacggctgtactctcttgcccttcatccgaatgccttcaagaggctcggggcctcccttgccttcaacaacatttaccgtgagtttagagaggaggaatccctggtcgagcaattcgtatttgaagcattagtcatttacatggagtccttagcactggctcacgctgatgaaaagtccttaggcaccatccagcagtgttgcgatgcaatcgaccatctctgcagaataatcgagaaaaaacacgtgtcactgaataaagccaaaaagcggcggcttccgcggggatttcccccgtctgcttcactctgtctgttagacctcgtcaagtggttactcgcccattgcggaaggcctcaaaccgagtgccggcataagtctattgagcttttttacaaattcgtgcctctgctgccaggtaaccgatcccctaatctctggctgaaggacgtgcttaaagaggagggagtgagctttttaattaacacttttgaaggcggggggtgcggacagccctcaggaatactggcccagccgacgctcctgtacagaggtccattcagcctccaggccacactgtgctggctggaccttctcctcgcagcccttgagtgttataacacattcataggagaaaggactgttggcgctttacaggtcctggggactgaggcgcagagtagcctgctgaaggcagtggccttcttcctggagagtatcgccatgcacgacatcatagcggccgaaaagtgttttggtaccggagctgctggaaaccgaaccagcccacaggagggcgaacgctataattactcaaagtgtactgtggttgtgaggattatggagtttaccaccacattactcaacacatcgcctgaagggtggaaattgctgaagaaggacttgtgtaacacccacctgatgagagtgttagttcagaccctatgcgagccagcctccatcggtttcaacatcggagatgtacaagtgatggcacacctgccggatgtgtgtgtaaacctaatgaaggcactgaagatgtcgccatacaaagacattctggaaacccatctgcgcgaaaaaataacagcgcagagcattgaggaactttgcgcggtgaatctctacggcccagatgctcaggtggatcggtcgagacttgctgcagtggtctctgcctgcaagcagctgcaccgcgccgggctactacataacatccttccatctcaaagcactgacctgcaccatagcgtgggaacggagctgttgagtttggtttacaagggtatcgcccctggagacgaaaggcagtgcctgccgtcattggatctgtcttgtaagcagctggcatctgggctgctcgagttggcctttgcattcggaggcctctgtgagcgactggtatctctcttgctgaatccagccgtgctatccaccgcgagcctaggcagttcacaaggatccgtgattcatttttctcacggtgaatacttttacagtttgttcagtgaaaccatcaacacagaattgctgaagaatttagacctcgctgtcctggaactgatgcagtcgtctgtagacaacaccaaaatggtctcagccgttctgaatgggatgctggatcaaagctttagggaacgagcgaaccagaagcaccagggcttaaagctagccacaacgattctccagcattggaaaaaatgcgattcctggtgggccaaggattcgccgcttgagactaaaatggcagttctggcactgttggcgaaaatcttgcaaattgattctagcgttagcttcaatacctcacacggcagcttcccagaggtgttcaccacttacataagtctgctggctgatacaaaactggatctccacctgaaaggacaggcagtcaccctcctgccgtttttcacaagcctgacagggggatctctcgaggaactgaggcgagtcctggaacagctcatagtggctcacttcccaatgcagagtcgggaatttccacccggcaccccaaggttcaataactatgtggactgtatgaagaaattccttgacgcactcgagctgtcgcaaagtcctatgctactcgagttaatgacagaggtgttgtgtcgggagcagcagcacgtcatggaggagctcttccaatcttctttcaggaggatcgcgcggcgggggtcttgtgtgacacaggtggggctgctggagagcgtttacgaaatgttccgcaaagatgaccctcgattatctttcacgaggcagtctttcgttgataggagcttgctgacactgctgtggcactgcagtctagatgcactccgcgagttcttcagcactattgttgtggacgcaattgacgtgttgaaaagtcgcttcactaaattaaatgagtcaacgtttgacacccagatcacaaagaagatgggttactacaaaattctggacgttatgtattctcgcttgcctaaggatgacgtgcacgctaaagaatcaaaaatcaaccaggtgttccacggcagctgcattacagaaggtaacgagttaactaagacattaatcaagctgtgttacgacgccttcacagaaaatatggcgggagaaaatcagctgcttgaacgtcgtaggctgtaccactgcgccgcttacaattgcgcaattagcgtgatttgttgcgtgttcaacgaattgaagttctaccagggcttcttattctcggaaaagccagaaaagaatctgctgatatttgagaatctaatcgatctgaaacgcaggtacaatttccccgtggaggtggaagtgcccatggagcgaaaaaagaaatatatagagatcagaaaagaggctagagaggctgccaatggcgactccgacggaccttcttatatgtcgtctctctcctacctcgcggactcgacactgtcagaagagatgtcacagtttgatttttcaacgggtgtccagagttacagttatagctcgcaggatcctaggcctgccacaggaagatttagaaggcgagagcagagagatcccactgtgcatgacgatgtgctcgagctggaaatggatgagctcaataggcacgagtgcatggccccactgactgccctggtcaagcacatgcacagaagcttaggtccccctcaaggtgaggaggactctgttccccgagacctgccatcctggatgaagtttttgcacgggaagctggggaaccctatagtgccactcaacatccggctttttcttgcgaaactggtgatcaatacggaagaagtcttccgtccatacgctaaacattggctgagcccccttttgcagctcgccgcatccgagaataacggcggcgagggtatccactacatggttgtcgaaattgtcgctaccattctgagttggaccggactcgctactcctacaggtgtgcccaaagacgaggtgctggccaaccgactcctgaacttcctcatgaaacacgtctttcaccctaagagggccgtgttccgccacaacctcgagatcattaaaaccctggtggagtgctggaaggactgtctctccatcccatacagattaatcttcgagaaattctctggtaaggatccaaatagtaaggacaactccgtcggaattcaactgttaggaattgtgatggccaacgatctgcccccctacgacccccagtgcggaattcagtccagcgaatatttccaagccttggttaacaatatgtcctttgtgagatataaggaagtatatgcagcggctgccgaagtgctgggcttaattcttcggtacgtcatggagaggaagaatattctggaagaatcactctgtgagcttgtcgcaaagcaactcaagcagcatcaaaacacaatggaggacaagttcatcgtctgtctgaataaggtcacgaagtccttcccaccactcgccgaccgcttcatgaatgccgtgttttttctgcttcccaagtttcatggggtactgaagacactctgcctggaagtggttctatgccgcgtagaaggaatgaccgaactgtattttcagctcaaatccaaagattttgtacaggtgatgcggcacagagacgatgagaggcagaaagtgtgccttgatatcatctataaaatgatgcctaagctgaagcctgttgagctccgggagctgctaaatcccgtggtggaatttgttagtcaccccagtaccacgtgtagggaacagatgtataacattctgatgtggatacacgacaattaccgcgaccccgaatcagaaacggataatgatagccaagaaatctttaagctggccaaagatgtgctgatccagggcttgattgacgagaatcccggcctccagctaattatacgcaatttctggtcacatgaaacaagattgccttccaatactctcgatcgcctgttggccctgaatagcctgtacagccctaagatcgaagtccatttcctgtccctggctacaaatttcctgctggagatgacttcaatgtctcctgattatcctaaccccatgttcgagcacccactgagtgagtgcgagtttcaagagtacacgattgattccgactggaggttccggagtaccgttttgaccccgatgttcgtggagacccaggcctcccaaggcactctccaaactagaactcaggagggcagcctgtcggcccggtggcccgtggcaggacagatcagggcaactcaacagcaacatgattttacccttacacagacagccgacggcagatcatcctttgactggctgaccggatccagcacagaccccctggtggaccataccagtccatccagcgacagtctcttgtttgcacacaagcgctcagagagactgcaaagggcccctctgaagagcgttggtcccgattttggcaagaagcgactgggactgccgggagacgaggtagacaataaggtgaaaggcgcggcaggccgaacagacctgctgcgcctgcgtcgaaggttcatgcgggatcaggagaaactctctttaatgtacgcccgaaagggagtggccgagcagaaaagagagaaagagatcaaaagcgagcttaagatgaagcaggacgcccaggtggtgctctataggtcgtatcggcacggtgatctgccagacattcagatcaagcactccagccttataactccactgcaggcggtggcccagcgcgatccaattattgccaaacagttgttcagttccctgttctcgggaatcctgaaagaaatggacaagtttaaaaccctgtctgagaagaataacattacacagaagttgttacaggattttaatcgttttctcaacaccactttctctttttttccaccgtttgtttcatgcatacaggacatttcctgtcagcacgcagccctactgagtctggaccccgccgcagtcagcgctggctgcctggcctcactgcagcagcccgtgggaatccgattactcgaggaagctttgctgcgcttgctgcctgccgaactaccagcgaagcgagtgcgtgggaaagcacgactgccacctgatgtactgcgctgggtcgaactagccaaactgtatcgaagtattggggaatatgacgtactaagaggtatcttcaccagcgaaatcggtactaaacagatcacgcagagtgccttgctggcagaggctagatccgactattccgaggcggcgaagcagtacgacgaagccctgaacaagcaggattgggttgacggcgaaccaacagaggctgaaaaggatttctgggaactcgctagtcttgattgctacaaccatctcgccgagtggaaatctctggaatactgctccacagcgtccattgacagcgaaaaccctcctgacctgaataaaatctggagtgagccattctaccaggagacatacctcccttacatgatacgtagtaaactcaaacttctactgcaaggtgaggcagaccagagtctgcttaccttcattgacaaggcaatgcatggcgagcttcaaaaggctatcttagaattgcattattctcaggagctctcgctgctgtacctgctccaggatgatgttgaccgcgccaaatattacattcagaacggcattcagtcttttatgcagaactattcctctattgacgttctgctacatcagtctaggctgaccaaactgcagagcgttcaggctcttaccgaaatacaggagttcatcagttttatttcaaagcaggggaatctgtccagccaagtgcctcttaagcgactcttgaatacctggaccaaccgttaccccgacgcgaagatggaccccatgaatatatgggacgatataatcacaaaccggtgtttctttctatcaaagattgaggaaaagttgaccccactccctgaggataatagcatgaacgtagatcaggacggcgacccctccgatagaatggaggtccaggagcaagaagaagacattagcagtctcattcggagctgcaagttctcgatgaagatgaaaatgatcgattctgctagaaaacagaataattttagccttgcaatgaaactcttgaaagagctgcacaaagaatctaagacgcgggacgattggctggtttcttgggttcaatcatactgtcggctttcgcactgccgcagtcggtcacagggctgtagcgaacaggtcctgaccgtcttaaaaaccgtttcccttctggacgaaaacaatgtgtcttcctatctcagtaaaaatatactcgcctttagagatcaaaatattctcttgggcaccacatatagaattattgctaacgcacttagcagcgagcctgcctgcctggcagaaattgaggaggacaaagcgcgacgcatcctggagctgtcggggagtagctccgaagattccgaaaaagttatagccgggctataccagcgcgcctttcagcacctctccgaggcagtacaggcagctgaagaggaggcccaaccaccgtcttggagctgcggacctgccgccggcgtcatagatgcttacatgaccctggcagacttttgtgaccagcagttgaggaaagaggaggaaaacgcgtctgttattgattctgcagaacttcaggcgtatcctgccctcgtcgttgaaaagatgctaaaagctctgaaactgaattccaatgaggcacgccttaagttccctaggttgctgcaaatcattgagaggtaccctgaggagaccctgtcattaatgacaaaggagataagctcagtaccttgctggcagttcattagctggataagtcacatggtcgccctgctggataaggatcaggctgtggccgtccaacactccgtcgaagagattaccgacaactacccccaagccatcgtatacccctttatcatcagcagcgaaagttactcttttaaggatacctctaccgggcataagaataaagagttcgtagcccggatcaagtctaagcttgatcaaggcggggtaatccaggactttatcaacgctctcgatcagcttagcaatccagaactgctgttcaaggattggtcaaacgacgtgcgggcagaactggccaaaacccctgtaaacaagaagaatatagaaaagatgtacgaaagaatgtatgccgccctaggtgacccaaaggcccccggactgggtgcttttagaagaaagttcattcagacgttcggcaaagagttcgataagcactttggaaaaggcggtagcaaattactgcgcatgaaactctcagactttaatgatatcaccaatatgctgctgctgaagatgaacaaggactcaaagcccccggggaacctgaaggagtgctccccttggatgagcgacttcaaggttgagtttctgcgtaacgaactggagattcccggccagtacgatggcaggggtaagccgttgcctgagtatcatgttcggatcgcggggtttgacgagcgggtcaccgtgatggcaagcttgagaaggcctaagcggatcataatccggggacatgatgagagggaacatccatttcttgttaaggggggtgaggatctgcggcaggatcagagagtggagcaattattccaggttatgaatggaatactcgcgcaggactctgcctgcagccagcgagccttgcagctgcgcacttatagcgttgtgcccatgaccagtaggctcggattgatcgagtggctggagaacacagttaccctcaaggatctgctgctaaatacgatgtcccaagaggaaaaggcagcttacctgagcgacccaagagcgcccccttgcgaatataaggactggttaacaaaaatgagcggtaagcatgacgtcggcgcttatatgttgatgtacaaaggagccaatcggacagagacagttacttctttccgcaagagggagtcgaaagtgccagccgacctgctcaaacgagcattcgttcgaatgtccacatctcccgaagcattccttgcactcaggtctcacttcgcctcctctcacgcccttatttgcatctctcactggattttaggaattggggaccgtcacctgaataattttatggtggcgatggagactggcggcgtgattgggatagatttcggccatgcatttggcagcgccacacagttcttgcccgtaccagaactgatgcctttcaggctcacaagacagtttattaacctgatgcttccaatgaaggagacgggtctgatgtattccatcatggtgcacgcccttagagcttttcggtccgatccaggccttctcaccaataccatggatgttttcgtgaaagagccctcatttgactggaaaaactttgaacagaaaatgcttaagaaggggggcagctggatacaggagattaacgtggctgagaaaaactggtatccccggcagaaaatttgctacgcaaagcgcaaattagccggagcaaaccccgctgtgattacgtgcgatgaactactgctgggtcacgagaaggccccggcttttagggattacgttgctgtggcgcggggatccaaggatcacaacattcgtgctcaggagcctgagagcggcttgtcagaagagactcaggtgaaatgtcttatggatcaggctaccgatcccaatatactcggtcggacctgggaagggtgggaaccttggatgtag

SEQ ID NO: 16857 - DNA, 12291 bp, Artificial Sequence
  Description of Artificial Sequence: Synthetic coding sequence
atggctggctcaggagctggagtgagatgcagtcttcttcgcttacaagaaacactctccgccgccgatcggtgcggtgccgcactagccggacatcagctcattcggggtctgggtcaggaatgcgtattatcgtcctcaccggccgtgcttgctctgcaaacctctctagtgttcagcagagactttggacttctggtcttcgttagaaagtcccttaatagcattgaattccgcgaatgccgggaagagattctgaagtttctctgtatatttctggaaaagatggggcagaagattgccccatattcggttgaaataaagaatacctgcacatccgtttatacaaaagacagagcagctaaatgcaaaattcccgctttagacctcctgattaaactcctacaaacatttaggtctagccgtctaatggacgagttcaagataggggaattgttcagcaaattctatggagagcttgcccttaaaaagaagattcccgatacagtgcttgagaaagtttatgaattacttgggctgcttggagaggtgcaccccagtgaaatgattaataacgctgaaaaccttttccgcgctttcctgggagaactgaaaacacagatgacgtccgccgtccgcgagcccaagctaccggtgcttgctggctgtctgaagggccttagcagcctgctgtgtaattttaccaagagtatggaggaagacccccagacctcccgggaaatctttaacttcgtgcttaaggccatcagacctcaaattgacctcaagagatatgcagtgccatcagccggtttgcggctgttcgccctccacgcttctcagtttagtacttgtcttctggacaattacgtcagcctcttcgaagtgctgctcaagtggtgcgcacatactaacgtggaattgaaaaaggccgcccttagtgcattagagtcgtttctcaaacaggtatcgaatatggtggcaaaaaacgctgagatgcacaagaacaaactgcaatactttatggaacagttttacggcataatcaggaacgtggattcaaataataaagaattgagcatcgccattcgcggctatggactattcgccggcccctgcaaagtcatcaacgcaaaagacgtggacttcatgtacgtggaattgattcaacggtgcaaacagatgtttttaacccaaacagatacaggcgacgatcgggtataccagatgccgtcatttctgcaatccgttgctagtgtgctgctgtacctggacaccgtccccgaggtatacacacccgtgctcgaacacctggtggttatgcagatcgactcattcccccaatatagtccaaagatgcagctggtgtgctgcagagccatcgttaaggtcttcctggctcttgctgctaagggcccagtgctacggaactgcatttcgactgtagtccaccaaggactgattcgcatttgtagcaaacccgtcgtcctccccaaagggccagaatctgaatcagaagaccatagagccagcggggaggttagaactggtaaatggaaggtcccaacatataaagactacgtagatctcttccggcacctcctgtcgagtgatcagatgatggactccattctggccgatgaagcctttttcagtgtgaacagctcttctgagagtctgaaccatctcctttacgacgagttcgtcaaatccgtgctgaagatcgtggagaagctggatcttactttagaaatccagactgttggtgagcaagagaatggggacgaagcgcccggcgtatggatgatccctacctcagatccagccgctaacctgcatcccgccaagcctaaagatttcagtgctttcattaatctggtcgagttttgccgagagattctgccagagaaacaagccgaattcttcgaaccttgggtgtattctttttcctatgaactgatcctccagtcaactaggttacctctgatttcaggattttacaaactgcttagcattactgttcggaacgctaagaagattaaatacttcgagggtgtgtcgcctaagtcccttaaacactcaccagaggacccagaaaagtatagttgcttcgctctcttcgtcaagttcggcaaggaagtggcagtgaagatgaagcagtacaaagatgaactgctggcatcttgccttacctttttgctctcacttccgcacaacatcatagagctggatgtacgcgcgtatgtgcctgcactacagatggctttcaaactcggactgtcctacacgccattggccgaggtcgggttgaacgcacttgaggagtggtcaatatatatcgaccgtcatgtaatgcagccctactataaagatattcttccatgcctggatggttatctcaaaacatccgcactcagcgatgagacaaagaacaactgggaggtgtcggccctgtctagagccgctcagaaggggttcaacaaggttgttcttaagcatctgaaaaaaactaaaaacctcagcagtaacgaagcaatctcactcgaagagataaggataagagtggtgcagatgctaggatccctgggcgggcagattaacaaaaatctgctgacagtcacatcaagcgacgagatgatgaagtcctacgttgcttgggatcgggagaaacggctgtctttcgcagttccctttcgcgagatgaaacccgtgattttcttagacgtttttctgccaagagtgaccgaactggctctcactgcttcagaccgccagactaaggttgccgcttgtgaactgctgcatagcatggtgatgttcatgctggggaaggccactcagatgcctgagggaggacaaggtgcgcctccaatgtatcagctgtacaaacgcaccttccctgtccttctcagactggcgtgcgacgtcgaccaagttaccagacaactgtacgagccactcgttatgcagctgatacactggttcaccaacaacaaaaagttcgagtcccaggacacagtggcgctcttggaagcaattctggacggtattgtggaccctgtagactctactctcagagatttctgtggtcgctgcattcgggaatttttgaaatggtcaatcaagcagattacgccccagcaacaagaaaagtctcccgtcaataccaagtccctctttaagcgcctttattctttggccctgcaccctaatgccttcaagcggctgggcgctagcctggccttcaataatatctatagggagttccgagaggaggaatctttggtcgaacagttcgtgttcgaagcactggtcatatatatggaatccctcgcccttgcccacgccgacgaaaagtctttaggaactattcagcaatgctgtgatgccatcgaccacctgtgtagaatcatcgagaaaaaacacgtcagtctcaacaaagccaaaaagcgacgtctgcctagaggttttcctcctagtgcttctttgtgcctactggacctggtgaagtggttgttagcacattgcggccgacctcagacagagtgtcgccacaaatctatcgagttattttacaagttcgtcccgctcctgccagggaatcgtagtcccaacctctggctcaaagatgtgttgaaggaggagggagtctcctttctgatcaacactttcgagggaggagggtgcgggcagccttcgggcatccttgcccagcccacacttctgtaccgtggtccattcagtctgcaggcaactctatgttggctggacctgttactcgcagccctggagtgctacaatacttttattggagaacgtacggtgggagccttgcaggtgctggggaccgaggcacagtcctctttgctcaaggctgtcgccttcttcctggaatctatcgctatgcacgatatcattgccgctgaaaaatgttttggtactggcgcggccggcaacagaaccagccctcaggagggcgagcgatacaactatagcaaatgcactgttgtcgtccggatcatggaattcacaaccacattgttaaacacaagtccagaaggatggaaactacttaagaaagacctctgcaacacccacctcatgcgggtgttagtgcaaacattatgtgaacctgcctcaataggcttcaatatcggggatgtgcaagttatggcacatctgcccgatgtgtgcgtcaatctgatgaaagctttgaagatgtccccttacaaagatattctggagacccatctcagggagaagataactgcccagtcaatcgaagaactgtgcgcggtgaacctttatgggcccgatgctcaggtcgatcgatcacgtctggccgccgtcgtgtccgcgtgtaaacagcttcacagagccgggctgctccacaacatcctgcctagccaatctacagacctgcaccatagcgttgggacggagctgctgtcactggtctataagggcatagctccgggagacgagaggcaatgtctgcccagcctggacctgagctgcaagcaattagcctcagggctgctcgaattggctttcgcctttggcggcctgtgtgaacggctagtcagcttgctactgaatcctgctgttttgtctacagcctctcttggctcctcccaaggttccgttattcacttctcacacggagagtatttttactcattattttctgaaacaataaatacggagctcctcaagaacctagaccttgctgtcctggaattaatgcagtctagcgttgacaataccaaaatggtttcagcagtccttaatggtatgctggatcagtcttttcgggagagggctaaccagaaacatcagggtctaaagctcgccactaccatactgcagcactggaagaagtgtgacagctggtgggctaaggacagccccctggaaacgaagatggccgtgctggcactgctcgctaaaatcctgcagatagattcctccgtgtccttcaacaccagccacggcagctttcctgaggtatttactacctacatctctctgctggctgacacaaaactggacctgcatctgaaagggcaggccgtcacgttgttacctttttttacatctctcacgggcggctccctggaggagctgcgcagagttctggaacaacttatcgtcgctcatttccccatgcaatccagagagtttcctcctggcacacctaggtttaataattacgtcgactgcatgaagaaattcctggacgccctggaattgagccagtcccctatgctgctggagttaatgaccgaggtcctttgccgggagcaacagcacgtcatggaggaacttttccagagcagtttccggagaatcgcaaggagagggtcctgtgtgacccaggttggactcttggagagcgtttacgagatgttcagaaaggacgatccaagattaagcttcacccggcagtcatttgtggatcgctccctgctgactctcctctggcactgctctctggacgcgctgcgcgaattcttctccaccattgttgtggatgctattgatgttcttaagagtcgatttaccaagctgaatgaatctacttttgacacccagattaccaaaaagatggggtattataagatactcgacgtaatgtacagtcgccttcctaaagatgacgtccatgcaaaagagtccaagataaatcaggtattccacggtagttgtataaccgaaggcaatgaattaaccaaaaccctgatcaaattgtgctatgacgcgtttaccgagaatatggctggggagaatcaactcttagagcggcgccggctataccactgtgcagcttacaattgcgccatctcagtgatttgctgtgtctttaacgaacttaagttctaccaggggtttctattcagcgaaaagccagagaagaacctgttaatcttcgagaatttaattgatctgaaacgccggtacaatttccctgtggaggtcgaagtcccaatggaacgaaagaaaaaatatatcgagattcgcaaggaagcacgagaggcagctaacggagactctgatggaccttcatacatgtcttcactctcctacctggcagatagcactctgtcagaggaaatgtcccagttcgatttttcgacgggcgtgcaatcatattcgtacagtagccaggatcctagacccgctactggcagattccgccgacgggagcaaagggatcctaccgttcacgacgacgtgctcgaactggaaatggacgagctgaaccggcacgaatgtatggccccactcacagcccttgtcaagcacatgcatcgttctttgggaccccctcagggtgaagaggactccgttcctcgtgatctgccctcctggatgaaattcctccatggaaagctggggaaccctatcgtgcctctcaacataagactttttctggcaaaactcgtaatcaatacagaggaggtcttccggccttacgctaagcattggctgagccccctgcttcaactggctgcaagtgagaacaatgggggagaaggcatccactatatggtcgttgagatcgtggcgacaattttgtcgtggacaggtcttgcaacgcctacaggagtgccaaaagacgaagtgctggctaacaggctgctgaacttcttgatgaagcatgtgtttcacccgaagagggccgtttttaggcataacttggagataatcaaaacattagtcgaatgctggaaagattgcctgagtataccatacaggctgatcttcgaaaaattttccgggaaggacccgaatagcaaagataatagcgtgggcatccaactgctgggaatcgtgatggccaacgatctccccccctatgatccgcagtgcggtattcagagctctgagtactttcaggccctggtgaacaatatgagttttgtgagatataaggaagtctatgctgcagcagcggaggtcctggggctcatcctgagatatgtgatggaacgaaagaatatcttagaagagagcctctgtgaacttgtcgcaaaacagctgaagcagcatcagaatacaatggaggacaaattcatcgtgtgtctgaataaggtaactaagtcctttccgcccctcgccgaccgttttatgaatgctgtttttttcttgctcccgaaatttcacggagttctcaagaccctttgcttggaggtggtgttgtgcagggtcgaaggtatgactgagctgtactttcagttgaaaagcaaggactttgtgcaggtcatgcgtcatagagacgacgagcgtcagaaagtctgtttagatattatttacaagatgatgcctaagctcaaaccggtggaactgcgtgaactgcttaatccggtggtcgagttcgttagccaccccagcactacttgccgcgaacaaatgtacaacatcctgatgtggatccacgataactaccgagaccccgagagtgagactgacaacgactctcaggaaatcttcaagctcgccaaggacgttctcatccagggcctgattgatgagaacccgggcctgcagctgattatccgaaacttctggtcacatgagacaagactaccctctaatacgctggaccgcttactcgcactcaattccctttattccccgaaaatagaggttcattttctgtccctcgcgaccaattttctacttgaaatgacctccatgtctcccgactatcccaatcccatgtttgaacacccactcagcgagtgcgagttccaggagtataccattgacagcgactggcggttcagatcaaccgtgctaacccctatgttcgtcgagacacaggcttctcagggtaccctacagactcgaacccaagaaggttctctttcagcccggtggccggtggctgggcagatacgtgccacccagcagcagcacgatttcactttaacacagacagccgatggtcggtcctccttcgattggctgactggcagttcgacggatcctcttgtggatcatacctcacctagttctgatagtctcctgttcgcacataaaagatctgaaaggctgcagcgcgccccattgaaaagcgtcgggcctgattttggcaaaaaacgactcggtctgcccggcgacgaagtagataataaggtgaagggagccgcggggcgcactgacctcctcagattaaggcgccgattcatgcgggaccaggagaagttgtctcttatgtatgcaagaaagggggtggctgagcagaagcgggaaaaggagattaagtcggaactcaagatgaaacaagacgcacaggtggtgttatatcgcagctacagacacggagatctgcctgatatccaaataaaacactcaagtttaattactcctcttcaggcagttgcgcagagggaccctatcatcgccaagcagcttttcagctcactcttcagcggtatccttaaggaaatggacaaattcaagaccctgagtgagaaaaataacattacccagaaactgctacaggattttaaccgttttctgaacacaactttctctttttttccacccttcgtcagctgtatccaggacatttcctgtcagcacgccgctctcctgagcctcgaccctgctgcggtgagcgcaggctgtttagcttcacttcagcagcccgttggcatcagactgctggaggaggctttactgaggctgctcccggcagagctgccagcaaagagagtgaggggtaaggctcggctgcctcctgatgtgctgaggtgggtagaacttgcaaagctttatcggtctataggcgagtatgacgtgctacgcggaatctttacgagtgaaataggcacgaagcagataacccagtctgctctgctggctgaggctagaagtgactattctgaggcagccaaacagtatgatgaggctctgaataagcaggattgggtagatggagaaccaacagaagctgagaaagacttttgggagctggcgagcctggactgctacaatcacttagcggagtggaaaagtttggaatactgctccaccgcttccatcgatagcgaaaacccccccgatctgaacaagatatggagcgaaccattttatcaggaaacgtacctcccctatatgattagatctaagttaaagctccttcttcagggggaagccgatcagtctctgctgactttcatcgacaaggccatgcacggagaactgcagaaggcaatactggagctgcattatagtcaggaactttcactgctttacctgctgcaggacgacgttgaccgggcaaagtattacatccagaacggtatccagtccttcatgcagaactatagcagtattgacgtcctgctgcatcagtctcgcctgacaaagctccagtctgtccaggcgctgactgagatccaggaattcataagttttataagcaaacagggaaacctgagctctcaggtcccgttgaagcgtctactgaacacatggacgaacaggtatccagacgcaaagatggatccaatgaatatttgggatgatataataaccaatcgatgcttcttcctctctaagatcgaggagaaattgacaccacttccagaagataacagcatgaacgtcgaccaggatggcgacccaagtgaccggatggaagtgcaggaacaggaagaggatatcagtagtttaataaggtcctgtaagttttcaatgaaaatgaaaatgatagactctgcgagaaaacaaaacaattttagcctagctatgaagctgctgaaggaattgcacaaggagtcaaaaacaagggacgactggcttgtcagttgggtgcagagctactgccgcctcagccattgccgatcccggtctcagggctgttctgagcaggtcttaactgtcctcaagactgtgtctttattggacgagaataacgtgagctcatacctatcaaaaaatatactagctttcagagaccagaatatcctgctaggcaccacctaccgaatcatcgctaatgcactgtcatcggaacctgcttgcctggctgaaatcgaagaagacaaagccagaaggatccttgagttatctggctcgagttcagaagatagtgaaaaggtgatagccggtctgtaccagcgagcttttcagcatctgtccgaggccgttcaggctgcagaggaggaggcccagcctccctcctggagctgcggcccggccgcaggggtgatcgacgcctacatgacgctggctgacttttgcgaccagcaactgcgcaaggaggaagagaacgcgagcgtcatcgatagcgctgagttacaggcttatcccgctttggtggtggaaaaaatgctgaaggcactgaaattaaatagtaacgaagcccgtctgaagttcccacgacttctgcaaattattgagagatatccagaagaaacactcagtcttatgacaaaggagattagttctgttccatgttggcagtttatctcctggattagtcatatggttgccctgctggataaggatcaagcggtggccgttcaacattcagtggaggaaataacagataattacccccaggccatcgtatacccatttataatcagcagcgagagttatagctttaaagacacatccactggccacaagaataaagagttcgtggccagaatcaagagcaagctggaccaaggcggggttatccaggatttcatcaatgctcttgaccagttgtctaatcctgagctccttttcaaagactggagtaacgacgtccgggcagagctggctaaaacaccagtgaataagaaaaacatcgagaagatgtacgaacgaatgtatgccgccctgggggacccaaaagctcccgggctgggagccttccggcgaaaatttatccagaccttcgggaaagagtttgacaagcactttggtaaggggggctcaaaattgttgcgaatgaagctgagcgatttcaacgacattactaatatgctcctgctcaagatgaataaggacagcaagccacccggcaatttgaaggaatgctccccatggatgtctgatttcaaagtggagtttctgcggaacgagttagaaatacctggccagtacgacggtcggggcaagcccttgccagaatatcacgttaggattgctggcttcgatgaacgagtcaccgtgatggcctcactgcgccgccccaagaggattattatccggggacatgacgaacgggagcatccgttcctggtgaaaggcggagaggacttgcgacaggatcagagagtagaacagttgttccaggttatgaacggcattttggcccaggactctgcttgcagccaaagagcactgcagctccggacatactcagtggttcctatgacgtctagtgatccccgcgctcccccctgcgaatataaagattggcttactaaaatgtctggaaagcacgacgtgggagcctatatgcttatgtataagggtgccaacaggacagagacagtgaccagctttagaaaaagggagtcaaaggtgccggctgatctgctgaagcgcgccttcgtgcgaatgagtacctccccggaggcctttctggcactacgcagccatttcgcatcaagtcacgcgttaatttgtatttcccactggatcctcggcattggtgatcgccacctgaataatttcatggtcgcaatggaaaccgggggcgtgatcggaatcgatttcggacacgctttcggttctgctacccagtttctcccagtgcccgagctgatgccctttcgcttaacccgccaatttattaacctgatgttgccgatgaaggaaactggtctgatgtattcaatcatggtgcacgccctgagagccttcaggtcggaccctggcctgttgacaaataccatggatgtcttcgtgaaggaacccagcttcgattggaagaattttgagcagaagatgctgaaaaagggggggtcctggatacaggagatcaacgtggccgaaaagaattggtatcctcggcagaaaatttgctacgctaagagaaaattggccggcgcaaatcccgctgtgatcacgtgcgacgaactgctgcttggacacgaaaaagcacccgctttcagagactacgtcgccgtcgcacgaggctccaaggaccacaacatacgagcccaagagcccgaatctggattgtcagaagagacgcaggtgaaatgtctgatggaccaggccacagatcccaatatcttgggacggacttgggagggctgggaaccatggatgtag

SEQ ID NO: 16858 - DNA, 444 bp, Artificial Sequence
  Description of Artificial Sequence: Synthetic coding sequence
atggctgcccagcgcctgggcaaacgagtcctgtcaaagctccaatcgccatctcgggcccgcgggcctgggggcagccctggcggattacagaaaagacatgcaagagtgacggtgaagtacgatcgccgggaattgcagaggcgcctcgacgtcgaaaagtggattgacgggaggctggaggaactatatcgtggaatggaggctgacatgcctgacgagatcaacatagatgagctgttggagctcgaaagcgaagaggaaagatctaggaaaattcagggactcctaaagtcgtgtgggaagcctgttgaggacttcatacaggagctgctggcgaagctgcagggactccaccgccagcctggcctgcgtcagccctccccctcacatgacggttccttgtccccattacaagaccgggctaggaccgcacacccatag

SEQ ID NO: 16859 - DNA, 363 bp, Artificial Sequence
  Description of Artificial Sequence: Synthetic coding sequence
atggcagctcagcggctaggaaagagggttctgtcaaagttacaaagcccatcacgtgctcggggccctggcggctctccaggtgggcttcagaagaggcatgctcgggttacggtcaaatacgatcgacgagagcttcaaagacggctggacgtcgaaaagtggattgacgggaggctggaggaactctataggggaatgggtcttctgaaatcttgtgggaaacctgttgaagactttattcaggaattactggccaaactccaaggactgcacaggcagcctggtctgcgtcagccgtccccgagtcacgacggctccctgtctcccctgcaggacagagccagaacagcccacccttag

SEQ ID NO: 16860 - DNA, 2025 bp, Artificial Sequence
  Description of Artificial Sequence: Synthetic coding sequence
atggctcccggccaggctcctcaccaagctacaccctggagagacgctcatcccttcttcttgctctccccggttatgggcctgctcagtcgggcttggtctaggttaagggggctggggcccctggagccgtggctggtggaagccgtgaaaggcgcagctctggtagaggcagggcttgaaggtgaagcacgtactcccctggctatcccgcacaccccctggggacgtcgacccgaagaggaagccgaggactcaggcggacccggagaggaccgcgaaaccctcgggctaaagacctcctcgtcactgcctgaagcctgggggctgctcgatgacgacgacggcatgtacggagaacgcgaggccacctccgtacctaggggtcagggctcccagtttgcagatggacagcgggcccccctaagcccatccctcctaatcagaacattacagggttcagacaagaaccccggtgaggagaaggccgaggaagagggcgttgcagaggaagagggtgttaataagttcagttatccgccgtcacatagggaatgctgccccgctgttgaggaggaggacgacgaagaggctgtgaaaaaggaggcacaccgcaccagtaccagtgccctgagccccggttcaaaacctagcacttgggtgagttgtccgggtgaagaggaaaatcaggcgactgaggataaaaggactgagcggtcaaagggcgcccggaagacatctgtgagcccgagatcttccggcagtgacccacgctcatgggagtaccgctctggggaagcaagcgaggagaaagaggagaaggcccacaaggagaccggcaaaggtgaggcggcacccggccctcagagttctgctccagcacagagaccacagctcaagtcttggtggtgccagccatctgatgaggaagaaggcgaggtgaaggccttaggagccgccgagaaggatggcgaggccgagtgccccccatgcattccgcccccttccgcattcttaaaggcatgggtttattggcccggggaagatactgaagaggaagaagacgaggaggaggatgaggactctgatagtggctctgacgaggaagagggggaagctgaggccagttcatcgacgccggctacaggcgtgttcctgaagtcatgggtgtatcagccaggcgaggacacagaagaggaggaggacgaagattcagatactggttccgccgaagacgaaagggaagctgagacctcagccagcacaccccccgccagcgctttcctcaaggcctgggtttacagacctggtgaagatacagaggaagaagaagatgaagacgtggattccgaagacaaggaagatgacagcgaagcagccctcggggaagccgagtccgatccccacccctcccatcccgaccagagagcccatttccgcgggtggggctatagaccagggaaggaaacagaggaagaagaagcagctgaggattggggagaggctgagccgtgtccatttcgggtcgcaatctacgttccgggggaaaaaccaccgcccccttgggcgcccccccgcttaccactacgtctccagcggcggttgaaacgccccgaaactcccacccatgacccggaccccgagacacccctgaaggcaaggaaggtgaggttctccgagaaggttacggttcacttcctggccgtgtgggctggtcctgctcaggctgcccggcaggggccttgggaacagctcgcacgcgatcggtctcgattcgctagaagaatcacccaggctcaagaagagctctcgccgtgcctgactcctgctgccagggctagggcatgggccagacttaggaaccccccactggctcctattccagctctgactcagactcttcctagtagttctgtgccgtctagtcctgtgcagacaacaccactgtctcaggcagttgctaccccaagtcggagttcagcagccgccgctgcagctctcgaccttagcggtagaaggggctag

SEQ ID NO: 16861 - DNA, 1545 bp, Artificial Sequence
  Description of Artificial Sequence: Synthetic coding sequence
atgaaggccgaggaagaaggagtggctgaagaggaaggagtaaataaatttagctatcccccgtcccacagggagtgctgccccgcagtggaggaggaggacgacgaggaagccgtcaaaaaggaagcccatcgtacctccaccagtgccctttcccctgggtccaaacctagcacctgggtgtcatgccctggagaggaggaaaaccaagccaccgaggataagcgcaccgagcgctctaagggggccaggaagacaagcgtgtctccaagatcctccggaagcgatccacggagctgggaatacagatcaggtgaggcctctgaagagaaagaggaaaaggctcacaaggagacagggaagggggaggctgcacccggaccgcagagttctgcccctgcccagagaccacagctgaagagctggtggtgtcagccatctgacgaggaagagggggaagtgaaagctcttggagctgccgaaaaggacggggaagctgagtgccccccctgcattcctccaccatccgcgttcctgaaagcgtgggtatactggcccggcgaagatactgaggaagaggaggacgaagaggaagatgaggattctgatagcggcagcgacgaggaagagggggaagctgaagctagttcatccactcccgccacaggcgtctttctcaaatcatgggtttaccagccgggagaagacacagaagaagaagaagacgaggactccgacaccggctcagccgaggacgagagagaggcagaaactagcgcatcaacaccgcccgcaagcgccttcctcaaggcgtgggtatataggccaggtgaggacactgaggaggaggaggacgaggatgtcgattctgaagacaaagaagatgattccgaagctgcactcggggaggccgaaagtgacccccaccctagccaccccgaccaaagagcccacttcagagggtggggctatcgaccaggcaaggaaaccgaagaggaggaagccgccgaggattggggcgaagctgagccatgtcccttcagggtggctatttacgtgcctggggagaaaccgccacctccctgggctcctccccgcctgcccttacggttgcagcgccgcctgaaacggcctgagactcccacacacgacccagatccggagactcccctcaaagctcgcaaagtgcgctttagcgagaaagtaaccgtacattttctagccgtgtgggccggaccagcacaggcagctaggcaggggccctgggagcagctcgcacgggatagaagcaggtttgccaggcggataacgcaggctcaggaggagctgtccccttgtctcactccagccgccagggctagagcttgggcacgccttagaaatccccccctggcccctattcccgctctcacgcaaaccttaccttcttcttctgtaccctccagtcctgttcagacaacccccctttcccaggccgtggcgaccccctcacgcagctccgcagccgccgctgctgctcttgatctttccgggcgaaggggatag

SEQ ID NO: 16862 - DNA, 1899 bp, Artificial Sequence
  Description of Artificial Sequence: Synthetic coding sequence
atgccgtggctagtggaggctgtcaaaggtgccgctttagtggaggcaggcctagagggggaggctcgaacccccctggctatcccccacacaccctggggaaggaggcctgaggaagaggcagaggattctggcgggccaggcgaagatcgcgaaactttaggactgaagacctcttccagcctgccagaagcgtggggattgctggacgatgacgatggtatgtacggcgagagagaggcgacctcagttccaaggggccaaggtagccagttcgccgacggacagagagcccctctgagtccctccctgctcatcaggacattgcaaggcagtgacaagaacccaggtgaggagaaagccgaagaagaaggagtagctgaggaagaaggagtcaacaaattcagttacccccctagccaccgggaatgctgtcctgccgtcgaagaggaagacgatgaggaagctgtcaagaaggaggcacaccgcacctcaactagcgctctgtcccctggcagtaaacccagtacttgggtctcctgtccaggagaagaggagaaccaggcaaccgaagataagagaaccgagaggagcaaaggggcaaggaaaactagtgtttcccccaggtcctcgggaagtgaccctaggtcatgggagtataggtcaggtgaggctagcgaagaaaaggaggaaaaggctcacaaggaaacaggcaagggagaggctgctcccggcccacagtctagtgcccctgctcagcgtccccagctcaaatcttggtggtgccagcctagtgacgaagaggagggagaagtgaaggctctgggtgcagccgagaaggacggcgaagccgagtgtccaccttgcataccccccccttcagccttcctgaaagcctgggtatactggcccggcgaggacactgaggaagaggaggatgaggaagaggatgaagattctgacagtggctcagatgaagaagagggtgaggccgaagctagttcatccacccctgcgactggggtattcctgaaatcatgggtctaccagccaggtgaagacactgaggaggaggaagatgaagattccgacacaggctcagctgaggacgaaagagaagccgaaacctccgcatcaaccccacccgctagtgctttcctgaaagcttgggtttacaggcctggtgaagatacggaagaggaagaagatgaggatgtagattctgaggacaaggaagatgatagtgaagcggcgctgggggaagcagaatccgacccacacccatcccaccccgaccagcgagctcattttcgcgggtggggatatcggccaggaaaagagactgaggaagaggaggccgccgaagactggggagaagcagagccttgtcctttcagagtagcgatctacgtcccgggggagaaaccaccaccaccttgggcgccacccagactccccctgaggctgcagcgacgcttgaagcgccctgagactcctacacatgacccagaccccgaaacccccctcaaggccagaaaggttagattcagcgagaaggttactgtgcactttttagctgtgtgggccggtccagctcaggctgccagacagggcccatgggaacaactcgcccgggaccggtcgagatttgcccgcagaattacgcaggcacaggaagaattgagtccctgcctcacaccagcagcacgtgctcgagcgtgggcaaggctcaggaatcccccgctggctccaatcccggcattaacgcaaacactgccatcatcatccgtcccctcatcccctgttcaaactaccccactctctcaggccgttgcaactccatcgaggtccagcgctgccgctgctgctgccctcgatctctctggtcgtagaggatag

SEQ ID NO: 16863 - DNA, 1671 bp, Artificial Sequence
  Description of Artificial Sequence: Synthetic coding sequence
atggcaggcgcatctgaactcggcaccggaccaggtgcggccggaggagatggggacgacagcctgtatccaattgccgttcttattgacgagctccggaacgaagacgtccagctgcgactgaacagcatcaaaaagctcagcaccatcgcactagcattaggcgtggagcgcacgaggtctgaattgctcccgttcctgaccgatacaatctacgacgaggacgaggtgcttctggctttagctgagcagctgggcaattttaccggcctggtgggaggaccagacttcgctcattgcttactccctcctctcgagaacttggcaactgtcgaagaaacggtggtgcgcgataaagcagtggagagtttacgccagatctcacaggagcacactccggtagcattagaagcctacttcgtgcctctagtcaagcgcctcgcatccggcgattggttcacctctagaacaagcgcatgtggactcttcagcgtgtgttaccccagggcttctaacgccgtaaaggctgagattcgccaacagtttcggagcttgtgcagtgatgataccccgatggtacgcagagccgctgccagcaaactgggagaatttgccaaggtactcgaactcgattcggtcaaatcagagattgtccctttatttacgtctttggcaagcgacgagcaggactcggtgaggcttctggcagtcgaagcttgcgtgagcatcgcccaactcctgtcccaggacgatctcgaaactctggtcatgcctacattgagacaagccgctgaagataagtcttggcgagtcagatatatggtggcagatagatttagtgaattgcaaaaagccatgggtcctaagatcactctgaacgacctgattcctgcttttcaaaacctgctgaaggattgtgaagctgaagtacgagctgcggctgcccataaagttaaggagctgggtgagaacctgcctattgaggatagggaaacaattattatgaatcagatcttgccatacatcaagtgtcccgacgtgaggctgaacattatctcaaacctggactgtgtgaacgaggtgattgggataagacagctttcccagagtcttctcccagccatcgttgaacttgcagaggatgccaaatggagggttaggctggcaatcattgagtacatgccactgctcgcagggcaactgggcgtagagttttttgacgaaaagctcaactcactgtgcatggcatggctcgtggatcacgtttacgccatccgggaagctgctaccaacaacctgatgaagctggtgcagaagttcggcacagagtgggctcaaaatacgatagtccctaaggtgctcgtgatggccaacgaccctaactacctccaccggatgactacgctattctgcattaatgctctcagcgaggcatgtgggcaggagattacaacaaagcagatgctaccaatcgtgttaaagatggcaggcgaccaggtggctaacgttcgcttcaacgtggccaagagtctgcagaagattgggccgatactggataccaatgcactccagggggaggttaaaccggtcctgcagaaactcggccaggacgaggatatggacgtgaaatatttcgcccaagaggccattagtgtcctggctctcgcctag

SEQ ID NO: 16864 - DNA, 1770 bp, Artificial Sequence
  Description of Artificial Sequence: Synthetic coding sequence
atggccgctgccgatggagatgactctctttacccaatagctgtgctgattgatgaattgagaaacgaggacgtccagcttcgcctgaattccatcaagaagttgagtactatcgccctggctttgggcgtggaaagaacccgatctgaactgttgccatttctgactgataccatttacgatgaagatgaggttttgctggcactcgccgaacagttaggcacctttactactctggtgggcgggcctgagtatgtgcattgtttattgcccccattggagagcctggcaacggtggaggagaccgttgtgcgcgacaaggcagtcgaatcattgagagcaattagccatgaacactccccaagcgacctcgaggcccacttcgtgccattggtgaagaggcttgcagggggagactggttcacctcaaggacgagcgcatgtggactgttcagtgtttgttacccccgagttagttctgctgtcaaggccgagctgagacagtattttcgtaatctctgctctgacgacacgcccatggtgcgacgggctgcagcaagtaagttgggagaatttgccaaagtgctggaactggacaacgttaaatctgagataatccccatgttcagtaatctcgccagcgacgaacaagattctgtcagattactggccgtcgaagcctgcgtgaacatcgcccaactgctaccgcaggaggatcttgaggccctggtgatgcccacgctccggcaggccgcagaggataaatcctggcgtgtgcgctacatggtggccgacaaatttacagagctacagaaggctgtcggaccagagattaccaagactgatctcgtaccggcatttcagaatttgatgaaggattgcgaggccgaagtgagagccgctgcctcccacaaagtgaaagagttctgtgaaaaccttagcgccgattgccgcgagaatgtaatcatgtcccaaatcttgccatgtatcaaggagctcgtgagtgatgcaaaccagcacgttaagagtgccctggcttccgtcataatgggcttaagtcctatcttaggtaaggacaacaccattgaacacctgctgcctttatttctggctcagttaaaagatgaatgtcccgaagtccgtctgaatattatctcaaacctagattgtgtgaatgaagttatcggcattcggcaactgtctcagtccctccttcctgccatcgttgagcttgccgaggacgcaaaatggcgcgtcaggttagctatcattgaatacatgcctctccttgcggggcagctgggcgtagagttttttgatgaaaagctgaactcgctgtgtatggcctggctggtggatcacgtctatgccatcagagaagctgctacctcaaatctcaagaagctggtcgagaaatttggcaaggaatgggcccacgctacaatcattccaaaggtgctggctatgagtggcgaccccaattacctccatcgcatgacgaccctgttttgtatcaatgtgttgagcgaggtgtgcggacaggatataacaacaaaacacatgctgccgaccgttctcagaatggccggtgatcctgtagctaatgtgagattcaacgtagccaagagtcttcagaagattggaccaatcctcgacaattccactcttcagagcgaagtgaagcctattctggagaaactcacacaggaccaggatgtggatgtcaaatatttcgcccaggaggctttgaccgttttgtcgctcgcctag

SEQ ID NO: 16865 - DNA, 1740 bp, Artificial Sequence
  Description of Artificial Sequence: Synthetic coding sequence
atggcggccgccgacggcgacgatagcctctatcctattgctgttctcatagacgaactgcgcaacgaggatgtgcagctgcgactcaactcaattaagaagttgtccactatagccttggccctcggagttgagagaacgcgctctgagctgctgccgtttctcacggacaccatctacgatgaagatgaggtgcttctggctctggccgaacaactgggcacttttaccactctcgtaggcgggccagaatacgtgcactgccttcttcctccgctcgagtctcttgcaacagtggagtcactgagggccatctcccatgaacacagcccatctgatcttgaggcccactttgtgccgttagtgaaaaggctagccggcggtgactggttcacctcacggacatccgcttgcgggttgttcagcgtgtgttatccgcgcgtatccagcgccgtgaaggccgagttgaggcagtactttagaaacctgtgtagtgatgatacccctatggtgcgtagggccgccgcttccaaactgggcgaattcgccaaagtgcttgagctggacaacgtgaaaagtgagatcattccaatgttttcaaatcttgccagcgacgagcaggacagtgtgcgcctcctggctgtagaggcgtgcgtgaacattgcacagctgctgccccaggaagatctggaagctctggtcatgccaactctgcggcaggcagcagaggataagagttggagagtccggtacatggtggccgataagtttacagaactgcagaaggcagtgggacctgaaattacaaagaccgacctcgttccagcgtttcaaaatcttatgaaggactgcgaggctgaagtacgtgccgcagcctctcataaagtcaaagaattctgcgagaatctcagtgctgactgtcgggaaaacgtgatcatgtctcagatcctcccctgcatcaaagagcttgtttccgatgccaatcagcacgttaagtccgctctggcgagcgtaattatgggcctatctcctattctcgggaaggataacaccattgagcacttacttcctctgttcttagcgcagcttaaagatgagtgtcccgaggtgcgccttaacataatctctaacctcgactgcgtgaacgaggtgatcgggatccgccagcttagccagagcttgctgcccgcaattgtggaactcgcagaagacgctaaatggagggtgcgcctggcaataatagagtacatgccactgctggctggacagttgggggtggagttttttgacgagaaattaaattctctttgtatggcctggctcgtggaccacgtgtacgcgatacgcgaggcggctacttccaacctcaaaaagcttgtggaaaagttcggcaaggagtgggcacacgccaccattatccctaaggttctggccatgtccggcgacccgaactacctgcacaggatgaccacgttgttctgtattaatgtactctccgaggtgtgcggccaggacattaccacgaagcatatgcttcctacagtgctcaggatggctggcgacccagtggcgaacgttcgtttcaacgttgccaaatcactgcagaagataggacctatcctcgacaactctacccttcagagcgaggtcaagccaatactcgagaaactaactcaggaccaggacgtagacgtgaaatactttgctcaggaggcgcttacggttctgagtctggcatag

SEQ ID NO: 16866 - DNA, 471 bp, Artificial Sequence
  Description of Artificial Sequence: Synthetic coding sequence
atggctgctgccgatggggatgatagtttgtaccccatcgcagtgcttattgacgagctaaggaacgaggacgtacagcttcgtttgaatagcaatcttaagaagctcgttgaaaagttcgggaaagagtgggctcatgctaccattataccgaaagttctggctatgagtggcgatcccaactacctccaccggatgacaacactgttctgcatcaatgtgctgagcgaggtgtgtgggcaagatatcaccaccaaacacatgctgccaactgtgctaaggatggctggcgaccctgtggccaacgtccggttcaacgtcgccaagagcttgcagaagatcggtccaattctcgacaactctacactccagagtgaggtgaaaccgatcctggaaaaacttacacaggatcaggacgttgacgtgaagtatttcgcccaagaggctctcacagtcctatctttagcatag

SEQ ID NO: 16867 - DNA, 1605 bp, Artificial Sequence
  Description of Artificial Sequence: Synthetic coding sequence
atgcggactttttcttttgcttcaaccgcttcacggtcttgtcctccttcaccatggccactgggcttgaaaggacctgaggtgtccttttgcctcagcctccagcctccactggagtcccttgccaccgtcgaagagactgttgtgagggataaggctgtggagagcctaagggccataagccacgaacacagtccatctgacctggaggcacacttcgttcctcttgttaagaggctcgcaggcggggattggtttacctcacgcaccagcgcatgtgggctgttcagtgtgtgctacccacgcgtgagctctgccgtcaaggcggagctcagacagtacttccggaacctctgttcagatgacacccctatggttaggcgggcagctgctagcaagcttggagagtttgccaaagtgctggagcttgacaacgtgaaatctgagattatccctatgttttccaacctcgctagcgatgaacaggacagcgtgcgtcttctcgcagtggaagcctgtgtgaatatagcccagttgctgccccaagaagatctagaagctctcgttatgcccactttgcgccaggcggcggaggacaaatcctggagagtgaggtatatggtggctgataagttcacagaactgcagaaggccgtgggcccagagataactaagacggatctggtccctgcatttcagaacctgatgaaagattgcgaggcggaggtgagagcggcagcctcccataaggtgaaggagttttgcgaaaacctttctgccgactgccgcgaaaacgtgatcatgtctcagatcctcccatgtatcaaggaactcgtgtcggatgctaaccagcacgttaagtccgcccttgctagcgtgatcatgggtctgagccccattctcggtaaagataataccatcgaacatttactgcccttatttcttgcccagctgaaggacgaatgtcccgaagtgagactgaatattatcagcaacctggactgcgttaatgaagtcattggtattaggcaactgagccagtcactcctgcctgcgatcgtggaactggcagaggacgcgaagtggcgggttagactggccattatcgaatacatgcctctactcgcaggccagttgggggtggagttcttcgatgagaagttaaattctctctgtatggcgtggctggtggatcatgtctatgctatacgggaagccgcaacctctaacctaaaaaaattggtggaaaaatttggaaaagagtgggcccacgcgaccatcatcccaaaggtgctggccatgtcaggggatcccaactacctacatcgtatgaccaccctgttctgcatcaatgttttgagcgaagtatgtgggcaggacattactacaaagcacatgttgcccacagtcctgcggatggctggagatccggtggccaacgtgcgctttaatgtcgccaagagtctgcagaagataggcccgatactcgataacagtacactgcagagcgaagttaaacccatcctggagaagctcacccaagatcaggacgtggacgtaaagtacttcgcccaggaggccttgactgtactatctctagcctag

SEQ ID NO: 16868 - DNA, 2004 bp, Artificial Sequence
  Description of Artificial Sequence: Synthetic coding sequence
atggccggggcaagtgagctgggaactgggcctggtgcagcaggcggcgacggggacgattccctgtaccccatcgccgtcctgatagacgagctgaggaatgaagatgtgcagcttaggctgaattcaattaaaaaactctctaccatcgcactagcccttggagtggaaagaacaagaagtgaacttcttcctttcttaactgataccatctatgatgaggatgaggttctgctagcgttggccgagcaactgggaaactttactggcctagtgggtggacctgactttgcccactgcttgctgcccccgctggagaacttggccaccgtggaggagaccgtggtcagggataaggctgttgagtctcttcggcagatttcacaagagcacaccccagtggctctagaagcgtacttcgtgcctttagttaagaggcttgccagtggagattggtttacatcccgaacgtcggcttgcggtctgttcagcgtttgctatccccgcgcatctaacgccgttaaggctgagatccgccagcagtttcggtcactgtgctctgacgatacacccatggtgcgccgggctgccgccagcaagctgggggaatttgccaaggtgctcgaactggatagcgtgaagtctgagatagtccctctctttacctcattggccagtgacgaacaagattccgttcgtctgctggcagtcgaggcatgtgtgtctatcgctcagctgttgagccaagacgatcttgagaccctcgtgatgccgactctgagacaggccgctgaggataaatcttggcgggttaggtacatggtggctgaccgtttctcagagttgcaaaaggctatgggaccaaagatcacacttaacgacctgatcccagcctttcagaacttgctcaaagattgcgaggcggaggtccgggctgccgcggcccataaggttaaagagttaggagagaatcttcctattgaggatagggaaacgatcatcatgaaccaaatactgccttacattaaggaactagtgtctgacactaatcagcatgtgaagagcgcacttgcttctgtgatcatgggactgtccactatcttggggaaggaaaacacaatagagcatctgttgcccctcttcttagcgcagctgaaggatgagtgcccagacgtacggctgaatataatcagtaacctggactgtgttaacgaagtgataggtatcaggcagctgtcccagtcactgctgccggccatcgtggagctcgccgaagatgccaagtggcgggtgcggttagccattatcgaatacatgcccctcctcgccggacaactgggtgtggagttttttgacgagaagttaaacagtctctgcatggcctggcttgttgatcatgtgtacgctatccgcgaggccgcgaccaataacctgatgaagctagttcagaaattcggaacagaatgggcccaaaatacaatagtgccaaaagttcttgtaatggctaacgacccgaattacttacaccgcatgaccaccctgttttgtattaacgctttgagtgaagcttgcggccaggaaatcaccacaaagcagatgctgccaatcgtgcttaagatggcgggcgaccaagttgctaacgtgcgcttcaatgtggccaagagtctccagaaaatcggcccgattctagacactaatgcgctccagggggaggtgaagcctgttctccagaaattagggcaggatgaggacatggatgtcaagtacttcgcacaggaagcaatcagcgtggtggcacagaggctccgcaagctcgagttccctgtgaaagatagcggagagccctccgtccctagagcagacaagaatcattttccccgtcctactgtaccgggcgaagacatgggtaaagggccggtgtaccagctgcgtggggatacacgcgacaccctggcgcagctgggcatcgccgagctggtccattttagccagtctaccgactag

SEQ ID NO: 16869 - DNA, 1425 bp, Artificial Sequence
  Description of Artificial Sequence: Synthetic coding sequence
atggccggcgccagtgaactggggacggggcctggcgcagccgggggggacggggatgacagcttatatcctatagccgtgctcatcgatgagctgagaaatgaggacgtccagctccgcctgaattctattaaaaagctgtctacaattgccctggcattgggagtggaacgaactagaagtgaattgctgccattccttaccgacacaatctatgacgaggacgaggtgttgctagccctggcagaacaactgggaaacttcactggcctggtaggaggccccgactttgcccactgcctccttgactctgtccgactactagctgtggaagcctgtgtctccattgcgcagctgctgtctcaggatgatctggaaaccctggtgatgcctacactgcggcaggctgccgaagataagtcttggcgagtacgctatatggtcgcagacaggttcagtgaactgcagaaagcgatgggccccaagattactctaaacgatctgatacctgcttttcaaaatctcctgaaggattgtgaggccgaggttcgggcagccgccgctcacaaagtgaaggagctcggcgagaatctccccatcgaggacagggaaactataatcatgaaccagatccttccctatatcaaagagctggtgtccgatacaaaccaacacgtgaagtccgccttggcatcagtgatcatgggcttgtccaccattctgggaaaagagaacactattgagcacttactgcctctctttttggcccagctaaaagacgaatgtcctgatgtgcgtctaaacattatttcaaatctagattgcgtaaacgaggtcatcggcataaggcagctcagtcagagcctcctgcccgccattgttgaactggccgaggacgcaaagtggcgcgttaggttggctatcatagagtatatgcccctgctggcgggccagctcggcgtggagttcttcgatgaaaagcttaattcactgtgtatggcctggctggttgaccatgtgtacgctatccgggaagctgccaccaataaccttatgaagctagtgcaaaagttcggcactgagtgggctcagaacacaatcgttcccaaggttctggtgatggcaaatgatcccaactaccttcacaggatgaccacactcttctgcattaacgctttgtccgaagcatgcggccaggaaatcaccactaaacagatgttacccattgtattgaagatggccggagaccaggttgccaatgtgcggttcaacgtggctaagtctttacaaaagatcgggcctattttggacaccaacgcactgcagggggaggtgaaacccgtcctgcagaaattgggccaggacgaagatatggacgtcaaatactttgcccaagaagctataagtgtcttggccctcgcctag

SEQ ID NO: 16870 - DNA, 1365 bp, Artificial Sequence
  Description of Artificial Sequence: Synthetic coding sequence
atggccggggcttctgaactgggaactgggcccggagcagccggaggcgacggagacgatagtttgtacccaatcgctgtcttgatcgatgaacttcgaaatgaagacgtgcagttgcggcttaactctatcaagaaactcagcacaatagcactggcccttggagttgagcgcaccagaagtgagttgctgccttttctgaccgataccatttacgatgaggacgaagtgttgttggcactagcagagcagctgggcaacttcaccgggttagtcggcggtccagattttgcccactgtctgctagatagcgttcgccttttagcagtggaggcgtgtgtgtccattgcacagctgttaagtcaggacgatcttgagactttggttatgcccactctgcggcaggcggccgaggacaagagttggcgggtgcggtatatggtggccgatcggttctcagaattgcagaaggccatgggtcctaaaataaccctaaacgatctgatccctgcattccaaaatctgctcaaggactgtgaagcagaggtcagagcagctgctgctcacaaggtaaaagaactcggtgagaacctgcccatcgaagaccgagaaacaataatcatgaaccagatccttccctacattaaggaattagtgtcagacaccaaccagcatgttaagagcgcccttgcctccgtgatcatggggctgtccactatcttgggcaaggaaaatacaatcgagcatttgttgccgctattccttgcccagctaaaggatgagtgtccagacgtcaggctaaacatcatatcaaatctggattgcgttaacgaagtgattggcatacgtcagctgtcacagtcgctcctgccagcaatagttgagctggccgaggacgcaaagtggcgggtgcgcttagctatcattgagtacatgccactgttagctggacagctcggcgtggagttcttcgacgagaagctcaatagcctgtgtatggcatggcttgtcgatcacgtctacgcaatcagggaagcagccacaaataacttgatgaaacttgtgcagaaatttgggaccgagtgggcccagaataccattgtgcccaaggttctggtgatggctaatgacccaaactacctgcacagaatgaccaccttgttctgcatcaatgcgctcagtgaagcctgcggccaggagattacgactaaacagatgctgccgatcgtaaaaaacggacgcagaccaagctccaaatgctccctgcagtgcggtcagatcagcacaaaagattggaccaactcccgctaccagtgcttcaccggccggtccgaagcctccacaaccgaggtcagaagcaggtag

SEQ ID NO: 16871 - DNA, 1812 bp, Artificial Sequence
  Description of Artificial Sequence: Synthetic coding sequence
atggcaggcgctagcgagttagggaccggacccggcgctgccggaggggatggcgatgacagcctttaccctatcgccgtcctgattgacgaattaaggaatgaagatgtccagccccctctggagaatctcgctacagtagaggaaactgtggtccgagataaggcagtagagtcactgcgccagatcagccaagaacacacgcccgtggcactcgaggcatacttcgttcccctcgtcaagagactggcctcgggcgactggtttacaagcagaacttctgcatgcggcctgttctccgtatgctaccccagggctagcaacgctgtgaaagcagagatcagacaacagttcagatcactgtgcagtgacgatacgcctatggtgaggcgagccgcagccagcaagctgggagaattcgcaaaggtgctggagctcgatagcgttaaaagcgaaattgtccccctgtttacctcgctcgcttctgatgagcaggattctgttcgcctgctggctgtcgaagcatgcgtgtcaatagcccagcttctatcacaggatgaccttgaaactctggtgatgccaactctgaggcaggccgcggaagataaatcctggagagttcgttatatggtcgctgacagattctctgagctgcaaaaggctatgggtccaaagataacacttaatgatcttatcccggcctttcagaacctgttgaaagattgtgaggccgaggttcgcgctgctgccgctcataaggtgaaagagctcggtgaaaacctgcctattgaagaccgggagactattatcatgaatcagatactcccttatatcaaggagcttgtgagtgatacgaaccagcatgtgaaatcagccctcgcctcagtgatcatgggtctctccacaattttaggtaaggagaatactatcgaacatcttctccccctgttcttagcccagctgaaagacgagtgcccagatgtgcggttaaacatcatcagcaatttggactgcgtgaacgaagtgattggtatcaggcagctgagtcaatcacttctgcctgccatcgtggagcttgcagaggacgcaaaatggcgcgtgaggttagctataatcgaatacatgccgctgttggccggccagctcggtgtagagtttttcgatgaaaaactcaattctctatgtatggcatggctcgttgaccacgtgtatgccattcgggaagctgcgactaataatctgatgaaactcgtccagaagtttggaacagagtgggcccagaatacaattgtgcccaaagtgctcgtcatggctaacgatcctaattatttacataggatgaccacattgttttgtattaatgccctgagtgaggcgtgcggacaggagatcaccactaagcagatgctgcctattgttttgaagatggctggcgaccaagtcgctaacgttaggttcaacgtggccaaaagtcttcagaaaattgggcccatcctcgatacaaacgctctgcagggagaagtgaagcccgttctgcagaaattgggtcaggatgaagatatggatgtgaaatacttcgctcaggaagccatctctgtcgttgcacagcgattgcgcaaattggagttcccagtgaaagattccggtgaacccagcgtgccgcgggcagacaagaaccacttccctcgtccaaccgtccccggggaggatatgggaaagggaccagtgtaccagctccgcggcgacactagggatacgctcgctcagctggggattgcagaattggtccatttcagccagtcaacagactag

SEQ ID NO: 16872 - DNA, 1323 bp, Artificial Sequence
  Description of Artificial Sequence: Synthetic coding sequence
atgatgcagcttaccttttggttgcgggtcccccctccttttagccactttaaacggcaatttcgctccctgtgctctgatgatacacctatggttcgacgcgccgctgcctcgaaactgggggagtttgccaaggtactggagctagatagcgtgaagagtgaaatcgtgccactcttcacaagcctggcgagcgatgagcaagatagcgtcagattactggccgtggaagcatgtgtaagtattgcacagttactgagccaggatgatcttgaaacccttgtgatgcctactcttagacaggccgcggaggacaagagttggagagtgcgctacatggtggcagatcgcttttcagaattgcagaaagctatggggcctaaaataacactcaacgacctcatcccggctttccagaacttgttaaaggactgcgaggctgaagtgagggcggccgcagctcataaagtgaaggagctgggggaaaatctgcccatcgaagatagagagacaattatcatgaaccagatcttaccctacatcaaggagctagtcagtgatactaatcagcatgttaagagcgccctggcgagcgttatcatgggtctgtcaacaattctggggaaggaaaacacaatcgagcatctgctccctttgtttctagcacaactcaaagatgagtgtccagatgtacgcctgaacattatttccaatctggattgtgtgaacgaagtgatcgggattcgacagctctctcagtccctgctccccgccattgtggagctcgcagaggatgcaaaatggcgtgtgcgcctggcgattattgagtatatgcccctgctcgcaggccagctcggagtggaattcttcgatgaaaagctgaacagtctctgtatggcctggctggttgaccacgtctacgcgattagggaggcagccactaacaaccttatgaaattggtgcagaaattcggaaccgaatgggcacagaacaccatcgttcccaaagtgctggtgatggctaacgaccctaactatctgcataggatgacaaccctcttctgcattaatgccctctccgaagcctgtggacaggagattaccactaagcagatgctccccatcgtcctgaagatggcaggtgatcaggtggcgaacgtcagatttaacgtcgccaagtcccttcaaaaaataggacccattctcgataccaatgccctgcagggtgaggttaagcctgttctgcagaagttgggccaggatgaagacatggacgtgaagtattttgcccaagaggccatcagtgttcttgccctggcgtag

SEQ ID NO: 16873 - DNA, 1806 bp, Artificial Sequence
  Description of Artificial Sequence: Synthetic coding sequence
atggccggagcttctgaactcggtactggccctggcgcggctgggggggatggtgatgactctctgtatccaatcgcagtcctcatcgatgaattaaggaacgaagatgttcagctgcgcctcaattcaatcaagaagcttagcaccatagcgctcgccctcggcgtggagagaacccgatctgagctcttgccttttctcacagacaccatctatgatgaggatgaggtcctcctcgccctcgccgagcagctgggaaactttactggcctggtcggcgggccagattttgcacactgtctcctccctcctctagagaatctggcgacagtggaggagacagtggtaagagataaggctgttgaatcattgagacagatcagccaggagcacacaccagtagccctggaggcgtattttgtgcctctcgtcaagaggctggccagcggagactggttcacatcacggacctccgcgtgtgggctatttagcgtgtgctacccaagagccagcaacgcggtgaaggccgaaatacgacaacaatttcgctccctgtgtagtgatgatacgcctatggtgcgaagagccgccgccagtaagctcggagaattcgccaaggttctcgaactcgatagcgttaaaagtgaaattgtgcctttattcacctccctggctagtgacgaacaggattccgtaagactcttagctgtggaagcatgtgtctcaatagcgcagctgctgtctcaagacgatctcgaaacactggtgatgcccaccctccgacaggccgctgaagacaaaagctggcgcgtgcgctatatggtcgccgatagattttccgaattgcaaaaggctatgggcccaaaaataactctcaacgacctcattccagctttccagaacctcctgaaggactgcgaggccgaagttcgcgcggccgcagctcacaaggtgaaggaattaggcgagaacctgcccatagaggacagggagactatcataatgaatcagatccttccttatattaaggaattggtgagcgacacaaatcagcacgtgaagtcagctctggctagcgtaattatgggcctgtctactattctcggcaaggagaatacaatagaacacttgctccccctgtttctggcgcaactgaaagacgagtgcccagatgtgaggctgaatattatctccaacctggattgcgtcaatgaagtaatcgggatcaggcagcttagccagtcgcttctgccagctattgttgaattagctgaggacgcaaaatggcgtgtcaggctcgccataattgagtacatgccgctcttagctggacaactgggggtcgaattcttcgatgaaaaattgaatagtctttgtatggcctggcttgtcgaccatgtctacgcgatccgggaggccgcgactaacaatctgatgaagttggtgcagaagtttggtaccgaatgggcccagaacaccatcgtccccaaagtcttggtaatggctaacgatcccaactacttacacagaatgacaaccttgttctgtattaatgccctgagtgaagcgtgtggacaggagatcacaactaagcagatgctacctattgtcctgaagatggctggcgatcaggttgcaaacgttcggttcaatgtggccaaaagtctgcagaagattgggcctatcctggatactaatgctctccagggagaggtgaaacccgttttacagaagctggggcaagacgaggacatggatgtcaagtacttcgcgcaagaagcaatctcggtgctggctttggcatag

SEQ ID NO: 16874 - DNA, 1566 bp, Artificial Sequence
  Description of Artificial Sequence: Synthetic coding sequence
atgagtggtcgtaggttccacttgagtactactgatcgcgtcattaaggccgtcccctttccccccacacagcggttgacctttaaggaagttttcgaaaatgggaagcctaaagtggatgtgttaaaaaatcacctggtaaaagagggaagactcgaggaagaagtagccctcaaaattattaatgatggcgccgcaatacttcgacaggaaaaaacaatgatcgaagtggatgctcctatcaccgtctgcggagacatccatggccagttttttgatttaatgaagcttttcgaagttggtgggagccccagcaatactcggtacctttttctcggggactacgtggaccgtggctacttttctatcgagtgcgtcctgtatctgtggagtctcaagattaatcatcccaaaacactgtttttactgaggggaaatcacgaatgtcggcacctgacagattacttcacattcaagcaggaatgtcgaatcaagtattccgagcaggtctacgacgcctgtatggagacatttgattgcctgcccctggctgccctgctcaatcagcagttcctttgtgtccacgggggcatgagtcccgaaatcacatcactggatgatataaggaaactggacaggtttacagaaccacccgcgtttggacccgtgtgtgacctgctgtggtctgatcctagtgaggactatggcaacgaaaagaccttggaacattacacccataataccgtccgcggatgctcatatttctatagttaccccgcagtgtgcgaattcctgcaaaataacaaccttctaagtatcatccgcgcccatgaggcccaggatgccggctatagaatgtaccgtaaatcacaggcgaccggatttccaagcctgatcacaattttctctgctccaaattacctggacgtttataataacaaagctgcagttttgaagtacgaaaataacgtcatgaatattcgccagttcaattgctccccccacccctactggctcccgaattttatggacgtgttcacttggtcactccctttcgttggtgaaaaggttacggaaatgctcgtgaacgtgctgaacatatgttctgatgacgagttaatctccgacgatgaagcggaggatcactacatacccagctaccagaagggctcaaccaccgtgcgtaaagaaattatcagaaataaaattcgcgccatcgggaaaatggcccgcgtgtttagtattctgcgccaagaaagcgaatctgttcttacccttaaggggttgacccccaccggcacacttcccctgggggtgctctccgggggcaagcaaacaatcgagacagcaaccgtcgaagcggtggaggctcgagaagcgatcaggggcttttctctgcagcataagatcagatccttcgaggaggcacgtgggttggacaggataaacgagaggatgcctccaaggaaggattctattcacgctggcggacccatgaagagtgtgacgtcagctcattcacacgccgctcacagaagtgaccagggcaagaaagcacactcatag

SEQ ID NO: 16875 - DNA, 1410 bp, Artificial Sequence
  Description of Artificial Sequence: Synthetic coding sequence
atgagcgaacccaaggcaattgatccaaaactttcaaccacggatcgagtggtcaaggccgttccctttcccccatcccaccgtctgaccgccaaggaggtctttgataacgacggcaagccccgtgtcgatatattgaaagcccatttaatgaaggaaggtcggctcgaggagtccgtagcgctgaggattatcacggagggagcatctatattgaggcaggagaagaacctgctcgacattgacgctccggtcacagtatgtggggacattcacggtcaattttttgacctcatgaagctctttgaagttggagggtcccccgctaatacacgttacctgttcttgggcgactatgtggaccggggctatttttctattgagtgcgtgttatacctgtgggccctgaaaatattatatccaaaaacactgtttctactaagaggtaaccatgagtgcaggcacctgaccgaatactttacgtttaagcaggaatgcaaaatcaaatattccgagagggtgtatgacgcctgtatggacgctttcgattgtctgccattggctgctctgatgaaccaacagtttctgtgtgtccatggaggcttatctccggaaatcaataccctagatgacatccgcaaactcgaccggttcaaagagccaccagcgtacggcccaatgtgcgatattctgtggtctgaccctttggaagacttcggcaatgaaaaaacacaggaacattttactcacaatacagtaagggggtgttcttacttttatagctatcctgccgtttgcgagtttcttcagcacaacaacctcctgtctatcttgcgagcgcatgaggcccaggacgcaggttatagaatgtatcgcaagtctcagaccactgggtttccctctctgatcaccatcttttccgcacccaattacttggatgtgtacaacaacaaggttacggagatgcttgtcaacgtgctgaatatctgtagcgacgatgagttgggatccgaagaggacggatttgacggcgctaccgccgccgcacgcaaggaggtgattaggaacaaaataagggcgatcggcaagatggcacgcgtcttttcggttctgcgcgaggagtccgagtcagtgttgaccctcaaggggctgacgccgactggcatgctgccaagtggcgtcctttcgggcggaaaacagactttgcagtctgcaattaaaggattctcaccccagcacaaaatcacttctttcgaagaggccaaaggactggaccggatcaacgaacgcatgcctcctagaagggacgccatgccctcggatgccaaccttaactccatcaacaaagcccttacctcggaaaccaatggtactgacagcaacggtagtaactcctctaatatccagtag

SEQ ID NO: 16876 - DNA, 1536 bp, Artificial Sequence
  Description of Artificial Sequence: Synthetic coding sequence
atgtctgaaccaaaagccatcgatcccaagctatctaccacagaccgtgtggtaaaggctgttcccttcccccctagtcatagactcaccgccaaagaggtcttcgataatgatgggaagccacgagtggatattttgaaggcacacctgatgaaagaagggcgcctcgaagaaagcgtggcgctgaggataattactgaaggtgcgtctatcttacgacaggagaaaaacttgctggacatcgacgcaccagtcaccgtgtgtggtgacattcacggtcagttcttcgatctaatgaagctttttgaggtgggggggagtcccgctaatacccgctatctctttttgggggactacgtcgaccgcggctacttctccatcgaatgtgtactgtatctgtgggccctgaagatcctgtacccaaaaactctctttctcctcagaggtaatcacgagtgtaggcatttgacagagtacttcaccttcaagcaagagtgcaagattaagtattcagagcgagtttatgatgcctgcatggacgcgttcgattgcctgcctcttgcagcactgatgaatcaacaatttctatgtgtgcacggcggactttccccagaaattaataccctggacgacatacgtaagctggaccggttcaaagagcctcctgcatatgggcctatgtgcgacattctgtggtctgacccactggaggacttcggtaacgagaaaactcaggaacacttcacacacaacacggtgagaggctgctcctacttttattcgtatcccgctgtctgcgagtttttacaacataacaatctgctcagcatcctcagagcacatgaagcacaagatgctgggtatcggatgtaccggaagtctcagacaaccgggttcccctcgctcatcacaatcttttctgccccaaattatttggacgtttacaacaacaaagccgctgtgctaaaatatgagaataacgtcatgaacatcaggcagttcaattgctcaccccacccttattggttgcccaacttcatggacgtgttcacctggtctctgccattcgtgggcgagaaggtgacagaaatgcttgtgaacgtgcttaatatctgttctgatgatgagctaggaagcgaggaagacggctttgacggcgctactgctgccgccagaaaggaggtgatacgtaataagattagagcaatcggcaagatggcacgagttttcagcgtactgcgggaagaatccgaatccgtgctcactctcaagggattgacacccacggggatgttgccctccggtgttctctccggaggcaagcagacattgcaaagcgcaatcaagggattttcaccccaacacaaaatcacttctttcgaagaggccaaaggtctggacagaatcaacgagagaatgcctccaagacgcgacgccatgcctagtgacgccaatctgaattctattaataaagccttgacttctgaaacaaacggcaccgactccaatggttcaaactctagcaacattcagtag

SEQ ID NO: 16877 - DNA, 1566 bp, Artificial Sequence
  Description of Artificial Sequence: Synthetic coding sequence
atgtcagagcctaaggccattgacccgaagctgtccactacagatagggtcgtgaaagccgtgccttttcccccttctcacaggctcactgctaaggaggtgtttgataacgacggcaagccaagagtggatatcctgaaagctcacttaatgaaagaagggaggctggaggagtctgtagctttgcgtattattaccgaaggcgcatccatcctgcgacaggaaaaaaatctgttggatatagatgctcccgtaaccgtatgtggcgacatccatgggcagtttttcgacctcatgaaactcttcgaggtaggggggtcccccgccaatacccgttatttattcctcggggactacgtcgatagaggctatttctcaatcgagtgcgtgctttacctgtgggccctcaaaattctgtaccccaagactcttttcctccttcggggaaaccatgagtgccggcatttgacagaatacttcaccttcaagcaggaatgcaagattaagtactccgagagagtttacgatgcctgcatggatgcctttgattgcctgcctttggcagctctcatgaatcagcagttcttgtgcgttcatgggggtctatctccagagataaatacactggacgatattcggaaactagaccgctttaaagagccgcctgcttacggcccaatgtgcgacattctttggagcgacccattggaggattttggaaacgagaagacacaggagcactttacgcataacacggtgcgcggctgttcttacttctactcctacccagcagtgtgcgagtttcttcagcacaataacttactgagtatcctgcgcgcccatgaagcccaagatgcaggatatagaatgtatagaaagagccaaacaaccggatttcctagcttgatcaccatctttagcgcccccaactatttggacgtgtataataataaggctgctgtcctgaagtacgaaaacaatgtgatgaatattcggcaatttaactgctcccctcatccttattggcttccaaacttcatggacgttttcacctggtcactgcccttcgtgggagagaaggttactgagatgctggtgaatgtcctcaacatttgctccgatgacgagctgggaagtgaggaggacggttttgatggcgccactgcagctgcacggaaagaggtcatccggaataagatccgcgccatcggcaagatggcaagagtgtttagtgtgctccgggaggaatctgaaagcgtgctgactctaaaggggttgactccaactgggatgctgccaagtggcgtgctgagcggcggcaagcagacattacaatcggccaccgtcgaggcgattgaggccgatgaggctatcaaagggtttagcccccagcacaagatcacttcctttgaggaggccaagggcctggataggataaatgaaagaatgcctccgagaagagacgccatgccttcggacgcaaatctcaactctatcaataaagcgctgacctccgaaacgaacggaacagattccaacggaagtaatagctcaaatatacagtag

SEQ ID NO: 16878 - DNA, 1272 bp, Artificial Sequence
  Description of Artificial Sequence: Synthetic coding sequence
atgaaactgtttgaggtcggcggttccccggcaaacacacggtatttgtttttgggcgactacgtggacagagggtacttttctatcgagtgtgtcctgtatctttgggccctcaaaattctgtacccgaaaacactgttcttgctgagggggaaccatgaatgtcggcatctaactgagtatttcacgttcaagcaggagtgtaagataaaatactctgaacgtgtctatgacgcttgtatggatgctttcgactgtctgcccctggcagctctgatgaatcagcagttcctgtgcgtgcacgggggactgagcccagagattaataccctagatgatattcgcaaattggaccgctttaaggagcctcccgcttacgggccaatgtgcgacatactgtggtctgaccccctagaagattttggcaatgagaagacacaggagcattttactcacaacacagtgagggggtgttcctatttttattcatatcccgccgtctgtgagtttctgcaacacaataatctattaagcatcttgcgcgctcacgaggcacaagacgccggctaccgaatgtaccggaaatcacagacaaccggcttcccttctctgataacaatctttagcgccccgaactatctcgacgtgtataataacaaggctgctgtgctgaaatacgaaaataacgtcatgaatatacggcagtttaattgttcccctcatccgtattggttgccaaattttatggacgttttcacgtggagcctgccatttgttggcgaaaaggttactgagatgctcgtaaacgtactcaatatttgtagtgacgatgagctcggaagcgaggaagacggcttcgacggggcgacagcagccgctagaaaggaggtgattcgtaataaaatcagagccattgggaagatggccagagtcttttccgtgctcagagaggagtccgagtccgtcctcactctcaaaggcttgactcctacggggatgctgccgtcgggggtgctgtcaggaggtaaacagacactgcagtccgccaccgtggaagctatcgaggctgatgaggccattaagggcttttcccctcagcacaagattacatcatttgaagaggccaaggggctggacaggattaacgaaagaatgccaccaagaagggacgccatgccttctgatgctaatctcaatagcattaataaagcactcacatctgagactaacggtaccgactctaatggctcaaattccagtaacattcagtag

SEQ ID NO: 16879 - DNA, 870 bp, Artificial Sequence
  Description of Artificial Sequence: Synthetic coding sequence
atgtcggaacccaaggctatcgatccaaagctgtcgacaactgacagagttgtgaaagccgtaccttttcctccaagccatcgcctgacagcgaaagaggtcttcgacaacgacggcaaaccacgggtggatatcctcaaggctcacttgatgaaggagggcagactggaggaatccgtggctcttcggattatcacagagggggcatcaatcttgagacaggaaaagaatcttctggacatcgacgcccccgtgactgccgcggtgctgaaatacgaaaacaatgttatgaacatccggcagtttaattgctcgcctcatccctattggctgcctaatttcatggacgtgtttacgtggagcctgccttttgttggcgaaaaggtcactgagatgctggttaatgtcctcaacatttgcagtgacgatgagctgggatcagaggaggacggatttgacggagcgacagctgcggcaaggaaagaggtcataaggaacaaaatccgggcgattgggaaaatggcacgtgtgttttccgtactgcgggaggagagcgaatcagttctgacacttaaaggcttgaccccgaccggtatgctgccgagcggcgttctgtctggtggtaaacagacactccagtctgctaccgtggaagccatagaagctgatgaagctataaaggggttttctcctcagcataaaatcacaagcttcgaagaggctaaaggcttggacaggataaatgaaagaatgccgcccaggcgggacgccatgccctcagacgcgaaccttaacagcatcaacaaggccctgacgagtgagactaatggtacggactccaatggctctaactcaagtaatatacagtag

SEQ ID NO: 16880 - DNA, 1365 bp, Artificial Sequence
  Description of Artificial Sequence: Synthetic coding sequence
atgtcagagccaaaagccatcgatcccaagctaagcaccacggacagagtggtgaaggtgtgtggggacatccatggacagttcttcgacctcatgaaactttttgaggtgggcggcagtcccgccaatacacgttacctctttctaggggactatgtggaccgcggttacttcagcattgagtgcgtactgtatctgtgggcgctcaagattttgtatcccaaaaccttgtttctgctacgtgggaaccacgaatgccgccatttgacagagtatttcacttttaaacaggaatgcaaaattaagtattctgagcgagtgtacgatgcctgtatggacgcatttgattgccttcccttggccgcgcttatgaaccaacagtttctctgtgtgcatggtgggctttcccctgagatcaatactctcgatgacatcagaaagcttgaccggttcaaggagccacctgcgtacggacctatgtgcgacatcctttggtcggatcccttagaggacttcggtaacgagaaaactcaggagcattttacgcataacacagtgcgtggttgttcctacttctacagctaccctgccgtttgtgaatttttacagcataataatctgctgagtatcctgagggctcacgaagctcaggacgccggttaccgtatgtaccgaaagagccaaacaacaggctttccttcgctgattactattttctccgctcccaactatctggacgtttataataacaaagctgccgtgctgaagtatgagaacaatgttatgaatatccgccagtttaactgttcacctcacccatactggctgcccaactttatggacgttttcacttggtccctgccatttgtgggcgaaaaagtgaccgaaatgcttgtaaacgtcctaaacatctgctccgatgatgaacttggtagtgaggaggatggcttcgatggagcgacggcagccgcaaggaaggaagtcattcgaaacaaaatacgtgctatcggcaaaatggcaagggtcttcagcgtcctgagggaggagtctgagagcgtactgactctcaagggcttaacacctactggcatgctgccctctggcgtcctgtcaggaggaaaacagaccctgcaaagcgcaaccgttgaggcaattgaggccgatgaggccatcaagggctttagtccccagcataagatcacctcctttgaggaggccaaaggactggatcggattaatgaacgtatgccaccacgccgcgatgctatgccgtctgatgctaatctaaacagtatcaacaaggcactgaccagcgaaacaaacggtacagactccaacggctctaattctagcaatatccaatag

SEQ ID NO: 16881 - DNA, 399 bp, Artificial Sequence
  Description of Artificial Sequence: Synthetic coding sequence
atgaaagaagggaggctggaggagtctgttgcacttcggatcattacagagggtgcttcaattcttaggcaggagaagaacttgctagacattgacgcgcctgtgaccgtatgcggggatatccatggccagttttttgatctgatgaagcttttcgaggttggcggttcaccggccaatacacgctatctctttctaggcgactacgtagacaggggatatttttcaatagagtgtgttctgtacctgtgggccttaaagatcttataccctaaaactctgttcctactaaggggcaaccacgaatgtaggcacctgacagagtacttcacatttaaacaagagtgtaagatcaaatactccgaacgagtatacgacgcttgcatggatgccttctag

SEQ ID NO: 16882 - DNA, 444 bp, Artificial Sequence
  Description of Artificial Sequence: Synthetic coding sequence
atgaaagaagggcgtttagaggagagcgtggctctccggatcattacagaaggggccagcatcttaagacaagaaaagaacctgctagatatagacgcaccagtgactgtttgcggcgatattcatggacaatttttcgacctcatgaagctgttcgaggtcgggggcagccctgccaatacgcggtaccttttcttaggcgactacgttgacaggggatacttttccatcgaatgtgtgttgtacctgtgggccttgaagatactctacccaaagactctcttcctgctcagaggaaaccacgaatgccggcatctgactgagtactttaccttcaagcaggagtgcaaaataaagtactcagaaagggtttatgacgcctgcatggatgccttcgattgcctgccactagcagcccttatgaaccagcagttcctgtgctag

SEQ ID NO: 16883 - DNA, 1491 bp, Artificial Sequence
  Description of Artificial Sequence: Synthetic coding sequence
atggctgcacccgaacctgcacgagccgccccgcctccaccacccccacctcctccacctcccggtgccgatcgggtggtgaaggctgtcccgttcccacccactcatcgccttacctcagaggaagtgttcgacctcgacggcatcccacgcgtcgacgtgttgaaaaatcacctggtgaaggaggggcgggtcgacgaagagatcgctctgcgtatcataaatgagggagctgccattttgcgacgggaaaaaacaatgattgaggttgaagcacccatcacagtgtgtggagacatccatggacaattctttgatcttatgaaactcttcgaagttgggggcagtccggcgaacacccgctatctctttctgggcgactacgtggaccgaggctacttcagcatagaatgtgtgctgtacctgtgggtcttgaagatcctgtacccttctacactgtttcttttgcgggggaaccacgaatgccgccatctcaccgagtacttcacatttaagcaagagtgcaaaataaaatactcggagcgggtgtatgaggcttgcatggaagccttcgattccctgccgttggctgccctgctgaatcagcagtttctttgcgtccacggagggctgagtcctgaaatccacaccctggatgacatccgaagactcgacagattcaaagaaccccccgccttcgggcccatgtgtgaccttctgtggtccgacccatctgaagattttggcaacgagaaatcacaggagcatttctcccacaataccgttagaggatgttcttatttttataactaccctgccgtgtgcgagtttttacagaataacaacctgttgagtattattcgagcacacgaggctcaggacgccggctatcggatgtaccggaaaagtcagacaacagggtttccaagccttataactatcttctcggctcccaactacctagacgtgtataacaataaggccgccgtgctgaaatacgaaaacaatgttatgaatatccgccaattcaactgctcaccccacccttactggttaccgaattttatggatgtcttcacatggtcgctgcccttcgtgggcgagaaggtgaccgagatgctggtgaacgtgctgtccatctgctcagacgacgagctgatgaccgagggagaggatcagttcgatggcagtgccgccgcgcggaaagaaattatacgcaacaagatacgtgcaataggaaagatggcgagagtgttttcagtcctgagagaggagtctgagtcagtcttgactctgaaaggactgacacctactggaatgcttccaagtggagtccttgctggcgggcgccaaacactgcagagcggtaacgatgtgatgcaattggccgttccccaaatggactggggcacacctcattcctttgcaaataatagccataacgcttgtagagagtttctattgtttttcagctcgtgtctttcaagctag

SEQ ID NO: 16884 - DNA, 1575 bp, Artificial Sequence
  Description of Artificial Sequence: Synthetic coding sequence
atggcagcaccagagcctgcaagggccgcccctcctccaccacccccgccgcccccccccccgggggcagatcgcgtggtaaaagccgtcccatttcccccaacacatcggctgacctctgaggaggtcttcgatctagatggaatcccccgtgttgatgtgctgaagaaccatctcgtaaaggagggccgcgtggacgaagagattgccctacgtatcattaacgagggcgcggccatactccggagggagaaaacaatgatagaggttgaagcccccatcacagtatgtggggatattcacggacagttcttcgacctgatgaagctgttcgaagtcggagggtcacctgctaacacgagatatttatttctcggggactacgtggataggggatatttcagcatcgagtgtgtactttatctctgggttctgaaaattctctatccttcaacactgtttctgcttaggggcaaccatgaatgtagacatctgaccgaatactttacattcaagcaggagtgcaaaatcaaatattcagagcgcgtgtatgaggcttgtatggaggcctttgactcacttcccttagccgccctcttaaaccagcagtttctctgtgttcacggtggcctcagtcctgagattcatacgctggacgatatcaggagactggaccgctttaaggagccacccgcgtttggaccaatgtgtgatttgctgtggagtgatccttccgaggacttcggaaacgaaaagtctcaggagcacttcagccataacacggtgagaggatgctcttacttttataactaccctgctgtgtgtgaattcttacagaacaacaacctgctctccatcattagggcacacgaagctcaggacgccggctaccgcatgtacaggaagagtcagaccaccgggttcccatctctgataactatttttagtgctccaaattacttagacgtctacaataacaaggcagcggttctgaaatatgaaaacaatgtcatgaacatccgccagttcaattgttcaccccatccctactggctgcctaatttcatggatgtgtttacgtggagcctgccattcgtcggcgagaaggtaaccgagatgctggtgaatgtgcttagtatctgtagcgacgatgaacttatgaccgagggagaggaccaattcgacggcagcgctgccgccagaaaagagatcattaggaacaagattagggccatcggtaaaatggcacgagtgttcagcgtcctgcgtgaagagagcgaaagtgtgttgaccctgaaggggcttaccccaaccgggatgttaccttctggtgtgctcgccggtgggcggcagacactccaatccgccaccgtggaggcgatcgaagcagagaaggccatcaggggattcagccccccgcaccgtatttgttctttcgaagaggccaagggcttggatcggattaatgagaggatgcctccgcgcaaggatgcagtgcagcaggatgggtttaatagtcttaatacagctcacgcaaccgaaaatcatggcacggggaatcacaccgctcagtag

SEQ ID NO: 16885 - DNA, 1545 bp, Artificial Sequence
  Description of Artificial Sequence: Synthetic coding sequence
atggccgctcccgaacctgcccgcgctgctccacccccacctcctcctcccccacctcctccaggcgccgaccgagtggttaaagccgttccgttcccccccacccaccggctgacctcagaggaagtgtttgatctcgacgggattccgcgggtggatgtcctgaaaaatcacctcgtcaaggagggtagagtcgacgaggagatagccttaaggatcatcaatgagggggctgctatccttaggagagagaagaccatgattgaagtggaggcgccgattactgtgtgcggtgatatccatgggcaattcttcgaccttatgaagctgttcgaagtcggcgggtccccagctaacaccagatatctctttctgggtgactatgttgaccgaggctatttctctattgagcatgtcctgggcacagaagacatttccattaatccccacaacaacattaacgagtgcgtgttgtacctgtgggtactgaaaattctgtatcctagcacattgttcctcctacgcggaaatcatgaatgccgccacctgactgaatacttcacttttaaacaggagtgcaaaatcaagtactccgagagggtctatgaggcatgcatggaagcctttgatagcttaccactggctgccctgttgaatcagcagtttctatgtgtacacgggggcctaagtcctgagatccacaccctggacgatatacgtaggctcgaccggtttaaggagcctcctgccttcggacccatgtgcgacttactgtggtctgatcctagcgaagacttcggcaacgagaaaagccaggaacactttagccacaacaccgtaagaggatgttcctatttttacaactatcccgcagtgtgcgagtttcttcagaataataacctcctcagtatcattcgcgcacatgaagcccaggatgcaggttatcgtatgtaccgcaagtcacagactaccggcttcccctcattgattactattttttcagcccccaattacctggatgtctacaacaacaaagcagcagtacttaagtatgaaaacaatgtaatgaacatcaggcagttcaactgttcaccacacccgtactggcttcctaatttcatggacgttttcacatggtcgttaccattcgtaggtgaaaaagtgaccgaaatgctcgtgaacgttctgagtatttgctccgacgacgagctaatgactgaaggagaggatcagttcgatggctctgcggctgctcgtaaagaaattattaggaataaaattcgggccatcggcaaaatggcacgcgtattctctgtcctgcgagaggaatccgagtcagtcctgaccctcaaaggcctgacacctaccggcatgctgccaagcggagttctagcgggaggtcggcagaccctccagtcgggcaacgacgtgatgcaattagccgttccacagatggactggggtaccccccacagcttcgctaacaattcccacaacgcttgtcgtgaatttcttctattctttagcagttgtttatcatcttag

SEQ ID NO: 16886 - DNA, 591 bp, Artificial Sequence
  Description of Artificial Sequence: Synthetic coding sequence
atgaacattcgccagtttaactgctctcctcacccctattggcttcccaacttcatggatgtgttcacatggtccctcccgttcgttggcgagaaagtgacggagatgttggtgaatgtgctatcaatctgcagcgacgacgagctgatgactgaaggggaggatcagtttgatgagcgtctcatttacgggaacaaaaagggtagcgccgcggcaaggaaggagatcattagaaataaaatcagagcgataggaaaaatggctcgcgtgtttagtgtgctccgcgaagagagcgagagtgtgctgacactcaagggcctcacccccactggaatgctccctagtggagtgcttgccggggggcgacagaccctgcagagcgcgaccgtggaagcaattgaagccgagaaggctatcagaggattttccccccctcacagaatctgctcattcgaggaggctaaaggtctggacagaatcaatgaacgcatgccgccacgtaaggatgctgtgcagcaagacggatttaactctctgaataccgctcacgccaccgagaatcacgggactggcaatcatacggcccagtag

SEQ ID NO: 16887 - DNA, 1548 bp, Artificial Sequence
  Description of Artificial Sequence: Synthetic coding sequence
atggctgcgcccgagccagccagagctgctccccctccaccgcccccaccccctccgcctcccggtgctgacagagtcgtgaaagcagtcccatttcctcctacccatcggctcacttcagaagaagtgttcgacctggatggcattcctcgggtcgatgtgctcaagaaccacctcgtgaaggagggcagggtagatgaagagatagctctacggatcattaatgagggtgccgcaatattacgtagagaaaaaacgatgatcgaggtcgaggcacctatcacagtctgtggcgacatccacggccaattttttgatctgatgaaactttttgaagttggcggatctcccgctaacaccaggtatctgttcctgggggactacgttgaccgcggatactttagtattgagtgcgtgttgtacctgtgggtcctgaagatcctgtacccaagtactttgtttttgcttcgcggcaatcacgagtgtcgccacttgaccgaatacttcacctttaagcaggagtgcaagattaagtactctgagcgcgtttacgaggcatgtatggaggccttcgattcactacctctggccgcgctattgaatcaacagttcctatgtgtccacgggggcctgtcaccggagattcacaccctggacgatatcaggcgcctggaccggttcaaagaacccccagctttcggacccatgtgtgatctactgtggtcagacccctcagaagactttgggaatgagaagagccaggagcacttcagccataacaccgttaggggatgctcatatttctacaattatcctgccgtatgcgagttcctccagaataacaatctgctgtcaatcatcagggctcacgaagctcaagatgccgggtacaggatgtatcgcaagtcgcagacaacaggttttccaagtctgattactatcttctcagcgcccaattatctcgacgtttataacaataaggctgccgttctaaaatatgaaaacaatgtgatgaacatcagacagtttaactgcagtccccatccatattggctgccaaactttatggacgtctttacctggagcttgccattcgtgggcgagaaggtgaccgaaatgcttgtgaatgtgcttagcatctgcagtgatgatgagctaatgaccgaaggtgaagatcaattcgatgtggggtctgcagccgctcgcaaggagattatcaggaataaaattcgcgcaatcggaaagatggcccgggtgtttagcgtactgcgtgaagaatccgagagcgttcttacactgaaagggctgacacccaccggaatgttgccaagcggcgtgttggccggtggaaggcagaccctgcagagtgccatccggggcttcagcccaccccataggatctgttcattcgaagaagcaaaaggcctcgaccggatcaacgagcggatgccccccagaaaagacgcagtgcaacaagacggcttcaactctctgaatacagctcacgccactgagaaccacggcacgggtaatcacaccgcccaatag

SEQ ID NO: 16888 - DNA, 1578 bp, Artificial Sequence
  Description of Artificial Sequence: Synthetic coding sequence
atggccgctccagaacccgcgcgcgccgcgcccccccctccccccccacctccccctccccccggtgcagatagggtggtaaaagcggtaccctttccgccgacacatcgccttacctcagaggaagtctttgacctcgacggcatccctcgtgtcgacgtactgaaaaaccatttagtgaaggagggaagggtcgatgaagagatagctttacgaattattaacgagggagctgctattctccggagggagaagactatgatcgaggtcgaagctcctattacggtgtgcggcgacatccatgggcagttcttcgaccttatgaagctctttgaggttggcgggtctcctgcaaatacccggtatctattcctcggtgattacgtggacagaggttacttctcgatagaatgcgtcctatacctgtgggtgctgaagatactatacccttcaaccctgttcctgctcaggggaaatcacgagtgcagacacctgaccgaatattttacattcaagcaggaatgcaagatcaaatattctgagcgcgtttacgaggcttgcatggaggctttcgatagcttaccactggccgccctgctgaatcagcagttcttatgcgtgcatggcggcctctctcctgagatccatacattggacgacatccgcaggctggatcggtttaaagagcctcccgcgttcggacctatgtgtgatctgctttggtcagatccatccgaagattttggtaacgagaaaagccaggagcacttctctcataataccgtgcgtggctgctcctatttttacaattatcctgccgtgtgtgaatttttacagaacaacaaccttctttcaatcatccgcgcacatgaagcacaggacgcggggtaccggatgtatagaaaatcacagaccacaggcttcccatcactgataactatattcagtgccccaaactatctggacgtgtacaataataaggccgctgtactgaagtacgaaaataatgtcatgaacatacggcagtttaactgtagtccacatccttactggttgcccaacttcatggacgtatttacgtggagcctgcctttcgtcggcgagaaggtgaccgagatgttagtgaacgttctgagtatatgctctgacgacgaattaatgacagagggtgaagaccagtttgatgtggggtcggccgccgcccgcaaggagattattcggaataaaatcagagctattggcaaaatggccagggtattttccgtgctccgggaggaatccgagtctgtgctcaccctcaagggacttactcctacaggtatgttaccctcaggagtactggctggggggcgacagactctgcagagcgctaccgtggaagccatcgaggcagagaaggctattcgcgggttctctcctccacacagaatatgttcgtttgaggaggccaagggcctggacaggataaacgaacgcatgcctccccgaaaggacgccgtgcagcaggatggattcaatagccttaatacagctcacgcaacagaaaaccatggcaccggcaaccacactgcccaatag

SEQ ID NO: 16889 - DNA, 561 bp, Artificial Sequence
  Description of Artificial Sequence: Synthetic coding sequence
catccttactggttgcctaatttcatggatgtgtttacatggtcccttcctttcgtaggagagaaggtaacggaaatgctcgtgaacgtgctgtctatctgcagcgatgacgaactcatgaccgagggtgaagatcaatttgacgaaaggctcatatatgggaacaagaaaggcagcgccgcagctaggaaagaaatcataagaaataagattagagccattggaaagatggctcgcgtttttagtgttctgcgggaggagtctgagtcagtgctgactctgaagggactgacaccaaccggcatgctcccttccggggttcttgcggggggccggcaaaccctccagagtgccacagtagaagccattgaggctgaaaaagcaattaggggcttttccccgccgcataggatctgtagctttgaggaagctaaaggcttggatagaattaacgaaagaatgccgcctagaaaagatgctgttcaacaagatgggttcaattctttgaacacagcgcacgcaactgagaatcacggaacaggaaaccataccgcccagtag

SEQ ID NO: 16890 - DNA, 459 bp, Artificial Sequence
  Description of Artificial Sequence: Synthetic coding sequence
atgctggttaacgtgttatctatttgctcagacgacgaactgatgactgagggcgaagaccagtttgatggaagcgctgccgcacgaaaggagatcatccgaaacaagatccgcgccatcggaaagatggcccgcgtatttagcgttctaagagaggagtccgaatctgtcctcacgttaaaagggctgaccccaaccgggatgttgccctccggggttctggcaggcggacggcaaacactgcagtctgccactgtggaagccatagaggctgaaaaagccattcggggtttcagtcctccacaccgaatctgcagcttcgaggaggcaaagggcttggataggattaatgagcgcatgcctccccgcaaagatgccgtgcaacaggatgggttcaatagcctgaatactgcgcacgccaccgagaaccatggtacaggcaaccacaccgcccagtag

SEQ ID NO: 16891 - DNA, 1236 bp, Artificial Sequence
  Description of Artificial Sequence: Synthetic coding sequence
atgattgaggtggaggccccgatcacagtttgtggagatatacacgggcaattcttcgacctgatgaagttgttcgaggtagggggttcccctgcaaacacacgttacctttttcttggggattatgtggaccgcggctatttctcgatagagtgtgtcctctacctgtgggtgctgaagattctgtatccgagcaccttattcctcttgaggggtaaccacgaatgcaggcaccttacagaatatttcacatttaaacaggagtgtaagataaaatacagcgagcgagtgtacgaggcctgcatggaggcattcgattcactgcctcttgccgctctcttgaatcagcagttcctgtgtgtgcacgggggattgagccccgaaatccatacccttgatgacatccgcagacttgatcggtttaaagaaccacctgcttttgggcctatgtgcgatctgctgtggtccgacccttctgaggacttcgggaacgagaagtcgcaggagcatttcagccacaacactgtccggggatgttcctacttctacaattaccctgccgtctgtgagttcctccagaataataaccttctgagcatcattcgagctcatgaggcacaggacgccggctaccggatgtatcgcaaatcacagaccacaggttttccctcgttgatcacaatcttcagtgcccctaattacctggatgtgtataacaacaaggccgccgtgttgaagtacgaaaacaatgtcatgaacatcagacaatttaactgcagtccacatccctattggctacctaactttatggacgtttttacttggtcccttcccttcgttggggagaaagtgacagaaatgctggttaacgtgctgagtatctgttccgatgatgagctgatgactgagggagaggatcaattcgatgtcggctcagccgccgcccggaaagagatcatcaggaataagattagagcaatcgggaaaatggcgagagtcttctctgtgctgagggaggagtctgagagtgtgttgacacttaagggcctgactccaaccggcatgttgccttctggagtgctagctggggggaggcagaccctgcagtcaggcaatgacgtgatgcagctggctgtgccccagatggattggggaactccccatagctttgccaacaatagtcataatgcctgcagggaattcctcctcttcttcagttcgtgcctgagctcctag

SEQ ID NO: 16892 - DNA, 1539 bp, Artificial Sequence
  Description of Artificial Sequence: Synthetic coding sequence
atgtcaggtcgaagatttcacttatcaacaacagatcgcgtcatcaaggcggtgccctttcccccgacgcagcgactcacctttaaagaggtctttgaaaacgggaagcctaaagtggatgtgctgaagaaccacctggttaaggagggcagactggaggaagaggtagccctgaagattatcaacgacggagctgcaatcctccgtcaggagaaaaccatgatcgaggtggatgcgccaattacagtctgcggggatatccacgggcagttcttcgacctgatgaaactgttcgaagtgggcggctcccctagcaacacccgatatctttttctgggcgactatgtagaccgaggctacttcagtatcgagtgtgtactttatctgtggtctttaaagatcaaccaccccaagacgctttttcttctccggggtaatcacgagtgcagacatcttactgattactttacctttaaacaggagtgccgcataaaatactcggagcaagtgtatgacgcttgtatggagaccttcgactgcctcccactggcagcactccttaaccaacaattcctgtgtgtgcatggcggcatgtctccagagatcaccagcctcgacgatattaggaagttggatcggttcaccgagccccctgcttttggacctgtctgtgacctgctctggtcagaccctagcgaggactacggaaacgagaaaacactcgagcattacactcataatacagtgcgcggatgctcctatttctactcataccccgcggtgtgtgagttcctccagaataacaacttactcagcatcatcagggctcatgaggcccaggatgcgggataccgcatgtatcgaaaaagtcaggccaccggatttcccagcctcatcactatctttagcgcccctaattacctagacgtttacaacaataaggctgctgtgttgaaatacgaaaataatgtcatgaacatcagacaattcaattgtagcccgcacccttattggctcccaaacttcatggatgtgtttacctggtcccttccttttgtcggcgagaaagtgaccgaaatgttggttaacgtccttaacatctgctccgatgacgagttaatctcggacgatgaggccgagggatccacaacagtgcggaaagaaatcatccgaaataaaattcgggcaattggcaagatggcccgggtgtttagtatccttcgacaggagtccgagtcagtgttgaccctgaagggactgactccaaccggaactctccccttgggagtcctgagtggcgggaagcaaaccattgaaacagccacggtagaggcagtggaggcccgggaagcaattagaggctttagcttgcagcacaagatccggtccttcgaagaggcccgaggcctggaccgcataaacgagcgcatgccgccccgcaaagattcaatacatgcaggtggaccaatgaagtccgtcactagcgcacactcacacgctgctcataggtccgaccagggaaagaaggcccatagttag

SEQ ID NO: 16893 - DNA, 1509 bp, Artificial Sequence
  Description of Artificial Sequence: Synthetic coding sequence
atgtccggacgtcgcttccatttgtccaccaccgacagggtgatcaaggccgtgccattccctcctactcagagattgacttttaaggaagtatttgagaacggaaaacccaaagtagatgttcttaagaaccacttggtcaaagagggacggctcgaagaggaagtggccctgaagataatcaacgacggggccgctatcctgaggcaggaaaagactatgattgaggtggatgctccaattactgtttgcggagatatacatggacagttctttgacctgatgaaactgttcgaggtaggagggagcccctcaaatacccgatatctctttcttggagattatgttgaccgcgggtacttttccatcgagtgtgtgctctatttgtggagtctcaaaatcaaccatcctaaaaccctttttctgcttcgcggcaatcatgagtgccgccatctgactgattatttcacgttcaagcaagagtgtcgcataaagtacagcgagcaggtctacgacgcctgcatggaaaccttcgattgcctgcctcttgctgccctgctgaaccagcaatttctctgcgtgcacggggggatgtcacccgagattacctctctggatgatatccgcaagctggatcgcttcacagagccgccagcttttggccccgtgtgtgatttactgtggtctgacccatccgaagactatggcaatgagaagaccctggagcactatacacacaatacagtgcgtggctgctcctatttctactcctaccccgccgtgtgcgagttccttcagaacaataatctgctatccatcatcagagcccacgaggcccaggatgccggctaccggatgtatcgcaaatcccaagctacagggtttccaagtctcatcaccatcttctctgcccctaactatctggacgtctataacaacaaggcggccgttctgaagtacgagaacaatgtcatgaacattcggcagttcaattgctcaccacacccatactggctgccaaactttatggatgtgtttacctggtcactgccgttcgtgggcgaaaaagtgaccgagatgctggtaaatgtgctgaacatttgctctgatgatgaactgatctccgacgatgaagccgaggggtctaccaccgtcaggaaagagatcatccgtaataaaatccgcgccatcggcaagatggcacgcgttttcagtattctgcgccaagagtctgaatccgttttgacattgaagggtttgacaccaacaggcacattgcctctgggcgtcctcagcgggggcaaacagaccattgaaacagccatccgcggattctctctgcagcacaagatccgctcgttcgaggaggcccgaggtctcgacagaatcaatgaacgaatgccaccgcgtaaggattccattcatgccggtgggcccatgaaatctgtgactagcgcccactcacatgctgctcacagaagcgaccaaggaaaaaaagcccacagttag

SEQ ID NO: 16894 - DNA, 345 bp, Artificial Sequence
  Description of Artificial Sequence: Synthetic coding sequence
atgtattacaaatttagtggttttactcaaaaactggcaggtgcctgggcttccgaggcctattcaccacagggcctcaagcccgtcgtgtcaactgaggccccccccatcatattcgcaacaccaactaagctgacctcagacagcactgtgtacgattatgccggtaagaataaggtgcctgaactgcaaaagttcttccagaaagccgacggagtgccagtttacttaaagcgcggactccccgatcagatgctctacagaacgacaatggctcttaccgtgggtggcactatttactgtttgatagcgctgtatatggcctcacagcccaaaaataaatag

SEQ ID NO: 16895 - DNA, 522 bp, Artificial Sequence
  Description of Artificial Sequence: Synthetic coding sequence
atgagtactatgggcaatgaggcgagttaccccgctgaaatgtgtagccactttgataacgacgagataaaacgtcttgggcgccgattcaaaaagcttgacctggacaaaagcggctctctgagcgtcgaggagttcatgtccctgccagaactcagacacaaccctttggtccggcgagtgatcgatgtgttcgatactgacggggatggcgaggttgacttcaaggagttcattttgggcacatctcagttctctgtaaagggagacgaggagcagaagctgagatttgcatttagcatctatgatatggataaggacggttacatcagcaatggagagttattccaggtgttgaagatgatggtaggaaacaacctcactgactggcaattacaacaattggtggacaaaacgatcatcatattggacaaggatggagacggtaaaatctcattcgaagagtttagtgccgtcgtgcgggatcttgaaatccataagaaactggtacttatcgtctag

SEQ ID NO: 16896 - DNA, 420 bp, Artificial Sequence
  Description of Artificial Sequence: Synthetic coding sequence
atgtctactatggggaatgaagccagctatcctgctgagatgtgttcacactttgacaacgatgaaatcaaaaggcttggcagacgatttaaaaaactggacctcgacaagtctggcagtctgagcgttgaggaatttatgtcactgccagagctgcgtcataacccactggtaaggcgagtgattgatgtctttgataccgatggagacggtgaagtcgatttcaaagagttcattctgggtacctcacagttttctgtgaaaggcgatgaggaacagaaattacgatttgccttttctatttacgacatggacaaggatggatacatctcaaacggtgaactgtttcaggtactgaaaatgatggtagggaataacctaaccgactggcagctccagcagctggtgctcatagtgtag

SEQ ID NO: 16897 - DNA, 1818 bp, Artificial Sequence
  Description of Artificial Sequence: Synthetic coding sequence
atggcgggtctctattcactgggagtttccgttttcagtgaccagggcggccgaaaatatatggaagatgtgacacagattgtggtggaacccgagcctaccgccgaagagaaaccgagccctcgccgctcgctctcccaaccattacccccaaggccctctcccgcagccctacctgggggggaggttagtggcaaggggccagccgtggctgctcgtgaagcccgcgaccctctgccagacgcgggggcaagcccggccccgagccgttgctgtcgccggcgcagctcagtggcatttttcgcagtttgtgatggacacggcggacgggaggcggcccagtttgccagagagcatctttggggctttatcaaaaagcagaaggggttcacttctagtgagcctgcaaaggtctgcgctgctattagaaagggttttctggcctgccacttggccatgtggaagaagctggccgagtggccgaagacaatgacagggttgccatcaactagcggcactaccgcctctgtggtgatcatcaggggaatgaaaatgtacgtcgctcacgtgggagacagcggggttgttctaggtatacaggatgatcctaaagatgacttcgtgcgggccgtggaggtgacccaggatcacaagcccgaactgcccaaggagagggagaggatcgagggactcggcggtagtgtgatgaacaagagcggtgtcaatcgtgtggtatggaaacgcccacgcttaactcacaacggccccgttagaaggagtacagtgatagaccagattcccttcctggcggtcgcacgggccctgggcgacctctggtcctacgattttttttccggcgaatttgtggtgtcaccagagccggatacgagcgtccatacccttgacccccagaaacacaagtacatcattcttggaagcgacggtttgtggaacatgattcctcctcaagacgcaatctctatgtgccaggaccaggaggaaaagaagtacctcatgggggagcacggccaatcctgcgccaagatgttagtgaaccgggcccttggacgttggcgccagcgaatgctgcgggccgataacacctcagccattgtgatctgtatttcacctgaggtggacaatcaaggcaattttaccaatgaggatgagctttatctcaacctaacggactcaccgtcctataacagtcaggaaacctgcgttatgacaccatcaccatgctcaacacctcccgtgaaaagccttgaggaagatccttggccaagggtgaactcaaaggaccacatccccgcactggtccgaagtaacgccttctctgagaacttccttgaggtctccgccgagattgcgcgggagaatgtgcagggtgttgtgattccctcaaaggatcccgaaccactggaggaaaactgcgccaaagcgcttaccctgcggatccatgacagcctgaacaattcgctgcctattggattagtgcccactaactccaccaatacggtcatggaccagaagaacctcaagatgagtacacctggacagatgaaagcgcaggagattgaaagaaccccaccaacaaacttcaagcggacactcgaggaaagtaactcaggtccactgatgaaaaaacacagacggaacggactctcaaggagctcgggagctcagcctgcgtccctgccgaccactagtcagcggaaaaacagcgtgaaactcacgatgaggcgaaggctgcggggacagaaaaaaatagggaacccactacttcatcaacacagaaaaaccgtgtgtgtgtgttag

SEQ ID NO: 16898 - DNA, 1293 bp, Artificial Sequence
  Description of Artificial Sequence: Synthetic coding sequence
atggcaggtttatacagtcttggagtgagtgtattcagtgaccagggaggccgtaagtacatggaagatgtgactcagattgttgtggagcctgaaccgactgctgaagagaaaccctctccacggaggagcttgagccaaccgctccctcctcgaccatcgcctgccgctctgcccggcggcgaggtgtccgggaagggaccagcggtcgccgcgcgtgaggcacgtgacccgcttcctgatgccggagcctcgcctgcaccctcacggtgttgcagacggcgtagctctgtggctttttttgcagtgtgcgatgggcatggcggacgtgaggcagcccagttcgccagggaacatctttggggttttatcaaaaagcagaaaggcttcaccagcagcgagcctgcaaaggtgtgcgccgcaatccggaaaggattcttagcgtgccacctggctatgtggaagaaactggctgaatggcccaagacaatgactggcctgccttccacaagcggtaccactgcgagcgtggtgattattcgggggatgaagatgtacgtcgcgcacgtgggcgacagcggcgtggtactcggaatccaggacgatccaaaagacgacttcgtgcgggcagtggaggttactcaagatcataagccagagctgcctaaggagcgggagcggattgaaggcctcggaggatcagttatgaacaagagcggagtgaatagagttgtgtggaagaggccaagacttacccacaacgggccggtgagaaggagcacagtaatagatcaaattccttttctggctgtggcacgggctctgggggatctgtggtcatacgacttcttttcaggagaatttgtggtgagcccagagcccgacaccagcgttcacaccctcgaccctcaaaaacacaaatacataatcctcggctctgatggtctgtggaacatgattcccccccaagacgctatctcgatgtgtcaagatcaagaagaaaagaagtacctcatgggggaacatggacaaagttgcgccaagatgctggtgaaccgagcgctcggaaggtggagacagagaatgctgagggccgacaacacttcggccattgtgatctgtatctctcccgaggtggacaatcagggcaactttacaaatgaagacgaactgtacctaaacttaaccgactcaccctcatacaattcccaagagacgtgcgtaatgacgccaagcccttgttcaacgccgcccgtgaaggactttggcttcgaattggactcccgtaaatag

SEQ ID NO: 16899 - DNA, 837 bp, Artificial Sequence
  Description of Artificial Sequence: Synthetic coding sequence
atgtggaaaaagctagctgaatggcctaagactatgaccgggttaccctctacctccgggaccacagcgtccgtggtcatcatccggggcatgaaaatgtacgtggcacacgttggggattcaggcgtggtgctggggattcaggacgaccctaaagacgacttcgtacgcgctgtagaggtcacccaagaccataaaccggaactcccgaaagagagggaacgaattgaagggttaggggggagtgtgatgaataaatcaggggtaaatcgggtagtgtggaagcgaccgaggcttacacacaacggtcccgtaaggcgctcaaccgtgatcgatcagatacctttcttagctgtcgcacgcgccttaggcgatctgtggagttatgacttcttttcaggcgaatttgtagtgtcccctgaaccggacacatccgtgcatacactggatccacagaagcataagtacattatcttaggctctgacggtctgtggaacatgattccaccccaggacgccatctctatgtgccaggatcaagaagaaaagaaatacctgatgggcgaacatggacagagttgtgccaagatgctggtgaatcgcgccctgggccgatggcggcaacgcatgctccgggccgacaacacctcggcaattgtcatctgcatctcgcccgaggttgataaccagggaaatttcacaaacgaagacgaactgtacctgaatctgactgattcaccctcttacaactctcaggagacctgtgtcatgactccctcaccctgctcaactcctcccgtcaaagactttggtttcgaactggacagtaggaagtag

SEQ ID NO: 16900 - DNA, 3432 bp, Artificial Sequence
  Description of Artificial Sequence: Synthetic coding sequence
atgtatttgtggctaaagctattagcattcggcttcgcttttttagatacagaggttttcgtcaccggccaaagtccaacaccgtccccaaccgatgcttacttaaatgcatccgagaccaccactctcagtcctagcgggtctgcagtgattagcacaactacgatagcaactaccccctcaaagccgacctgcgatgagaaatacgctaacattacagttgactatctgtataacaaagaaacgaaactttttaccgccaaacttaacgttaatgaaaacgtggaatgcggaaataacacttgtaccaacaacgaggttcacaacttgactgagtgcaagaacgcctctgttagtatatcacataacagctgcactgctcccgacaagacattgatcctcgacgtgccacccggggtcgagaagttccagctacatgactgtacccaggtggagaaggccgatacaaccatttgcctgaagtggaagaacattgagaccttcacctgcgatacccagaacattacttatcggttccagtgtgggaatatgatcttcgacaacaaagagataaaacttgagaacctggagcctgagcacgagtacaagtgtgactccgagatactctataataatcataaattcactaacgcttcgaagatcataaagacagatttcggcagccctggcgagccccagatcattttctgccgttctgaggcagctcatcaaggagtgatcacctggaatccccctcaacggtcattccataacttcacgctctgctacatcaaagagaccgagaaggattgtttaaacctggacaaaaacctgattaaatatgacctccagaatctgaagccctataccaaatatgtcctgagcctccacgcatatataatcgccaaggtccagcgcaatggcagtgccgctatgtgccactttaccactaagtctgctccgccatcccaggtgtggaacatgactgtctctatgaccagtgacaactctatgcacgtgaaatgcaggccaccgcgggaccggaacgggccccatgaacggtaccatctggaggtagaggccgggaacaccctagtgcgcaatgagtcccataagaactgcgattttcgagttaaagacctccagtattccacagattacacgtttaaggcctatttccacaatggagactaccctggagagccattcatactgcaccacagtacatcgtataactccaaggctttaatagcattcctggcatttctcattattgtcaccagcatcgcattgctggtagtcctctataagatttacgacctccacaaaaagagaagttgcaacctggacgaacaacaagagctggtcgagcgggacgacgaaaagcagctgatgaatgttgagcccattcacgccgacatcctcctggagacatacaagcggaagatcgccgatgagggccgcctctttttggcagaatttcagtccatcccacgcgtctttagtaaattccccatcaaggaggctcggaagcccttcaaccagaacaagaaccgatatgtggatatcctcccatacgattacaaccgtgttgagctgagtgagataaacggggacgccggcagtaattatatcaatgctagctatatcgacggcttcaaggaacctcgcaaatatattgcggctcagggccccagagacgagactgtggacgatttctggagaatgatttgggagcagaaagcaacggtcatagtgatggtgactagatgtgaagaaggcaatcggaataagtgcgccgagtactggccctccatggaggaggggactagagcatttggtgatgtggtcgtgaaaatcaaccagcataaaaggtgcccagactacatcattcagaagcttaacatagtcaataagaaagagaaggccacagggcgcgaggtaacccacatccaattcacatcttggcctgaccatggagtccctgaggacccacatctgctcctgaagttgagaagacgggtaaacgcattttctaatttcttttcagggcctatcgtagtccactgctccgctggagtcggacgtacaggaacatacataggcattgacgctatgctcgaaggtctggaagccgagaataaggttgatgtctatggctacgtggttaagctaagacgtcagcgctgcttgatggtccaggtggaagcacagtatatcctgatccatcaggctctcgtcgagtacaatcagtttggtgagacagaggtcaacctcagcgagctgcatccttatttgcacaatatgaagaagagagatccaccctcagaaccatctcctctggaagctgaattccagcggctgcctagctaccgaagttggcgcactcagcacatcggtaatcaggaggagaataaaagtaagaaccgcaattctaacgtaattccatatgactataaccgagttcctcttaaacatgagctggagatgtctaaggagagcgaacacgatagcgacgaatcaagtgacgacgacagcgactccgaggagccatctaaatatatcaacgcctcctttatcatgtcctactggaagcctgaagtcatgatcgccgctcagggccccttgaaagagaccataggcgacttttggcagatgatcttccaaaggaaggtcaaagtcatcgtaatgctaacagagctgaaacatggcgaccaggaaatctgcgcccagtactggggcgagggtaaacagacatatggcgacattgaagtggacctgaaggatactgataaatcatctacatacactttgcgggtctttgagctgagacactcgaaacggaaagactcgcgcaccgtgtatcagtaccagtatacaaactggagcgtcgaacaactgccagccgagccaaaagagctcatcagtatgattcaggttgtgaaacagaaattacctcagaagaactcatctgaggggaataagcaccataagagcaccccgctgctgatacactgtagggatggtagccaacaaactggcattttttgtgctctactgaatctcctcgagtctgcggagacggaggaagttgtggacatattccaggtagtaaaagccctgcgtaaggcacgtccaggaatggtttccacatttgaacagtatcagtttctttatgacgtcattgcatccacctacccagcccagaacggtcaagttaaaaaaaacaaccaccaggaagacaagattgaatttgacaatgaggtggataaggtgaaacaggacgccaattgcgtgaatcctctaggcgctcccgaaaagctgcctgaagcgaaggagcaggccgaaggcagcgagcccacttccggaacagaaggtcctgaacacagcgttaacgggcccgcttcccctgcgttgaaccaaggttcatag

SEQ ID NO: 16901 - DNA, 105 bp, Artificial Sequence
  Description of Artificial Sequence: Synthetic coding sequence
atgtacctgtggctgaagttgctcgcttttggtttcgccttcctggacaccgaagtgtttgtaacaggacaatcacctaccccgtcccccaccggtaaaaattag

SEQ ID NO: 16902 - DNA, 447 bp, Artificial Sequence
  Description of Artificial Sequence: Synthetic coding sequence
atggcacgcatgaacaggccagcccccgtggaggtgacctacaagaatatgaggtttctcatcacccataaccccaccaatgccacccttaataagttcatcgaggagctgaagaagtacggcgtaacaactatcgtgagggtgtgcgaggccacatacgatacaacgctcgttgaaaaagagggcatccacgtgctcgactggccctttgatgatggcgcacctccttccaatcagatcgtggatgattggctgagtcttgtcaaaattaagtttcgggaagaaccagggtgttgcattgcagtgcactgcgtcgctggactcggccgcaagcgtagaggagccttcaattcaaagcagctcctatatttagaaaagtacaggccgaagatgagacttcgctttaaagattctaacggacaccggaacaactgctgcatccagtag

SEQ ID NO: 16903 - DNA, 447 bp, Artificial Sequence
  Description of Artificial Sequence: Synthetic coding sequence
atggctcgcatgaaccggcctgccccggttgaggtgacctacaagaatatgaggttcctaattacgcataatccgactaatgccactctcaacaagttcattgaagagctgaaaaagtacggagtaaccactatcgtgcgtgtatgcgaggccacgtatgatacgacactcgtggaaaaggaaggaatacacgtgctagactggcccttcgatgatggggcaccccccagcaatcagatcgtggatgattggctttcactggtaaagatcaagttcagagaggaaccgggatgttgcattgccgtgcactgcgtggcaggcctgggccgcaagcggaggggcgcctttaattcaaagcaattactgtacctggaaaaatatcgcccaaaaatgagactacgctttaaagattccaacggccaccgaaataattgttgcattcagtag

SEQ ID NO: 16904 - DNA, 522 bp, Artificial Sequence
  Description of Artificial Sequence: Synthetic coding sequence
atggctcggatgaaccgccccgcgccagtggaagtcacttataagaatatgagattcctgataacccataacccaactaacgctactctcaacaaattcatcgaggaattgaagaaatacggagtgactactatcgtgcgcgtgtgcgaagctacatacgatactacgctggtggaaaaagagggcattcacgtcttagactggccatttgacgatggtgcgcctccgagtaaccagatcgtagatgactggctgagcttagtgaaaatcaagtttcgcgaggaacccgggtgctgtatcgcagtccattgcgtcgccggtctaggtagagctcccgtgttggtggcgcttgccctcatcgagggaggaatgaaatatgaagacgccgtccagttcatccggcagaagagaaggggggcgttcaactccaaacagctactttacttggagaagtacaggcccaagatgagactcaggttcaaggattcaaacggacacaggaataattgctgcatacaatag

SEQ ID NO: 16905 - DNA, 1308 bp, Artificial Sequence
  Description of Artificial Sequence: Synthetic coding sequence
atggaaatggaaaaggagtttgagcagatcgataaatccggttcctgggctgctatctatcaggatatcagacatgaggcctccgactttccatgcagggttgctaaactgcctaagaataaaaaccgaaacaggtaccgcgacgtgagccctttcgaccactcccggatcaaactgcaccaggaggacaatgattatattaacgccagcctcattaagatggaagaagcccagagatcatacatcctgacacaggggccattgcctaacacttgcggccatttttgggaaatggtgtgggaacagaaaagtcgaggcgtcgttatgctcaatcgcgtgatggaaaaagggagcctgaaatgcgcacagtattggcctcagaaggaggagaaggaaatgattttcgaggataccaacctgaagctgactctgatctccgaggatattaagagctattacacagtacgtcagttagagctcgagaatctgacaacgcaagagacgcgcgagatattacactttcattatacgacgtggcccgacttcggggtgccagaatcccccgcctcattcctcaatttcctgttcaaagttcgagagtccgggtccctctctccagaacatggaccagtggtggtacattgctcagctggcatcgggcgtagcggcacgttctgcctggcagacacctgcctcctgctgatggacaagagaaaggaccccagcagcgtggatataaagaaagtgcttctggaaatgcggaagtttaggatgggccttatacagactgcagaccagctgcgattttcttacctcgcggtgattgagggagccaaatttatcatgggggacagtagtgtgcaggaccagtggaaagagttaagccacgaggatctggaaccgcccccggaacatataccacccccccctcggccgccgaaacggattctggagcctcacaacggaaagtgtagggaattttttcccaatcatcagtgggtcaaggaggaaacccaagaggataaggattgcccaataaaggaagaaaagggtagtccactgaatgcggccccgtatgggatcgaaagcatgtcccaggacactgaagttagaagcagggttgtcggtgggagcctgcgcggggcgcaagcagcgtccccggccaagggtgaacccagcctgcccgagaaggacgaggatcacgcactatcttattggaagccttttctggtgaatatgtgtgtcgccaccgtgctaacagccggggcctatctgtgctaccgcttcctattcaatagcaatacatag

SEQ ID NO: 16906 - DNA, 1089 bp, Artificial Sequence
  Description of Artificial Sequence: Synthetic coding sequence
atggaggaggctcagcgttcctatatcctgacacaaggcccattgcccaatacttgtggacatttctgggaaatggtctgggaacagaagtctagaggagtcgtgatgctgaatcgcgtgatggaaaagggatccttaaaatgtgcccagtattggcctcaaaaagaggaaaaagagatgatttttgaagacacgaatttgaaactcactctcattagtgaagacattaagagctactacaccgtgagacaactagaattggaaaaccttaccacacaagagactcgagaaatcctacacttccattatacaacctggcctgacttcggcgtccctgaatctccagcttccttcctaaactttttgtttaaggtgcgagaatccggatccttgagtcccgaacatggcccggttgtagtacattgttctgcaggtattggccgctccggcacgttctgtctcgctgatacctgtctcctgttgatggataagagaaaagatcctagctctgtggatatcaagaaagtacttttggagatgagaaaattcaggatgggcctcattcagacagctgaccagctcaggttcagttatctcgcagtgatagaaggggctaaatttataatgggcgactccagtgtacaggatcagtggaaagaactgagtcacgaggacctggaaccaccgcctgagcacattcccccccccccacgtcctcccaagaggatcctggaaccccacaacggaaagtgtagagagtttttccctaatcaccagtgggttaaagaggaaacgcaggaagacaaggactgtccaataaaggaggagaagggatccccattgaacgccgcaccatatgggatcgagtcaatgtcacaagacaccgaggtgcgttctagagttgttggcggctccctcaggggagcacaggctgccagcccggctaagggggagccaagtctacctgagaaggatgaggatcacgcgctctcatactggaagcccttcttggtgaacatgtgcgtggctaccgtgctcaccgctggggcgtatctatgttacaggtttctgtttaatagcaacacctag

SEQ ID NO: 16907 - DNA, 1782 bp, Artificial Sequence
  Description of Artificial Sequence: Synthetic coding sequence
atgacctcacgacgatggtttcaccctaatatcacaggcgtggaggccgagaacttgttgctgaccagaggagtagatggttcctttctcgcccggccatccaagtctaaccctggggattttaccttatccgtgcgtcgcaatggtgctgtgacacacatcaaaatccagaatactggggattactatgacctgtacggcggcgaaaagtttgcgacattggctgagctggtacaatattacatggaacatcacggacagctgaaggaaaagaatggagatgtgattgagctcaagtatcccctaaattgcgcagatccgactagcgaaagatggttccacggccacctgtcaggtaaagaagctgaaaagcttttgaccgagaagggcaagcacggatcctttctggttcgggagagccagtcccatccaggcgacttcgtcctctccgtccgcactggcgacgacaaaggggagagcaacgatggcaagtctaaggttactcacgtgatgattagatgccaggagcttaagtacgatgtcggtggcggtgagcggttcgactctttaacagatcttgtggaacactacaaaaagaacccaatggtggaaacattaggcacagttctgcaattaaagcaacccctgaacacaacccggataaacgccgccgagatcgagagtcgggtccgggagctttctaaactcgcggagaccactgataaggtgaaacaggggttttgggaggaattcgagactctgcaacagcaggaatgtaaactcttatactcgcggaaggagggccagcgccaagagaataaaaataaaaatcggtataaaaacattctgccgtttgaccacacacgtgtcgtcctccatgacggagatcccaatgagcccgtgtcagattacattaacgccaacatcatcatgccagaattcgagactaagtgcaacaatagcaagcctaaaaaatcctatatcgccacccagggatgcctacagaacactgttaacgacttttggagaatggtgttccaggaaaactctagggtgattgtgatgaccactaaagaagtcgagagaggcaaaagcaaatgtgtgaaatattggcctgatgagtacgccctcaaagagtatggggtcatgcgggtacggaacgttaaggaatctgcagctcatgattatactctgcgggaattgaaattaagtaaggttggccagggtaataccgagcgtaccgtgtggcaataccattttcgaacatggcccgatcatggcgtgccgtcagatccgggaggggtcctggatttccttgaagaagtgcatcataagcaggagagcatcatggacgcaggtcccgtggtggtgcactgttcagcaggtatcggccgaacaggtacttttatagtgatcgatatcctgatagatatcatccgcgaaaagggagtagattgcgacatagatgtgcctaaaaccatccagatggtccgcagtcagcggtcaggaatggtacagaccgaagcacaatataggttcatctatatggctgtgcagcactacattgagacactgcagagaagaatcgaagaagaacaaaaaagcaaaaggaagggtcatgagtatacaaacatcaagtatagtctcgcggatcagactagtggtgatcaaagcccactccctccctgtacgccgaccccaccttgcgccgagatgcgcgaggatagcgcacgcgtctacgagaatgtaggcctcatgcagcaacagaaatcttttcgctag

SEQ ID NO: 16908 - DNA, 651 bp, Artificial Sequence
  Description of Artificial Sequence: Synthetic coding sequence
atgaccagtaggcgctggttccacccaaacatcaccggggtagaagccgagaatttactgctcactcggggagtggacgggtctttcctggcaagaccgagcaaatccaatcccggtgacttcaccctgagcgtcaggcgcaatggcgctgtcactcacatcaagattcaaaacacaggggactactacgatttgtacggaggcgagaagttcgctaccctggccgagcttgtgcagtactatatggagcaccatggacaactcaaggagaagaatggcgatgtaatcgaactaaagtaccccctgaactgcgccgaccccaccagcgaaagatggttccacgggcacctaagtggtaaggaagccgagaaactccttacagagaaagggaagcacgggtcattcctggtgagggaatctcagagccatcctggcgacttcgttctgtcagtgaggacgggagatgataagggcgagtcaaatgacgggaaatcaaaggttacccatgttatgatcaggtgccaagaacttaagtacgacgtgggcggcggggaacgatttgattcccttaccgacctcgtggagcattacaaaaaaaatcctatggtggagaccctcgggactgttctgcagctaaagcagcccctttag

SEQ ID NO: 16909 - DNA, 1383 bp, Artificial Sequence
  Description of Artificial Sequence: Synthetic coding sequence
atgacgtctcgtagatggttccatccgaacattaccggcgttgaggccgaaaacctgctcctgacacgcggagtggatggctccttcttggcaaggcccagtaagagtaatcccggggacttcacactatctgtccgcagaaacggagccgtcacgcacattaagattcagaacacaggcgactactacgacctgtacggtggtgagaagttcgccactctggctgagctcgttcagtattatatggagcaccatggacagcttaaagaaaaaaacggggatgtgattgagctgaaatatcctcttaattgcgcagaccctacatcggagcggtggttccacgggcatctgtcgggaaaagaagccgagaaattgctgactgagaagggaaagcatggaagctttctcgtgcgcgaatcccagtcccatccaggggactttgtgctgtccgtgcgtacaggcgacgacaaaggtgagagcaacgacggcaaatcgaaggtcacccatgtgatgatcaggtgccaggagctgaaatatgatgtgggtggcggagagcgttttgactccttaacggacctggtggagcattacaaaaagaatcccatggtcgagacactcggtactgtcttacaacttaagcagcccctgaataccacacgaattaatgccgccgagatagaatctcgagtgcgggaactgtctaagctggccgaaacaactgacaaagtgaagcagggtttctgggaggaatttgagactctccagcaacaagagtgtaaattgctttactctcgcaaagaggggcagagacaggaaaataagaataagaatagatacaaaaatatattgccattcgatcacacaagggtcgtgctgcatgacggagatcccaacgagcctgtttctgattatataaacgccaacataataatgcctgaatttgaaacaaagtgtaataacagtaaacctaagaaatcctatatagccacgcagggatgtctgcagaatacagtaaacgacttctggcggatggttttccaagaaaacagccgcgttattgtgatgactactaaagaagttgagcgcgggaaatccaagtgtgtgaaatattggccggacgagtacgccctgaaggaatacggagtgatgagggttagaaatgtaaaggagtccgcggcgcacgactacacacttcgtgaactcaagcttagtaaagtgggacaggggaatactgaacgtacagtctggcagtatcacttccggacgtggcccgaccacggcgtgccttcagaccctggcggcgttctggacttcctggaggaagtccaccacaaacaggagtccatcatggacgcaggcccagtggtggtccattgcaggtag

SEQ ID NO: 16910 - DNA, 723 bp, Artificial Sequence
  Description of Artificial Sequence: Synthetic coding sequence
atgtacctctggctgaaactgctggccttcgggttcgcctttctggatactgaagtgttcgtcaccgggcaatcacccacgccaagcccgacaggccacctccaggccgaggagcagggaagtcagtcaaagtcacccaatctcaagagtagggaggccgactcatccgctttctcttggtggcccaaggctcgcgagcccctgaccaaccactggcgcttaacaaccgccaaaatgccaagcgtaccgctgagctccgatcctttaccaactcacacgactgccttctcccctgcctcaacgtttgagcgcgaaaacgatttctctgaaacaactacgagcctgtcgcccgataatactagcacacaggtttcgcccgattctctggataatgcgtccgcattcaataccactggagtatcgtcagtgcagactccccacttacccacccatgctgacagtcagactccaagcgccggcacagacacccagaccttctcaggatccgccgcaaacgccaagctgaacccaacgcccggaagcaacgcaatttctgatgtgccgggcgaacgctccactgcctccacatttcctactgatcctgtctctcccttgactacgacgctgtctctagcacaccattctagcgcggcattacccgcccgcacctcaaatactactatcactgctaatacttccgatgcttacctgaacgcttcttag

SEQ ID NO: 16911 - DNA, 3432 bp, Artificial Sequence
  Description of Artificial Sequence: Synthetic coding sequence
atgtacctctggctgaagcttttagcctttgggtttgccttcttagatacggaggtcttcgttaccggtcagagcccgacccccagtccaacagacgcttacttaaacgcctccgagacaactaccctgtctccgtctggaagtgctgtgatatctacaaccaccatcgccaccactccatccaagccaacatgcgatgagaaatacgcaaacataaccgtggactacctctataacaaggagaccaagttgttcacagcaaagctgaacgtcaatgagaacgtagagtgcggcaataacacatgcactaataatgaagtacacaatctcaccgagtgcaaaaatgcttccgtatccatctctcataatagctgcaccgcacccgataaaactcttattctcgacgtgccccccggcgtcgagaaatttcagttgcatgactgtacacaggtggagaaggctgacacaactatctgcttgaagtggaagaatatcgagacattcacgtgtgatactcagaacattacgtacagatttcagtgtggtaacatgatttttgataacaaagaaattaagctggaaaacctggagccggaacatgagtacaagtgtgattccgagatcctatacaataatcataagtttacgaacgccagcaagattattaaaaccgactttggctctcctggggagccgcagatcatattttgccgcagcgaggctgcccaccagggcgtcatcacttggaacccacctcagagaagcttccacaacttcacactgtgctatattaaggaaacagagaaagactgcctgaacctggataaaaatttaataaaatatgaccttcagaatttgaagccttataccaagtatgtgctgagtttgcatgcctacatcatagcaaaggtgcagaggaacggttcagccgctatgtgtcactttactaccaaaagcgcccccccttcacaggtctggaacatgactgtctcaatgaccagcgataactcaatgcacgtcaaatgcaggccaccaagagacagaaatggaccgcatgagagataccacttggaggtggaagctgggaacaccctggttaggaacgagagccacaaaaattgcgactttcgtgtcaaagacttacagtatagtactgactatacatttaaggcctatttccacaatggcgactacccgggcgaaccgttcatccttcatcattcaacaagctacaatagcaaagccttgatcgccttcctagcctttctaattatagtaaccagtatcgccttactggtggtcctgtataagatttatgacctccacaaaaaaagatcttgcaatctggacgagcaacaagagctggtcgagagagatgacgagaaacagctgatgaacgtcgagcccatccacgcagatattttgctggagacatacaagaggaaaattgccgacgagggcaggctctttctggctgaattccaatcaattccgagggtgttcagcaagtttcccatcaaggaggcacgcaagccttttaatcaaaacaaaaaccggtacgtagacattctgccttacgactacaaccgtgtggagctgagtgaaatcaacggtgacgcaggttccaattatatcaatgcaagttacatcgacgggttcaaagaaccaagaaagtacatcgccgcccagggtccgcgcgacgagacggtggacgacttctggaggatgatctgggagcagaaggccacagtgattgtgatggtgacccgatgtgaggaaggcaataggaataaatgtgcagagtactggcccagtatggaggaaggcacgcgtgctttcggcgacgtcgtagtcaagataaaccagcacaagcgctgccccgattacatcatccagaagcttaacatcgtaaataaaaaagagaaggctactggcagagaggtgacacatattcaatttactagctggcctgatcacggcgttccggaggaccctcacctcttactgaagctcagacgaagagtcaatgcattctctaatttcttctcaggcccaatcgtcgtgcactgtagtgccggtgtaggccggactggcacgtacatcggtatcgacgctatgttagaggggttggaggctgagaataaggtcgacgtgtatggatacgttgtgaaattgcgccggcagcggtgcctgatggtgcaggttgaagctcagtacatccttatccatcaggccctcgtggaatataaccaatttggcgagacagaggtcaatctgagtgagctgcatccttacctccacaacatgaagaagcgggatcctccctctgagcctagccctctagaggccgaatttcagaggttaccttcctatcggtcatggcgtacacagcacattggcaatcaagaggagaataagtcgaagaatcgaaacagcaacgttattccatatgactacaaccgggtgcctctgaagcatgaattagaaatgagcaaggagagcgagcatgacagtgatgaatcaagcgatgacgattcagactccgaagaaccttcaaaatacatcaatgccagctttatcatgtcgtactggaaacctgaggtgatgatcgcagcacagggccctcttaaagagactattggggatttttggcaaatgatattccaacggaaggttaaggtcattgttatgttgaccgagctgaagcatggagaccaagaaatttgcgcccagtactggggagagggaaagcagacctatggcgatattgaggtggatctgaaagacacggacaaatcgagcacctataccttgcgcgttttcgagctgcggcatagtaagcggaaggactctcgcactgtctaccaatatcagtatacaaattggagtgtggagcaactgccagcagagcccaaggagttgatatccatgatacaggtggtgaaacagaagttgcctcagaaaaacagcagtgaggggaataagcatcataaatcaacgccccttctgatccattgtagggacgggtctcaacaaaccggcatcttctgcgctctgctcaatctgttagagtcagcggaaacagaagaagtcgtggatatatttcaggtggtgaaagccctgcgcaaagctcggcccggaatggtgtccacattcgaacagtatcagtttctctacgacgtgattgcctcgacctaccccgcacagaacggtcaagtgaaaaagaacaatcatcaggaagacaagattgaattcgataatgaggtggataaggttaagcaggatgctaactgtgttaacccattgggggcccctgaaaagctgccagaggccaaagagcaggctgagggctccgagcccacatccggaaccgaggggcccgaacacagcgtgaatgggcccgccagtcctgctctgaaccagggaagctag

SEQ ID NO: 16912 - DNA, 3771 bp, Artificial Sequence
  Description of Artificial Sequence: Synthetic coding sequence
atgtatttgtggcttaaactgctggcattcggattcgcgttcttggacacagaggtctttgtaactggtcagtcgccgaccccatctcctacaggcctgactactgcgaagatgccatctgtgccattgtcctctgaccccctgcctactcacactactgccttttcgcctgcttccaccttcgagcgggagaatgacttcagcgagaccaccacatccttatcacccgacaacacgagcacccaggtgtcacccgattccttggataatgccagcgcctttaatacgaccggagtgtcctccgttcagaccccccatctgccaacgcatgccgattcccagacgccctcggccggtactgacacccaaacattctctgggtcggctgccaatgccaaattaaatccaaccccgggctcaaacgccatcagcgacgcttatctgaatgcctctgagactaccacactgtctcctagtgggtcggctgtcatctccacgactactattgctaccacacccagcaaaccaacctgcgacgaaaaatatgctaacattaccgtggactacctgtacaataaggaaactaagctgtttacagccaaactgaacgtcaacgaaaacgtggaatgcggcaacaatacttgcaccaataatgaagttcataacttaacggagtgtaagaacgcctctgtaagtattagccataacagctgcaccgcgccagacaaaacactgatcctggatgtgcctcctggtgtcgagaagtttcaactgcacgactgcacacaggtggagaaggcagacaccaccatttgccttaaatggaaaaatattgaaaccttcacctgcgacacccagaacataacatataggttccagtgcgggaacatgatcttcgacaacaaggagataaaactcgaaaatcttgagcccgagcatgagtacaagtgcgacagcgagatcctttacaataatcacaagttcacaaatgcttctaagattataaagactgactttggatcgcctggagaacctcaaatcatattttgtcgcagtgaggccgcccaccagggggtgatcacctggaacccccctcagagatccttccacaatttcacactatgctacataaaggaaaccgagaaggattgtctgaacttggataagaacctgattaagtacgacttacagaatcttaagccgtataccaagtacgtcttgtctctccacgcatatattatcgccaaagtgcagcggaatgggtccgccgccatgtgtcacttcaccactaagagtgcccctccctcacaggtgtggaacatgactgtatctatgacgtccgataattctatgcacgtcaaatgccgcccaccgcgcgacagaaacggtccccatgaacgataccatcttgaggtggaggcgggcaataccctggtcaggaacgagagccacaagaattgcgacttcagggtgaaagacctgcagtatagtacagactacacatttaaagcgtattttcataacggtgattatcccggggagcctttcattctccaccactccacaagctacaattccaaagccctgatcgcgttcctggcatttctcataatcgtgacaagcattgctcttctggtagtgctttataagatttacgatcttcacaagaagcggtcttgcaacctggatgagcagcaagagttagtcgaacgtgacgatgagaaacagctcatgaatgtggagcctattcacgccgacatcttgctggaaacttacaagcggaaaatcgccgatgagggtagactgttccttgctgaatttcagagtattccgagagtcttctcaaagttcccaattaaggaggcaagaaagcctttcaatcagaataaaaaccggtacgtggacatcttaccatacgactataacagggtagagctgtctgagatcaatggagacgccgggtccaactacattaacgcatcctacattgacggctttaaagaaccgcgcaagtatatcgccgcacagggcccgagagacgaaactgtcgacgatttttggagaatgatttgggagcagaaggcaaccgtgattgttatggtcactcggtgtgaggaagggaataggaataaatgcgcagagtactggccttctatggaggaaggtacacgggctttcggtgatgttgtcgtgaagattaatcagcacaagcggtgtcccgactacatcattcaaaaactgaatatagtgaataagaaagagaaggccacgggtagggaagttacgcacatccagttcaccagctggcctgaccatggcgtcccggaggatcctcatctgttgcttaagcttaggaggagggtgaatgccttttccaactttttcagtgggccaattgtcgttcactgtagtgctggagtgggccggaccggaacgtatataggcattgacgcaatgctcgagggattagaggcagaaaacaaggtggatgtgtatggctacgtggtgaagttacggagacaacggtgtctaatggtgcaggtggaagcgcagtacattctcattcatcaggcgctcgtggagtacaatcaatttggggaaactgaagtcaacctctctgagctgcacccctatttacacaacatgaagaagagagatccccctagcgaaccgtcccctctggaagcagagttccagaggttgccctcttatcgctcctggcggacacagcacatcgggaatcaagaggagaataagtctaaaaaccgcaacagcaatgtcattccttatgactataatcgagtacctctgaagcacgaacttgagatgtccaaggagagtgagcatgactccgacgaatctagtgatgacgactctgacagcgaggagccctccaaatatataaacgcatcctttatcatgtcttactggaaacccgaggtgatgattgctgcccaggggccactcaaagagaccattggcgatttttggcagatgatctttcagcgaaaagtgaaggtgatagttatgctgactgagcttaagcacggcgatcaggagatctgtgcccagtactggggtgaaggaaagcagacatatggtgatatagaagtggacctgaaggatacagacaagtcatccacctatactttgagggtgttcgagctgcgtcatagtaagagaaaggacagccgtaccgtgtaccagtaccagtataccaactggtctgtagagcagctccccgccgagcctaaggagctcatatccatgatacaggtcgtgaaacagaagctgcctcaaaaaaactcttccgagggaaataaacaccataaaagcacaccacttcttatccactgtagagacgggtctcagcagacaggcatcttctgtgctctgctgaacttactggaatcagctgagacggaggaagtcgttgacatctttcaggttgtgaaggcgctgcggaaggctaggccgggaatggtgtcaacgtttgaacaatatcagttcttatatgacgttatcgccagtacctatccagcgcagaatggccaagtcaagaaaaacaatcatcaggaagacaagatagaatttgataatgaggtggataaagtgaaacaagatgccaactgcgttaacccgctgggagctccagagaagctgccggaagccaaggagcaggcagagggtagcgagcctacatctggtactgaagggcccgagcactctgtgaatggacccgcctcaccagcactgaaccaaggatcctag

SEQ ID NO: 16913 - DNA, 2208 bp, Artificial Sequence
  Description of Artificial Sequence: Synthetic coding sequence
atgaccatgtatctgtggcttaaactgctcgcctttggtttcgcattcctggatacggaagtctttgtgaccggacagagtcctacccctagtcccactggagtctcgtccgtgcagacaccgcaccttcctacccacgctgattctcaaacaccctccgcgggtaccgacactcagaccttttcaggctccgctgcaaatgccaaactgaacccgaccccagggtcgaatgctatctccgatgtcccgggagagcgttctactgcctcgacatttcctacagaccctgtctcccctttgacaactaccttgtcactggctcatcactcttctgcagcccttcctgccagaacgagcaatacgacaattaccgcgaacacctctgatgcatatttgaacgcgagtgaaactactactctctccccttccggttctgccgtgatttcgacaactactattgcaaccactccatctaagccaacatgcgatgagaaatatgccaacataacagtggactacctttacaataaagagactaaactgttcacagccaaactcaatgtgaatgagaatgttgagtgcggaaacaatacgtgcactaataatgaagtgcacaatctgaccgaatgtaaaaatgcttccgtgtctattagccataactcctgtactgcaccagacaagaccctaatccttgatgtaccaccaggagtcgagaagtttcagctgcacgactgtactcaagtcgagaaagccgatactactatctgtcttaaatggaagaacattgagacttttacctgcgatacccagaatatcacatatagatttcagtgcggaaacatgatcttcgacaataaggagatcaaactagaaaacttggaacccgagcacgagtacaagtgcgactctgagattctgtacaacaatcacaagttcacgaatgcctcgaaaatcatcaagaccgacttcgggtcccccggcgagcctcagatcatcttctgccgatcagaggctgcacatcaaggtgtgatcacctggaatcctcctcaacggtcctttcacaacttcactttatgttacatcaaagagacggaaaaggactgtctgaaccttgataaaaacctgatcaagtacgatctgcagaacctgaagccatatactaagtacgtgctatccctgcacgcgtacatcatcgccaaggtacaacggaacgggtcggcagcgatgtgccattttaccacaaagtccgcacctccttcccaggtatggaacatgacagttagtatgacttcggataatagtatgcacgtcaagtgtaggcccccaagggatcgcaatgggccgcatgagaggtaccacttggaggtggaagctggaaacaccctcgtacgcaacgagagtcacaagaactgcgactttagagttaaggacctgcagtactcaacagactacacatttaaggcatactttcataacggcgactacccaggagagccattcatcctccatcacagtaccagttataatagtaaggctttaattgcattccttgccttccttatcatcgtgacctctatcgcacttcttgtcgtcctttacaaaatctacgacctccacaaaaagcgctcctgcaatctcgacgagcagcaggaactggtcgagagagacgatgaaaagcaactgatgaacgtggagcccatccacgcagatatcctgctagaaacgtacaaacgaaaaattgccgacgaaggccgtctcttcctggccgagttccagtctattccccgcgttttctctaagtttcccatcaaggaggccaggaagccatttaaccaaaacaaaaaccggtatgttgacattctaccctacgactataatagggtcgagctttccgagataaatggggacgccggcagcaactatattaatgctagctacatcgacgggtttaaagaaccccgcaagtatatcgccgcccaaggacccagggacgagaccgtggatgatttctggcggatgatctgggagcagaaagccactgttatcgtaatggtgactagatgtgaagaaggcaatcggaataaatgtgcagaatattggccatcaatggaggaggggaccagagcctttggcgacgtggtcgtgaagattaatcagcacaaacgctgtccagactatattattcaaaaactcaacattgtgaattag

SEQ ID NO: 16914 - DNA, 2202 bp, Artificial Sequence
  Description of Artificial Sequence: Synthetic coding sequence
atgtatctgtggctcaagctcctcgcctttggtttcgcctttctggatacagaggtgtttgtgaccggccagtccccaaccccgtcacccacaggagtttcatctgttcagactccccatctcccgactcatgctgactcccaaaccccttccgccggcacagacacacagaccttttccggaagcgctgccaatgctaagctcaatcccactccgggaagtaatgccatttcggacgttccaggtgaacggtctacagcatctacattcccgacagaccctgtttcccctctgactactacgctctcccttgctcatcattctagcgcggcccttccggctagaaccagcaatactacgatcacagcgaacacctccgatgcttacttaaacgctagtgaaacgacaactctgtccccaagcggctctgccgttatttctacaactaccattgccactacaccttctaaaccgacctgcgatgagaagtatgcgaacatcaccgttgactacctctataacaaggaaaccaaactcttcactgcaaagctcaacgtgaatgaaaacgtcgagtgcgggaacaacacctgtactaataacgaagtgcacaacctgactgagtgtaaaaacgcttccgtttctatttctcacaatagttgcaccgccccagacaaaacgctgatattggacgtgccccctggtgttgagaagtttcagttacatgactgtactcaagtggaaaaagccgataccaccatctgcctgaagtggaagaatatagaaaccttcacctgcgatactcagaatattacttacagatttcagtgtgggaatatgatcttcgacaataaggagatcaaactggaaaatctcgagcccgaacacgaatataagtgcgacagtgaaatcctgtacaacaaccacaagttcactaacgcttcaaagattattaaaaccgattttggaagtccaggggaaccgcagatcatcttttgtcggtccgaggccgctcatcaaggggtcataacatggaatcctccacagcggtccttccacaatttcacgttatgctatatcaaggaaactgagaaggattgtctgaatttggataaaaacctgatcaaatatgatctacagaacctgaagccttataccaagtacgttcttagcctgcacgcctatatcattgcaaaggtgcagcggaatggtagcgcagcaatgtgccattttaccactaagtcggcgcctccctcccaagtgtggaatatgaccgtgtccatgacctctgacaatagcatgcacgtgaagtgtaggcctccacgcgacaggaacggcccccatgagcgttatcatctagaggtggaagccgggaacacactggtccgcaacgagagccataaaaattgcgacttcagggtcaaagacttgcaatattcaaccgattatacattcaaggcatacttccacaatggcgattacccaggcgagccctttatcctgcatcacagcacttcttataattcaaaggcattgattgcttttctcgcattcctgatcatagtgacaagcatcgctttacttgtcgttctgtataaaatctacgatctgcataaaaaacggtcatgtaaccttgacgagcagcaagagctcgtcgagagggacgacgaaaaacaattaatgaatgtggagcccatccatgcagacatattgctggaaacctataagcgaaaaatcgcagacgagggacgcttatttttggctgagtttcagagtatccccagagtctttagcaaattccctatcaaggaagccaggaagccattcaatcagaataagaatcgctacgtggacattctgccctacgattacaaccgagtggaacttagtgagatcaacggcgatgccgggtctaattacatcaatgcctcctatattgatggctttaaggaacctcggaagtacatagccgcccagggccctcgggacgagacagttgatgatttttggaggatgatctgggagcagaaagctacagtcatcgtcatggtgacaaggtgtgaagagggcaacagaaacaaatgcgccgaatattggcccagtatggaagagggcactagggcatttggagacgtggtcgttaaaatcaatcagcataagaggtgccctgactatatcatccagaagctcaacatcgtaaattag

SEQ ID NO: 16915 - DNA, 3921 bp, Artificial Sequence
  Description of Artificial Sequence: Synthetic coding sequence
atgactatgtacctatggttgaaattactggcctttggatttgctttcctcgacacagaggtgttcgtgaccgggcagagtcccacaccaagccctacaggactaacaactgcaaagatgcccagtgtgccccttagcagtgaccctctgcccacgcacaccacagcattctccccagccagtaccttcgaaagggaaaacgatttttcagagaccaccaccagccttagccccgataatacatccacccaagtaagcccagattctctagataacgcgtcagcctttaacaccacaggcgtctccagtgttcagaccccccacttgcctactcacgcagactcgcaaacaccatctgcaggaactgacactcagacttttagtggatccgccgccaacgccaaattgaatcccactcctggaagcaatgctataagcgacgtgcccggcgagcggtcgacggcgagcacctttcctacagacccggtatcccctctcactaccacactcagtttagctcaccattccagtgccgcgctgcctgcaaggacgtctaatactacaattaccgccaatacatcagacgcctacttgaacgcatcagagaccactacactgtctccatccggctccgcggttatatccacaaccactatcgccacgacgcccagcaagcctacctgcgatgagaaatacgctaacataactgtggactatctttacaacaaggagaccaagctctttaccgctaaactgaacgtcaacgagaatgttgaatgtgggaacaacacttgtaccaacaacgaggtacataatttgaccgaatgtaaaaatgccagcgtttccatctctcataatagctgtacagcgccggataagactttaatcctggatgtgccgcctggggtggagaagttccagctccacgactgtacccaggtagagaaagccgacaccacgatttgcctaaaatggaagaacatcgaaacttttacttgcgatacacaaaatataacataccgctttcagtgcggcaacatgatctttgacaacaaggagataaagctcgaaaatctggagccagagcacgagtacaagtgcgactccgagatcctgtacaacaaccacaagtttaccaacgcctctaagattatcaagactgattttggatctcccggagaaccccagatcatcttctgcaggtccgaagcggctcatcagggagtcattacctggaacccccctcagagatcgttccacaattttacactgtgctatattaaggagaccgagaaagattgtctgaacttggacaaaaacctgattaaatacgatctgcagaatttgaagccgtataccaagtacgtgcttagtctgcatgcctatatcatcgcaaaggtccagcgtaacgggtccgcagctatgtgccacttcacaacaaagagcgcccctccaagtcaggtctggaatatgaccgtaagtatgacgagcgacaactctatgcacgtcaagtgccgacccccccgagacaggaatggtccccatgaaaggtatcatttggaggtggaagctgggaacactctggtccggaacgagagccataagaactgcgacttcagggtcaaggacttacaatattcgaccgattacacatttaaagcatactttcataatggagactatccaggtgagccctttatcttgcaccattcaacgagttacaactcgaaggctctgatcgccttcctggcatttctcatcatcgtaacatcaatcgccttgctggtggtgttgtacaaaatctacgatctccacaagaagaggtcttgcaatcttgacgaacagcaggaactcgtggagcgcgacgacgagaaacagctgatgaatgttgaacccatccacgctgatattctgctggagacctacaagcgcaaaatagccgatgaaggccgtttatttctggctgagttccagtccatcccaagggtgttctctaagttccccataaaggaggcccgcaagcccttcaaccagaataaaaaccggtatgttgacattctgccctatgattataacagggttgagttatccgagatcaatggagacgcgggctctaactatattaacgccagttatatcgacggctttaaagagcctcgaaaatacattgctgcgcagggaccccgggacgaaacagttgacgatttctggcgtatgatctgggagcagaaggccaccgtcatagtgatggttacaaggtgtgaagagggcaaccgaaataaatgcgcagagtattggcccagcatggaggagggtacaagggccttcggagacgtcgtcgttaagattaatcagcacaagaggtgccccgattatatcatccaaaaactgaacattgtgaacaagaaagaaaaagccactggacgagaggtgactcacatccaatttacctcgtggccggatcatggggtccctgaggatccccacttgctcttaaagttgcgaaggcgggttaacgctttcagcaactttttttctgggccaatcgtggtccattgctcagcaggtgttgggagaaccggcacctacatcgggattgatgccatgctcgaaggattagaggccgaaaacaaggtcgacgtgtacggttacgtggttaaattgaggcggcagaggtgtcttatggtgcaggtggaagcccagtatatcctcattcaccaagctctggtggaatacaaccaatttggagaaaccgaggtgaacctaagcgagctgcacccctacctgcacaacatgaagaagagagatcccccatccgagccctccccactggaggccgaattccagcgcctaccttcttaccggtcatggagaacacaacatatcgggaaccaggaggaaaacaagtccaaaaatagaaactctaacgtgatcccatatgattacaatagagtgcctttgaagcacgagctggagatgagcaaggaatcagagcacgactctgacgaaagtagtgacgacgattccgactctgaggaaccctccaagtacattaacgcgagttttattatgagttattggaaacccgaagtcatgatcgcggcccagggcccactgaaagagaccatcggcgatttctggcaaatgatctttcaaagaaaggtaaaagttatcgttatgctcaccgaactaaagcacggtgaccaggagatttgtgctcagtattggggtgaggggaaacaaacctatggtgacattgaagtagacttgaaagataccgataaaagctctacctatacgttgcgcgtgtttgagttgagacactctaaaagaaaagactcaagaaccgtttaccagtatcagtacactaattggtccgtggagcagctacccgccgagccgaaggaactcatctctatgatccaggtggtcaagcaaaagttaccccagaaaaattcctctgaaggcaacaaacatcacaagtctacccccctgttgatacactgcagagatggatctcaacagactggcattttctgtgccctccttaacctgctcgaatcagccgaaacggaggaagtggtcgacatattccaagtggttaaggcacttaggaaagcaagaccaggcatggtgagcacttttgagcagtaccagttcctgtacgatgtgattgctagcacttaccctgctcagaatggccaggttaagaagaacaaccaccaggaggataagatagagttcgacaatgaggtagataaagtgaagcaagatgcaaactgtgttaatcccttgggcgctccagagaagctgcccgaggccaaggagcaagcagaggggagcgagcctacctccggaacagaaggccccgagcacagtgtcaatggacccgcctctcccgcgctgaatcagggctcttag

SEQ ID NO: 16916 - DNA, 441 bp, Artificial Sequence
  Description of Artificial Sequence: Synthetic coding sequence
atgtacttatggcttaaattgcttgccttcggattcgcctttctagataccgaagtgttcgtaacagggcagtcgcctactccttctccgactgacgcttacttgaatgcttcagagactactacattgagtccctctggcagcgctgtcatcagcacgacaacaatcgcgacaacaccaagcaagcctacttgcgatgaaaagtacgccaatatcaccgtggactacttatacaacaaggaaacgaagctcttcactgcgaagctgaacgtgaacgaaaacgtggagtgtggaaacaatacctgcacgaacaatgaggtccacaatctgactgagtgcaagaacgctagtgtttcgatttcgcataatagctgtacagcacccgataagaccctcatcctggacgtgccacccggagtcgagaagttccaactgcattag

SEQ ID NO: 16917 - DNA, 351 bp, Artificial Sequence
  Description of Artificial Sequence: Synthetic coding sequence
atgtatctgtggctgaagctccttgctttcggtttcgctttccttgacactgaagtctttgtgacaggtcagtctcccacccctagtccaacaggccttacgaccgcaaagatgccttcggtccctctctctagcgatcccctgcctacccacactaccgctttctctccagctagcaccttcgagcgcgagaatgatttctctgagactaccacaagcctctcgccagacaatacttctacacaggtatcccctgactctctcgataatgccagtgcattcaatacgaccggagtgagctctgtacagactcctcaccttcctacccacgctgattctcagaccccttag

SEQ ID NO: 16918 - DNA, 3915 bp, Artificial Sequence
  Description of Artificial Sequence: Synthetic coding sequence
atgtacctgtggctgaagctactcgcttttggtttcgcctttttggacaccgaggtcttcgtgacgggccagagtccaacgccgtcccctaccggtctgaccaccgctaagatgccatcagttccactatcctcagatcctttgcctactcacactacagcattctcccctgccagcacctttgagcgagaaaacgatttcagcgaaactacgacatccctctcccctgacaacactagtactcaggtcagtccagattccctcgacaacgcgtccgcttttaacacaactggtgtaagctcggtacagaccccacaccttcctacacacgctgactcacagactccgtcagctgggacagatacccaaaccttctcaggctcagccgccaacgcaaagcttaatccgacacctgggtccaatgccatctctgacgttccaggcgagagatctaccgcctctaccttcccaacggaccctgtatccccgctcacgactacactttcacttgcccatcactcaagtgcagccctgcctgctcgaacttctaacaccactataacagcaaatacatcagacgcgtacctgaacgcctcagagaccacgactcttagcccgtctggcagcgctgtgatctcaacgacaactatagccaccactccgagtaaacccacctgcgacgagaagtacgctaacattacagtagactatctgtacaacaaagagacaaaactcttcactgccaagctgaacgtcaatgagaatgtggagtgcgggaacaatacatgcaccaataacgaggttcataatctcactgagtgcaagaacgcctctgtgtcgatttcccacaactcatgtacagctccggacaagacactcattctagatgtcccaccaggagtggagaaattccagttgcatgactgtacccaggtggaaaaggctgatactaccatctgtttaaagtggaaaaatattgaaaccttcacttgcgatacacagaatatcacttatcggttccaatgtggcaacatgatctttgacaacaaggagatcaagttggagaatctggagcctgagcacgagtataaatgtgactccgagatactgtataataatcacaagtttaccaacgccagcaagattatcaaaactgattttggatcgccaggggaaccacagattattttttgtcgttccgaggccgcacaccaaggcgtgatcacgtggaacccgcctcagcgtagctttcataattttactctctgctacatcaaagagaccgagaaggactgtctgaacttggacaaaaatctgattaaatacgatctacagaacctcaagccttacactaagtacgtgctgtctctgcatgcatatataattgctaaggttcagcgaaacgggagcgccgctatgtgccatttcaccaccaaaagcgccccgccaagtcaggtttggaatatgacagtgtccatgaccagcgataacagcatgcatgtaaagtgccgcccaccaagagaccgcaacggcccgcatgaacggtatcacttagaggtagaagcggggaataccctggtcaggaacgagagtcataagaactgcgattttcgggtgaaggatctccagtacagtacagactacaccttcaaggcctatttccataacggagactatcctggcgaaccttttattcttcaccacagtacatcttacaatagtaaagcgctgattgcctttttagccttcctgataatcgttactagcatcgcactcctggtggtgctgtataagatctatgatcttcataaaaaacgcagctgcaatctcgatgaacagcaggaactggtggagagggatgacgaaaagcagctgatgaatgtggagcctattcacgctgatatcttgttggaaacctacaagcgaaaaatagccgacgagggtaggctattcctggccgaatttcagagcatcccacgcgtatttagcaagttccctatcaaagaggctagaaagccctttaaccagaacaagaaccgttacgtcgatatcttaccttatgactataacagagtggagctgagtgaaattaatggcgacgccggttcgaactacatcaatgcctcctacatcgatggatttaaggagccgagaaaatacatcgcagctcagggcccccgcgatgaaacagtggacgatttttggcgcatgatttgggagcagaaagccaccgtcattgtcatggtcacccgttgcgaggagggcaaccggaacaagtgcgcagagtattggccctccatggaggaagggacccgagcattcggcgatgtggtggtgaaaataaatcagcacaagcggtgccccgactacattattcagaagctaaacatcgtcaacaaaaaagagaaggccacagggcgggaggtgactcacatccagtttacaagctggcctgaccatggggtacctgaggatccccatctgcttctgaaactacggcggcgcgtgaacgctttctcaaactttttttctggacccattgttgttcactgcagtgccggtgtcggaaggaccggaacctacatcggcatcgacgccatgctcgaggggctcgaggctgaaaataaggtggacgtgtacggatacgttgttaaactgaggcggcagagatgccttatggtccaggtagaagcacagtatattcttatacatcaggcgctcgtggagtataaccagtttggagaaacggaggtgaatttgtccgagctccacccgtacttgcacaatatgaaaaagagggacccgcccagcgaacccagtccgctagaagccgaatttcagcggctccccagctatcggtcttggagaacccaacacatcggcaatcaagaagagaataaatcaaaaaacaggaactcaaatgtcattccctatgattataatcgcgtcccgctcaagcatgaactggaaatgtcgaaggagtccgagcatgatagcgatgagagctccgacgatgattccgactccgaagagcccagcaagtatatcaacgcctctttcatcatgtcctactggaagccggaggtaatgatagccgcccagggacctctgaaggagactataggagatttctggcagatgatcttccaacgtaaagtgaaagtgatcgtgatgctcactgagctgaagcacggggaccaagagatctgtgctcaatattggggcgagggaaaacagacatacggagacatcgaggttgacctcaaggacaccgacaaaagttcaacgtatactctgagagtattcgaattgagacactctaagcggaaggacagccggacagtgtaccagtaccagtacacgaactggtctgtagagcaattgcccgcagaacccaaagaattgatttccatgatacaggtggtcaaacagaagctaccacagaagaactcttctgagggaaacaaacaccacaagtcaacaccgctactcattcattgtagggacgggtctcaacaaaccggcattttttgcgcactacttaacctattggagtcagccgaaaccgaggaggtagtggacatcttccaggtcgtgaaggcccttcgcaaagcaaggcctgggatggtctctacgttcgagcaatatcagttcctgtacgacgtgatcgccagcacttacccagcccagaatgggcaagtgaaaaagaacaaccaccaggaggataaaattgagtttgacaacgaagtcgacaaagttaagcaggatgccaattgtgtgaatcctctcggcgcccccgagaagcttccggaagcaaaagagcaggcagaaggcagtgaacctacgtctggtaccgagggtcccgaacactcagtcaatggccccgcctcccccgcgctcaaccagggaagttag

SEQ ID NO: 16919 - DNA, 1797 bp, Artificial Sequence
  Description of Artificial Sequence: Synthetic coding sequence
atgtacctatggctgaaactcctggcgtttgggttcgcttttcttgataccgaagtcttcgtgacaggccagtcgcctaccccttcccctaccggggtgagttccgttcagaccccgcacttgccaacacacgccgactctcagactcccagtgccggtaccgacactcagacctttagtggtagcgccgctaatgcgaaactaaacccaactcccggatcaaacgccataagcgatgcctacctcaacgcgtctgagacaaccacgctgtccccctctggaagtgccgtgatttccactacaactatagccacgacacccagtaagcctacatgtgatgagaaatatgcaaacatcacagtggactacctgtataacaaagaaacaaagctttttacagctaaactgaatgttaatgaaaacgtggagtgtgggaataacacctgcactaacaatgaggtgcataatctcactgaatgtaagaatgcgtcagtgagtatcagccataacagttgcaccgcccccgataagaccttaattctggacgtgcccccaggcgtggagaagttccagctgcatgattgtacccaggtcgagaaagccgatacaacaatatgtctcaaatggaagaacattgaaacctttacctgcgacacacagaatataacttataggtttcaatgtggcaatatgattttcgacaataaggaaattaaactggagaacttggagccagagcatgagtacaaatgcgattccgagattctgtataataaccataagttcactaacgcctcaaaaattatcaagaccgactttggaagtcccggcgagccccaaatcattttttgcagaagcgaggccgcacaccagggcgtgatcacctggaacccacctcagcggtctttccacaactttactctctgctatattaaggagaccgagaaggattgtctcaacctggacaagaacctcattaagtatgatctgcaaaatcttaaaccatatacaaagtacgtgttgtccctgcatgcttatatcatcgcgaaagtgcagcgaaacggatctgctgccatgtgccatttcacaacgaaatctgcccccccatcacaggtatggaacatgacagtgagtatgacgagcgataacagcatgcacgttaagtgtcgcccaccgcgcgaccgcaatgggcctcacgagcgctaccatttggaggtggaggctggaaatactctggtgcggaacgaaagccacaagaactgcgattttcgggttaaagatctgcagtattcgacagactacacctttaaagcttattttcataacggggattatccaggggagccttttattctacatcactccacatcatacaacagtaaagcccttatcgcttttctcgcatttctgattatcgtgaccagcattgccctgctggttgtactttataaaatttacgacctccataagaagagatcctgtaacctggatgagcagcaggagttggtcgagagggacgacgaaaagcaattaatgaatgtggagcctatccacgctgacatcctgcttgaaacatataagcgaaagatagcggacgaaggtcgcctgtttctagccgagtttcagagcattccgcgagtgtttagtaagttcccaattaaggaggctcggaaaccattcaaccaaaacaagaatcgatacgtagatatcctgccctatgactataatagagtggaactgtccgaaataaacggggatgcaggaagtaactacattaacgccagctatattgattag

SEQ ID NO: 16920 - DNA, 2271 bp, Artificial Sequence
  Description of Artificial Sequence: Synthetic coding sequence
atgtatctctggctgaaattactggcatttggtttcgcatttctcgacacagaggtctttgtgaccggccagtctcctacacccagccctaccggcctgaccaccgccaaaatgcctagcgtgcccttgagctctgacccacttccaacgcacacaactgctttcagtccagccagcaccttcgaaagagagaatgatttttcagaaaccacaacgagtctttctcccgacaatacgagcacacaggtgagtcccgatagtctggataatgcgtcggcatttaataccaccggggtgtcctccgtgcaaaccccccatctacctacccacgccgattcccagacaccaagtgcaggcaccgatacccaaacattttccggatctgctgccaacgccaagctgaatcccaccccgggcagcaatgctatatccgacgcatacttgaatgcctccgagacaaccactctgtcacctagcggcagtgccgtcattagtactacgacaattgccactacccctagcaagcccacatgcgatgaaaaatacgctaacatcactgtggactacctgtacaataaggaaactaaactttttactgctaagctaaacgttaacgagaatgtagagtgcgggaacaatacatgtactaacaatgaagtgcataatttgaccgagtgtaagaatgccagtgtcagcatttctcacaacagctgcacagcgccggataagactctgattctggacgtgcctccaggagttgaaaagttccaactccacgactgtacacaggtggagaaggcagatacaacaatttgtcttaagtggaaaaatattgagacattcacatgtgatacccagaacatcacttataggttccaatgcgggaacatgatcttcgataataaggagattaaattggagaatctggaacccgagcacgaatataagtgcgacagcgaaatcctttataacaaccacaaattcactaatgccagtaaaatcattaagactgacttcggatcacccggggagcctcagatcattttctgtcgatccgaggccgcgcatcaaggggtgattacttggaatccaccccagagatcttttcacaactttacactgtgctatataaaagagacagaaaaggattgcctgaacctggacaagaatctgattaaatacgatctgcagaacctgaaaccatatactaagtacgtgctgagcctccatgcctatatcatagcaaaggtccaacggaacgggagcgcagctatgtgccacttcactacgaagtcggctcccccctcccaggtgtggaatatgaccgtgagcatgacatccgataattccatgcatgtgaaatgtagaccaccaagggatcggaacggtccacatgagaggtaccacttagaggtggaagcgggcaacactctcgtgcggaatgagtctcataagaactgcgacttcagggtcaaagacctgcagtatagcacagactatacctttaaggcttacttccacaacggcgattatccaggagagccttttattttacaccactctaccagctacaactccaaagcacttatcgcctttctggctttcctaattattgtgacatctatcgctctgctggtcgtgctctacaagatttatgacctgcataaaaaacggagctgtaatttagacgaacaacaggagctggtggagagagacgacgaaaagcagttgatgaacgtagaacccattcatgcagatatcctactcgagacatataaacggaagatagccgatgaggggcggctcttcctggcggagttccagagcatcccaagggttttctccaaatttccgatcaaagaagcccgtaagcccttcaaccaaaacaaaaacaggtatgtcgacatcctgccctacgactacaacagggttgagctgagtgaaattaacggcgatgccgggtcaaactacatcaatgcctcctatattgacggcttcaaagaaccgcgaaagtacattgcagcacagggacctcgggacgagactgtcgacgatttctggagaatgatttgggaacagaaggcgaccgtgatcgtgatggtgacacggtgtgaggaaggaaacaggaataaatgcgccgagtactggccatccatggaagagggaacacgggcttttggtgacgttgtcgtcaagatcaatcagcataagcgttgtccagactacatcatacagaagctgaacatcgtcaacaaacagaaaagcaaatag

SEQ ID NO: 16921 - DNA, 1662 bp, Artificial Sequence
  Description of Artificial Sequence: Synthetic coding sequence
agtgactacatgatcattaagaagaaatccaactatgaagtgttggaaaaagacgttgggctgaagagatttttccccaagtcactactcgatagtgtcaaagcgaaaacacttcgcaagctgatccaacagacctttaggcagtttgccaacctgaatagagaagaaagtattctgaagttttttgaaatcctgagccccgtctaccgttttgataaagaatgctttaaatgtgcgctgggcagtagctggataatatcggttgagctggcaattgggcccgaggaggggattagttacttgaccgacaagggttgtaaccccacccacctggctgactttacccaggtccagacaatacaatattcaaactctgaggacaaggataggaagggcatgttacagctcaagattgcaggtgcgcccgagccgctaactgtaactgcacctagccttactattgctgagaacatggccgacctgatcgacggatactgcagattagttaacggaacatctcagtcatttatcatcaggcctcagaaggagggggaaagagccctgccaagtattcctaagttggcaaactcagaaaaacagggcatgaggacccacgctgtatctgtgagcgaaaccgacgattacgctgaaattatagatgaggaagacacttacactatgccttctaccagggactatgagatccagagagagcgcattgagctgggacggtgtataggggaaggtcagttcggggatgtgcaccagggcatatatatgtcacctgagaacccagccctggcagtggctatcaagacatgcaaaaattgcacctccgacagcgtcagggaaaagttcctgcaggaagcctgccactacacatctctgcactggaattggtgcagatacatctctgaccccaatgtggactgccctgatccacggaacgcggaagtcaccatgagacagttcgaccacccacacattgtcaagctgattggggtcatcacagagaatccggtatggataatcatggagctgtgtacgctgggggagctgcgctctttcctccaagtgcggaagtatagtttagatctggcctcactgatcttatacgcctaccaactgtccaccgctctggcgtacctggagagcaagagatttgtgcaccgcgacatcgccgcccgaaatgtccttgtttcaagcaatgattgcgtaaagctgggtgactttgggctgagccgttatatggaggactctacatactataaggcctccaaaggtaagttacctatcaagtggatggctcccgagtccattaacttccggcggtttacctctgcgtccgatgtgtggatgttcggtgtttgcatgtgggagatcctgatgcacggtgtgaaaccatttcaaggagtcaagaacaatgacgtgattggtagaatcgagaatggtgagagactccctatgcctcctaattgcccgcccaccctttacagtttaatgaccaaatgttgggcgtacgacccctcccgtcgccccaggttcaccgagcttaaggcccagctgtcctttcaaaaccctgctcagatgttgcccgcatctggccgtctgcccaaccagccctgccccgagcgtgagaactacagctttgccacattttag

SEQ ID NO: 16922 - DNA, 2931 bp, Artificial Sequence
  Description of Artificial Sequence: Synthetic coding sequence
cggagtttcattatcttgaaggcaatcgtgtcccagcctccggggccagtgctgtctggcatggagatgctgctgatgagcggctacgagctgcgaattaggtatctgcctaaggggtttctgaaccagttcaccgaagataaaccgaccctcaacttcttttatcagcaggtgaaaagtgactatatgctggagattgccgatcaagttgatcaggagattgctctaaaactaggctgtctggagattcgtcgctcatattgggagatgcgggggaacgccctcgagaagaagtctaattacgaagtcctggaaaaggacgtgggacttaagcgcttctttccgaagtcactgctggacagtgtgaaggccaaaacactgcgcaaacttatccagcaaaccttccgacagtttgctaatctgaacagagaggagagtatcctgaagttcttcgagatactgtcccctgtgtatagatttgacaaagagtgctttaagtgcgctctggggtcttcatggattatatcggttgaactggctatcgggcctgaagagggaatatcatatctgacagataaggggtgtaatccgacccacctggcagacttcactcaggtgcagactatacaatacagcaactccgaagataaggatcggaaaggtatgttacagctgaaaattgctggcgccccagagccgctaacggttactgctccgtccctgaccatcgccgaaaatatggctgatttgattgatggatattgtcgcctagtcaatggaacctctcagtcgtttataatcagaccgcagaaagagggggagcgagcgttgccctccattcccaaattggcaaactcagagaagcaggggatgcggacccacgctgtttctgtatctgatgagattcctggagcggagacggatgattatgctgagatcattgatgaggaggatacctatactatgccatcgatcaaatcttactgcatagacgtcgcacgagactacgaaatacagcgggagcgcatcgaactcggacggtgtatcggggaaggacaattcggtgacgtccaccagggcatttatatgagtcccgaaaatccggccctggctgtggccatcaaaacctgtaagaattgtacgagcgactcagtgcgggagaaattcttacaggaagccctaacaatgcgccaattcgaccacccccacatcgtgaagctgattggtgtaatcacagagaatcccgtttggatcatcatggagctgtgcacgttgggcgaactgaggtcttttctgcaagtgcgtaaatattctctggacctcgcctccttaatcctctatgcttaccaactctctacagctcttgcttatctcgaaagtaagcgatttgttcacagggacatcgccgctcggaatgtcctggtgagcagcaatgactgtgttaagttaggcgacttcggtctgtcacgctacatggaggactccacgtattacaaagcctctaagggaaagttacctatcaagtggatggctccagagagtatcaactttaggcgctttaccagtgcaagcgacgtttggatgtttggagtgtgtatgtgggaaatcctgatgcacggcgttaagccattccagggcgtaaaaaataatgacgtaattgggcgcattgaaaacggtgagagactccccatgcctccaaactgtcctccgacgttatactctctgatgaccaagtgttgggcctatgacccctcacgccgtccccgctttaccgagttgaaagcgcaactgagcacaattcttgaagaagagaaagcccagcaagaggagcgcatgaggatggaatcacggcggcaagcgactgtctcctgggactccggtggaagcgacgaggccccccccaaaccctcaaggccaggctaccctagtcccaggagctctgagggattttatccctcaccccagcacatggttcagaccaaccattaccaggtttctgggtatcccggcagccacggcataacagcaatggccgggtccatctatccagggcaggcgagccttctcgatcaaaccgatagctggaaccatcggcctcaagagattgcgatgtggcagcctaacgtggaagactctaccgtgctagaccttcgcgggatagggcaagttctaccaactcacttgatggaggagaggttaattcggcaacaacaggagatggaagaagatcaacggtggcttgagaaggaggagaggttcctgaagcccgacgttaggctgagcagaggcagtattgaccgggaagacggttctcttcagggaccgattgggaatcagcatatctatcagcctgtgggaaagccagatccggccgcccctccaaagaaacctcctcgaccaggcgcacctggccacctcggaagcttggctagcctctcctcaccagccgattcttataacgaaggcgtgaagccccttagactgcagcctcaggagatcagtccaccgccaaccgctaatctggaccgcagtaacgataaagtttacgagaatgtaacagggctagtgaaagctgttatcgagatgtcgtctaaaatacagcccgccccgcctgaggagtacgttcccatggttaaagaggtgggtctggccttgcgcactctgctcgccaccgtcgatgaaacaatacctctgttacctgccagcacccatagggagatcgaaatggcgcaaaaacttcttaattctgatttgggcgagcttataaacaagatgaaactcgctcagcagtacgttatgacgtccctccaacaggagtataagaaacagatgctgacagctgcccatgccctggctgtggatgctaaaaacctcctcgacgtgattgaccaagcaagattaaagatgctgggccagacgcgacctcattag

SEQ ID NO: 16923 - DNA, 3024 bp, Artificial Sequence
  Description of Artificial Sequence: Synthetic coding sequence
aaggcagaatatgacaggtacttggcgtctagtaagatcatggccgccgcctaccttgaccccaaccttaaccacactcctaaggaatggaagtacgagctcagaatccgctatttacccaagggattcttaaatcagttcaccgaggataagcctactctcaacttcttttatcagcaggtgaagtcagattacatgttggaaatagccgatcaggtggaccaggagatcgctctgaagctggggtgtctcgagatccgccggagctactgggagatgagaggcaacgcactcgagaagaagagtaactacgaggtgttggaaaaagatgttggcctaaagcgcttcttccccaaaagcctgctagactcagtcaaagcaaagacgttgcgaaagctgatccaacagactttcagacaattcgccaatttgaacagagaggagtcaatcctgaagttttttgaaattctgagccccgtgtataggtttgacaaagagtgctttaagtgtgccctgggatcctcttggatcatttcagttgagttggccattggcccggaagaggggatctcatatttgacagataaaggctgcaacccaacccacttggcggatttcactcaggtgcagacaatccagtactcaaacagtgaggacaaagacagaaaagggatgctccagctgaagattgccggcgcgccggagcccctgaccgttacagccccttctcttaccattgccgagaatatggccgatctgatcgatgggtattgccgccttgttaatggaactagtcaatcatttatcattcggccacagaaagagggagagcgcgccttgcctagcatccctaagctggccaattctgagaagcaggggatgaggacgcacgcagtctcggttagtggagtgtctcattgccaacacaaggtgaagaaggcccgtcgtttccttcccctggtcttctgcagtcacgatccacctagtactgatgaaatcagtggcgacgagacggatgattatgccgaaattatcgatgaagaggacacatacacaatgccatccatcaagagctactgtattgatgtggctcgggactatgagattcagcgggaaagaattgagctgggacggtgcataggcgaaggccaatttggggatgtccaccagggtatctatatgtctcccgagaaccctgccctggctgtcgctattaaaacttgcaaaaattgcacaagcgacagcgtaagagaaaaattcctgcaggaagcgcttaccatgcggcaatttgatcaccctcacatcgtcaaactcatcggagttattacagagaatcccgtttggattataatggagctttgcactttgggagagctccgctcgttcctccaggtccgaaagtatagtttggatctggcctcattaatcctgtatgcctatcagctctctacggcactcgcatacctcgagtctaagcggttcgtacatagagacattgcggccaggaacgtgctcgtcagtagcaatgactgtgtgaaactaggcgacttcggcttgtctcgttacatggaggacagtacttactacaaggcctctaagggtaaactgcccataaagtggatggcacctgaaagcattaacttccggcggtttaccagcgcctcggacgtttggatgttcggggtctgcatgtgggaaatactcatgcatggggtgaagccatttcagggagtcaaaaacaacgacgtgatcggacgaattgaaaatggcgaaagactaccaatgccccccaattgccctcctaccctgtactcactcatgaccaagtgctgggcttatgacccatctcgtcggccaaggtttacagagcttaaagctcagttatctactattttggaggaagagaaagctcaacaggaggaacgaatgagaatggaaagcagacgtcaggcaactgtctcgtgggacagcggggggagtgatgaggccccaccaaagccaagccgccccgggtatccgtcccccagaagctcagaaggtttctacccaagtcctcaacacatggttcagacgaaccactatcaggtgtctgggtatcctggaagtcacggtattacggccatggccggcagtatctatcctggtcaggcatccctgctggatcaaaccgactcttggaatcatagacctcaggagatcgccatgtggcagcccaatgtcgaggatagtactgtcctcgacctgagaggtatcgggcaggtgcttccaactcacctgatggaggaaaggttgatccgacagcagcaggaaatggaagaggatcagaggtggttggagaaggaagaaagattcctgaagccggacgtgaggctgtcccggggcagcatcgaccgcgaggacgggtcactacagggacccataggcaatcagcatatttatcagcccgtgggaaagccggacccggctgctccgcccaagaaaccaccccgaccgggagcccccggacatctcggctctctggccagtctgtccagccctgccgactcgtacaacgagggtgttaagccactgcggttgcagccacaggaaatttcgcccccacctaccgcgaacttggatcgtagcaatgacaaggtatacgagaacgtgaccggattagttaaagcggttatcgaaatgagtagtaaaattcaaccagcaccgcctgaggaatatgtgcccatggtgaaagaggttggcctcgccctcaggacgctcctcgcaacagtggatgaaaccattcccctcttacccgccagcacccatcgtgaaatagaaatggctcagaaactgttgaactccgatttgggcgagctaattaataaaatgaagctggcccagcaatatgtcatgaccagcttgcaacaagaatacaaaaaacaaatgcttacagccgctcacgctctagccgtagatgctaagaatctgcttgacgtcattgatcaagcgcgcctaaaaatgctgggacagactaggccccattag

SEQ ID NO: 16924 - DNA, 3198 bp, Artificial Sequence
  Description of Artificial Sequence: Synthetic coding sequence
atggctgcggcttacttggaccccaatttaaaccatacgcccaacagctccacaaagacacacctcggaacaggaatggagcgatctcctggcgcgatggagagggtcctgaaggttttccattattttgagagcaattctgaacccaccacgtgggctagtatcattcgccacggcgacgccactgatgtccgggggatcattcagaagatcgtggattcacacaaagtaaagcacgtcgcctgctacgggtttcgtctgtcacacctgcgctctgaggaggtgcactggttgcatgtagatatgggagtatcttcggtgcgcgagaagtacgagctcgctcacccaccagaagagtggaagtatgagttgcggataagataccttccaaagggctttctgaatcaattcaccgaggataaaccaaccctgaacttcttctatcagcaggttaagtctgactatatgttagaaatcgccgaccaggtggaccaggaaattgctctcaaattaggctgtctggaaattagaagatcatattgggaaatgaggggtaatgctcttgaaaagaagagtaactacgaagttctggagaaagacgtcggcctgaagagattcttcccaaaatctcttttagattccgttaaggctaagaccctgcgcaaattgatccaacagacctttcggcagttcgcgaatctgaaccgtgaagagagtattctcaaattttttgagattctatcccccgtctaccggtttgataaagagtgctttaaatgtgctctgggttctagttggatcatttctgttgaactggccataggccctgaagaggggatctcttacctgacagataaggggtgtaacccaacacacctggcagactttacacaagtgcagacaatccagtactccaattctgaagacaaggatcgaaaaggaatgttgcaactgaaaatcgcaggggcccctgaaccccttaccgtgacagctccttccctgaccattgccgagaatatggccgatttaatcgacggatattgtcgcctcgtgaatggaaccagtcagagtttcattatcaggccccaaaaggagggcgagagggctctgccatcgattcctaaactggctaatagcgagaaacaaggtatgagaactcatgcggtttctgtgagcgagaccgatgattatgccgaaatcattgatgaagaggatacatataccatgccatccacgagagattatgagatccagcgcgaaaggatcgagcttgggcgctgcatcggagagggccagttcggcgatgtacaccaaggaatctacatgtcacccgagaatcccgctctcgctgtcgccatcaaaacgtgcaagaattgcacaagcgattctgtgcgtgaaaaattcttgcaggaggctctcaccatgcgccaattcgaccacccccacattgtgaaactcattggagtaattactgagaacccggtgtggataattatggagctgtgtaccctaggagaactccgcagcttccttcaggtgaggaaatacagtttggacctggcatctttgatcctttacgcataccaactgtccaccgccttggcatacctcgaatctaaacgcttcgttcaccgcgatattgctgcccggaacgttctggtgtccagtaatgattgcgtcaagttaggagacttcgggctatctcgctatatggaggacagtacttattataaagcgtcaaagggaaaactccccatcaaatggatggctccagagagcattaattttcgaagatttacgagtgcaagcgatgtgtggatgttcggggtgtgcatgtgggaaattctgatgcatggggtaaagccattccaaggcgttaaaaataatgatgttattggacgcatagagaacggcgaaagactcccaatgcccccgaactgcccaccaaccctgtactctctaatgacgaaatgctgggcttatgatccctcaaggcgtcccagatttaccgaactgaaggctcaactgtccaccatcctcgaggaggagaaagctcaacaggaggagcgcatgagaatggagtctcggaggcaagcaacggtctcctgggattccggcggtagcgatgaagccccacccaagccaagccgaccaggttacccttcaccgaggtccagtgagggcttctacccctccccacagcacatggtgcagacgaaccactaccaggtgtcgggatatccggggtcgcatggaattactgcaatggctggaagtatctacccgggtcaggcctcactgctggatcagactgattcctggaaccaccgcccccaggaaatcgctatgtggcagccaaacgttgaggactccaccgtgctggacctcaggggcatcggtcaggtcctgcctactcacttaatggaggaaagactgatccgacagcagcaggagatggaagaggatcagagatggctcgagaaagaggaacgatttctgaagccggacgtgaggcttagccgtgggagtattgacagagaggatggatctctgcaaggcccaattggcaatcagcacatctatcagcccgtaggaaaaccaggcaaggaagaaaagaactgggcagaaaggaatccagccgcgccacctaagaaaccacctagaccgggggctccaggccatctaggctctcttgcatccttaagctcccccgccgacagctacaatgagggcgttaagcctaatcagctgcagccccaagagatctctccacccccaaccgccaatctcgataggtctaacgacaaggtatatgagaacgtgacaggccttgttaaggcagtaattgagatgtccagtaaaatacagcccgcgccgccagaggaatacgtgccgatggtcaaggaggtgggcctggccctcagaactctgttggcaaccgtggatgagacaatccccctgcttcctgcctcaacccatagggaaatagagatggcacagaaactgctaaacagcgacctcggtgaactgattaacaagatgaaacttgcccaacagtatgtgatgacttccctgcagcaggagtataagaagcagatgctcactgcggcacatgctttggctgtcgatgcaaaaaatcttcttgacgtcattgatcaggcacggctgaaaatgttggggcagactagacctcattag

SEQ ID NO: 16925 - DNA, 2253 bp, Artificial Sequence
  Description of Artificial Sequence: Synthetic coding sequence
atggccgatcttatcgatgggtactgtcgcctcgtcaatggaacgtcgcagtcgttcattattcgcccgcagaaagagggcgaaagagccctcccaagtatcccgaagctggccaacagcgaaaagcagggtatgagaacccatgccgtgtccgtgagtggagtgtctcactgtcagcacaaagtcaaaaaggccaggcggttcctcccacttgtattttgttctcatgaccccccctccacggacgaaataagtggcgatgagaccgatgactatgccgagataatcgatgaggaggatacatatactatgccttcaacccgggactacgagattcagcgggaacgaattgagcttggccgctgcattggggaaggtcagttcggcgacgtgcatcagggcatctatatgtctccagaaaaccccgccttggcggtggcaattaagacctgcaagaactgtaccagtgactctgtgcgagaaaagttcctgcaagaagccttgacaatgaggcagtttgatcatcctcatattgttaagctaatcggagtcataactgagaacccagtgtggattatcatggagctgtgtactctgggagaactgaggagtttcctccaggtgcggaagtactctctcgatttagcgagtcttatcctgtatgcctaccaattgtctacagccctggcttatctcgaaagcaagcgtttcgtgcatagagacatcgccgcccgtaatgtccttgtaagttccaatgactgtgtgaagctaggagatttcgggttaagtagatacatggaggactcaacatattacaaagcatccaaaggcaaattacctattaaatggatggctccagagtctatcaatttccgtaggtttacttcagcctcagacgtttggatgttcggagtctgcatgtgggaaattctgatgcacggagtgaaaccgttccagggtgtgaagaataatgatgtaataggacggatcgagaacggcgaaaggcttccaatgcccccaaactgtccccctaccctctactcattgatgaccaaatgctgggcttatgatccgtctagacgcccaagattcaccgaactcaaagcgcaattgagcaccatcctggaagaggagaaagcgcagcaggaggagcgaatgcggatggagagtaggcgccaagctacagtgtcgtgggactctggggggtcagatgaggccccaccaaaaccaagcaggccagggtatcccagtccaaggtcttccgaaggcttttacccatccccgcagcacatggttcagacaaaccattaccaggtctctggctacccaggctcacacggcataaccgctatggccggttccatctatccggggcaagcctctcttctggatcaaacggattcttggaaccacaggcctcaggagattgccatgtggcagccaaacgtggaagacagcactgttttggaccttagggggatcggtcaggttctgcctacacaccttatggaagagcggttgattcggcagcagcaggaaatggaagaagaccagcgctggttggagaaggaagaaaggtttctgaagcccgatgtgagacttagcagaggaagcattgacagagaggacggctccctgcagggtccaattggcaatcagcacatttatcaacccgttgggaagcccgaccctgccgctcccccaaagaaacccccgcgacctggagcacctgggcacctcggtagcctggcttccctgtcctctccagcagactcatataacgagggagtgaaaccttgtaggttgcagcctcaagagattagcccccccccaacagccaatttggacaggtccaatgacaaggtttacgaaaatgttaccggtctcgtgaaagccgtgattgagatgtcttccaaaatacagcctgccccccctgaggagtacgtgccaatggtgaaagaggttggcctggcactgcgcacgttactggccaccgtcgacgaaactattccactgctgcctgcatcaacgcacagagaaattgaaatggcccagaaactcctgaattccgacctcggagaactgataaacaagatgaagctggctcaacagtacgttatgacctcattgcagcaggaatacaagaagcaaatgctcacagcggcccacgccctcgcagtggacgcgaaaaacctgcttgacgtaattgaccaagcacgactgaaaatgctgggtcaaactcgaccccattag

SEQ ID NO: 16926 - DNA, 1089 bp, Artificial Sequence
  Description of Artificial Sequence: Synthetic coding sequence
atgcgcatggaatctagacgccaagcaaccgtgagctgggattctgggggaagtgatgaagctcctcccaagccttcgaggcccggctatccttcgcctcgctccagtgaaggtttctaccctagcccccagcacatggtccagactaatcattatcaggtatctggatatcccggatctcatgggatcactgccatggctggctctatctacccagggcaggcaagcctcttagatcaaacggattcctggaatcatcgccctcaggaaatcgccatgtggcagcccaatgtggaggactccacagttctggaccttagaggtatcggtcaggtgctgccaactcatctgatggaagaacgtttgatcaggcagcagcaggaaatggaggaggatcaacgctggttagagaaggaagagaggttcctgaaacccgacgtaaggctctcccgcgggagtattgatagggaagatgggagcctgcagggacccatcgggaatcagcatatataccaaccggtgggcaaacctgaccctgccgcgccaccgaaaaagcctccccggcctggcgctccagggcatctcgggagtttagctagcctgtcttcccccgcggacagctataatgagggcgtaaagctgcagccccaggaaatcagcccaccaccaaccgccaacctggatagatccaatgataaggtctacgagaacgttacaggcctggttaaagcagtcatcgagatgagcagcaaaatacagcccgccccccccgaggaatacgttcctatggtgaaggaagttggtctcgccttaaggactctactcgcgacagtggatgaaaccatcccattgttacccgcaagcacccaccgcgaaatcgagatggcccagaagctactgaattccgatctcggggaactgattaacaaaatgaagttggcccaacagtacgtgatgacgtcacttcagcaggagtataagaaacagatgctcacggcggctcacgctctcgctgtcgacgcaaaaaatcttttagacgtgattgaccaagcaagacttaagatgttaggacaaacgagacctcactag

SEQ ID NO: 16927 - DNA, 354 bp, Artificial Sequence
  Description of Artificial Sequence: Synthetic coding sequence
atggccgctgcttacctggatcccaatctcaatcataccccaaactcttcaaccaaaacacatttaggtacggggatggaaagatcaccgggggcaatggagcgcgtgcttaaagtcttccactacttcgagtctaattctgagcctaccacctgggcctccatcattaggcatggcgacgcaaccgatgtgaggggtatcatccagaagatagtggactctcacaaggttaaacacgtggcttgctatggttttcgcctgtcccacctcaggtcggaggaagtgcactggctccacgtagatatgggggtatcctcagtgcgtgaaaagtacgaactggcacacccaccatag

SEQ ID NO: 16928 - DNA, 3291 bp, Artificial Sequence
  Description of Artificial Sequence: Synthetic coding sequence
atgcttctcgaactagcgggccaggaggctctgaaacctgccggcgctatctacatggaaaaatctggctgttctccattcccagtatgctgggccaaggagtacgatcgttacctcgcctcctcgaaaatcatggccgccgcttacctcgacccgaatttaaatcatacgccaaacagttccactaaaacccacctggggaccggcatggaacgctcgcccggagcgatggagcgtgtgttgaaggtgttccattatttcgagtcaaatagcgagccaactacctgggcctccattattcggcatggcgacgctacggacgtgaggggcatcattcagaaaatcgtggatagccacaaggtaaagcacgtcgcctgttatggattcaggctgagccatctaagatccgaggaggtgcattggcttcatgtcgacatgggggtgtcatccgtacgggagaaatatgaactggcgcacccccccgaggagtggaagtacgagctcagaatcagatatctacccaaaggctttctgaatcaattcaccgaggataagcccacacttaattttttctatcagcaggtcaaaagtgattatatgttggagatcgctgatcaggtggaccaagagatcgccctgaaacttggctgtttggaaattcgacgcagctactgggagatgcggggcaacgcactcgagaaaaagagcaactacgaagtgcttgaaaaggatgtcgggttgaaacggtttttcccaaaatcgctgctggattctgtcaaagctaaaactctgcgcaaactaatacagcagacgttcaggcagtttgccaacctgaatagggaagagagtatcctgaagttctttgaaatactgagcccagtttacaggttcgacaaggagtgcttcaaatgtgccctcgggagttcctggattatctctgtcgaactagcaattggtcctgaagagggcattagctatctcactgacaagggctgcaatcctacgcacctggcagacttcacacaggttcagacgatccaatactctaatagcgaagataaggatagaaagggcatgttgcagctaaagatcgcgggcgcaccagagcccctgactgtgacagctccttctctgaccatcgcagaaaatatggccgatctgattgacgggtattgtcggctggtcaatggcacgtcgcagtcttttattatcaggccacagaaagaaggggaaagggctctcccctcaattccgaaattagctaactccgagaagcagggcatgagaactcatgccgtctccgtgtcggagaccgacgattacgccgagatcattgatgaagaggacacctatactatgccatcaacgcgggactacgagattcagcgggagcgcattgaactgggtaggtgtattggtgagggtcagtttggagatgtacaccaaggtatctacatgtcgcccgaaaaccccgcgcttgccgtagctattaaaacctgcaagaattgtactagcgactcagtgcgggaaaaattcctgcaggaggccctaactatgcgtcagttcgatcacccccacattgtgaagctaattggtgtgattactgagaaccccgtgtggattattatggagctttgcactctgggagaattgaggtcctttcttcaagtgagaaagtattccctggacctggcgtctctgatactttatgcatatcagctctctacagctctggcataccttgagtctaaacgattcgttcatagggacatagccgcacgtaacgtgctcgtgtcttctaacgattgtgtcaaactgggtgatttcggattgagccgctacatggaagactctacctactacaaagcctccaagggtaagctgccaattaagtggatggcccctgaatccatcaatttccggcgctttacctctgccagcgacgtgtggatgttcggggtctgcatgtgggaaattcttatgcacggagtgaagccatttcaaggagtgaagaacaatgacgtaattgggaggatcgaaaatggcgaaaggctgcccatgccgccaaattgtccccctacgctgtactctctaatgacgaaatgctgggcctacgacccttcacggcgcccccgcttcaccgagctcaaggcccagttgagtactatcctcgaggaagagaaggcacagcaagaggaaaggatgcggatggaaagccgtcggcaggccactgttagctgggattccggcggctctgatgaagcccctcccaagccgagtcggcctggatatccatccccgcgttcatcggaaggcttttatcccagcccccagcatatggtccaaactaatcactatcaggtttccggttacccaggcagccacggaataactgctatggctggatccatctatccaggccaagcttctctgttggatcaaactgacagctggaaccatcgcccacaggaaatcgcaatgtggcagcctaatgttgaagactccactgttctagacctccgaggcatcgggcaagtgctgcccactcaccttatggaagaaagattaataaggcaacagcaggagatggaggaggatcagagatggttggagaaagaagaacggtttctcaaacccgacgtacggttgagccgcggtagtatcgacagggaggatggcagcttacaggggcctatcggaaatcagcacatttatcagccagtgggcaaacccgatcccgccgcaccaccaaagaaacctcctcgccctggcgcacctggccacctgggaagcctggctagtctgtcaagcccagcggattcttacaatgaaggcgtcaagctgcagcctcaggaaattagccccccccctacagctaacctggatagatcaaatgacaaggtctacgaaaacgtcacaggtcttgtgaaggctgtaatagaaatgtctagcaagatccagcctgctcctccagaggagtacgtgcccatggtgaaggaagtaggactggcccttcgcaccctgctcgctacagttgatgaaactattcctctgcttccagcatctacacaccgcgagatcgagatggcacagaaactgttaaactcagatctaggggagttgataaataagatgaaactggcccagcagtacgttatgactagtctgcagcaggagtacaaaaaacagatgctaaccgcagcacacgccttagccgtggacgccaaaaatctcctggacgtcatagatcaggcgcgtctaaagatgctgggccaaactcggcctcactag

SEQ ID NO: 16929 - DNA, 3291 bp, Artificial Sequence
  Description of Artificial Sequence: Synthetic coding sequence
atgcttctcgagcttgccggtcaggaagccctaaagcccgctggggccatctatatggaaaaatcgggctgctcaccatttcccgtatgctgggcgaaagaatatgacagataccttgcgtcctcgaagattatggccgcagcatatctggatcccaatctgaatcatactcctaacagttctaccaaaacacatctaggcaccgggatggagcgtagtcctggagcaatggagcgggtcctcaaggtgttccattacttcgaaagtaactccgagcccaccacatgggcctcgatcattcgccatggcgacgctactgatgtgcgtggcatcatacagaagattgtggattcacacaaggtaaagcacgtggcttgctatggctttcggctgtcacatttaagatccgaggaggttcattggctgcacgtggatatgggcgtctcttcagtgagggagaagtacgagctggctcatcccccggaggagtggaaatacgagctaaggatccggtatcttcctaaggggttcttaaaccaattcactgaggacaagccaacgctgaattttttttaccagcaggtcaaaagtgattatatgctcgaaatcgcagaccaggtggaccaagaaattgcccttaagctgggatgccttgaaatccggcgctcttactgggaaatgaggggtaacgccctggagaagaagtctaactatgaggtgctggagaaagatgtgggcttaaaacgtttcttccccaagtccctcttggactcagttaaggcaaaaacactcagaaagctgatacagcagacgttcagacagtttgctaacctcaacagggaggagtccattctcaagttttttgagatattgtcacctgtgtacaggttcgacaaggaatgctttaaatgtgctcttggaagttcttggatcatctctgtcgagctggccatcggcccagaggaaggaatctcctatcttactgacaaggggtgtaatcccacccatctggcagacttcacacaagtccagaccatccagtactcaaactctgaagacaaagaccgtaagggcatgctccagctgaagatagcaggggctcctgaacctctgactgtaacggcgccttcccttaccatagctgagaacatggcagatctgatcgacggctattgtcgcctcgtcaacggtacctcacagagttttattatccgcccacagaaagaaggagaacgtgccttgcctagtataccaaaactggccaactcagaaaagcaggggatgcggacccatgccgtctcagtcagcgagactgacgactacgcagagattattgacgaagaagacacttatacaatgccttcaacaagggattatgagattcagcgagaaagaattgagctgggtcggtgcatcggcgaaggccagtttggcgacgtccatcagggcatctatatgtcccctgagaaccccgccctcgccgtggccatcaagacttgtaagaactgcacaagcgatagcgtgagggagaagttcctacaagaggcactgacaatgcggcagttcgaccaccctcatatcgtgaagctgatcggcgtgataaccgagaaccctgtctggatcataatggagctgtgcacgctcggtgagctccgcagctttcttcaggtgaggaaatacagtctcgatttagcaagcctgatcttatatgcctatcagctgagcaccgccctcgcttatcttgaatccaagcgtttcgttcaccgggacatcgctgcccggaatgtactggtgtcaagcaatgactgcgtgaagctaggagattttggcctcagtaggtatatggaggactcaacctattacaaagctagcaagggtaaactgcctattaagtggatggcacctgagagcatcaacttccgtcgcttcacttccgcttccgacgtatggatgtttggcgtatgtatgtgggagattctgatgcatggcgtgaagcccttccaaggcgtgaaaaacaacgatgtgattggcagaatagaaaatggagaaagactccccatgccgccaaattgccccccaaccctgtattccctaatgactaagtgctgggcctatgacccatcacgccggccacgcttcacggagctgaaggcacagttgtcgacaattctggaagaggagaaagcgcaacaagaggagcggatgcgcatggaaagccgacgtcaagcaaccgtctcatgggattccggcggatccgacgaggctccacccaagcctagccgtcccgggtacccatcaccacggtcttctgaagggttctacccgagccctcagcacatggtgcaaaccaaccattaccaagtgtcggggtaccccggctcacacgggatcacagccatggctgggtccatatacccaggacaggcctccctgctggatcaaaccgactcctggaaccatcgtccgcaggagattgcaatgtggcagccgaacgtggaagatagtactgtgctggatttgagaggcattggacaggtgctgcctacacacctcatggaggagaggctaattagacaacagcaggagatggaagaggaccagaggtggctggaaaaagaggagaggttcctgaagcctgatgtgcgcctgtctcgaggatccattgatcgtgaggatggttcactccagggtccgataggaaatcagcatatttatcagcccgttggtaagcccgaccccgctgcccctccaaagaaaccccccaggccaggagcccccgggcacctgggctcgcttgcatctttgtcctctccagccgattcttataatgaaggagttaaactacagcctcaggagatttcaccacctcctacggccaacctggatcgctccaacgacaaggtatacgagaacgtgacagggctcgtcaaggcggtgatcgagatgtcgtcaaaaatccaacctgcaccacccgaagagtacgttccgatggtgaaagaggtgggactcgcactgagaactctgttggccacagtggacgagacaatcccactactgccagcttctacccatagagagatcgaaatggcacaaaaactgctgaatagcgacttgggcgagctgataaataaaatgaagctcgcccagcagtacgtcatgactagcctccaacaagaatataaaaagcaaatgctgaccgctgcccacgctctggcagtggacgccaagaacctgctagacgtgattgaccaagccagacttaagatgctgggccagacaaggccgcactag

SEQ ID NO: 16930 - DNA, 2043 bp, Artificial Sequence
  Description of Artificial Sequence: Synthetic coding sequence
atgaagtaccaggaggtccgatgccttacttcattcaacatttctgtgtctttccccgcagagaccgacgactacgccgaaatcatcgatgaggaagatacctacactatgcccagtaccagggattatgagattcaacgcgagagaatcgagctgggcaggtgtatcggtgagggccagtttggggatgtgcaccaaggaatctacatgagccctgagaaccctgcactggctgtcgctatcaaaacttgcaagaattgcacctcagactctgtacgggagaagttcttgcaagaagcgttgaccatgaggcagttcgaccacccacacatcgtaaagctgattggagttattactgaaaaccccgtgtggatcattatggagctgtgcacacttggcgagctcaggtcttttctccaggtgcgtaaatattccctggatttggcgtcactgatcttatatgcctatcagctgtctacagccctggcctaccttgagagcaaacggttcgtgcacagggatattgcagcacgaaatgtgttggtctcaagcaacgactgtgtcaagctaggcgatttcggattgagtcgttacatggaggactcaacctactacaaggcatcgaagggtaagttacccattaagtggatggcgccagaaagcatcaattttcgcagattcacgtcggcatctgatgtctggatgttcggagtttgtatgtgggaaatcctcatgcacggggttaagccatttcagggggtgaagaacaatgatgttatcggcaggattgaaaatggggagagactgcctatgccccctaactgtccacctacgctgtatagcctgatgactaaatgctgggcatatgatccaagtcgtcgaccacgtttcacggagctgaaggctcagctcagtacaatcttggaagaagaaaaagcccagcaggaggagcgcatgcgaatggagtcacggaggcaggccaccgtgtcttgggatagtggaggctcggatgaggccccccctaaaccctcaagaccaggctacccgagccctcggtcatcggaaggtttctacccatctccccaacacatggtccagacgaaccactaccaggtctccggctaccccggctcccacggcatcacagctatggcgggcagtatatatcctgggcaggcctctctgctggatcagactgattcctggaaccaccgtccgcaagagatcgccatgtggcagccaaacgtggaggattctaccgtgcttgacctcagaggaatcgggcaggtattgcccactcacctgatggaggaaaggttaattaggcagcagcaggaaatggaggaggaccagaggtggctggagaaggaagaacgttttttaaagccagatgtgcggttgtccaggggaagtatcgacagggaagatggaagtctgcagggtcccatcgggaatcaacatatctaccaaccggttggtaaaccggatcctgccgcccctcccaaaaagccacccagacccggtgccccgggccacctggggagcctggcgtcgctctccagtcctgctgacagttataacgagggtgtgaagctgcaaccccaggagatctccccacctcctactgctaacctggaccggagtaacgataaagtatacgagaatgttactggcctggttaaggccgtgattgaaatgtcttctaagatccagcccgccccccccgaggaatatgttcccatggtcaaagaggttggtcttgcactgcgtacccttctggcaacggtggacgagacgattccgttactgcccgcttccactcatagagagattgagatggctcagaaactactgaattctgatctaggtgaactgatcaacaaaatgaagctggctcagcagtacgtaatgactagcctccagcaggagtacaaaaagcaaatgctcactgcggcccacgccttggcagtagatgcaaagaatttgcttgatgttatagaccaagcccgacttaagatgctcggccagactcggccgcactag

SEQ ID NO: 16931 - DNA, 3054 bp, Artificial Sequence
  Description of Artificial Sequence: Synthetic coding sequence
taatatgatcgctacttggccagtagcaaaattatggccgccgcttaccttgacccaaacctgaaccacactcccaactccagcactaagactcacctggggactgggatggaacggtccccaggggcgatggaacgtgttctgaaggtattccactactttgaaagcaatagcgagccaacaacgtgggcttccataatccggcatggcgatgccaccgatgtgagaggcatcatccaaaagatcgtggactcccacaaagtgaagcacgtggcttgttacggatttcgtctttcccatctgcggagtgaagaggtccactggttgcacgttgacatgggtgtgtctagcgtaagggagaagtacgaacttgcccatcctccagaagagtggaaatatgaactgcggatacgttatcttccaaaagggttcctaaaccaatttaccgaagataagccaaccttgaacttcttctatcagcaggtgaagtcggactatatgctcgaaatcgcggaccaggtcgatcaggaaatcgcattgaaattggggtgtctggagatccggcggtcttattgggagatgagaggaaatgctctggaaaaaaagagtaactacgaggtgttagagaaggatgtgggcctgaaaagattctttcccaaatcgctgctggactcagtcaaggccaagaccttgcggaaattgattcagcaaacattccgacagttcgcaaatttgaatcgggaggagagtattttgaaattttttgaaatactgagtccagtctaccggtttgacaaggagtgctttaaatgtgccttaggctctagctggatcatcagtgttgaactcgcgattggtccggaagaaggtatatcttacctgacggataagggctgcaaccctactcacctggccgactttactcaggtacagactattcagtacagcaacagcgaggataaggatagaaagggaatgctgcagctgaagattgccggggccccagagcctctgaccgtcactgctccctctctaaccattgcagagaatatggctgacctgatcgatggttactgcagactagttaatgggacctcacagtctttcataattcggcctcagaaggaaggggagcgggcattgccatccatccccaagctcgcaaattccgagaaacaaggcatgcgtacgcatgcagttagtgtgtctgaaaccgatgattatgccgaaattatcgacgaggaggacacatacaccatgccatctactcgagattacgagattcagcgggagcgcatcgagttgggccgctgcatcggggaagggcagttcggagacgtgcaccagggaatttacatgtcgccagagaatccagcattggctgtggctatcaaaacatgtaaaaattgtacatccgattccgtcagggaaaaatttctccaggaagcccttacaatgcgccagtttgaccacccacatatcgttaagctgattggtgtcatcaccgaaaaccctgtgtggataattatggaactgtgtaccttaggcgaactgagatcgtttctccaagtgaggaagtatagcctggacctggctagtcttatactttacgcatatcagttgagcacagccctggcatacctagagtccaaacgttttgtgcatagggacatcgccgctagaaatgttttggtcagttctaacgattgcgtgaaactgggagactttggcctgtcacggtacatggaggactcaacatactataaggccagcaaagggaaattacccatcaagtggatggcaccagagagcataaactttcggagattcaccagcgcaagcgacgtttggatgtttggcgtatgcatgtgggaaatcctgatgcatggtgtgaagccttttcagggcgtcaagaacaacgatgtgattggcagaattgagaacggcgagcggctaccaatgccccctaactgcccacccacactgtactccctaatgactaagtgctgggcgtatgatccaagtagaagacctcggtttacggaactgaaggcgcagctgtcgacaatcctagaagaagagaaggcccagcaggaagagaggatgaggatggagtcccggcggcaggctacagtgtcctgggattcagggggtagtgatgaagctcctcctaagccgtctagacctgggtatcccagccctcggtcctctgaagggttttatccgtcaccacaacacatggtgcaaaccaatcactaccaggatagcactgtgctggacctcaggggcatcgggcaggtgctgcccacgcacttgatggaagagcgcttgattcgacaacagcaggaaatggaagaggaccagcgatggctggaaaaggaggagcgcttcctgaagccggatgtgcggttaagccgaggctctatcgaccgcgaggacggcagtttgcagggcccaatcgggaaccagcacatataccagccagtgggcaagcctgacccagccgccccccccaagaaacctccccgccccggtgcaccgggccatctgggcagcctggcaagtttgtcatcgcctgccgacagctacaacgagggggtcaaattacagccgcaagaaatttccccgcctcccacagccaacttggacaggtcaaacgacaaagtctatgagaacgtcaccggcttggtaaaggcagtcatcgagatgagttctaagatccagcctgctccaccggaggaatacgttcccatggtcaaagaggtcggcttggcccttagaacactgttggccaccgtggatgagaccatacctctgctacccgcgtctacccaccgggaaattgagatggcccaaaagctgttgaacagtgacctcggcgaactgataaacaagatgaaactggcccaacaatacgttatgacaagcctgcaacaggagtataagaagcagatgcttaccgccgcccatgcgctcgctgtggatgccaagaatctgctggacgtaatcgaccaggccaggcttaaaatgctggggcagactcgccctcactag

SEQ ID NO: 16932 - DNA, 354 bp, Artificial Sequence
  Description of Artificial Sequence: Synthetic coding sequence
atggccgccgcctatctggacccaaacctcaaccacacccctaactcttcaacaaaaacccacctggggactggcatggaacgcagccctggggccatggaacgtgtgctgaaggtgtttcactatttcgaatccaattccgaacctacaacctgggcttccattatccggcatggtgatgccactgatgttcgggggatcatccagaaaatcgtcgacagccacaaagtaaagcacgtggcctgctacggctttcgcttatctcaccttcgatcagaagaagtgcactggttgcatgtggacatgggagtaagctccgtcagggaaaaatacgaactcgctcaccctccctag

SEQ ID NO: 16933 - DNA, 471 bp, Artificial Sequence
  Description of Artificial Sequence: Synthetic coding sequence
atggccgccgcttaccttgacccaaacctcaaccacaccccgaacagctctaccaaaacccatcttggcaccgggatggagagatcccctggcgcaatggaaagagtgctcaaagtttttcactatttcgagagtaacagcgagcctacaacatgggcctctataattcgccacggcgatgccacagatgtcagagggatcatacagaagatagtcgactcacataaagtgaagcacgtggcatgctatggctttagactaagccacctgagatctgaagaggtgcactggctccacgtggacatgggcgtcagctcagttcgggagaaatatgagctggctcatcccccagaggaatggaagtatgagctcaggatacgctatctccccaaaggattcctgaaccaatttacagaagataagcctacactgaacttcttctaccagcaggtaaagtccgactatatgtag

SEQ ID NO: 16934 - DNA, 3159 bp, Artificial Sequence
  Description of Artificial Sequence: Synthetic coding sequence
atggcagccgcctacctggatccaaatctaaaccatacgccaaatagcagcaccaagactcacctcggaaccgggatggagcggagcccaggcgcaatggagagagttctaaaggtgtttcactacttcgagtccaacagcgaacccactacctgggcatcaattatcaggcatggcgacgccaccgacgttcgcggaataatacaaaaaatcgtggactcacataaggtgaaacatgttgcatgttacggttttagattgtcccacctcaggtcagaggaggtgcattggctgcacgttgatatgggggtctcctccgtcagggagaaatacgaattggctcatcctcccgaggagtggaaatacgaactgcggatccgatacttgcccaagggattcctaaaccagtttaccgaagacaagcctacacttaacttcttctaccagcaggtgaaaagcgactacatgcttgagatcgccgaccaagtagatcaagagatagccctcaaactgggatgcttggaaataaggagaagctattgggaaatgcgggggaatgccctggagaaaaaaagtaactacgaggtgctcgaaaaggacgtaggtcttaaacgcttcttccccaagtctctccttgacagtgtcaaagctaagaccctgcggaagctgatccagcagacatttcgccagttcgccaatctgaaccgagaggagtccatactgaagtttttcgagatactcagccccgtttataggtttgacaaagaatgctttaaatgtgcactggggtcctcatggatcatctctgtggaactggcaatcggtccagaggaaggcatatcctatttaacagacaaggggtgcaatcctacacatctcgcagactttactcaggtccagaccatccagtattcaaatagtgaggataaggatcggaaaggcatgctacagctgaaaattgcaggtgcaccagaaccacttactgtaacagcgccaagtctgactatagccgaaaatatggctgaccttattgacgggtactgtcggctggtgaatggaactagccagtcttttatcattcggccccagaaggagggagagagggctctcccttcaattcctaagctggcaaattctgagaagcagggaatgaggacccacgcggtgagtgtaagcgaaactgacgactatgctgaaattattgatgaagaggacacttacaccatgccgagtactcgagattacgaaatccagcgagaacgaatcgagctgggacgctgcattggggaggggcagtttggggacgttcaccagggcatatacatgtctccggaaaatcccgctctggcagttgcaattaaaacatgtaaaaactgcactagtgatagcgttagagaaaagtttctccaggaggcactgaccatgaggcaattcgaccacccccacattgtcaaacttatcggagtgattaccgaaaatcccgtctggatcatcatggaactctgcacactgggcgaactccgcagctttctccaggttcgaaaatatagcctggacctggcgtcgctgattctttatgcttaccagctctctacggcccttgcctatctggagagcaagcggttcgtgcatcgggacatagccgctcgcaacgtgcttgtctcatccaatgactgtgttaagctgggcgatttcggcctgtctagatacatggaggacagcacttattacaaggccagcaagggcaaattacccataaaatggatggctccagaatccatcaactttcggcggtttacttccgccagtgatgtgtggatgttcggcgtctgtatgtgggagattttgatgcacggtgttaagcccttccagggggtaaagaataacgatgtaatcggcaggatcgaaaatggcgaacgccttcctatgcctcctaattgcccgccaaccctttacagcctgatgacaaagtgctgggcttatgacccatctcggcgaccccggtttactgagctgaaggcccagctgtctactatcctggaagaggaaaaggcccagcaggaggagagaatgcgcatggagtcaagacggcaggcaaccgtctcatgggatagcggggggtcggatgaggcccccccaaagccatcgcggcccggctatccctcccctaggagtagcgagggtttttacccaagcccccagcacatggtccagacaaatcactaccaggtttctgggtatccggggagccatggtatcactgcaatggctggtagcatatatcccggccaggcttcattgttggatcagaccgactcatggaaccacaggccacaggaaatcgctatgtggcagcccaacgtcgaggatagtaccgtgctggacctgcgaggaatcgggcaagttctgcccactcacctgatggaggaaaggttgatacgccaacaacaggagatggaggaggaccagaggtggttggagaaggaagagcggttcttgaagcccgacgttcggctgtcgagaggatccattgaccgggaagacggctccctgcagggtccgattggaaaccagcacatctaccaacctgtgggaaagcctgatcctgccgccccccccaaaaagccgcctaggccaggtgccccaggacacttaggctcccttgctagtttatctagccctgccgacagctacaatgagggcgtaaaactccagcctcaggaaattagccccccacccacagccaatctcgataggagcaatgacaaagtatatgagaatgtaaccggcttggtcaaggccgtgattgagatgtcctcaaagattcagccagctccccctgaggagtacgtcccaatggtaaaggaggtcgggctggcattaaggactcttctggctacggtggacgaaaccatccccctgcttcccgcatctacccaccgagaaatcgagatggcccagaaactcctgaatagtgaccttggtgaactgatcaataagatgaagcttgcacagcagtacgttatgaccagcttacagcaagaatataagaagcagatgctaaccgcggcacacgcactcgcagtggacgccaaaaatctactggatgttatagatcaggcaaggctcaaaatgctgggccagacacggccccactag

SEQ ID NO: 16935 - DNA, 198 bp, Artificial Sequence
  Description of Artificial Sequence: Synthetic coding sequence
atggccgccgcctaccttgaccccaacctgaatcatacgcctaattcctctactaagactcacctggggaccggcatggagcgatccccaggcgcaatggaaagagtgctgaaggtgttccactacttcgagtctaacagtgaaccaacaacctgggctagcattatccgtcacggggacgctaccgatgtgagatag

SEQ ID NO: 16936 - DNA, 324 bp, Artificial Sequence
  Description of Artificial Sequence: Synthetic coding sequence
atggccgctgcttatttagaccctaatctaaatcacactcccaatagcagcactaagacacacctcggcacgggtatggaacgcagccctggggctatggagagagtactgaaagtctttcattattttgagagcaacagcgagccaacgacatgggccagtatcatcaggcatggggacgccacagatgtgaggggaattattcagaagattgtcgactcgcacaaagtgaagcatgtggcctgttatggatttagattatcacacttgagatccgaagaagtgcactggcttcatgtggatatgggggttagctctgtgtag

SEQ ID NO: 16937 - DNA, 360 bp, Artificial Sequence
  Description of Artificial Sequence: Synthetic coding sequence
atggccgctgcttatctcgaccccaatctgaaccacactccaaacagtagcaccaagactcatctgggaaccggaatggaacgttccccaggggcaatggagagagtactcaaagtgtttcactattttgaatctaatagtgagcctactacatgggccagcattattcgccacggtgacgccactgatgtaagagggattatccagaaaattgttgacagtcataaggtgaaacacgtcgcctgttacggattcaggttaagccatctgagatctgaagaggtgcactggctgcacgtcgatatgggggtctcatcagtacgtgaaaaatacgagttggctcatccaccagaggaatag

SEQ ID NO: 16938 - DNA, 2262 bp, Artificial Sequence
  Description of Artificial Sequence: Synthetic coding sequence
gccgagaacatggccgacctcatcgacgggtactgtagactcgttaacgggacaagtcagagctttattattcgcccacaaaaggagggggagcgcgccctgccaagtatccccaagctcgcaaactcagagaaacaggggatgcggacccacgccgtatcagtttcgggggtgagccattgccagcacaaggtgaagaaggcaagaagattcctgccactcgtcttctgctctcacgatccaccttctacagatgagatctcaggcgacgaaaccgacgattacgctgaaatcatcgatgaagaggatacttacaccatgccaagtacccgggattatgagatacagagagagaggatcgaactgggccggtgtattggggaaggacagtttggtgacgtccatcagggaatttacatgagccctgaaaacccagcgttggccgtggccattaagacctgtaaaaactgcacatctgactctgtgagagaaaaatttctccaggaggcattaaccatgcggcaattcgatcatccacatattgtcaagttgattggagtgattactgagaacccagtttggataatcatggaactctgcaccctcggggagctgagatcgttccttcaggttcgaaaatactcgctggacctggcctcacttatcctctatgcctaccagctttccaccgcactggcatacctcgaatccaagagattcgtccaccgcgatattgcagccagaaacgtgctcgtcagctctaacgactgcgtgaagctgggggacttcggtctctcaaggtatatggaagactcaacctattacaaagcttctaagggaaagctccccattaagtggatggcgcccgagtctatcaacttcaggaggttcacaagcgcttccgacgtttggatgttcggagtttgcatgtgggaaatactgatgcacggcgttaaaccatttcaaggagtgaaaaacaacgatgtaattggacgtatcgagaatggggaaaggttacccatgcccccgaattgtcctcctaccctttattccctgatgaccaagtgttgggcctacgacccttctagacgtcctcgttttactgagttaaaggcccagctttcgacaatccttgaggaagaaaaagctcaacaggaagagcgcatgaggatggagagtcgacgccaggccaccgtgtcctgggatagcggtggctctgacgaagcgcccccgaaacccagccgtccaggctaccccagtcctaggtcttcagagggattttatcccagccctcagcacatggtccaaacaaatcattatcaggtgtcagggtacccaggtagtcacggtattaccgccatggccggctccatctatccaggccaggcttctctgctggatcagactgacagttggaaccatagaccacaggagatcgccatgtggcagcccaatgtagaggactccacggttctcgatctgagaggcattgggcaagtgctccccactcatctgatggaggagaggctcatacgacagcaacaggaaatggaggaggatcagcgatggttggaaaaggaagaacgcttcctgaagcccgatgttaggctatctcgcgggtcgatagatcgggaggacgggtcgctgcagggaccaatcgggaaccaacacatttatcagcctgtcggaaagccagaccccgccgcaccccccaagaaacccccacgcccgggcgcccctggtcatcttggatcattagcctcactcagctccccggctgactcgtacaacgaaggggtgaaaccatggcgccttcagccacaggagatttcaccaccccctaccgctaatttggatcgctccaacgataaagtttatgagaatgtgactgggttggtcaaggctgtcattgagatgagttcaaagattcagcctgcgccaccagaggagtatgtacccatggtgaaggaggtcggcttagccttaagaactctgcttgctacggtggatgagaccatccccctattgcctgcaagcacccaccgcgaaatagaaatggcacagaaactactgaactcagaccttggtgagctcatcaataagatgaaactcgcccagcagtatgtgatgacctcacttcagcaagagtataaaaaacagatgctgacagcagcgcacgcactggctgttgatgccaaaaacctcctcgatgttattgaccaggctcgacttaaaatgttaggccaaacgaggccgcattag

SEQ ID NO: 16939 - DNA, 3159 bp, Artificial Sequence
  Description of Artificial Sequence: Synthetic coding sequence
atggcagccgcctatcttgacccaaacctcaaccacacacctaatagttccactaagacgcaccttggcaccggtatggagcgaagtccgggggccatggagcgcgttctgaaggtattccactattttgagagtaactcagaaccaaccacttgggcctcaatcattcggcatggcgatgcgaccgacgtgcgaggaatcattcagaagattgtggattcccacaaagttaagcacgtcgcatgctatgggttccgactcagtcatctccgatcagaggaggtgcattggcttcacgtggacatgggcgtgtcaagcgtccgggaaaagtacgaactcgcccaccccccggaggaatggaagtacgaactgagaatcagatacctgcccaaaggttttctcaatcagttcacggaagacaaacctactctgaacttcttctaccagcaggtcaaaagcgactatatgctcgaaattgcagaccaagttgaccaggagatcgccctgaagctgggctgtctcgagattagacgctcttactgggagatgagagggaatgcccttgagaaaaagtctaactacgaggttctggagaaagacgtgggcctgaaacggttttttcctaagtccttgttagactccgtgaaggccaagacgctcagaaaactcattcagcaaacgttccggcagttcgctaatctcaacagggaagagagcattctgaaattcttcgaaattcttagtccagtctacaggttcgacaaagagtgttttaagtgcgctctcggctcttcctggattatcagtgttgaattggcgatcggccccgaagaaggaatttcatatcttacagacaagggatgtaaccctactcatttagctgacttcacccaggtgcagaccattcagtacagcaactcagaagacaaggacagaaagggaatgctgcagcttaagatcgctggcgctcccgaaccgctgacagttaccgccccctccctgacaattgctgaaaatatggcagacctgatagacggatactgtaggctggttaacggaactagtcagtcttttattattaggccccagaaggagggtgaacgggcactgccaagcatccccaagctcgctaattcagaaaaacagggaatgagaacccacgcggtgtccgtgtctgagactgacgattatgccgaaattattgatgaggaagacacatacactatgccctccacacgtgactatgagattcagagagagcgcatcgagctcggcaggtgcattggcgaggggcaattcggggatgtgcatcaggggatttatatgtctcccgagaatcctgccctcgcagtggccatcaagacatgcaagaactgcacctcagattcagtgcgtgaaaagtttctccaggaggcccttaccatgagacagtttgatcatccccacatcgttaaattgatcggggttataactgagaaccctgtttggatcatcatggaactgtgcactcttggtgagctaaggagttttttacaggtcagaaagtactccctggaccttgcttcgctgatactttacgcataccagctctcgacagctctcgcctatttagagagcaagagattcgtccatcgggatattgccgcgagaaatgtccttgtctcaagtaatgattgtgtgaagctcggcgacttcgggctatcccggtatatggaagactctacatactataaagcctccaaaggcaaactccccatcaagtggatggccccggaaagtatcaattttagacggtttacatcggcttctgatgtttggatgttcggcgtgtgcatgtgggaaatactgatgcacggtgttaagccctttcagggcgtgaaaaacaatgacgtgattggccgcattgaaaatggtgagagactccccatgccccccaactgcccacctactctgtactccctgatgacaaaatgctgggcatacgatccatcccgccgccctcggtttaccgaattaaaagcccaactctctaccatattggaggaggagaaagcccagcaggaggagcgtatgcgaatggaatctcgtcgacaggcaacagtatcctgggacagcggcgggagcgacgaagctccaccaaagcccagcaggccgggatatccctctccccggtcctcagagggcttctacccatcacctcagcacatggtccagacaaaccactaccaggtgagtggatatccggggagtcatggaatcaccgctatggcaggatccatctaccctggtcaagcgagcctgctcgaccagactgactcctggaaccaccgtcctcaggaaatcgcaatgtggcagcccaacgtcgaagatagtaccgtgcttgacctccggggcatcgggcaagtgcttcctacccacctaatggaggagagactgatcagacagcaacaggagatggaggaggatcagaggtggctggagaaagaggaacgctttctgaagcccgatgtgcggctttctaggggtagcattgaccgggaagatgggtctctgcaaggcccaatcgggaaccagcacatctatcagcctgtgggcaaacccgatcctgccgcacctccaaagaaacctccccgaccgggcgccccgggacatctgggcagtctggcctctctgagctccccagccgactcttacaacgaaggcgtcaagctgcagccacaggagatcagcccgcctcctaccgcaaatctggacagaagcaatgacaaagtttatgaaaacgtaaccggattagtcaaagccgttatcgagatgtctagtaaaatccagccagcacctcctgaagaatacgtccccatggtaaaagaggtggggctcgctcttagaacccttcttgcaaccgtggatgagacgattcccctgctgcccgcctctacgcatcgtgagatcgagatggctcagaagctgctgaactccgacctgggagagctaattaataaaatgaagttagcacagcaatacgtcatgacaagcctgcagcaggaatataaaaaacaaatgcttaccgcagcccacgctctcgccgtcgacgccaagaatctgctggacgtgatagaccaggcacgcctgaaaatgttgggccagactaggccacactag

SEQ ID NO: 16940 - DNA, 2175 bp, Artificial Sequence
  Description of Artificial Sequence: Synthetic coding sequence
attgctgagaacatggcagaccttatcgatgggtattgccggcttgtaaatggcacctctcaatcatttatcatcagacctcagaaagagggagaacgggcccttccatccattcctaagctcgcaaacagcgagaaacagggcatgcggacccacgccgtgagcgtatcggaaaccgatgattacgccgaaatcattgatgaggaagacacctacacaatgccttcgaagtcttacgggatagacgaggccagagactatgagatacagcgtgaacgcattgagttgggaaggtgcatcggagaggggcagttcggtgacgtgcatcagggaatttatatgagcccggagaaccctgccctggcggtcgctataaagacctgcaagaactgcaccagtgattccgttagagaaaaatttcttcaggaagcactcaccatgcgccagttcgaccaccctcacatcgtcaagcttattggtgtcatcaccgagaacccagtgtggattatcatggagctgtgcaccttaggcgagctacgctccttcctccaggtaagaaaatacagcctcgacctggcaagtctcattctttacgcatatcagctgagtacagcccttgcctatttggagtcaaaacggttcgtacaccgtgatatcgcggccaggaacgtgctcgtttcgtcgaacgactgtgtcaaactcggcgatttcggtctgtcgcggtatatggaggactctacatactataaagcatccaaggggaaactgcccatcaagtggatggcccctgaatcgatcaactttcggcggttcaccagtgcatccgatgtgtggatgttcggggtgtgtatgtgggaaatactgatgcacggcgtgaaaccttttcagggcgtgaagaacaatgatgtaattgggagaattgaaaatggcgagagactgcccatgcctcccaactgtccacctacactgtactcccttatgacaaagtgctgggcctacgacccgagcaggcgaccaagattcacagaactgaaggcccaactgtccactatcctcgaggaagagaaagcacagcaagaggagcggatgaggatggaatctcgccggcaagccactgtttcctgggacagtggcggctccgacgaagctcctcccaagccatcccggcccggatatccgagcccccggtccagcgaaggattctaccccagcccccaacatatggttcaaacgaaccactatcaggtgtctggatatccggggtcccatgggatcacagcaatggctggctccatttatcctgggcaggcctccctgttggaccagaccgactcttggaatcaccgtcctcaggagatcgcgatgtggcagcccaatgtggaggacagtaccgttttggatctccggggcattggccaggttcttccgactcacctcatggaagagcggctgatcagacaacagcaggagatggaagaggaccagcgctggctcgaaaaggaagaacgcttccttaagcccgatgttagactttccaggggctctatagacagagaggatggcagcctgcagggtccaatcgggaaccagcatatctatcagccagtgggtaagccagaccccgcagccccccccaaaaaaccccctaggcctggggcacccggacatttgggatctctcgccagtttgagtagcccagccgacagctacaacgagggcgttaaactccaaccacaagagatttcacctcctcctacagctaatttagacagaagcaatgataaagtgtacgaaaatgtgacagggctggttaaagccgtgattgaaatgtcaagtaaaatccaacccgccccccccgaagagtacgtgcctatggtgaaagaagtcgggctcgccctgcggactctgctcgcaaccgtggacgaaacaattcccttacttccagcatcgacacacagggaaatagaaatggcgcagaagctgctgaattcagacttgggtgagctcataaataagatgaagctggcccagcaatacgtcatgacttccttacagcaggaatacaaaaaacaaatgcttaccgcagcgcatgcactggctgtcgacgcaaagaatctccttgacgttatcgaccaggccagactcaagatgttgggtcaaacgcgaccacactag

SEQ ID NO: 16941 - DNA, 363 bp, Artificial Sequence
  Description of Artificial Sequence: Synthetic coding sequence
atggccgctgcttacctggaccccaacctcaaccacacaccgaattcttctacaaaaacccacctggggaccgggatggaacgctccccaggggctatggagcgtgttttaaaagtctttcactattttgaatcaaactccgaacccaccacctgggcatcaataatccggcacggcgacgctacggacgtcaggggcatcatccagaagatcgtagactcgcacaaagtgaaacacgtggcctgttacggcttcaggcttagccatctccgaagtgaagaggtgcactggctccatgtcgatatgggggtctcctcagtcagggagaagtacgagctggcacatcctccagaagaatggtag

SEQ ID NO: 16942 - DNA, 156 bp, Artificial Sequence
  Description of Artificial Sequence: Synthetic coding sequence
atggccgctgcctatctggatccaaatctaaaccacacaccaaactccagcacaaaaacccaccttggcactggtatggagcggagtccgggcgctatggagagagttctgaaggtcttccactacttcgaaagcaactctgagccaactacatag

SEQ ID NO: 16943 - DNA, 3021 bp, Artificial Sequence
  Description of Artificial Sequence: Synthetic coding sequence
atggcagccgcctacttagatcccaacctgaatcacacacccaattctagtaccaagacccatctgggtaccggtatggagcgatcaccgggcgctatggaaagagtactgaaggtatttcactacttcgagagcaacagcgaaccaacgacctgggcctccatcatcagacacggcgatgctacagatgtgagaggaattatccagaagatcgtcgattcccacaaggtgaaacacgtggcctgctacgggttccggctctctcacctccgttctgaggaggtccactggcttcatgtggacatgggcgtgtcatctgtgagagagaagtacgaacttgcccatccaccagaggagtggaaatatgagcttagaattcggtacctccctaaaggattcctgaatcagttcacagaagataagcctaccctgaattttttctaccaacaggtgaagtcggattatatgctcgaaattgccgaccaagtggaccaggagatcgctttaaaactgggttgcctagaaattaggcgaagctactgggagatgagggggaatgcgttggaaaaaaagtccaactacgaagtgctggaaaaggacgttggcctcaaaaggtttttccctaaatctcttttggacagcgtcaaagccaagaccttaagaaaactgattcaacaaacattcaggcagttcgcaaacctaaaccgcgaagagtcaatcctgaagttttttgaaatactgagccctgtgtaccgctttgacaaagaatgtttcaagtgcgcactggggagttcttggatcattagcgtggagttggcgattggcccggaagagggaatttcctacctgaccgataagggctgtaaccctacacacctcgccgactttacccaggtgcaaactatccagtactctaatagcgaagacaaggaccgaaaggggatgctgcaactgaagattgccggagctcccgaacccctcaccgttactgctcccagccttactattgctgagaatatggccgatctgattgatggatattgtcgcctggtgaatgggaccagccaatccttcatcatccgtccccagaaggaaggcgagcgggctttaccgagcattcccaagctggccaattccgagaagcagggcatgcgtacccacgctgtctcagtatctgaaaccgacgattatgccgagatcatcgacgaagaagacacctatacaatgcctagcacacgggactacgagatccagagggagcgaatcgagttgggtcgatgcatcggtgagggacaatttggtgacgtgcaccagggcatctatatgtccccagagaatcccgccctcgctgtggctatcaagacttgtaagaattgtacatctgactctgtcagagaaaagttccttcaggaggctctaaccatgcgtcaatttgaccatccccacatcgttaagctcatcggcgtcattaccgagaaccccgtgtggatcatcatggaactgtgcactctcggagaacttagaagttttttgcaagtgcggaagtattcccttgaccttgcatcacttattttatacgcctatcagttgtctacagccctggcatacttagaatcaaaaaggtttgtccatagggatattgccgcccgtaacgtgttggtgagctcaaacgactgcgtcaaactgggagacttcgggctgagcagatatatggaggactcaacctactataaggcctccaagggaaaactgcccattaagtggatggccccagaaagcataaactttcggcgtttcacctccgcctccgatgtgtggatgtttggggtctgcatgtgggaaatcctgatgcatggagtcaagccattccagggggtgaaaaataacgatgtcatcggccgaatcgaaaacggggaaaggttgcctatgccacctaactgtcctcctaccctgtatagtcttatgacaaaatgttgggcttatgatccttcacgtagacctcggttcactgagctgaaagcacaactgtcaacgatcctcgaggaggaaaaggcacaacaagaggagcggatgaggatggaatcccgacgtcaggccactgtgtcatgggatagcggtggcagtgacgaagcccctcccaaaccttcccgccctggttacccctccccccggtccagcgaaggtttctatccctccccgcagcatatggttcagactaatcattatcaggatagtacagtccttgaccttagaggcattggacaggtcctacccactcacctcatggaggaacgtcttattcgccagcagcaggagatggaagaggaccagagatggctggagaaagaggagcgttttcttaagcccgacgtgaggctctccaggggcagtattgaccgggaggacggatcgctgcaaggacccattggcaatcagcacatctatcaacctgttggtaaacccgatcccgccgcccccccaaaaaaacccccaaggccaggcgcgcccggccatttgggctccctggcctctctctcctcacccgctgactcctataacgaaggggtgaagctgcaaccccaggaaataagtccaccgccaaccgctaaccttgacaggtctaatgacaaagtatacgaaaacgttaccggattggtaaaggcagtcatcgagatgagctcgaaaattcagcccgctcctcctgaagagtacgttccaatggtgaaagaggtcgggttagctttgaggaccctgttggctacggtcgacgaaaccattccactcctgcccgcctcaactcatagagagatcgagatggcacaaaaattgctcaatagcgaccttggcgaactgatcaacaagatgaaactcgcccagcagtacgtgatgacgtcactgcaacaagagtataagaagcagatgcttaccgctgctcacgcactggccgtggacgcgaagaatctgctggatgtcatcgatcaggcaaggctgaagatgctcgggcagaccagaccgcattag

SEQ ID NO: 16944 - DNA, 2163 bp, Artificial Sequence
  Description of Artificial Sequence: Synthetic coding sequence
atggcagatcttatagatggctattgtaggctggtgaacggtaccagccagtcctttatcatccggccacaaaaagagggggagagagccctgccgtcaatcccaaagctggcaaacagcgagaagcagggcatgcggacacatgcagtttccgtgtctgaaacagatgactacgcagagatcatcgacgaggaggatacgtacacaatgccttctaaatcttacggaatcgatgaggcgcgagattatgagatccagcgggagcggatagaactgggaagatgcattggagaagggcagttcggcgatgtgcaccagggaatctacatgtcccccgaaaacccagccttagcagtcgcaatcaagacctgcaagaattgcacctcggattctgttagggagaagttccttcaggaagccttgacaatgcgtcagttcgaccatccccatattgttaaattaattggagtcataacagaaaatcccgtatggatcatcatggagctatgcacacttggagagctgcgctctttcctccaggtcaggaagtattctctggacctggcctcgctaatactctatgcttatcagctgtctacagctcttgcctacctggaatctaagcggtttgtgcacagagacattgcagcccggaatgttctcgtgagcagtaacgactgcgttaagttgggtgacttcggcttaagccgatacatggaggactccacttactataaggcgtccaagggaaaattgcccattaagtggatggctccagaaagtataaactttaggcggtttacctccgcatccgacgtttggatgttcggtgtgtgtatgtgggagatactgatgcacggggtgaagccatttcagggtgtgaagaacaacgacgtgattggacgcatcgaaaatggcgagagacttccgatgcccccaaactgtcctcctacgttgtactcactcatgacgaaatgttgggcttatgatccttccagacggcctaggttcaccgaattgaaagcacagttatccactattctagaggaggagaaggcacagcaggaagaaaggatgagaatggagagtcgcaggcaggccactgtgtcctgggattctggcggctccgatgaagcccctcctaaacccagccgccccggttaccctagcccaaggtcttctgaggggttctacccctcgcctcaacatatggtgcagaccaatcattaccaggttagtggatatcccgggtcccacgggatcacagccatggctggcagcatttatcctggacaggcctcactcctagatcagacagactcttggaatcaccggccacaggaaatcgccatgtggcagcccaacgttgaagacagcacggtgctagacttgaggggcatcggtcaggtcttgcccacccacctgatggaggagaggctgatccgccagcagcaggagatggaagaggaccaacgttggttagagaaggaggagagatttctgaagccggatgtgagattgtctcggggatccatagacagggaggacgggtctctgcaaggaccaattggtaaccagcacatctatcaacccgtggggaagcccgaccccgctgccccacctaaaaaacccccacgcccaggcgcaccaggccacctgggctctctcgcaagtctgagttcccccgccgacagctacaacgaaggtgttaaactccagccccaggagatctcacctccccctaccgcaaatctcgatagaagcaacgacaaggtgtacgagaatgttacaggcctggtcaaagccgtcatcgagatgtcaagcaaaatccagcctgccccaccagaggagtacgtgcctatggtgaaggaagtgggtctggctctaaggacgctactggctaccgtcgatgaaacaattccgctcctcccagcaagcactcatagagagattgaaatggcccagaagctcctcaacagcgatctgggagaattgattaacaaaatgaaattggctcaacagtatgtgatgacttccctgcaacaggagtataagaagcagatgctcacagccgcacacgcccttgccgtggatgcaaagaatctgctcgatgttattgatcaagccaggctgaaaatgcttgggcagacacgcccccattag

SEQ ID NO: 16945 - DNA, 3198 bp, Artificial Sequence
  Description of Artificial Sequence: Synthetic coding sequence
atggctgcagcatatctcgaccctaacctgaaccataccccaaattcttcaacaaagacacacttgggcactggcatggagcgatctcccggtgccatggaacgtgtgctgaaagtattccactacttcgaatcgaactccgaaccaaccacttgggcatctataatcaggcacggggacgccacagacgtacgaggcattattcagaagatcgtggactctcataaagtgaagcatgttgcttgttacggatttcgtctcagccaccttcgcagtgaagaggtacactggctgcacgtggacatgggagtctcctcagtgagggagaaatacgagctcgcacatcccccggaggaatggaaatacgaattacggataaggtacttgcctaagggcttcctcaatcagtttaccgaagataaacccacacttaatttcttttatcaacaggtaaaatccgactacatgctggaaattgccgaccaggtggatcaggagattgctctgaagctcggctgcctggagattcggcgttcttattgggagatgcggggaaacgcactggagaagaagtcaaattacgaagtcctggagaaggacgtgggactgaagcgcttctttcccaagtccctcctggactctgtcaaggccaaaaccttgcgaaagcttattcagcaaacttttaggcaatttgctaatctgaacagggaggagtctatcctaaaattttttgaaatcctgagtcccgtgtacaggtttgacaaggagtgttttaaatgtgctctgggcagctcatggatcatctccgtagaactggctattggcccggaggaaggaatctcctatctcaccgataaaggttgcaatccaactcatctagccgatttcacccaagtgcagacaatccaatacagtaattcggaagataaagacagaaagggcatgctgcaacttaagatagctggtgcccccgagcccctcaccgttacagcacccagtctgaccattgcagagaatatggccgatctaatcgacggctactgccggctggttaatggaaccagccaatcgttcataataaggccacaaaaggaaggagagagggccctacctagcattcctaagcttgcaaattcagagaagcagggaatgagaacccacgctgtctcggtctctgaaactgatgattatgctgaaatcatagacgaggaggacacctacacaatgccctcaacacgtgactatgaaatccagcgcgagcggatcgagctcggacggtgcattggggagggccagttcggtgatgtgcatcagggcatctatatgagcccagagaacccagcccttgctgtcgctattaagacatgtaaaaactgcacttccgactccgtgagggaaaagttcttgcaggaggcgctcacaatgcgacaatttgaccatccccatattgtgaagcttataggggtgatcaccgagaaccccgtgtggatcataatggagctgtgcactttgggtgagctgcggagttttttacaggtgcgaaaatactccctggacctggccagcctgatactgtatgcctaccagttgtccactgcactcgcctatctggagtccaaacggtttgttcaccgggatatagctgctagaaacgttctggtaagctctaacgattgcgtgaagttgggcgatttcggcctctcacgatacatggaggattctacatactataaagcatcgaaggggaagctgccgattaagtggatggcccctgaaagtattaattttcggcgttttaccagtgcatccgacgtctggatgtttggcgtctgcatgtgggagattctcatgcacggcgtgaaaccttttcagggggttaaaaataacgatgtcattggccgaatcgaaaatggtgagaggctgcctatgccccccaattgcccccctacattatacagtcttatgaccaaatgctgggcttatgaccctagcaggcgccctcgtttcacagaattgaaagcacagctgagtaccatcctcgaggaagagaaggctcaacaggaggagagaatgcgtatggagtcacgacggcaagcaacggtctcctgggatagtggcgggtcggatgaggctccgcccaaaccgtcacgccctggttatccctccccgcggtctagtgaagggttttacccaagcccacaacatatggttcagaccaaccactaccaagtgtccggatacccagggtcacacgggatcacagctatggctggctctatataccccggacaggctagtcttctggatcagacggacagttggaatcatcgcccccaagaaattgctatgtggcagccaaatgttgaggattctaccgttttagacctgagaggcataggacaggtgttacccacacacttgatggaggagcgcctaatccgacagcagcaagaaatggaagaagaccaaaggtggttagagaaagaggaacgattcctgaagcccgatgtaagactttcacggggctcaattgatcgggaagacggcagcctgcagggccccattgggaatcagcacatttaccagccagtgggaaagccgggaaaggaggaaaagaattgggctgaacgcaatcccgccgcgcccccaaagaagccgcctagacctggcgcacctggacatctgggatccctggcaagcctgtcttctcccgccgactcttacaatgaaggtgtcaaaccgtggcgactgcagccacaggaaatctccccacccccaacagctaaccttgatcgctctaacgataaggtctacgaaaacgtgacaggtctggtcaaagccgtgattgaaatgtcaagcaagatacaacctgcccctccagaagagtacgttccaatggtgaaggaggtgggactagctttgagaacactgctagctaccgtcgatgagaccatacccctgttgcccgcttcgacgcaccgagagattgagatggctcagaagctgctgaactccgacttgggagaactgatcaacaaaatgaagttggctcagcagtacgtgatgacctcccttcagcaagaatacaaaaagcagatgctgaccgctgcccacgcactggccgtggatgcaaaaaatttgctggatgtgattgatcaggcacggctaaagatgcttgggcagaccagaccacactag

SEQ ID NO: 16946 - DNA, 2904 bp, Artificial Sequence
  Description of Artificial Sequence: Synthetic coding sequence
atgtccggagtctccgaacctcttagtcgggtgaaattagggacccttagaaggccagaagggccagcagaacctatggttgtggtgccagtcgatgtggaaaaagaggacgttaggattctcaaggtatgcttttacagtaattcctttaatcctggcaaaaattttaaactggttaagtgcacagtgcagactgagattcgcgagatcataacctcgatactactcagcggcaggattgggcccaatatccgactcgctgagtgctatggactgcgattgaaacatatgaagtccgacgagatccactggctgcatcctcagatgactgtgggcgaagttcaggacaagtacgaatgcctacacgtagaggcagagtggcgctacgatcttcaaatccgctatctacctgaggacttcatggagtcacttaaagaggaccgcacaacgcttctctatttttatcaacagctgcggaacgactatatgcagagatacgcgagtaaggtctccgagggcatggctctacaattgggttgcctcgaattaaggagattctttaaagatatgccccataacgccctggacaaaaagtcaaactttgagctcctggagaaagaggtgggccttgacctgtttttccccaaacaaatgcaagaaaacttaaagccaaagcagttccggaagatgatacagcagacatttcagcaatatgcttcactgcgggaagaggagtgtgttatgaagttcttcaataccctggccggcttcgctaacattgaccaggaaacctatcggtgcgagctcatccagggatggaatattactgtggacctggtgataggaccgaaaggcattaggcagctgaccagccaggacgccaaacctacatgccttgcagaatttaagcagatcagaagtataaggtgcctgccacttgaggagggacaggctgtactgcagctgggaattgagggcgccccgcaagcgctgagcattaagacaagtagcctagcagaagctgaaaacatggcggatctgatcgatgggtactgtaggcttcagggcgagcaccagggcagccttataatccaccccagaaaagacggagagaagaggaactcactacctcaaattcctatgctcaacctcgaggcaagacggagtcacttaagcgagagctgcagtatcgagtctgacatttatgccgagatccctgacgagaccctgcgacgtcctgggggcccccagtatggtatcgctagagaagacgttgtccttaatcgcatcttgggggaggggttctttggggaggtttacgagggggtctataccaaccataaaggagagaaaattaacgtcgccgtcaagacatgtaagaaggattgcaccctggacaacaaagagaagttcatgagcgaggccgtcatcatgaaaaatcttgatcacccgcatatcgttaagttaattggaataattgaggaggagcctacatggatcatcatggagctttacccgtacggtgaactgggacactatttagagcggaacaagaactctctgaaagtgctgaccctggtgctatactccctgcagatttgcaaggctatggcatatctcgaatcaatcaattgcgtgcacagagatatcgccgtgagaaatatactggtggccagtccagagtgcgtgaagttgggcgatttcggtctctcccgctacatcgaggacgaagactactataaggccagcgtcacccgcctgcccataaagtggatgtctcccgaatctatcaacttccgccgtttcaccacagcctccgatgtttggatgtttgccgtttgcatgtgggaaatactttctttcggcaagcagccatttttttggctggagaacaaggacgtcatcggcgtcctggagaagggcgatagactccctaagcccgatctttgcccaccagtgctgtatacgttgatgacccgctgctgggattacgacccgagcgacagacccaggtttacagagctcgtttgtagtctatcggacgtgtatcagatggaaaaagacattgcaatggaacaagagcggaatgctcggtacaggaccccgaagatcttagagccaacagctttccaggagcccccaccaaaaccatcacgtcccaagtatcgcccccctcctcagaccaacctgctagcccccaagctccagtttcaggaagaggactttattcagccatcttcaagggaggaagctcagcaactgtgggaggcggagaaagtcaagatgcgccagattttggacaaacagcagaagcagatggtggaagactaccagtggttgcggcaggaggagaaatcactggatccgatggtgtacatgaacgacaaatcccctctgacaccagaaaaggaagttggctatctggaattcaccggccctcctcagaagcccccgagactcggcgcacaaagcattcagcccactgcaaacctggatcgcactgatgaccttgtgtacctgaatgttatggaactggttagggctgttcttgagctgaaaaatgagctatgtcagttgccacccgagggctacgttgttgtggttaaaaatgtagggcttacattgcgaaagctgatcggaagtgtggatgacctgttgccttctctcccctcatcctcacgtacagagattgaaggcactcagaagctgctgaacaaggacctggctgaattaattaataagatgaggttggcgcagcagaatgcagtgacctctctctccgaagagtgcaagcgccagatgttaacagccagtcacacactcgcagttgatgcgaaaaacctgctcgatgcagtggaccaggccaaggtgctggctaatctggcacacccccccgcagaatag

SEQ ID NO: 16947 - DNA, 3030 bp, Artificial Sequence
  Description of Artificial Sequence: Synthetic coding sequence
atgtcaggcgtgagtgaacccctgagcagagtcaagctggggaccctgcgccgtcccgagggacccgctgaaccaatggtggtcgtgcccgtggatgtcgaaaaggaagatgtgagaatactaaaggtgtgcttttatagcaactcctttaacccgggcaagaatttcaagctggtgaaatgcaccgtgcagaccgaaatcagagagatcattacctccatccttctttcaggtagaatcggacctaatatcaggctcgccgaatgctacggcctgaggctgaagcacatgaagtccgatgaaatccactggttgcatccccagatgactgtgggagaggtccaagacaaatacgagtgtctgcatgtggaggctgagtggcggtacgatctgcagattaggtatcttcccgaggactttatggaatcactgaaagaggatcggacaacgcttctatatttttaccagcagctgcggaacgattacatgcagagatacgcttctaaagtcagtgaaggcatggccctgcagctgggttgcctagagttgcgcagattttttaaggatatgcctcacaatgccctggacaaaaagagcaactttgagcttcttgagaaggaggtgggtctcgaccttttcttcccgaaacagatgcaggaaaatcttaagccgaaacagttcaggaagatgatacaacagacattccaacaatacgcgtcgctgcgcgaggaggaatgtgtcatgaaattctttaacacattggccggtttcgcaaacattgaccaggagacatatcgatgcgagttgatccagggatggaatatcacagttgatctggtcattggtcctaagggtattcgccagctgacttcccaggatgcgaagccgacgtgcttggccgaattcaagcaaatccgctccatccgctgcctgcccctagaagaagggcaggccgtgcttcagcttggcatcgaaggcgctcctcaggccctctctatcaagacatcctctctggcggaggcagaaaacatggccgacctcattgatggctattgccgccttcagggggagcatcaaggatccctgatcattcacccacggaaggacggcgagaagcgcaactcccttccccagatccccatgctcaatttggaagcccgccgtagccacttatctgaatcttgttcaatcgaatctgacatctacgccgaaataccggacgagaccttgagaagaccgggtgggccacaatacggtattgcccgcgaggacgtggtccttaatagaatcctgggcgaggggttttttggtgaagtatacgagggcgtgtatactaaccacaagggggagaagatcaatgtggcagtaaagacatgtaagaaagattgtacattggacaataaagaaaagttcatgagcgaggccgttattatgaagaatctcgaccacccacatattgtcaagctgattgggattatcgaagaagaaccaacctggatcatcatggagctttatccatacggggagttggggcactatcttgagcgaaacaaaaacagcctgaaagtgctaacacttgttctgtacagtctgcagatatgcaaggcaatggcatacctcgaatctattaattgcgtccaccgtgatatcgccgtgcgtaatattctggtggccagtcccgaatgcgttaagcttggagactttggcctgagcaggtatatcgaagacgaggactattacaaggcctcagttacccgtctcccgataaaatggatgtcaccagagtcaattaacttccggcgctttacgaccgcctccgacgtgtggatgttcgccgtgtgtatgtgggagatcctgtcctttgggaaacagccatttttttggctcgaaaataaggatgtgattggggtgctggagaagggggatcgcctgcctaaacccgacctgtgcccccccgttctgtacactctcatgacccggtgctgggactacgacccgtctgaccgcccaaggtttacggaactcgtctgtagtctcagtgacgtgtaccagatggagaaagatatagccatggagcaagaacgaaacgcccgataccgtaccccaaagatcttagagcctacggcctttcaagaaccacccccaaagccctcgaggccaaaatacaggccccccccccagaccaatttactggcacccaaattgcagtttcaagtcccagagggcctttgcgcaagctctcccacactgaccagccctatggagtatccttcgcctgtgaattcactgcacacaccacctttgcaccggcataatgtgttcaaaaggcattccatgagggaagaggactttatacagccaagttctcgggaggaagcgcagcagctgtgggaagctgagaaggtcaagatgcgacagatcctggataagcagcagaagcagatggttgaggattaccaatggctaagacaggaagagaagagcctggacccgatggtttatatgaacgacaaatcccccctcacaccagagaaggaggtcggatacctggaattcaccggcccccctcaaaagcccccgagactgggggctcagtcaattcagcccacggcaaatctcgatcgaacagacgatttggtgtatttaaatgttatggagctggtcagagccgttttggagctgaaaaacgaactgtgtcaactgccccccgagggatatgtagttgtggtgaaaaatgtaggcctaaccctgcggaagctaatcggttccgttgatgacctactcccctcgctcccttcatcaagtcgaaccgaaatcgaagggacccagaagctcctcaataaggatctggccgagctcatcaataagatgcgcctcgcacaacaaaatgccgttactagcctttctgaggaatgtaaaaggcagatgctcacggctagccacacccttgcagtagacgccaagaacctgctggatgctgtggaccaagcaaaggtactggccaacctggctcatcccccagccgaatag

SEQ ID NO: 16948 - DNA, 3030 bp, Artificial Sequence
  Description of Artificial Sequence: Synthetic coding sequence
atgtctggggtgtccgaaccattgtctagggtcaaactcgggacactgagaaggcccgaaggcccagccgagcccatggtcgtggtgccagtcgatgtggagaaggaggacgtgagaatcttaaaggtatgcttctactctaactctttcaaccccggaaagaacttcaagttagtcaaatgtaccgtacaaactgaaattagggagatcatcacttctatccttctgagtggaaggattgggcccaatatccggctggctgagtgttacggcttgcggctgaagcacatgaaatctgatgagattcactggttacatccacagatgactgtcggcgaagtccaggataagtatgagtgtcttcatgtcgaggctgagtggagatacgaccttcaaataagatacttgcccgaggatttcatggaaagtctgaaggaagaccgcacgaccttgctttacttttatcaacaacttcggaacgactatatgcagagatacgccagtaaggtaagtgagggcatggctctccagctagggtgtctggaactgcgcaggttcttcaaggacatgccccacaatgcacttgataagaagtctaactttgagcttttggaaaaagaagttggtctggacttgttttttcctaagcagatgcaggagaacctgaagccaaaacagtttagaaaaatgatacaacagacttttcagcagtatgcctccctacgggaggaagagtgtgtgatgaaattttttaacacactggctggatttgctaatatcgatcaggagacttataggtgtgaactcattcagggatggaatatcacagttgatttggtaattggcccgaaggggattcggcaactgacctcccaggatgctaaacccacctgcctcgccgaattcaaacagatacggtctataagatgcttgcctttagaggagggccaggctgttttgcagctgggaatagagggcgcgccccaggctttatcaatcaagacttcaagtctcgcagaagcagagaacatggcagacctgatcgacgggtattgtcgtttgcagggagagcaccaggggtccctgattattcatcccagaaaggacggcgaaaagcgtaatagcttaccccagattccgatgttaaacctcgaggcccggcggtctcatctaagcgaatcatgcagtatagaatctgatatttacgctgagatacctgacgaaacactgagaaggccgggggggccccagtacggaatcgccagggaagacgtcgtgctgaaccggatccttggggaaggcttctttggcgaagtctatgaaggagtgtacacaaatcataagggcgagaagatcaacgtcgccgtcaagacctgcaagaaggattgcaccctcgataacaaagaaaagttcatgagcgaggcggtaattatgaagaatttagatcatccccatattgtgaagctgataggcatcatagaggaggaacctacatggatcatcatggaactctatccgtatggggagctggggcattacttggaaagaaataagaacagcctgaaggtgctcacactggtgctttattccctccaaatctgcaaggcgatggcctatctagagtctattaattgcgtacatcgcgatatagccgttagaaatatcctggtcgcctcccccgagtgtgtcaaacttggagacttcgggctgtctcgatatattgaagatgaggattactacaaggcttctgtaactaggctcccaattaaatggatgtctccggaaagtatcaattttaggcgttttaccactgcctcagatgtctggatgttcgccgtatgtatgtgggagattctgtcatttggcaagcaaccctttttttggctagagaataaagacgtgattggagtactggagaagggcgaccggctgccaaaacctgacctctgtcctcctgtgctgtacaccctgatgactaggtgttgggactacgacccttccgaccgccctagattcacagaattggtttgcagtttatcagatgtctatcagatggaaaaagacattgcaatggagcaggagcgcaatgcaagatatcggacccccaagattctggagcctaccgcctttcaggaaccaccccctaagccgagtaggcctaaatatagacccccaccccagaccaaccttctggcacccaagctacagttccaggtgccagaaggcctttgtgccagctcccccactctgacgtctccgatggagtatccctccccggttaactccctccacacaccgcccctgcatagacacaatgtgtttaagcgccattccatgcgggaagaggacttcatccagccctccagtagggaggaggcacagcagctgtgggaggctgagaaggtcaagatgagacagattctggacaaacaacagaagcagatggttgaggactaccagtggcttcgccaagaggagaaatcccttgaccctatggtgtacatgaatgacaaaagccccttaacgcctgagaaggaagttgggtacctggagttcactggcccccctcaaaagcctcctcgactgggtgcacagagcatccaacccacagcaaatttagatagaacggatgatctcgtttatctgaatgtgatggagttggtgagagctgttcttgagcttaagaatgagctctgtcagctgccacctgaagggtatgtcgtggtggttaagaatgtcggtctgaccctccgaaaactgatcggctcggtggacgacctgctgccctctttgccctcctctagtaggaccgagatagaagggacccagaagctcctgaacaaagatctggccgagcttatcaacaagatgagactggcccaacagaatgccgtgacaagtctttcagaagagtgcaagcgccagatgttgacagctagccataccctggcagtagatgctaagaacctgctcgacgccgtggaccaggccaaagtccttgccaatcttgcgcatcccccggccgagtag

SEQ ID NO: 16949 - DNA, 2904 bp, Artificial Sequence
  Description of Artificial Sequence: Synthetic coding sequence
atgtctggggtgtcagagcctctctcgcgggtaaagttaggaacgctgcgcagaccagaggggcctgctgagcccatggtagtggtacccgtggatgttgaaaaagaggacgtccggatcctgaaggtctgcttctatagtaattcctttaacccaggcaaaaactttaaattagtgaagtgtaccgttcagaccgagattagggagattattacgtctatccttctttcgggtcgaatcggacctaacattcgcctcgccgagtgttacgggctaagactgaagcatatgaagtctgacgagattcactggctccacccgcagatgaccgttggtgaagttcaggataagtacgagtgtctgcacgtggaagcagagtggaggtacgatctgcaaatccgatatctgccggaggattttatggaatccctaaaagaagataggactactctgctgtatttctaccagcagctgaggaatgattacatgcagcggtatgccagtaaggtgtctgaaggtatggctctgcagctcggctgtctcgaactgcgccgcttttttaaggatatgccgcataacgctttggataagaagagcaatttcgagctgctcgaaaaagaagtcggcctggatctgttttttccaaagcaaatgcaggaaaatttgaagccaaaacagttcagaaagatgattcagcaaacgttccagcagtatgcctcgctgagagaggaggaatgcgtgatgaaattcttcaatactttggcgggcttcgcaaacatcgatcaggaaacttacagatgtgagcttatccaagggtggaacataacagtggacctggttattgggccaaagggaattcggcaactgacttcacaggacgcaaagcccacatgtctcgcagagttcaaacagattagaagcatcagatgcctgcccctggaagagggacaggctgtcctgcagcttggtatcgagggagctccccaggccctgagcatcaagaccagctccctggccgaagccgagaacatggcggacttgatagacggctactgtagactgcagggcgagcatcagggctcacttatcatccatccaagaaaggatggcgagaagcgcaattccttaccacagatacccatgctgaacctcgaagccagaaggtctcacctgtctgagagctgttctattgagtccgacatctatgcagaaattcctgacgaaaccctgcgtcgccccggcgggcctcaatatggtatcgcccgggaggacgtcgtactaaatagaatcctgggcgaaggcttcttcggggaagtttacgaaggagtttacacgaaccacaagggagaaaaaattaatgtggcagtcaagacttgcaagaaagattgtactcttgataataaagagaaattcatgtccgaggccgtgataatgaagaatctcgatcacccccacatcgtgaagttgattggaattatcgaagaggagcctacatggatcattatggaactttatccttacggtgaattggggcattacctcgaacgcaataaaaacagcctgaaggtgctcaccttggtgttgtatagtttacaaatctgcaaggccatggcttatctggagtccattaattgcgtccacagggacattgcggtgcggaacattctagtagctagccccgagtgcgtgaaattaggggactttggcctgtccaggtacattgaagatgaagactactataaggcttctgtcacgagactgccaattaagtggatgtcacctgaatcaataaatttccgtagattcacaactgctagtgatgtctggatgtttgccgtctgtatgtgggagatcctatcctttggaaaacagccgttcttttggctggagaacaaagatgtaatcggcgtcctagagaagggcgacagactgccaaagcccgacctatgtccacccgtgttgtacaccctgatgactagatgctgggattatgatccttccgacaggcctcgctttaccgagctggtttgcagcttgagcgatgtgtaccaaatggagaaagatatcgcgatggaacaagaacgcaacgcacgttaccgaaccccaaagatattagagccaacagctttccaggaaccaccgcccaagccatcccgaccaaaataccgaccgcctccccagaccaacttgctggccccaaaactccaattccaggaagaggattttattcaaccatcctctcgggaggaagcccagcagctttgggaggccgagaaagtgaagatgcgtcaaattctggataaacagcagaagcagatggtagaagattatcaatggctacgacaggaagagaagtcattagacccaatggtgtatatgaacgacaagagtccgctgactccagaaaaagaagttggttacctggagtttacgggaccgccgcaaaaaccccctcgtctgggcgcacagagtatacagccgactgccaatcttgatcgaaccgatgacctcgtgtatctgaacgtcatggaactagtcagagcggtcctggagctgaagaatgagctttgccagcttccccccgagggctacgtggtggtcgtcaagaacgttggcctgaccctccgcaagcttataggaagcgtggatgacctccttcccagcctgcctagctcgtcaaggacagaaatcgagggcacccagaaactgttgaacaaggatctcgcggagctgattaataagatgaggctggcacagcagaacgcggtcacgagcctgtcggaggagtgtaaacgccaaatgctgacagccagtcatacgcttgcggtggacgccaagaatctacttgacgctgttgaccaagctaaggtgcttgcaaatctcgcacacccacccgccgaatag

SEQ ID NO: 16950 - DNA, 2904 bp, Artificial Sequence
  Description of Artificial Sequence: Synthetic coding sequence
atgtccggggtgagcgagccactgagtagagtaaaactggggacattaagaaggccagaaggcccagctgagccgatggtggtggtaccagttgatgtggaaaaggaggacgttcggattctgaaggtatgtttctacagtaactcattcaaccccggaaagaattttaagttggtaaaatgtactgtacaaacagaaatccgggaaatcattacttccatcctgctcagcgggaggatcgggccaaacatccgcctggccgagtgttacggcctacggctgaaacacatgaaatccgatgagatccactggcttcatccccagatgacagtgggcgaggtgcaggacaagtacgagtgccttcacgtggaggccgaatggagatacgacttacaaatcaggtatttgcccgaggatttcatggagtccctgaaagaagataggaccactctcctctacttctaccagcagctccgaaatgattacatgcagcgctatgcctccaaggtttctgaaggcatggccttgcagctgggctgtctggaactaagacggtttttcaaagacatgccccacaatgcattagacaagaaaagcaactttgagcttctggagaaagaggtgggcctcgatctgttttttccgaaacaaatgcaggagaatcttaaaccgaagcagtttaggaaaatgatccagcaaacttttcagcagtacgcgagcctgcgcgaggaagagtgcgttatgaaatttttcaacactcttgctggctttgctaacatcgatcaggaaacgtatcgatgcgagctcatacaggggtggaacattacggtcgatctggttattggtcccaaggggattagacagctgaccagccaggatgctaagcccacttgcctggcagagttcaagcaaatcaggagcataaggtgccttcccctagaagaagggcaggccgtccttcagcttggtatagagggagcgcctcaggctttatccattaagacatcttcactcgcagaggctgagaacatggccgatttaatagatgggtattgccggctgcagggggagcatcaggggtcactgatcatacaccccagaaaggacggtgagaaacggaattccttaccacagattcctatgctgaacctggaggcaaggcgcagtcacctttctgagtcttgttctattgagtctgacatctatgctgagataccagacgaaacccttcggagacctggcgggccccagtacggcatagccagagaagacgtggtgttgaaccgaattctgggagaaggcttttttggggaagtgtatgagggcgtgtacactaatcacaagggagagaaaatcaacgtggccgttaaaacatgtaaaaaggattgtaccctcgacaataaggaaaaattcatgtcagaggcggttatcatgaaaaacctcgaccacccccatatagtgaagctgattggaatcatcgaagaagaacctacatggatcatcatggaactgtatccctacggcgagctgggacactatctggagagaaataaaaattcccttaaagtcctgacactagtgctttactcccttcagatctgtaaggccatggcctatctggagtcaattaattgtgtgcaccgcgatattgccgtccgcaacatcctggttgccagcccggaatgcgtaaaactgggggatttcgggctgtctcgctatattgaagatgaagactattataaggcctccgtaaccaggttgcccattaagtggatgtcaccggagagcatcaattttagacgcttcacaacagcaagtgacgtgtggatgtttgccgtctgcatgtgggaaatcctgagcttcgggaagcagcctttcttctggctggagaataaggacgtgattggggtgctggagaagggtgataggttaccaaaaccggacttatgccctcccgtgctatatacccttatgacccgttgctgggactacgatccctctgatcgccctcgtttcaccgagctggtctgctctctgtccgatgtgtatcaaatggagaaggacatcgccatggagcaggagcggaacgcccgttaccgcacgcccaagatattagagccgacggccttccaggagccaccccccaagccttctaggcctaagtataggcctcccccgcaaaccaaccttcttgcacccaagctgcaattccaggaggaggatttcatccagccttcgtccagagaggaggcccagcagctgtgggaggcagagaaagtaaagatgcggcaaattctcgacaagcaacagaagcagatggtagaggattaccaatggttacgccaggaggaaaagtccctcgaccccatggtgtacatgaatgacaaatccccactgacgccggaaaaggaggtaggctatctggagttcacaggacccccccagaagccgccccgcctcggcgcacagtccattcagcctactgccaacttagataggaccgacgatctggtgtacctaaatgtgatggagctggtgcgcgcagtgttggagctcaagaacgaactttgtcagctgcctcctgagggatacgtcgtggtagtgaagaacgtcggcctgactctgcggaagttgattggatccgtggacgacctcctgcctagtctcccaagtagctctcgtacggaaatagaaggaacacagaaactgctgaataaagacctggctgaattaatcaacaagatgagactggctcagcagaacgccgttacctccctctcagaagaatgtaagaggcaaatgctcacggcatctcacacacttgcagtggatgctaaaaacctgctggacgccgtcgatcaggctaaggttctggccaatctcgcacatccaccagcggagtag

SEQ ID NO: 16951 - DNA, 2409 bp, Artificial Sequence
  Description of Artificial Sequence: Synthetic coding sequence
ctcctccctgaacggatgagcggagtgagtgagcccctctcaagagtgaagctcggaacactgcgaaggcccgagggtcccgcggaaccaatggtagtcgtgccagtcgatgtggagaaagaagatgtcagaatcctgaaggtctgcttttatagtaactccttcaatcccgggaagaattttaagctggtaaaatgtactgttcaaaccgaaattcgggagatcataacttccattctgctctctggaaggatcggaccgaacatcaggctcgcagagtgttacggattgcgcctcaaacatatgaaatccgatgagattcactggctgcaccctcaaatgacagtcggggaggtgcaggataaatacgagtgcttgcatgttgaagccgagtggaggtacgacctgcagattcgctatcttccagaagatttcatggaatccttgaaggaggaccgtaccaccctgctttatttttaccagcagcttaggaacgactacatgcaacgctatgcttccaaggtgagcgaaggaatggcactacagctgggctgtctcgaactcagaagattctttaaagatatgccccacaatgctttagacaaaaaaagtaattttgaactgcttgaaaaagaggtaggactcgacttattttttccaaaacagatgcaggagaatctaaaacccaagcagtttaggaaaatgatccagcagactttccaacagtacgcttccctgcgcgaggaagagtgtgtgatgaagttttttaacacactagcgggctttgcgaatatcgaccaggaaacatacaggtgtgagctaattcagggatggaatatcacagttgatctagtaattggcccaaaaggcattcgacaacttacatcacaggacgctaagcccacgtgtttggctgagttcaagcaaattcgcagcattcggtgtctccctcttgaggagggtcaggcagttttgcagcttggaattgagggcgccccgcaggccctgtccattaagacaagttcccttgcagaggcagaaaacatggctgatctgattgatgggtactgtcgccttcagggcgagcaccaaggaagcctaataatccacccgcgtaaggacggtgagaagagaaacagtttaccccaaatcccaatgttgaacttggaagctaggcgctcccacctcagcgaaagctgttcaattgagtccgacatttacgccgagatccccgatgaaacgctgcgccggcctggcggtccgcaatatgggatagcccgtgaggacgtggttctcaataggatattgggggagggcttctttggtgaggtttacgaaggtgtttacacgaaccacaagggtgagaagatcaatgtcgctgttaaaacgtgtaagaaggactgtacattggacaacaaagaaaagtttatgagtgaggcagtaatcatgaaaaacctagatcacccacatattgtgaaactgatcggcataatcgaggaggagcctacctggataatcatggaactttacccatacggtgagctgggtcattatcttgagaggaataaaaacagtctgaaggttctgactctcgtgttgtatagcttgcagatttgcaaggcaatggcttacctggaatcgatcaactgcgttcatcgagatattgccgtgagaaatatcctggtcgcttcgcctgaatgtgtgaagcttggagacttcggactgtcccgctatattgaagacgaagactattacaaagcgtccgtcactcggctgcccatcaaatggatgtccccggaaagcattaacttcagacggttcactaccgctagtgacgtgtggatgttcgccgtatgcatgtgggagattctcagttttggaaagcaaccctttttttggttggagaacaaggacgtaattggcgtccttgagaaaggagatcggctccccaaacctgatctttgcccacctgtgctgtacactctgatgacaaggtgttgggattacgatccctcagacagaccccgatttacagagctggtgtgcagcctgagcgacgtgtaccaaatggaaaaggacatcgccatggagcaggaacgtaacgcccgctaccggacaccaaaaatcctggaacctactgcattccaggaaccccctccaaagccctctaggcccaaataccggccgcctccacaaacaaatcttctcgcaccaaaactgcagttccaggtaccagagggtctttgcgccagttcgcccacactgacaagtcccatggaatatccatcccccgtcaactccctgcataccccaccgctccatcgtcataacgtgtttaagcgccactctatgcgcgaggaggactttatccaaccatcatcccggggccctgcggctgtgggaggatag

SEQ ID NO: 16952 - DNA, 3030 bp, Artificial Sequence
  Description of Artificial Sequence: Synthetic coding sequence
atgagcggagtttcggaacccctgagtcgagtcaaactcggaactcttagaaggcccgaaggcccagccgagccgatggttgtcgtgcctgttgacgtggaaaaagaggacgtgcggattctgaaagtgtgcttctactctaattctttcaatcctggcaagaactttaaactggtgaaatgtactgtccaaacggagattagagagattattacctccatcctgctctcaggccgaattggccccaacatccgacttgccgagtgttacggtcttcggcttaagcacatgaaatctgatgagattcactggctgcacccccagatgacagtgggcgaggtacaagacaaatatgagtgtctgcatgtggaagctgagtggagatatgacctgcagattcgctacctgcccgaagattttatggaaagtcttaaggaggataggactactcttctgtatttctatcagcaactccgcaacgactatatgcagagatacgcatccaaggtgtcagagggcatggccctgcagctagggtgcctcgagctgcgccgatttttcaaggacatgcctcataatgccctggacaagaaatccaatttcgaactgctcgaaaaagaagttggcctggacctgtttttccccaaacagatgcaggagaatcttaagcccaagcagttccgaaagatgatacaacaaacatttcaacagtatgcgagcctccgggaagaggaatgtgtgatgaagttcttcaacaccttggccgggttcgctaatatcgatcaggagacatacagatgtgagttgatccaaggttggaacattacagtcgatctcgtaatcggtcccaagggcatcaggcagttaacttctcaggacgctaagcctacctgtctcgctgagttcaagcagattaggtctatacgctgccttccgctcgaggagggccaggcagtgctgcagctagggatcgaaggggccccacaggccctctccatcaaaacttctagtctggcggaggctgagaacatggctgacctaattgatggttactgcagactccagggcgagcaccagggcagcttgatcatccacccccggaaggacggcgaaaaacgaaattctcttccccagatcccaatgctgaatctggaggcccggcgcagtcacctcagcgaaagttgttccattgaatcagacatctacgccgagatccccgatgagaccctgaggagaccagggggaccccagtacggtatcgctcgagaagatgtggtcctaaatcggatccttggcgagggattcttcggggaagtttacgaaggagtgtacaccaaccacaaaggcgagaagatcaacgtcgccgtcaagacgtgtaagaaagattgcacactggataacaaagagaagttcatgtcagaggccgtcataatgaagaatctggaccatccacacatcgtgaaactaatcggcattatcgaggaggagccaacatggatcattatggaactttacccctatggggaactgggacactatttagagcggaacaaaaacagcctaaaggtgcttaccttagtgctgtattcattacagatatgcaaagccatggcatatctggaatcaatcaactgcgtccatcgagacatcgccgttagaaacattctcgttgcaagccccgaatgtgtcaaactgggcgactttggtctgtccaggtacatcgaggacgaagactattacaaagcgagcgtcacccggctgccaatcaagtggatgtctccggagagtatcaactttaggcgtttcaccactgcgagcgacgtgtggatgttcgccgtgtgcatgtgggaaatcctctcatttggtaaacagccatttttctggctcgagaacaaggacgttattggtgtgcttgagaagggcgatcggctgccgaagccagacctttgcccacctgtgctgtacacactgatgaccaggtgttgggattacgatccctccgatcggccccgcttcaccgagctggtttgttccctgagcgacgtgtaccagatggaaaaagacatcgcaatggagcaggagaggaacgcccgctataggacacccaaaatcctggaaccgaccgccttccaggaaccacctccaaagccgtccaggcccaaatacaggccacctcctcaaacaaacttgctggctccgaaactccagtttcaagtgcctgagggtttgtgcgcctctagccccacactcacctcccccatggaatacccttctcctgtcaacagcctccacacccctccgctgcatcgccacaatgtgttcaaacggcactctatgagggaggaggatttcatccaaccgagttcccgggaggaggcccagcagctctgggaggccgagaaagtgaaaatgagacagattctggacaagcagcagaagcaaatggtggaggactatcaatggctgaggcaggaggagaaatccctggatccaatggtctacatgaatgacaaatctcccctgacgcccgagaaagaggtcggctacctggagttcacaggacctccccagaagccaccccgcctgggtgcgcagtcaatccagcctactgcaaatctggaccgtaccgacgatcttgtatatctgaatgtaatggagcttgtgagggcagtcctggagctgaagaatgagttgtgtcagttgccgcctgaaggctatgtggtcgttgtcaagaatgtagggttgaccctccgcaaactgatcgggtcggttgatgatctgcttcctagcctgccttcttcaagtcggaccgaaatagagggaactcagaagctgctgaataaggacttggcagagttgatcaacaagatgcgcctcgcacagcaaaatgctgtaaccagtctctcggaagagtgtaaaagacagatgctcacagcctcacacaccctggcagttgacgcaaagaatctgctcgacgctgtcgaccaggcaaaggtcctggccaacctggcacatccgccagcagagtag

SEQ ID NO: 16953 - DNA, 969 bp, Artificial Sequence
  Description of Artificial Sequence: Synthetic coding sequence
atggctgaccgcgacagcggatccgagcaaggaggggctgccttgggttctgggggttccctcggtcatcctggatccggcagcgggtccggcggcgggggcggcggcggaggcggcggcggtggaagtggcggcggcggaggcggagcgccaggcggtcttcagcatgaaacccaggagcttgcatctaaacgagtggacatacaaaacaagagattctatttagatgtaaagcagaatgccaaaggccggttcttaaagatcgcagaggttggcgccggaggaaataagtctaggcttaccctatcaatgtccgtagccgtggagtttagagactacctaggggatttcattgagcactacgcacagctgggcccgagccagccgccagatctggctcaggcgcaggacgaaccgcgaagggccctaaagtccgagttcctggttagagaaaaccggaagtactatatggatctgaaagaaaatcaacgggggagatttctgcggatcaggcagaccgttaatcgcggcccgggacttggctcaactcagggtcagacaattgccctccccgcccaggggttgattgagttccgagatgcgctggcaaagctgatcgatgattacggagtcgaggaggaacccgctgagctccccgaggggacttctttgacggtcgataacaaacggttcttttttgatgtcggaagcaacaagtacggggtcttcatgcgtgtatcagaagtaaagcctacttatcgaaattctatcaccgtgccctataaggtgtgggccaagtttggccataccttttgcaaatattcagaggaaatgaaaaagattcaagaaaagcagcgcgaaaagagagccgcatgcgaacagctgcatcagcagcagcaacaacagcaagaggaaacagctgccgctaccctgcttctacaaggagaggaagagggtgaagaagattag

SEQ ID NO: 16954 - DNA, 588 bp, Artificial Sequence
  Description of Artificial Sequence: Synthetic coding sequence
atgggtagagcccgcgacgccatactcgatgccctggaaaacttgacagccgaggaactcaagaagttcaagctgaagctgctgtctgtgccacttcgcgaagggtacgggcgcatccccagaggagcccttctgagtatggatgcgctggacctgaccgataagctggtttccttttatctagagacctatggagcagagctgacagcaaacgtcctcagagacatgggactgcaagaaatggccggccagttgcaggccgcaactcatcagggatccggcgctgcgcccgccgggattcaagcacccccccagtccgccgctaaacccggtctgcactttatcgaccaacatcgggcagccctgatcgccagggtcaccaacgttgaatggctcttggatgcactgtatggtaaggttctgaccgatgagcagtaccaggcagtgagagccgaacccactaatccttctaaaatgcgaaagctcttttcctttacacctgcttggaattggacatgcaaggatcttttgctccaggcactgcgcgaaagtcaatcctatctggtggaggatttagagagatcttag

SEQ ID NO: 16955 - DNA, 531 bp, Artificial Sequence
  Description of Artificial Sequence: Synthetic coding sequence
atgggccgtgcgcgcgatgccatcctggatgcgctcgagaatctgacggccgaggagctcaagaaattcaagctaaaactcctgtctgtaccactgcgggaggggtatggaagaatccctaggggagccttattgtccatggatgccttggatctgaccgataagttggtctctttctacttagagacttacggagcagagctgactgcaaatgtcttgcgagacatgggacttcaggaaatggccggacaattgcaggccgctacccatcagggcctgcacttcattgaccagcacagggctgcgcttattgccagggtcactaatgtggaatggcttttggacgcactgtacggaaaagtgctcaccgacgaacagtaccaggcggtgcgggccgaaccaaccaatcctagtaaaatgcgcaaacttttctcctttaccccagcttggaactggacttgtaaagatctccttctgcaagccctccgggaaagtcagagctatttagttgaggacctcgaacggagctag

SEQ ID NO: 16956 - DNA, 408 bp, Artificial Sequence
  Description of Artificial Sequence: Synthetic coding sequence
atgggacgtgctagggacgcaatacttgacgccctcgagaacctgacagcagaggagctcaaaaaattcaaactgcaagctgccacccatcaggggagcggcgcagcaccggccggcatccaagcccctcctcagagcgccgccaaaccgggtcttcactttatcgatcagcatcgcgccgcactcattgcacgcgtcactaatgtagaatggctcctggacgccctctatggcaaagtcctcaccgacgagcagtatcaggcggtgcgagctgagcctacaaatccatctaagatgagaaagctctttagcttcacacctgcgtggaattggacttgcaaagatctcctgctccaggccctaagggaaagtcagtcttatctggtcgaggatctcgagcgaagctag

SEQ ID NO: 16957 - DNA, 1311 bp, Artificial Sequence
  Description of Artificial Sequence: Synthetic coding sequence
atgcggctcgcccggctgttacgcggggctgcactggctggcccaggaccaggactcagggctgccggctttagtcggagtttctcttctgactccggttcgtccccagcatcggagcggggcgttccggggcaggtggacttctatgctcgatttagtccctccccactgagcatgaagcagtttctggactttggctcagtcaatgcatgcgagaagacgagtttcatgtttcttcgccaggagttgcctgtgcgcctggccaatataatgaaggagatcagcctcttacccgacaacctgctccgtaccccctcagtgcaactcgtgcagagctggtacatacagtcgctgcaggagcttctggatttcaaagacaagagcgccgaggatgcaaaagccatctatgatttcacggacacggttatcagaattaggaatcggcacaatgatgtgatacccacaatggcccaaggggtcatagagtacaaagagtcatttggcgtggacccggtgacatcccagaatgtgcagtattttttggacagattttacatgtcacgaatctccatcaggatgctcctgaaccaacattctctgctgttcggggggaagggaaaagggagtccaagtcatagaaagcacattgggtccatcaaccctaactgcaatgttcttgaggtgatcaaggatggctacgaaaatgctcgccgcttatgtgatttgtattatatcaactcacccgaactcgaattggaggagcttaacgctaaatcaccagggcagcccatccaggtagtttacgtcccatcccacctctatcatatggtgttcgaattgttcaagaatgctatgagagccaccatggagcatcacgctaaccgaggcgtgtatcctcctatccaagtccacgtgacactgggaaacgaggacctgaccgtgaagatgtcagacagggggggcggggtgcccttaaggaagattgacaggttatttaactacatgtactctacagctccccggccgagggtggaaaccagtagggcggtcccgctcgccgggtttggctatggactacccatttcccggttatatgcccagtatttccagggagacctgaagctatactcactggagggctatgggacagacgcagtgatatatataaaggccctctctactgattctatagagaggctgccagtttacaataaggcggcatggaaacattacaataccaaccatgaggcggatgactggtgtgtgccctcaagggaacccaaagatatgactacgtttcgtagtgcgtag

SEQ ID NO: 16958 - DNA, 1371 bp, Artificial Sequence
  Description of Artificial Sequence: Synthetic coding sequence
atgcgcctggcccgtctgctgcggggggccgcattagccgggcccgggccgggactgcgggcggctgggttttcacggagtttttctagtgatagcgggagcagccctgcttctgaaaggggagtcccaggccaagttgatttttacgcccgcttttcgccctcgcctctcagcatgaagcagtttctggatttcggatccgttaatgcgtgtgaaaagactagttttatgtttctgcgccaggaacttccagtaagactggccaatatcatgaaggagatcagcctgctaccagacaatcttctcagaactcccagcgtccagctggttcaaagctggtacatccagtccctgcaggaactactagatttcaaggataaaagtgctgaagatgccaaggctatctatgagaggccaagacggacatggcttcaagtgagttctctctgctgcatggcttgcaaaatgatcttcaccgacaccgtcattcgaatccggaataggcataacgacgtcattcccaccatggcgcagggagttatcgaatataaggaaagttttggagtcgatccggttacgtcccagaatgtgcagtactttctcgatcggttttatatgtccagaatttcaattcgtatgttgctcaatcagcattctctgctatttggcgggaaagggaaggggtctccttctcatcggaagcatataggaagcatcaatcctaactgtaatgtcctcgaggtcattaaagatggctacgagaacgctagaaggctctgcgacttgtactatatcaactcccccgagctggagctcgaagagctgaatgcaaaatctccagggcaaccgatccaggtggtgtacgttccaagtcatctgtaccacatggtgtttgagttgttcaaaaacgctatgagggcaacaatggaacatcacgccaacagaggcgtgtaccctcctatccaagttcacgtgacacttggtaatgaggatttgaccgtgaaaatgagtgaccggggggggggagttccccttaggaaaatagatcggttgtttaactacatgtactcaactgcaccacgacctagagtcgagacgtcccgcgccgtccccttggccggattcggctacgggctgcccatctcccggctttacgctcagtacttccagggagacctcaagctctactctcttgaggggtatggcacagacgctgtgatctatatcaaggcactgtcaaccgactccatcgagcgcttgcccgtctacaataaggcagcctggaagcattacaataccaatcatgaggctgacgactggtgtgtacccagccgggagccaaaagacatgacaaccttccgctccgcctag

SEQ ID NO: 16959 - DNA, 1311 bp, Artificial Sequence
  Description of Artificial Sequence: Synthetic coding sequence
atgcgcttggccagattgttgcggggggctgccttggccggacctggccctgggttgagagcggctggcttctctcgatcattttcatcagattccgggtcctccccagccagtgagcgtggagtccctggccaggtcgacttttatgctcgcttcagcccaagtccgctctctatgaagcagtttctggactttgggtctgtgaatgcatgtgagaagacctcatttatgttcctaagacaagagctgccagtccggctggcaaacatcatgaaggaaatttccttgctgcctgacaacttactgcgcactccaagcgttcagctggtgcaaagctggtacattcagtcccttcaagagctcttagatttcaaagacaagtctgccgaagacgccaaggcgatatatgattttacagacacagtgattcgaatccgtaatcgccacaacgacgtgattcccactatggcacaaggagtgattgagtataaggagtcttttggggtggatcccgttacatctcaaaatgtgcagtattttctcgaccgtttttacatgagccgaatctctatcaggatgttattaaaccagcactcgcttctctttggaggaaagggaaaggggtcacctagccatcgcaagcacatcggcagcatcaaccccaattgcaacgtcctggaagtcatcaaggacggctacgagaacgctagaagactatgtgacttatactatatcaattcacctgagttggagctcgaggagttgaatgccaaaagtcctgggcaaccgattcaggtcgtctatgtgccctctcacctgtaccacatggtgttcgaattattcaagaacgcgatgcgggcaacgatggaacaccatgcgaacagaggtgtgtatccacctatccaagtccatgtgaccctgggaaacgaggatctcacagtgaaaatgtccgatagaggcggcggagttccactgaggaagatcgatagactgttcaattatatgtattcaacagctccccggccccgggtggaaacatctcgagctgtccctctggctggatttggctatgggttgccgatctctcgtctatacgcccagtactttcagggtgacctgaagctgtactctctcgagggctatgggaccgacgcggtgatttacatcaaggcattgtcaactgatagcatcgaacgcctgccagtctacaataaggccgcctggaagcactacaataccaaccacgaggcagatgactggtgcgtcccgagcagagagccaaaggatatgacaacctttagatcagcatag

SEQ ID NO: 16960 - DNA, 1083 bp, Artificial Sequence
  Description of Artificial Sequence: Synthetic coding sequence
atgttcctcagacaggagctgccagtgcgactggccaacattatgaaggagatctcactgctgcctgacaatttgctgcgcactccgagcgtccagctggtgcagtcctggtacatacagagcctgcaggagctgcttgatttcaaagataagagcgcagaggacgctaaagccatttacgactttaccgatactgtcatccgtatacgaaataggcataatgatgtgattcccactatggctcagggcgtgatcgaatataaggaatcttttggagtggaccccgttacctcacagaacgtacaatacttcttagaccgcttctacatgtccaggatctccatcaggatgcttctcaatcagcattcactcctgttcggtggcaaaggcaaggggtccccaagtcaccgaaagcatatcggatccataaatcccaattgtaatgtgctagaagtcatcaaggacggctatgagaacgctcggaggctctgtgacttatattacatcaatagtcctgaactggagctcgaggaactgaatgccaaaagtccagggcagcccatccaggtggtgtacgttccaagtcatctttaccatatggtgtttgagctgtttaagaacgcgatgcgagctactatggagcatcacgccaatagaggtgtgtatcccccaatccaggtgcacgtgactcttggcaacgaagacctgacagtgaagatgtccgatcgaggtgggggtgtccctctgagaaagatcgacaggctgttcaattacatgtatagcacagctccaaggccgagggtggaaacaagccgagcagtgcccctagctggattcgggtacgggctccccatttcccgcctgtacgcccaatattttcagggcgatctcaaactatactccctggaggggtacggcaccgatgcagtcatctatatcaaggcccttagcaccgactctatcgaacggctccctgtttacaacaaggccgcctggaagcattataacaccaaccacgaagccgacgactggtgcgtcccatctagagagcctaaagatatgactacatttcggtcagcgtag

SEQ ID NO: 16961 - DNA, 846 bp, Artificial Sequence
  Description of Artificial Sequence: Synthetic coding sequence
atggcacagggagtcatcgagtataaggagagctttggcgtcgatcctgtcacttctcagaacgtgcagtacttcctggataggttttatatgagccggatttcaatccggatgctcctcaatcagcatagcttgttgttcggcggaaagggaaagggcagtccctctcaccgaaaacacattggctccatcaaccccaactgtaatgtcctggaagtgatcaaggatgggtatgaaaacgcccgcagactttgtgatctgtattacatcaactcgccagagctggaattagaggagctgaacgctaagagccccggccaaccaatacaagtggtgtacgtgccgagtcatctctaccacatggtctttgaactttttaagaatgccatgcgtgcaactatggaacaccacgcaaatcggggtgtatatccaccgattcaggttcacgtcaccctgggcaacgaggacctgacagtcaaaatgtccgatcgggggggaggagtgcccctccgaaagatcgaccgactgtttaattatatgtactctactgctcctcgcccccgagtggaaactagccgggcagtgcctctggcaggcttcggctacggactccctatttcaaggctgtatgcccagtattttcagggagaccttaaactttacagtttagaggggtacggcactgatgccgtgatttatattaaggccctctctaccgattctatcgagcgactgcctgtctataacaaggccgcttggaaacattataacaccaatcatgaggcagacgattggtgcgtgcctagtcgggaacctaaagacatgacaacttttcgtagcgcatag

SEQ ID NO: 16962 - DNA, 1032 bp, Artificial Sequence
  Description of Artificial Sequence: Synthetic coding sequence
atgaaggaaattaacttgctcccagaccgtgtcttgagtacacccagcgtgcagctcgtgcaaagctggtatgttcagagcctcctggacatcatggaattccttgacaaggacccagaagaccacagaactttgagccagtttacagatgcgttagtcacgatccgtaatcggcacaatgatgttgtcccaactatggcccaaggtgtgctggaatataaggatacgtacggagacgacccagtcagcaatcagaatatccaatactttttggataggttctacctttcaagaattagtattcggatgctgattaaccaacacactcttatcttcgacggtagcacaaaccccgcccacccaaagcacatcgggtctatcgacccaaattgcaacgtgtccgaggtggtgaaagatgcatatgatatggcaaaactcctgtgtgataagtattacatggccagtccagatttagagattcaggaaataaacgcagccaacagtaagcagccaattcacatggtgtacgtaccatctcacctgtaccatatgctgttcgaactattcaagaatgccatgcgagccaccgtggagtcgcacgaaagcagtctgatattgccccctatcaaggttatggtcgccctgggcgaggaggacttatctatcaagatgagtgaccgcggcggaggggtcccactgcggaagattgagcgcctgtttagttacatgtactcaacggctccaaccccacagccaggaacaggcggaacaccactcgctggtttcggctacggcctccctatttcacgcctgtatgccaagtatttccagggagacctgcagctattttcaatggaaggtttcggaacagatgccgtgatttacctgaaagccctaagcaccgattcagtagagaggttgcctgtttataataaaagcgcctggcggcactatcagaccattcaggaagccggcgactggtgtgtaccttctaccgagccaaagaacacttcaacatacagggtttcgtag

SEQ ID NO: 16963 - DNA, 1224 bp, Artificial Sequence
  Description of Artificial Sequence: Synthetic coding sequence
atgcgatgggtgtgggcccttcttaaaaatgcttccctggcaggcgcgcccaagtacatcgaacacttttctaagttctccccaagcccattgtccatgaagcagttcctggatttcggatcctccaatgcctgcgaaaagacatctttcacctttctcaggcaagagctacctgtcagactcgctaatattatgaaggaaattaacctgctgccagacagggtgctgtctaccccaagcgtacagttggtccagagttggtacgttcagagcttgttagacattatggaattcttggacaaggatcctgaagaccatcgcacccttagccagtttacagacgccttagtgaccatcaggaacaggcacaatgacgtggttcccaccatggctcagggcgtcctggaatacaaggatacatacggggatgatcccgtatccaatcagaacatccagtacttccttgaccgcttttatttgtctagaatttcgatacggatgctgattaaccagcacaccctcatatttgacggatctactaaccccgctcaccccaaacatatcggcagtatcgatcctaattgtaatgtctctgaggtggtgaaagatgcttacgatatggccaaactgttatgtgataaatactacatggccagcccggatttggagatacaggagataaacgccgccaacagtaagcagcctattcacatggtctatgtccctagtcacttataccatatgttgtttgaactctttaagaatgcaatgcgggcaaccgtcgagagtcacgagtcctcattaatcctgcccccaatcaaggtgatggtggccctcggagaggaagacctgtctattaaaatgagcgatcgtggggggggagtgcctctcaggaaaatagaaaggctgttcagttacatgtactccacagcaccaactccccagcccggcacaggaggcactccccttgctgggttcggctatggcctgccaatctccaggttatacgctaaatatttccagggggatctccagctgttcagcatggagggcttcgggacagatgcagtgatatacctgaaggctcttagcaccgactccgtcgaaagacttcccgtgtataacaagtcagcttggagacattatcagaccatccaggaggccggggactggtgcgtcccaagtactgagccgaagaacacaagcacttaccgcgtaagttag

SEQ ID NO: 16964 - DNA, 849 bp, Artificial Sequence
  Description of Artificial Sequence: Synthetic coding sequence
atgcctctgctcacgcagcagattcaggatgaggacgatcagtacagcctagtcgctagcttggacaatgtaagaaatttgtcaacaattttgaaagccattcattttcgtgaacacgcgacgtgctttgcgaccaagaatggaattaaagtgactgtggagaacgccaagtgtgtccaagcaaacgcttttattcaggccggaatctttcaggagtttaaggtgcaagaagagagcgtgacatttagaatcaacctcacagtgctgctggactgtctaagcatcttcggaagttcacctatgcccggaactttgacagccctgaggatgtgttaccagggttacggataccccctgatgctatttttagaggaaggcggagtcgtgacagtgtgcaaaataaacacccaggagccagaggagacacttgacttcgatttttgtagcactaacgtgataaataaaatcattttgcagagtgaggggctgagggaggcattctctgagcttgatatgacttcagaggtcctgcagatcactatgagccctgataagccatactttcgcttgtccacatttggtaacgcagggtcctcccacttggattaccctaaggactccgacctgatggaagcattccactgcaatcagacacaagttaatagatacaagatctctctgctaaaaccttccactaaggctttggttctgtcgtgcaaggttagcatccgtacagacaataggggctttttgtctctgcagtatatgatccggaacgaggatggccaaatttgtttcgtggagtactattgctgccccgatgaggaagtaccagagtccgagtcgtag

SEQ ID NO: 16965 - DNA, 849 bp, Artificial Sequence
  Description of Artificial Sequence: Synthetic coding sequence
atgcctctcttgacacaacagatccaggatgaggacgatcagtattcactcgtcgcgtcacttgacaatgtacggaatctgagcacaatcctcaaagcaatccacttcagagaacatgctacatgctttgcaaccaaaaacggaataaaagttactgtggagaatgccaaatgtgtccaggcgaatgctttcatccaagcaggcattttccaagagttcaaggttcaggaagagtctgtgactttccgcatcaatctgactgtgctgttagattgcttaagcatcttcggctctagcccaatgcccgggacccttaccgccctgcgcatgtgctaccaagggtacggatatcctctgatgctcttcctggaagagggcggcgtcgtaacagtatgtaagatcaatacacaggaacctgaggagacactggacttcgacttctgctccacaaatgtgattaacaagatcatcctgcagagcgagggcttgcgggaagcattttcggaactggatatgacttctgaggttctccagattacgatgtcccccgataaaccctatttccgcctgagtacttttggaaatgctgggagtagtcacctcgattacccaaaagacagcgatttgatggaggccttccattgcaaccagacccaagtcaatcgctacaaaatttcactgctgaagccttctaccaaagcgctggtcctgagttgtaaagtgtccattaggacagataatcgggggttcctgtccttacagtacatgatcaggaacgaggatgggcagatctgctttgttgaatactactgctgccctgacgaagaggtgcctgagtctgaatcttag

SEQ ID NO: 16966 - DNA, 741 bp, Artificial Sequence
  Description of Artificial Sequence: Synthetic coding sequence
atgcccctgctgactcagcagattcaagacgaggatgatcaatactctctcgtggcctcactggacaatgtgcggaacttgagcacaatccttaaggctatccacttccgggagcacgctacctgctttgcgactaaaaacggaatcaaggttactgtcgagaacgccaagtgcgtgcaggccaacgcattcatccagggcactttgaccgccctaagaatgtgctatcaaggctatggatatcctctaatgctattcttggaagagggcggcgtcgttaccgtttgtaaaataaatactcaagagccagaagaaacgctcgactttgacttttgctctacaaacgtgatcaacaaaattattctgcagtcagaagggctgcgcgaggccttttccgaactagatatgacttcagaggtgctgcagatcacaatgtccccagacaaaccttattttcggctgagtacattcggaaacgcagggagttcccaccttgattatcccaaggactctgacttgatggaggccttccattgtaatcagacacaagtgaatcgctataaaatcagccttttaaaaccgtcgaccaaagccctcgtcctctcctgtaaagtgagcattcgcacagataacaggggcttcctgagcctgcaatacatgattaggaatgaagacggtcagatctgcttcgtcgagtactactgttgtcctgatgaggaggtccctgagtctgaatcatag

SEQ ID NO: 16967 - DNA, 1755 bp, Artificial Sequence
  Description of Artificial Sequence: Synthetic coding sequence
atgaaccagcacgaactggctgtgcacaaaaagaagatcgaggaagtcgagacatggcttaaggctcaggtgctcgaacgacagcccaaacagggtggatcaattctgctgatcacagggccacctggatgtgggaaaacaaccacactgaagattctttccaaagaacatggtatccaggtccaggagtggatcaaccctgttctgcccgatttccagaaggatgactttaaggggatgttcaacaccgaaagctccttccatatgttcccataccagtcacagatcgcagtctttaaggagtttttgctgcgcgctacaaagtacaacaagctccaaatgctcggggacgaccttcggaccgacaagaaaattatcttagttgaggacctgcccaatcagttttacagagatagtcacacactccacgaggttcttaggaaatacgtgagaatcggcagatgtccgctaatctttatcatatccgatagcctgagtggcgacaataatcagagattgctatttccaaaggagatccaagaagaatgctctatctcaaacatcagcttcaacccagtcgcaccaacaatcatgatgaagtttctgaatcgaatcgttaccatcgaggctaataagaacggagggaaaattacggtgcctgacaagactagtctcgaactattgtgccagggctgcagcggggacattaggagcgccattaatagcctgcaatttagctcgtcaaagggcgagaacaacctccgccctagaaagaagggcatgtcattaaagtccgatgcggtgctgagcaagtcaaaacgaaggaagaagcccgatagggtatttgagaatcaggaggtgcaggcaatcggcggaaaggacgtatcattgttcctattccgcgcacttggaaaaatcctttactgcaagcgggccagtctgactgaactagactctcctaggctcccctcccacctgtctgagtacgagagagatacactgctcgtggaaccagaagaagtggttgaaatgagccatatgccaggggacctattcaacctctatctgcaccagaattacatcgactttttcatggaaattgatgacatagtgcgagcctccgagttcctaagcttcgcagacattctcagcggtgattggaacacgagatcattgctaagggaatacagcacctctatcgccacacgtggcgtgatgcactccaacaaagcacgcgggtatgcccactgccaggggggaggatcgagttttcgaccgcttcacaagccacaatggttcctgatcaataagaagtacagagaaaattgtctggctgcaaaagccctgtttcctgacttctgtctccccgcgctgtgtctgcagacacagttgttaccctatcttgccctgcttaccattcccatgcgaaaccaggctcagatctccttcattcaggatattggccgcctcccactgaaacgccatttcggccgcctcaagatggaggccctgaccgatagagaacatgggatgatcgacccagacagcggggacgaagctcagctcaacggcggacattcagcagaggagtcactgggcgaacccacccaggcaactgtgcccgagacctggtccctcccactgtctcagaactctgcatctgagctacccgcctcacaacctcagcccttctctgcccaaggcgacatggaagagaacattatcatcgaggattacgaaagtgacgggacatag

SEQ ID NO: 16968 - DNA, 2013 bp, Artificial Sequence
  Description of Artificial Sequence: Synthetic coding sequence
atgaaccaagtaaccgattgggtggacccctcattcgatgacttcctggagtgttccggcgtatccaccattacagctactagcctgggcgtcaataactcaagccatcgtagaaaaaacggtcctagtaccttggaaagtagtcgattccctgcacgcaagcgggggaatctgtcttccttggaacagatttacggcctagagaactccaaagaatatctttctgaaaatgaaccctgggtggataaatataagccagagactcaacatgaactggctgttcacaagaaaaagatcgaggaagtggagacatggttgaaggcgcaagtattggagcgccagccaaagcagggcgggtcaattctgctgataacaggccctcccggctgtgggaagactacaacattaaagattctgtccaaggagcacggcatccaggtgcaggaatggattaatccagtgctacctgactttcagaaggacgacttcaaaggaatgtttaataccgaatctagcttccacatgtttccctaccagagccagatcgcagtttttaaggaattcttacttcgggcaaccaaatacaacaagctacagatgcttggagatgatctgcgcaccgataagaaaataatcctggtcgaggacttgccgaaccagttctaccgggattcccataccttacacgaggtcctgcgcaagtacgtgcgaattgggagatgcccactcattttcattataagtgattctttgagcggtgacaataatcagcggttgctattccccaaagaaatccaggaggaatgtagcattagcaacatctcatttaaccctgtagcacctactatcatgatgaaattcctcaaccggatagttactattgaagccaacaagaacggcggaaagataaccgtccctgacaagacttcactggaactgctttgtcagggatgctccggtgacattcgtagcgcaatcaacagccttcagttcagttcatctaagggcgaaaacaatcttagaccaaggaagaagggtatgtccctgaaaagtgatgccgtattgagcaaatctaagagacgcaaaaagcccgatcgagtctttgaaaatcaagaggtgcaggccataggcggaaaggatgtgtcactctttctgttcagggccctgggcaaaatcctgtattgcaagcgagcctccctcacagagctggattcaccccggctcccatctcatttaagtgagtacgaacgggataccttacttgtcgaacccgaggaggttgtggaaatgagccacatgccgggtgatctgttcaatttgtacttacaccaaaactatattgacttcttcatggagatcgatgatatcgtgcgggcaagcgagttcctcagctttgccgatattctgagtggcgactggaatacacggtctcttctgagagagtactcaacttcgattgccacccggggtgtcatgcattccaataaggccagaggatacgcacattgccagggcggcggtagcagcttcagacccttgcataagccacaatggtttttgataaataagaagtatcgggaaaactgcctggccgccaaggcgctcttcccagacttctgcctccctgccttatgtctgcaaacacagctcctgccctatctggctctgctgacgataccaatgcgcaatcaggcccagatttcgtttatccaggatattggcaggctgcctctcaaaaggcatttcgggcgtttaaagatggaggccttgaccgatcgtgagcacgggatgattgaccctgattcaggggatgaggcgcaactaaacggcggccactctgctgaggaatccctgggtgagcccactcaggccactgtgccagagacatggtctcttccgctctcacagaatagcgctagcgagttgcctgcctcgcaacctcaacccttttccgcacagggcgacatggaggaaaacatcattatcgaggattacgaaagtgatggcacgtag

SEQ ID NO: 16969 - DNA, 2013 bp, Artificial Sequence
  Description of Artificial Sequence: Synthetic coding sequence
atgaatcaggtgactgactgggttgacccaagctttgacgactttcttgagtgctccggagttagcaccataacagctacatcgctgggcgttaataactcgagccaccgcagaaagaatggaccctcaaccctagagtcttcccggtttcccgctaggaaacgtggcaacctgagttctctcgagcaaatttatgggctggaaaactcaaaagagtaccttagtgaaaatgaaccttgggtcgacaaatacaaaccggaaacccaacacgaactagcagtgcataagaaaaagatcgaagaagtcgagacatggttgaaagctcaagttttggagagacagcctaagcagggcggcagtattctactgatcactgggccccccgggtgtgggaagacaactaccctgaagatactgagcaaagaacatggtattcaggtgcaagagtggatcaacccggtccttccagacttccagaaggacgacttcaaagggatgttcaatacggaaagtagtttccatatgtttccctatcagtcacaaatagccgtatttaaggaatttctcttgagagccacaaaatataataagctgcagatgctgggcgacgacttgaggaccgacaaaaaaattatcttggttgaggatctgccgaatcagttctatagagactctcatacactgcatgaggtcttgcgtaagtacgtcagaataggccgttgccctttaattttcataatctccgactcgctgtctggcgataacaatcaacgcctgctgttccccaaagaaatacaagaagaatgcagcatcagtaatatctcctttaatcctgtggctccaactatcatgatgaagtttctcaaccgcatcgtaactatcgaagccaacaagaacggaggaaagattactgtcccagataagacgagtctggagctgctttgtcaggggtgttccggggatattcgctcggcaattaactcgctccagttttccagcagcaagggtgaaaacaacctgagacctcgtaaaaaggggatgagcctgaaatcggatgcagtactttctaagtctaagaggaggaaaaagccagatagagtgttcgagaatcaggaggtccaagcaatcggggggaaggatgtctccctatttctgttccgcgcgttggggaaaatcctctactgcaagcgggcaagcttgaccgaactggacagtcctcgactgcccagtcatctgagtgagtatgagcgggacacactcctggtcgagcccgaagaagtggtcgagatgtcccacatgccaggagatctgttcaatctctacttacatcagaattacatcgatttttttatggagatcgacgacatcgtccgggcatcggaattcttgagctttgccgatatcctcagtggcgactggaacactcgatcattactgagagaatattccactagcattgccacccgaggcgtgatgcacagtaataaggctcggggatatgcccattgtcaggggggtggtagttcattcagacctctccacaagcctcaatggttcctcattaataaaaagtaccgagagaattgcctcgctgccaaggctctgtttccggacttttgcctgccagctctgtgtttgcagacccagctgctgccttacctcgccctgctgactatccccatgcgtaaccaggcccagatttccttcattcaggatatcgggagactgccgttaaagcgccatttcgggcgtcttaagatggaagctttaaccgaccgagagcacggtatgatcgatcctgactcaggagacgaggcccagctcaatggcggccactccgcagaagagtccctgggagaacctactcaagctacagtccctgagacctggtctctgccgcttagccagaactctgcttccgaactgccagcatctcaaccgcaaccattcagcgcacagggagatatggaggaaaatattatcatcgaagattacgagagcgatggcacttag

SEQ ID NO: 16970 - DNA, 2013 bp, Artificial Sequence
  Description of Artificial Sequence: Synthetic coding sequence
atgaatcaagtaacagattgggtggatccgagtttcgatgacttccttgagtgctccggggtgagtactatcacggccacttctctaggggttaataacagttctcaccggcggaagaatgggcccagcaccctggaatcatctaggttccctgctaggaaaagaggaaatttgtctagtttagagcagatctacggtctcgagaattctaaggagtacctaagcgagaatgagccatgggtcgataagtacaagccagagactcagcacgaactcgccgtgcacaaaaaaaagatcgaggaagtagagacctggttaaaggcgcaggtgctcgagagacagccgaagcaaggcggatcgatcctgctgattaccgggccaccagggtgcggtaaaacaactactttgaagatactgtctaaagaacacggtatccaggtgcaagagtggatcaaccccgttctgcctgacttccagaaggacgacttcaagggcatgtttaacaccgagtccagcttccacatgttcccctaccagagccagatcgccgtatttaaagagtttctcctcagggccacaaagtataacaaactgcagatgttaggagacgacctgagaactgacaagaagatcatactcgtagaggaccttccaaaccaattttacagagattctcacactctccatgaagtgctcaggaaatacgtgcgcatcgggcggtgccccctgatcttcatcatttcagattccctttccggggataataaccagaggttactcttccccaaggagatccaggaagagtgctcaatctcaaacatcagtttcaatccggtggcaccgacaattatgatgaaatttctgaacaggatcgtcactatagaggccaataagaacgggggcaaaatcactgtgcccgacaaaacctccctggagctgctttgtcaagggtgttccggcgacatccggagcgccatcaattcgctgcagttcagtagctcaaagggagaaaacaatctgcgcccccggaaaaaaggaatgtctcttaagtccgatgctgtcctgagcaagagcaagagaagaaagaaacccgatagagtcttcgaaaaccaggaagtgcaggcaataggcggtaaggacgtgagcctgttcctttttagggctctggggaagattctttattgtaaaagggcttccctgactgaactcgactccccacggctgccgtcccaccttagtgagtacgaacgagacacattattagtggagccggaggaggtggttgaaatgagccacatgcccggtgatttgtttaacttgtatttacaccaaaactatattgactttttcatggagattgatgatattgttcgagcctctgagttcctgagcttcgctgatattttatctggcgattggaatacaagaagtctgctgagagaatactctacctcaattgcgacccggggggtgatgcattcaaataaggctagaggatacgctcactgccagggggggggttcctctttccgcccactgcacaagccacaatggtttctgattaataaaaagtatagggagaattgtctcgctgcaaaagccctgtttccagacttttgtctcccggctctgtgtttacagacacagcttctcccgtacctggcactcctgaccatcccaatgagaaatcaggctcagatctcctttatccaggatattggacgtctgcctttaaaacgccatttcggtagattgaagatggaagccttaacagatagggaacatggcatgattgatccggacagcggcgacgaggcacagctgaatgggggtcactccgctgaggagtctcttggggaacccacccaggccaccgttcccgaaacatggtcgttgcccctgtcccagaactctgcctcagaacttccagcctcccagccccagccattttctgcccagggagacatggaagagaacattatcattgaggattatgagtccgacggcacttag

SEQ ID NO: 16971 - DNA, 2013 bp, Artificial Sequence
  Description of Artificial Sequence: Synthetic coding sequence
atgaatcaggtgactgattgggtcgacccttcatttgatgacttcctcgagtgctcaggcgtgagcaccataacagccaccagtctgggggtgaacaactctagccatcggcgaaaaaatggaccgtccaccctggagagcagcaggtttcccgcacgaaagcggggcaacttgtcctctctggaacaaatatacggtcttgaaaatagcaaggagtatctgtcggagaacgaaccttgggtggataaatataaacccgagacccagcatgagctggccgtccacaaaaaaaaaatcgaggaggttgaaacctggcttaaggctcaggtcctggaacggcagcctaaacagggtggctccattctcctgattactgggccaccaggatgcggaaagaccacaactctgaagattttgtcaaaagagcatggaatccaggtgcaagaatggattaatcccgtgctgccagactttcaaaaagacgatttcaagggaatgtttaataccgagtcctccttccacatgttcccatatcaatcacagatcgcggtcttcaaggagtttttattacgtgccacgaaatacaacaaactacagatgttgggggacgacttaaggacggataagaagataattctggtcgaagacctgcccaatcagttttatagagactctcacacgttgcacgaggtccttcgaaaatatgtgaggatcgggaggtgtccactgatcttcattatctcagacagcctgtccggagacaacaatcaacggctccttttccccaaggagatccaggaagagtgttccattagtaatatttcatttaacccggtagctccaactattatgatgaaatttctgaatcgaattgtcactatcgaggctaacaaaaacggaggcaagataactgtccctgacaaaacatcccttgaactgctttgccagggttgctcaggcgacatccggagcgcgattaatagtctccaattctctagtagcaagggcgaaaacaacctcagacctaggaaaaagggaatgtctttgaagtctgatgctgttctgagcaagagtaaacgtcggaaaaagcccgacagagtttttgaaaatcaagaggttcaggccatcggggggaaggacgtgtcattattcctattccgcgcattgggaaagatcctctattgtaaaagggcttccctaacagaacttgatagcccaaggttaccgtcccatttaagcgaatatgaacgcgatactcttttggttgaacccgaggaggtagtggaaatgagtcacatgcctggcgacctgttcaacctgtatctccaccaaaactatatcgatttcttcatggagattgatgatattgtccgggcctcggagtttttgagcttcgccgatatcctgtcaggggactggaacacacggagcctcctgagagaatactctacttcgatagccaccagaggggtgatgcacagtaacaaggctaggggctacgcacactgccaaggcgggggcagctcattccggccactacacaagcctcagtggtttcttataaacaaaaagtatcgcgagaattgtttggcagccaaagctctgttcccagacttttgccttcccgctttgtgcctgcaaacccaactattaccttacctcgcccttctaaccattccgatgagaaatcaagcccagatctcttttattcaggatattgggagactgcccctgaagaggcactttggacgcctgaaaatggaagcccttacggatcgggaacacggcatgatagacccggacagcggtgacgaagctcagcttaacggcggccactccgccgaagagtctctcggagagcccacccaagccacagtgcctgagacttggagcctgcccctgtcacagaattctgcctcagaattacccgcgtcccagccccaacccttttcagcacaaggagacatggaagaaaatattatcatcgaagattacgagtctgacggaacttag

SEQ ID NO: 16972 - DNA, 1518 bp, Artificial Sequence
  Description of Artificial Sequence: Synthetic coding sequence
atgtttaataccgaatcctcattccatatgttcccttaccagagtcagattgccgttttcaaagaatttttactgcgcgctactaaatacaacaaactacaaatgctgggcgatgacctccggacggataagaagatcatactggtggaggacctccctaaccagttttaccgagattctcataccctgcatgaagtgcttaggaaatacgtgcgaatcggacgttgtcccttgattttcattatctcggattctctctcaggagataacaatcagagactgctgtttccgaaagaaatccaggaagagtgttcaatctctaacatcagcttcaatcctgtggcccctaccatcatgatgaaattcctgaacaggattgtgacaatcgaggccaataagaatggcggcaaaattacggtacctgataagacaagcctggagctcttgtgtcaaggctgctccggcgatatccgctccgctatcaacagtcttcagtttagcagttccaagggggaaaacaacctcaggcctaggaaaaaaggtatgtccctgaaaagtgatgccgtgctcagcaaatccaagcgtagaaaaaagccagaccgtgtgttcgaaaatcaggaggtgcaagcaattgggggcaaggatgtctcattgttcttatttcgcgctcttggcaaaattttatactgcaagagagcgagtttaaccgagctggactcacctcggctgcctagccacttgagtgaatacgaacgcgatacgctcctcgtggaaccagaggaggttgtggaaatgagccatatgcctggggacctgtttaatttgtatctgcatcaaaattacatcgatttctttatggaaattgatgacattgtgagagcttctgaattccttagctttgctgacattttgtctggcgactggaatacacgctcgctactccgcgagtatagcacaagtatagccactcgcggcgtgatgcacagcaacaaggctagagggtacgcacactgccagggcgggggctctagctttaggccgctgcacaagccccagtggtttctgataaataagaagtatcgcgagaactgtcttgcagcaaaggcgctctttcctgatttttgtctccccgcactctgtctgcaaacacagctgctgccttaccttgcgctgctcacaatccccatgcgcaatcaggcacagatcagttttatccaagatataggaaggctgcccctaaaacggcattttggtagattgaaaatggaggcgctcacagatagggagcacggcatgattgacccagattccggtgacgaagctcaacttaacggaggccattctgctgaggaatcactgggagaacctacacaggccacagtgccggagacctggtccctgcccctgtctcagaatagtgcctcagaattaccggcaagtcaaccccagcctttctccgcgcagggagatatggaagagaatatcatcatcgaggactatgagtcggacgggacatag

SEQ ID NO: 16973 - DNA, 2013 bp, Artificial Sequence
  Description of Artificial Sequence: Synthetic coding sequence
atgaaccaagttaccgactgggtcgatccaagctttgacgacttcttggagtgtagcggcgtatccaccatcacagcaacatctctcggcgttaataacagctcacataggcgcaagaatggccccagtaccctggagtcaagccggtttccagcacggaagaggggtaatctgagtagccttgaacagatctacgggctggagaactctaaagaatatctgtccgagaatgagccgtgggtcgacaaatataagcctgagacccagcacgagctcgcagttcataaaaagaagattgaagaagtggagacctggctcaaggcccaagtcctcgagcgccagcccaagcaaggcgggtcaattctccttattactggcccccctggctgtggaaaaacaactaccctcaagattctgtcaaaagaacatggcatccaagtccaggaatggatcaatcctgtgttgcccgacttccaaaaggatgattttaaaggaatgttcaatactgaaagctctttccacatgtttccgtaccaatctcagatcgctgtatttaaagagttcctcttgcgggccacgaagtacaacaagttacagatgttgggtgatgacctgagaactgacaagaaaatcatcttggtggaggatttgccaaaccaattttatagggattctcatacactgcacgaggtgctgcgaaaatatgtgagaatcgggcgctgccctttaatctttataatttcagattctctgagcggggataataatcagcgcctgctttttcccaaggagatccaggaggagtgcagcattagcaacatcagttttaatccggtggctcctaccattatgatgaagttcctgaaccgaatagttactatcgaagccaataaaaacggcggaaagataaccgtcccagataaaacctctctcgaactgctgtgccaaggatgttccggtgacattcgcagtgcgatcaactcgctgcaattttctagttccaagggtgagaacaacctgaggccaaggaagaagggaatgagcctcaagtccgacgcagtgctgtcgaagagtaagcgccggaagaaaccagatagagtgtttgagaatcaggaagttcaggcgattgggggaaaagatgttagcctctttctttttagggcattaggcaaaattctgtattgtaagagagcgagcctgacagaactagacagcccaagacttcccagccacttgagcgaatacgagcgtgacacactgctcgtcgaacccgaggaggtagtggaaatgagccacatgccaggggaccttttcaacctctacctgcaccagaactacatcgactttttcatggagatcgatgacatcgtgcgggcgagtgaatttttgtcattcgctgatattctttccggcgactggaacacacggtcccttcttagagaatattctacatcaattgccactcgtggggttatgcatagtaataaggcacggggctacgctcattgccaaggcgggggtagctcattcaggcccctgcataagccccagtggttcctgatcaacaagaaatatcgcgagaattgcctggctgcaaaagccttgtttcctgatttctgcctgcctgccttgtgtctgcagactcaactgctgccgtacctggccctgctgactatccccatgcgaaaccaggcccaaatttcctttatccaagatattgggcgtttgccccttaaacgacatttcggccggctcaaaatggaggctctgactgatcgagagcacgggatgatagatcctgactccggcgatgaggcccagttgaatggaggacattcagccgaggagtctcttggtgaaccaacacaagccacggttcctgaaacgtggagcctgcccctgagccagaattcagcaagtgagctacccgcctctcaaccccagcccttttctgcccaaggcgatatggaagagaacattatcatagaggattatgagtcagacggcacttag

SEQ ID NO: 16974 - DNA, 2046 bp, Artificial Sequence
  Description of Artificial Sequence: Synthetic coding sequence
atgagcaagacgtttctccgcccgaaggttagtagcactaaggtgaccgattgggttgatccaagttttgatgacttcctcgaatgttccggagtcagcaccattaccgctactagcctcggcgttaacaactctagtcaccgaaggaaaaatggccctagcacacttgaatcaagccgattccccgcccggaagcggggaaatctgtcctcactggagcaaatctacgggctggaaaatagtaaggagtacctcagcgagaacgagccttgggtggataaatacaaaccagagacccagcacgagcttgcggtccataagaaaaagatcgaggaggtggagacttggctaaaagcccaggtgttagagaggcagcctaaacagggcgggtccatactcctcattaccgggccacctgggtgcggaaagaccaccacactcaaaattctgtccaaggaacatgggatccaggtgcaagagtggatcaacccagtgttaccggatttccagaaggacgacttcaaaggtatgtttaatactgagtctagcttccatatgttcccttaccagtctcagatagctgtgttcaaggagtttctcctgcgggccacaaaatacaacaagctccagatgctcggggacgacctgcggacggataaaaaaatcatcctagtggaggacttgcccaatcaattttaccgagacagccacacccttcatgaagtgctacgaaaatacgtgcgaatcggacggtgcccactgattttcattatttctgattctttgagtggcgacaacaatcagcgcttactgtttcccaaggaaatccaagaggaatgctccatttccaatatcagtttcaaccccgtggcacccaccattatgatgaagtttctcaatcgaattgtgacaattgaggcaaataagaatggaggaaagataaccgtccccgataagacatcactggaactcctgtgtcaaggctgcagcggcgatatcaggtcggctatcaactctcttcaatttagttccagtaaaggagaaaacaacctccgcccccgtaagaaaggtatgtcactaaagtccgacgcggtcctctccaaatcaaagcgccgcaaaaagcccgacagagttttcgagaatcaggaagtccaggccatcggaggtaaagacgtgagtctgtttctgttcagagcactgggtaagattctatattgcaaacgtgcaagcctgacggaactagactcccctcgcctgccatcgcacctgagtgaatacgagcgggacaccctgctggttgaaccggaggaggtggtggagatgagccatatgccaggcgatctttttaatctctacctgcatcaaaattacatcgattttttcatggagattgacgacatcgtccgtgcctctgagtttctctccttcgctgacatactctccggagactggaatactagatcactgcttagggagtactccacttcaattgcgactaggggcgtgatgcatagtaacaaggcccggggatatgctcactgccaagggggtggttcgagcttccggcctctgcacaagccccagtggtttctcatcaacaagaaataccgcgagaactgcctggctgccaaagcactttttccggacttttgtctacctgcattatgcctgcaaactcagctcctcccttatttggccctactgaccattcctatgaggaaccaggcccagatatctttcattcaggatattggtcgactgccactgaaaaggcattttggaagactgaaaatggaagctcttactgatagggagcacggtatgatcgacccagactcaggtgatgaagcacagctaaacggagggcatagcgcagaagaatcattaggagagcccacccaggccaccgtccccgaaacctggtccctgcccctgtcccagaattccgcctccgagctgcccgcgagccagccccaacctttctccgcccagggagatatggaggaaaacataatcattgaggattatgagagtgatggaacctag

SEQ ID NO: 16975 - DNA, 510 bp, Artificial Sequence
  Description of Artificial Sequence: Synthetic coding sequence
atgaatcaggtgacagattgggttgatccatccttcgacgactttctcgaatgcagtggtgtgagtactattacagctacaagcctgggcgtaaataattccagtcacagaagaaagaacggacccagcactctggagagcagcagatttccagcacgaaagagaggaaatttatcatcattggagcagatttatggactcgagaacagtaaagagtatttgtcagagaacgaaccctgggtcgataagtacaagccagaaacccagcacgagctggctgttcacaagaaaaagatcgaggaggttgagacctggctcaaggcgcaggtcctggaacgccagcctaaacagggaggctctatcctcttaattacaggcccacctggatgtggcaagacgacaaccttgaagattctgtccaaggagcatggcatccaggttcaagagtggattaacccggtcctccctgacttccagaaagacgacttcaagggtatgtttaacacctag

SEQ ID NO: 16976 - DNA, 66 bp, Artificial Sequence
  Description of Artificial Sequence: Synthetic coding sequence
atgaaccaagttacagactgggtggatcccagtttcgacgattttctggagtgctccggggtctag

SEQ ID NO: 16977 - DNA, 2046 bp, Artificial Sequence
  Description of Artificial Sequence: Synthetic coding sequence
atgtcgaagacctttctccgcccaaaggtgtccagcaccaaggttaccgattgggtcgacccaagctttgacgacttcctcgagtgcagcggggtctcaaccatcacggcaacctctctgggcgtgaataattccagtcaccggaggaagaacggcccctcaaccttggagagctcccgattccccgctagaaaaaggggaaatcttagctctctcgaacagatttatggcctggagaattcaaaggagtatctttctgagaacgagccctgggtggataagtacaagcctgagacccagcacgagctcgccgtgcacaaaaaaaaaattgaagaggtagaaacatggctcaaagctcaggtgttagagagacagccaaagcaaggcgggtctattttgctgattacaggcccaccaggatgcggaaaaaccacgaccctcaagatcctgtcaaaggagcatgggatccaggtacaggagtggattaaccccgtccttccagatttccagaaggacgacttcaaaggaatgttcaacacagaaagttctttccacatgtttccctaccagagccagatagcggtgtttaaggagttcctgctgcgggccaccaagtacaataagcttcaaatgttaggggacgatttacgtacagacaagaagatcatcttagtggaggacctgccgaatcagttttacagagacagtcacaccctgcatgaggtgctgaggaaatacgtgagaataggacgctgtccactgatcttcatcatatctgactctttgagcggcgataacaaccagcggctgctattcccgaaggagattcaggaagagtgctctatctcgaacatatcattcaaccccgtcgcccctaccattatgatgaaatttttgaacagaattgttaccatagaggctaacaaaaacggcggcaagattacagtcccagataaaacgagtttagaactgctatgccaaggctgcagtggtgatataaggagcgctatcaattctttacagttcagcagtagcaaaggcgagaacaacctgcgccccaggaagaaggggatgtccctgaagtctgatgccgtactgtccaagagtaaacggcgaaaaaagcctgatcgggtcttcgagaatcaggaagtccaagccatcggcggtaaagacgtttccctcttcctctttagggctcttggtaaaatattgtattgtaagcgagcttcactcaccgaactcgattcccctcggctcccttcccatctcagtgagtacgagagagataccttactcgtggagccggaggaagtcgtggagatgtcacacatgccgggtgacctgtttaatctttacctgcaccagaactatatcgatttttttatggagattgacgacatcgtaagagcatctgagttcctgtcgttcgccgacattctgtccggggactggaatacaaggagcctgctgcgcgaatattctacttcaatcgcaacgagaggggtcatgcatagtaataaggctcggggctatgctcattgccagggaggcggatcatcattccggccgctgcacaagccccagtggtttcttatcaataaaaagtaccgggaaaattgcctcgcagcgaaagccctgttcccggatttctgcctgcccgctctgtgcctgcagacacagctcctaccttacttggcccttctgaccatacctatgcgtaaccaggcccagatttcatttatccaagacataggaaggcttcctctgaagcgtcactttggacggctcaagatggaagcactgacagatcgcgagcatggtatgatcgacccggatagtggagatgaggcacagctgaacggcgggcactccgccgaggaatcacttggagagcccacgcaggccacggttcctgagacttggtccttgcctctaagtcaaaattcagcatctgagctccctgcctcccagccacaacctttcagtgcccagggggatatggaggagaatattatcatagaagactatgaatcagatggtacttag

SEQ ID NO: 16978 - DNA, 1518 bp, Artificial Sequence
  Description of Artificial Sequence: Synthetic coding sequence
atgttcaataccgaaagtagttttcatatgtttccctaccagtcccagatcgcggtgttcaaggagttcctattgcgcgcgacaaagtataacaaactgcaaatgcttggcgatgaccttaggactgacaagaaaattatattggttgaggatttgcctaaccaattctatcgggattcacacaccctgcacgaagtattaagaaaatatgtgcgaattggccgctgccctctaattttcatcatatctgactcactgtcaggcgacaataatcaacgcctcctctttcctaaggaaattcaggaagaatgctctattagtaatatatcatttaatccagtcgccccaactatcatgatgaagttcctgaatagaatcgtcaccattgaagccaataaaaatggcggtaagattaccgtccccgataagacaagtttggaactcctgtgccagggctgctctggagatatccggtcagctataaattctctgcagttcagtagctctaaaggagagaacaacttgcgccctcgtaagaagggaatgagcctgaagtccgacgcagtcctgtctaaaagtaagaggagaaagaaacccgaccgggtttttgagaatcaggaggtgcaagctatcggcgggaaggacgttagcctttttctatttcgcgccttgggcaaaattctgtactgtaagagagcatcactgactgaactagatagtccccggctccccagccacttatctgagtacgagagagatacacttctggtcgagcccgaggaagtggtcgagatgtcacacatgccaggcgatctgttcaatctctatctccaccagaactatatagacttctttatggagattgacgacattgtgcgggcttcagagtttctgagcttcgcagacatactctcaggagattggaatacaaggtcactactaagggaatactcaacgtctattgcaactcgaggtgtgatgcactcaaataaagctcgggggtacgcccactgtcaaggaggtggatcgtctttccggccactgcataagccacagtggtttctgataaacaaaaagtaccgagaaaattgtctcgctgcaaaggcattattcccagatttctgtctccctgccctctgcctgcagacacagctgttaccatacctggctctgctgactatcccgatgaggaatcaggcgcagatcagcttcattcaggacatcggcagactccctttgaagcgtcactttgggagattgaagatggaggcattgacggacagggaacacggaatgatagaccccgacagtggagacgaggcccaactgaacggaggccactccgctgaagagtctcttggggaacctacccaggcgactgtgccggaaacttggagccttcctctgtcacagaactcagcctcagagctaccagcgagtcaacctcaacccttcagcgctcagggcgatatggaggagaatataatcattgaggactatgagagtgatgggacatag

SEQ ID NO: 16979 - DNA, 1488 bp, Artificial Sequence
  Description of Artificial Sequence: Synthetic coding sequence
atggacagtctggctgagtcgaggtggccgcccggtctagccgtgatgaaaaccattgacgatctgctcagatgcggcatctgttttgaatacttcaatattgcaatgatcattccacagtgttctcacaactactgttcactgtgtataaggaagtttctgagctacaagacacagtgccccacctgctgcgtcactgtcactgagccagatttgaaaaacaacaggatattagacgagctggtgaagagcctgaattttgctaggaaccacctgctacagtttgcacttgagagtccagcaaaatctccagccagtagctcttccaaaaatcttgccgtcaaagtttacactcccgtggctagccgccaaagcctcaagcagggctcccgcttgatggataatttccttattcgcgaaatgtcaggctcgacatccgagctcctgatcaaggaaaacaagtctaagtttagtcctcagaaagaagcgtcccctgccgctaaaacaaaggagacccgatctgtggaggagatcgctcctgatcctagcgaagccaagaggcccgagccaccatctacaagtactctgaaacaggtgacaaaagtcgattgcccagtctgtggtgttaacattccagagagccatatcaacaaacatctcgactcatgcctgagtcgggaggaaaaaaaggaaagcctgcgtagttcagtacataagagaaaaccactccctaaaacagtctataacttgctgagtgatcgggacctgaaaaagaaactcaaggagcatgggctaagcattcaggggaacaagcagcagctcatcaagcgtcaccaggagtttgttcatatgtacaatgcccaatgtgacgctctgcatccaaaatccgcagctgaaattgtccgagagattgaaaacatcgagaaaacccggatgaggctggaggcttcaaaactcaacgagtctgtgatggtcttcacgaaagaccagacggaaaaggagattgacgagatccattctaagtaccgaaaaaagcacaaatctgaattccagctgctggttgatcaggccaggaaagggtacaaaaagatcgctgggatgtcccagaagacagtcacaatcaccaaggaagacgagagcacagagaagttgagcagtgtgtgcatgggtcaggaagataatatgacatccgtcactaaccacttctctcagagcaagctagatagtccagaagagctggagccggacagagaggaagatagctcctcttgtatcgacatccaggaggtgctgtcttcaagcgaaagcgattcttgcaatagttctagttcagacatcatccgggacctgctggaagaggaggaggcttgggaggcttcccacaagaacgaccttcaggacaccgaaatttccccaaggcagaatagacgcactcgcgccgcagaatcagccgagatcgagccaagaaacaaacgaaataggaattag

SEQ ID NO: 16980 - DNA, 279 bp, Artificial Sequence
  Description of Artificial Sequence: Synthetic coding sequence
atggatagcctcgcagagagccgttggcctcccgggctggccgtaatgaagacaatcgacgacctcctcaggtgcggaatatgcttcgagtactttaatattgccatgattataccacagtgttctcacaactactgcagcctgtgtatccgaaaattccttagttacaagactcagtgccccacctgttgcgtgactgtgacggagccagatctgaagaataaccgcatactggatgaactcgtcaagtccctcaattttgcaagaaaccatctttag

SEQ ID NO: 16981 - DNA, 1092 bp, Artificial Sequence
  Description of Artificial Sequence: Synthetic coding sequence
atggccgtaacgataacattgaagactctccagcagcagacattcaagattaggatggagcccgacgaaaccgtcaaagtgttgaaagaaaagattgaagccgagaaggggagggacgcgtttcccgttgcaggccagaaacttatctacgcaggaaagattctgtccgacgacgtaccaatcagagattacagaattgatgagaaaaacttcgtggtggttatggtaaccaagaccaaggccggacagggaacctcagcaccccctgaagcatcacctacagcagcgcctgagtcatccacttcttttcctcccgcacctacctctggcatgtcacatcccccaccagccgcaagggaagacaagtccccttcagaagaatcggcccccacaacttccccagagtcagtctcaggaagcgtacctagttccggatctagtggacgcgaggaagacgcagccagtactctggtgacggggagtgaatacgaaaccatgctgactgagattatgtcaatgggatacgaacgggagagggtcgttgctgccttgcgtgcttcctataataacccccaccgggcagttgagtatctactgacaggaatcccaggctctcctgaacccgagcacggaagcgttcaggagtcacaggtgtctgagcagcctgcgacggaggcggctggcgagaaccccctggagttcctgcgcgaccagccccaattccagaatatgcggcaagtgatccagcaaaatcccgctcttctcccggctctcttgcagcaacttggtcaagagaatcctcagctgttgcagcagatctccaggcaccaagagcaatttatccaaatgctcaacgaaccgcctggagaacttgccgacattagcgacgtggaaggggaggtgggcgccatcggagaagaagccccccagatgaattacattcaggtgacaccccaagagaaggaagctatcgaacgactaaaggcactgggatttccagaatccctggtcatccaggcatattttgcgtgtgaaaagaatgagaatttggcggcaaatttcctgttgtctcagaacttcgacgatgaatag

SEQ ID NO: 16982 - DNA, 597 bp, Artificial Sequence
  Description of Artificial Sequence: Synthetic coding sequence
atgcttacagagatcatgagtatgggatatgagcgcgagcgtgtggtcgcagctctgagggctagctataataatcctcatcgagccgtcgagtatcttctcactggtatccccgggtcccctgaaccagagcacggttcagtgcaggaatctcaagtaagcgagcagcccgctaccgaggctgccggagagaaccctctggagtttctaagagatcagccccaatttcagaacatgcggcaagtaattcagcagaatccggctctgcttcctgctttgctgcagcagctcgggcaggaaaacccccaactcctacagcagatttcaaggcaccaggaacagtttattcagatgttgaacgaacctcctggcgagcttgccgacatctcggacgttgagggggaggtcggggccataggcgaagaagccccacaaatgaattatatacaggtgacacctcaagagaaagaagcgatcgagaggcttaaagctctgggattcccggaatcactagtaatacaggcttactttgcttgtgagaagaacgagaatttagctgcgaactttttactgtcacaaaacttcgatgacgaatag

SEQ ID NO: 16983 - DNA, 1092 bp, Artificial Sequence
  Description of Artificial Sequence: Synthetic coding sequence
atggctgttacaattactttgaaaactctgcaacagcagacgtttaaaattagaatggaacctgacgaaactgtcaaggttctgaaggaaaagattgaggccgagaagggcagggatgcctttccagtcgcgggccagaaattgatttacgctgggaagatcctgtcagatgacgtcccgatacgcgactataggattgacgaaaaaaactttgttgtggtaatggttactaagaccaaagctgggcaggggacatccgcacccccagaggcatctcctaccgcagctccagaatcgagcacatcctttcctcctgcacccacgtctggaatgagccatccacctccggctgcccgagaggataagtccccgtcagaagagagcgctccaacaaccagtcccgagagcgtgtccggatccgtcccatcctccgggagtagcgggagagaggaagacgctgcctccactctggtcaccgggtccgagtacgaaacgatgctaaccgagatcatgtccatgggatatgagagggaacgagtcgtggctgcactccgcgccagttataacaacccccatagggcagtggaatatctgttaactggcatccccggttcgcccgaaccggaacatggatcagtccaggaatctcaggttagcgagcaacccgccactgaagccgccggcgaaaatcctctcgaatttctgagggatcaaccacagttccagaatatgcggcaagtgattcagcaaaatcctgcactcttgccggctctcttacagcagcttggccaggaaaaccctcagctcctgcagcagatatctcgacaccaggagcaattcatccagatgctgaatgagcctccaggagagcttgcagatattagcgacgtggagggtgaggtgggagccatcggggaggaggccccccagatgaactacatacaagttacgccccaagaaaaggaagctatcgagaggttgaaggccctgggtttccctgagagcctcgtgattcaggcctattttgcttgcgagaaaaacgaaaatcttgcagctaattttctattgagccagaattttgatgatgaatag

SEQ ID NO: 16984 - DNA, 927 bp, Artificial Sequence
  Description of Artificial Sequence: Synthetic coding sequence
atggccgttactattacattgaagacgctgcagcagcaaacatttaagattcggatggagcctgacgagaccgtcaaggtactgaaggagaaaatcgaggccgagaagggtcgcgatgcattcccggtggctgggcagaaactcatctatgctggaaagattctgagcgatgatgtgcccatacgcgattatcgcatcgatgagaagaactttgtcgttgtaatggtgacaaagactaaggctgggcaaggaacctccgcaccccctgaggcgtcaccaactgcggcccctgaatcatcaacctcatttcctcccgcacccacttcagggatgtcacacccaccgcccgcagcaagagaggacaaatcaccaagtgaagagtcagccccaacaaccagcccggaatctgttagcggctctgtgccttcgagtgggtcttccgggagagaagaggatgccgcctctaccctcgtgacaggctccgagtatgaaaccatgctcaccgaaattatgtccatgggctatgaaagggagcgggtcgtggcggctctgcgcgcaagctacaacaacccacacagggcggttgaatatctattgaccggaatcccaggatcgcccgaacccgaacacggatccgtgcaggagagccaggtctctgaacaacccgctactgaagccgcaggagaaaatcccctggagttcctccgcgatcagccccagtttcagaatatgagacaggtcattcagcaaaaccccgctctcttgccggccctcctgcagcagctcggtcaagagaatccacaactgctgcagctgaaggctttagggttcccagaaagtcttgtcatccaggcttacttcgcctgcgagaagaacgaaaaccttgcagccaactttcttttgtcccaaaacttcgacgatgagtag

SEQ ID NO: 16985 - DNA, 1230 bp, Artificial Sequence
  Description of Artificial Sequence: Synthetic coding sequence
atgcaggtgacactcaagaccctgcagcagcaaactttcaaaatcgatatcgaccccgaggagactgtgaaggccctcaaggaaaaaatcgagtcggagaagggaaaagatgccttccccgtggccggacagaagcttatatatgctgggaagattctgaatgacgacaccgctttgaaagaatacaaaatcgatgagaagaacttcgtcgttgtcatggtaacgaagccaaaggccgtgagcacaccagcccccgctacaacacaacagagcgccccagcctcgaccacagcagtcacatcgtcaactactactaccgttgcccaagctcccacgccggtcccagccctggctcctactagcacaccagcaagcatcacccccgcaagcgcaaccgcttcctctgaaccagcccccgcctccgcggccaaacaggagaaaccagccgagaagcccgccgagacccccgttgccacatctccaactgcaactgatagcacatccggagactctagtaggtccaacttgttcgaagatgccacaagtgcgctggttactggccagagctacgagaatatggtgaccgagattatgagcatgggctatgagagagaacaggtcattgccgctttgagggccagctttaacaatcctgaccgcgccgtggagtacctgcttatgggtataccaggggacagagagtcgcaggccgttgtcgacccgccccaggctgcgtcaacgggagcaccccagtccagcgctgtcgcagctgcagcagctaccaccaccgccaccaccacgaccacatccagcggggggcacccactcgagttcctgcgtaatcagccccaattccagcagatgcgccaaattatccagcagaatcctagccttttgcccgctttgctccagcagatcgggcgcgaaaatcctcaactccttcagcagatctcccagcaccaagagcacttcatccaaatgctgaacgagccagtccaagaagccggtgggcaggggggtggcggagggggaggttctggcgggattgcggaagctggaagcggccatatgaattacatacaggtgacaccccaggaaaaggaagcgatagagcgcctcaaggccctcggatttcctgaaggcctggtgattcaggcttacttcgcctgtgagaaaaacgaaaatcttgccgcaaacttcttgctgcagcagaatttcgatgaggactag

SEQ ID NO: 16986 - DNA, 519 bp, Artificial Sequence
  Description of Artificial Sequence: Synthetic coding sequence
atggtgaccaagccaaaggcagtttccacccccgcacctgcaacgacccagcagtccgcgcccgccagcacgaccgctgttacctccagcaccaccacaaccgtcgcccaagcgcccacccccgtgcctgcgctggccccaaccagcacaccagccagtatcacaccagcatccgccaccgctagtagcgagccagcacccgcatccgcggctaaacaggagaagcccgccgaaaaaccagcagagactcctgtcgcgacttctcccaccgcaaccgattcgacctctggagattctagtagaagcaacttgttcgaagatgccacaagcgcactcgtgactggacagtcctatgagaacatggtaaccgagattatgtctatgggttacgaacgcgaacaggtcatagccgcactgcgcgcctcattcaataaccctgaccgggctgtggagtaccttttgatgataattgttaagacagggaacaagaagaaaaagcaacctcttctgggaaagtag

SEQ ID NO: 16987 - DNA, 1014 bp, Artificial Sequence
  Description of Artificial Sequence: Synthetic coding sequence
atggtcactaagccaaaagctgtgagtacaccagctcctgccacaacacagcagtctgccccagcgtccaccacagcagttacctcgtccacgaccactactgtggcccaggctcctacccccgtccccgcgttggcccctacatccacccccgcaagcattactccagcaagcgcgaccgcgagcagcgagcctgctcccgcctctgcagcaaagcaggaaaagccagcagaaaagccggccgaaactccagtggcaacctccccgaccgccaccgattccacatccggggatagttcacggtctaatctctttgaggacgctacctccgctttggtcaccggtcagtcatacgaaaatatggtcacggaaattatgagtatggggtacgaacgggaacaagtcattgccgccctgcgagcttccttcaataatcccgaccgcgccgtggagtatctgctcatgggaattccaggagatcgcgaatcgcaagctgttgtggatcccccccaggcagcttccaccggcgcaccccagtcatctgccgtcgcagcagccgctgctactacaactgcaaccacaaccacaaccagcagtggaggccatcccctggagtttctgcggaatcagccgcagttccagcagatgcgacagatcatccaacagaatccatcacttctgccagccttgttgcaacagatcggcagggaaaaccctcagttgttgcagcaaatttcacagcatcaggagcacttcatacagatgttgaatgaacccgtgcaggaggcaggaggtcaaggcggcggtggagggggaggctctggagggatcgcagaggcggggtcaggccacatgaattatatccaggtgacccctcaggagaaagaggctatcgaaagactgaaagctctggggttcccggagggactggttatccaggcatactttgcttgcgaaaagaacgagaacttggccgctaattttctactgcaacagaactttgatgaggactag

SEQ ID NO: 16988 - DNA, 441 bp, Artificial Sequence
  Description of Artificial Sequence: Synthetic coding sequence
atgcaggtcaccctgaagacactgcagcaacagactttcaaaattgatattgaccctgaggaaactgtcaaggcccttaaagaaaagatcgaatcagagaaggggaaggacgccttccccgttgcaggtcagaagcttatctatgccgggaagatcctgaacgatgacaccgccctgaaagagtacaaaattgacgagaagaatttcgttgtggtaatggtgactaagcccaaagctgtgagtaccccagccccggccacaacccaacagtccgctcctgcatcgactacagccgtgacctccagcaccactactaccgttgcccaggccccaacccctgtcccagctctggcgcctacgtccacacctgccagcatcaccccagcaagcgccacagccagtagcgaacctgcccccgcctccgcagcgaaacaggagtag

SEQ ID NO: 16989 - DNA, 243 bp, Artificial Sequence
  Description of Artificial Sequence: Synthetic coding sequence
atggtcaaggcgctcaaagagaaaatagaatccgagaaaggaaaggacgcattcccagtggcaggtcaaaaattgatttatgccgggaaaattcttaatgatgatacagctttgaaagaatataagattgatgagaagaattttgtcgtcgtgatggttaccaaaccaaaggccgtctctacacctgctcctgctacgactcagcaatcagccccagcctccaccaccgctgtcactagctag

SEQ ID NO: 16990 - DNA, 345 bp, Artificial Sequence
  Description of Artificial Sequence: Synthetic coding sequence
tgaacggcctcatcagagcctgccccagcatcagcggcaaagcaggagaagcccgcggagaaacctgctgagactcccgtcgccacgtcccctacagccaccgatagcacctctggagatagctcaaggtccaacctcttcgaggatgcaacaagcgctcttgtgaccggacaaagttacgagaatatggtgacagaaatcatgtccatgggctacgaacgcgaacaagtgattgccgcactgagagcgtcatttaataaccctgaccgcgctgtggagtacctgctgatgataatcgtaaagacaggcaacaaaaaaaagaaacaaccattgcttggcaagtag

SEQ ID NO: 16991 - DNA, 3939 bp, Artificial Sequence
  Description of Artificial Sequence: Synthetic coding sequence
atgtctcgaatagagaagatgtcaattctgggcgttagatcatttggaatagaagacaaagacaaacaaattattaccttctttagcccattaacaattctggtgggaccaaatggcgctggcaaaacaacaattattgaatgcctaaaatacatctgcaccggggactttccgcctggaacgaaaggaaatacattcgtccatgacccaaaagtagctcaggaaacagacgtccgggctcagatccgccttcagtttagggacgtgaacggagaacttattgccgtccagcgctctatggtctgcacacagaagagtaaaaaaacagaatttaaaaccctcgagggggttatcacccgaactaaacacggggaaaaggtctcccttagtagtaaatgtgccgagatagatcgcgagatgatttcatctttgggagtctcaaaagccgtgctgaataatgtcatcttttgccaccaggaagatagcaactggccactctctgaaggcaaagcactgaagcagaaattcgatgaaattttttctgctacacgttatataaaggctctcgaaacactccgccaggtgaggcaaactcagggccagaaagtgaaagaatatcagatggaactaaagtatctgaaacagtataaagagaaagcatgcgagattagggaccagatcacctccaaggaggcccagctcacatcttcaaaggagatcgtgaaaagttatgaaaacgaactcgacccgctaaagaaccgattgaaggaaattgaacataacctctcgaaaatcatgaaactagacaatgagattaaggctctggattctcgcaaaaagcaaatggaaaaagataacagcgaactcgaggagaagatggagaaagtcttccagggcactgatgagcaactgaatgatctgtaccacaatcaccagaggacagtcagggagaaagaaaggaagctggtggattgccatagggagctggagaaacttaacaaagagtcacggctcctgaatcaggagaagtccgagctgctcgtggaacagggccgcctgcagctgcaggcagatcgacaccaggagcacattcgtgctagagattcactaatccagtcgctggctacgcaactggaactggatggcttcgagcggggccctttttccgagcgccagattaaaaactttcataaacttgttcgagaaaggcaggaaggcgaagccaagactgccaaccagctgatgaacgatttcgctgagaaggaaaccttaaaacagaagcagatcgatgaaatccgcgacaagaagacaggtttgggtaggattatcgagcttaaaagtgagatcttgtcaaaaaaacaaaacgagctcaaaaatgtgaaatatgagctgcagcaactggagggtagtagcgatcggatcctggagctggatcaagagctgataaaagcggaacgagagctgagcaaggcagaaaaaaactccaacgtggagactctaaaaatggaagtcatctctctacaaaatgagaaagccgacctggatcgtaccttgcggaagcttgaccaggaaatggaacagctcaatcatcacacgactaccaggacccaaatggaaatgttaactaaagacaaagcagacaaggacgaacagatccggaagatcaagtcacggcatagtgacgaactgacatctttgctgggctattttccaaataagaagcaactggaggattggctccactcaaagtctaaagaaataaatcaaactagagaccgtctcgccaagctcaataaagaactcgcctcttcagagcagaacaagaaccatattaataatgagttgaagcggaaggaggagcagctctcatcatacgaggataaactatttgatgtctgtggcagtcaggactttgaatctgatctggacagacttaaggaagagatcgagaagtcctccaagcagagagcaatgctggctggggccacagcggtttacagccagttcattactcagcttacggatgagaatcagtcctgttgtcccgtgtgccagcgggtgtttcagacagaggccgagctgcaggaggtgatttcagatctgcagagcaaactgcgcctagcccccgataagctgaagagcactgaatcagagttaaaaaaaaaagaaaaacggcgcgatgagatgctcggtctggtcccaatgcggcagtctatcatcgacctgaaagaaaaggaaatccccgaactgaggaacaagcttcaaaacgtgaacagggacatccagcgcctaaaaaatgacatcgaggagcaggagactctgctgggcactattatgcccgaagaggagtcagcgaaagtgtgcctgaccgatgtcacaattatggagaggtttcagatggagctgaaggacgtggagaggaaaatcgcgcagcaggccgccaaactgcagggaatcgacttggaccggacagtgcagcaggtcaaccaagagaaacaggaaaagcaacacaagctcgacacagtttctagcaaaattgagctgaatcggaagctcatccaggatcagcaggaacaaatccagcacctgaagagcaccacaaacgagctgaagtctgaaaagctccagatttcaaccaacctgcaacggagacagcagctcgaggagcagacagtggaactgtccacagaggttcagtccctatacagggaaataaaggatgcaaaggagcaggtctcccctcttgaaaccacattggagaagtttcaacaggagaaagaagaactcattaacaagaagaataccagcaacaaaattgcacaagacaaactaaacgatatcaaggaaaaagtgaagaatattcacggatatatgaaggatatcgaaaactacatccaggatggcaaagacgattataaaaaacagaaggagacagagctgaacaaagtgattgctcagctgtccgaatgtgagaagcacaaagagaagatcaacgaggacatgaggctcatgaggcaagatatcgatacccagaagatccaagagcgatggctgcaagacaacctgaccctgaggaaaaggaatgaagaactgaaagaggttgaagaggaacggaaacagcatctcaaggaaatgggccagatgcaggtactccagatgaagagtgagcatcagaagttggaggagaacattgacaacattaagcgcaatcacaatctggccctcggaaggcagaaggggtacgaagaggagatcatccattttaaaaaggagttgagagaaccccagtttagggatgcagaagagaagtaccgtgagatgatgattgtgatgcgtacgactgaacttgtgaacaaggatctcgacatttattacaagactctggatcaggcaataatgaaattccacagcatgaaaatggaggaaataaataaaattattcgggacctgtggcgtagtacatacaggggacaggacattgagtacatcgagatcaggtccgacgccgacgagaacgtcagcgcctcggacaaaagacggaattacaattatcgggtcgtgatgctgaaaggtgacacggcattagacatgcgcgggagatgcagcgccggtcagaaggtcctggcttcactaatcatacgtctggcattagccgaaactttctgcttgaattgcggaattatagccctagacgaaccaaccaccaatctcgatagagaaaacatcgagtcactcgcccacgctctggtagagattatcaagtccaggtcacagcagcggaatttccagctcctggtaattacacatgacgaagattttgttgagcttctaggaagaagcgagtacgtggaaaaattctatcgcataaagaagaacattgaccagtgctcagagatcgtgaaatgtagcgtttccagtctggggttcaatgtccactag

SEQ ID NO: 16992 - DNA, 3522 bp, Artificial Sequence
  Description of Artificial Sequence: Synthetic coding sequence
atgatatcctctctcggcgtttctaaagccgtgctcaataatgtgatcttctgccaccaggaagactctaactggcctctgtccgaggggaaggcacttaagcaaaaatttgacgaaatctttagcgccaccaggtatattaaggcactggaaaccctaaggcaggtgaggcagactcaggggcaaaaggtgaaggagtaccagatggagctgaaatacctgaagcagtacaaggaaaaagcttgtgagataagggatcagatcactagtaaggaggcccagctcactagctccaaggagatcgtgaagtcctacgagaatgaactggatcctctgaaaaacaggttaaaggagattgagcacaatctctctaaaatcatgaagcttgataacgagattaaagccttggattctcgcaaaaaacagatggaaaaggacaattcagaactcgaggaaaagatggagaaggttttccaggggacggacgagcagctgaatgacctctaccataaccatcagcgcaccgtgcgggagaaggaacgcaagcttgtagactgccacagagagctggaaaagctgaacaaggaatctcgactgctgaaccaggagaagtcggagcttctggttgagcagggtaggctgcaattgcaggctgatcgacaccaggaacatattcgtgcccgggacagcttgatccagtcattggccacgcagctggagcttgatgggttcgaaaggggaccattctcagaaagacagatcaaaaacttccacaaactagtgcgtgaaagacaggagggcgaggctaagaccgctaaccaactgatgaacgattttgcagagaaggagacacttaagcaaaaacagatagacgagattcgtgataaaaaaactggtttgggccgcatcatcgaacttaagtcagaaattctctccaagaaacaaaatgaacttaaaaacgttaagtatgaactacagcaactggaagggtccagcgatcggatactggagctcgatcaagagctgataaaggctgaacgggaactgagcaaggccgagaagaattctaatgttgaaactctcaagatggaagttatcagtctccaaaacgagaaggccgaccttgaccgcacgctcaggaaactcgaccaggagatggagcagttgaatcatcatactaccaccaggacccagatggaaatgcttacgaaagacaaggccgataaagacgagcagattcgaaagatcaaatctagacattccgacgaactgacatctctgctggggtatttcccaaataaaaagcagctggaggattggctccactccaagtccaaagaaattaaccaaacaagagatagactagccaagctgaacaaagaactggctagtagtgaacaaaacaagaatcacattaataacgagctgaagcgcaaggaggaacagttatcatcatatgaggacaaattatttgacgtgtgcggctcacaggacttcgagtctgacctcgaccggttgaaggaagaaatcgaaaaaagcagtaaacagcgcgcaatgctggctggtgcaactgccgtgtatagtcagttcatcacccagcttacagacgaaaatcagtcctgctgtcccgtgtgccagagggtgtttcagacagaagccgagctgcaggaggtgataagcgatctgcagtcaaagctccggctcgcacccgataaattaaagtctacggaatccgaactgaaaaagaaggagaagaggagggatgagatgcttggactcgttcccatgaggcagtccatcatcgacttaaaggaaaaggagatcccagaacttcgaaataagctccagaacgtgaaccgggacattcagagactcaaaaacgacatcgaagagcaggagaccctactgggaacaatcatgccagaggaggagtctgcaaaggtgtgtctgactgatgttactatcatggagcgctttcagatggagcttaaagacgtcgaaaggaagatcgcccagcaagcagctaaactccagggaattgatttagacaggacagtccagcaagttaaccaggagaagcaagaaaaacagcataaactggataccgtgtcctcaaagattgagcttaaccgcaaactcatccaagaccaacaagaacagattcagcacctcaaaagtactacaaacgaactcaagtccgagaaactccaaatctccactaatctccagagacggcaacagctggaggagcagacggtcgagctgagtacagaggtgcagtctttgtatcgggaaatcaaggacgctaaggaacaggtctctcccctggagaccactcttgagaagtttcagcaggagaaagaggaattaatcaataagaaaaacacctccaacaagattgctcaggacaaattaaacgatataaaagagaaggtgaagaacatacacggctatatgaaggacattgagaattatatccaggacggtaaggatgactataagaaacaaaaggaaactgaactgaataaagtcatcgcacaactgtcagaatgtgaaaagcataaagagaaaatcaacgaagatatgagactgatgcgccaagacattgacacccagaaaatccaggagcggtggctgcaggacaatttgactctccgaaagcgcaatgaggaattgaaggaggttgaagaggaacgtaaacagcatttaaaggaaatgggccaaatgcaggtgctgcagatgaagtcagagcaccagaagctcgaggaaaatatagacaatatcaagcggaaccacaacctggccctgggcagacagaaaggctatgaggaggagatcatacattttaagaaagagcttagggagccacagttccgcgatgccgaggaaaagtaccgcgaaatgatgattgtcatgagaacaacggaattggtgaataaagacctagatatctattacaagacgcttgaccaggctatcatgaaattccactcaatgaaaatggaggagattaataaaattattcgcgacctatggcgaagtacgtaccgtggccaggacatagagtatattgaaatccggtcagacgccgacgagaatgtttctgcatccgataagcggaggaactacaactatcgcgtggtgatgctgaagggggacactgcgctagatatgcgcggcagatgttctgcggggcaaaaggtcctcgctagcctgattataaggctggcactggctgaaaccttttgcctcaattgcggaatcattgcgctcgacgagcccaccacgaatcttgatcgcgagaatatcgaatccctggctcatgccctggtggagataataaagtcgcgaagccagcaacgcaacttccagcttcttgtgatcacacacgacgaagattttgtggagttactggggagatccgaatatgttgaaaagttttatcgtatcaaaaagaacattgaccagtgttccgaaatcgtgaaatgctctgtgtcctccttagggttcaacgtgcattag

SEQ ID NO: 16993 - DNA, 1020 bp, Artificial Sequence
  Description of Artificial Sequence: Synthetic coding sequence
atggcaatgcagatgcagctggaagccaatgccgacaccagcgtggaagaagagtccttcggcccacaaccgatatctagactcgagcagtgtggaattaacgctaatgatgtgaagaagctggaggaagccggatttcatacagtagaggctgtggcttacgcccctaagaaggagttgattaatatcaaaggcattagcgaggccaaggccgataagatcctcgcggaagccgcgaagttagtccccatgggcttcaccaccgccactgagttccaccagagacgaagtgagataattcagatcactacaggctctaaagagctggacaaattgctccaaggcggaatagaaaccggaagtattacagagatgttcggagaattccgaaccgggaaaacacaaatttgccacactctggcagtgacctgccagctgcccatcgatcggggcggaggcgaagggaaggccatgtatattgacacagaaggaacctttcgccctgagagactcctggctgtggccgaacgatacgggctttctggttctgatgttcttgacaatgtggcctacgccagggccttcaatacagaccatcaaacacagttgctataccaggctagcgccatgatggtagaaagcagatatgctctcctgattgtcgatagcgccacggcactttataggactgattacagcggtcggggcgaattgtctgctcgccagatgcatcttgcccgattcctcaggatgctgctgagactggctgatgaatttggtgttgctgtggtgatcaccaaccaagtcgtggcacaggtcgatggagccgcgatgtttgcagctgatcccaagaaaccgatcggagggaatatcatagctcacgcctccacaactcggctctacttgagaaagggacggggggaaacccgcatatgtaagatctacgacagcccatgcctccctgaagcggaagcaatgtttgctattaacgcagatggggtgggagatgcaaaagactag

SEQ ID NO: 16994 - DNA, 729 bp, Artificial Sequence
  Description of Artificial Sequence: Synthetic coding sequence
atggcaatgcagatgcagttggaggcaaacgctgacacctcagtggaagaggaaagtttcggaccccagcctatcagtagactggaacagtgtgggataaatgcaaacgatgtgaaaaaactggaggaggccggcttccacactgtggaggccgtcgcctatgcgcccaagaaggaactcattaacatcaaaggcatcagcgaggctaaagctgacaagatacttcttctgtcccaccgttacgggcttagcgggagcgacgtactggacaacgtggcatacgcccgcgcttttaacacagaccatcagactcagctgctgtaccaggcgagtgccatgatggtggagtccaggtacgcgctccttatcgtcgacagcgctactgccttatatcggaccgactattccggacgcggggagctttccgctcgccagatgcacttagccagatttctacggatgctgctcagactggctgatgagttcggagtcgcagtagtaatcactaatcaagtcgtggcacaggtggacggggccgcaatgttcgcagccgaccctaagaaacctatcggcggaaatattattgcacacgcgtctacaaccagattatacctgaggaaaggtaggggtgaaacaagaatctgtaaaatttacgattcaccgtgtctgcctgaggccgaggcaatgttcgcaatcaacgccgatggagtcggggatgccaaagattag

SEQ ID NO: 16995 - DNA, 1023 bp, Artificial Sequence
  Description of Artificial Sequence: Synthetic coding sequence
atggccatgcagatgcagctggaggcaaatgccgatacgagtgtcgaagaagaaagtttcggaccccagcccatcagccgccttgaacagtgcggaattaacgcgaacgacgttaaaaagctggaggaggcagggttccacactgttgaagccgtggcctacgctcccaagaaggagttgataaatatcaagggaataagcgaggccaaggcggataaaattctcacagagagccggtctgtggcacgtttggaatgtaacagcgtgatccttgtgtattgtaccctgcggctctccggttcatctgatagccctgcctccgccagtagagtggtcgggactactggtggtatcgaaaccggctctatcaccgaaatgttcggggaattccggacaggtaagacccagatttgtcatactttggccgtgacatgccaacttcccattgacagaggaggaggggagggcaaggcgatgtatatagataccgagggaacgtttaggccagaacgtttgttggccgtagccgaaagatatggactttccggaagcgacgtcctggataacgtagcctacgcgagagccttcaacacggaccaccaaactcagctgctgtaccaggcttcagctatgatggtggaaagccggtacgcactgttaatcgtggattccgccactgccctttatcgtaccgactattccggccggggagagcttagcgccaggcagatgcacctggcgaggttcctccggatgctacttcgcctggccgatgagtttggggttgctgtggtgatcacaaaccaggtcgtagctcaggtggatggtgccgccatgttcgctgccgatcccaaaaagccaatcggcggtaatattattgctcacgctagcaccactcgcctgtatctgagaaaagggaggggtgaaacccggatttgtaagatctatgatagtccgtgcttacccgaggccgaagctatgttcgccattaatgcagatggagtgggagatgccaaagactag

SEQ ID NO: 16996 - DNA, 843 bp, Artificial Sequence
  Description of Artificial Sequence: Synthetic coding sequence
atggctatgcagatgcagttagaggctaatgcggacacatcagtcgaagaagagagttttggcccccagccaatctcccgcttggaacaatgtggcatcaacgccaatgacgtgaagaaacttgaagaggccggctttcacaccgtggaagcagtggcgtacgcacccaagaaggagctaattaatattaaaggcatcagtgaggctaaggctgataagattcttgcagaggcggcgaagctagtccccatggggttcacaactgccactgagtttcaccagagacgaagcgagattattcaaatcactactggctctaaagagttggataaactgttgcagggggggatagagacaggaagcatcacagagatgtttggtgaattcaggacagggaaaacccagatttgccacactctagcagtgacctgccagctccctatcgacaggggagggggggagggtaaggcgatgtatatcgacacggaaggcacattccggcccgaacgcctcttagcggtggccgaacggtatgggctgtccgggtctgacgtcctggacaacgtggcttatgccagggcctttaatacggatcaccagacacagctcctttatcaggcgagtgcaatgatggttgaatctagatatgcccttctgatcgtggatagcgccactgcattatatagaacagactactccgggcgaggggagctgtctgctcgacagatgcatttggctcggtttttaaggatgctgctgcgactcgctgacgaaatcgttagcgaagaacgtaaaagaggaaaccagaacctccaaaaccttagactctctctgagttcatag

SEQ ID NO: 16997 - DNA, 456 bp, Artificial Sequence
  Description of Artificial Sequence: Synthetic coding sequence
atggcaatgcagatgcagctggaggcgaatgccgatacctcagtcgaagaggaatcttttggcccccagccgattagcagattagaacagtgcggcattaacgccaacgatgtgaagaaactcgaggaagccggtttccacactgtggaagctgtggcttacgccccgaaaaaagaactcattaatataaaaggcatttctgaagcgaaggccgataagattttagctgaagcggccaaacttgtgccaatggggtttacaactgccacagagttccaccagaggcggagcgagatcattcagatcacaaccggctcaaaggagctggataaacttctgcaggggggtatcgaaacaggcagtattaccgaaatgttcggtgagtttaggaccggcaagactcaaatctgccacacgctggcggtcacatgccaggtgtggtccctgtggcaatag

SEQ ID NO: 16998 - DNA, 228 bp, Artificial Sequence
  Description of Artificial Sequence: Synthetic coding sequence
atggctatgcagatgcagctggaggcaaacgctgacaccagcgtcgaggaggagagctttggcccacaacctattagtagattggaacagtgtggtattaatgccaatgacgtaaagaagctagaggaagcgggctttcatacagtggaagccgtggcgtatgcccctaagaaggaactgataaatattaagggcatatccgaggcgaaggcagataaaattctttag

SEQ ID NO: 16999 - DNA, 519 bp, Artificial Sequence
  Description of Artificial Sequence: Synthetic coding sequence
atggccatgcagatgcaattagaagccaacgccgacactagcgtagaagaagaaagctttggcccgcaacccatttctcgcctggaacaatgtggcatcaatgccaatgacgtgaaaaaactggaggaggccggttttcacacggttgaggctgtcgcttatgctccaaaaaaagaactaatcaatattaagggcatctccgaggcaaaggcggacaagatcctcgccgaggctgctaagctcgtacccatgggcttcaccaccgcaacggagttccatcagcgccggagcgaaatcatccagatcacgacaggatccaaggagctcgataagctgttgcagggaggtatcgaaactgggagcatcaccgagatgtttggtgaattccgtacagggaaaacgcaaatatgccacactctcgcggttacttgtcagttgcctattgatagaggtggcggcgaagggaaggccatgtacatagacacagagggaacatttagacccgagaggttgctctag

SEQ ID NO: 17000 - DNA, 303 bp, Artificial Sequence
  Description of Artificial Sequence: Synthetic coding sequence
atggcaatgcagatgcagctcgaggcgaacgccgacacttcagtggaggaagagagttttggcccccagccaatctctcggcttgaacagtgtggcatcaatgcgaatgacgtcaaaaaattggaagaggctgggttccacacagttgaggctgtggcatacgccccgaagaaagagttaattaatatcaaggggatcagcgaggctaaagcagacaaaatccttgtagagctccgccttgacctgtctcagaaatgcctcgaaaattccgagctagggaggccccgtagcgttatcaggtag

SEQ ID NO: 17001 - DNA, 1023 bp, Artificial Sequence
  Description of Artificial Sequence: Synthetic coding sequence
atggccatgcagatgcagttggaggccaatgccgatacttccgtggaggaagaaagctttggcccgcagccaatctctcggctcgagcagtgtggtatcaatgctaacgacgtgaaaaagctcgaagaggccggcttccataccgtggaggccgtagcatacgcccccaaaaaggagttgatcaatattaaggggatctcagaagccaaggcagacaaaatcctcaccgagagccgtagtgtcgccaggctggagtgcaattcagtgatccttgtttattgcacactgaggctgtcagggtcctcagactcccccgccagtgccagccgcgtcgtgggaactaccggtggaatcgaaacaggttccataaccgaaatgtttggagagtttagaacaggcaagacgcagatttgccacaccttggcagtcacatgtcaactgcccatcgaccgggggggcggcgagggcaaggccatgtatattgacacagagggaaccttccgtccggagagactgctggctgttgctgaaagatatggcctgtcagggtctgacgtgctggacaatgttgcatacgctcgcgcgttcaacacagaccaccaaacgcagctcctttaccaagcctccgccatgatggtggagagccgctacgcattactgattgtggattctgcaaccgccctttatagaacagactatagcggtcgcggtgagctgtccgctcgacaaatgcatctagcgaggtttctacgaatgcttctgaggttggcagatgaatttggagtcgccgtggtgattactaaccaggtggtcgcacaggtggacggagcagccatgttcgccgccgacccaaagaagccaatcggtggcaacataatcgcccacgcgagtacaactagactgtacttgagaaaggggagaggcgagacacgaatctgcaagatttacgacagcccctgcctacctgaggccgaggccatgttcgctatcaacgccgatggcgtgggcgacgccaaagattag

SEQ ID NO: 17002 - DNA, 729 bp, Artificial Sequence
  Description of Artificial Sequence: Synthetic coding sequence
atggcaatgcagatgcagttagaggcaaatgcggacactagcgttgaggaggagagcttcggcccccagcccatttccaggctggagcagtgcggaatcaacgcaaatgacgtgaaaaagctcgaggaggcgggctttcatacggtcgaggcagtcgcttacgctcctaaaaaagagttgattaatatcaaaggaatctccgaagccaaggcagataaaatcctagccgtggccgagcgctacggcttatcagggagcgatgtgctggacaacgttgcctacgccagggctttcaatacagatcatcagacccagctgctgtaccaggcttccgcgatgatggtggagagccgatatgccctcttgatcgtggactcagccacagctctctatcgcactgattatagcggcaggggcgaattgtccgcacggcagatgcatctagcgcgttttcttaggatgcttctgaggctggctgatgagttcggtgtggcagtggtgattactaatcaggtagttgctcaggtcgatggcgctgctatgtttgcagctgacccaaagaagcccatcggcggcaatattattgctcatgcctctacaacaagactttacctgcgaaaaggccggggagagactcgtatctgtaagatttacgactcaccctgtctcccagaagctgaggcgatgtttgctattaatgcggacggcgtcggagatgccaaggattag

SEQ ID NO: 17003 - DNA, 1053 bp, Artificial Sequence
  Description of Artificial Sequence: Synthetic coding sequence
atgggttctaagaagcttaaaagagtgggcctctcacaggaactttgcgaccggctttcacggcaccagatccttacctgccaagacttcttatgcctaagccctttggagctaatgaaggtaacagggctgtcctaccgcggcgtccacgagttgctgtgcatggtgagcagagcatgtgcccccaagatgcagaccgcgtatggcattaaagcccaaaggtcagccgatttctcacccgctttcttgagcactacactgagcgccctagatgaggcgttgcacggcggcgtcgcttgcggtagcctgaccgaaatcaccggaccacccggatgtggaaagacccaattctgtattatgatgtctatcctggcgacactccccaccaacatgggcggcctggagggggctgtggtgtatatcgataccgaaagcgccttttcggcagaacgcctggtggagatagccgaatcccgctttccccggtactttaataccgaggagaagctgctactgacctccagtaaagtccatttatacagggagctcacttgtgatgaagtgctccagcgcattgagtcccttgaggaggaaataatcagcaagggcattaagttggtgatcctggatagcgtggcaagtgtggttcgaaaggagtttgacgcccagctacagggaaacctgaaggaaaggaataagtttctcgcgagggaggccagtagcctaaaatacctggcggaagagttcagcattcctgtaatcctcaccaaccagataacgactcacctgtccggggcattggccagccaggcggacttagtctcacctgctgatgatctatccttgagcgaagggacttctgggtcttcttgcgtcattgctgctttgggcaacacttggtctcacagcgtgaacactcgcttaatcctgcagtatctcgactctgagcgccgccagattctgatagcaaaaagccccctagcccccttcacttcatttgtgtacacaataaaagaagaaggcctggtattacaagcttacgcacagtgttag

SEQ ID NO: 17004 - DNA, 1101 bp, Artificial Sequence
  Description of Artificial Sequence: Synthetic coding sequence
atggggagcaagaagctcaaaagagtcggcctcagtcaggagctttgtgatcgtctgtcaaggcaccagattttgacatgtcaggattttttgtgccttagcccactcgagttgatgaaggtaacaggcctctcttacagaggcgtccatgagttactttgtatggtctcccgggcctgtgcgccaaagatgcaaacggcctatggcatcaaggcacagaggtctgcagatttctctcccgcttttttgagcacaacgctgtccgccctggatgaagccctccacggcggtgttgcatgtggctcgttgactgagatcacaggtcctccaggatgtggaaaaacccaattctgcattatgatgagcatattggctactctccctactaacatggggggcttagagggggccgtcgtctacattgacacggagagcgctttctccgcggaacggctcgttgaaatcgcagaatctaggtttcctcggtacttcaacaccgaagaaaagctgctgttgacatccagtaaggtgcacctgtacagggaactaacttgtgatgaggtgttgcagcgaatcgaatccctggaggaggagattatctccaagggaatcaagttggtaattctggatagcgtcgcgtctgtggtaagaaaggagtttgatgcacagctgcaagggaacctgaaagaacgcaacaaatttctggcacgcgaagccagctcgttgaagtatctggcagaagaattttcaattcctgtcattctcaccaatcagatcacaacacatttgagcggcgcgctcgctagccaggctgatctagtgtccccagccgatgacctcagtctgagcgaggggacttctgggtcatcatgtgtgattgccgcgttgggcaacacttggtcccattctgtaaatacacgtcttatactgcaataccttgactctgaaagacgacagatcctgatagcaaaaagccctctcgcaccgttcacatcatttgtgtatacgataaaggaggaaggcctggtgctgcaggagttttggcatatctgtatctctggattttccatccagaataggctgaaggagaacgagtcatag

SEQ ID NO: 17005 - DNA, 1053 bp, Artificial Sequence
  Description of Artificial Sequence: Synthetic coding sequence
atgggaagcaagaagctgaagagagtaggactgtcccaggaactgtgcgacaggctgtccaggcaccagattcttacttgccaggacttcttgtgtttgagccctctggaactcatgaaggtgaccggcttgagttatcggggagtgcacgagctgttgtgcatggtctccagagcatgcgctcccaagatgcagaccgcctacggcatcaaggcccagcggagcgcggatttcagtccagctttccttagcactacactgagtgctctagatgaagccctacatgggggtgtggcttgcggatcgcttactgaaattaccggccccccgggatgcggcaagacccagttttgcatcatgatgtcaattttggctactttgccaacgaacatgggaggcctggagggggctgttgtgtatatcgatactgaaagcgccttcagcgccgagaggctggttgagatcgctgaatctcgcttccctcgctactttaataccgaggaaaaactgctgctgacctcatcaaaggtgcacctgtacagggagctcacgtgcgatgaagtgctgcagcggatcgagtccttagaggaagaaatcatctctaagggcatcaagctggtgattctggactccgttgccagcgtggtgaggaaggaatttgacgcacaacttcaaggtaatctgaaggaacggaataagttcctagccagggaggcatccagccttaagtatctggcagaagaattttccatccctgtgatcttgacaaatcagataactacgcacctgtcgggggctctcgcttcacaagctgacctggtgtcacctgccgatgacttaagtctctctgagggcacttctggctcgtcttgcgtgatcgccgcactcggcaatacttggtcgcactcagttaataccagactgatcctgcaatatcttgactctgagcggcggcagattctcattgcaaagagcccgctagccccattcaccagttttgtctataccatcaaggaagagggcctggtcctgcagggccaagaaacgccatag

SEQ ID NO: 17006 - DNA, 1053 bp, Artificial Sequence
  Description of Artificial Sequence: Synthetic coding sequence
atggggagtaaaaaactgaagcgggtgggattgtcccaggaattgtgcgacagattgtcaagacatcagattctcacatgtcaggatttcctatgtctttctcccctggaactcatgaaagtgaccggcctatcatatagaggagttcacgagctgctgtgcatggtctctagagcgtgtgcccccaaaatgcagacagcatatggaattaaagcccagcggtccgctgattttagcccagcctttctgagcaccacgctgagcgcattggacgaggcactccatggcggggtggcctgcggcagcctgaccgagatcacaggacctcccgggtgcgggaagacccagttttgcattatgatgtcaattctggccaccctgccaaccaatatgggcggcctcgaaggcgccgtcgtatatatcgacacagaatccgccttttccgctgaaaggctggtcgaaattgctgaatctcgctttccgcggtatttcaacactgaggagaagttactgctaaccagcagcaaggttcatctgtatcgtgagctgacatgtgacgaggtactgcagagaatcgagtctttagaggaggagatcatttccaagggcattaagctggttattctcgactctgtagcgtcagtggtaagaaaagagtttgacgcccaattgcaggggaaccttaaggagcggaataagtttttggcccgggaggcgtcaagccttaaatatctggccgaggaatttagcatccctgtgattctgacaaaccaaatcaccacccacttatccggcgccctggcctcacaggctgatcttgtgagtcccgcggacgacctatccttgagcgagggcacaagtggttccagttgtgtgatcgccgccctcggaaacacgtggtctcactctgtgaatactcggctaattctccagtaccttgactccgagcgcaggcagatcctgatcgcaaaatcaccactcgccccattcacttcgttcgtatacaccataaaggaggagggattagtgctccagggccaggagaagccgtag

SEQ ID NO: 17007 - DNA, 402 bp, Artificial Sequence
  Description of Artificial Sequence: Synthetic coding sequence
atgggtagcaaaaaattaaagagggtgggactgtcacaagagctatgtgatcgcctgagtcgccaccagatattgacatgtcaggacttcctctgtctgtctcccctggaactcatgaaagttactggcctctcatatcgaggagttcacgagctgctatgcatggtttctagagcttgtgccccaaagatgcagaccgcctacggcatcaaggctcagagatctgccgacttttctccggcattcctatctaccaccctgagtgccctcgacgaggcactgcacggcggtgtggcatgtgggtcactaacagagatcaccgggccccccggctgtgggaaaacacagttctgtataatgatgagcatactcgcgacccttcctaccaacatggggggctag

SEQ ID NO: 17008 - DNA, 1155 bp, Artificial Sequence
  Description of Artificial Sequence: Synthetic coding sequence
atgggttccaagaaacttaagcgcgtcgggctttctcaggagctgtgcgatcgactctcccgtcaccaaattctgacttgccaagactttctgtgtctcagcccactggagctgatgaaagttaccggactgtcctacaggggtgtgcatgaactgctctgtatggtgagtagagcctgtgcacccaagatgcagactgcgtacggaattaaggcacagcgaagtgcagacttctcgccagccttcctgagtaccactctctccgccctcgatgaggccctacacgggggcgtggcatgcggctctctgacagagatcacaggcccccccggttgtgggaagactcagttctgtattatgatgtcgattctggctacacttcctaccaatatgggtggccttgagggcgcagtcgtttacatcgacaccgagagcgcattttccgcagaacggctggtggaaatcgccgagtcaaggtttcctcggtacttcaacacagaggagaaactactgctcactagcagtaaagtccacctatacagggagctaacatgtgacgaggtgctgcagaggatcgaatccctggaggaagagattatatccaaggggatcaagctcgtcatcctggatagcgtcgcttccgtggttcggaaggagttcgatgctcagttgcaggggaacttgaaggaacgtaataaattcctggctagagaggcatcctcactgaaatacctcgccgaagaattcagtataccggtgatcctcacaaatcagatcaccacccatttgagcggagcgcttgcttcccaggccgacttagtctctcctgctgatgatctatccttgagtgagggcaccagtggtagcagttgtgtcatcgccgctctggggaatacctggagccatagtgtgaataccagacttatactacagtacctggactctgagcggcgacagattctcattgcaaaatcgccacttgccccttttactagcttcgtgtataccatcaaagaggagggattggtgctacaggagacgacgttttgtagtgtgacccaggcggagctcaattgggccccagagatcctgcctccccagccaccagaacagctgggcctccaaatgtgccatcacacgcaactgattttttag

SEQ ID NO: 17009 - DNA, 1101 bp, Artificial Sequence
  Description of Artificial Sequence: Synthetic coding sequence
atgggctctaagaagcttaaaagggtcggcctgtctcaggaactctgtgacaggctaagtcggcaccagatcctgacgtgccaggactttctgtgtctgtctcccctggaactcatgaaggttactgggctgtcatacaggggggtgcacgagttactgtgcatggtgtctagagcctgcgcgccgaaaatgcagacagcctatggtatcaaagcgcaaaggagtgcagatttcagccctgccttcctgtccacaaccctcagcgccctggatgaagcgttgcacggtggagtggcctgcggctctctgacggagattacaggacctccaggatgtgggaaaacacagttttgtatcatgatgtctattctggctactctgcccaccaatatggggggtctcgaaggggccgtagtctatatcgatacagagtcagcttttagcgcagagagactggtggaaatcgccgaaagccggtttcccaggtatttcaacaccgaggagaagctcctgctcacctccagtaaggtgcacctctaccgggagctaacctgcgacgaagtgctgcaaagaattgagtcccttgaggaggagattattagtaagggcatcaaattggtgattctggactccgttgcgtccgtggtgcgcaaagagtttgacgcccaattgcagggtaacctgaaagagcgaaataagtttctcgcacgggaggcgtcttcgctaaagtacttagcagaggagttctcaattcctgtaatattgaccaatcaaatcaccacccacttgtctggagcgctagccagtcaggcagatctggtcagtccagccgacgatttgtctctgtccgagggtacttctggctcaagctgcgttattgccgccctggggaatacttggagccactccgttaacacccgactgatcctgcagtacttagacagtgaaaggcgacaaatacttatcgctaagtcacccttagctccgtttacatccttcgtatacacaataaaagaagaggggctggtgctgcaggaattttggcacatctgcatctccggcttctctattcagaacaggctcaaggagaatgagtcgtag

SEQ ID NO: 17010 - DNA, 228 bp, Artificial Sequence
  Description of Artificial Sequence: Synthetic coding sequence
atgggctcgaaaaagctaaagcgcgtgggcctctcccaagagctgtgcgacaggctgagccgccaccagatcttgacgtgtcaggattttctgtgcctatcgccgcttgagttgatgaaggttaccggcctctcatataggggagtccacgagcttttatgtatggtatctagggcctgcgcccctaaaatgcagaccgcttatggaattaaagcccagcggtcctag

SEQ ID NO: 17011 - DNA, 1131 bp, Artificial Sequence
  Description of Artificial Sequence: Synthetic coding sequence
atgcgcgggaaaacctttagatttgaaatgcagcgggacctggtgagtttcccactcagtccagctgtgagagtaaagctggtgagtgccggatttcagactgcagaggaactgttagaggtaaagccttcggagttgtccaaggaggttggtatctctaaggcggaagcactcgagacccttcagattatcagacgtgaatgccttaccaataagcccagatatgcgggcactagcgaaagccacaagaagtgtacagctctggagctgctggaacaggagcatacgcagggttttatcatcacgttctgctcggccttggacgatattctgggtgggggggtccccctgatgaagacaaccgagatatgtggagcacccggcgtgggtaaaactcagttgtgtatgcaactcgccgtggacgtacagatacccgagtgtttcggtggcgtcgctggggaagccgtgtttattgacaccgagggtagtttcatggtcgaccgagtcgtagacctggctacagcctgcatacaacatctccagctcattgcggagaaacataagggggaggagcatagaaaggcactggaagacttcactttggataatatcttgagccatatctactacttccgatgccgagactacacggagcttcttgcacaggtgtatcttctgcctgacttcctctcagaacattcaaaggtcagactagtgattgtggatgggatcgcattccctttcagacatgacctcgatgacctcagcctgcggactcgtctactgaacggcttagcccaacaaatgatctcactggcaaataatcaccgccttgccgtgatcctcacaaatcagatgactaccaaaattgaccgaaaccaggccctcttggtgccggcgttaggagaatcatggggacatgccgcaaccatcagactgatattccattgggacagaaagcagcggctggccacactctacaagtcaccatcacagaaggagtgcaccgtgctctttcagatcaaaccgcaaggattccgagataccgtcgtgacgagcgcttgctcgctccagaccgaaggctcactgtccacccgaaagcgcagtcgagatcccgaagaagagctttag

SEQ ID NO: 17012 - DNA, 987 bp, Artificial Sequence
  Description of Artificial Sequence: Synthetic coding sequence
atgggcgtcctcagggtcggactgtgccccggtcttaccgaggagatgatccagctgctgcgcagtcatcggatcaagacagttgtggatcttgtcagtgccgacctcgaagaagtcgctcaaaaatgcggactttcttacaaagccctggtggcattgagaagggtgctgcttgcacaattctccgcttttccggtaaatggcgccgacctctatgaggagctcaaaacttctacggcgatattatctactggtattggccggattcgcctgtcaggcaatgccagatggctgatgccgaaggttaccgaaattgtggggggaccagggtctggaaagactcaggtatgtctgtgcatggccgccaatgtcgcccatggtcttcagcagaacgtcctatacgttgactctaacggcggcttaacggcaagccggctgctccagctgctgcaggctaagacacaggatgaggaggaacaggccgaggcactccgccgcattcaagtcgtccacgcattcgatattttccagatgctcgacgtacttcaggagctgcggggaaccgtagcacagcaggtgaccgggtcctctggcaccgtaaaggttgtcgtggtcgatagcgtcacggctgtagttagccccctgctggggggccaacagagggaaggcctcgccctaatgatgcagttagctcgcgagcttaagactctcgccagggacctgggcatggcagtcgttgtgacaaaccatattactcgtgaccgcgacagcgggcggttaaagccagcactggggcgttcatggtcctttgtcccttctactcgaatcctccttgacactatcgaaggggccggtgcttctggtggacgccgcatggcctgtcttgcaaagagctcacgacagcctaccggcttccaggaaatggtcgacattggcacttgggggacaagtgaacaatccgccacacttcaaggcgaccagacttag

SEQ ID NO: 17013 - DNA, 987 bp, Artificial Sequence
  Description of Artificial Sequence: Synthetic coding sequence
atgggagtcttgcgggtgggcctctgtcccggcctcacagaagaaatgatacagttacttcgctctcatagaattaagaccgtggtggatctggtcagcgcagatctggaagaggttgctcagaaatgcggactgtcctacaaagcgctcgtggcccttagacgtgttctcctggcccaattctcggcattccccgtgaatggcgctgatctgtatgaagaactgaaaaccagcactgcgatcctttccacgggaatcggcagtctggacaaattactcgatgctggcctgtacacgggtgaagtgacggagatagttggaggacccggatctggcaaaacgcaagtctgcctctgtatggctgcgaacgttgctcacggcctgcagcagaacgtgttgtacgtagattcgaatggggggctgactgcctctcgacttctgcagctgctgcaggccaaaacccaagacgaagaagagcaggcagaagctctgaggaggattcaagtagtgcatgcctttgacatttttcaaatgttagacgtactccaggaactgcggggaacagtggcccagcaagttaccggcagttctgggactgtcaaggtggtggtcgttgatagcgttaccgcggttgtttcccccttattggggggacaacaaagagagggcctggcactcatgatgcaactggctagagaactgaagaccctcgcccgtgaccttggaatggctgtggtagtgaccaaccacattactagggacagagactctgggcggctcaaacccgctctggggcgatcctggtctttcgtgccatcaacccgcatcttactggacaccatcgagggcgcgggcgctagcggaggaaggcggatggcctgcctggctaagagcagccgtcagccaaccggctttcaggagatggtcgacatagggacctggggaacaagcgagcagtccgccacgttacaaggggatcagacgtag

SEQ ID NO: 17014 - DNA, 651 bp, Artificial Sequence
  Description of Artificial Sequence: Synthetic coding sequence
atgggggtcctgcgcgtaggattatgccctggcctaactgaggagatgattcagttgctgcggtctcatcgtataaaaacagtggtggatttagtgtctgctgatctggaggaggtagctcagaagtgtggtcttagctacaaagccgaagcactgcgaagaatccaggtggtgcacgcatttgacatttttcaaatgctggacgttctgcaggagttaagagggactgtcgcccagcaagttacaggatcatccgggactgtgaaggttgtggttgttgactcagtgactgcagttgtgtctcctctcttgggtggccagcaacgggaagggttagccttaatgatgcagctcgcccgagaactcaaaacattggccagggacctcggcatggcagtcgtcgtgaccaaccatatcaccagagatcgggacagcgggcggctgaaacccgccctcgggcgctcgtggtcgtttgtgccttctactagaatccttctggataccattgaaggagccggcgcctctggtggcagacggatggcatgcttggccaagtcaagcagacagccaaccggctttcaggagatggttgatatcggcacatggggtacaagcgagcaatccgcaactctgcagggcgaccagacatag

SEQ ID NO: 17015 - DNA, 357 bp, Artificial Sequence
  Description of Artificial Sequence: Synthetic coding sequence
atgggcgtgctgagagtcgggctgtgtcccggcctgactgaagagatgatacagctgctgagaagtcaccgcataaaaactgtggtggacctggtgagcgcggacctcgaagaggttgcacagaagtgtggacttagttataaggccttagtagcccttcggagagtgctgctggcccagttttcagccttcccagtgaatggcgccgacctttatgaggagttaaagacaagcaccgcgatcctttccacaggtatcggccggcacgggggacggactcaggtgggtacctgggaagattgtagctgtctccgctcaccccagggagacaggggtgtcggatccggcatgctctag

SEQ ID NO: 17016 - DNA, 852 bp, Artificial Sequence
  Description of Artificial Sequence: Synthetic coding sequence
atgggagttctcagagtcggcctatgtccaggcctgaccgaagaaatgattcagcttctccgcagccacaggatcaagacagtggttgacctggtatctgccgacctggaagaggtggcccagaaatgcggcctctcatacaaggcgctcgttgctctgcgtcgagtcctgctggcccagttttcagcctttcctgtgaatggagccgatctgtatgaggagctcaaaacgagcaccgctattctttcaacaggaatcggatcgttagataagctgctggacgccggactatacaccggggaggtcactgagattgtgggcggacctggttccggaaagacacaggctgaggcattacgacgaattcaggtggtgcacgcgtttgacattttccagatgctggatgtcctccaggagcttcgcggcactgtggcacaacaggtgaccggcagctcaggaacagtgaaagttgtggttgtagacagcgtcacagcagtcgttagccctctcttgggtgggcagcagcgcgaaggtctcgcactgatgatgcaacttgcccgggaactcaaaacactggcccgcgatctgggtatggctgtggtcgtcactaaccatatcacccgggatagggatagcggaagactgaagcccgccctgggccggtcttggtcattcgttccgtcaacacgcatcttattggatacaatagagggcgcaggagcatcgggtggccggagaatggcatgtctcgcaaaaagcagtaggcagccaactggtttccaagagatggtggacattgggacatgggggacttccgaacagtcagccactctccagggggaccagacctag

SEQ ID NO: 17017 - DNA, 1047 bp, Artificial Sequence
  Description of Artificial Sequence: Synthetic coding sequence
atgggcgtgttgcgggtggggctctgccccgggttaaccgaagagatgatacagcttcttcggtcgcacaggattaagactgtggtggatctcgtttctgccgacctagaagaggttgcgcagaagtgtggcctcagctacaagacatggagagcacacagttctggtaatttgggaggcctgcagcttccccaagttcccgcaggtagatcatggagtggggtgcggaatgccctgaagaaagctgggctgggtcacggcggcaccgacgggctgagtctcaacgcgttcgacgaacgaggcactgctgtgtcaacatcaaggctggacaagctcctagacgccggcctgtatactggcgaagtcaccgagatcgtaggtggtcctgggtcgggtaaaacacaggtgtgcttgtgcatggctgccaatgtggcccacggtctgcagcagaatgttctgtatgtcgatagcaacggtggactcacggccagccggctcttgcaactcctacaagcaaagacccaggacgaagaggaacaggcagaagctctgcgtcgtatacaggtggttcatgctttcgacattttccagatgctggatgtactccaagagcttagagggacagtggctcagcaggttaccgggagtagcgggactgtcaaagtcgtcgtggtcgactccgtgacagctgtcgtgagcccacttcttggggggcagcaacgagaaggacttgcgctgatgatgcagctggctagagagcttaagaccctagccagagatctcggtatggcggtggtggtcacaaatcacatcacccgcgacagagattcaggcagattgaaacctgccctgggccgaagctggtcatttgtgccttccactaggatcctattagatacaattgagggggctggcgcctccggcggacggaggatggcatgtctagcgaagtcctcacgccagcccactggatttcaggaaatggtggatatcggcacgtgggggacctccgaacaatccgctacgctgcaaggcgaccagacttag

SEQ ID NO: 17018 - DNA, 648 bp, Artificial Sequence
  Description of Artificial Sequence: Synthetic coding sequence
atggtgatggcagccttgccctttagtgaggacctcaaaatgccagatacatgtgtgctgccccactgtcctggcaaggagaacaaggatgtggttgacttggtatcggctgatcttgaagaggtggctcagaaatgtgggttgtcttataaggctctagtggctctgcgcagagttcttctggcgcaattctcagcgttccccgtcaacggggctgacctgtacgaagaacttaagacctctaccgccatcctatcaactggaattgggagtttggacaaattgctggatgctggactgtacactggggaagtgactgagattgtcgggggccctgggtcaggaaaaacccaggtgtgtctttgtatggcggccaacgtggcacacggcttgcagcagaatgtactgtatgtcgactcgaacggcggcctgaccgctagcaggttgttacagcttctgcaggctaaaacacaagatgaggaagagcaggcggaggcacttcgaaggattcaagttgtccacgcgttcgatatctttcaaatgcttgatgtgctgcaggagttgcgtgggaccgtcgcccagcaagacggtattccggagcaccttaatcacatcccacactgcctccacgtccacttaccttgctag

SEQ ID NO: 17019 - DNA, 711 bp, Artificial Sequence
  Description of Artificial Sequence: Synthetic coding sequence
atgggggtgctgcgtgtaggcctgtgtccaggtctcaccgaggagatgatccagctgctgcggtcgcacaggattaaaacagtggttgacctggtcagtgcagatttggaggaagttgcccagaagtgcggactgtcatataaggctctggtggccctccgccgcgtattgctcgcccagtttagtgcgtttcccgtcaatggcgcagacctctacgaggaactgaaaacatcaaccgccatcctctctacaggcatagggagcctggacaaactgttggacgcggggctttacacaggagaggtcaccgaaattgttggagggccagggagtgggaagacgcaggtctgcctttgtatggcggccaacgtggctcatgggctgcagcagaacgtcctctacgtggactctaacggaggcctaaccgccagccggctgctgcagttactacaagccaagactcaagatgaggaggagcaagctgaagctctcagaaggattcaggtggtgcacgcttttgacatttttcaaatgctggacgtgttacaggagctgcgtggtactgtggcacagcaagtgactgggtcttccgggactgtgaaagtggtcgttgttgacagcgtaacagccgtcgtgtctcccttgctgggcgggcagcagagagagggtcttgctttgatgatgcagctagcaagagaactgaagacttag

SEQ ID NO: 17020 - DNA, 1047 bp, Artificial Sequence
  Description of Artificial Sequence: Synthetic coding sequence
atgggcgtgctgagagtggggctctgccccgggctgactgaggagatgatccaactgttaaggagccataggattaaaacagtggtcgaccttgtgtccgccgacctagaagaagtggcccaaaagtgcgggctctcctacaagacatggagggcccactccagcgggaacctaggagggctgcagttgcctcaggtaccggccgggcgctcgtggtccggagtcagaaacgccctcaaaaaggccggactcggacacggaggtaccgacggtctgagtctcaacgccttcgacgaaagaggcacagcagtctccacttctagactggataagctcctggacgcaggtttgtacactggagaagtcaccgagatcgtggggggcccaggaagtggcaaaacccaggtatgcttatgcatggctgccaatgtggcccatggcctgcagcaaaacgtgctgtatgtcgactcaaacggtggcctgacagcaagccgtcttctgcaactgctgcaggcaaaaactcaagatgaggaggagcaggcagaagctcttaggcggattcaagttgtccacgcgttcgacatcttccagatgctagatgtcttgcaagagctacgagggacagtggcgcagcaagtcactggatcttcaggcacggttaaagtcgtcgtggtcgacagtgtcacagccgtggtttcaccacttctcggcgggcagcaacgggaaggtctcgctcttatgatgcagctggctagggagcttaaaaccctggccagagatttggggatggccgttgtcgtcaccaatcatatcacgcgggacagggactccgggcgcctaaaacccgctctgggtcggtcgtggagtttcgtcccaagtacccggattctgctcgacacaattgagggggccggagccagcggggggcgacgaatggcgtgtctggctaagtcaagcaggcagccaaccggctttcaagaaatggtggacattggcacctggggcacctcggaacagtccgccaccctccagggcgatcaaacatag

SEQ ID NO: 17021 - DNA, 1257 bp, Artificial Sequence
  Description of Artificial Sequence: Synthetic coding sequence
atgtcggggaccgaagaggcaatactgggtggacgagactctcatccggccgctggaggtggcagcgtgctatgttttggtcaatgccaatatactgctgaagagtaccaagcaatacaaaaggccctcaggcagcgtctcggcccagagtatatctccagccgcatggcaggaggaggccagaaggtttgttacatagaaggccatcgtgtgatcaacctggcaaacgaaatgtttggatataatgggtgggcgcactcaattacccaacaaaacgttgactttgtcgatcttaacaacggaaagttctacgtcggtgtgtgtgcgtttgtacgggtccagctgaaggacggcagctaccatgaggatgtgggatacggcgtcagcgaaggcctgaaaagtaaggcgctatctcttgagaaggcaaggaaagaagccgtcacagacggcttgaagcgagccctccgctcctttggcaatgctcttggaaactgtatcctcgataaggactaccttcggtctctgaacaaactacctcgccagcttcctctcgaagtggacttgaccaaggccaagcggcaagacctcgagccctcagtggaagaggccaggtacaattcttgccgccctaatatggcgctggggcaccctcagctccagcaagtgacatcgccctctagaccaagccacgccgttattccagccgatcaggattgctcaagtaggagccttagcagttctgccgtggaatccgaggctacgcaccagcggaagctacgccagaaacaactccagcagcagttccgagaacgtatggagaagcagcaggtacgagtgagcacgccatctgcagagaagtcagaagccgctccacccgcaccacctgttacccactctacccccgtcacagtgtccgaaccgctgcttgagaaggatttcctcgccggagtgacgcaggagctgatcaagactttggaggacaacagcgagaaatgggcggtaaccccagacgcaggcgacggcgtggtcaaaccgtcgtctcgagccgacccagcacagacctctgataccctcgccctgaacaaccagatggtaactcaaaaccgtacaccacacagcgtgtgtcatcagaaacctcaggcgaaaagtggatcctgggaccttcaaacctacagtgctgatcagaggacaacaggcaactgggaatcacaccggaagagtcaggacatgaagaagcgtaagtatgatccctcctag

SEQ ID NO: 17022 - DNA, 1257 bp, Artificial Sequence
  Description of Artificial Sequence: Synthetic coding sequence
atgtccggcaccgaagaggctatactggggggtagagattcccatcccgcagccggaggcggatccgtcttatgttttgggcagtgtcagtatacagccgaggagtaccaggccattcagaaggccttaagacagcgcctgggacccgagtacatctccagccgcatggcaggaggcggacaaaaggtgtgctacatcgaggggcacagagtaattaacctggccaatgaaatgtttgggtataacggatgggctcattctattacccaacagaacgtggactttgttgacctgaacaatgggaagttctatgttggcgtttgtgctttcgttagggtccagctaaaggacggatcttaccacgaagatgtgggctatggggtctccgaaggcctgaaatctaaagccctgagcctcgagaaggcacgtaaggaggccgtcacggacggcttgaaacgggccttacgctcatttggcaacgctttgggcaattgcatcctcgataaggactatttgaggtccctgaataaactgccaaggcagctgccgttggaagtggacctgactaaagctaagagacaggatctggagccaagcgtcgaagaggctcgttataactcttgtcggcctaatatggctttaggccatccacagttgcagcaggtgacatctccctccaggcctagtcacgcagtaatccccgcggaccaggattgcagttctaggtcattatcttcctccgctgtagagagcgaagcaacacaccagcgaaagcttcgccagaagcagctgcagcagcagtttcgcgagcgcatggaaaaacagcaggtacgcgtgtctactcccagcgctgaaaagtctgaggcagccccccccgccccccccgtgactcactcgaccccagtaaccgtatctgagcctctcctggagaaagatttccttgcaggcgtcacacaggagcttattaagaccctagaagacaattctgaaaagtgggctgtcactccggacgccggagacggcgttgtcaaaccatccagccgtgctgatccagctcagacttcagataccctcgccttgaacaaccagatggtaactcagaataggacaccccacagcgtgtgtcaccagaagccacaggccaagtctggaagctgggatctgcagacctattcagccgatcagcgcaccacaggcaattgggagtctcatcggaagtctcaagatatgaaaaaacgcaaatatgacccttcttag

SEQ ID NO: 17023 - DNA, 1026 bp, Artificial Sequence
  Description of Artificial Sequence: Synthetic coding sequence
atgttcggatataatggatgggcacatagcattacacagcagaacgtcgacttcgtggatcttaacaacggaaagttctacgtaggcgtgtgcgcattcgtgagagtacagctcaaggacggtagctaccacgaagacgttggatacggcgtgagtgagggcttgaaatcgaaagccctctctctggagaaggcacggaaagaggccgtaaccgacgggttgaagcgtgcgctgcggagcttcggtaacgccctaggcaactgtatcctcgataaagattatctccggagcctgaacaagctgcctcgccaactgcccttagaggtcgacctaaccaaagcaaagcgccaggatctggagccgagtgtggaggaagctcgatataactcttgcaggccaaacatggcccttggccacccgcagcttcagcaggtcacgtcaccaagtagaccttcccatgccgtaatcccagcggatcaagattgttcatcccgcagcttatcaagcagcgctgtcgagagtgaagcaactcatcagcggaaactacgacaaaaacagctccagcagcagttccgggagcgaatggaaaagcagcaggtgcgcgtctcaacaccctctgcagaaaagtcagaagccgccccccccgcaccaccggtgacccatagcactccagtaacagtgtccgagccactccttgaaaaagatttcctcgccggcgtcacacaagagctcattaagacactcgaggacaacagcgaaaaatgggcagtaactccggatgccggggacggcgtcgtgaagccaagctcacgtgcagatcccgcccagacttctgataccctcgctttaaacaatcagatggtaactcagaaccggactccacattcagtgtgccatcaaaaacctcaggcaaagtctgggagctgggatctgcagacctacagcgctgaccaaaggactaccggtaactgggaatcccacagaaaatcacaggatatgaagaagcgcaagtacgacccaagttag

SEQ ID NO: 17024 - DNA, 681 bp, Artificial Sequence
  Description of Artificial Sequence: Synthetic coding sequence
atgagcggaacagaggaggccatcctgggaggcagagatagccatcccgctgccggcggcggaagtgtgctgtgctttggtcagtgtcagtacaccgctgaggagtatcaggccatacagaaggcccttaggcagagactggggcccgagtacatctccagtagaatggccggcggaggacagaaggtgtgctatatcgaaggtcacagagtgattaacctcgccaacgagatgtttgggtacaacggatgggcccactccatcactcagcagaatgttgactttgtggatttaaacaatggtaaattttacgtgggcgtttgcgcattcgtgcgcgtccagctgaaagacgggagctatcatgaggatgtaggttatggggtgagcgaagggctaaagagcaaagccctttctctcgagaaagctcgcaaggaggctgtaactgatggcctgaagcgggccctacggctaccgttgcttggggtctcaggacgcatactgtacagtttgttctctgtccactccgtgatgtgtgccgggggacttccaactccgaccgcttccgctcagaccgcaccctccagcccttgttctagcgcagtgctcaggtacgctcaagaattctgggagtgtacatggaagttatatagtggccagcggttacccgagattacaaaatag

SEQ ID NO: 17025 - DNA, 2244 bp, Artificial Sequence
  Description of Artificial Sequence: Synthetic coding sequence
atgcggaggtctctggccccatcccagctggccaagcgaaagccagagggaagatcctgtgacgacgaggactggcaaccgggtcttgtgacaccgagaaaacgcaagtcttcaagcgaaactcagatccaagaatgtttcctctcgcctttccgtaagcccctttcccagcttacaaaccagcctccttgtctggactctagccagcatgaagcattcatccggtccatcctgagcaagcccttcaaagttcccatccctaactaccagggacctcttgggtccagggccctggggctaaagagagcgggcgtcagaagggcactgcacgaccccctagagaaggacgctctcgtgctctatgagcctccccccctcagtgcgcacgatcagctcaagctcgataaggagaagctccctgtacacgtggtggtggacccgatcctgagcaaggtgcttcggccgcaccaaagggagggggtaaagtttctctgggagtgtgtcactagtcgcaggatccctggcagccatgggtgcattatggcggacgagatgggcctggggaagacactccagtgtattacacttatgtggacactcctccgccagtccccggagtgcaagcctgagattgacaaggctgttgtggtgagcccttcttctttggtgaaaaattggtacaacgaagttggaaaatggttggggggtcggatacagcctctggccatcgacggtgggtcaaaggacgagatcgaccaaaagctcgagggctttatgaatcagaggggggctagggtgagctccccaattctgatcatctcatatgagacattccgacttcacgtgggggtgctccagaaggggtctgttggactggtcatttgcgatgaggggcaccgtctcaagaattcagaaaaccaaacatatcaggctcttgactcccttaacacctcacgacgcgtcctgatctccgggactcccattcagaacgacctgttggaatatttctccctggtgcatttcgtgaatagtggcatcctggggacagcgcatgaattcaaaaagcacttcgagctccctatattgaagggccgggacgcggcggcgagcgaagccgacaggcagttaggtgaggagcggttgagggagctgacgtcgatcgttaatcgctgtcttatccgcaggacaagcgatattttgtcaaagtatctgccagtgaagatagagcaggtggtgtgctgtaggctgacaccgctccagactgagctctacaagcgctttctgagacaggccaaaccagctgaagaattgttggaagggaagatgagtgtgagttctcttagctctatcacgtccctgaaaaaactgtgcaatcatcccgccctcatatacgacaagtgtgtcgaggaggaggatggatttgtgggagccctggacttgtttcctccaggatacagctcaaaggctctggaaccccagctgtccggcaagatgctggtgttggattacattttggcagtgactcggtcccggtcgagtgacaaagttgtcctagtcagtaattacacccagaccttagatctttttgaaaagctgtgccgggcgcgccgatatctctacgtgcggctggacggcaccatgtctataaagaaaagagcaaaagtcgttgagagattcaactccccaagctcccctgacttcgtgtttatgctgtcctctaaggctggaggctgcggtctgaatttgatcggcgctaacagactggtaatgttcgaccctgactggaatcccgcaaacgacgagcaggcgatggcacgggtttggagggatggccaaaagaaaacatgttatatctatagactcctgtcggcgggtacaattgaggagaagatattccagagacagtctcacaagaaggccttaagcagctgtgtcgtggatgaggagcaagatgtggaaagacatttcagcctaggcgagcttaaagagctcttcattctggatgaagcgagtctgagtgatacccatgaccgattgcattgccggagatgcgtgaattcaaggcagatacgccctccacccgatggcagcgactgtacaagcgatcttgcaggctggaatcattgtacagataagtgggggctgcgcgatgaggtcctgcaggccgcttgggatgcagcctccaccgccatcacattcgtgtttcatcaacggtcccacgaagaacagcggggactgcgttag

SEQ ID NO: 17026 - DNA, 2244 bp, Artificial Sequence
  Description of Artificial Sequence: Synthetic coding sequence
atgcggaggtctttggcaccttcccaattagccaagagaaagccggaaggccgcagttgcgacgacgaggattggcagcctggtctggtgacccctcggaagagaaagtcatccagcgaaacgcaaattcaggagtgttttctgagccccttccgaaagcccttaagccagctaaccaatcagcctccatgtctggactcctctcaacacgaagctttcattcggtctatactaagcaagccatttaaggtacctatacccaactatcagggacccttggggtcacgagcactcggccttaaaagggcaggtgtgcgtcgcgctctgcacgatccactggaaaaagacgccttggttctgtatgaaccaccccccctgtcagcccacgatcagttgaaacttgacaaagaaaaactccccgttcatgtggtggtggaccccattttaagcaaagtgttgaggcctcaccaacgcgagggggtgaaatttctgtgggagtgtgtaactagtcgacgcatccccggaagccacggctgcattatggctgacgagatgggcttgggaaagaccctccagtgcatcacactgatgtggacgctactgaggcagagccctgagtgtaaaccagagatcgacaaagcggtggtggtatccccctcttcgttggttaagaactggtacaatgaggtcggcaagtggctgggtggtcgaatccagccactcgctattgacggcggcagtaaagacgaaatcgaccaaaaactggaggggttcatgaaccaaagaggagccagagtgtcctcgccaattctaatcatatcatacgagacttttcgcctccacgtaggggtgctgcagaagggttctgtcggattagtgatctgcgacgagggccaccgcttgaaaaactcagaaaatcagacctaccaggccttagactccctaaacacgtcccggcgagtgctaatatctgggacccccatccagaatgacctgctggagtacttctctctcgtgcattttgtgaacagtggaatcttggggacagctcacgaattcaagaaacactttgaacttcctatcctgaaggggagagacgcggctgctagcgaagcagacaggcaactgggcgaggaacgtctcagggagcttacttccatcgtcaacagatgtctcatccggcggactagtgatatcctctcgaaatatctcccagtaaaaatcgaacaagtggtgtgttgtagactcactccactgcagacagagctttataaacggtttctgcgacaggccaaacccgcagaggaactgctggaaggcaaaatgtctgtgtcgtcactatcctccattacctccctaaagaaactgtgtaatcaccccgccctcatctacgacaaatgtgttgaggaagaggacggttttgttggggcgctagacctgttcccgcccgggtatagctccaaggctcttgagccacagctgagtgggaagatgcttgtgctggactacatcctggcggtgacacgctctcgatccagtgacaaggtggtgctggttagcaactatacccagacattggatttgttcgaaaaattgtgtcgggcgcggcgctacctttacgtcaggcttgacggaaccatgtcgataaagaagcgggcgaaagtggtggaacgttttaacagcccatcatcccctgacttcgtttttatgttgagctctaaggctggaggctgcgggctaaacttaatcggcgctaaccgacttgtaatgttcgatcctgactggaacccagccaatgatgaacaagcaatggcacgggtttggcgggatggccaaaagaaaacctgttatatatatagactgctatccgccgggaccattgaagaaaagatctttcaaaggcagtcacataaaaaagctctgtccagctgcgtcgtagatgaggaacaggatgtagagaggcatttctcactcggggagctgaaggagctgtttatcttggacgaggcaagcttgtctgacacccatgaccgcctgcactgtaggagatgcgtgaactcaagacagattcgaccaccgccggacggatccgactgcacatctgacctggccgggtggaaccactgtacagataagtgggggctgcgggatgaagtgctgcaggcagcgtgggacgccgcatccaccgcaatcacctttgtattccaccaacggtcccatgaagagcagaggggccttcggtag

SEQ ID NO: 17027 - DNA, 1704 bp, Artificial Sequence
  Description of Artificial Sequence: Synthetic coding sequence
atggcagacgagatgggtctgggtaaaactttgcagtgcattaccttgatgtggacattgcttcggcagtcccctgagtgtaagcctgaaatcgataaggcggtggttgtgtccccctctagcctcgtgaagaactggtataatgaagtgggaaagtggctgggagggcgaatacagcctcttgctatcgatggcggatcaaaagacgagatagatcagaaactggaaggatttatgaatcagagaggcgcccgcgtgagcagtcccatactaatcatttcctatgaaacgtttagactgcatgtcggcgtcctgcagaagggctccgtggggctagtgatttgcgatgagggtcaccggctgaaaaactcagagaaccagacataccaggccttggacagcttaaacacatcgcgcagggtccttatctcagggacccctatccaaaacgaccttcttgaatacttctccctcgtacacttcgtgaatagcggaatactagggactgcccatgagttcaaaaagcatttcgaactccccatcctcaagggccgcgacgcggccgccagcgaggcagatcggcagttgggcgaagagcgccttagagagctaacatccatagtcaataggtgtctgattaggcgaacctccgacatcctctccaaatacttgccggttaaaatagaacaagtggtgtgttgcaggttgacccctctgcaaacggagctgtacaaaaggttcctcagacaggctaaacctgccgaggaactgctggaaggaaaaatgtccgtatcttccctgagtagtattaccagcctgaagaagctctgtaaccaccccgccctcatctacgataagtgtgttgaggaagaagacgggttcgtcggggcgcttgacttgtttccccccggatactcatccaaagcactcgaaccccaactaagtggcaaaatgctggtgctcgactatatactggccgtgactaggagcagaagtagtgacaaagtcgtattagtgagcaattacacccagaccttagatttgtttgaaaagctctgcagagcacggcgatacctctacgtgagattggatggcacaatgtctataaaaaagagagctaaagtcgtcgagagattcaattctccctcctctccggacttcgtcttcatgctgagcagcaaagcgggtggatgcgggctcaatctgatcggtgctaatcgtctggtcatgtttgaccccgactggaatcccgccaatgacgagcaagcaatggcaagagtttggagggatggacagaagaagacttgctatatctacaggcttctgtctgcaggaacaattgaggaaaagatatttcagagacaatctcacaagaaagccctgagctcctgcgtcgtggatgaagagcaggatgtcgagcggcatttttccctgggtgaacttaaggagttgttcatcctggatgaggcctctctcagcgatacacatgatcgcctgcattgcagacgttgcgtcaactcccgacagatacgcccccctccggatgggtctgattgtacctcggatctagccggttggaatcactgcacagataagtggggactgcgggacgaagtgctacaggctgcttgggacgctgccagtaccgctatcacttttgtctttcatcaacgctcccacgaggaacagcggggactgcgttag

SEQ ID NO: 17028 - DNA, 1176 bp, Artificial Sequence
  Description of Artificial Sequence: Synthetic coding sequence
atgaagtgtctcgtcaccggtggtaatgtgaaggtgcttgggaaagctgttcattccttaagccgcattggagatgagctctacctggaacctttagaggatgggctgtcgcttcgaaccgtgaatagtagtagaagtgcttacgcctgtttcttgtttgcgcccttattttttcagcaatatcaagctgctacgcccggtcaggacttgcttaggtgtaagatcttaatgaagtcttttctctcagtgttccgctccctcgcaatgctggagaaaacagttgagaagtgttgcatcagcctgaatggcaggagctctagactcgtggtgcagttgcattgtaaatttggcgtgcgcaagacgcataatttatcctttcaggattgcgagtcattgcaggccgtttttgatcctgcgagctgccctcacatgttgcgggcgcccgcaagggtgttaggcgaggctgtgctaccattcagtccagctctggccgaggtcaccctcggaattgggaggggaagacgcgtcattctaagaagttatcatgaggaagaggccgattccaccgctaaggccatggtcacagagatgtgcctgggggaagaggactttcagcagctccaggctcaggagggtgtggccataactttttgcctcaaagagtttcgtggcctgctctcttttgccgagagtgcaaaccttaacttgtccatacactttgatgctcccgggcgccccgctatctttaccatcaaggactcactactggacggacacttcgttctggcaactttaagcgataccgacagccactcccaggatcttggatctcctgaacggcaccagccggtgccacaattgcaggcccactctaccccgcaccccgacgacttcgctaatgatgatattgattcctatatgatcgctatggaaacaacgatcggaaatgagggtagccgggtgttgccaagtataagcctcagtcccggaccccagccgcctaagtctcctggtccacattccgaagaagaggatgaggccgaaccttccacggttcccggcactcctcctcctaaaaagttcaggtccctgttcttcgggagtattctggcacctgtgcgctctccacaagggcctagtccagttctcgcggaggactctgaaggagagggatag

SEQ ID NO: 17029 - DNA, 1752 bp, Artificial Sequence
  Description of Artificial Sequence: Synthetic coding sequence
atgcctaagcccatcaatgtgagagtgacaacgatggatgccgaactcgagttcgccattcagcctaacactacaggcaagcaactgtttgaccaagtagttaagacagtcggccttagagaagtgtggttcttcggtctccagtacgttgacagcaaaggctactctacctggctaaagctcaataaaaaggttacccagcaggatgtgaagaaggagaatccactgcagttcaagttccgcgccaaattcttccctgaggacgtgtctgaagaactgatacaggaaatcacgcagcgacttttcttccttcaggtgaaggaagccatcttgaatgatgaaatctactgtcctcccgaaacagccgttctgcttgcctcttatgccgttcaagctaagtatggagactacaataaagagatacacaagcccggatacctggccaatgaccgactactccctcagagagttttggaacagcataagctgactaaagaacagtgggaagagagaattcagaattggcacgaggaacaccgggggatgctacgggaggatagcatgatggagtacttgaagattgcccaagatcttgaaatgtacggggttaattactttgagataaagaacaaaaaaggcaccgaactttggcttggcgtggacgcactgggcctgaacatctacgaacacgatgataagctgacccccaaaattgggttcccttggtcagagattaggaatatatcctttaatgataaaaagttcgtcatcaagccaatcgataaaaaagctcctgactttgttttctatgcaccccgattaaggatcaacaaacgcattctcgcactgtgtatgggcaatcacgagttgtatatgcgacggcgcaaacccgacacaattgaggtgcagcagatgaaagcccaagcccgcgaggagaagcatcagaagcagctggaacgggcacagctagaaaacgaaaagaaaaagagggagatcgctgagaaggaaaaagagaggatcgagagagaaaaagaggaacttatggagcgtctcaaacagattgaggaacaaaccatcaaggcgcaaaaagagctggaggagcagaccagaaaagccctcgagctagaccaggaaagaaaaagagcaaaggaagaagccgaaagattagagaaggaacgcagggccgccgaggaagccaagtccgctatcgccaagcaggccgctgatcagatgaagaaccaggaacagctggctgctgagctcgccgagtttactgcaaaaatcgcgctattagaggaagccaaaaagaaaaaggaggaagaagccactgagtggcagcataaggctttcgcagcccaagaagatctcgagaagacaaaggaagagctgaaaaccgtaatgtcagcccctcctccaccccctcccccacccgtgatacccccaacagagaatgaacacgatgagcacgacgagaataacgccgaagcttctgcagagctctctaacgagggcgtgatgaatcacaggagtgaagaggaaagagtgacggaaacgcagaaaaacgagagagtgaagaaacaactgcaggcattgtcatctgagttagcacaggcacgggacgagacaaaaaagacgcagaatgacgtgctgcatgctgagaatgttaaggccggcagggacaaatacaagactctccgacagataaggcagggtaacacaaagcagcgcatcgatgagttcgaggctatgtag

SEQ ID NO: 17030 - DNA, 1815 bp, Artificial Sequence
  Description of Artificial Sequence: Synthetic coding sequence
atgcccaagcctataaacgtgcgcgtgacgactatggacgccgaactcgagttcgccattcagcctaacacaactggcaaacagctgttcgaccaggtggttaaaacagtgggtttgcgagaggtgtggtttttcggcctgcaatacgtcgactccaaaggatactctacatggctcaaacttaacaaaaaggtgactcaacaggatgtgaaaaaggagaacccattgcaatttaagttccgcgcaaagttctttcctgaagacgtatccgaagagctcattcaggagatcacgcagagactctttttcctgcaagttaaggaggccattctgaacgacgagatttactgcccgccagagacggctgtactgcttgcatcttacgctgtccaggcaaagtacggcgattataataaggagatccacaagccgggctacttagcaaacgaccgcctgttgcctcagagggtgctggaacagcataagctgacaaaggaacagtgggaggaacggatccagaactggcacgaggaacaccgcggaatgttgagagaagactccatgatggagtacctgaagatcgcccaggatctggaaatgtatggagtgaattacttcgagataaagaacaagaagggaacagagctgtggctgggcgtggacgccctgggtctcaatatttacgagcatgatgataagctcacccccaaaatcggtttcccatggagtgaaatacgaaacatttctttcaatgataagaaattcgtcatcaaacctattgataaaaaagctcctgacttcgtgttctatgccccccgtctgaggataaacaaaagaatcctggccctgtgcatgggaaatcacgagctgtatatgagaaggcgcaagcccgataccattgaagtccagcaaatgaaggcccaggctcgagaagaaaagcaccaaaaacaacttgaaagagcgcaactggagaatgagaaaaagaaacgcgagattgctgagaaagagaaggagcgaattgagcgcgaaaaagaggaactcatggaacggctcaaacagattgaagaacagactatcaaggcacagaaggagctcgaagagcagacacgaaaagccctggagctggatcaggagcggaagcgcgcgaaagaggaagccgaacgccttgaaaaagaaagaagggctgcagaggaagctaagtcagcgatcgccaaacaggcagccgaccagatgaaaaaccaggaacaactcgccgcggagctggccgaatttaccgccaagatcgctctcctggaagaggctaaaaaaaaaaaagaagaggaagccacagaatggcaacataaagccttcgccgcccaggaggacctcgaaaagacaaaggaggaactcaaaactgtaatgagcgcccctccacctccccctcccccgcccgtcatcccaccaaccgagaatgagcacgacgagcatgatgaaaacaacgcagaagcgtcggcagaactttcaaatgagggcgtcatgaatcatcggtcagaagaggaacgtgttacagagacccagaagaatgagcgggtgaagaagcagctgcaagccctctcatccgagctggcccaggctcgtgacgaaaccaaaaagacccagaacgatgttctgcatgccgagaatgtcaaggcaggtagggataaatacaagactctcaggcaaatcaggcagggcaataccaagcagagaattgatgaatttgaggcgatgtggggcccaaaactgtatgccttgtttcagatgaggtcttgtcagtctagcatcaaacagatgtag

SEQ ID NO: 17031 - DNA, 1020 bp, Artificial Sequence
  Description of Artificial Sequence: Synthetic coding sequence
ccacaccctaagatcaatgtgcgcgtcaccactatggacgccgaactggaatttgccattcagccaaatacaacgggcaaacagctcttcgatcaggttgtgaagaccgtgggcctgagggaggtgtggttcttcggtctgcagtacgtggatagcaagggctactcaacctggctgaaactgaataagaaggtaacacagcaagacgtgaagaaggaaaaccctcttcagtttaaatttcgcgcgaagttttttcctgaagacgtttctgaggagctgatccaagagataacccagcggctctttttcctgcaggtcaaggaagcaattctcaacgacgaaatctactgccccccagagactgccgtgctgcttgcttcgtacgccgtccaggcgaagtatggagattataataaagagatccacaagcccggctatctagccaacgatagactgctgcctcaaagagttttggaacaacacaagctgaccaaagaacaatgggaggagaggatccagaactggcacgaggaacatagaggaatgctgcgagaagattcgatgatggaatatctgaagattgcccaggatctcgaaatgtacggggtgaattactttgagataaaaaacaaaaaaggtaccgaactttggctcggtgtggatgcactggggttgaacatctatgagcacgatgacaaattgacaccaaaaattgggtttccgtggagcgaaatacgtaacatcagcttcaacgataagaagtttgttataaaaccaatcgataaaaaggctcctgactttgtattctacgcacctaggctcagaattaacaaacggatattggctctgtgcatggggaatcacgagctttacatgcgtcgcaggaaaccagataccattgaagtgcaacagatgaaggcacaagctcgggaggaaaaacaccaaaagcagctcgaacgcagtcgactttccaagatcaaaaaaaaaaaacggaaaaagaaaaaaaaaaagaagaagtag

SEQ ID NO: 17032 - DNA, 1815 bp, Artificial Sequence
  Description of Artificial Sequence: Synthetic coding sequence
atgcccaagccgatcaatgtcagagtgaccacgatggacgccgaactcgagttcgccattcagccaaacactactgggaagcagctgtttgaccaggtagtcaaaacagtaggcctccgcgaggtgtggtttttcggactgcaatacgtggactcaaaaggttactcaacatggctgaaactgaacaagaaagtaacacagcaggatgtgaagaaggagaaccctctgcagttcaaattcagggctaaatttttccccgaggacgtatctgaggaactcatacaagagataacacaacgactattctttttacaggtcaaggaggccatcctcaatgacgagatctactgtccacctgaaacggctgtcctcctggcaagttatgccgtgcaagccaagtatggagactacaataaggagattcacaagccaggatacttggccaacgataggttactaccccaacgggtactcgagcaacacaagcttacgaaagaacagtgggaggagagaatccagaactggcacgaggaacatcggggcatgctacgggaggactccatgatggagtaccttaaaatcgctcaagatttagaaatgtatggtgtcaattacttcgaaattaaaaataagaaaggcacagagttgtggctcggcgtggatgctctgggcctgaatatctacgagcatgacgataagttgacacctaaaattggctttccctggtccgaaatcagaaatatctctttcaacgacaagaagtttgttatcaagcccatagataagaaagctccagatttcgtgttttacgccccccgattgcgcatcaacaagcggatcctggctctgtgtatgggaaaccacgagttgtatatgcgccgcaggaagcccgacacaatagaggtgcagcaaatgaaggcccaggcgcgagaagagaagcaccagaagcagctggaacgcgcccagctggaaaatgaaaaaaaaaaaagggagatcgcagaaaaggagaaggagcggatagaacgagagaaggaggaactaatggagagactaaagcaaattgaagagcagacaatcaaagcacagaaagaactggaggagcaaactcgtaaagcactggaactcgaccaggaaaggaagagagcaaaagaagaggcagagaggctcgagaaggagcgaagggccgcggaggaggcaaagagtgcgattgctaaacaggcggccgaccagatgaagaaccaggagcagctcgcagcagaactcgctgaattcacagctaagatcgcattactcgaagaggctaaaaagaagaaggaggaggaagcaactgaatggcagcacaaggcgttcgccgcccaggaagacttggaaaaaacgaaagaggagctgaagactgtcatgagtgcacctcctccaccccccccaccgccagtgattcctcccacagaaaacgagcacgatgagcatgacgagaacaatgccgaggcctctgcagaactgagcaacgaaggagttatgaaccaccgcagcgaagaagagagggttaccgaaacacaaaagaacgaacgcgtgaagaaacagttgcaggccctgtcctccgagctcgctcaggcccgcgacgagacaaaaaagacgcaaaatgacgtcctgcacgcggaaaatgtcaaagccgggagagataaatacaagaccttacgtcagatccgtcaggggaatacgaagcagcgcatagacgaattcgaggccatgtggggccccaaactctacgccctgtttcagatgaggagttgccaaagttccattaaacaaatgtag

SEQ ID NO: 17033 - DNA, 774 bp, Artificial Sequence
  Description of Artificial Sequence: Synthetic coding sequence
atggagcgtttgaagcagattgaggaacagacgataaaggcacagaaagaactcgaagagcaaactaggaaagccctcgagctcgatcaggagaggaaacgggcaaaagaggaagctgagaggttggagaaagagagacgcgccgccgaggaagctaaatccgctatcgcaaagcaggcggccgaccagatgaagaatcaggaacagctagccgcggagctcgccgagtttaccgccaagatcgctctgcttgaagaagccaagaagaaaaaagaagaggaggccactgagtggcagcacaaggctttcgccgcacaagaggatctggaaaagaccaaggaggagctgaagacagtgatgagtgcgccccctcctccccctccacccccagttatcccccccacagaaaacgaacatgatgagcacgatgagaataacgctgaggcttccgctgaactgtctaacgagggtgtgatgaatcacagatcagaggaagaaagagtcactgagactcaaaagaacgagcgcgtgaagaagcagctgcaggctctgtcatctgaactggctcaagccagagatgaaactaagaaaacacagaacgatgtgctgcacgccgagaatgtcaaagccggcagggacaagtataagaccttaagacagattcgccagggcaacactaaacagcggatagacgaatttgaggcaatgtggggccccaaattatatgcactcttccaaatgaggtcctgtcaaagtagcattaaacagatgtag

SEQ ID NO: 17034 - DNA, 762 bp, Artificial Sequence
  Description of Artificial Sequence: Synthetic coding sequence
ggcggccggattgcacgggcccatgagtttgaagctgccgtgtcgttttgtaccagcgcgtgggcaacagaacgtgatccagtaagcaggaagcagcgcgagctagaagaacagaccaggaaagccctggagttagaccaggaacgcaagcgggccaaagaagaggcggaacgcctcgagaaggagcggcgtgccgccgaggaggctaagtctgccattgccaagcaggccgccgaccagatgaaaaatcaggaacaattagctgccgagcttgcggaattcactgctaagatagcattgttggaggaggcaaaaaagaaaaaagaggaagaggcaacagagtggcagcacaaggctttcgctgcccaggaggatttagaaaagacgaaagaagaattgaagacagtgatgtccgctccacccccaccacctccgcctccagtcataccgccaacagagaacgagcacgacgagcatgacgaaaacaatgctgaagcgtccgccgaactctccaatgagggggtgatgaatcaccgcagtgaggaggagagggtgactgaaacccagaagaacgaacgggttaagaaacagctccaggctttatcttccgagctggctcaggcgcgtgatgagacaaaaaaaacacagaacgacgtgctgcacgccgaaaacgttaaagctgggagagacaaatacaaaacactgagacagattaggcagggtaacaccaaacagagaattgatgagttcgaagccatgtag

SEQ ID NO: 17035 - DNA, 603 bp, Artificial Sequence
  Description of Artificial Sequence: Synthetic coding sequence
atgcccaagcccatcaatgtgagagttacaacaatggacgctgagcttgaatttgccatccaacccaatactacaggtaagcagctgttcgatcaggtgactcagcaggatgttaagaaggagaacccattgcagtttaagtttcgcgccaagttcttcccagaagacgtgagtgaggagctcattcaggaaattacacaacgactcttcttcctacaggtgaaggaagcaatactgaatgatgagatttattgcccaccggagaccgccgtcctattggcttcttatgccgtgcaggcaaaatatggtgactacaacaaagagatccataagccgggctatctggctaacgatcggcttttacctcagagagtcctggagcaacacaaacttactaaggagcaggatgaaacgaaaaagactcagaacgacgtactgcatgcagagaatgtgaaagccggacgggataagtataagaccctgaggcaaatcaggcagggaaacaccaaacagaggatcgatgaatttgaggctatgtggggaccaaaactatacgccctgttccagatgagatcttgtcagtccagcataaagcagatgtag

SEQ ID NO: 17036 - DNA, 1815 bp, Artificial Sequence
  Description of Artificial Sequence: Synthetic coding sequence
atgccaaaacccattaacgtgagggtgaccactatggacgctgaacttgagttcgccatccagccaaacacaaccggtaagcagctgttcgaccaggtcgtcaagacggtgggcctgcgggaagtctggttctttggcttacaatatgttgattctaagggatacagtacatggctaaaactcaataaaaaggttacccagcaggacgtgaaaaaggagaatccacttcagttcaagtttcgggcaaaattttttccagaggacgtgagtgaggagttgattcaggagatcactcagcggctgtttttcctgcaagtgaaggaagctatcctgaacgatgagatttactgccctcccgagaccgccgtgttgcttgcgagctatgccgtgcaggctaaatatggagattacaataaggaaatccacaagcccgggtacctggctaatgaccgcctgctgccccagcgcgtcttggaacagcataagctgactaaggaacagtgggaggagagaatccagaattggcatgaagaacacagggggatgttgcgagaagatagcatgatggaatatcttaagattgcacaggacttggagatgtacggggtgaattatttcgaaataaagaataagaaagggacagaactatggttaggtgttgatgcactggggctgaacatctacgagcacgacgataaactgacacccaagataggctttccttggagtgagataagaaacatcagcttcaacgataaaaaatttgtgattaagcccatcgataaaaaggcccctgattttgtgttttatgcgccccggcttcgtattaataagcgcattctggccctgtgcatgggcaaccatgagctctatatgcgaagacggaagcctgacacaatcgaagtgcagcaaatgaaggcccaggcaagagaggagaagcatcagaaacaactggaacgggcccagctggaaaatgagaaaaagaaacgggaaatcgcggagaaagagaaagaaaggattgaacgggagaaggaggaacttatggaacggctgaagcaaatcgaggagcaaaccataaaggctcagaaggagctagaggaacagactaggaaggccctcgagctggaccaggaacggaagagagcaaaagaggaagcggagaggctcgagaaggagagacgcgctgccgaggaggccaaatcggccatcgcgaagcaggccgccgaccagatgaagaaccaagagcagctcgccgcagagcttgctgagtttactgcaaaaattgcactactggaagaagccaaaaaaaagaaagaagaagaggccaccgagtggcagcacaaggcttttgctgcccaagaagatctggaaaagactaaagaagagttgaagacggtgatgagcgccccaccgcctccaccccctcctccagtgatccccccaacagaaaatgagcatgacgaacatgatgagaataatgctgaagccagcgcagagttatcaaacgagggcgtcatgaatcaccgttctgaggaggagagagtgaccgagactcagaaaaatgagcgcgtgaaaaaacagctccaagctctgtcatctgaattggctcaggctagagatgagacaaagaagacgcagaatgatgtgctgcatgccgagaacgtcaaagcaggtagagataagtataagaccctgcgccagatccgccaagggaatactaagcaaaggatcgatgagttcgaggctatgtggggcccaaaactgtacgcactgttccagatgcgctcttgtcagagcagtatcaaacaaatgtag

SEQ ID NO: 17037 - DNA, 1344 bp, Artificial Sequence
  Description of Artificial Sequence: Synthetic coding sequence
atgcttagttggaacttgcccttttcacccatccagcttgccaataacttcctgacttctgtgctggaacagcacaagcttaccaaagaacagtgggaagagcgaatccagaattggcacgaagaacaccgggggatgctgcgggaagattcaatgatggagtacctgaaaattgcccaggacttggaaatgtacggcgtgaactattttgagatcaagaataagaagggaacagagctgtggctgggagtcgacgccttgggtcttaacatctatgaacacgacgataaacttacgcccaaaataggattcccgtggtcagaaatcagaaacatcagctttaacgataagaaattcgtgatcaaaccaatagataagaaggcacccgattttgtgttctacgcacctcgtctccgcataaacaaaaggatcctggctctgtgcatgggcaatcacgagctctatatgaggaggaggaaaccggacacaatcgaagtgcagcagatgaaagcccaagctcgggaagagaaacatcaaaaacaacttgaacgcgcacaactagagaacgaaaaaaagaaacgggagatcgcagagaaggagaaggaacggatcgaaagggaaaaagaagagctcatggagaggcttaaacagatcgaggagcagaccattaaggcacaaaaggagctggaggaacagacaaggaaagcccttgagctggaccaagaaaggaaacgtgccaaagaggaggctgagcgtcttgagaaggagcgacgagcggccgaggaggcgaaaagcgcaatcgccaagcaggccgccgatcagatgaagaatcaagaacagctagccgctgagctggccgagttcaccgctaaaatagccctgctagaagaggccaagaaaaaaaaagaagaggaagctactgagtggcagcataaggcgttcgccgctcaggaagacttagagaaaacaaaggaggagctgaagacggtaatgagtgcaccccccccccccccacctccacctgtcatccccccaacagagaatgaacacgatgaacacgatgaaaacaatgctgaagctagcgccgagctcagcaatgaaggcgtcatgaatcatagaagcgaagaggaaagagtgacagagactcagaagaatgagagggttaaaaaacagctacaagcacttagcagtgagctggctcaggctcgcgacgagacaaagaagacccagaatgacgtgctgcacgcagaaaacgtgaaggctgggagagacaagtataagactctgagacagatcagacagggcaataccaagcagagaatcgatgaatttgaagccatgtag

SEQ ID NO: 17038 - DNA, 3234 bp, Artificial Sequence
  Description of Artificial Sequence: Synthetic coding sequence
atggatactgattcacaacgctcacatttgtcttcattcaccatgaagctgatggacaagtttcacagccccaagatcaagcggacaccctccaaaaagggaaaacccgctgaagtttcagttaagatccccgagaaacccgtgaacaaggaagctactgataggttcctgcctgaggggtacccccttccattagacctggagcaacaggctgtcgagttcatgagcacatctgcggtcgcctcaaggagtcagaggcaaaagaatctgagttggctggaggagaaggagaaagaggtcgtgtccgcgttgagatatttcaaaaccatagtcgacaagatggctatagacaagaaggtgctggagatgctgcccggatcagcctccaaagtgctggaggcaatcttgcccttagtccaaaacgacccccggattcagcactcctctgccctctctagctgctattccagggtgtaccagtccctcgccaacctgatcaggtggagcgaccaggtgatgcttgaaggcgtcaattcagaggacaaggaaatggtgaccaccgtgaaaggggtaattaaagccgtgctagacggagtcaaagagctcgtgagattgactatcgagaaacaggggaggcccagccccacttcgccggtgaagccatcatcacccgcgagcaagcccgatggacccgctgaattaccgctcaccgacagggaagtggaaattctgaacaagacaactggaatgtcccagagcaccgagctactcccagatgcgacagacgaagaggtggccccaccaaagccccctctaccagggatccgcgtggtcgacaatagtccacctccagcactgcctcccaaaaaacggcagagcgctcctagccccaccagggtggcggtggtggctcctatgagccgcgctaccagcggctcctccttgcccgttggcattaacaggcaagatttcgacgtggattgttatgcccagcggcgtctttcagggggaagccacagctacggaggcgagtcacccaggctaagcccctgtagcagcatcgggaagctgtctaagtctgatgagcagctctcttctctcgatcgggactcggggcagtgctcacgtaataccagttgcgagacattggatcattatgatcccgactatgagtttctccagcaggatctgagtaatgctgaccaaattcctcagcagactgcttggaacctgagccctctcccagaatcactgggcgagtccggcagcccattcctgggtcccccttttcagcttccacttggcggacatccccagcccgacgggccgctggcccccggacagcaaactgacactcctcctgccctgccggaaaaaaagagacgctctgctgccagccagaccgccgatggcagtggctgccgtgtgtcgtatgaacggcacccatctcagtacgataacatatcaggcgaagacttgcagtctaccgcacctataccaagtgtcccatacgcaccgttcgctgccatcttgcctttccagcatggtggcagctcagccccagttgagttcgtgggcgacttcactgcgcccgagagtacaggagaccccgagaagcctcctccactcccagagaagaagaataaacatatgttagcttacatgcaactgctggaagattacagcgagccccaaccatctatgttctaccagactcctcagaacgaacatatctaccagcaaaagaataagctgctgatggaggtatatggcttctccgattctttttctggggtggatagtgttcaggaactggcccctccgccggccctgcctcctaagcagcgacaactggagcctcctgccggaaaggacggacaccctcgggatccgtcggcagtctcgggcgtgcctgggaaagatagtagggatggatccgagagagccccaaagtcccctgatgccttagagtccgcgcagtccgaagaagaagtggacgagctcagcctcattgaccataatgagatcatgagccggctgaccctgaaacaggaaggcgatgacgggcccgacgttcgaggcggaagcggggacattctactagtgcatgcaactgaaaccgatcgtaaggacttggtgctctattgcgaagcgttcctcactacttaccgaacgttcatatcccctgaggagcttatcaagaagctgcagtacaggtacgaaaagttttcccctttcgcagatacctttaaaaagcgtgtgtccaagaatactttctttgttctcgtgagggtggtggatgagctgtgtttggtggagctgaccgaggagatactcaagctactcatggaactcgtcttccggttggtgtgcaatggagagctgagtttggctcgagtccttcgcaaaaatatcctggataaagtcgaccaaaagaagttactgcggtgtgccaccagttcacaaccacttgctgcccggggagtcgcggccaggccagggactctgcacgacttccatagccatgaaatcgccgaacagctcactctgcttgacgccgagttattctataagatcgaaatcccagaggtgcttctgtgggcaaaggagcagaacgaggagaagtcaccaaatctgacacagttcaccgaacactttaacaatatgagctactgggttagaagcattataatgctgcaagagaaagctcaggatagggagagactgcttctgaaatttattaagatcatgaaacacttaagaaaactcaataactttaatagttaccttgcaatcctcagcgctttggattcagcacctatacgtagactcgaatggcagaaacaaacatctgaagggctggctgaatattgtacattgatcgatagttcatcttcatttagggcataccgtgccgccttgtccgaagtggaacccccttgtataccatacctgggtctgattctgcaggatctgacatttgtgcacttagggaatcctgattatatagatgggaaggtcaatttcagtaaaaggtggcagcagtttaatattcttgattcaatgcgatgctttcagcaagctcattacgacatgaggcggaacgacgatattataaacttcttcaacgatttttcagaccatctggcggaagaagccttgtgggaactaagtctcaaaataaaaccccgtaacattactcgtcgcaaaacagaccgggaagaaaagacttag

SEQ ID NO: 17039 - DNA, 3168 bp, Artificial Sequence
  Description of Artificial Sequence: Synthetic coding sequence
atgtccacctctgctgttgcgagcaggagccagaggcagaagaatctctcttggctggaagaaaaggaaaaagaggtggtgtcagcacttagatactttaagactatcgttgacaaaatggcaattgataaaaaagttctagagatgctgccaggctctgcttccaaggtgctggaggccatcctgccccttgtacagaacgacccccgcatccagcactctagcgcgctgagttcgtgctacagcagggtgtaccagtccctggctaacttaatcagatggtccgaccaggttatgttagagggggtcaatagtgaggataaggaaatggtgactacagtaaagggggtaatcaaggcagtcctggatggcgtgaaagaactcgtgaggctgactattgaaaagcagggtcgaccctcacctaccagccctgtgaagcccagctcccctgcttcaaaacctgatgggcccgctgagctccctctgactgacagggaagttgaaatcttgaataagactactgggatgtctcagtcaacagagctgctgccagacgcaactgatgaggaggtggccccccccaaaccgcctctgcctggcatccgggtcgtggataacagtcctccgcccgccttgccacccaagaagcgtcaatccgcaccaagcccaacaagggtggccgttgttgctcctatgtcaagagctacaagcggatcttctttacccgttggtattaaccgccaggacttcgatgtagactgttatgcccagcgtcgcctgtctgggggtagccatagttacggtggcgaatcaccacgcttatctccatgctcatctattggcaagttaagcaagagtgacgagcaattatccagtctggaccgggattccggacagtgctctcgtaatacaagctgtgaaactttagatcattacgacccagactatgagtttctccagcaggacctgtcaaatgccgaccagatcccccagcaaactgcctggaaccttagtccgctcccggagagcttgggagagtctggttcccctttcctgggccccccgtttcaactgcctctgggagggcaccctcagcccgacggacctctggcccccggacaacagacggacacccctccagccctgccagaaaaaaagagacgaagcgctgctagccagaccgccgatgggtcaggatgtcgggtgtcatatgaacggcacccctcccagtatgacaacatatcgggagaggatctacagtccacggctcctatcccaagcgtcccgtatgctccctttgccgccatcctgccctttcagcacggggggtccagcgcaccagtagagttcgtgggagacttcacggccccagagtctaccggcgaccctgagaaacctcccccgctcccggaaaaaaaaaataaacacatgcttgcctatatgcaactgctagaggattactcagagccacaaccaagcatgttctaccaaaccccgcagaacgagcacatctatcagcagaaaaacaagctcctaatggaggtctacggctttagcgactctttttcaggcgtggactcagtacaagaattagcacctccaccagcccttccgccaaagcagagacagcttgcgtcttgcgcagctagcagcttcagcagtgtcagtcactgtgtgcagcagacaaaagtggctttcacacccgaagatggcagcgccgcccaaggcctgagcgtgtctgtgtccaattctttccttagcagacacggctcactgcccgtgccatctgagcccccagctgggaaagacggccaccctcgggacccctctgccgttagcggggtgcccgggaaggattctagggatggttccgaacgagccccaaagtcacctgacgcactggaatcggcccagtcagaggaggaggtcgatgaactgtctttgattgaccataatgaaatcatgagccgtttgactctcaaacaggagggggatgacggcccagatgtgcgtggggggtccggtgacatcctgttagttcatgccaccgagactgatcggaaagacctcgttctgtattgcgaggcattcctcaccacctatcgaacatttatcagccctgaagaactgattaaaaaactgcagtaccgatatgaaaaattttcaccttttgccgacacctttaagaaaagggtgagcaaaaacaccttctttgttctcgtgcgcgtagtggacgagttgtgcctggtagagctcacagaggaaattctgaagctactcatggaactggtctttcgcctcgtgtgtaatggagagttgtctctcgcgcgagtgctccgaaagaatattctggataaagtggaccagaaaaaactgctccggtgcgctacatcctcccagcctctggccgcacgtggcgtggctgctagacctggcaccctgcacgacttccattcccatgagattgcagagcagctaacactcctggacgccgaactcttctacaagatcgaaattcctgaagtactgctgtgggctaaggagcagaatgaggaaaaaagtcctaacctgactcagtttaccgagcattttaataatatgtcatactgggtccgctctatcataatgcttcaagagaaggcccaagaccgcgaaaggcttttgttaaagtttatcaagatcatgaaacatctccgaaaactaaataacttcaacagttacttggcgatcctgagtgccctggactcagcccccatacgtcgcttagaatggcagaagcagaccagcgagggcctggcagagtattgtacactgatcgacagcagttcatcattcagggcgtatcgggctgccttatctgaagtggagcctccctgcatcccataccttggactaatactgcaggacttgacgttcgtccatttggggaaccctgattatatagacggaaaggtgaatttttccaagcgctggcagcaattcaacatcttggactctatgcggtgctttcaacaggctcattatgatatgagacggaacgatgatatcatcaacttttttaatgacttttctgatcatctagctgaggaagcactctgggagttatcactgaaaattaagcccagaaacataactcgccgcaagacggaccgcgaggagaagacgtag

SEQ ID NO: 17040 - DNA, 3285 bp, Artificial Sequence
  Description of Artificial Sequence: Synthetic coding sequence
atgagtggcggactgggcctgaggcggagcccggaaatgtccggaaagattgagaaggcagattcccagcgtagtcatctttcatcgtttactatgaaacttatggataagtttcacagccccaagatcaaaaggacaccaagcaagaagggaaagcctgcagaagttagcgttaaaatccctgagaaacccgtaaataaagaggccaccgaccgctttttgcccgagggctacccgctccccctggatctggagcaacaagccgtggagtttatgagcacgagcgcagttgctagcaggtcacagcgccaaaagaatctctcctggctggaggagaaggaaaaagaagtggtttccgcactgcgttattttaaaaccatagtggataagatggcgattgacaagaaagttctcgaaatgctcccagggagtgcctctaaggtcctggaagccatcctccccctggtgcagaacgatccacgcattcagcactccagcgcactgtcctcctgctacagcagagtataccagagtctggccaacctgattcgctggtcagatcaggttatgttggagggtgtgaattccgaggacaaagagatggtaacgacagtgaagggagtgatcaaggccgtactggacggtgttaaagaactcgtgcgtctgacgatcgagaaacaggggcgtccttcaccgaccagtccagtcaaacctagtagcccagcatccaaacctgacggacccgccgaactaccgctgaccgacagggaggtggagatccttaacaaaaccacagggatgtctcagtcaaccgagcttctacccgacgctactgacgaggaagtagctccccccaagcctcctcttcctggaatcagggtggttgacaattcccccccaccggctctccccccaaaaaagagacaatctgccccgtctcctaccagagttgccgtggttgcccccatgagtagagctacaagtggcagctctctcccagtgggaattaacagacaggatttcgacgtagattgttacgcccagcgccggctatccggcggaagtcatagctacggcggcgaaagccctaggctctccccatgcagctccatcggcaagctgtcaaaaagcgacgaacagctgtcctctctggaccgggattctggacagtgctcaagaaacacgtcatgtgaaaccctcgatcattatgacccagactacgagtttctgcagcaggatctttctaacgccgaccagatccctcagcagacagcgtggaaccttagccctctccctgaaagcctgggagagtccggcagccccttcctggggcctccttttcagctccctctgggcggacatccccagcctgacgggccactggctcccggacagcagaccgatactccgccggccctgccagaaaaaaagcggaggagtgccgcttcccaaaccgcggatggatccggatgccgagtgtcatatgaacggcacccttcacaatatgacaatatctcaggagaagacctgcagagtaccgcacccataccatctgtgccttacgctcctttcgctgcgatcctgcccttccaacatggtgggtccagcgcgccggtcgaatttgtcggagattttacggcacctgaaagtaccggcgaccctgagaagcccccaccactccccgaaaagaaaaacaaacatatgctggcctatatgcaactgctggaggattatagcgagccacagccatcaatgttctatcagacccctcagaatgagcacatctaccagcagaagaacaagttgctcatggaagtgtacggtttctctgattctttcagtggggtggacagtgtgcaggaactggccccaccacccgcactcccgcctaaacagcggcagctagagcctcccgccgggaaggatggccacccccgcgatccctctgctgtatctggagttccgggcaaggattctcgggatggttcagaacgggctcctaagagccccgatgcattagagagtgcacagagtgaagaagaggtggacgaactttcactaattgatcacaatgagatcatgagccggcttactctcaagcaggaaggcgacgacggccctgacgtgcgaggtggctccggtgacatcttactggtgcatgcaacagagactgacaggaaggacctggtgctgtattgcgaagcgttcctgactacatataggacatttatttcaccagaggaattaatcaaaaagctgcagtataggtacgaaaagtttagtcctttcgcagacactttcaagaagagagtatctaagaacacgttttttgtgttggtgagagtagtggacgaactctgtctcgtggaacttacggaagagattctgaagcttctgatggaattagtattcaggcttgtgtgcaacggcgagttgtccctcgcgagagtgctaaggaagaacatcctggataaagtcgatcaaaaaaagctgctgcgttgcgctaccagttcgcagccattagccgcccgcggcgtagccgctcgacctgggacacttcatgacttccactctcacgaaatcgccgaacaactcactcttttggatgctgagctgttctataagattgaaattccggaagtcctgctatgggctaaagaacagaacgaggagaagagtcctaacctgacgcaatttactgaacacttcaacaacatgagctactgggtgagaagtatcatcatgttacaggaaaaagcgcaggacagagagcggcttctcctcaagtttattaaaattatgaaacatctcagaaagctaaacaactttaatagttatctggccatcttgtcagctttagattctgcacctattcgccggctagagtggcaaaaacagacttcggaagggctggcagagtattgcactcttatcgattcttcttcctcttttcgcgcgtatagggccgccctcagtgaggtggagcccccatgcattccgtacctaggacttattctgcaggaccttacatttgtgcacctgggcaaccctgattacatcgacgggaaggtgaacttttccaagaggtggcagcagttcaacatcctggactccatgagatgttttcaacaggctcactacgatatgagacggaacgatgatataatcaactttttcaacgactttagtgatcatttggccgaagaagcattgtgggagttgtctctgaaaatcaaaccgcggaatattactcgtcgcaagacagatcgcgaggagaaaacctag

SEQ ID NO: 17041 - DNA, 3234 bp, Artificial Sequence
  Description of Artificial Sequence: Synthetic coding sequence
atggacacagactcccagagatcccacctgtccagctttactatgaagctgatggataaattccacagccccaaaatcaaacgcactccaagcaaaaagggaaagcccgccgaggttagcgtgaaaatccccgagaaacccgtgaacaaggaggcaacggatcgcttcttgcccgaaggataccctctgcccttggacctggagcagcaggcagtcgagtttatgtcaacatcagccgtcgccagccggtctcagaggcagaaaaacctctcttggctggaagaaaaggagaaagaagtggtctccgcgctccggtacttcaagaccattgttgacaaaatggccatcgataaaaaggtacttgaaatgctccctggcagcgcatccaaggtgctcgaagctatactgcccctggtacagaatgaccccaggattcagcactccagcgcactctcatcctgttactcccgggtttatcaaagtctggctaatctgatccgctggagcgaccaggtgatgcttgagggagttaatagtgaggacaaagagatggtgacaactgtcaagggcgttataaaggctgtgttggacggtgttaaagagctggtcaggctcacgatcgagaagcagggcagaccatcgccaactagtccagtgaagcctagcagtcccgcatcaaaacctgacggccctgccgaacttcctctcaccgatagggaggtcgaaatcctgaacaaaactactggtatgagccagagcacagagttgcttcccgacgcgactgacgaggaagtcgcacccccaaagccaccccttccaggcatccgggttgtggataactctccgccccctgctctgcccccgaaaaagagacagtcagctccttctcctactcgagtggccgttgtcgcccctatgagtagggctacctcgggatcaagcctgcctgttggcattaacagacaggactttgacgtcgattgttacgcgcagagacgcctgagtggggggtcccacagctatggcggggagtctccaagactgtccccctgtagtagtatcggcaaactaagcaagagtgacgaacagctcagtagcttggatagggacagtgggcagtgcagtagaaacacttcatgtgagaccctggatcactacgatcctgattacgaattcctacagcaggatttgtcaaatgctgaccagattcctcaacagactgcctggaatctctctcctcttcctgaatccctcggggagtcaggaagcccattcctgggtcccccctttcaactcccacttggcggccatccacagcctgacggaccgctcgcccccggacaacaaactgacactccccctgccctgcctgaaaaaaagaggcgcagtgcagccagtcaaactgcggacggatcgggctgcagagtatcatatgagcgacaccccagtcagtatgataatatctctggggaggacctgcaatccacagcccctattccctccgtgccatacgcaccattcgctgccattctccctttccagcacgggggatcctccgcgcccgtagaatttgtgggtgatttcaccgctccagagtctactggtgacccagaaaagccgccccctcttcctgaaaaaaagaacaaacacatgcttgcctacatgcaactgctagaggactacagtgagccccagccctccatgttctatcagacaccacagaacgaacatatttatcagcagaaaaataagctgctgatggaagtgtacggtttctcggattcttttagcggcgtcgacagtgtccaagagttggcccctccacctgccctgcctcctaagcagaggcagctggagccgccagcaggcaaagatggacacccgcgagacccatcagctgtgagtggcgtccccggtaaagactcccgggacggtagcgagagagctccgaagagtcctgatgccttggaatcagcacaatccgaggaggaagtggacgagctgtcactgatcgaccacaacgagatcatgagccgcctaacactgaagcaggagggagatgacggccccgacgtacggggtgggagtggggacatccttctcgtgcacgcaaccgagactgatagaaaagacctcgtgttgtactgcgaggccttcctcactacctaccgtaccttcataagcccggaagaacttattaagaaactacagtatagatatgaaaagttttctccttttgccgatacttttaaaaaacgagtgtccaagaatacattcttcgtgctggttcgcgttgttgacgaactgtgtcttgttgagctgactgaggagatactaaaacttctaatggagctggtctttaggctggtgtgcaacggggaactcagcctggcacgggtgttacgcaaaaatattctggacaaggtagatcagaagaagctgctgaggtgtgccactagcagtcaaccgctggccgcaagaggcgtggctgcacgacctggcacattgcatgacttccactcacacgagatagcggaacaacttacgctgttggacgcggaactgttttacaaaatagagatacccgaagtgttgctgtgggcaaaagagcagaacgaggaaaagtccccaaacttgacccagtttacagagcatttcaataacatgtcctactgggtgagatctattattatgctccaggagaaggcccaggatcgggagaggttgcttctcaagtttatcaagataatgaaacatttacgtaagctgaataacttcaattcctatctcgcaatcctgtctgccctggacagcgcccccattcgaagactggagtggcagaaacagacaagcgagggactggccgagtattgtacactcattgacagctcttcaagctttagagcctatcgggcagcactctcagaagtcgagcctccttgcatcccctatttaggccttatacttcaggacctgacattcgtgcaccttgggaatcctgactacattgacggcaaggtcaatttcagcaaacgttggcagcagttcaatattttagacagcatgaggtgtttccagcaggctcattatgacatgaggaggaacgatgacataatcaacttctttaacgacttctccgatcatttggctgaggaagcgctatgggagctcagtttgaaaattaaaccccggaacatcactcgaaggaagacggaccgcgaggaaaaaacgtag

SEQ ID NO: 17042 - DNA, 3288 bp, Artificial Sequence
  Description of Artificial Sequence: Synthetic coding sequence
atgggaaatgccatcgaaaagcagaagcccctcaagcgaagtcatctgtacccctggaagcaggactcccagcgaagtcatctgagttcttttactatgaaattaatggacaagtttcacagccccaagatcaaacggaccccctcaaaaaaggggaaaccggccgaagtctcagtaaagatcccagaaaagcccgtcaacaaggaggctacagatcgattcctcccagagggctatccgctgccactggacctggagcagcaggcagtggagtttatgtctacttccgccgttgcttccagaagtcagcggcagaagaatctgagctggctggaggagaaagagaaggaggtggtcagcgcactcaggtatttcaagactattgtcgacaaaatggccatagacaagaaggtccttgagatgctgcctggctccgctagtaaggtgctggaggctattctgccacttgtacaaaacgaccctcgaatccagcacagttccgccctctcttcatgctattccagagtttatcaatctctcgctaacctgattcgttggtccgaccaggtgatgctggagggtgtcaacagcgaggacaaggaaatggtaacgaccgttaagggagtcatcaaagctgtattggatggagttaaagagctcgttaggctgacaattgaaaagcaagggagaccctcacctacaagcccggtcaaacctagtagcccggcctctaaacctgatggacctgccgagcttccgttgaccgatcgggaggtggagatattgaataaaaccacaggcatgtctcagtccactgaattattgcctgatgccacggatgaggaggtggccccacccaaaccccccctgcctgggatcagggtggtcgacaactcgcccccacccgccttgccacctaagaaaagacagtctgctccgtctcccactagagttgctgtcgtggctccaatgagccgcgcaacttccgggagtagcttgcccgttggaatcaatcgacaggacttcgacgtggattgctatgctcaacgaagactttcaggtggaagccattcgtacggcggcgagtccccgcggcttagcccatgcagctccattgggaagctgagcaagtccgatgagcaactcagcagtctagaccgggacagtggccagtgttcacggaataccagctgtgagaccttagatcactacgaccccgattacgaattcctgcagcaggatttatccaacgcagaccagatcccccagcagaccgcgtggaacctttctccccttcctgaaagtttaggtgaaagcggaagtccattcctaggcccaccgtttcagctgccactgggcggtcacccccaaccagatgggcccttggcccctggacagcagaccgatacacctccagccctccctgagaagaagagacgttcagccgccagccagaccgcagacggatctgggtgtagagtctcatacgagagacacccatctcagtatgataacatctccggcgaggatctgcagagcaccgctcccatcccgtccgttccatacgcccccttcgccgccattctgcccttccagcacggaggaagctctgcacccgtcgagttcgtgggcgacttcaccgcccccgagtctaccggtgatcctgagaaacccccaccgctcccagagaaaaaaaataaacacatgctagcctatatgcagctcttggaggattatagtgagcctcagccaagcatgttctatcagacccctcagaatgagcacatttatcagcagaagaataaactgctgatggaggtatacggcttctccgattcgttttccggagtggactccgtgcaggagttggcgccccctccagcactcccacctaagcaacgacaactggaacctccagccggtaaggacgggcaccctagagatccttccgccgtgtccggggtccctgggaaagatagtcgggacgggtctgagcgagcacctaagagtccggacgctctcgagtctgcccagagtgaggaggaagtcgacgaactgagcctgattgatcataacgagataatgtcccgtcttacactcaaacaggagggtgatgacggccccgatgtccgaggggggtccggggacattctgctcgtccatgctacggagaccgacaggaaggacctggtcctatattgcgaggcatttctgacaacatataggacattcatttcacctgaggaattgattaagaaacttcaataccgctacgagaaattttccccattcgccgacacatttaaaaagcgagtctcaaagaacaccttcttcgtgttggtgcgagtggtcgatgagttgtgtttagtagagctaacagaggaaatcctgaaacttctaatggagctggtattccggctggtgtgcaatggcgaactgtctctggcacgtgtcctcagaaagaacatcctggataaggtggaccagaagaaacttctgcgatgtgctacgtcctctcagcctctggctgcacgcggcgttgctgcccgaccggggacactgcatgatttccactctcacgagattgccgaacagcttaccctgttggatgcggagctgttctacaagattgaaatccccgaagtgctgctgtgggccaaggaacagaatgaagagaaaagccccaatcttacgcagtttactgagcacttcaacaatatgagctattgggtccggtctattatcatgctccaggaaaaagcccaggaccgagaaaggctgctactcaaattcattaagatcatgaaacatctccggaagctgaacaattttaattcctacctggcgatcctgagcgctctcgattcagcgcccattcggaggttggagtggcagaaacagacctccgagggtctggccgagtattgcacattgatcgactcttcctcctctttcagggcctacagggcagctctctctgaggtggaacccccttgtattccctacttaggactgattctgcaggatctgacttttgttcacctgggtaaccccgactacatagatggaaaggtcaacttcagcaagagatggcagcagttcaatatcctcgattccatgaggtgctttcagcaggcccactacgacatgcgaagaaacgatgatatcattaacttcttcaatgacttctctgatcacttagcggaggaggctttgtgggagctgagtctgaagatcaaacccaggaatattaccagacgaaaaaccgatcgcgaagagaagacttag

SEQ ID NO: 17043 - DNA, 1395 bp, Artificial Sequence
  Description of Artificial Sequence: Synthetic coding sequence
atgtccagagccaccagcggtagtagcctgcccgtgggcattaacagacaggattttgatgtggattgttacgctcagcggagattaagcggtgggtctcactcttacggaggcgaaagccctcgcttgagtccctgctccagcatcggtaagctgagcaaatccgatgagcagctatcttccttagaccgtgacagtgggcagtgcagtcgcaatacaagttgcgaaactctcgaccactatgatcctgactatgaattcctacagcaggacctgtctaatgctgatcagatcccacagcagactgcatggaacctgagtcccttgcctgaatccctcggtgaatctggaagtccattcctgggacccccctttcagctccctttgggagggcacccgcagccggacggaccacttgcacccggacagcaaaccgacacaccgcccgcacttcccgaaaaaaagcgacgatctgctgcatcacagacagctgatgggagtgggtgcagggtgtcttacgagagacaccctagccaatacgacaatatatcaggggaggacctccagagcacagctccaattccttccgtgccgtacgccccttttgctgcaattctgccatttcagcacgggggcagctcagccccagttgagtttgtgggggatttcaccgccccggagtcaaccggggatccagagaaaccaccacctctccccgaaaagaagaataaacatatgcttgcctacatgcagctgctggaagattattctgaaccacaaccgtccatgttttatcaaactccccagaacgaacatatctatcaacagaagaacaaattactgatggaggtgtacggatttagcgattctttctctggagtagattctgtgcaggaactcgcccccccaccagccttgcctcccaagcagcggcagcttcaggcctcatgcgccgccagttcgttcagctccgtaagtcattgcgtgcaacaaaccaaagtcgccttcacccccgaggacgggtcagctgcccagggcctgtcagtgtccgtgtctaactcctttttaagtcggcacggaagtcttcccgttccatcgtataagtcagtgttccgaagctactctcaggacttcgttccacatcaccaggccagcgtgccacctttcctgcctccgacatcctcaagctccccccatttccccccagcacatcaatctcaatctagcgatttagcggttccaacaatggccggccccccccccagcacagtagatgggcccctgagtgcatcacaggagagctcatttcacggcaatacagtgtgtctgccttccgagacgtcctttactgattctgaaccaccagcaggcaaggatggtcaccctagggattag

SEQ ID NO: 17044 - DNA, 3285 bp, Artificial Sequence
  Description of Artificial Sequence: Synthetic coding sequence
atgagcggcggtctcggactgaggagaagccccgagatgtcaggcaaaatcgaaaaggccgattcacagcgttctcatctgtcgagttttaccatgaagttaatggataagtttcactccccaaagattaaacggacaccgagcaaaaagggaaagccagccgaagtctccgtgaaaattcccgaaaagccagtaaacaaggaagcgacagacaggtttctcccagagggctaccctttacccctcgatctggagcaacaagccgtggagtttatgagcacctctgcagtcgcctccaggtcccagagacagaagaacctgagctggctggaggagaaagagaaagaagtcgtgtctgcccttcgttatttcaaaacaattgtggataaaatggctatcgataagaaagtactcgagatgcttccaggatcagcatctaaggttttggaagctatcctacccctcgtacagaacgaccctaggattcagcactcgagtgccctttccagctgctactctcgtgtttaccagtcacttgccaacctgataaggtggtctgatcaggtgatgctcgaaggggtgaactcagaggacaaagaaatggtgaccactgtgaagggcgtcattaaagctgtactggacggggtaaaagaactggtgaggctcactattgaaaaacaaggccgtcccagtccgacgtcacccgtaaagccctcgtcccctgcttcaaagccagatggccccgccgaactcccactgaccgatcgggaagtggaaatcctcaacaaaactaccggtatgagtcaatccaccgaacttcttcccgacgccactgacgaggaggttgctccgcccaagcctcccttgcccggaatccgcgtggtggataacagccctccgcctgctctgccaccgaagaagagacagagtgccccctcgcctacgcgcgtcgcggtggtggctcccatgagtagggctacatcagggtccagtctgccagtgggcattaacaggcaggatttcgacgtcgactgctacgcccaacgcagattgagcgggggctcccattcctacggaggagaatccccgcgactgagcccatgcagtagcataggaaagttgagcaagagcgacgagcagctatcatccctggacagagacagtgggcagtgctcccggaacacatcttgtgagaccctagaccactacgaccccgattatgagttcttgcagcaggacctcagtaacgcggaccagatcccgcagcaaaccgcttggaatcttagccctctgccagagtccctgggggaatcgggctcaccatttttggggcctcccttccagctccccttgggcggacaccctcagccagacggaccactggcacctgggcaacagaccgacacacccccggcactgccagaaaagaaaaggaggtccgcggcatcacaaactgccgatggttcgggatgcagagtctcgtacgagcgccacccttctcaatacgacaacattagcggtgaagacctccagtctacagcccccatcccaagcgtcccgtacgccccatttgccgccatactgccattccaacacggaggctcctccgccccagtggaattcgtcggagactttacagcacctgaaagcaccggagaccccgaaaagcccccaccattgccggagaagaagaacaagcacatgcttgcttacatgcaactgcttgaggattactctgaaccacagccgtctatgttttatcagaccccacagaacgagcatatttatcagcaaaaaaataagctgctgatggaggtatacggattttcggactccttttcgggcgtcgacagtgtccaggagctggcccctccaccggcattgcctccaaaacagcgccagctggaacctcccgccggcaaagatgggcatcctagagatccaagcgccgtgtccggtgtgcctgggaaagattctcgagacggctctgaacgcgccccaaagagtcctgacgcactggagagcgcccaaagtgaagaagaggtcgacgagctgagcctcattgatcataacgaaataatgagtcgattaacactcaaacaggagggggacgatggacccgacgtgcgtggcgggtccggggacatcctgctcgtgcatgccactgaaacagatcgcaaagatctggtgctgtattgtgaggccttcctgacaacgtataggacatttatctccccagaagagctcattaaaaaactccagtatagatatgagaaattcagcccattcgccgatacctttaaaaagagagtgtccaagaatactttcttcgttctggtgagagttgtggacgaattgtgccttgtggaactcaccgaagaaatcctgaagcttctgatggagcttgtgttccggctggtttgcaacggggagctttcccttgcgagggtgctgagaaaaaacatcctcgataaagtcgatcagaagaaactgctgcgctgtgccaccagcagtcagccgctcgccgcaaggggcgtcgccgcacggccaggcacacttcatgatttccattctcacgaaatagcagaacaattgacactcctggatgccgagctgttttacaaaatagaaatcccagaggtgctcttatgggccaaagagcagaacgaagagaagtccccaaatcttacccagttcaccgaacattttaacaatatgtcttactgggtacgttccattataatgttgcaggagaaggcccaagacagagaaagactgctcctgaagttcattaaaattatgaagcacttgcgcaaacttaacaacttcaattcttacttggctatcctgagtgctttggattccgctccaattagaagattggagtggcagaagcaaacctccgagggcctcgctgagtattgtaccctgattgatagctcttcctccttccgagcttaccgggccgcactcagtgaggtcgagcccccctgtattccttatctgggactgatcttgcaagacctcacctttgtgcacctgggcaatcctgattatatagacgggaaggtgaactttagtaagcgatggcagcagttcaacatactagattctatgcgctgcttccagcaggctcattatgacatgagacggaacgatgatattattaactttttcaacgacttttcagatcacctggcggaggaggccctgtgggagctgtcgcttaaaattaagccccgaaacatcacccgcagaaaaaccgatagagaggagaaaacatag

SEQ ID NO: 17045 - DNA, 1011 bp, Artificial Sequence
  Description of Artificial Sequence: Synthetic coding sequence
atggaagtttatggattctctgattcattctccggcgtggatagcgtgcaggaactggctcctcccccagcactcccacccaagcaacgccagttaagcgagaatgctagtgaggaagctggggagggggaatacgttaatctgtattcctcgggacaaagtagcgaagagcttgccccatctagaggggaacccccagcaggtaaagacgggcatccccgcgatccttccgcggtttctggtgtgcccggcaaggactctagggacgggagcgagcgcgctcctaaatcaccagacgctctcgagtctgctcagtcagaggaagaagttgatgagctctccctaattgatcataatgagatcatgtcccgcttgacactgaagcaggaaggggatgacggtcccgacgtgcgggggggaagcggcgacatcctgctggtgcacgcgactgaaactgataggaaagaccttgtgttgtattgcgaagccttcctcaccacctaccggacgttcatttcgcctgaggaattgatcaaaaaactgcagtaccgctacgagaagttctctccatttgcagacactttcaagaagcgagtgtccaaaaacacgttctttgtcctggtcagggttgttgatgagctatgcctcgttgagctgaccgaagagatactcaagctgttgatggagctggtattccggctcgtgtgcaacggggagctctccctggcgagggtactacggaagaacatcctggacaaagtagaccagaaaaaactgcttcgttgtgcaacatcctcccagccgttggccgctcggggcgtggctgcccggccggggaccttgcatgatttccatagccatgaaatcgccgaacagttgacccttctggacgcagagctgttttataagattgagatcccagaggttctgctgtgggcaaaggaacagaacgaagaaaagtcacctaacttaacacaattcacagagcacttcaacaacatgtcttactag

SEQ ID NO: 17046 - DNA, 3174 bp, Artificial Sequence
  Description of Artificial Sequence: Synthetic coding sequence
atgggcaacgcaatcgaaaaacagaagcccctcaaacgcagtcacctctacccttggaaacaggacagtcagcggtcccatctgtcttccttcactatgaaactgatggacaagttccatagtccaaagatcaagcgaaccccatccaaaaagggcaaaccggcggaggtttctgtcaagattcctgagaagcccgtgaataaaaacctgtcgtggctggaggagaaggaaaaagaagtagtgtccgcactgcgctactttaagaccattgttgacaagatggctattgataagaaggtgcttgagatgttacctggaagcgcaagtaaagtgcttgaagccatcctccccctggtccagaatgacccccggatacagcactcctccgcactctcttcatgttactcccgggtgtaccaatctctggccaacttaattagatggagcgaccaggtgatgctggaaggggtgaatagcgaggataaggagatggtgacaacagtaaagggcgttatcaaagccgtcctggatggtgtcaaagagctggtcaggctgacaattgagaagcaggggcgcccctctccaacatcaccagtgaagcccagttctcctgcttccaaacccgacggtcctgcagaactccctttgacagaccgcgaggtggagatactgaataagaccaccggtatgtctcaaagtacagaactcctgccagatgccacagacgaggaggtagcacctccaaaaccccccctacctggaatccgcgtcgtggacaactctccccctcccgcccttccgcctaaaaagaggcagtctgctccctctcccacacgtgtggcagtcgtagcaccaatgtcccgcgcgacatcaggcagctcacttcctgtcggtattaaccgtcaggacttcgacgtagattgctacgcccaaaggagattgagtggaggaagccactcatacggaggcgagtcacccaggctaagtccatgctccagcattggcaagctgagcaagagcgatgaacagctgtcaagtcttgacagagacagcggacagtgcagcagaaatacatcctgtgagacccttgaccactatgatcctgactacgaatttctgcagcaggatctgagcaacgcagaccagataccgcagcaaacagcttggaacctgtcaccacttccagaaagcctgggtgaaagcgggtctccatttttaggtccaccatttcagctccccctaggcgggcacccccagccggacggccctttggcccctggccagcaaaccgatactcctcctgccttgcccgaaaagaagcggcgaagcgccgcttcccagacagccgacggatccggctgccgggtgtcttacgagcggcatcctagtcagtatgacaacatttccggcgaggatttacaaagtacagctccaataccatcagtgccctatgcgccgtttgctgccattctgcctttccagcatggcgggtcatccgcccccgttgagtttgtgggcgattttaccgcacctgaaagtactggggaccctgagaagccaccccctctgcccgagaaaaaaaacaaacacatgcttgcgtacatgcaactcctcgaagactatagcgagccgcagccgtcgatgttctatcagaccccccagaatgagcacatctaccagcagaagaataaactgctcatggaggtgtatgggtttagcgatagcttctctggagtcgatagcgtgcaggagctcgccccgccgcccgctttgcctcccaaacaaaggcagctggagcctccggccggcaaagatggacatccgcgcgatccgtcggccgtttcaggtgtgcctggaaaggatagccgggatgggtctgaaagagccccaaaatctcctgacgcactcgagagcgcacagtccgaagaagaggttgacgagttaagtctcatcgaccacaatgagattatgtctcgtctgactctgaagcaggaaggtgatgacggcccagatgtgcgcggggggtccggagacatcctgttggtgcatgccaccgagaccgatcgtaaggacctggtgttatactgtgaggcgtttttgacaacctataggacttttatttctccagaggaacttattaagaagctccagtacagatatgagaaattctctccgttcgccgacaccttcaaaaagcgggtctctaaaaatacattttttgtgctggtgagggtggtggatgagctgtgcttggttgaattaaccgaagagatcttgaagctgctaatggagctggtcttcaggctcgtctgtaacggtgagctgtccctggctcgggtgctgcggaaaaacattcttgacaaggtggaccagaagaagctccttagatgtgcaacttcctcccagccactcgctgcccgcggtgtagccgccagaccgggtacattgcacgattttcattcccacgagattgcggagcagctgacactgctcgacgctgagctgttttacaaaattgaaattccagaggtccttctttgggctaaagaacaaaatgaagaaaagtcccccaaccttacacagtttacagagcactttaataatatgtcatactgggtgcgctcaattatcatgctgcaggagaaggctcaggaccgagagcggctgctgcttaagtttatcaaaataatgaagcacctgagaaagctgaataattttaacagttacctggctatcttgtctgctcttgactcggctcctatacgccggctggagtggcagaaacaaacaagtgaggggcttgccgagtactgtaccttaattgattcgagttcatcatttagggcctatcgcgccgccttgagcgaggtcgagcccccctgcattccatatctggggctgattctgcaggacttgactttcgtacacttgggtaatccagactacatcgacggaaaagtgaacttcagcaagcgctggcagcagttcaacatccttgattccatgcgatgtttccagcaggctcactatgacatgcgtcgcaacgacgatataatcaatttcttcaatgacttcagtgaccacttagcagaggaagcgctgtgggaactgtcgttaaaaatcaaacctagaaatattactcggcggaagaccgatcgagaggaaaaaacctag

SEQ ID NO: 17047 - DNA, 960 bp, Artificial Sequence
  Description of Artificial Sequence: Synthetic coding sequence
tgactggccccaccacccgcactccctcccaagcagaggcagctgtctgagaacgcaagcgaagaggcaggtgaaggggagtatgtcaatttgtattcctctggccagtccagtgaggagctggccccaagccggggagaaccaccagccggtaaggacggccaccctcgagacccaagcgccgtgtccggggtgcccgggaaggactcaagagacggcagcgagcgagcaccaaagtctccggatgccttggaatctgctcaatccgaggaagaagttgatgagttgtccctgatagaccacaatgaaattatgtccagacttaccctgaaacaggagggtgacgacgggcccgatgtgaggggaggatcgggggacattttgcttgttcacgctacagaaaccgacagaaaggatctggttctgtactgtgaggcattcctcacaacctatcgcaccttcatctcccctgaagaattgatcaagaagctgcagtacagatatgaaaagttctcgccctttgcagacacgttcaagaaaagggtttctaagaacacgttcttcgtactggtcagggtggtggacgagctctgcctggtggagctgaccgaggagattttgaaactcctgatggagctggtctttcgcctcgtgtgcaacggagaactgtctctggcaagagtgctgcgcaaaaatattttagataaggtggaccagaaaaaattactacgctgcgcaacctcttctcagcctcttgcagctaggggcgtggccgcccgccccggaactcttcatgatttccactcacatgaaatcgcggaacagttgaccctactggacgcggaattgttctataaaattgaaatacccgaggtcctgctctgggccaaggagcagaacgaggaaaagagtccaaaccttacccaatttacggaacattttaataacatgtcatattag

SEQ ID NO: 17048 - DNA, 687 bp, Artificial Sequence
  Description of Artificial Sequence: Synthetic coding sequence
taactgccagagaaaaagaataaacatatgctcgcctatatgcagctcctggaggattatagcgagccccagcctagcatgttttatcaaacaccccagaacgaacatatctaccagcagaagaacaagcttctgatggaagtgtacggctttagtgatagcttcagcggggtggattcagtgcaagagctggccccgcccccagcgctacctccgaagcagagacagttgcaggcctcctgcgcagctagctcgttctcttccgtaagccactgcgtccagcagaccaaagtagcttttaccccggaggatgggagcgccgcccagggactgtctgttagcgtctcaaatagctttttgtcccggcacggctccctccccgttccttcatacaaaagcgtctttcgaagttacagtcaggattttgtgcctcaccatcaagcgagtgtaccaccgtttctccctcctacctctagcagcagcccacacttccccccagcccaccagtctcagtcgtcagatctcgccgtccccactatggcagggcctccacctagcacagttgatgggcccctgtctgctagtcaggagagctctttccacgggaacaccgtctgcttaccatctgagactagcttcactgatagtgagccacccgccgggaaggacggtcatccaagggactag

SEQ ID NO: 17049 - DNA, 582 bp, Artificial Sequence
  Description of Artificial Sequence: Synthetic coding sequence
atgggcaatgcaattgaaaaacaaaagcctctaaaaagatcccacctctacccttggaaacaggacagtcagagatcccatctcagcagctttactatgaagttgatggacaagtttcatagtcccaagattaagcggaccccttctaagaagggcaagcctgccgaggtgtccgtgaagatcccagagaagccggtgaacaaggaggctactgaccgtttcctcccggaaggctaccctcttcctctggatctcgagcagcaggctgtcgagttcatgtcgacctcagccgtggcatctagaagccagaggcagaaaaatttgagctggctcgaggagaaggagaaagaagtcgtgtctgcactcaggtattttaagaccatagtggataagatggccattgacaaaaaggtgctggaaatgcttcctggctccgcgtctaaggtgctggaggcaatcctgccactagtccagaacgatcctcgcattcagcattcatctgctctgagttcttgctactcacgcgtgtaccaaagcctagcgaacctgattaggtggtctgatcaggtgatgctggagtag

SEQ ID NO: 17050 - DNA, 3072 bp, Artificial Sequence
  Description of Artificial Sequence: Synthetic coding sequence
ttcaagactattgttgataaaatggcgattgacaaaaaggtattggagatgctgcctggtagtgcgagtaaagtcctggaagctatcttaccgctcgtgcagaacgatccccgcatccagcactcaagtgcgctttcctcatgctacagtagagtgtaccagtcgttagccaatctgatccggtggagcgatcaggtgatgcttgagggggtcaactccgaggataaagagatggtgacaaccgtgaagggcgtgattaaggctgttctggacggggtcaaggagcttgttaggctgacaatcgaaaagcagggccggccctcacctactagccccgtgaagcccagcagtccagctagcaagcctgatgggcccgctgaactccccttgacagatagagaggtcgaaatcctgaataagactaccggaatgagccaatccactgagctgttgcctgatgcgaccgatgaggaagtcgctccacctaagccaccgcttccaggcattcgggttgtcgacaatagcccacctccagcccttccccccaagaaacgccagtcagctccaagtcctaccagggtggccgtcgttgcacctatgagtcgcgctacctccggttccagcctgcctgtagggattaaccgccaagactttgacgtcgactgctacgcacaacgcagactcagcggcggatcacactcctacggcggcgagagtccccgcctcagcccctgtagctccattggaaaactgtccaagtcggacgaacagttgtcttccttggatcgtgatagcgggcagtgttcccgcaatacctcgtgcgagacactcgaccattatgacccggattatgagtttctgcagcaggatctctccaacgccgatcagattcctcaacaaacagcctggaacttatcgcccttacccgagtctcttggcgagtccggctcccccttcttagggccaccattccagctgccgttaggcggccatccacagccagacggacccctcgccccaggccagcaaactgatacacctcccgcccttccagagaaaaagaggagatccgctgcgtctcagaccgccgatggttcggggtgccgagtttcatatgagcgccatccttcacaatacgacaatatctcaggcgaggacctgcagagcacggcaccgattcccagcgtgccttatgccccttttgcagcaatcctcccctttcagcacggtggatcatccgcccccgtggagttcgtcggggattttaccgctcctgagtcaaccggagacccagaaaagccccccccactgcccgaaaagaaaaataagcatatgctggcatatatgcagctgctcgaagactattctgaaccacagccctccatgttctaccagactccacagaatgagcacatataccagcagaaaaataagcttctaatggaagtgtatgggttcagtgactccttttcaggcgtggactccgtccaggaactggcaccccccccagctctgccgcccaaacagagacagctcgcctcctgtgcggcctcttcattttcttctgtgagtcactgtgtgcaacagacaaaggtggcatttactccagaggatggaagcgctgcacagggcctcagcgtttccgtttccaatagttttctatccagacatgggtccctgcctgttccttctgagcccccagcaggcaaagatggccaccctagggacccaagcgctgttagcggcgtgccaggaaaagactcccgcgacggatccgagcgagcgccaaaatctccggatgctctcgagagcgcacagtctgaggaggaggtggatgagctcagtctaattgaccacaatgaaataatgtcccgtttgacactgaagcaggaaggcgatgacggaccagacgtgcggggaggttccggagacatcctcttagtccacgctaccgagacggaccgcaaggacctggtgctgtattgtgaagcgttcctgaccacatacaggacattcatttcacccgaggagttgatcaagaagctgcagtataggtatgagaaattttccccgtttgccgacacttttaagaagagggtgagcaagaatacttttttcgtcttggtccgcgtcgttgacgaactttgtctcgttgaacttaccgaggaaatcctgaagttgctgatggagctggtgttccgtttggtgtgcaacggtgagctaagcctggcacgggtcctccggaagaatatcctcgataaagtggaccagaagaaactcttaaggtgtgctacaagctctcaacccctcgcggcccggggcgttgccgcaagaccaggcaccctgcatgatttccattcccacgagattgcagaacaacttaccttgttagatgcggagttattctacaaaattgagattccagaagtgctgttatgggccaaagagcagaatgaagagaaatcacccaacttgactcaatttacagaacatttcaacaatatgtcttactgggtccggagtataatcatgctgcaagaaaaagctcaggatagagagagactgctcctcaagttcattaagattatgaagcatctgaggaagctgaataactttaacagttacctggccatcttgagtgccttagactccgctcctattaggcggctcgagtggcagaagcagacttcagaagggcttgccgagtactgcacacttattgacagcagttctagcttccgagcataccgggcggccctgagtgaagttgagccaccctgtattccttacctggggctcatactacaagacctgaccttcgtgcatctcggcaaccccgactacattgatgggaaggtgaacttctctaaaaggtggcagcagttcaacattttggacagcatgcggtgctttcagcaggcgcactatgacatgcggaggaacgatgacatcatcaacttttttaacgacttctctgaccacctcgctgaagaagccctttgggagctcagcctgaagattaaacctagaaatattactcgccgaaaaaccgatagggaggagaagacatag

SEQ ID NO: 17051 - DNA, 480 bp, Artificial Sequence
  Description of Artificial Sequence: Synthetic coding sequence
atggaagtctatgggttcagcgacagctttagcggagttgatagtgtccaagaactggcacctccaccagccctgcctcccaagcagagacagctgtacaagagcgtgttccgctcatactcccaagacttcgtgccccaccaccaggccagcgtgccccccttcttgccccccacgtcctcgagctccccacacttcccaccagcccaccaatcccagtcatctgatcttgccgtacctaccatggcgggcccccctccaagcaccgtcgacggccctcttagtgcaagccaggagtcaagcttccatggcaataccgtctgtctgccatctgaaaccagtttcacggacagcgagccacccgcagggaaggacggccacccaagagatccatcagcagtgtcaggcgttccaggaaaggatagccgagacggatccgaacgtgcacccaagtctcctgatgccttggagagcgcttag

SEQ ID NO: 17052 - DNA, 696 bp, Artificial Sequence
  Description of Artificial Sequence: Synthetic coding sequence
atggaagtgtatggcttctccgacagcttttccggagtggatagtgtccaggaattagcgcccccccccgccttgccccctaagcaacgccagttacaggctagctgtgccgcaagtagcttcagttccgtcagtcattgcgtccagcagactaaggtcgccttcacccccgaggatggatctgcagctcagggactgtcagttagcgtttctaacagctttttgtctcggcacggatccctgccagtgccttcctataaatctgtctttcggagctacagtcaagattttgtccctcatcatcaagcatctgtgcctccgttcctgccgcctacaagctcttctagcccacattttccacctgctcatcagagtcagtcatcagacctcgctgtgcctaccatggccgggccacctccctccactgtggacggcccactgtcagccagccaggagagctcctttcatgggaatacggtgtgtctgcctagcgagacaagctttaccgacagctcagagaatgctagcgaggaggcaggcgaaggcgagtacgtgaatctgtattcctcaggtcagtccagcgaggagctggcccctagccgcggagagccacccgccggtaaggacggacacccgcgggacccctcagcagtctcaggcgttccaggtaaggactcaagggacggctccgagtag

SEQ ID NO: 17053 - DNA, 477 bp, Artificial Sequence
  Description of Artificial Sequence: Synthetic coding sequence
atgagtggcgggcttggccttagaaggtcacccgagatgagtgggaagattgagaaagcagactcacaaaggtcccatttaagctccttcacaatgaaactgatggacaagtttcattccccgaaaatcaagcggactccaagtaaaaaaggtaagccggcggaggtcagtgtgaagattccagaaaagcccgtcaacaagaacttaagttggctggaagaaaaagagaaggaagtcgtctctgctctcaggtatttcaaaacgatagtagacaagatggcaattgataagaaggttctggaaatgctaccaggttccgcttccaaggtgctcgaagctatactgccgttagtgcagaatgatccaagaattcaacatagctcagcactgagcagttgctacagtagggtgtatcagtcgcttgccaatctgatcagatggagcgatcaagttatgcttgagggcgtcaatagctag

SEQ ID NO: 17054 - DNA, 261 bp, Artificial Sequence
  Description of Artificial Sequence: Synthetic coding sequence
atggaagtctacgggttttcagacagtttttcaggcgtagattctgtacaggagctggcaccaccaccagccctcccgcctaagcaacggcaactggagcccccggctgggaaagacggccacccaagggacccgagcgccgtttctggcgttcccggcaaggactccagggacggaagcgaatccgggatcaccagcgtgtatcggtggaacatccagcgtcagcaaagactgagctatggacatactgcatctcagtag

SEQ ID NO: 17055 - DNA, 7419 bp, Artificial Sequence
  Description of Artificial Sequence: Synthetic coding sequence
atgaccgccagagggcagtcaccgttggctcctctgctggaaaccctggaggatcccagcgcttcacacggtgggcagacggatgcgtaccttacgcttacttctcggatgaccggtgaggaggggaaagaagtgattactgagattgaaaaaaaactaccaagattgtacaaagtgctcaaaacccatatttcttctcagaattcagaactgtccagcgcagccctacaggctctgggcttctgcctgtacaaccctaaaattacttctgaactttccgaggcaaacgcactcgaactgttgagtaaactgaatgacaccattaagaactccgataagaatgtcaggacccgggccctgtgggtcatctcgaagcagacgttcccctcggaggtcgttggcaagatggtcagttccattatagacagtctggaaattctattcaacaaaggagagactcacagtgctgtggtggattttgaagcactgaatgtgatcgtgcggctgattgagcaggcccccattcagatgggcgaagaggccgttaggtgggccaagctggtgatccctctggtggtccattccgctcaaaaggtgcacttacgtggcgctacagctctcgagatggggatgcccctgttgctgcaaaagcagcaggaaattgcatctattacagagcagctgatgacaacaaagttaatctctgagttacagaagctgttcatgagtaaaaacgagacctatgtgctgaagctgtggcctttgttcgtgaaactgctgggacggaccctgcacaggtcaggtagcttcatcaacagtctcttgcagctggaagaattgggcttccggtctggcgctccaatgatcaagaagattgcattcattgcttggaagagcctaattgacaatttcgccctgaaccctgatatcttgtgttctgcaaaacgcttaaagctcctcatgcaacctctctcttcgattcatgttcgcactgaaactcttgctctcaccaaactggaagtttggtggtatctgctgatgaggctgggcccccacctgcccgctaacttcgaacaggtgtgtgtaccactgatccaatccaccatctccattgatagcaatgctagccctcagggtaactcgtgccatgtcgccacatcccctggattgaatcccatgacgcctgtgcacaagggggcttcatccccttacggagccccaggtaccccacggatgaacctatcttccaacttaggtggcatggccaccatacctagcattcaactgttgggactggaaatgcttctacatttccttttaggccccgaagcactctctttcgctaagcagaacaagctcgtgctgtcccttgagcctctggaacatccactaattagtagtccttcctttttttccaaacatgcgaataccctgatcacagccgttcacgattcatttgtcgctgtgggaaaagatgcacctgatgtggtggtgagcgccatctggaaggagcttatatcccttgtcaaaagtgtgacagaatctgggaacaagaaagagaagcctggatccgaagtgctgaccttactgctgaagagcctagaatccatcgttaaatctgaggtcttccctgtgtctaaaaccctggtgttgatggagatcaccatcaagggcctgcctcagaaggtcttggggtcacccgcttaccaagttgctaatatggatattctgaacggcacccctgcattgttcctgatccagctgatcttcaacaattttttagagtgtggggtttccgatgagagattttttcttagcctcgagtctctggtcggatgcgtcctgagcggccccactagtcccctcgcgttctctgactctgtactgaatgttattaaccagaatgcaaagcagcttgagaacaaggagcatctgtggaaaatgtggagcgtgatcgtgacccctctgacggagctgattaatcagaccaacgaggtgaaccaaggagatgcattagagcacaattttagtgctatatacggggcgctgactttaccggtgaatcacatcttttctgagcagagatttcctgttgccactatgaagactctgctgaggacatggagtgaactgtatagggccttcgcccgatgtgccgcgttggtggctacagccgaggagaatctctgctgtgaagaactctcttctaaaataatgtccagtctggaggacgaaggcttcagcaatcttctgttcgtcgacaggattatatatatcattactgtgatggtcgattgcattgatttctctccttataacataaagtaccaaccgaaggtgaagtccccacagcggccatccgactggagcaaaaagaaaaatgaacccttaggcaagctgaccagtctgtttaagttgattgttaaggtgatctactcgttccacaccctctcctttaaggaggctcattcagatactctgttcacaataggcaatagcatcactgggatcatttcctccgtcctgggacacatttccttgccctcgatgattaggaagatctttgcgaccttaacaagaccgctggctctgttttatgaaaactccaaactagacgaagtacccaaagtttacagttgtctcaataacaagctggaaaagctactgggagagatcatcgcttgcctgcagtttagttatacaggaacctatgactccgagcttttagagcagttgtcgccacttctctgcataattttcctgcacaagaacaagcagattcggaaacagtcagcccaattctggaacgccacgttcgcgaaggttatgatgctggtatatcccgaggagctgaagcctgtgttgacacaggccaagcagaagttcctcttgctgcttccaggcctcgagaccgttgagatgatggaagagagttccggcccgtacagtgacggtaccgagaactcccagctaaacgtgaaaattagcggtatggaaagaaagtcaaacggtaagcgcgatagcttccttgcccaaactaagaacaaaaaagagaatatgaagcccgctgcaaagctgaaactcgaatccagctccctgaaggtgaagggcgaaatcctgttggaggaagaaaaaagtaccgatttcgttttcatccctccggagggcaaagacgcaaaggagcgaattcttaccgaccatcaaaaggaggtgctcaagacgaagagatgcgatatccctgcaatgtacaacaatctggacgtgtcccaggacaccctgttcacccaatattctcaagaggaacctatggaaatccccactttgactcgcaagccaaaagaagatagcaaaatgatgattacggaggagcagatggactccgacatcgttatcccccaggacgtgactgaggattgcgggatggccgagcacttggagaagagctcactttctaacaatgagtgcggcagccttgacaaaacttcgccagagatgagcaactccaacaatgacgaacgaaaaaaggcgctcatcagtagtcggaagacaagcacagagtgcgcaagttcaactgagaattctttcgtcgtttcaagtagcagcgtgagtaacacgaccgtggctggcacacccccatacccaacctcaagaaggcagacattcattacactcgaaaagttcgatgggagtgagaaccggcctttcagtccctcaccattaaacaatataagctctaccgttacagtgaaaaacaatcaagagacaatgataaaaacagacttcctgcccaaagccaagcagcgggaaggaacctttagcaagagcgactctgagaagattgttaacgggaccaagcggagctctcggagggctggaaaggcagagcagacaggcaataagaggtccaagcctctgatgcgctcggagcccgaaaaaaacactgaagaaagcgtggagggcattgtagtgctcgagaacaaccctccagggctgctgaatcagactgaatgcgtatcggacaatcaggtccatctgtccgagtcaactatggaacatgacaacaccaagttgaaggctgccaccgtggagaacgccgtgctgctcgagactaacacagtcgaggagaagaacgtggagatcaatctcgagtctaaggagaatacaccaccagtggttatttcagctgaccagatggtgaacgaagacagccaggttcagatcactccgaatcagaaaactctccgccgtagctctaggaggaggagcgaggtggtggaatcgacaacggagtctcaggataaagaaaactcccaccagaaaaaagagcgacgaaaagaagaggagaaaccccttcagaagagccccctgcacattaaagatgatgtactgcccaaacagaaacttatcgctgaacagactcttcaggagaacttgattgagaaggggagcaacttgcatgaaaaaaccctaggcgaaacctccgctaatgcagagactgaacaaaacaaaaagaaagccgaccctgagaacattaaatcagaaggtgacggtacccaggacatagttgacaagagtagcgagaagctggtcaggggtcgcacgcgctatcaaactagacgagcctcccaaggtctactgtcttctatcgaaaattccgaatcagactccagcgaagctaaggaggagggcagccgtaagaagcgctcaggcaagtggaagaacaaatctaatgaaagtgtggacatacaggatcaagaggaaaaggtggtgaagcaggaatgtatcaaagctgagaaccaatcccacgactataaagccacttcagaggaagacgtttccattaagtcccctatctgcgaaaaacaggatgagtcaaacactgtgatatgtcaggattccacagtcacctctgatttgctgcaggtgcctgatgatctccccaatgtgtgcgaagaaaaaaatgaaacttcaaaatatgccgaatatagttttacaagcctgcctgtgcccgagtcaaacctgaggaccagaaatgccatcaaacggcttcataaacgggattccttcgacaactgctcacttggggagtcaagcaaaataggcatctctgacatctctagcctttccgaaaaaacctttcagaccctagaatgtcaacataaacgtagcaggagagtcagacgcagtaaaggttgtgattgttgcggcgagaaatcccagcctcaggagaaatccctgatcggacttaaaaataccgaaaataacgatgttgagattagcgagaccaaaaaggctgatgtgcaagctccggtaagcccaagcgagacttcgcaggccaatccttacagcgaaggacagtttttagacgaacaccattctgtcaatttccacctgggcctcaaggaggataacgacaccattaacgattctctcattgtgtcagaaactaagtcaaaagaaaataccatgcaggaaagcctcccgtcaggcatcgtgaacttccgagaggagatctgcgacatggactcgtcagaagcgatgtcacttgagagtcaagagtctcccaacgagaattttaagacagtaggcccttgccttggggatagcaagaatgtgtctcaggaatctctcgagactaaagaggagaagcctgaggagacccctaagatggagctgtcattggagaacgtcacggtggaaggaaacgcgtgtaaagttacagagagcaacctggagaaggccaaaacaatggaactgaatgtgggaaatgaggcttcattccacggccaggaacgtaccaagacaggcattagcgaagaggccgccatcgaggagaataaacgaaacgatgactctgaggcagacaccgccaagctcaatgccaaagaagtcgccaccgaggaatttaattctgacatctctctttctgacaataccacccccgtgaagctgaatgcacagacagagatatcagagcaaactgccgcaggtgagctggacggcggcaatgacgtctccgacctccactcttccgaagagaccaataccaaaatgaaaaacaatgaagagatgatgatcggagaagctatggctgaaaccggacatgacggggagacggaaaacgaggggatcacgactaagacaagtaagcccgacgaagccgaaacaaatatgcttacggcagaaatggacaattttgtgtgtgatacggtagagatgtctaccgaagaggggattatcgatgccaacaagacggagactaataccgaatacagcaagtccgaagagaagcttgacaacaatcaaatggttatggaaagcgatattttgcaagaggaccatcatacctcccagaaggtcgaggaaccgagccaatgtctggcctctggaacagctatctcggaactgatcatcgaggacaataacgcttctccacaaaaattaagagaactggatccctccctagtctcggccaacgattccccatcaggaatgcaaacgcggtgcgtttggtccccattggctagtccatctacgtcaatcctgaagcgagggctaaagcgaagccaggaggacgaaatttcaagcccggtcaacaaagtgaggcgcgtgtcctttgctgaccccatttaccaggcaggcctggccgatgacatcgatcgcaggtgtagtatcgttcgctcacacagtagcaattcctctcccattggaaagtccgtgaagaccagtccgaccactcaaagtaagcacaatactacatcagcaaaggggtttttaagccccggctctagatctcctaaatttaaatcctctaaaaagtgtctgatctcggagatggccaaggagtccatcccttgtcccaccgaatccgtgtacccccctctggtaaactgcgtagcccctgtagatataattctgcctcaaattaccagcaacatgtgggcacgcggactgggtcagctcatcagagcaaaaaatatcaagaccatcggggatttatccactttgacggccagcgaaatcaagacgctgcccatccggtcacccaaagttagcaacgttaagaaggcccttcggatctaccacgagcagcaggtcaagaccaggggcctcgaggaaattcctgtgttcgatatcagtgagaaaactgtaaatggaatcgagaataagagccttagccccgatgaggaaagacttgtgtcagatatcattgatccagtggctctggaaatacctctctccaaaaatctgctcgcgcagataagcgcactcgccttgcagctggacagcgaggatctccacaactattccggttcccagctcttcgaaatgcacgagaaactgtcctgtatggcaaactccgttattaagaatcttcaaagtaggtggcggagcccttcgcatgagaactcgatttag

SEQ ID NO: 17056 - DNA, 264 bp, Artificial Sequence
  Description of Artificial Sequence: Synthetic coding sequence
atgacggcccgcggccagtcacccctcgcccccctgctagaaactctcgaggacccatccgcctcccacggcggccagacagatgcttatctaaccttgacttcacgaatgactggagaggagggaaaggaggtgatcactgaaatcgagaagaagctgcccaggctgtacaaagtgctgaaaacccacataagctctcagaattccgaactctcttctgcagccttgcaagcgttggggttctgtctttacaatccaaaatag

SEQ ID NO: 17057 - DNA, 7341 bp, Artificial Sequence
  Description of Artificial Sequence: Synthetic coding sequence
atgaccgctcgcggtcagagcccgctcgctccgctgctcgagactctggaagatccctctgcaagccatggagggcaaacggacgcttatctgacattgactagccgcatgactggagaggaggggaaggaagtgataactgagatcgagaaaaagttgccccgactgtataaagtgctgaagactcacatctcttctcaaaactcagaactctccagcgcagcacttcaggccctcggcttctgtttgtataatcccaaaattactagtgagttatccgaggccaacgcattggaactgcttagcaaactcaacgacactatcaagaattccgataaaaacgtaagaacccgggcgttgtgggtaatcagtaaacagacatttccttccgaggtcgtgggcaagatggtgagcagcatcatcgacagtcttgagattttgtttaacaaaggagaaactcacagcgccgtcgtggatttcgaggcgctaaacgttattgtgcgcctcatcgagcaagctcccatacaaatgggggaagaggcagtccgctgggctaagttagttatacctctggtggtgcacagtgctcagaaggttcacctacggggcgcaacagcactggaaatgggcatgcctctcctacttcaaaagcaacaggagattgcctcaattacggagcaactgatgaccaccaagctaatctccgaactccagaagctctttatgagtaaaaacgagacatacgttctcaaattatggcctcttttcgtcaaattgctggggcgcactctgcatagaagcggaagttttattaactccctgttacagctcgaggagctgggctttaggtcaggtgctcctatgatcaagaaaattgctttcatcgcctggaagagcctgatcgacaatttcgcactgaaccctgacatcctctgctcagccaagcgcctgaagctgcttatgcagcccttatccagcatacacgtcaggacagagaccctcgccctgaccaaactggaagtctggtggtacctcctgatgagattgggaccccacctccccgcaaactttgaacaggtctgtgttcctttaattcagtctaccatctcaattgacagtaacgccagccctcagggtaactcttgtcatgtagctacttcaccagggctcaaccctatgacacccgtgcataagggcgctagcagtccatatggggctcccggcactcctcgcatgaacctgagctccaatcttggcggaatggctaccataccttccatccaactcttgggcctggaaatgctgttgcacttcttactgggacccgaagctctgtcgtttgccaaacagaataagctggtgctgagtctcgaacccctggagcaccctctgatcagctctccctccttctttagcaagcacgctaataccctgataacagccgtccacgactcatttgtggcagtcggcaaagacgcgcccgatgtcgtagtgtctgccatctggaaggaactcatttctctcgtaaaatcggtgaccgaatcaggcaataagaaagaaaagcccggctctgaggtgctcactctgctcctgaagagcctcgagtccattgttaaatcagaagtcttcccagtgtcaaaaaccctggtcctgatggagattacgatcaaaggcctcccgcaaaaagttctcgggtccccagcctaccaggtggcgaatatggacatcctgaacggtaccccggctctgttcctcatccagttgatctttaataattttctggagtgcggggtgtcagacgagcgcttcttcctgtctctggaaagcctcgtggggtgcgtcctctccggaccaacaagtcctctcgccttctctgactccgttctgaacgtaattaaccagaatgccaagcagctggaaaataaggaacatctgtggaaaatgtggtcggtgatagtcacacctttgacagaactgatcaatcagaccaacgaagtaaaccaaggggacgcattagaacacaacttctctgcaatttacggagctttgacacttcccgtcaaccacattttttcagagcagcgctttccggtagctacgatgaaaacactcctaagaacttggagcgagctgtaccgcgcttttgcacggtgcgccgcgcttgtcgcgactgctgaggaaaacctctgctgtgaggaactaagcagtaagattatgtcgtcgttggaagacgagggatttagtaacttgctctttgtggatcggatcatttatatcatcacggtcatggtcgattgcatcgacttctccccttataatatcaaataccaacctaaagtcaagagtccccaaaggccgagtgactggagtaagaaaaagaatgagccattgggcaaactgacatcactcttcaaactgattgtcaaggtgatctacagctttcatacgctgagttttaaagaagcacacagcgataccctgtttaccataggtaattctattacaggaataataagcagcgtcctgggacacatatctcttccgagcatgattaggaagatctttgcaacgcttacgcggccgctggcactcttctacgaaaattccaaacttgacgaagttccaaaggtgtacagctgtttaaacaataaactcgaaaaactgttgggggagattattgcttgtctccagttcagctatacaggaacctacgattcagagctactggaacagctttcccccctgttgtgcataattttcctccataaaaataagcagataaggaaacagagcgcccaattctggaatgctacctttgcaaaggttatgatgctcgtgtacccagaggagctgaagcccgtattgacgcaggctaaacagaagttcctgctattactacccgggttggaaacagtcgaaatgatggaggagtctagcggaccttatagcgacggaacggagaatagccagttgaatgttaaaatctcaggaatggagaggaaatcaaacggaaagagagatagctttttggcccaaacaaagaataaaaaggagaacatgaaacccgccgctaagctgaaacttgagagtagcagtctaaaggtgaagggcgaaatcctgcttgaggaggagaagagcaccgacttcgtgttcatcccacccgaaggcaaggatgctaaggagcgcatactgaccgatcatcaaaaggaggtcctgaagacaaagcgatgcgatattcccgctatgtacaataacctggacgtatctcaggacacactgtttacacagtatagtcaggaagaaccaatggaaattcccactctgacaagaaaaccgaaggaagactccaaaatgatgatcacggaggaacaaatggatagtgatattgtgattccacaagacgttacggaagactgtggcatggcggagcatctggaaaagtcatcgttgtccaacaatgagtgcggcagtctggataaaacctctccggaaatgtctaactccaacaacgacgagagaaagaaggcgcttatctcttctaggaagacctctactgaatgtgcatcctctacggaaaattcctttgtggtgtcgtcatctagtgtgtccaacactaccgtggctggcacccctccctatcctacctcacgccggcaaacttttattactcttgagaagtttgatgggagcgagaacagacctttcagcccaagccccctgaataatatcagctctacagtcactgtaaaaaacaatcaggaaaccatgattaaaaccgactttttacctaaagcaaaacaacgagagggaaccttttctaagtccgattctgaaaaaattgtgaacggtaccaagcggagctctaggcgagcaggtaaagcggaacagactgggaataaaagatccaagcctctgatgcgatccgaaccggagaagaatacagaggagtctgtggagggcatcgtcgtgctggaaaacaatccgcctggtttgctgaatcagacagaatgcgtgtccgacaaccaggttcacttgtctgagtcgacaatggaacatgacaacaccaagttaaaggcggcaaccgtggaaaatgccgtcttactcgagacaaatactgtcgaagaaaagaatgtggaaatcaacctggagtctaaggagaacacacccccagtcgtcatcagtgccgaccagatggtgaacgaagacagtcaggttcagattactccaaatcagaaaactcttagaagatcctctcggaggcgctccgaggtggtggaaagcacgacagagtcccaggacaaggaaaactcccaccagaagaaagagcgtaggaaggaggaggagaagcccctgcagaaaagccctctgcacattaaagacgatgtgttgccaaagcagaaactgattgcagaacagactctgcaggagaaccttatcgaaaaaggatccaacttacatgagaagactctcggggagacctccgccaatgctgaaacggaacagaataaaaaaaaagctgatcccgagaacatcaaatcggagggtgatgggactcaagatatagtggacaagtcaagcgaaaaacttgtgcgaggtcgaaccaggtatcaaacacgcagggcgagccagggtttattgtcgagtattgagaatagtgaaagtgattcgagcgaggccaaggaagagggaagcagaaagaaacgctcagggaagtggaaaaataagagtaacgaaagtgtggacattcaggatcaggaggagaaagttgtcaagcaagagtgtattaaggctgagaaccagtcacacgactacaaagccacttcggaggaggatgtgagtatcaagtcccccatctgtgaaaaacaagacgaatccaacactgtgatatgccaggacagcaccgttactagcgatctgctgcaggtgccagacgatctgcccaatgtgtgtgaggagaaaaacgagaccagcaagtacgccgaatatagttttacttcactgcccgttcccgagtccaatctgcgcaccagaaatgccatcaaacgactgcacaagcgagattcatttgacaattgcagtctcggcgagtcaagcaaaataggcatttcagacatttcctccctgagtgagaagacattccaaacattagagtgccaacacaaacgctctaggagagtgcggagatccaaggggtgtgactgctgtggtgaaaaaagccagcctcaggagaagagcctaattggcctcaagaacactgaaaataacgacgtggaaatttctgagacaaagaaagccgatgttcaggcccctgtatcaccctcagagacttcacaggccaatccgtacagtgaaggccagtttttggacgagcatcacagcgtgaacttccacctgggtttaaaggaggacaacgataccatcaatgattcactgatcgtgtcagaaactaaaagcaaggagaatactatgcaggaatctctcccctccgggattgtgaactttagagaagagatttgtgacatggactcttcagaggctatgagcctggagagccaggagagtccaaatgagaacttcaagacagtagggccatgcctaggtgatagcaagaatgtgtcccaagagagcctggaaactaaggaagaaaagccagaggaaaccccaaagatggagctgtcattagaaaatgtgacggtggaagggaatgcgtgcaaggtaaccgaatctaacttagaaaaagccaagacgatggagctgaatgtcggaaacgaggcttcattccatggtcaagaacgcactaagacaggaatcagtgaagaagccgcaattgaagaaaacaagaggaacgatgattccgaagccgatacagctaaactgaacgcgaaagaggtggccaccgaggagtttaacagcgatatctctctgagcgacaacactactcccgtgaaattaaacgctcagaccgagattagtgaacagacagcagctggcgagctggatggcgggaacgatgtgtctgatctacactcctctgaagagacaaacacaaagatgaagaataatgaagagatgatgatcggggaagcgatggccgagacaggtcatgatggcgagacagaaaacgaggggattacaaccaagacaagcaaacccgatgaggctgaaacaaatatgctcacggcagagatggacaactttgtgtgcgacactgttgagatgtctaccgaggaaggcattatcgatgcaaacaagacagaaacaaataccgagtattcgaagtccgaagaaaagctggataacaaccagatggtgatggagtccgatatactgcaggaagaccatcacacttcccagaaagtcgaggagccatcacagtgtctagcgagtggcactgcaatttctgagctcatcatcgaggacaacaacgccagtccccaaaaattacgggaactcgacccatctctggtaagtgccaatgacagcccttcaggcatgcagacccgttgcgtctggtctccactcgcaagtccctcaactagcattctgaagcgcgggctcaagcgatcccaagaggatgagatttccagtcccgtcaataaagtgcgacgtgtgtcttttgcagacccaatctatcaagcgggtctggctgacgatattgaccgaagatgtagcatcgtaaggagtcattccagtaacagtagtccaatcggcaaatctgttaagaccagccctactacacagtcaaagatatccgagatggcaaaggagtcaatcccttgtcctaccgagtcggtttaccccccactggtgaactgtgtcgcccctgttgacataattctgcctcagatcactagcaacatgtgggccagggggctggggcaactgatacgcgcaaagaatatcaaaaccatcggagatctgtccaccctcaccgcgtctgaaataaagaccctgccaatccggtcgccaaaggtctctaatgtgaaaaaggcattgcgcatatatcacgagcaacaggtcaagacccgagggcttgaagagattcctgtatttgatatctcagagaagacagtgaatggcatcgaaaataaatctttgagtccggatgaagaacgactcgtgagcgatatcatcgaccctgtggccctggaaatcccgctgtccaagaatttgttggcccaaatctccgccttggccctgcaattagattccgaggaccttcacaactattcagggagccagctctttgagatgcacgagaagctgagttgtatggctaacagcgtcattaagaatctccagtctaggtggcgttctccgagccacgagaacagcatctag

SEQ ID NO: 17058 - DNA, 7341 bp, Artificial Sequence
  Description of Artificial Sequence: Synthetic coding sequence
atgaccgcaagagggcaaagcccattggctcccctgctggaaactctggaagatccctcagcatctcacgggggccagaccgatgcttacctgacgctgacatcgaggatgactggagaggaaggtaaagaggtcattactgaaatcgagaagaagctcccacgcctttacaaggttcttaagacccatatctcctctcagaactctgaactatcttccgccgctctgcaggctctgggcttttgcctatacaacccaaaaattaccagcgaactgtctgaagccaacgcgttggagcttttgtccaagctgaacgacacaatcaagaactcagataaaaacgtgaggaccagagccctgtgggttattagtaaacagaccttcccatcagaggtggtgggcaagatggtcagtagcatcattgactctctggagattctgttcaacaaaggtgaaacgcattcagctgtggtggacttcgaggccctgaacgtgatcgtgcggcttattgaacaggccccaatccagatgggagaagaagccgtcaggtgggctaagctcgttatcccactggtggtccattcagcgcagaaagtccacctgcggggagctacggctctcgaaatgggtatgccgctgctgctgcaaaagcagcaggaaattgcctcgatcactgagcagctgatgacaacaaaattgatctccgagctccagaagctattcatgagcaagaatgaaacttacgttctgaaactgtggcctctgtttgtgaaattgcttggtagaacgctgcaccgttccggatcattcatcaactctctgctgcaactcgaagaattggggtttcgtagtggcgctccgatgatcaagaagatcgcatttatagcatggaaaagtttgatagacaattttgccctcaatcccgatatcctgtgtagcgcaaaaagactcaagctgttgatgcagcctctgtcatccattcacgtgcgcacagagactctagccctgacaaagctcgaggtatggtggtatctactcatgaggttggggcctcacctccccgccaatttcgagcaagtatgcgtacctctgatccagagtacaatctctatcgacagcaatgcctcccctcaggggaactcatgtcacgtagccacctctcctggactgaacccaatgactcctgtacataagggtgcttcctcgccctatggcgctccaggaactccgagaatgaatctgtcctccaatttgggcggtatggccactatccccagcattcagctccttggactggagatgctcctgcactttctacttggtcccgaggccctctcattcgcaaaacagaacaagcttgttctgtctctggagccactggagcaccccctaattagctctccgtctttcttttccaagcacgccaatactctcatcacagctgtgcacgatagcttcgtggcggttgggaaggacgcacctgatgtggtcgtgtccgcaatatggaaagaattgataagccttgttaagagtgtgaccgaatcaggcaataaaaaagagaagccgggctcagaagtgttgacactgcttctgaagtctttagagtcaatcgtgaaatccgaagtgttcccagtcagcaagacacttgttcttatggaaatcacaatcaagggcttaccccagaaggtgctcggctcacctgcataccaggtggctaatatggatattctcaatggcacccctgcacttttcctgatccagctgatctttaataacttcctggagtgtggagtgtcagatgaaagatttttcctgtccctagagtctctggtgggctgtgtactgtccggccctacgtcacctcttgctttcagcgattcagtcttgaatgtcatcaatcaaaacgccaagcaactcgaaaataaggaacacctgtggaaaatgtggtccgtcattgtcacccccttaaccgaactcatcaatcagaccaatgaagtaaaccagggcgacgcgctagaacataatttttcagccatctatggagctctgacccttccggtgaaccatatattcagtgaacagcgttttcccgtagccacaatgaagactctgctgcgcacctggagcgagctctatagagcttttgcgcgctgcgcagctctggtagctaccgccgaggagaatttatgctgcgaggagctcagctcaaagattatgtcaagtcttgaggacgaaggattttctaatcttctgtttgtagatcgcatcatctacattatcacggtgatggtcgattgtattgacttctccccatacaatatcaaataccagccaaaagtaaagtctccccagcggccaagtgactggtcaaaaaagaaaaacgagccacttggaaagctcacctccttgtttaaactcattgtgaaggttatatactcctttcatacccttagttttaaggaagcccactccgataccctgttcactataggcaactctattaccggcattatttcgagcgtgttaggtcacatttctcttccatccatgatccggaagatattcgctaccctgacacgacccctggctctcttttacgagaactcaaagctggatgaggttccgaaggtgtactcctgccttaacaataagctggagaaacttctgggtgaaattatcgcgtgcctccagttctcatacactggaacgtatgattccgaactccttgagcaacttagccccttgctctgtattatcttcttacataagaataagcagataaggaaacaatcggcccaattttggaatgccacttttgccaaagtaatgatgttggtctaccctgaggagctgaaaccagttttgacccaagccaaacaaaagttcctgctgttgcttccaggcctggaaaccgtagaaatgatggaagaatccagcggcccgtactcagacggcacagaaaattctcagcttaatgtcaaaattagtgggatggaaagaaaatccaatggcaaaagggacagctttctggcacagaccaagaataagaaagagaatatgaaacctgctgcaaaacttaaactggaatcctcatccctgaaggtgaagggcgagatcttattagaggaagaaaagagcaccgatttcgtgttcatcccgccagaggggaaagacgcgaaggagagaattctcactgaccatcagaaggaggtgcttaagactaaacgctgtgacatccctgcaatgtataacaacctagatgtttctcaagacaccctgttcacccagtactcacaagaagagcccatggaaatccccacactgaccagaaaaccaaaggaagactctaaaatgatgattactgaggagcagatggactccgacatcgtgatcccccaggacgtgaccgaggactgtggcatggccgaacacctggaaaaatcttcgctgagcaacaacgaatgtggatcgctcgacaaaacctctcccgagatgtctaacagcaacaatgatgagaggaagaaggcccttatctcatctcgcaaaactagtactgaatgcgctagcagcacggagaattcattcgtggtaagttcttcgagcgtgagcaataccaccgttgcaggaacccccccctatcctacctctcgtagacagacgttcattacgcttgaaaagtttgatggctctgaaaataggccatttagcccctctccacttaataacatctcatccaccgtcacggtaaagaacaatcaggagaccatgataaagacagattttctgcccaaagccaaacagcgagaagggacgttttcaaaatccgatagtgagaagattgtgaatgggaccaagagaagtagccgccgcgctgggaaggcggaacagaccggaaataaacgatcaaaaccactcatgaggtcagagccggagaagaacactgaagagtccgtagagggcattgttgtgctggaaaataatcctcccggtctgcttaaccagacagaatgcgtgagcgacaatcaggtgcatttgagtgaaagtacaatggaacacgacaacaccaagttaaaagccgctacggtggagaatgcagtgctcctagagactaacaccgtcgaggagaagaacgtcgaaataaaccttgaatccaaagagaacaccccaccagtggtgatcagtgctgaccaaatggtcaacgaagactctcaggtacagatcacacccaatcagaaaaccctgaggcgctcctccaggaggagaagcgaagtcgtagagtccactacagagtctcaagataaggaaaattcccaccaaaaaaaggagcggcggaaagaggaggaaaaacctctgcagaagtctccgctccatattaaggacgatgtcttgcctaagcaaaagctgatcgcagaacaaacgctgcaggagaatctgatcgagaaaggcagcaacctccatgagaagacattgggcgaaacctccgccaatgctgaaactgagcaaaataagaaaaaagccgatcctgaaaatattaaatcagagggagacggtacgcaggacattgtagataaatctagcgaaaagctcgttcgagggaggacccggtaccagacccggagagcatctcaggggctgctgtccagtatcgagaatagcgagagcgacagctcggaagccaaagaagagggctctaggaagaagcgatcagggaagtggaagaataaatccaacgagagcgtggatattcaggatcaggaggaaaaggtagttaaacaagagtgtattaaagctgaaaatcagtctcatgactacaaagccacctcagaagaagatgtgtcgatcaaatcacctatatgtgaaaagcaggacgagagcaacactgttatttgtcaggattctactgtaacttcggacctgctgcaggtccccgatgacctgcctaacgtgtgcgaggagaagaacgagacctcgaagtacgccgaatactccttcactagccttccagtgccagagtctaacctccgcactcgcaatgccattaaacgtttgcacaagagagacagtttcgacaactgttccctgggcgagagctccaagattggtatctccgatatcagctccttgtccgaaaaaactttccagactctcgaatgtcagcacaagcggagcagaagggttaggcgctctaagggctgcgactgctgtggtgagaaatctcaacctcaagagaaatctcttattgggctgaagaacaccgagaacaatgatgtggaaatatctgagaccaagaaagccgatgtccaagcacccgtgtcgccatctgaaacgtctcaggctaacccatatagtgaaggtcagtttctggatgagcaccattcagtaaacttccacctgggactgaaggaggataatgatactattaatgatagtctcattgtctcagagacaaagtccaaagagaataccatgcaggaatccttgcccagtgggatagtgaactttcgagaggagatttgcgatatggacagctcggaagctatgagcctcgagtcgcaggaatcccccaacgagaatttcaagactgtgggcccttgtttaggtgactccaaaaatgtatcacaggagtctttggagaccaaggaggaaaagccagaggaaacccccaagatggagctgtccttggagaatgtgacagtggaaggtaatgcatgcaaagtgactgagtccaatctggaaaaggcaaagactatggagctgaacgtgggaaacgaggcctccttccacgggcaggagaggactaagactgggattagtgaagaggcggctatcgaggagaataaacgcaacgatgatagcgaggccgacaccgcaaagttgaacgctaaagaggtggccaccgaggaatttaactccgacatcagtctgtccgataacaccaccccagtgaagctcaacgcacagaccgagatctcagaacagacagccgcaggcgagttggacgggggcaacgatgtttcagatctgcatagtagcgaagagaccaataccaagatgaaaaacaacgaggaaatgatgattggggaggccatggcagaaacaggccacgatggtgagacagaaaacgaaggaatcactaccaagacgtcaaagcccgacgaggccgaaacaaacatgctgaccgcggagatggacaatttcgtttgtgataccgtggaaatgagtacagaagagggcattatagacgcaaacaagaccgagacaaacacggaatactctaaatccgaagaaaagctcgataacaaccagatggtcatggaaagcgacatcctgcaagaggaccaccacacttcgcagaaggttgaggaacccagccagtgcttagcgagcggaactgccatatcagagcttattatcgaagacaacaatgctagtcctcaaaaattgagagagctggatccatcgctcgtctcggcgaacgactcccctagtggaatgcagacgcggtgcgtgtggagtccactggctagtcctagtaccagtatcctgaaacggggacttaaaagaagccaagaagatgaaatcagctcccccgtcaataaggtgaggcgagtgtcattcgccgaccccatctatcaagctggcctcgctgacgatatcgatcgtcggtgttctatcgttcgctcccattccagtaattcatcgcctatagggaagtccgtgaaaaccagcccaaccacacagtcgaagatctccgagatggcaaaagagtcaatcccctgtccgaccgaaagcgtttacccccctcttgtgaactgtgtggctcctgtcgacatcattcttccgcagattacaagtaatatgtgggccagaggtctgggccagctgattagagccaaaaacattaaaacaattggggatctgtccactttaaccgcatccgaaattaagactctgcctatccgctcccctaaagtcagcaatgtcaagaaggcacttcgtatctaccacgaacagcaggtaaaaacgaggggcctagaggagattcctgtattcgacatttccgaaaagacagtcaacggcatcgaaaacaagagtctttcccccgatgaagagcgcctggtctccgacataatcgaccccgtcgccctggaaatcccattgagtaagaatcttttggcgcagatatccgccttggccttgcagcttgactcagaggatctccacaactattcaggatctcagttgtttgaaatgcatgagaagctgagctgcatggccaatagtgttatcaaaaacttgcagagcagatggaggagcccatcccacgaaaatagcatctag

SEQ ID NO: 17059 - DNA, 1026 bp, Artificial Sequence
  Description of Artificial Sequence: Synthetic coding sequence
atgactgctcgtggacagagcccactggcccctctgctcgaaacactcgaagatccaagtgccagccatggagggcagactgacgcctacctcactcttacttctcggatgacaggggaggagggtaaggaggtaataactgaaatagagaagaagctccctcgcctgtacaaagttctgaaaactcacatttcttcccaaaattcggaactgagcagcgccgcgttacaggcgctaggattctgtttatacaaccctaagattacatcagagctgtcagaagccaacgcgcttgagctccttagcaagcttaatgatacaatcaagaatagcgataagaacgtcaggactagagccctgtgggtgatttccaagcagaccttcccgtccgaggtggtgggaaaaatggtctccagcatcattgattccctggagatcctgtttaataagggggagactcattctgccgtcgtggacttcgaagccctaaatgtgatcgtcagacttatcgagcaggcccctatccaaatgggggaggaggcagttcggtgggctaagcttgtgatcccccttgtcgtccatagtgctcagaaggtacacttgaggggggctacagctctggagatggggatgcccctgctgctgcaaaaacagcaggaaattgcgagcataacagaacaattgatgaccaccaccctccatcggtccgggagttttatcaattcacttctgcagctagaggagcttggattccgcagtggcgctcccatgattaagaaaattgcattcatcgcttggaagagcctcatcgataattttgccctcaatcccgacatactatgtagcgcaaaaaggcttaagcttctaatgcagcccctttcatccattcatgtaaggacggagacccttgcgttaactaagctagaggtctggtggtacctgctgatgcgcctgggcccccatctcccggcaaactttgagcaggtcctgccgccacggaccgaacctcgagaactaccagagtag

SEQ ID NO: 17060 - DNA, 7419 bp, Artificial Sequence
  Description of Artificial Sequence: Synthetic coding sequence
atgaccgccagggggcagagtccactagcgccattgctcgagaccctggaagacccctcggcttcccatggcggccagacggatgcctatctgaccctaacttcccggatgacaggagaagagggaaaagaggttattaccgagattgaaaagaagctccccaggctgtataaggtgctgaagacacacatcagttcacaaaactcagagctgtcaagcgcagcactacaggctctgggcttctgtttgtataatcccaagattacctccgaattgagcgaagctaatgccctcgagcttttatccaaactgaatgacacaatcaagaatagtgataaaaacgttcgcacgcgcgcgttgtgggtgatatctaaacagacattccctagtgaagtggtgggcaaaatggtcagttccatcattgactctctggagatcctgttcaacaaaggagaaacccacagcgcggtagtggattttgaagcgcttaatgtcatagtgagattgattgaacaggcccctatccagatgggtgaggaagctgtgcgatgggccaaactcgtgatccccttggtcgttcactccgcccagaaggtgcacctacggggcgccacggccctcgagatgggcatgcctctgctgcttcagaagcagcaggagatcgcaagcataactgaacagctgatgactacaaaattgatttcagaactccagaagctcttcatgagcaaaaatgagacctacgtactgaaactgtggcccctgttcgtgaagctgctgggccgaactctgcataggagtgggagcttcatcaactcactgctgcagctggaggagctcgggtttcggtctggcgcgcccatgattaagaaaatcgctttcatcgcgtggaaatctctgattgataacttcgctttgaatcctgatattctttgttcagcaaagcgcctgaagctcctcatgcaacctctatcctctatccacgtccgaacagaaactctcgcactcaccaagctggaggtgtggtggtaccttctgatgcgactgggccctcacctgccagcaaatttcgaacaggtgtgtgtccctcttattcaaagtacaatttcgatagactcgaacgccagtccacaaggcaactcatgccatgtggccacatcgcccggcctcaaccccatgacccccgttcataaaggcgcctcaagtccgtacggcgcaccgggcacacctcggatgaatttatcctcaaatctcgggggcatggcaacaataccaagtatccagctcctgggccttgaaatgctgctgcatttcctgttaggccctgaggcactgagctttgccaagcagaacaagctagtactttcccttgagccgctagaacatccgctgattagttccccttctttctttagcaagcacgccaatacccttatcaccgctgtgcatgatagctttgtagccgttgggaaggacgctccagatgtggtcgtctccgcaatctggaaggagctaatcagtctcgtgaaaagcgtcactgagtccggaaacaaaaaggagaaacctggcagtgaagtgcttaccttgctgctcaaatctcttgaaagcatcgtgaaatccgaggtgttccctgtgagcaagacgctcgtactcatggagattaccatcaaggggctcccccagaaagttcttggatcgccggcttatcaggtagccaacatggacattctcaacggtaccccagccttgttcctgatacagctgatcttcaacaactttctcgaatgcggagtgtccgacgaaagattttttcttagtctggagagtctcgtcggctgtgtgctgtcaggcccgacctctcccctggcgttcagtgactccgtgctgaacgtcattaatcagaacgctaagcaattagaaaacaaggagcacctatggaaaatgtggtccgttattgtgacgcctctgactgagttgatcaatcagaccaacgaagtcaaccagggtgacgcactcgaacataatttcagtgccatttatggagctctgacactgcccgttaaccacatcttctcagaacagaggttccctgtcgcaactatgaaaacgttgctgagaacttggagtgaactctatcgggcttttgctcgatgcgccgctctagttgccactgcagaggagaacctctgttgcgaggaactatcctccaagataatgagctcgctggaggacgagggcttctctaatttactttttgtggatagaatcatctatattatcaccgtaatggtcgactgtatagactttagcccgtacaacatcaaataccagcctaaagtcaaaagcccgcaacgtccctccgattggagcaaaaagaaaaacgagccgctcggaaagctgaccagcctgttcaagctgattgtgaaggtcatatactcctttcacaccctaagtttcaaagaggctcacagcgatacgctgttcactatcgggaatagcattacaggcatcatttcaagcgttctaggtcatatctcattaccatcaatgattcggaaaatcttcgcaactctgactcggccactggcactattttacgagaatagcaaacttgacgaggtaccaaaagtttactcctgcttgaacaataagcttgagaagctgctgggtgaaattattgcatgccttcaattttcatacaccgggacatacgactccgagctgcttgaacagctgtcccctttgttatgcataatcttcttgcataaaaacaagcagataaggaagcagagcgcccagttttggaacgcaacttttgccaaagtgatgatgctggtttatccagaggaactaaaacccgtactgacccaagccaagcagaagtttttgctgttgctgcctggtctggaaaccgtggagatgatggaggagtcgtcgggaccttattcggacgggacagagaactcccaactcaacgtgaagatttccgggatggagcgtaaatccaacggtaagagagactccttccttgctcagactaagaataagaaagaaaacatgaagcctgccgcaaagttgaagctggaatcttccagcctgaaagtcaaaggtgagatcttgctcgaggaagagaagagcacagatttcgtgttcatccccccagagggcaaggacgccaaggagcgcatcttgaccgaccaccagaaagaggtgctgaagaccaagcgatgcgatatccctgccatgtataacaaccttgacgttagccaggacacgctattcacccagtattcccaggaggagcccatggagataccaacgctcacgaggaagcctaaagaagacagcaaaatgatgattacggaggaacagatggattcggacattgttatccctcaggatgtaactgaagattgcggaatggctgaacatctggagaaaagcagcttgagtaacaacgagtgtggctctctcgacaaaacgagccctgaaatgtctaacagtaacaacgacgagcgaaagaaggcccttatctccagcaggaaaacatccaccgaatgtgccagttcgacggaaaactcttttgtggtgtcttcctccagcgtaagcaacactaccgttgccggaacacctccttatcccacgtccagacggcagacattcatcactttagagaaattcgacgggtctgagaaccgcccatttagcccgtctcccctgaacaatatctcaagtaccgtcaccgtgaaaaataaccaggaaactatgatcaaaactgatttcttacccaaggccaagcagagagagggaacgttctccaagtctgatagcgagaagattgtcaatggaactaagaggtcttcacggcgggcagggaaagcagagcagactgggaataagcgtagcaaacccctcatgcggtccgaacccgaaaagaatactgaagagtcagtggagggcatcgttgtcctagagaataatccgccgggcctccttaaccagactgagtgcgtgtccgacaaccaggtgcatctgtcggagagcactatggaacatgataacaccaagcttaaagcagctaccgttgaaaacgccgtcctgctcgagactaatacggtggaagagaaaaatgtggaaatcaatctagaatctaaggaaaacactccaccggtagtcatcagcgcggaccagatggtaaacgaagacagtcaagttcaaatcactccaaaccagaagacactccggaggtcgtccagacgtcgctccgaggtagtggagtccaccacagaatcgcaggacaaagagaatagccaccagaaaaaggagcgtcggaaagaagaagaaaaacccctgcagaaaagtccacttcatataaaagacgatgttttgcctaagcagaagctgattgctgaacagactctacaggagaatttaatcgagaaggggtcgaaccttcacgaaaagacacttggcgagacgagtgctaatgccgagacagagcagaacaagaagaaggcggatccagagaatataaagagcgagggggatggcacacaggacatcgtagacaagagtagtgaaaagttagtgagggggcggacccgataccagacccggcgggcctctcagggactgctgagctctatcgagaattctgaatccgactctagcgaggccaaggaggaaggctcccggaagaagagatctgggaagtggaaaaacaagtcaaatgagagtgtggatatccaagaccaggaggagaaggtcgtgaagcaggaatgtatcaaggcggaaaatcagagccacgactacaaagctactagcgaagaagatgtgtcaattaagtcgccaatctgtgagaaacaggacgaatcaaacacggtgatctgccaagattcaaccgttaccagcgacctcctgcaggtgcccgacgatttaccaaatgtatgcgaagagaaaaacgaaacttctaaatatgccgagtattcattcacatcactccccgtgccggagtcaaaccttcggacccggaacgctataaagcggctgcataagagagatagttttgataattgctcacttggcgaaagttctaaaatcgggatctccgatatttctagtctgagcgagaaaaccttccaaaccctggaatgccagcacaagaggtcccggagagtgcgccggagcaagggctgcgattgttgcggtgagaaatcccagccacaggaaaaatcactcatcggcctgaagaacaccgagaacaacgacgtcgaaatctcagagactaaaaaagctgacgtgcaggctccggtatcgccaagcgagacttcccaggccaatccgtatagcgaaggtcagttcctggacgagcaccactctgtaaattttcacctcggcctcaaggaggacaacgatacaattaatgattctctgattgtctccgaaactaagtcaaaagaaaacactatgcaggagtccctgccctctggtattgtaaatttcagggaagagatctgcgatatggactcatcagaggccatgagcctcgaaagtcaggaatcgcctaatgaaaattttaaaactgtagggccttgcctaggggattctaaaaatgtaagccaggagagcctcgaaactaaggaagagaagcccgaggaaactccaaaaatggagctcagcttggaaaacgtgaccgtggaaggcaatgcttgtaaggtcaccgaatccaaccttgaaaaggccaagactatggaattgaatgtgggcaacgaggcctcattccacggccaggaacgtaccaaaaccggaattagcgaggaagcagctattgaggagaataaacgtaacgacgactccgaagccgacactgctaaactgaatgctaaggaggtggcgacggaggaatttaactctgacatcagcctgtctgataacaccactcccgtaaaactgaacgcacagaccgagatctctgagcagacggcagcaggagaattagacggagggaacgacgtgagcgacctgcacagctccgaggaaaccaacaccaaaatgaagaataatgaggaaatgatgataggagaagcaatggcagaaacaggacatgacggtgagacagaaaatgagggcatcactacaaagacaagtaagccagatgaggccgaaacaaacatgctgactgctgagatggataactttgtctgtgataccgtggaaatgagcactgaggagggcatcattgacgccaacaagacggaaactaacaccgagtacagtaaatccgaggaaaagctggacaacaaccagatggtcatggagtccgatatcctgcaagaagaccaccacacctcgcaaaaggtagaggaaccttcacagtgtctggcgtctggaacagccatctccgaactgataatcgaggacaacaacgcgtctccacagaagcttcgggagctggaccccagtctggttagcgccaatgactcaccatccggtatgcagaccagatgcgtttggagtccactggcctctccctccaccagcatcctgaagaggggcctgaagaggtcccaggaagacgaaatctcctcacctgtgaacaaagttaggagggtctctttcgctgaccctatctatcaggcaggtctagctgatgacatagaccgccgatgttccattgttcgctctcactccagcaactcctcaccaattggcaaatcagtgaaaacatcgcctactacacaaagcaaacataacaccacctcagctaaaggtttcttgtctcccggaagccggagccctaagttcaagagtagcaagaagtgtcttattagcgaaatggctaaggagtccattccatgtcctaccgagtctgtgtatcctcccttagtcaactgtgttgctcccgtcgatattatcttacctcagatcacctccaacatgtgggcaagggggttaggccagttgatccgggcgaaaaatataaagacaattggtgaccttagcacgttaacagccagcgagattaagacattaccaattaggagcccgaaggtgtccaacgtcaagaaggcactgcggatatatcacgagcaacaggtgaaaacgcgaggcctggaggaaattcccgtattcgacatcagcgagaagacagtgaacgggattgagaacaaaagcctttccccggacgaggagcggctggtctctgacatcattgatcccgtggccctggaaatcccactgtccaagaatctattagcacagataagcgcactggctcttcaattggactcagaggatctccataactactctggaagtcagctgtttgaaatgcacgaaaagctttcttgtatggctaacagtgtgattaaaaatctgcagtctcggtggcggagcccatcacatgaaaattctatctag

SEQ ID NO: 17061 - DNA, 7341 bp, Artificial Sequence
  Description of Artificial Sequence: Synthetic coding sequence
atgacggcgcgcggtcagagcccattggccccacttttggagaccctcgaagacccgagcgcttcccatggcggacagaccgatgcctatctcaccctgacatcccgtatgacgggagaggaaggcaaggaagtgatcacggaaattgagaagaaattacctcgactatacaaggtgcttaagactcatatttctagtcagaactcagagctgtctagtgcagccttgcaagccctcgggttctgtctctataatcccaagatcaccagcgaactatccgaggctaatgcactagaactgttgtccaagctcaatgataccatcaagaacagcgataagaatgtccggacgcgggccctctgggtcatttcaaagcagacctttccctcagaagtagtcggaaaaatggtatcaagtatcatagattcactggagatactcttcaataaaggcgaaacccattccgccgtggtagattttgaggccttgaacgtgatcgttaggcttatagagcaggcacccattcagatgggcgaagaagcagttcgctgggccaaactggtgattccgctggtggtgcacagcgcccagaaggtacacctgaggggggctaccgctctcgagatggggatgcctttgttgctgcaaaagcaacaggagatcgcctcaatcaccgagcagctgatgaccacaaaactgataagcgaactccagaagttgtttatgagtaaaaatgagacctatgttttgaagttgtggccactcttcgtcaagctgctgggcagaactctgcaccgtagcgggtcttttataaactcattgttacaactggaggagctgggttttcggtcgggggcccccatgattaagaaaatcgcatttatcgcgtggaagtctctgattgataattttgccctgaaccccgatatcctgtgtagcgcgaaaaggctcaaactcctgatgcagccccttagctccatacacgtgcgtacagagaccttagcgctcacaaaactggaagtttggtggtacctgttgatgaggctaggcccacatcttcctgccaattttgaacaggtgtgcgtgcctttgatccagagtacaatctccattgatagcaacgcttcccctcagggtaactcatgtcacgtggccacatcacccggattaaatccaatgactcccgtccacaagggggcctcttccccttatggagccccaggtactcctaggatgaacctaagttccaacctgggcggaatggctactatcccaagcatacagctgcttgggctagagatgttattgcactttcttctgggacctgaggccctctcctttgccaaacagaacaagctggtgctgtctttggagcctttggagcatccactcatctcttccccttccttcttttccaagcatgcaaacactcttatcacagcggtgcacgactctttcgttgccgtggggaaagatgccccagacgtagtagtatcagccatctggaaagagttgatatcactggttaaaagcgtcactgaatcggggaacaaaaaggagaagcccggatctgaggtgctcaccctgctgctgaagtcattggagagcatcgtaaaaagcgaggtctttcccgtgtcgaagacgttagtgctgatggagatcaccatcaaagggctgccacagaaagtcctgggcagccctgcataccaagttgcaaatatggatatcttgaatggaacccccgccctctttctgattcaactcatcttcaacaactttctagaatgtggcgtgtccgacgagcggtttttcctgagtctggagtccttagtcggctgtgtgctgtctggccctacctcgccgcttgctttctctgacagcgtgcttaacgtgatcaatcaaaatgccaagcagctcgaaaataaggagcacctctggaagatgtggagtgtaattgtgacaccactgacagagctcatcaatcagacaaatgaagttaaccagggggatgccttggaacacaattttagcgcaatctatggcgcattaactctacctgtgaaccatatttttagtgaacaaaggtttcccgtcgctaccatgaaaactttgttacgaacgtggagcgaactgtaccgagcattcgcgaggtgtgctgccctggtggcaaccgctgaggagaacctttgctgcgaagagctgtcaagcaagatcatgagcagcctggaagatgaaggtttctccaacctgctttttgtggacagaattatttacataattacagtaatggtggattgtatcgatttttctccctataacattaaataccagcctaaagtaaagtctccacagagaccgagcgattggagcaagaaaaaaaatgaacctctcggcaagctgacgtctcttttcaaactgattgtgaaggtgatatacagctttcacaccttatctttcaaagaagctcactcagacacactgttcaccatcggaaactcaataaccgggatcatttcgtccgttctgggccatattagtctgccttctatgatcaggaagatcttcgctaccttgacgcgacctctggcccttttttacgaaaatagcaagttggacgaggtccctaaggtgtactcctgcttgaataacaagttagagaagctactcggcgaaatcatcgcctgcttgcagttttcgtacacggggacatatgattccgagctgcttgaacagctcagcccacttctctgcattatttttttgcataagaacaagcagattcgcaagcagtccgcccagttttggaacgccacatttgccaaggttatgatgcttgtgtatccagaagagctaaagccagtgcttacgcaggccaagcaaaagtttttactcttgctcccgggcttagagaccgtcgagatgatggaagagtcaagcggcccttattctgatggtacagagaattcccagctgaatgtgaagatcagcggcatggaaagaaaatccaacggaaaaagagactcgttcctggcccagacaaagaacaaaaaagagaacatgaagccggcggctaagctgaagctcgaatcctcgtctctgaaggtgaagggcgaaattctcctggaagaggaaaaatctaccgactttgtgttcattcccccagaaggtaaggacgccaaggagaggatccttactgatcatcaaaaggaggtgctgaagacaaaaagatgtgatatccccgcaatgtataacaacctggacgtctctcaggacacattgttcacacagtatagtcaagaagagcctatggagattcctacactaactagaaaaccaaaagaggacagcaagatgatgattactgaagagcagatggactctgatatcgtcattcctcaggacgttaccgaggactgcgggatggctgaacatctggagaagagctcactttccaataacgaatgtggaagtctcgacaagacatcccccgaaatgtctaatagcaacaatgacgagaggaagaaagccctgatatcatctaggaaaacctcaaccgaatgcgcctcctctacagaaaatagctttgtcgttagcagttccagcgtctcaaatacgactgtagcgggaacgcctccctaccctacttcacgtcggcaaacttttattaccttagagaagttcgacgggagcgaaaatcgaccatttagcccttccccgctgaacaatatctcatctacagtgaccgtgaaaaacaaccaggaaacaatgattaagaccgattttctacccaaggccaaacagcgagaagggactttctcaaaatctgactcggagaaaatagtcaatggaaccaagaggagttcccggcgggccgggaaggccgagcagacaggtaacaagcgatccaaacctttgatgcgcagcgaaccagaaaagaatactgaagagagcgtggaaggaatcgtggtgttagaaaacaatccccccgggttgctgaatcaaaccgagtgcgttagcgataatcaagtgcatctcagtgaaagcacaatggaacacgacaacacaaagctgaaggccgccactgtggagaatgctgtactgctggaaacaaatactgtggaagagaagaatgtcgagatcaacctcgaatccaaggagaataccccgccggtcgtgatttcagccgatcaaatggtcaacgaagacagtcaggttcagatcaccccgaatcagaagactctgaggagatctagtaggagaagatctgaggtggtggagagtactacagaatctcaggataaggagaattctcaccaaaaaaaagaacgccgaaaagaggaggaaaagcctctgcaaaagtccccactgcacattaaggacgatgtgctcccaaagcagaaattgatcgccgaacagactttgcaggagaatttaatagagaagggcagcaacctgcacgaaaaaaccctcggagaaacttctgcaaatgctgagactgagcagaacaagaagaaggccgatcccgaaaatatcaaatccgaaggggacggcacacaagacatagttgacaagagttcggagaagctcgtgcgcgggagaacacgctatcagacccggagagcttcccagggcctgctgtcctccatcgaaaactccgaatcagattcgtctgaggccaaagaggaggggagtcgtaaaaaacgaagcggaaagtggaagaacaagtccaacgagtcagttgacatccaagatcaggaggagaaagtggtgaagcaggagtgtatcaaggctgagaaccagagccatgattacaaagcaacgtccgaggaagatgtgtccatcaagagccccatctgtgagaagcaggatgagtccaatacagttatttgccaggactccactgtgacttctgaccttctgcaggtcccagatgacttgccgaacgtgtgcgaggagaaaaacgagacatcaaaatatgcagaatactcttttacgagtctgcctgtgcctgagtccaatctgaggactagaaacgccatcaagcgcctgcacaagcgagactcatttgataactgctcacttggcgaatccagcaagattggcatatctgatatcagttcattgtctgaaaaaacatttcagacacttgagtgtcagcataaacgatcaaggcgggtgcggagatccaaaggctgtgactgttgcggtgaaaaatcccagccgcaggaaaaatccttaatcggtttaaagaataccgagaacaacgatgtggagatcagcgagaccaagaaggcagatgtccaggcccccgtcagtccatcagagactagccaggctaacccgtactcggagggccaatttctcgatgagcaccattcagtgaacttccacctaggtctaaaggaggataatgacactatcaatgactcacttatcgttagcgagactaagtcaaaggaaaataccatgcaggagagtctgccatccggtattgtcaactttagagaagagatctgcgatatggattccagcgaagcaatgtcactggaaagccaggaaagtcctaatgaaaactttaagaccgtggggccttgtttgggggacagtaaaaatgtatcgcaggagtcactggagaccaaagaggagaagccagaagaaactccaaagatggagctctctttagagaacgtcactgtggaggggaacgcatgcaaagtgacagaaagcaaccttgagaaagccaagactatggaactcaatgtgggcaacgaggcctctttccatggccaggaaagaactaaaacaggcattagcgaagaagcagccatcgaggagaacaaacggaatgatgattcagaggccgatacagccaagctgaacgccaaagaagtagctacagaagaattcaactctgatatcagtctctctgacaacaccacacctgtgaaactgaacgcccagaccgaaatatccgaacagaccgccgccggcgaattggacggcggaaacgacgtctccgacctgcactctagcgaggagacaaacacaaaaatgaagaataacgaggagatgatgataggcgaagcaatggccgagaccgggcacgacggcgagaccgaaaatgaggggatcaccaccaaaacttctaaaccagatgaagcagagactaacatgttgacagccgagatggataacttcgtgtgcgacacagtcgagatgtcaacggaggagggtattattgatgccaataagacagaaaccaacactgagtactccaaatccgaagagaaactcgacaataaccagatggtaatggaatctgacatccttcaggaggaccatcacacgagtcagaaggtagaggagcctagccagtgtctggcctcaggcacagccatctccgagctgatcatcgaggacaataatgcttccccacagaaactgcgggagctggatccctcgctggtatctgccaacgactctccgtcaggaatgcagacaaggtgcgtctggtctcccctcgcgtccccctcaactagtatactgaaacgaggacttaagaggagccaggaggatgagattagttctcccgtcaacaaggtacgacgggtcagcttcgcggacccaatttaccaggccgggctggccgatgatattgaccggaggtgctcaattgtccggagccattcttctaacagctctcccattgggaagtctgtcaagacttctcccactactcagagcaaaattagcgagatggctaaggaatcgatcccttgccccaccgaaagtgtctatccacctttggtgaattgcgtggccccagtggacatcatactgccccagataaccagtaacatgtgggctagaggtctgggccagctcatcagggcgaagaacataaaaaccataggcgacttgagcacccttaccgcttcagaaatcaagacactgcccatcaggtcacctaaggtctctaacgtcaagaaggcgttgagaatctaccacgagcagcaggtgaagacaagagggcttgaagaaattcctgtgtttgatatcagcgagaagacagtaaacggtattgaaaacaaatctctgagccccgacgaagaacgccttgtgtctgatataattgaccccgtggccttggaaatccctctgagcaaaaaccttctggctcagattagcgccctggcccttcagttagactccgaagatctgcataactatagcggctcccagctgttcgaaatgcacgagaagctctcctgtatggcgaacagtgtgatcaagaatttgcagtcacggtggcgttcgcccagtcatgaaaacagcatctag

SEQ ID NO: 17062 - DNA, 555 bp, Artificial Sequence
  Description of Artificial Sequence: Synthetic coding sequence
atgagagagtacaaattggttgtgttgggatctggaggagtcgggaagtccgcgcttaccgttcagtttgtgcaggggatttttgtcgaaaagtacgaccccaccatcgaggacagctaccggaaacaagtcgaagtggattgccagcagtgcatgctcgagatcttggacactgcaggaacagaacagttcaccgctatgagggacttatatatgaagaatgggcaggggttcgccctggtttattccattaccgcacaatccacctttaatgacctgcaggacttgagagagcaaattctgcgggtgaaggacactgaagacgtgcctatgatactggttgggaacaaatgcgacctggaggatgagcgggtggtcggaaaagaacagggacaaaacctggctcgccagtggtgcaattgcgcctttctggaatcaagcgctaaaagcaaaattaacgtaaacgagatcttttatgatctggttcggcagattaacaggaaaacacctgttgagaagaagaaacctaagaagaaaagctgtcttctcctctag

SEQ ID NO: 17063 - DNA, 555 bp, Artificial Sequence
  Description of Artificial Sequence: Synthetic coding sequence
atgcgggaatacaaattggtcgtgcttggctctgggggagtcggcaagtcagcccttacggtgcaatttgttcaaggaatcttcgttgaaaagtacgatcccaccatcgaggacagctaccggaagcaggtggaagtggactgccagcaatgcatgctggaaatcctcgataccgccgggaccgagcagttcaccgctatgcgcgatctttatatgaaaaatggacagggctttgcccttgtatactcaattaccgcacagtccaccttcaacgatctgcaggacctccgggaacagatcctgagagtcaaagacactgaggatgtacctatgatcctcgtgggtaacaagtgtgatcttgaggatgagcgggtcgtggggaaggaacagggtcagaatctggcccggcaatggtgtaattgcgcttttctagagtcatctgcaaagagcaagatcaacgtcaatgagatcttttacgacctggtgcggcaaatcaacagaaaaacgccggttgaaaaaaagaagccaaagaaaaagtcgtgccttctgctttag

SEQ ID NO: 17064 - DNA, 390 bp, Artificial Sequence
  Description of Artificial Sequence: Synthetic coding sequence
atgcgggagtacaagcttgtagttctcggttccggcggcgtgggtaaatctgcacttactgtgcaatttgtgcaaggcatttttgtggagaagtatgaccctaccatcgaagattcgtatagaaaacaagtagaagttgactgtcagcaatgtatgctcgaaatcttggacactgctggaacagaacagtttactgcaatgcgggacctgtatatgaaaaatggccaaggttttgccttggtctatagcattacggcccagagtactttcaacgatctgcaggatttaagggaacaaattctcagagtgaaggacacagaggatgtgccaatgattctggttggtaacaagtgtgacttggaagacgaacgggtggtgggtaaggagtag

SEQ ID NO: 17065 - DNA, 555 bp, Artificial Sequence
  Description of Artificial Sequence: Synthetic coding sequence
atgcgtgagtataagctggttgtgcttggttccgggggtgttggaaagagcgcactgactgtacagtttgtgcaagggatatttgtcgagaaatatgacccaacaatcgaggactcctacaggaagcaggtggaggttgactgccagcagtgtatgctggaaattcttgacaccgcgggtacagagcagtttaccgccatgcgcgacctatacatgaaaaacggacagggcttcgctctcgtttactccataacagcgcaaagcacatttaacgacctacaagacctgagggagcagatacttcgagtgaaggacacagaggatgtgccaatgatactcgtggggaataagtgcgatctcgaagatgagagggtggttggtaaggaacaagggcagaatctcgcgcgccagtggtgcaactgtgccttcctagaaagttccgctaaatctaaaataaacgttaatgaaatattctacgaccttgtacgacaaataaaccgcaaaacccccgttgaaaaaaagaaaccaaagaagaagtcttgtttgctcctgtag

SEQ ID NO: 17066 - DNA, 555 bp, Artificial Sequence
  Description of Artificial Sequence: Synthetic coding sequence
atgcgcgaatacaaattagttgttctcggctccggaggtgtgggaaagtccgccctcacagtgcagtttgtgcagggaatcttcgtagagaaatatgaccctacaattgaagactcttacagaaaacaggttgaggtggattgccagcagtgcatgttggaaatcctggacacggccggcaccgaacagtttactgcaatgagagacctatacatgaaaaacgggcaaggctttgccctggtatactctatcacggcccagtcaacattcaacgacttgcaggatctaagggaacagatcctgcgagtcaaagacacagaggatgtcccaatgatccttgtgggaaacaaatgtgacctcgaagacgaacgagtcgtagggaaggagcagggacagaatttggcgcggcaatggtgcaattgtgctttcctagaatctagcgccaagtcaaaaatcaacgtgaacgagatcttttatgatctggtgaggcagattaatcgtaagaccccagtagaaaaaaagaaaccaaaaaagaaatcatgtctgctactctag

SEQ ID NO: 17067 - DNA, 1380 bp, Artificial Sequence
  Description of Artificial Sequence: Synthetic coding sequence
atgagggcccagatcgaggtgattccgtgcaaaatttgtggggataaatcaagcggaatccattacggggtgataacctgcgagggctgcaagggtttcttccggaggagtcagcagaataacgctagttattcttgccccagacagaggaattgtttgattgatcgaacaaacagaaaccgatgccagcattgccgtctgcaaaagtgcctggcgcttgggatgtccagagatgccgtgaaattcgggcgtatgagcaaaaagcagcgcgattccctgtatgccgaggtccagaaacatcagcaacgcctccaagaacagagacagcagcagtctggagaggctgaagccctcgcaagagtttacagctctagcatttctaacggactgagcaatcttaacaacgaaacctctggcacctatgctaacgggcatgtgattgacctgccgaagtccgagggctactacaacgtagacagtggccagccatccccagatcagtcaggcttggacatgaccgggatcaaacagattaagcaggaacctatttatgacctaacatctgttcctaacctctttacctatagtagtttcaataacggacaactcgctccaggcattactatgactgagatcgacagaattgcgcagaatatcatcaagtcccacctggagacctgccagtacacaatggaggagttacaccagttggcttggcagacacatacctacgaagaaatcaaggcctatcagtctaagtcccgtgaagctctgtggcagcagtgcgcaattcaaatcacccacgctattcagtacgtggtagaattcgccaaacgaattaccggcttcatggagctctgccagaacgaccagattcttctgctcaagtctgggtgcctggaggtagtactggtcagaatgtgtcgcgcctttaaccccctgaacaatacagtgcttttcgaagggaagtacggtggcatgcagatgttcaaggccctgggatcggatgacctggtgaatgaagctttcgatttcgcaaagaacctgtgtagcctccagctgaccgaggaagagattgcccttttttcttccgccgtgctcatctcccccgatcgcgcttggctaattgaaccaaggaaggtacagaagctccaggagaaaatctatttcgcactgcagcacgtgatccagaagaaccatctcgatgacgaaactcttgctaagctgatcgccaagattccaacaattactgcagtgtgcaatctgcacggggagaaactgcaagtctttaaacagtctcatcccgagatagtgaatacactcttcccccctctatataaggaacttttcaatcctgattgtgcgactgggtgcaagtag

SEQ ID NO: 17068 - DNA, 1413 bp, Artificial Sequence
  Description of Artificial Sequence: Synthetic coding sequence
atgtgcgagaaccagttaaaaacaaaagcagatgccacagcgcagatcgaagtcatcccatgcaagatttgcggagataagagcagcggcatccactatggtgtcattacatgcgagggctgcaaagggtttttccggcggtctcagcagaataatgcaagctatagctgccctaggcagcgtaattgtctgattgaccgaactaataggaatcggtgccaacactgtcgtctgcagaaatgcctggccctgggcatgagccgcgatgccgtgaagtttgggaggatgagtaagaagcagcgcgattccctttacgccgaggtgcagaagcatcagcagcgtctacaagaacagagacagcagcagagcggggaagctgaggcactcgctagagtatactcgtcaagcatttcaaacggcctctccaacttgaataatgaaacgagcggtacttacgccaatggacatgtgattgatttacccaagtcagaaggttattacaacgtggattccggccagcccagccccgatcagtccgggctagatatgactgggattaaacagatcaaacaggaaccaatctacgacctcacctccgtccctaaccttttcacttactccagttttaataatggtcagctggcgccaggaatcactatgactgagatcgatagaattgcccaaaatataattaagtcccatctcgagacttgccagtatactatggaggaactgcaccagctggcctggcaaacgcacacctacgaggagataaaggcttaccagtccaaaagcagagaagcgctctggcagcagtgcgccatccagatcacccacgccattcagtacgtggtcgagttcgcaaaacgaataactggcttcatggagctctgccagaatgatcagatcctactgctcaaaagcgggtgtctggaagttgttctggttcgaatgtgccgggccttcaatcctctgaacaatactgttctgttcgaaggtaaatatggcggaatgcaaatgttcaaagctctgggcagtgacgatcttgttaacgaagcgtttgattttgctaaaaatctgtgctccttacagctgacagaggaagagatcgccttgttctctagcgctgtgcttatcagccccgatagagcatggctcatcgagcctaggaaggttcagaagttgcaggaaaagatctactttgcgcttcaacacgtgatccagaagaatcatctggacgatgagaccttagcaaaactaatcgctaagattccgaccataactgctgtctgcaatctccacggcgaaaagctgcaagtatttaagcagtctcatcctgagatcgtgaacaccttgtttccacccctttataaggagctctttaatcctgactgcgcaaccgggtgtaaatag

SEQ ID NO: 17069 - DNA, 813 bp, Artificial Sequence
  Description of Artificial Sequence: Synthetic coding sequence
atgggggaggccgaggccccatcctttgagatgacatggagtagcacaacgagttccggatattgcagccaggaggactcagattctgagctcgaacagtatttcactgctaggactagtctggcccggcgtcccaggcgtgatcaggatgagcccgtggaatgggagacccctgatctttcccaggcggagatcgaacagaaaatcaaagaatacaatgcccagatcaactcgaatctctttatgtctctgaacaaagacggctcatacaccggtttcatcaaagtgcaactgaagctggtgcgccccgtgtctgtgcccagctccaagaaaccaccctctttgcaggacgctcgtagggggccaggtcggggaacatccgtcaggcgccgtaccagtttctatctgcctaaagacgctgtcaaacacctgcacgttttaagccggacaagagcccgtgaggtgattgaagctctcctgcgtaagttcctcgtcgtggacgatcctcgcaagttcgccctctttgagagggcagagcgtcacggccaagtgtacctgcgaaaacttctggatgacgagcagcctcttaggctgcgtctcctggctggaccgtcggacaaagcactgagctttgtgctcaaagaaaatgactccggcgaggtgaattgggatgctttttctatgcccgagctgcataacttcttgagaattttacaaagagaggaggaagagcacctacgccagatattacagaaatactcgtattgtcggcaaaagattcaagaagcccttcatgcctgcccactgggatag

SEQ ID NO: 17070 - DNA, 1035 bp, Artificial Sequence
  Description of Artificial Sequence: Synthetic coding sequence
atgagcggggagccagagctaatagaactgagagagctggccccagcaggaagggccggcaaaggtaggacccggcttgaaagagctaatgcactgcgcattgctcgtgggacagcgtgcaatcctacacggcaactcgtgcctggaagaggtcatcgcttccagcccgccggtccggccacccatacttggtgtgacttgtgtggtgactttatatggggggtcgtccggaaagggctccaatgcgccagactgagcgcagattgtaaattcacatgccattatcgttgtcgagccctggtgtgcctggactgctgtggtccacgcgatctgggatgggagccagctgtggaacgggatactaatgtagatgagcctgtggagtgggaaacgccggatttgtcgcaggctgagatagagcagaagatcaaggagtacaacgcccagattaacagtaatctgtttatgagcttaaataaagacggcagctataccgggtttatcaaggttcagctcaaacttgtgcgacccgtgtctgtgccctccagcaaaaagcccccaagcttacaagatgctagacgaggtccagggcggggtaccagcgtgagaaggcggacaagcttttacttacctaaggatgctgtcaaacatctgcatgttttaagcagaacacgagctcgagaagtgattgaagccctgctcagaaagttcctggtcgtcgatgaccccaggaagttcgccctgtttgagcgagccgaaaggcatgggcaggtgtatctgcggaagcttctcgatgatgaacagcctctcagactgaggttattagcaggtccctctgataaggccctttccttcgtgttgaaagagaacgatagtggggaggttaattgggacgcattctcaatgcccgagctccataactttctgaggatacttcagagagaagaagaagagcacctccgacaaatccttcaaaagtattcgtattgcagacagaaaatccaggaagcacttcatgcctgcccactcggctag

SEQ ID NO: 17071 - DNA, 1023 bp, Artificial Sequence
  Description of Artificial Sequence: Synthetic coding sequence
atgagcggcgagcctgagctgatcgaactgagagagctagcacctgccggcagggctgggaaaggaaggacccgactcgaaagagctaacgcgctgagaatagctcgaggaactgcctgcaaccccacaaggcagctggttcccggcaggggacaccgtttccagccagctggtccagcaactcacacctggtgcgacttgtgcggggatttcatctggggcgtcgtgaggaaaggtcttcagtgtgcgcactgcaagtttacctgtcactaccggtgcagggccttagtatgtttggattgttgcggccctagggacttaggttgggaacctgccgtggaacgcgacacaaacgtggacgagcctgtagaatgggagaccccagatctgagccaggccgagatcgagcagaagatcaaggaatacaatgcccagattaactccaacctgttcatgagtctaaacaaagatggatcctatactggctttatcaaagtgcagcttaaattagttcgccctgtgagcgtgccctcatcaaagaaacccccatccctacaagacgccaggcgcggacccgggcgggggacgtcagtgaggaggagaacatctttttacctacccaaggacgcagtgaagcatctgcacgtactcagcagaactcgagccagagaggtgattgaggctctgttgcgaaaatttctggtcgttgatgacccgagaaagtttgctctgtttgaaagagctgagaggcacgggcaagtgtacttaagaaagctcctggacgatgagcagcctctgcggttacgcctcctggcaggacctagcgataaggctttgtctttcgttctgaaagaaaatgactctggtgaggtgaactgggatgcattcagtatgcccgagctccataattttctgcggatcctgcagcgcgaggaggaggagcacctgcgccagattctgcagaaatatagttactgtaggcagaaaatacaggaagctctgcacgcctgtccgctgggatag

SEQ ID NO: 17072 - DNA, 570 bp, Artificial Sequence
  Description of Artificial Sequence: Synthetic coding sequence
atgagtttaaacaaggacggatcctacaccggtttcatcaaagtgcagctgaaactggtccggccggtgtctgttccctccagcaagaaacccccgagtttgcaggacgctcgacggggacctggccgcggcacaagtgtgcggcgcaggacctccttctacctaccaaaggacgctgtcaaacacctgcatgtgctgagccgcacccgcgcacgtgaagtgatcgaggctctgctcaggaaattcctggtggtggacgacccccggaaattcgcactcttcgaacgggctgagagacacgggcaggtttacctgagaaaactgttagacgatgagcagccactgcgcttgcgcctgctcgcaggtccgtcagataaggcactgagcttcgtcctgaaagaaaatgactccggggaggtcaactgggatgccttttccatgcccgagctgcacaattttctgagaatattacagcgcgaggaggaggagcacctgcgtcaaattctgcagaagtactcttactgtcgacagaaaatccaggaagctcttcatgcatgccctcttggttag

SEQ ID NO: 17073 - DNA, 981 bp, Artificial Sequence
  Description of Artificial Sequence: Synthetic coding sequence
atggattacagtcaccagacctccctggttccctgtgggcaggacaagtacatcagcaaaaacgaactgctgctccacctgaaaacttataatttatactatgagggccagaacctccagctcaggcacagagaggaggaagacgaattcatcgtggaagggctgctgaacatcagttggggcttacgcagacctattaggctgcagatgcaggacgacaacgaaagaattagaccacccccgtcctcttcttcatggcactcaggatgtaacttgggggctcagggtaccacacttaaaccgcttaccgtcccaaaggtacaaatttcagaggtcgatgcacctccagaaggcgaccagatgccgagttccacggattccagagggcttaaacctttgcaggaggataccccgcagctgatgagaacccgctcagatgtgggagtgaggcgacgtggcaacgtgcgtaccccaagcgaccagaggaggatccggcgccatagattctcgatcaatgggcatttttacaaccataagacgagtgtgtttacacccgcctatggaagcgttaccaacgtacgcatcaattccaccatgacgacacctcaagtgctgaagcttcttttgaataagtttaaaatcgaaaactccgctgaagagtttgcactgtacgtggtccatacaagtggagaaaaacagaaactgaaggctacggactacccactgattgcaaggattctgcaaggaccttgtgagcagatctcaaaggtcttcctcatggagaaagaccaggtcgaagaagtaacctacgacgttgcccagtacattaaattcgaaatgcccgttctcaagagctttatccagaagctgcaggaggaagaggatcgtgaagttaagaagctaatgagaaagtatactgtgttgcggctgatgatccgccagcgcttagaagaaatcgcagaaactcctgctactatctag

SEQ ID NO: 17074 - DNA, 981 bp, Artificial Sequence
  Description of Artificial Sequence: Synthetic coding sequence
atggattatagccaccagacaagtctagtgccctgcgggcaggacaagtacattagcaagaacgagctgttgctgcacttgaaaacttacaatctgtattacgaaggacagaatctgcagttgaggcatagggaggaggaagatgagtttatagtcgaggggcttctgaatatcagctgggggttgcggcgccccatcagactgcagatgcaagacgataacgagagaatcagacctccacccagtagcagctcatggcatagtggctgcaacttgggggcacagggtaccacacttaagcccctcacggtgcccaaagtccagatcagcgaggtggatgctcctcccgagggggatcagatgccaagtagtactgacagtcggggattgaagcctctacaagaagataccccccaattaatgaggacacggtctgatgttggagtccgcaggcgggggaacgtacgaactccctcggaccagagaagaatccggagacacagattttctattaacggtcacttttacaatcataagacatccgtgtttactccagcttacgggtcggtaactaacgtacgaattaattcaaccatgacgacccctcaggttctgaaactgctgctgaataagtttaagatcgagaattcagctgaagagtttgctctgtacgtggtgcacacctctggagagaaacagaagctgaaagccacggattacccactgatagcaaggattctacagggcccctgcgaacagatctctaaagtattcttaatggagaaagatcaggtggaggaagtcacgtacgatgtggcacagtacatcaagttcgagatgcctgttctgaagtcatttatacagaaactccaagaggaggaggaccgcgaggtgaagaaactgatgcgcaagtataccgtgctgagactgatgatccgtcagagattggaggaaatcgctgaaacacctgcaaccatctag

SEQ ID NO: 17075 - DNA, 993 bp, Artificial Sequence
  Description of Artificial Sequence: Synthetic coding sequence
atgaaagaagattgcctccccagctctcacgtgccaatttctgacagtaaatcaatccagaaaagggacgtgcaggggctaagcgaggaggggaccctaattatcgagggacttctcaatattgcctgggggctccgccggcctatacggcttcagatgcaggacgatcgggagcaggtgcacctgcctagcacatcatggatgccccggcgcccctcttgcccactaggctgctggtccctgttgctcggcttgagttcgctgagcctgcccgccgccatcagtgccctgcaactgtctgtttttcgcaaggaaccctccccccagaatggaaatatcaccgctcaagggcccagtatccaacccgtgcacaaggccgagagcagcaccgatagtagtggtccccttgaggaagccgaggaagcaccccagttaatgcgcactaagtccgatgcatcttgcatgagccagaggcgaccaaagtgccgggctccaggcgaggcccagcgtatccgcagacaccgcttctcaattaacggccatttctataaccacaaaacatctgttttcacacccgcttatggcagcgtcactaacgtgcgagtgaactctaccatgactaccctgcaggtgctgacactccttctcaataagtttagagttgaggacggcccatctgagtttgctctctatattgtgcacgagagcggcgaacggaccaagcttaaagattgcgagtacccgctaatctcccgcatactgcacgggccttgcgaaaagatagccagaattttcttgatggaagcagatctgggggttgaggtgccacacgaagtggctcaatatattaagtttgagatgcccgtactggactcgtttgtggagaaactgaaagaggaagaagagcgggagatcataaagctgactatgaagtttcaggccctgcgactgaccatgctgcagcgccttgagcagctggtagaggccaaatag

SEQ ID NO: 17076 - DNA, 966 bp, Artificial Sequence
  Description of Artificial Sequence: Synthetic coding sequence
atgaaggaggattgcctcccctcaagtcatgtgccaatatccgactccaaatccattcaaaagagtgagctgcttgggcttctgaaaacttacaattgctaccacgaaggtaaaagtttccagctccggcacagagaggaggaaggtacactcatcattgagggcctccttaacatcgcatggggcttgagaagaccaatccgcctgcagatgcaggatgatcgagaacaggtgcacctcccgagcactagctggatgcctcgccggccttcctgccctctgaaagagcccagtcctcagaatggtaatataacagcccaaggcccttcgatccagccggtgcataaggcagagtcttctaccgatagttcagggccactcgaggaggctgaagaggctcctcagttaatgagaacaaagtccgacgcctcctgcatgtcccaaaggaggcccaagtgtcgggcgcctggagaggctcaacgtattcgcaggcaccgattcagcattaacgggcacttttacaatcataaaacctccgttttcacaccggcttacggttcggtcacaaatgtgagagtgaattctaccatgacaacgctccaggtgcttacgctgctgcttaacaagttcagagtggaggacggccccagcgagtttgcactgtacatagttcacgagagtggcgagcgcacaaagctcaaggactgtgaataccctttaatctcccggatcctccatggaccctgcgagaagattgctagaatttttctgatggaggccgatctgggagtggaagtgcctcacgaagtggcccagtatatcaagttcgaaatgccggttctcgatagttttgtcgaaaaactgaaagaggaagaagaaagggagatcataaagctcaccatgaagttccaggctctgcgtttgacaatgctccaacggctagaacagctggttgaggccaagtag

SEQ ID NO: 17077 - DNA, 1239 bp, Artificial Sequence
  Description of Artificial Sequence: Synthetic coding sequence
ggcagcaacgcgggcggcggccaaggcggatgccaggggctgacttgtgactccgagagtgtcgggaccttggacatcttggaccagactcaggcttgtcctgtgtctctggcatcttcctcggctagaccgccctgcccccctcccggaccttgcgcggagccctcaggatgtatcgccatggccgtttggagtcctcttgtgatgccaggccgcagagagggctgttgccatacacctgtgactaatgaggagaccgaagcaagagaagccaaagggcagaagctgagaccctgccacacactgggagttcatgtgtgtctgagcctgtttagatctgaacttttggggctgcttaagacctataactgttatcatgaagggaaaagcttccagctccgtcaccgggaggaggagggcacactaatcatcgaaggcctgctcaacatcgcatgggggttgagacgtccaatacgtttgcaaatgcaagacgacagagaacaggtccatcttccttcaacttcgtggatgccccgcaggcccagttgtccgctgaaggagccgtcaccccaaaatgggaatataaccgctcaaggcccatctattcagccagtccataaagctgagagctctacagatagttctggccctctcgaagaagctgaagaagcaccacagcttatgaggaccaagagtgacgcctcctgtatgagccagcgccgacctaagtgtagagccccaggcgaagcacagcgtatccgtcgtcaccgatttagcatcaacggccacttttacaatcataaaaccagcgtgttcacgccagcatacgggtccgttacaaatgtccgagttaactctactatgaccaccctacaggtactcactttgctactcaataaattcagagttgaggacgggccctcggaattcgccttgtacatcgtgcatgaatccggtgagaggactaagctcaaggattgcgagtacccgctgataagccggatcctgcacgggccctgcgagaaaatcgctcgcatctttttgatggaggccgacttgggcgtcgaggtgcctcatgaagtggcgcaatacattaaatttgaaatgcctgtcctcgactccttcgtggagaagctgaaagaggaagaagagcgtgagattatcaagttgacgatgaaattccaagcactgcgtctcactatgctccagagactggagcaactggtagaagccaagtag

SEQ ID NO: 17078 - DNA, 393 bp, Artificial Sequence
  Description of Artificial Sequence: Synthetic coding sequence
atgaaggaggattgcttacctagcagccatgttccaatctccgacagcaaaagtattcaaaagagtgaactcctcggacttcttaagacatataattgctatcacgaaggaaaatccttccagctgaggcaccgtgaggaggaagggactctgattattgagggactactcaatatagcttggggcttgcgccgacctatcagattgcaaatgcaagacgaccgggagcaggtccatctcccaagcacttcatggatgcccaggcggcctagttgccctctccacctcgctggcaagaaaggcagattacagcctggagggttgcctaccccaatgcaggctgaacacgttagcccatcgttggttctttccttgaagttcaccaggatctag

SEQ ID NO: 17079 - DNA, 381 bp, Artificial Sequence
  Description of Artificial Sequence: Synthetic coding sequence
atgaaggaggattgcttgcctagctcacacgtacctatctccgattcaaagagcatacagaagagcgagctcctcggcttgctgaagacctataactgctaccacgagggtaaaagcttccagcttaggcatcgcgaagaggagggtaccctgattatcgaagggctgctcaacattgcatggggattacggcgaccaatacggctccaaatgcaagacgaccgtgagcaggtacatctgccttcaacctcatggatgcctaggagacccagttgtccactcgcacccggcggtgggcggggcggcccccccgcagatgccgaccaggagaggcgacagctgcacgagccagaagaggcgcaggtgcctcgaccaaggtag

SEQ ID NO: 17080 - DNA, 456 bp, Artificial Sequence
  Description of Artificial Sequence: Synthetic coding sequence
atgaaagaagactgcctccctagcagccatgttcctatcagtgattccaaaagcattcagaaatcagaacttctcggattactgaagacttataactgttatcacgaaggaaagtcttttcagctgagacaccgcgaagaggaggggaccttgatcattgagggtttgttaaatatagcctggggtctgcggcgcccaatcagactgcaaatgcaggatgacagggaacaggtgcacttgcctagtacatcgtggatgcctagacgtccctcatgcccgctcggctgttggtctctcctcctgggtctgtcttctttatctcttccagctgctattagcgcactgcagctcagtgtttttcgaaaggaaccgagcccccaaaacggtaatatcactgcacagggccccagtattcagcccgtgcataaagcagagtcttcaactgactcctcgtag

SEQ ID NO: 17081 - DNA, 372 bp, Artificial Sequence
  Description of Artificial Sequence: Synthetic coding sequence
agcagtcacgtgcccatatcagacagcaagtcaatccagaagagcgagctgctggggcttttgaaaacatacaactgttaccacgaaggtaagagcttccagctccggcaccgggaggaggagggcactctcataatcgagggactactgaacattgcctggggactgcggcggccaatcaggttacaaatgcaggatgatagggaacaggttcatttgccttcaacaagctggatgccacggcggccttcatgccctctgcacttggccgggaagaagggcaggctccagccgggtggcctgcctaccccaatgcaggcggaacatgtctccccgtctttagtgctctcgctgaagttcactaggatctag

SEQ ID NO: 17082 - DNA, 798 bp, Artificial Sequence
  Description of Artificial Sequence: Synthetic coding sequence
atgacagtggactcctcgatgagcagtggatactgttcacttgacgaggagttggaggattgcttttttaccgccaaaactactttctttcgaaacgcacagtccaagcatctcagcaaaaacgtgtgtaagccagtggaggagacacagaggcccccaactttgcaggagatcaagcagaaaatcgactcatataacacgagggagaaaaactgtcttggcatgaaactgtctgaagatggaacatacaccgggttcatcaaggttcacctcaagctacggcggccagtgactgtccctgccggcatcaggccacagtccatatacgacgccattaaggaggtgaatcttgccgcaactacagataaacggacttcattctaccttccactggatgcaataaaacagctccacatttcctccacaacaaccgtcagcgaggtcatccaaggcttactgaaaaaatttatggtggtagataatccccagaagtttgccctgttcaaaaggatccataaggatgggcaggttctgttccaaaaacttagcatcgctgacagacctctatatcttcggctgcttgcaggccctgacacggaggtgctaagtttcgtcctcaaagagaatgagaccggcgaggtagaatgggacgccttttctatccccgaactgcagaattttctcacgattctcgaaaaagaggagcaagacaaaatccagcaagtgcagaagaagtacgacaagtttaggcagaagctggaggaggcattaagggagtcccaaggaaagccaggatag

SEQ ID NO: 17083 - DNA, 1179 bp, Artificial Sequence
  Description of Artificial Sequence: Synthetic coding sequence
atggcaatggcgtcaccagccattggccagcgtccatatccgctgctgctggatccagaaccgcctcgatacctgcagtctctttccgggccagagctacctcctccaccccctgaccgttcttcccggctctgcgtgcccgctccactgagcacagctccaggcgccagagaggggcggtctgcccggagggccgccaggggaaacctggagcccccaccaagagcttcccggccagcacggcctctccgaccggggctgcagcagcggctgcgaagaagacccggtgcccctcgacctagggatgtgaggtctatatttgagcagccacaagaccccagagtaccagccgaacgtggtgaagggcactgtttcgccgagctggttctccctgggggacccggatggtgtgacctgtgcggcagagaagtgctccgacaagctctgcggtgtaccaactgcaaattcacctgtcaccctgaatgcaggtctctaatccagctggactgttcgcagcaggaaggactgagcagggatcgcccgtcccccgaatccactttgacggtgacattttcccagaacgtctgtaagccagttgaggaaactcagagaccccccaccctgcaggaaataaaacagaagatcgactcgtataacaccagggagaagaactgtctgggaatgaaattaagcgaagatggaacatatactggttttatcaaagtgcacttaaagctgcgacgacccgttactgtgccggctggcattagaccacagtcaatctacgatgcaattaaagaagtgaatcttgccgctactaccgataagcgaacaagtttttacctcccactggatgcaattaaacaacttcacataagttccactacaactgtgagtgaggtgattcaagggctcttgaaaaaattcatggtggtcgataacccacagaagtttgccctctttaagcggatccataaagacggccaagtcctgttccagaaattgtctatcgccgatcgccccctttacctgcgcctgctggcaggtcccgatacagaggtcctgtcttttgtcttaaaggagaacgaaactggagaagtcgagtgggatgcattttcaatccccgagctgcagaatttcttgtctagctggtgcattcaaatttatctctattactag

SEQ ID NO: 17084 - DNA, 1257 bp, Artificial Sequence
  Description of Artificial Sequence: Synthetic coding sequence
atggcaatggcaagcccagcaatcggccagcgcccttatccactgctgctggaccctgagccacctcggtatttacagagtctgagtgggcctgaactgccgcccccccctcccgatcgaagctcacgcctgtgcgttccagcaccactgtcaaccgctcccggcgcacgtgagggcagatctgctcggagagcggcacgcggcaatttggaacctccacctcgcgcctcccgcccggcaaggccactgcgccccgggctgcagcagagattgaggcggagaccaggggcaccccgaccccgcgacgtacgttccatctttgagcagcctcaggacccgcgcgtccccgcagagcgcggagagggccattgtttcgcagagctcgtactaccgggcggacccggctggtgtgatctctgcggtagagaggtgctgagacaggccctcaggtgcacgaactgtaaatttacttgtcacccagaatgtcggagcctgattcaacttgattgttcccaacaggagggcctgagcagggaccggccttcccccgagagtactttgacagtcaccttctcccaaaatgtatgtaagcctgtggaggagacccagcggccacctacactgcaagaaatcaagcagaagatagacagttacaacacgcgcgagaagaattgcctcggtatgaaattgtcagaggacggaacctacaccggcttcattaaggtccatcttaagttgcgacgcccggtgacagtaccagccggcattcgaccccagagcatttatgatgcaatcaaggaggtgaatcttgctgccacaaccgacaaaaggacttccttctaccttcctctggacgctatcaagcagctgcatatctcctctaccacaacagtcagcgaggtgattcagggcttgcttaaaaaatttatggtagtggataacccccagaagttcgcactttttaagagaatccacaaggatggccaggtcctttttcaaaaattgtccatcgctgatcggcctctctacctgaggctgcttgctggccccgatacagaagtgctgtcttttgtcctgaaggagaatgagacgggagaggtggagtgggacgccttttctatcccagagttgcaaaattttttgacaatcctggagaaggaggagcaggacaagattcagcaagtgcagaaaaagtatgataagtttaggcagaagctggaagaggctctgagggaatcacaggggaagcctggatag

SEQ ID NO: 17085 - DNA, 1011 bp, Artificial Sequence
  Description of Artificial Sequence: Synthetic coding sequence
atggccatggcgagccccgccattgggcagcgcccataccccttgctgcttgaccctgagcctccaagatacttgcagagcctgagcggacctgagctgcctcccccccctcccgataggtcctcccgcctgtgtgtgcccgctcctttatctaccgcacctggggctcgagaagggaggtcagcgcggcgggctgcgcggggtaatcttgagcctccaccccgcgccagtcgccctgctcgcccccttaggccagggcttcagcagcggctgcgcaggcggccaggcgccccgagaccccgcgatgttcggagcatatttgaacagcctcaggatcctcgcgttcccgctgagaggggggaaggacattgttttgcggagctggtgctgcccgggggacccggctggtgtgatctttgcgggcgggaggtgctgcggcaggccctgcgatgtactaactgcaaattcacttgtcaccctgagtgtcgctcccttatccagctggattgctcccaacaagagggcctgagcagagaccggccctcccccgagtccactttgaccgtcacatttagtcagaacgtctgtaaaccagtggaagagacacagcggccgcccactctccaagaaattaagcagaagattgatagctacaatacgagggagaagaactgtctgggaatgaagctttccgaagatggaacctacactggattcatcaaagtccatctgaagttgaggcggccggttactgtgcccgccgggatccggcctcagtcaatctatgatgcaatcaaagaggtgaatctggcagccacaacagacaagagaaccagtttttacctcccgctggacgctatcaagcagctccacatttctagcacaaccaccgtatctgaggttatccagggcctcttgaaaaagttcatggttgtggataacccgcagaaatttgctctgttcaaaagaattcataaagatggccaggtgggttgcctgctgcacccgtag

SEQ ID NO: 17086 - DNA, 1182 bp, Artificial Sequence
  Description of Artificial Sequence: Synthetic coding sequence
atggccatggcctctccggccattgggcagcggccttaccccctcttattagacccagaaccaccaaggtacctgcagtccttgtccggacctgagctgcctcccccaccacccgatcggtccagccggctgtgtgtgcccgctccactttccaccgccccgggggctcgtgaggggagatcagccaggcgcgccgcccgtggaaatctcgaacctcccccccgcgcatcaaggcctgctagaccactcagacctggcctgcagcagcgtctgcggcgccggcctggggcaccgcgcccaagggacgtgagaagcatcttcgagcagcctcaggaccctcgcgtaccggccgaaaggggagaggggcactgtttcgcagagctcgtgctgcctggcggaccaggttggtgtgacctgtgtggtagggaggtcctgagacaggcgctgaggtgtactaactgcaagttcacttgtcatcctgagtgtagaagcctgattcagcttgactgttcacagcaagagggtttgagccgagatcggccgtcgccggagtccacgctcaccgtcacgtttagtcaaaacgtttgcaagcctgtggaggagacccagcggcctccaacactgcaagagataaagcagaaaattgactcttacaacacaagagaaaaaaactgcttgggtatgaaactaagtgaagatggcacttacactggattcatcaaagtccacctcaagctccgccggccagtgaccgttcccgcaggaatcaggccacagtctatctatgatgccatcaaggaggttaatttggctgcaaccacggataaacggaccagtttctatctgccattagacgccattaaacagctgcatatcagctccactacaacagtgtctgaggtcatccagggattgctcaagaagttcatggttgtggacaatcctcagaaattcgccttgttcaaacgcattcacaaagacgggcaggttttgtttcagaaactgagcattgcagatcggcccctgtatctgaggctgctggccggccccgataccgaagtacttagctttgtcctgaaggaaaatgagactggcgaagtggaatgggacgctttctccatcccagagctgcagaactttttcttgtcaagctggtgcatccagatttacctgtactactag

SEQ ID NO: 17087 - DNA, 555 bp, Artificial Sequence
  Description of Artificial Sequence: Synthetic coding sequence
atgcctcaatctaaatcccgaaaaatcgctatactaggctacagatctgttggcaagtccagcctcactatccaattcgtggaggggcaatttgtcgactcctatgaccccactatcgaaaacacctttacaaagttgatcaccgtgaatggtcaagagtaccaccttcagctggtggatactgctggtcaggatgaatatagcatctttccacagacttatagcattgacatcaacggttacatcttggtgtactccgtgactagcattaaatccttcgaggtcattaaggtgattcatggaaagctactggacatggtcggcaaagtgcagatacccataatgttagttggcaacaagaaagacctgcacatggagagggtcatctcctatgaggaaggcaaagctctggcggagtcgtggaatgctgcgttcctagagtccagcgccaaagaaaatcaaaccgcagtcgatgtgttccgtagaatcatcttagaagctgaaaaaatggacggcgccgctagccagggaaaatcaagctgttcagtgatgtag

SEQ ID NO: 17088 - DNA, 582 bp, Artificial Sequence
  Description of Artificial Sequence: Synthetic coding sequence
atggctgccatccgtaagaaactggtcatagtcggggacggggcttgcggcaaaacttgcctgctaatagtcttctccaaggaccagtttcccgaggtatacgtgccaacggtatttgagaactatgtggctgatatcgaggttgatggtaaacaggtcgagctggccttgtgggacaccgcaggacaggaggattacgacagactgcgacctctgagctaccctgacaccgacgtaatcctgatgtgcttcagtatcgactcccctgacagcttagagaatattcccgagaagtggactccagaagtgaagcatttttgtcctaacgtacctatcatccttgtcggtaacaagaaagatttgaggaacgatgagcacacacggagggagctggccaagatgaaacaggagcctgtaaagccagaagagggccgggatatggctaaccgtatcggggcttttgggtatatggaatgctctgcaaagacaaaggatggagtgcgcgaggtcttcgagatggccacgcgggcggcactccaggcccggaggggtaaaaaaaaatctggctgcctggttttatag

SEQ ID NO: 17089 - DNA, 591 bp, Artificial Sequence
  Description of Artificial Sequence: Synthetic coding sequence
atggctgccattcgcaaaaagctcgtcgtggtgggggatggtgcgtgtggcaagacttgccttcttatcgtgttctcgaaagacgagttccccgaggtgtatgtgccgaccgtattcgagaactatgtggccgatatcgaagtagatgggaaacaggtggaactagctctttgggacacagctggccaagaagattatgaccgcctgcgcccattgtcttacccagatacagacgtgatcctgatgtgttttagcgtagatagtcccgattcgctagagaatatccccgagaagtgggtcccggaggtgaagcacttctgcccaaacgttccaatcatactggtagcgaataagaaggaccttcggtcagacgaacacgtgcgaacagagctagcccggatgaagcaagagcccgtacgtacagacgatggacgagcgatggctgtgcgcatccaggcctacgactatctagagtgtagcgcaaagactaaggagggcgtgcgtgaagtcttcgagaccgcaacccgcgctgcgcttcagaagaggtatggttctcaaaatggctgtatcaattgttgcaaggtgctgtag

SEQ ID NO: 17090 - DNA, 582 bp, Artificial Sequence
  Description of Artificial Sequence: Synthetic coding sequence
atggcagctattagaaaaaagctcgtcatcgtgggagacggcgcatgcggcaagacctgtctgctcattgtgttcagcaaggatcagttccccgaagtatacgtccccacagtcttcgagaactacatcgcagacatcgaggtcgacgggaagcaagtcgaactggcgctctgggatacagccggacaggaagattacgatcgattgcggcctctgagctacccagatacagacgtcatccttatgtgcttttccatcgactcccctgattcgctggagaatatcccggaaaagtggaccccggaggtgaagcatttctgtcctaatgtacctatcatcctcgttggtaataaaaaggacctgaggcaagacgaacataccagacgcgagctggcaaagatgaagcaggaacctgtccggtctgaagaaggccgggacatggccaacagaattagcgcctttggctatttagagtgcagtgcaaagactaaagaaggcgtccgagaagtgtttgaaatggccacccgcgccggccttcaggtccgtaagaataagaggaggcgagggtgccccatcctgtag

SEQ ID NO: 17091 - DNA, 582 bp, Artificial Sequence
  Description of Artificial Sequence: Synthetic coding sequence
atggcggcaattcgcaaaaaacttgtaatcgtgggagacggggcatgtggaaagacgtgcctgttaattgttttttcaaaggaccaattccccgaggtctatgtgccaaccgtatttgaaaactatatcgccgacattgaagttgacggcaagcaggtggaactggcactctgggacacagctgggcaggaggactacgatcgcctgaggcctctgtcctacccggacaccgacgtgattctgatgtgtttttctattgattctcctgactccttggagaacatccccgaaaagtggactcccgaggttaaacatttctgtccaaatgtacccataattcttgtgggaaataagaaggacctcaggcaggatgaacacacgcgtcgcgaactggctaaaatgaaacaggaacccgtaagatccgaggaaggccgcgacatggccaaccgcatctctgcattcggatacctggaatgctctgctaagacgaaagaaggcgtccgggaagttttcgagatggccacacgggccgggctgcaggtcagaaagaataagcggcgacgcggttgtcccattttatag

SEQ ID NO: 17092 - DNA, 582 bp, Artificial Sequence
  Description of Artificial Sequence: Synthetic coding sequence
atggcggcaattcgaaaaaaactggtcattgtcggagacggggcatgcgggaaaacctgcctgttaattgtgttttctaaagaccagttccctgaagtttacgtgccaacagtctttgaaaactacattgccgacattgaggttgatggtaaacaggtcgaactggctctgtgggacacagccggccaggaagattacgataggctgagacctctgagctacccggataccgacgtaatcctgatgtgtttcagtatcgatagccccgatagcctggaaaatataccagaaaagtggactccagaggtgaaacacttctgtccaaacgtaccaatcatccttgtggggaataagaaggacctccgccaggacgaacatactcggcgggaacttgccaagatgaaacaggaacctgtgcgaagcgaggaaggtcgggacatggccaatagaatatctgcgttcggctatcttgagtgcagcgcaaagacaaaagaaggtgtaagagaagtgtttgagatggccactcgggcgggtctccaggtgcggaagaataaacgccgccgcggatgcccaattctgtag

SEQ ID NO: 17093 - DNA, 582 bp, Artificial Sequence
  Description of Artificial Sequence: Synthetic coding sequence
atggcggctatcaggaagaaacttgtgatagtcggcgatggagcctgcgggaaaacctgtctgctgatcgtgttctctaaagaccagtttcccgaggtttatgtcccaaccgtgtttgagaattacatcgctgatattgaggtggatggcaaacaggtggaactcgccctctgggacactgccggtcaggaggactatgaccgcttacggcccctcagctatcctgacaccgacgtgatcctcatgtgcttttctatagatagtccagacagcctagagaacattccagagaagtggacccccgaagttaaacacttctgcccaaacgtgccaatcatcttggttggaaacaagaaagaccttaggcaggatgagcatacccgcagagaactggccaagatgaagcaggaaccggtgagaagtgaggagggccgcgacatggctaatcgcatctcggccttcggctacctcgagtgttccgcgaaaacaaaagagggggtgcgcgaggtgttcgaaatggccaccagggcagggcttcaggtaaggaaaaataaacgccggcgtggatgccccatactctag

SEQ ID NO: 17094 - DNA, 600 bp, Artificial Sequence
  Description of Artificial Sequence: Synthetic coding sequence
atggccgccatccggaaaaagctggtgattgtgggcgacggtgcctgtggcaaaacttgtctcttgatagtcttcagtaaagaccaattccccgaagtatatgtacctaccgtcttcgaaaattatattgcagatatcgaggttgacggaaaacaggtggagttggcgctgtgggatacagcagggcaggaagactacgaccggctccggccactctcctaccctgacaccgacgtgattctgatgtgtttttctatcgattcccccgattcccttgaaaatattccagagaagtggaccccggaggtgaaacatttttgccctaatgtgccgatcatactggtgggtaacaaaaaagatctgaggaaagccggaacctggcggactggtagtgttcccctggccacattgtccgcccagccacgccccagaagggagtgcggcagatgcctgagatggcccttgggtctggcgtcccgttccgcaagaacttctgttggtggtgcggtccctttcagtgagatccctaaagccttccccacttgtccgctgccctcacaaggatatcggaattacccgcccactacaccagcctcctag

SEQ ID NO: 17095 - DNA, 582 bp, Artificial Sequence
  Description of Artificial Sequence: Synthetic coding sequence
atggccgccatacggaaaaagctggttatcgtgggcgatggggcgtgcggaaagacatgcctgttgatcgtcttctcaaaagaccaatttcccgaggtttatgttccaactgtgtttgagaactatatcgccgatatcgaggttgacgggaaacaggtcgaactggccctgtgggacacggccggacaggaagactatgaccgtttacgcccactgtcttatccagacacagacgtgatcttaatgtgtttctctattgattcccccgacagtctcgaaaatatccctgagaagtggacaccagaggtaaaacacttttgccctaatgtaccgatcatcttggtgggaaacaagaaggatctacggcaggacgagcatacccggagggaactggccaagatgaagcaagaacctgtgcggtcggaggagggaagggatatggcaaaccgcatcagcgcgttcggctatcttgagtgttccgcgaaaacgaaagaaggggtgcgggaagtcttcgaaatggctacccgggccggattacaggtgcggaagaacaaacgtcggcgtggctgtccgatcctctag

SEQ ID NO: 17096 - DNA, 582 bp, Artificial Sequence
  Description of Artificial Sequence: Synthetic coding sequence
atggcggccatacggaagaagctcgtaatcgtgggagacggtgcctgtggtaagacgtgcttgctgattgttttcagcaaagaccagttccctgaagtgtacgtccctaccgtcttcgaaaattatatcgccgacatagaggtcgacggtaagcaggttgaacttgccctgtgggacaccgccggccaagaagattacgaccggctcagacctctaagttatcccgacacggatgtcatcctgatgtgtttctctatcgattcaccagattcactggagaatataccagagaagtggaccccggaggttaaacatttctgccctaacgtaccgattattctggtaggcaacaagaaagacctgcgacaggatgagcacacacgtcgggaactggctaaaatgaagcaggagccagttagaagcgaagagggacgggatatggctaacaggataagtgcctttggctacttggagtgcagtgctaagactaaagaaggcgtcagggaggtgttcgagatggccacgcgggcaggcctgcaggtcaggaagaacaagcgccgtcgcgggtgcccaattctgtag

SEQ ID NO: 17097 - DNA, 582 bp, Artificial Sequence
  Description of Artificial Sequence: Synthetic coding sequence
atggccgcaatccgcaaaaagctggttattgtcggggacggcgcctgtgggaagacctgccttctgattgtgtttagcaaagaccaatttccagaggtctatgttcccacagtttttgaaaactacatcgccgatatagaggtggacggcaaacaggtcgaattggcactttgggatactgcgggtcaagaagactacgaccgcctcaggcccctctcttacccagatacggacgttattctgatgtgttttagcatcgattctcccgactccctggaaaacattcctgagaaatggacccccgaggtaaaacacttctgcccaaacgtgccaattatcctcgttggcaacaagaaggatcttcgtcaggacgaacacacccggagagagcttgccaagatgaaacaggagcccgtcagatctgaggaggggcgagatatggcgaatcgtataagcgctttcgggtacctggagtgctccgccaaaacaaaggagggggttcgtgaagtgtttgagatggcaacccgggccggactgcaggttcgtaagaacaaacgacgccgcggttgccccatcctgtag

SEQ ID NO: 17098 - DNA, 279 bp, Artificial Sequence
  Description of Artificial Sequence: Synthetic coding sequence
atggctgcaatcagaaagaagctggtgattgtgggggacggagcctgtggcaaaacttgccttctgattgtgtttagcaaggaccagttcccagaagtgtacgttcctactgtctttgaaaactatatagccgacattgaggtcgacggtaagcaagtggagctggcgctatgggatactgcaggtcaggaggactacgacaggctcaggcccttaagctaccctgatacagatgttatactcatgtgcttcagcattgatagccccgattctctgtag

SEQ ID NO: 17099 - DNA, 570 bp, Artificial Sequence
  Description of Artificial Sequence: Synthetic coding sequence
atggctgctatacgaaagaagctcgtgattgttggtgatggcgcctgtgggaagacctgtctgcttattgtgttctcaaaggaccaattccctgaagtgtacgtgcctactgtgtttgagaattacattgccgacattgaggtcgacggaaagcaagtggagttggcactgtgggacacagccggccaggaggattatgaccgtctgcggcctctgtcttacccagataccgacgtcattctaatgtgtttctcaatagattcccccgatagcctcgaaaatatccccgaaaaatggacaccggaagtgaagcacttttgccctaacgtgccaatcatactcgtggggaacaaaaaagatctgcgccaggatgaacatacccggcgggagttagcgaaaatgaagcaggagccagttcgctctgaagagggaagggatatggccaaccgcatctccgccttcggctacctggaatgctccgccaaaactaaagagggagttagagaggtctttgagatggctacccgggccggattacaggtgaggaagaataagaggcggaggggctag

SEQ ID NO: 17100 - DNA, 384 bp, Artificial Sequence
  Description of Artificial Sequence: Synthetic coding sequence
atggctgcgatcaggaaaaaattggtgatcgtgggggatggcgcatgcgggaagacctgcctgttaatcgtgttctcgaaggaccagttccctgaagtttatgtacctacagtcttcgaaaattacatcgccgatatagaggtcgacgggaaacaagtggaattggcactttgggacacggccggacaagaggactacgaccggttgcgccccctcagctaccccgatacagacgtgatcttgatgtgttttagcatcgactccccggattcactggaaaatattcccgaaaaatggactcccgaagtgaaacacttttgccccaatgtgccaattatcctggtggggaacaagaaagacttacgacaggatgagcacacatag

SEQ ID NO: 17101 - DNA, 690 bp, Artificial Sequence
  Description of Artificial Sequence: Synthetic coding sequence
atggtgagcatttcagggggcgaccttccaactggtctcgacttcatatctgcccccgaacccgctctttcctcatgtagtctgggcactagcgctggttggtcccccacaatggcagcaatcaggaagaaactggtgatcgtgggagacggtgcttgtgggaaaacgtgtttgctcatcgtgtttagcaaagatcagttccctgaggtgtacgtgcctacagtctttgagaactacatcgctgacatcgaagtagacggaaaacaagtagagctagccctgtgggacacggccggacaggaagattatgaccggctcaggcccctttcctatccagataccgacgtaatcctgatgtgcttttcaatcgactcccctgattctctggagaacatccctgagaagtggactccagaggtcaagcacttttgtcccaatgttccgatcatcctggttggcaacaaaaaagatcttaggcaggatgaacacaccaggcgggagttggccaaaatgaagcaagagcccgtgagatcagaggagggtcgggacatggcaaaccgaatcagtgctttcggataccttgagtgtagtgctaagacaaaggagggcgtacgagaggttttcgaaatggcaacaagagccggattgcaagtccggaaaaataagaggcgccgtgggtgcccaatctag

SEQ ID NO: 17102 - DNA, 510 bp, Artificial Sequence
  Description of Artificial Sequence: Synthetic coding sequence
atggccgccattcgaaagaaactggtgatagtcggggacggtgcttgcggtaagacctgcctcctcatagtgtttagcaaggatcagttccccgaggtctatgtccctaccgttttcgagaactacatcgccgatatagaggtggatgggaagcaggtcgagctcgcactgtgggatactgccgggcaagaggactacgacagactgcgccctcttagttatccggacactgacgtgattctcatgtgcttttccatcgactcacctgactcccttgagaacatcccagagaaatggactccagaagttaagcacttctgtcccaatgtccccattatcttggttggcaacaaaaaagatcttcgccaggatgaacataccaggcgcgaacttgcaaaaatgaagcaggagccggtcagatccgaagaaggtcgcgacatggctaaccggatttctgcgtttggctacctggaatgttccgctaaaactaaagaaggagttcgagagtag

SEQ ID NO: 17103 - DNA, 3144 bp, Artificial Sequence
  Description of Artificial Sequence: Synthetic coding sequence
atgatggcggccgaagctggttcagaggagggggggccggtgaccgctggtgcaggaggaggcggcgcagccgctggcagttctgcctaccctgccgtgtgccgggttaaaatcccggccgctctgcccgtggccgccgcgccctatccagggctggtggagaccggcgtggctggaaccctggggggtggagccgccctgggcagtgagttccttggcgcagggtcagttgctggtgccctgggcggagctgggctcaccgggggggggaccgccgcgggagtcgccggtgcagctgcgggggtcgctggagcggcagtggccggcccctctggagatatggctctgacaaagctgcctactagtctgctggccgagaccttgggtccaggaggaggattcccccccctacctcctcctccttacctaccaccactgggggccggccttgggacagtggatgaaggggattccctggatggcccggagtacgaggaggaagaggtggctatccccctaacagctcctccaaccaaccagtggtaccatggaaaacttgaccgcactattgccgaggaaaggctgagacaggcagggaagagcggatcttatctaatccgcgaatctgaccgaaggccgggttcctttgtgttgagcttcctatcacagatgaatgtggtaaaccattttcggattattgctatgtgcggcgattattatatcggtggtcgtagattttcttccttgtctgatcttataggatactattcccacgtgtcatgtctgcttaagggagagaagctgctatatcctgtggctccacccgagcctgtcgaggatagaaggagagtccgggctatcctgccctataccaaagtccctgacactgatgagataagttttttgaagggcgatatgttcatagtccataatgagcttgaggatgggtggatgtgggtgaccaacctgaggacagatgaacaagggctgattgtggaggacctggttgaggaggtggggcgtgaggaggaccctcacgaagggaaaatctggttccacggtaagatctcaaaacaggaggcgtacaacctgctgatgactgtaggacaggtctgcagctttctggtcaggccgtcagataatactccaggcgactactcactgtatttcaggacaaatgaaaacatccagcgctttaagatttgccctacccccaataaccagtttatgatgggtggccggtattacaactctatcggagatatcatcgatcattatagaaaagaacaaattgtggagggttactacttgaaggaacccgtgccaatgcaggatcaggaacaagtgttgaatgatacagtggacggcaaggagatctataatacaatccgtaggaagactaaggatgccttctacaagaacattgtcaagaaggggtatttgctgaaaaagggaaaaggtaagaggtggaaaaatttatattttattctggagggcagcgatgctcagctaatctacttcgagtccgagaagagagctaccaagccaaaaggcctcattgacctatcagtctgtagcgtgtacgtggttcacgactctttgttcgggcgccccaactgtttccagatcgtggtgcagcatttcagcgaggagcactacattttttactttgcaggcgaaacccctgaacaggctgaggattggatgaaaggcttgcaagccttctgcaacctgagaaaatcctctcccgggaccagtaataagcgtttgcgacaagtctccagcctggtcctgcatatagaggaagcacacaagctgccggttaagcatttcacaaatccctactgtaatatctacctaaattccgttcaggtggcgaagacccacgccagggagggccagaatccggtatggtcagaggagttcgtgttcgatgaccttccccctgatatcaatcgctttgaaataactctgtcaaacaaaacaaaaaagagcaaagaccctgatatcctttttatgcgctgccaactctcccggttgcagaagggccacgctaccgacgagtggtttctgctgtcaagccacattccccttaaagggatcgagccagggtctctgcgggtgcgcgctcggtattcaatggagaagatcatgcctgaagaagaatattctgaatttaaggagctgatccttcagaaggagctgcacgtggtctacgctctcagccatgtttgtgggcaggaccgcacattactggccagtatactgcttcgtatctttctgcatgagaagctcgagtccttgcttctttgcacactgaacgacagggaaatctccatggaggatgaagccacaaccctgttcagggctacaactctggcgtcaaccctgatggagcagtatatgaaggccacggccacacagttcgtccaccatgctctgaaggatagtatcctgaaaataatggagtcaaaacaaagctgcgagctgagcccgagcaagctggagaagaacgaggacgtgaacactaaccttactcatctgctcaacatattatccgaactcgttgagaagatctttatggcatcagagatcttgccacctaccctcagatatatttacggctgtctccagaagagtgtgcagcataaatggcctactaacactaccatgcgaactcgggtcgtgtctggattcgtgtttttaagacttatatgccccgccatcctgaacccccgaatgtttaacatcatctcagattcacctagcccaatcgccgctcgcacactgatcctggtggcaaaatctgtccagaacctggcaaacttagtggagttcggcgcaaaagaaccgtatatggagggcgtgaacccctttattaagagtaataaacacaggatgattatgttcctggatgagctggggaacgtcccagagctgccagatactactgaacattcccggaccgacttatcaagggacttggcggcgctgcacgagatctgcgttgcacactctgacgagctcagaacactgagcaatgaacgcggcgcccaacaacatgtgcttaaaaagctactagctataaccgaattgctacagcagaagcagaatcagtataccaaaactaacgacgtgaggtag

SEQ ID NO: 17104 - DNA, 2613 bp, Artificial Sequence
  Description of Artificial Sequence: Synthetic coding sequence
atgaagggatggtaccatggaaagctcgacagaaccatcgccgaagagcgactacgccaggcaggcaagagcggaagctaccttatccgagaatctgatcgacggcccgggagctttgtgctttccttcctaagccagatgaacgtggtgaaccattttaggatcatcgcaatgtgtggagactattacatcggaggcaggcggttctcttcactcagtgatcttataggatattatagccatgtttcctgtttgctgaagggagagaagctactgtatccagtggcaccccctgagccagtggaagacaggcggagagtgcgggccattctaccttacacgaaggtccccgacaccgatgagatctctttcctcaagggcgacatgtttattgtgcacaacgagctcgaagatggctggatgtgggtcaccaatctgaggaccgacgaacagggcctgatcgtcgaagatctggtagaggaggtaggtcgagaggaagatccccacgagggtaagatctggtttcacggaaagattagcaaacaggaagcctacaaccttttaatgacggtggggcaggtgtgcagctttttggtgagaccatcggataacactcccggcgattattctctgtacttccggacaaacgagaacatccaaagatttaaaatatgtccaactcccaataaccagttcatgatgggggggaggtactataacagtatcggcgatattatcgatcattatagaaaggagcaaatcgtggaaggatattacctgaaagaacctgtccccatgcaagatcaggagcaggtgctgaacgacactgtggacggaaaagagatttataacaccatcaggcgaaagactaaggatgccttctataaaaacatagtgaaaaaaggttatctcctcaagaaaggtaaagggaagaggtggaaaaatctgtactttatattagaaggctctgacgcccagctaatctacttcgagtccgaaaagcgggctaccaagccaaaaggccttattgacctctccgtgtgtagtgtatatgtggttcatgacagtctctttggccgccccaattgtttccagatcgtggtgcagcatttttcagaagagcactacattttttactttgcaggcgagacaccagagcaggcggaagattggatgaaaggcctccaggcattctgtaacctgcggaagagcagtccaggaacctctaacaagcgactgaggcaagtgagctcactggtattgcacattgaagaggcccataaactaccggtcaaacattttacaaatccatactgtaacatttatctgaattcagtccaagtagccaaaacccacgcccgagaaggacagaatcccgtctggtccgaagaatttgtctttgatgatctgcctccagacatcaataggtttgagatcacgctttctaacaagacaaagaagagcaaggaccctgacatattattcatgcgctgtcagttgtctcgcctccagaaggggcatgcaaccgacgaatggttcttactgtcgtctcacatccccctgaaaggaattgagcccgggagcctacgtgttcgggcccgatactccatggagaagattatgccagaagaagagtacagcgaattcaaagaactgatactgcagaaggagttacacgtagtgtacgcattatcccacgtttgtggtcaagacaggactttgctggccagcatcttactcagaatattcttgcatgaaaagctcgagtctcttcttttatgtacccttaacgatcgggaaatcagcatggaagacgaagcaacgaccctttttcgcgcaacaacacttgccagtactttgatggagcagtatatgaaagctaccgctacacaatttgtccaccacgcattgaaagactcgattctcaagataatggaaagcaagcaatcgtgtgagctgtctccttccaagctggagaagaatgaggatgtgaataccaacctgactcacctgctcaacatcctgagcgagctggtggagaagatcttcatggctagcgaaatattgccacccaccctgcgctacatctacgggtgtcttcagaagtctgtgcaacataagtggcccaccaacactaccatgagaactagggtggtgtctggctttgtttttttgcggctgatctgccccgccatcctgaacccgagaatgttcaatattatatcagatagcccttcacccattgctgcccggacccttatcttggtggcgaaatcagtgcaaaacttggctaatcttgttgaattcggtgccaaagagccttatatggagggggtgaacccgtttatcaagtcaaacaaacatcggatgattatgtttcttgacgagctgggtaacgtccccgaacttcctgacactaccgagcactccaggaccgatctgtctagagatttggctgctttacacgagatctgcgtggcccattctgatgagctgcggacactgagcaatgagcgcggcgcccagcagcacgtgcttaagaagctgcttgctataacagagctcttgcagcagaaacaaaatcagtacacaaagacaaatgatgtcagatag

SEQ ID NO: 17105 - DNA, 2646 bp, Artificial Sequence
  Description of Artificial Sequence: Synthetic coding sequence
atgtgcctggtgaaaagctggttcttgtccatacgatcacgatggtaccacgggaagctggatcggaccattgcggaggagagattgagacaggctggaaaaagcgggtcctacctcattcgggagtctgatcgtcgtcctggcagctttgttctttccttcttgtctcaaatgaacgttgtgaaccatttccgaatcatagccatgtgtggggattactatatcggcggaagaaggtttagttctttgagtgacctgattggatactatagtcacgtgtcctgcctgctgaagggagagaagctgctctacccggttgccccccccgagccagttgaagaccggagacgagtgcgtgcaattctgccttataccaaagtgccagacaccgacgaaattagctttcttaagggcgacatgttcatcgtacacaatgagcttgaggacggctggatgtgggttaccaacctgcgaaccgacgaacagggattaatagttgaggacctggttgaggaggtcggcagggaggaggatcctcatgagggaaaaatttggtttcatggaaagatcagcaaacaggaggcgtataatttgctaatgaccgtgggtcaggtgtgttcatttctggtgagacctagtgacaacacccctggagactactccttatattttcgtacaaatgagaatattcagcgatttaagatatgtccaactcccaacaatcagtttatgatgggaggacggtattacaattctattggcgacattattgaccattaccgcaaggagcagatcgtcgagggctactatctcaaggaacccgtccccatgcaggaccaggaacaggtattgaatgacacggtggatggcaaggagatctataatacgattcggaggaaaaccaaagatgcgttctacaagaatattgtaaagaagggctacttactcaaaaaaggtaagggtaagcggtggaagaatctttactttattctcgagggaagtgatgcccaactcatatattttgagtcagagaagagggccacaaagcctaagggcttgattgacttgagtgtttgcagcgtgtacgtggtgcatgactcattgttcgggcggcctaattgttttcagattgtcgttcagcacttctcagaagaacactacatcttctactttgccggcgaaacacctgaacaggccgaagattggatgaaaggtctgcaagctttttgtaatttaagaaagtcctctcctggcacttcaaacaagaggctgaggcaagtgtcaagcctggttttacacatcgaagaagctcataaactcccagtaaagcattttaccaatccatattgtaatatttacttaaactctgtacaagtcgcaaaaactcacgctagagagggacagaatcccgtgtggtccgaagaattcgtctttgacgacctcccccctgatattaatcggttcgagatcaccctgagtaataaaactaagaaatcgaaggaccccgatatcctgtttatgcggtgtcaactcagcagactccagaaggggcacgcaacagatgagtggtttctcctgtcctcacacatcccactgaaggggattgagccaggatcactcagggtgcgggcaaggtacagcatggagaagattatgcccgaggaggagtattcagagttcaaagagctcatcttgcaaaaagagctccatgttgtgtatgccctctctcacgtctgcggccaggacaggacattgctagcaagcatactgttacgcatcttcctacacgaaaaactagaatctctgcttctgtgtacacttaatgaccgcgagatcagtatggaagatgaggcaactaccctcttccgggccacaactttggcaagcaccttgatggaacaatacatgaaggctaccgcaacacagttcgtccatcacgcacttaaggactctatactgaagataatggaatctaagcaaagctgcgaattgtccccgtcaaaactggagaagaatgaggatgtcaataccaatttgacacatttgctcaacattctcagtgagctggtcgaaaagatttttatggcgagtgagatcctgcctcccaccctgaggtacatttacggctgtctgcagaaaagtgttcagcacaagtggccaaccaatacgaccatgcgtacccgggttgttagtggctttgtctttctgcgtttaatttgcccggcaatcctgaaccctcgaatgttcaatattatatcagattccccctcccccattgcggcccgtacactcattctcgtggccaagtccgtacaaaatctggcgaacttggtcgagtttggggcaaaggaaccttacatggagggcgtgaacccattcattaaatcaaataagcatcgcatgattatgttccttgatgagttggggaacgttcccgagctgcctgacactaccgagcacagcagaacagatctgtctagagacctcgctgccttgcatgagatttgcgtggcacactcagacgaattgcgaactctgtccaacgaacggggggcgcagcagcacgttttgaagaagctgctggcgataacagaactgttgcagcagaagcagaaccagtacactaaaactaatgacgtgcgctag

SEQ ID NO: 17106 - DNA, 2643 bp, Artificial Sequence
  Description of Artificial Sequence: Synthetic coding sequence
atgaggacagggtatagttcagtaccttcaaagttaagatggtaccatggaaagctcgacagaactattgccgaggagcggctccggcaggccgggaagtccgggtcctatttgatccgagagagcgaccggagacccggcagttttgtactatcattcttgtcacagatgaacgtagtgaaccacttcaggatcattgccatgtgcggtgattattacattggaggcagacggttttctagcctctctgacctgattgggtactatagtcatgtgtcatgtctgttgaaaggggagaaattgttgtaccctgttgcccctcccgagcccgttgaggataggcggcgggttcgagcaatcctgccttacacaaaagtacccgatactgacgaaatttccttcctaaaaggggatatgttcatagttcacaacgaattggaggatggatggatgtgggtcacaaatctgcggacagacgaacaagggctaattgtagaggacctggttgaggaggtaggccgcgaagaggaccctcatgagggcaagatttggttccacggaaagatttccaagcaggaagcatacaacctcttaatgaccgtaggtcaggtgtgttctttcctggtgcgtcctagtgacaataccccaggagattattcgttatacttcaggaccaatgagaacattcagaggttcaaaatctgtcccaccccgaataaccagtttatgatgggggggcgatactacaactccattggcgatatcatcgaccattataggaaggagcagattgtggaaggctattatctgaaagagcctgtgccgatgcaagaccaggagcaggtccttaacgatacagtggacgggaaggagatctataacaccattagacgaaagacaaaggacgcattttacaagaatattgtgaagaagggctacttgttgaagaagggtaagggcaaacgctggaagaatttgtactttattcttgagggttccgacgcccagctgatatacttcgaaagtgagaagcgcgctactaagcctaaaggccttattgacctgagcgtgtgctcagtctacgtcgtgcatgacagtctcttcggacggcccaattgtttccagattgttgtgcagcatttctccgaggagcactacatcttctattttgccggcgaaacaccagaacaggccgaggactggatgaaggggctgcaagcattttgtaatttgagaaaaagttcacccggcacaagcaataaaagattacgccaagtcagcagtcttgtgctacacatcgaagaggctcacaagctgcccgtgaagcattttacaaatccttactgcaacatttatctgaacagcgttcaggttgcaaaaactcacgcgcgagaagggcagaatcctgtgtggtccgaggaattcgtgtttgacgacctcccacccgatatcaacagatttgaaattaccctcagtaacaaaaccaaaaaatcaaaggacccagatatcttgtttatgcgttgccaactgtcaaggctgcagaagggtcatgccaccgatgagtggttcctcttatctagccacatacccctgaagggaatcgaacctggtagtctgagggtgcgggcccgctattctatggagaagataatgccagaggaagagtattccgagttcaaagagcttatccttcagaaggagctccacgttgtgtacgccctgtcacatgtgtgtggccaggaccggactttgctagcgtcaatcctgctcaggatctttctgcacgagaagctggaatctctgctgctgtgcaccctgaacgatcgggagatcagcatggaagatgaagccaccaccctctttcgggcaacaacattggcgagcacgcttatggagcagtacatgaaggcgactgccacacagtttgtccaccatgccctgaaggatagcattctcaaaatcatggagtccaaacagagctgcgagctgtcaccatctaagctagagaagaacgaggatgtcaacacaaacctgacacacctcctgaatatcctgtcagagctcgttgaaaaaatctttatggcgtcagaaattttacccccgacgctccggtacatatacggatgtctccaaaagtccgtccagcacaagtggcctactaacacgactatgcgcactagggtggtgtcaggattcgtattcctgagactaatttgccctgctattcttaacccccgcatgtttaacattatcagcgatagcccaagccctatcgcagctcgcaccctgattttagtggcaaagagtgtgcaaaaccttgcaaatctggtggaattcggcgcaaaggagccctatatggaaggcgtgaacccattcataaagtctaacaagcacaggatgattatgtttctcgacgaattgggcaacgtgcctgagctgcccgacaccacagagcacagtcggaccgacttgtcccgcgaccttgccgccttgcatgaaatctgtgtcgcccactctgacgagctgaggacgctctctaatgaacgtggggcccagcagcacgtactgaaaaagctcttggcaattaccgagttgctccaacagaagcagaatcaatatactaaaacaaacgacgtcaggtag

SEQ ID NO: 17107 - DNA, 2616 bp, Artificial Sequence
  Description of Artificial Sequence: Synthetic coding sequence
cgaggggacgcttccggctggggctgtagcgaaccgggccctggtggaccatggggctctcgtgccggacgggttgggcagtctagagctggttttaacatgatggcagcagaggctgggagcgaagagggcggacccgtcactgcaggcgcaggcggcggaggggccgccgcaggatcctctgcttaccctgctgtttgccgcgtgaaaatccccgccgccttaccggtggccgccgccccttacccaggactggtggagactggtgttgcgggaacgttaggcgggggcgccgcactcggctctgaattcctgggcgctgggtccgtggcaggggctttgggaggggctggcctcacgggggggggaacggcagctggtgtggcaggcgctgcagccggtgtggccggcgcggcggtggctggccccagcggggacatggctctgacaaaattacctacttctcttcttgcagagaccttaggacccggaggagggttccctcccctgccacctcccccatacctcccacctttgggggctggcctcggcactgttgacgaaggagactcacttgatggtccagagtacgaagaagaggaagtcgcaataccgctaaccgccccccctactaaccagtggtaccacggcaaactagaccgtaccatagcggaagagcgcctcaggcaggcgggtaagagtggctcctatttaataagagaatcagacaggcgtcctgggagctttgttttaagttttctttcgcaaatgaacgtggtgaaccacttcaggataatagcgatgtgcggagattactatatcggcggacggcgttttagtagcttaagtgacctcatcgggtattattcacacgtgtcctgccttctgaaaggcgaaaaactgctctatcctgtggcccctcccgaacccgtagaggaccgtaggcgagtgagagctatacttccttatactaaggtgcccgacacagatgaaattagtttcttaaaaggagacatgtttatagtgcacaatgagttagaggacggatggatgtgggtcacaaaccttcgtaccgacgagcaggggctcatcgtggaagacctcgttgaagaggttggcagagaagaagacccccacgagggtaaaatttggtttcatggcaaaatctccaaacaggaagcctacaacctgctgatgaccgtcggtcaggtgtgctccttccttgtgcgcccctcggacaacacgcccggggactacagcctgtattttcgaacaaacgagaatatccagagatttaagatctgccctacacctaataatcagttcatgatgggaggaaggtactataatagcataggagacattatcgaccattatagaaaagaacagatcgtagaggggtattacctcaaggagcccgttcccatgcaggaccaggaacaagtgctaaatgacacagtcgatggaaaagagatctataatactataaggagaaagaccaaggacgccttttacaagaacatcgtgaaaaaaggctacctcctaaagaaaggtaaggggaaacgatggaagaacttatacttcatcctcgaagggagcgacgcacagcttatctatttcgaaagtgaaaagcgggctaccaaacctaagggactgatcgatctctccgtgtgcagcgtgtacgtggtccacgactccttgttcggaaggcctaactgttttcagattgttgtgcagcatttctccgaagaacactacattttttattttgccggcgaaacaccagaacaggcggaggactggatgaagggtctacaggctttttgcaacttgcggaaatcaagtcccggtacaagtaacaagcgccttcgccaggtaagctcactggtgctgcatatcgaggaggcgcataagctgcccgttaagcacttcaccaatccctactgcaatatctacctaaatagcgtccaggtggccaagacccatgcaagagagggccagaatcctgtatggagcgaagaattcgtctttgatgacctgccaccagacataaaccggtttgagattacactctccaacaaaactaagaaatccaaggacccagacatattattcatgagatgccaactgtcacgactacagaaaggccatgctacggacgagtggttcttgctgagctctcacattcctctaaagggaatcgagcctggatctctaagagttagagccagatactccatggagaaaattatgcccgaggaggagtactcagaatttaaggagttgattctgcagaaagagctgcatgttgtgtacgcgctcagccatgtgtgtgggcaggatagaacgctgttggcgtccatccttctcagaatttttctccacgaaaagctcgaatctcttcttctttgcacccttaacgacagagagatttctatggaggatgaggccaccaccctgtttcgcgcaacaaccctggcttctactctcatggaacagtacatgaaggccacggcaacacagttcgtccatcatgcgttgaaggacagcattctgaagatcatggagagtaagcagtcatgtgagctcagtagctccaaattgcaaaaagcttag

SEQ ID NO: 17108 - DNA, 1161 bp, Artificial Sequence
  Description of Artificial Sequence: Synthetic coding sequence
atgaatccccagatccgcaaccccatggaacgcatgtacagagacactttttacgataactttgagaatgagccaatcctgtatggaaggtcctacacctggttatgttacgaggtgaagatcaaacgaggacgctctaaccttctgtgggataccggggtcttcagagggcccgtgctgccaaagcgccagtccaaccacaggcaggaagtgtatttcagatttgagaatcacgctgagatgtgcttccttagttggttttgtgggaatcggctgcccgcaaacaggagattccagattacatggttcgtctcctggaacccctgtttgccctgcgtggtgaaagtgacaaaatttttagccgagcacccaaacgtgaccttgactatcagcgcggccaggctgtattactacagggatcgggattggagatgggtcctgttgcgccttcacaaggcaggcgcccgcgtcaaaattatggattatgaggactttgcctattgctgggagaatttcgtgtgcaacgaaggtcaacctttcatgccatggtacaagtttgatgataactacgcttcactgcataggacactgaaagagatcttgcgcaaccccatggaagcaatgtacccccacattttctactttcacttcaaaaaccttcttaaggcttgcggccgaaacgagagctggctgtgctttactatggaagtgacaaaacaccattctgccgtttttcggaagcgaggagtctttcgtaatcaagtggaccccgagactcattgccatgcagaacgatgctttctgtcttggttctgtgacgacatcctgagtcctaacacaaattacgaagtcacgtggtacacgagttggtccccatgccctgaatgcgcaggtgaagttgccgaattcttagctcgccactctaacgtgaatctcacgatattcactgccaggctttgctacttttgggacactgactatcaggaagggttatgcagcctgagccaggagggagcttcagtaaagatcatgggatacaaagattttgtgtcctgctggaagaactttgtgtacagcgatgacgagccattcaaaccctggaaagggttgcagaccaactttaggctgcttaagcggagattgagagagatcttgcaatag

SEQ ID NO: 17109 - DNA, 348 bp, Artificial Sequence
  Description of Artificial Sequence: Synthetic coding sequence
atggggggttctttgagggtggccgtccttggagctccaggtgtgggaaaaacggctatcatccgtcagttcctttttggcgattacccggaaagacaccgtccaacagatggtccacggctgtaccgtcccgccgtattgctagacggtgcagtgtacgacttatctattagagatggagatgtagcaggcccaggatctagccctggaggacctgaagagtggcccgacgccaaggattggtctctacaggataccgacgccttcgttctggtttatgatatatgctctcccgactcctttgattatgtgaaagccctccgacagcgcatagctgagaccaggtag

SEQ ID NO: 17110 - DNA, 579 bp, Artificial Sequence
  Description of Artificial Sequence: Synthetic coding sequence
atgcaggcaataaagtgcgtagtcgttggcgacggagcagtaggcaagacttgtctgctgatttcctatactacaaacgccttcccaggtgagtacattcccactgtttttgacaattatagcgcaaacgtgatggtggatggaaagcctgtgaatttaggtctctgggacactgccggccaggaggactacgaccgactccggcctctttcctaccctcagactgatgtcttcctaatatgcttctctcttgtatccccagcatcgtttgagaatgtccgcgccaagtggtaccctgaggtgcggcatcactgtcctaataccccgatcatcttagtggggactaagctggacctccgtgatgacaaagacacgattgaaaaactgaaagagaagaaacttactccgatcacctacccacagggccttgccatggcaaaagaaattggcgcagtcaagtatttggaatgcagcgcactcacccagcgaggcctcaaaacggtctttgatgaagctattagggccgtgttgtgcccacctccggtcaagaagcgcaagcggaaatgtctcctgctgtag

SEQ ID NO: 17111 - DNA, 636 bp, Artificial Sequence
  Description of Artificial Sequence: Synthetic coding sequence
atgcaggctattaagtgtgtggtggtgggagatggtgccgttggcaagacctgcctcctgatctcatacaccaccaacgccttcccgggcgagtatataccaaccgtgttcgacaattactccgccaatgtcatggtggatggaaaacctgttaatctcgggttatgggatacagctggacaggaagattacgatagactgcgacctctgagttatccccaaaccgtcggagagacatatggtaaggatatcacaagcaggggaaaggataagccaatagcagatgttttccttatctgtttctccctcgtcagtcctgctagcttcgagaacgtgcgggccaagtggtaccccgaggtccggcaccattgcccgaatacccccatcattctcgtcggcacaaaactggacctcagggatgacaaggacaccattgaaaagttgaaggagaaaaaacttacacctattacatacccgcagggactggcgatggctaaggagataggcgccgtgaaatatctggagtgttccgcactgacccagagggggctaaaaacggtgttcgacgaggccattagagctgtgctatgtcccccgcctgttaaaaagaggaaaagaaaatgcttgctgttgtag

SEQ ID NO: 17112 - DNA, 579 bp, Artificial Sequence
  Description of Artificial Sequence: Synthetic coding sequence
atgcaggccattaagtgtgtggtggtaggtgatggtgccgtcggcaagacatgcctgctgatctcgtatacaaccaatgcatttccaggcgaatatattcctaccgtgttcgataactattctgccaatgtcatggtggattctaaacccgtgaacctgggcctctgggataccgctggtcaggaggactacgaccgccttcgtcccttatcatatccacagactgacgtcttcctcatttgtttctcacttgtctctccagctagctacgaaaatgtcagagcaaaatggtttccggaagtgcgccaccactgcccatccacccccataatcctagtaggtactaaactcgacctgcgggatgacaaggacaccatagagaagttaaaagagaagaaattagctccaatcacatatccccagggcctggcccttgctaaagagatagacagtgtgaaatatttagagtgcagcgctctgactcaaagaggcctgaaaactgtattcgacgaagccattcgagctgtgctgtgtccccagcccaccaggcagcagaaacgcgcttgttctctcctgtag

SEQ ID NO: 17113 - DNA, 261 bp, Artificial Sequence
  Description of Artificial Sequence: Synthetic coding sequence
atgcaggctatcaaatgcgtggttgtcggcgatggggcagtggggaaaacatgtctcctgatctcctacacaaccaatgcctttccaggagagtacatcccaactgtgcctggcaggccatgcgctttgctacaagacgcagaggccggtttgtcatcggacgtcgaaggcgcttgctggtgccagacccaagaggggaggatgacaggggaggctcctgcacccccatggccagccctgagaggtccccaccattcttag

SEQ ID NO: 17114 - DNA, 558 bp, Artificial Sequence
  Description of Artificial Sequence: Synthetic coding sequence
atgcaagcaatcaaggccgttggaaagacttgtctgcttatcagttatacgacaaatgcattccccggtgagtacattccaaccgtgtttgacaactactctgccaacgtgatggtcgattccaagcccgtgaacctgggcctgtgggacaccgcggggcaagaggactacgaccgcctgaggccactttcctacccccagacagatgtgttcctcatctgtttttccctggtgtctccagcatcctatgagaacgtgcgtgccaagtggttcccagaagtgcgacatcattgccccagcacgcctattatcctggtaggaacaaagttggacctcagagacgataaagacaccatcgaaaagcttaaggagaaaaagttggctcctattacctatccacagggactggccctggctaaggagatagattccgttaaatatctggagtgcagcgcactgacacagcgcgggctgaagaccgtcttcgatgaagccatcagagctgtattgtgccctcaacctaccagacagcagaagcgcgcatgcagcctcttatag

SEQ ID NO: 17115 - DNA, 447 bp, Artificial Sequence
  Description of Artificial Sequence: Synthetic coding sequence
atggtcgacagtaagcctgtcaatctcggactctgggatacagctgggcaggaagactacgatcgcctgcgccccttgtcctatccacaaaccgacgtttttctcatatgtttctccctggttagtcctgcctcatacgaaaacgtccgcgctaagtggttccccgaagtgcgccaccactgtccatcaacgcctattatcctggtgggaaccaagttggacctgagggacgacaaagatacaatagagaagcttaaagaaaagaagctggctcctattacataccctcaggggcttgcactggccaaagagattgacagtgtgaaatacttggaatgtagtgcattaactcaaaggggcctcaagacagtcttcgatgaagctatccgcgccgtgctttgtccgcagcccactaggcagcagaagagggcgtgcagcttgctgtag

SEQ ID NO: 17116 - DNA, 501 bp, Artificial Sequence
  Description of Artificial Sequence: Synthetic coding sequence
atgcaagcaatcaagtgcgtcgttgtaggtgatggagcagtagggaaaacttgtcttctgatttcctataccactaacgcctttcccggcgaatacattcccacagtgttcgacaattacagtgccaatgttatggtcgacagcaaaccggtgaatttgggtctgtgggacacagctggtcaggaggactatgatcggcttagaccgctctcatacccccaaacagacgtctttctcatctgcttttccctggtctcacctgcgtcgtacgagaatgtgcgtgcaaaatggttcccggaggtgcgccaccattgccctagtacgcctattatactcgtgggaaccaaattggatcttcgtgacgataaggacaccatcgaaaagctgaaagagaaaaagctggcgcccattacatacccccagggtctggcactggctaaagaaattgacagtgttaagtatctagagtgcagcgcactcactcagagaggcttaaagtag

SEQ ID NO: 17117 - DNA, 4785 bp, Artificial Sequence
  Description of Artificial Sequence: Synthetic coding sequence
atgaagctctacgtctttcttgtcaacacaggaactaccctcactttcgatactgagcttacagtgcagactgtggctgacctaaagcacgcgatccagagcaagtacaaaatagctatccaacaccaggttctggttgtcaatgggggggagtgtatggcagctgatcggcgcgtgtgcacatatagcgctgggaccgacacaaacccaatttttctgtttaacaaagagatgattctctgcgacaggccccccgctatccctaagaccaccttctcaactgaaaacgacatggaaattaaggtagaggaatcactaatgatgcctgcggtgtttcatactgtcgcttcgagaactcagcttgcacttgaaatgtacgaggtcgccaagaagctgtgctccttctgtgagggacttgtgcatgacgaacacctgcagcaccagggctgggccgctattatggctaacctggaggattgttctaattcatatcaaaaactgctcttcaaattcgaaagcatctacagtaattatctgcagtctatcgaggacatcaaactgaaattgacccacttgggtacggccgtttctgtgatggctaagattcccctgctggagtgccttaccaggcacagttaccgcgagtgcctgggaaggttggattcgttgcctgagcacgaagattctgagaaggccgagatgaaacgctctactgagctagttttatcgcctgatatgcccaggactacaaatgaatctctcctcactagcttccctaaatccgtggagcatgtctcacctgacactgctgacgccgagagtggcaaggaaattcgcgagtcatgtcagtccactgtccaccagcaggacgaaaccacgattgacaccaaggatggcgatttgcctttcttcaacgtgagccttctggactggataaatgtgcaggataggccaaacgatgttgaatcccttgtccgcaagtgtttcgactccatgtcaaggttagatccaagaatcatcagaccattcatcgctgagtgcagacagaccatcgccaaactcgataaccagaacatgaaggccattaaggggctagaggataggttatatgccctggatcagatgattgcaagctgcgggaggctggtgaacgaacagaaggagctggcacaggggttcctggccaaccagaaacgtgccgagaatctcaaagacgcctctgtgcttcccgacttatgcctctcacatgcgaaccagctcatgatcatgctgcaaaatcatagaaagcttctagatatcaagcagaaatgcacgaccgcaaaacaggagctcgccaataacctgcatgtgcgcctcaaatggtgttgctttgtcatgctgcacgcagaccaggatggcgagaagctgcaggccctgctgcgcttagtcattgagctccttgagcgggtaaaaattgtggaagcacttagcaccgtcccacagatgtactgcctggccgtagtggaagtcgtaagacggaagatgttcattaaacattatcgcgagtgggcaggcgccctcgtgaaggacgggaaaaggttgtatgaagcggagaaatcgaagcgcgaaagcttcggcaaactctttcgaaagtcgttcctgcggaatagactgtttagaggtctggacagctggccaccctctttttgcacacagaaaccgcgtaagttcgactgcgaacttcctgatatcagccttaaggacttgcagtttttgcagagtttctgccctagtgaggtacaaccgtttttgcgcgtgcctctcctgtgtgacttcgagcccctgcaccagcacgttctggctctgcacaatctggtgaaggccgctcaatccctcgacgaaatgagccagacgattaccgatctgctatctgaacagaaagcttctgtttcgcagactagtcctcagagtgccagtagcccccggatggagtccaccgccggcatcactacaaccacttccccacggacaccacctcctttaacagttcaggaccctctttgtcccgcagtttgcccactcgaagagttgtctccggacagcatcgacgcccacacattcgacttcgagacaataccacatcctaacatcgaacagaccatccatcaagtctctctggacctagacagcctggctgagtcgccagagtcagattttatgtctgctgtaaatgagtttgttattgaagagaacctgagctcccctaacccaatttccgatcctcagtccccggagatgatggttgaatccctctacagttctgtcatcaacgcaatcgattctcgtagaatgcaagatactaacgtgtgtgggaaagaagatttcggagatcatacctctctcaatgtacagctggagcgatgccgtgtggtcgctcaggactcacatttctctatccagacgatcaaggaggatctctgccattttaggacatttgtgcaaaaggaacagtgtgacttcagcaattcgctgaaatgtactgctgttgagatcagaaatattatcgaaaaagtgaaatgcagcctcgaaattacactgaaggaaaagcatcaaaaagagttgttgtctttgaaaaatgagtacgagggcaagcttgacgggcttataaaggagactgaggaaaatgagaataagatcaagaagctcaaaggcgaattggtttgtctggaagaggttctccaaaacaaggataacgaattcgccctggttaagcatgagaaagaggctgtgatctgcctgcagaacgagaaggaccagaagctcctggagatggagaatatcatgcactcccagaactgcgaaatcaaagagcttaaacaaagtcgcgaaatcgttctggaggaccttaaaaagttgcacgtcgaaaacgacgagaagctccagctcctccgcgcagaacttcaatcactggagcaatctcaccttaaggaattggaagacaccctccaagttcgtcacattcaagagttcgagaaagtgatgacagatcaccgcgtgtccttagaagagctcaagaaggagaatcagcaaatcattaatcagattcaggagtcccacgccgaaataatccaggagaaagaaaaacaactccaggagcttaaattgaaagtttctgacctatcggatactcggtgcaaattggaggtagaactagctctgaaggaagccgagactgatgagataaagattctgctggaggaatcgcgggcacagcagaaagagaccctgaagagcctgctggagcaggaaactgagaacttaagaaccgaaatttctaagttgaatcagaaaattcaggataacaatgagaactatcaggtggggttagctgaacttcggactctgatgaccatcgaaaaagaccagtgcatatctgaattaataagcaggcatgaggaagagagcaacatactaaaggcagagctgaataaggtcactagcctacacaatcaggccttcgaaatcgaaaagaaccttaaggagcagatcattgagttgcagtctaaactggatagcgagctgtccgcactcgagcgccagaaggacgagaagatcacccagcaggaagaaaagtacgaggctattatccagaacttggagaaggaccggcagaaactggtgagcagccaggagcaagaccgtgaacagttgatccagaaactgaattgtgaaaaggacgaagcaatccagaccgccctcaaggaatttaaactggagcgggaagtagttgagaaggaactcttagaaaaggtgaagcacctcgagaatcaaatcgcaaagtctcctgcgatcgattcgacgcggggcgatagctccagcttagtagccgagttgcaggagaaactgcaagaggagaaagctaaatttctggagcaactagaagaacaggagaagcggaagaatgaggagatgcaaaatgtgaggacttccctgatagcggagcaacagacgaattttaatacagtgctcaccagagagaaaatgcgaaaggaaaatataataaatgatttgtctgataagctcaagagcaccatgcagcagcaggagagagacaaagatttgatagagtcgctcagcgaagatagggccaggctcttagaagagaagaagaagttggaggaggaggtgtctaagctgaggtcctccagctttgttccctccccttacgtcgcaaccgcccctgagctctatggtgcctgcgcccccgagctgcctggggaatccgacagaagtgcagtcgaaactgccgacgaaggccgggtcgatagcgctatggagacgagcatgatgagcgttcaagaaaatattcatatgctctctgaagaaaaacagcgaatcatgttacttgaacggaccctgcagctgaaagaagaggagaacaaacgcctgaaccaacgacttatgagtcagagcatgtcaagcgtgagctcgcgccactcagagaagatagccatcagggacttccaggtgggtgacctcgtactgattattctggatgaacggcacgataattacgtgctcttcaccgtttcccccacactctattttcttcatagtgaatcattgccagccttggaccttaaaccaggcgaaggggccagtggagcgagtagaaggccctgggttctcggcaaggtaatggagaaggagtactgtcaagcaaaaaaggcgcagaatagattcaaagtgccactgggcaccaagttttaccgcgttaaggccgtgtcttggaacaaaaaggtgtag

SEQ ID NO: 17118 - DNA, 4776 bp, Artificial Sequence
  Description of Artificial Sequence: Synthetic coding sequence
atgaagctctacgtctttctggtaaacactggcacaacgctgacttttgacaccgaactgaccgtccagaccgtggctgacctgaagcacgctatccagtctaagtataaaattgctatccagcatcaggtattggtagttaatggcggagagtgcatggccgccgatcgtcgtgtgtgcacctattccgccggcaccgatactaatcccatttttctgttcaataaggagatgatactatgtgaccggccccccgctattccaaagactacatttagcacggagaacgatatggagattaaggtagaggaatccttaatgatgccagctgtcttccacaccgtagcaagcaggacccagttagctctggaaatgtatgaggtcgccaaaaagttatgctcgttttgcgagggactggttcatgacgagcatctgcagcaccagggatgggcagctatcatggctaatttggaggattgttcgaactcttatcaaaagctgttgttcaagttcgagtccatttacagcaattatctgcagagcattgaagatatcaagttaaaactgacccacctgggcaccgctgtgagtgtcatggctaaaatccccctgcttgagtgtttgacaagacactcatatcgtgagtgtttggggaggctggattctctccctgaacacgaggactcagagaaagccgagatgaagcggtcaacagagctagtcctgtcccccgatatgccgagaaccacaaacgagtcactgctgacctctttccctaagtccgttgaacacgttagtcccgacaccgcagacgcagagtcgggcaaggaaatccgggagagttgtcaatctaccgtacatcagcaggacgagaccactatagataccaaagatggggacctccccttctttaacgtttccctccttgattggatcaatgttcaggataggccgaatgacgtcgagtctctggtccgcaaatgtttcgatagcatgtcacggttggaccctcggatcattcggccattcattgcggagtgcaggcaaacaattgcaaaactggacaatcaaaacatgaaagccattaaaggattggaagacaggctctatgccctggatcaaatgatcgcttcttgcgggagactggtgaatgaacagaaagaattagcgcaagggttcctggcaaatcaaaagagggctgagaatcttaaggacgcctcggtgctgcccgacttgtgcttgtctcacgctaaccagcttatgattatgttacagaatcatcgaaagctcctggacatcaaacagaagtgcacaaccgccaagcaagagctggctaataacctgcacgtacgcctaaagtggtgctgttttgttatgctccacgcagatcaggacggggagaaactccaagctctcttgagactggtcatcgagcttttagagagggttaagatagttgaagctctcagcaccgtgccacagatgtattgcttagctgtcgtggaagttgtgaggagaaaaatgttcattaagcactaccgcgagtgggccggtgcccttgtcaaagacggaaagcgcttgtatgaggctgaaaagagtaagcgcgagtctttcggtaaactattccgcaaatcattcttaagaaaccgtctcttccggggacttgacagctggccgcctagcttttgcactcaaaaaccacggaagttcgactgtgagctgccagacatctctctaaaggatctccagttcctgcagtcattttgtccgagcgaggtgcaaccattcctccgtgtgccccttctgtgcgattttgagcctttgcaccagcacgtgctggcactgcacaatctcgtgaaggccgctcagagcctggatgagatgtctcagacaattaccgatctgctctctgaacagaaggccagcgtttctcagacatccccacagtctgctagctcacccagaatggaatcaaccgcggggatcactaccacgactagtccaagaacaccgccgcccttgaccgtgcaggatcctctttgccctgccgtgtgtcccttggaagagctcagcccagacagtattgacgcccatacctttgattttgaaactatccctcaccctaatatcgagcagactattcaccaagtctctctcgaccttgatagtctggccgagtcgcccgaaagcgattttatgagtgccgttaatgagtttgtgattgaagagaatctttcaagtcctaaccccattagtgacccacaatcccccgagatgatggtggagtccctgtatagctctgtcattaacgccatagattccaggaggatgcaagatacaaacgtttgtggaaaggaggatttcggcgaccacacatcactgaacgtgcagctcgagcgatgcagggtggtcgcgcaggactcgcacttctcgattcaaactataaaggaagacctctgtcactttcgtacatttgtccaaaaagagcagtgcgacttcagtaactcacttaagtgcacagctgtggaaatccgaaacatcatagagaaagtgaagtgttctctcgagatcactttgaaggaaaaacaccagaaagaattgttgagcttgaaaaacgagtacgagggcaaactggacgggcttattaaagagacagaggagaacgaaaataagatcaaaaagctgaagggggaactcgtgtgcctggaggaagtgctgcagaacaaagacaacgagttcgccctggttaaacatgagaaggaggccgtgatttgtctgcagaacgaaaaagaccaaaagttattggaaatggagaacattatgcatagtcaaaattgtgaaatcaaggaactcaagcaaagccgggaaattgtgttagaagacttaaaaaaactccatgtggagaacgacgaaaaactgcaactgttgcgcgcagagctccagtctctcgagcagagtcatcttaaagaacttgaggatacgctccaagtccgacatatacaggagtttgaaaaggtgatgacagaccatcgtgtctcactggaggaattaaagaaagagaaccagcagattattaatcagatccaggaaagccatgcggaaatcatccaagaaaaagagaaacaattgcaggagctaaaactgaaagtgagcgacttgtcggacacccgttgcaaacttgaggtggagctggcattaaaggaggccgaaacagatgagatcaagatactgttggaggaaagccgggcccaacaaaaagaaaccctaaaatctttattggaacaggagacagagaatctgagaaccgagataagcaaactaaatcaaaagatccaggacaacaatgagaactaccaggtcgggctcgctgagttgaggacattaatgaccattgagaaagaccagtgtatctcagaattaatttcaaggcacgaggaggagtctaatatacttaaggctgagctcaataaggtgacaagtctacataaccaggcattcgagattgagaaaaacctcaaagagcagattatagagttgcaaagcaaattagattcggagctgtcagcgcttgaacgtcagaaagatgaaaaaattacccagcaggaagagaagtacgaggctattatccaaaacctcgagaaggacaggcaaaagctcgtgagttcccaggagcaagacagggagcagctcatccagaagctgaactgcgagaaagatgaggccattcaaacagccttaaaggagttcaagttggaacgggaagtggtcgagaaggaactgcttgagaaagtaaagcacctggaaaatcagatcgcaaagtcccccgctatcgatagcacaaggggcgacagctcgagcttagtcgctgaactacaagagaagctccaggaggagaaggcaaaattcctagaacagctggaggagcaagagaagaggaaaaacgaggaaatgcagaatgtgcgtacttcactgatcgctgagcagcaaaccaatttcaacaccgtgctcacgcgtgagaaaatgcgtaaggaaaacataataaacgacctatccgacaagttgaagtccaccatgcagcagcaagaaagggacaaagatttgattgagtcattatcagaggacagagctagactacttgaggagaagaagaaactagaggaggaggttagcaaactgcgaagcagcagcttcgtgccatctccatacgtcgctacggcccccgaactgtatggagcgtgtgcacccgaactacctggcgagtccgatcgatctgcagtagagactgcggacgaaggcagggtggacagtgccatggagacatcgatgatgtctgtccaggaaaatatccacatgctgtctgaggagaaacagcggatcatgctcctagagaggacgctgcagctgaaagaggaggagaacaaaagactgaaccagcggttgatgagtcagagcatgtcttcagtgagctcgagacacagcgagaagattgccatcagagactttcaggttggtgacctggtcctgatcatcctcgatgaacgacatgacaactacgttctattcacagtctcacctactttgtacttcctccactccgagagcctcccggccctcgacctgaaacccgcatcaggagcgtctagacgaccctgggtgctcggcaaagtgatggaaaaggaatattgccaagccaagaaggcacagaacaggttcaaggtaccattgggcaccaagttttaccgggtgaaggccgtctcctggaataagaaggtatag

SEQ ID NO: 17119 - DNA, 48 bp, Artificial Sequence
  Description of Artificial Sequence: Synthetic coding sequence
atgaaactttacgtgtttttggtgaataccggcactaccctaacgtag

SEQ ID NO: 17120 - DNA, 4776 bp, Artificial Sequence
  Description of Artificial Sequence: Synthetic coding sequence
atgaagctgtatgtcttccttgtcaataccggcactacactgacctttgatactgagctgacagtgcaaaccgtggccgatctgaaacacgcgatccagagtaaatataaaatcgcaattcagcaccaggtgctggtggttaatggcggggagtgtatggcagctgaccgccgggtttgtacgtattctgccgggaccgatacaaatcccatttttctcttcaacaaggagatgattctatgtgacagaccccccgccattcctaaaaccacgttctctacagaaaatgatatggaaattaaggtggaagaatcacttatgatgcccgccgtgttccatactgtggctagtcgaactcaattagcgctggagatgtacgaggtcgctaaaaaactctgtagcttctgcgagggattagtacacgacgagcatctccaacatcagggctgggcagccattatggcaaacctggaagattgtagtaacagttatcagaagttactgtttaaatttgagtctatctatagcaattacctgcaatccatcgaagatatcaaactgaaactcacacacttgggaacagccgtatccgtcatggcgaaaattccactattggaatgtctgacccgccacagctatagagagtgcctgggacgtctggacagcttgccagaacacgaggactcagagaaggcggaaatgaagcggagcaccgaactggtcctaagtcccgatatgcccagaaccactaatgagagcctactcacgagcttccccaaatcagtagaacacgtttcccccgacaccgccgacgcagaatctgggaaggaaatcagagagagttgccagagtacagtccaccagcaggatgagaccactatagataccaaagacggagacctccctttttttaatgtatctttgctggattggatcaacgtgcaggataggccgaatgacgttgagtcactcgtgcgaaagtgtttcgactccatgagccggctggatccgaggatcatccgaccctttatcgccgaatgccgccagacaattgccaagcttgacaatcaaaatatgaaggctattaaaggactcgaggatcgactgtacgctctcgatcagatgatagcatcctgtgggaggctggttaacgaacagaaggagctggcacaggggttccttgctaatcagaaacgagctgagaatctgaaagacgcatccgtcctccctgatctctgtctttcccatgcaaaccagctcatgatcatgttacagaatcatcggaaattgttggacataaaacagaagtgtaccacggcaaaacaagagcttgctaacaacctgcacgtgaggctcaagtggtgttgcttcgtgatgcttcatgctgatcaggacggagaaaagttgcaggctcttttgcggctggtcattgaactgcttgagcgggttaaaattgtagaggccttgtccactgttcctcagatgtactgtcttgccgtagtggaagtggtgagaaggaagatgttcatcaagcactatcgcgaatgggccggagccctggtgaaagatggtaagaggctgtatgaagctgagaaatcaaaacgcgaaagtttcggaaagctattccggaagtcatttctgaggaaccgtctattccggggacttgactcttggcctccgagcttttgtacacagaagccgcgcaaatttgactgcgaacttccagacataagtctgaaggatctgcagtttctccagtcattttgtcctagtgaagtgcagccctttctaagagttccccttctttgtgactttgaaccgttgcaccagcacgtcctcgcgctgcacaatctcgtgaaggccgcgcagtccctggatgagatgagtcaaacgatcacagatttgctttctgagcagaaagcctccgtgtcccaaacttctccgcagtccgcctccagcccccgaatggagagcacggccggcatcactacaactacgtcccctaggaccccgccccctctgaccgtgcaggatcccttatgcccagcagtctgcccacttgaggagctttcaccggacagcatcgatgcacacacattcgacttcgaaactatccctcaccccaacatagagcagaccatccaccaagtctcgctggatctagattctctggcagaatctcccgagtccgacttcatgagtgctgttaacgaatttgtaattgaagagaacttaagtagcccaaatcctatctctgacccacaatcccccgaaatgatggtcgaatctctgtactcctcagtcatcaatgccatcgatagccgcagaatgcaggacacaaatgtgtgtggcaaagaggactttggcgatcatacgagtctaaacgtccagctcgaacggtgccgggtggtggctcaggatagccactttagcatccagacaatcaaagaggacctgtgccacttccgtacttttgtacagaaggagcaatgtgatttcagcaacagcctgaagtgtacagcggtggagataagaaacattatcgaaaaggtaaaatgcagcttggagataacactgaaggagaaacatcagaaggagctgctctccttgaaaaacgagtatgagggcaaattagacggtctgatcaaggagaccgaagagaatgaaaataagattaaaaagctgaagggcgaacttgtgtgtctcgaggaagtgctgcagaacaaagataatgagttcgctctcgtgaagcatgagaaggaggccgttatctgcctgcagaacgaaaaagaccagaaactactggagatggaaaacatcatgcattcgcagaactgtgaaataaaagagttgaaacagtcgagggagattgtgctcgaggaccttaaaaagctccatgtggaaaacgacgagaaactgcagcttcttagagctgagcttcagtcacttgaacagtcgcaccttaaggaactggaggataccttacaagtccggcatatacaggagttcgagaaggtgatgaccgaccaccgggttagtctggaagaactgaaaaaagaaaaccaacagatcattaaccaaatccaggagtcccacgctgagataattcaggaaaaagagaaacagctgcaagagctaaagttaaaagtcagtgacctgagtgacacacgatgcaaactcgaggttgagctagctttgaaagaggctgagaccgatgagattaaaatattgttagaagagagccgggctcagcagaaagaaacattgaagtccctcctcgaacaggaaactgagaacctaagaacagagatcagcaagcttaatcagaaaatccaggataacaacgaaaactatcaggtgggcctggctgaactgagaactctgatgaccatcgagaaagaccagtgcatttcagaactcatcagcaggcacgaggaggagtctaatatcctaaaggctgagctcaacaaggtgaccagtctgcacaatcaggcctttgaaatcgagaagaatttgaaagagcagattatcgagctacagagcaagttagatagtgagctttcagcacttgagcgccagaaggatgagaaaattactcagcaggaagagaagtacgaagcaattatccagaacctggaaaaggaccgccagaaactggtatcaagccaggagcaggatcgcgagcagctgattcagaaacttaattgcgagaaggacgaggccatacagacagcgctgaaagagttcaaactagagagggaggtggtggaaaaggagttactcgaaaaagttaaacatttagaaaaccagattgccaagagccctgctattgactcaactaggggagacagttccagcctggtcgccgagctgcaagagaagctccaggaagagaaagcaaagtttctcgagcagctggaagagcaggagaagcgtaaaaatgaagagatgcaaaacgtccggacctccctgattgctgagcagcaaaccaactttaataccgtgctgaccagggaaaaaatgagaaaggaaaatatcataaatgaccttagtgacaaactcaagtcaactatgcagcagcaagaaagggataaggatttgatagagagtctaagtgaggatcgggccaggctgttagaggagaaaaagaaactcgaagaggaggtctccaaactccgtagcagctccttcgtgcctagtccctatgtggccactgctcctgagctctacggagcttgtgcccccgaacttcccggagagtccgacagaagcgccgtggaaacagctgatgagggtagagtggacagcgccatggagactagtatgatgagtgttcaggaaaatatccatatgctgagtgaggaaaagcagcggatcatgttactcgaaaggacactccagctgaaagaggaggaaaataagcgactcaatcagcgactcatgtcacagtccatgtctagcgttagttctcggcactccgagaagatagctatccgcgactttcaagtaggtgatctcgttctcattatactggacgaacgacacgacaactatgtcctcttcactgtgagtcctaccttatattttttgcactccgagagcctcccagctctagacttaaaacctgcctccggcgccagccggcgcccatgggttttgggtaaggttatggagaaagaatattgccaggcaaagaaagctcagaatagatttaaggtacctctgggaacaaaattctatagagttaaagccgtgtcatggaacaagaaggtatag

SEQ ID NO: 17121 - DNA, 6471 bp, Artificial Sequence
  Description of Artificial Sequence: Synthetic coding sequence
atgagcgacacacccagcactgggttctctattatacaccctacctcatcagagggccaggtgcctccaccgcgccatctctcccttacccaccctgttgtggcgaagaggatctctttttacaagtcaggcgacccccagttcggcggcgtccgagttgtggtgaacccccggtctttcaaaagtttcgacgccctgctggacaacctgagcagaaaagtcccactgccctttggagttagaaacatctctactcctagagggcgtcactccattacgagactggaagaactcgaggatggtgagagttacctgtgttcccacggacgcaaagttcagcctgtcgatctcgacaaagctcgcagacgcccaagaccctggctgtcaagtagggccatatctgcgcactccccaccccaccccgtggccgtcgccgccccaggcatgcctaggccgccaaggtccctcgtagtgtttcggaacggcgaccccaagacaaggagagccgtcctgttgtctagacgggtcacccaatcatttgaagcattccttcaacatcttaccgaagtgatgcagcgcccggttgtcaaactctatgcgactgatggtaggcgagtgccttccttgcaggccgtgatcctgtccagtggagcggtcgtcgcggcaggtcgcgaaccatttaagccaggcaactacgacatccagaagtacctcttgcccgcaaggctgcccggcatctcccagagggtttaccctaaggggaacgccaaaagtgaatccagaaagatcagtacccacatgtcctcgagctccaggagtcagatatattctgtgtccagtgagaaaacgcacaataatgactgctatctcgactactccttcgtgccagaaaaatatttggccttggaaaaaaacgattctcagaacctgcctatatatcctagcgaagacgacatcgaaaaatccatcattttcaaccaggacggaactatgactgtggagatgaaagtcagatttaggattaaagaggaggagacgattaagtggaccacgactgtgtcaaagacagggccctctaacaacgatgagaaaagcgagatgtcattccccggcaggaccgagagcaggtcaagtggacttaaacttgcagcctgttcatttagcgcggatgtgtcaccaatggagcggtcttcgaatcaggaaggatcgttggcagaggagattaacattcagatgactgaccaggtggctgagacatgttccagcgcttcctgggaaaatgcaacagtcgacactgatatcatccaaggcacccaggaccaagccaaacaccgattttatcggccccccaccccaggccttcgtagggtccgccaaaagaaatcggttatcggttctgtcaccctggtgtcagaaacagaggtgcaggagaaaatgattggccagttttcctacagcgaagagagggaatcaggtgagaataaatcagagtaccatatgtttacccacagctgttctaagatgagctccgtgagcaacaagccagtgctggtgcagattaataataacgaccaaatggaagaatcctccctcgaacggaagaaggagaacagtttgctcaaatcttcggcgatatccgccggggtcattgagattacttcacagaaaatgctggagatgtcacataataacggattgccaagcacaataagtaacaacagtatcgtggaagaggatgtcgtggactgtgtcgttctcgacaacaagaccggcatcaagaatttcaagacatatggcaacactaacgacagattcagccctattagtgcagacgctacccacttctcatccaataatagcggtaccgacaaaaatatcagcgaggccccagcctccgaagcctcttcaacagtgacagctcggattgataggttaatcaatgaattcgcccaatgtgggttaactaaactacccaagaacgagaagaagatactaagcagcgtcgcaagtaagaaaaagaagaagtcccgccagcaggcgatcaacagccgctatcaggacggtcagctcgcgacaaaggggatcctgaataagaacgagcggatcaatactaagggtcgcatcaccaaggagatgatagtccaggactcagactcccctctgaaaggaggcattctgtgcgaagaagacctgcagaagtccgacacggtcatcgagtcaaatacgttttgctctaagagtaatctgaatagcacaatctccaaaaacttccatcgtaataagttgaacacgacccaaaattcaaaggtgcagggtcttctaactaagcgtaagagtaggagtcttaacaaaatcagtctgggggcccccaagaagcgagagatcggtcaacgcgacaaggtttttcctcacaatgaatctaaatattgcaaatcaaccttcgagaataaatcactgtttcacgtcttcaatatactggagcagaagcccaaggatttttacgcccctcagtcgcaagccgaggtggcttctggctatctaagaggaatggctaagaagtctctggttagcaaagtgacagacagccatatcacactcaagagccaaaagaaaagaaagggtgacaaagttaaggcctctgcaatcttgtcgaaacagcatgccacgactagggccaattccctcgcctctctcaagaagccggactttcctgaggccatcgcccatcattctattcaaaattacatccagagctggctacagaatattaacccataccccacgcttaagccgataaagagtgccccagtatgtaggaacgaaacctctgttgtgaattgctccaacaattctttctcaggaaacgacccacatacaaacagcgggaagattagcaatttcgttatggagtctaacaagcacattactaaaattgcgggcctgacgggtgacaatttgtgcaaagaaggcgacaagtctttcatcgctaatgacactggtgaggaggatttacacgagactcaagtgggctcattgaacgacgcctacctggtgccactgcacgagcattgcaccctgagccagagcgctatcaatgaccacaacaccaagagtcacatagcagctgaaaaatctggtcctgaaaagaaactcgtgtatcaggagatcaacctagcgcggaagaggcaaagtgtggaagctgctattcaggtggaccctatcgaggaagaaacacctaaggacctgctcccagtacttatgctgcaccaacttcaggccagtgttcccggcatccataaaactcagaacggagttgtgcagatgcccggctcactggccggggttccctttcactccgccatttgcaattcctcgaccaatctgctgctggcctggttactagtgctgaatctgaaaggatctatgaattcattttgtcaggtggatgcgcacaaggccacgaacaagagttctgagacccttgcactcctagaaattctgaagcatatcgccatcactgaggaagcagacgatctgaaggcggccgtggcaaacctagttgagtctaccacgtcccacttcgggctgtcagaaaaggaacaagacatggtccccattgatctttctgccaactgtagcaccgttaacatccagtccgtccctaagtgctctgaaaacgagagaactcagggaatctcttcacttgacggtggatgttcggcatccgaggcctgtgctccagaggtctgcgtcctggaagtgacatgttcaccttgtgagatgtgcactgtaaacaaagcctattctccgaaggagacatgcaacccttctgacactttttttccctccgatggttacggcgtagatcaaaccagcatgaataaagcttgcttcctgggcgaggtttgctctctcaccgacactgtcttttccgacaaagcttgtgcccagaaagaaaaccacacatatgagggtgcgtgtcccattgatgagacttacgtgcctgtcaacgtctgcaacactattgactttctcaactcgaaggaaaacacctacacagataacttggacagcacggaggagttagagcgcggcgatgacattcaaaaggacctgaatatactgactgaccctgaatataaaaatggattcaatacgcttgtctctcaccagaatgtctccaacctaagcagctgcggcctctgtctgtcagaaaaggaagccgagctcgataaaaaacattcatccctggatgactttgagaactgttcgctccgcaagttccaggacgagaacgcctacacgagttttgatatggaagagccgcgcacttctgaagaacctggcagcatcactaacagcatgacctcctccgagaggaacatcagtgagctggagtccttcgaagaattggaaaatcacgatacagacatattcaacacagtagtcaacggcggggaacaggccacagaggagttgattcaggaggaagtcgaagcttccaagaccctggaactgatagatatcagctcgaagaacatcatggaagagaagcgaatgaacggcatcatatacgagatcatttcaaagcgattagctactcccccctccttagacttctgttacgatagtaaacagaattctgagaaagaaactaacgagggcgaaaccaagatggtgaagatgatggtcaaaacaatggaaactgggtcctacagcgaatcgtcgccagatctgaagaagtgtattaagtcaccggttacttctgactggtctgactaccggcccgactcagattccgaacagccatacaagacttcctctgatgatccaaatgactcaggagaactgacacaggaaaaagagtataacatcggcttcgtgaaacgggcaatagaaaagctgtacgggaaggcggatattattaaaccatctttttttccaggttcgacccgaaagtcccaggtgtgcccttacaattcagtcgaattccagtgcagtagaaaagcgtcgctatatgacagcgagggccagtcattcggatcttccgaacaggtgtccagttcctcaagtatgctacaggagtttcaggaagagaggcaggacaaatgtgacgtgtccgctgtccgagacaactactgccgcggcgatatcgtggagcccggaactaaacagaacgacgattctcgaattctgaccgatatcgaggaaggtgtcctgatcgataaagggaagtggcttctcaaggagaatcatttactgagaatgtcgtccgagaaccccggcatgtgtggaaatgccgatactacatcagtggacactttgctggataacaattcatcggaggtgccctactcacactttggtaatcttgcaccaggccccacgatggacgagctaagcagctccgaacttgaggagctcacccagcccctggaactgaagtgtaactattttaatatgccacatggctcggacagcgaacctttccatgaggacctgcttgatgtgcgcaacgagacatgcgcgaaggaaaggattgcaaaccaccacactgaggagaaaggctctcatcagagtgaacgcgtctgcacctcggtgacacattctttcatctcggctgggaataaggtctatcctgtgtcagacgatgccattaaaaatcagccgctgccaggctccaacatgattcatggtaccctgcaggaggcggacagtcttgacaaactctatgcactctgcgggcagcactgccctatcctgaccgtcatcatccagccaatgaatgaggaggatcgaggattcgcctaccggaaggagtccgatatcgagaactttttaggcttttatttatggatgaaaatccatccatacctcctacagacggataagaacgtgtttagagaggagaacaacaaggcttcaatgaggcagaaccttatcgacaacgctattggggatatctttgatcagttctatttctcgaacactttcgatctgatgggaaaaaggcggaagcagaaacgaatcaacttcctaggcttggaagaggaagggaatttaaagaaattccagcctgacctgaaggagcgcttctgtatgaacttccttcacaccagcctactcgtcgtaggaaatgtggacagcaatacacaagacctgtcggggcagaccaacgaaattttcaaggccgtggacgaaaataacaatctattaaacaaccgattccagggcagccgtaccaaccttaaccaggtggtgcgggaaaatattaactgccactactttttcgagatgttaggccaagcctgtctcttggatatctgtcaagtagagacgagtctgaacatttccaaccgcaatatcctagaactctgtatgttcgagggcgaaaacttgtttatttgggaggaagaggatatcctgaaccttacggatctcgaaagcagcagggaacaggaagacttgtag

SEQ ID NO: 17122 - DNA, 1212 bp, Artificial Sequence
  Description of Artificial Sequence: Synthetic coding sequence
atgacaccccctctgctccaccatgacctgaaaacacagaacatccttctcgataatgaattccatgtcaaaattgctgactttgggctttcgaaatggcgtatgatgtcattatcccagtcccgcagttccaaatcggctccagagggggggacgattatatacatgccgccagagaactacgaacccggccagaagagccgggcctcaatcaaacatgacatatactcctacgctgtgattacatgggaggttctgagccgcaagcagccttttgaagacgttactaacccactacagatcatgtatagcgtgagccaagggcacaggcctgtgattaatgaggagtctcttccttatgacattccacatcgagctaggatgatcagcctaatcgaatcgggatgggcccagaatcccgacgagcggccatcatttcttaagtgtctaattgagttagagcccgtacttagaactttcgaagagatcaccttcctggaggctgtgatacaactcaagaagactaaacttcagagtgtcagtagcgctattcatctctgcgataaaaaaaagatggagctttctctgaatataccggtgaaccacggaccacaggaggagtcttgtggatcctctcagctacatgagaactcagggtcacccgaaacttccagatccttacctgctccacaggacaacgactttctctcccgcaaggctcaggattgctactttatgaaactgcaccactgtcccgggaatcacagctgggactccactatctccgggtctcagcgcgccgccttctgcgaccataagacaacgccatgcagcagcgcgattataaaccctctttcaacagcaggcaattccgagagactgcagccaggaatcgcacagcagtggattcagtcaaagcgggaggatatagttaaccaaatgaccgaggcctgtctcaaccaaagcctggatgcgctcctctctagagacctgattatgaaggaagactacgagctcgtctcaacaaagccaactcgtacctccaaggttcgacagctgctcgatacaaccgacatccagggagaggagtttgccaaggtgatcgtacagaaacttaaggacaataaacagatgggattgcagccctatccagaaattcttgtggtttcccgaagcccatcactgaacttgcttcagaataaaagcatgtag

SEQ ID NO: 17123 - DNA, 10377 bp, Artificial Sequence
  Description of Artificial Sequence: Synthetic coding sequence
atggagaggtcagggtgggccagacagacctttcttctggccctgcttctgggggccaccctgcgggcgagagccgccgcagggtattaccccaggtttagcccattctttttcctatgtacccaccatggggaacttgagggtgacggcgagcaaggggaagtgctgatcagcctgcatatcgctggcaaccccacctactacgtgcccggccaggagtatcacgttacaatctcaacctctacatttttcgacggcctgctggttacgggattgtatacttccactagcgttcaggcttctcaatccatcggaggttctagtgcctttggtttcggaataatgtctgatcatcagtttggaaaccagttcatgtgcagtgtggtggcttcgcatgtgagccacctgcccaccaccaacttaagctttatctggattgccccccccgctgggactgggtgtgtcaacttcatggctaccgccacacaccgtggtcaggtcattttcaaggatgccctggctcagcaactgtgtgaacaaggcgcgcccaccgacgtaactgtgcatccacacctggcggagattcactccgactctatcatactaagagatgatttcgactcttaccatcaactgcagctaaaccccaatatttgggtggagtgcaacaactgcgagactggggagcagtgtggagcaattatgcatggtaacgcagtcacattttgcgaaccttatgggcccagggagttaattaccactggtctgaacaccaccacagcatctgtgttacagttctcgataggatcaggctcctgcagattttcttactccgatccgtctattatcgtcttatatgcaaagaataatagtgcagattggatccagctagagaaaatcagagcaccttccaacgtatcgactataatacacatcctgtatctgccagaggatgccaagggcgaaaatgtgcagtttcagtggaaacaggaaaacctccgtgtgggcgaggtgtacgaagcctgttgggccctagataacatcctcatcataaatagcgctcataggcaggttgtcttggaagactccttggacccggtggataccgggaactggctatttttccccggggccacagttaagcactcctgccagtccgacggaaatagcatctacttccatgggaacgaagggagtgaatttaactttgccacaacaagggacgtcgatttgtcgacagaggacatccaggagcaatggtccgaagagttcgaatcccagccaaccggatgggacgtgctgggagccgtgatcgggaccgagtgcgggactatcgaaagcggtctctctatggtgttcttgaaggatggtgaacggaaactgtgtacaccctcaatggatacaacaggttacggtaatctaaggttctacttcgtaatggggggaatctgtgatcctgggaattcacatgagaacgatatcatactgtatgcaaaaatagagggtcggaaggagcatattacactggacacactcagctattccagttataaggtaccttcactcgtgtcagtcgtgattaatcccgagttacagacccctgctacaaagttctgcctcaggcagaaaaaccaccaggggcataacagaaacgtttgggctgtagacttcttccacgttctgcccgtccttccatccaccatgagccacatgatccaatttagtatcaatctgggttgcggcacacaccagcccggcaactctgtgagtctcgagtttagtacgaatcacggaaggagctggagtctcctccacacagagtgcctccctgagatctgcgcagggccacacttgccgcactcaacagtgtattctagcgaaaactacagtggctggaatcgcatcacgattcccctgccgaacgccgccctaacccgcaacactaggattcgttggcgccagacaggtccaattctggggaatatgtgggctatcgataatgtttacattggcccgagctgtctcaagttttgcagcggtcgcggccagtgtacgcggcacggatgtaagtgcgacccaggcttttctggtcccgcttgcgagatggcttcccagacttttcccatgtttatttctgaatctttcggatctagtagactgtctagctatcacaacttttactccattagaggcgcagaagtaagttttggatgtggggtgctggcatccggaaaggcgttggtgttcaataaggacggacgccgccagctgatcacatcattcttagattcatctcagtcccgattcctgcagtttaccttgcgactcggatcaaagtccgttctgagcacttgtagagcccccgaccaaccaggggagggggtccttctgcactactcatatgacaacggcataacttggaagttactcgaacactactcctacttgagctaccacgagccaagaataattagtgtagaactgccaggagatgccaagcagttcggcattcagtttagatggtggcagccttaccacagctcccagcgcgaagatgtctgggctattgacgaaatcatcatgactagtgtattattcaacagtatctccctcgattttactaacctcgtggaggtgacacagtctctcggattttaccttggcaatgtgcagccatattgcggccatgactggactctttgctttactggcgactcaaagcttgcctccagcatgcggtatgtggagacccagagcatgcagattggcgcgtcatacatgattcagttcagtctggtgatgggttgtggtcagaagtataccccccatatggataatcaggtgaaactggagtattcaaccaatcacggattgacatggcatctcgttcaggaggaatgtctcccgtcaatgccaagctgtcaagaatttacatccgctagcatttaccatgcaagtgagttcacacaatggcggagggtcattgtcctgctccctcagaagacatggtctagtgctactcggtttcgttggtcacagtcttactatacagctcaggatgaatgggctctggattctatctatatcggccaacagtgtcccaacatgtgctctgggcacgggtcatgcgatcacggaatctgtaggtgcgatcaaggctatcagggtactgaatgccacccagaagcggccctcccttccactatcatgagcgactttgagaatcaaaatggatgggagagtgattggcaggaagtgatcggaggagagatcgttaagcccgagcagggatgcggcgtgatctcaagcggtagctctctctatttctccaaagcagggaagcgtcagttggtgtcctgggacctcgatacttcttgggtagactttgtccagttttatatccaaatcggaggcgaaagcgcatcgtgtaacaaacctgacagtcgggaggagggagtgctgctccagtatagcaacaacggcggtatacaatggcatctcctggccgagatgtatttcagtgatttttccaaaccacggtttgtctacttggaactgcctgccgccgcaaagaccccctgcaccaggtttagatggtggcagccagtgtttagcggggaggactatgatcagtgggcagttgacgacatcataatcctgtccgaaaagcagaaacagattattcctgtgatcaacccaactttgcctcagaacttctatgaaaaacctgcatttgattaccctatgaatcagatgagcgtgtggttaatgttggccaatgaaggcatggtcaagaatgagactttttgtgccgccactcctagtgctatgatttttggtaagagcgatggggataggttcgccgtaactcgcgacctaacacttaaacctgggtatgtgctgcagtttaagctgaatattggatgcgccaaccagtttagctctactgcgccagtgttgctacagtactctcacgacgccgggatgagctggtttttggtcaaagaaggctgttatcccgcttcagctggcaaaggatgcgaaggtaattcccgcgagttgagtgaaccaacaatgtatcacacaggtgatttcgaggagtggacacggatcacaatagtgattccccgatccctggcctcctcaaaaactcgctttcgatggatacaggagtcctcgtctcagaaaaacgtgcctccttttggactggacggcgtgtacatttccgagccttgtccgagctattgcagcggacacggtgattgcattagtggcgtgtgcttctgcgatctgggttatacagcggcacaagggacctgcgtcagtaatgtgcctaatcacaatgaaatgtttgatcgattcgaagggaaactctctccactgtggtacaaaattactggagctcaagttggaacgggctgcggcaccctaaacgatggcaaaagtttatactttaacggcccaggcaaacgagaggccaggaccgtgcccctcgacactcggaacatccgactcgtccagttttatattcagatagggtctaagacctctggaatcacttgcatcaaaccaaggacccggaatgagggtctgatcgtgcaatattccaacgacaacggcatcttgtggcacctgctgagagaattggatttcatgtcattcttggagccacaaataatcagtatcgacctgcctcaggacgccaaaacgccggcaacagcgttccgctggtggcagcctcagcacggaaagcacagtgcacagtgggcactagatgacgttctgatcggaatgaatgacagcagtcaaaccgggttccaagacaaattcgatggttccattgatttacaggccaactggtacaggattcagggtggccaggttgatatcgactgcctctccatggatacagccctcatcttcacggagaatattggcaaacctcgatacgctgaaacatgggatttccacgtgtcagcctccacttttctccagtttgagatgtctatgggctgtagcaaacccttttctaattcgcactccgtgcaactccagtatagcctgaataacggaaaggactggcacctggttacggaggaatgcgtccctccgaccatcggctgcctgcactacacagagtctagcatctatacttccgagcgcttccagaactggaagcgcatcacagtctacttgccactgtccaccatctctccccgcactcgctttaggtggatccaagcgaattacaccgtgggagccgatagctgggcaatcgataacgtggtactggcctcaggttgcccctggatgtgcagcggaagagggatttgcgacgctgggcgctgcgtctgtgaccgggggtttggcggtccctactgtgtccctgtggtacctcttcctagcatcctgaaggacgacttcaatggcaatcttcaccccgatttgtggcctgaggtctatggcgctgaacggggcaatctgaatggcgagactatcaaaagtgggacatcactgatttttaagggcgaaggcctgcggatgcttatttcgcgcgatcttgactgcacaaacactatgtacgtgcagttctctctaaggttcatcgcaaagtctacccctgaacgatcccattctattcttctgcagttctcaattagcggaggaatcacatggcatttgatggacgagttctacttccctcagacaaccaacattctcttcatcaatgtgccactgccctacactgcccagaccaatgccactagatttagactgtggcagccttataacaacggcaagaaggaggaaatttggatagtagatgatttcatcatcgatgggaacaatgtgaacaatcctgtgatgctactggacacctttgactttggcccccgagaggacaactggttcttctatcctggtggtaacattggactgtattgcccatacagctctaaaggggctcctgaggaggacagcgccatggtatttgtttccaacgaagttggagaacacagcatcacaaccagggacctgaacgtgaatgagaataccatcatccaattcgaaataaacgttgggtgctctaccgattcctctagcgcagaccccgtgaggctggagttctctagggatttcggggccacctggcatttgctcctgccattgtgttaccacagctctagtcacgtctcttcactttgttctaccgagcatcatccatccagcacgtactacgcggggacgatgcaggggtggcgcagagaggtagttcatttcggaaagctccacctgtgtggtagcgtccgttttcggtggtatcagggcttttaccctgcaggcagccagccggtgacatgggctatcgataacgtgtatattggaccacaatgtgaagagatgtgcaacggacagggctcatgcatcaatgggaccaaatgtatctgcgatcctggatatagtggacccacctgtaagatcagcacgaaaaatcctgactttctgaaagatgactttgaggggcagctggagtcagaccgttttctccttatgagcgggggtaagccaagtcgtaagtgcggtatcttgagcagcgggaacaacctgttcttcaatgaggacggacttcggatgcttatgacgcgtgacctggatctgagccatgcccggtttgtgcagttttttatgagactaggatgtggcaagggggtcccggacccgcggtcacaacccgtcttgctgcagtattctttgaatggtggcctttcatggagcctattgcaggaattcctcttttccaatagcagcaacgtgggtaggtatatcgccctggagatcccgctgaaggcacggtcagggagtacaagacttaggtggtggcagccctctgagaatggccatttttactcaccgtgggtcattgaccaaatcctgattgggggtaacatatccggaaatacagttctggaggatgactttaccacattggattctcgcaagtggctgttgcatcccggaggcacgaaaatgcccgtttgtggcagtacaggcgatgcccttgtgtttatcgaaaaggccagcacgagatacgtcgtgagcactgacgtggcagtgaatgaggactcattccttcagatcgactttgctgcttcatgttccgtgactgacagctgttacgcaatcgagttggaatattctgtggatctgggtctgtcgtggcacccactcgttagagattgtctgccaactaacgttgaatgctctcggtaccatttacagcgtatcctggtctcggatacttttaataagtggacaagaatcaccctcccactccccccctacacgcgatctcaggcaacccgcttcaggtggcaccaacccgccccatttgacaaacagcagacatgggctattgataacgtgtacatcggagatggatgcatcgacatgtgcagcggccatggacgttgtatccagggcaactgtgtttgtgacgagcagtgggggggtctgtactgcgacgatccggaaacgagccttccaacgcagcttaaggataactttaacagggcacccagctcgcaaaactggctgaccgtcaacggcggtaagctatcaacagtgtgtggcgcagtcgccagcggaatggccttacacttctccggcggctgttcacggctgttggtaactgttgacctgaacctcaccaacgcagagtttatccagttttacttcatgtacggatgcctgattacccccaacaatcgcaaccaaggagtgctacttgaatattccgtgaacggagggatcacatggaacctcttgatggagattttctacgatcaatactccaaaccggggttcgtcaatattctgctaccccccgatgctaaggaaattgccacgcgctttaggtggtggcagcccaggcacgatggacttgatcaaaacgactgggctatcgataacgttctcataagtggatccgctgatcagcgtaccgtgatgctcgacacattctccagcgcgccagtaccacagcacgaaagatcaccagcagacgccggcccagtggggaggattgccttcgacatgttcatggaggataagacgtctgtgaatgaacactggctcttccatgacgattgtacagtagagcggttctgtgattctcccgatggcgtaatgctttgcggatcacatgacgggcgggaggtgtacgctgtgactcatgacttaacacccaccgaaggctggatcatgcagtttaaaatcagcgtgggctgtaaagttagtgagaagatcgcacaaaaccagatacacgtccagtacagcacagactttggcgtgagttggaactacttggtcccacagtgtctccctgccgatccaaagtgttccgggagtgtgagtcagccaagtgttttttttcctacaaagggatggaagcggatcacgtaccccttgcccgagtccctggtgggtaatccggtccggttcaggttctaccagaaatactccgacatgcaatgggccattgataatttttatcttgggcccggctgtttggataattgccgcggccacggagattgcctccgagaacagtgcatttgcgatcctggatactcaggtccaaactgctatctcactcacacactgaagacctttttaaaagagagattcgactcagaagagatcaaacctgatctctggatgtcacttgagggcggcagcacatgcacagagtgtgggattctggccgaagatacagcgctgtattttggtggctcaaccgtgcgtcaggcagtaacacaggatcttgacctgcgaggagctaaattcctgcagtattggggccgcataggatccgagaataatatgaccagctgccatcggcccatctgccgcaaggagggagtgctgctcgattactctacagatggaggtattacttggacactgctgcacgagatggactaccagaagtacattagtgttcgccacgattatattttactgcccgaggacgcacttacaaacaccacccgtctacggtggtggcagcctttcgttatttccaacggaattgttgtgtcaggggttgagcgggcacagtgggccttggacaatatactgataggcggagcagagatcaatcctagccagctggtcgatacatttgacgacgagggtacctcccacgaggaaaactggtctttttaccccaatgccgtgcggaccgctggtttctgtggcaacccatcttttcatctctactggccgaataagaagaaagataagacacataatgccctgagctctcgcgagctcatcatccagccaggctatatgatgcagttcaagatcgtggtcggttgtgaggccacttcatgtggcgatctgcatagtgtcatgctcgagtacaccaaggacgccagatctgactcctggcagttagtgcagactcagtgcctaccttcaagctcaaacagcatcgggtgcagtccgttccaattccacgaagctactatctacaactcggtgaactcttcaagctggaagagaatcaccattcagctgcccgaccacgtgtcaagtagcgccactcagttcaggtggatccagaaaggcgaagagactgagaagcagtcttgggcaatcgaccacgtgtacatcggggaggcatgtccaaagttgtgctccgggcacgggtattgcaccaccggggcaatctgcatctgcgatgagtcttttcaaggagacgattgttctgtgtttagccatgatctgcctagctatatcaaggacaacttcgagagcgcaagagtgaccgaggccaactgggagaccatccagggaggagtcataggtagcggttgtggacagctggccccatacgcccatggagactctctgtactttaatggttgccaaatcagacaagcagccacaaagccacttgacctgaccagggcctctaaaattatgttcgtgttacaaatcgggagcatgtctcagactgatagctgtaactcagacctgagcgggccacacgccgtcgacaaggccgtgctccttcaatatagcgtaaacaacggtattacatggcatgtgatcgcccagcaccagccgaaagactttacccaggcccagagggtgtcttacaatgtgccgctcgaggccaggatgaagggggtacttctaagatggtggcagcccagacataacggaacaggccatgatcagtgggcattagaccacgtggaagtggtcctgacacgaaaacaaaattacatgatgaacttttcacgacagcacggattaagacatttttataaccgtagaagacggtccctgcgccgctacccttag

SEQ ID NO: 17124 - DNA, 10383 bp, Artificial Sequence
  Description of Artificial Sequence: Synthetic coding sequence
atggagcgcagcggctgggctcgccagacattcttgctggccctgctgttgggggcgacactgagggccagagctgcagccggttattaccccaggttctccccctttttttttctatgtactcaccacggcgagctggaaggtgacggtgagcagggggaggtcctcattagcctacatatcgccggtaacccaacttactatgttccgggccaggagtaccatgtgacgattagcacctcaaccttttttgacgggctcctggtgaccggactgtatacaagtacttcagttcaggcaagtcagagcatcggcggatcgagtgccttcggttttgggattatgtctgatcaccagttcggaaaccagttcatgtgctcggtagttgctagccacgtttcccacctccccacgactaaccttagcttcatctggatcgctccacccgctgggacaggctgtgtaaattttatggcaacagccacccaccgaggccaagtgatcttcaaagatgccctggcacagcagttatgtgagcagggggcccccacagacgtcacggtccatccccatctggccgaaattcattcggacagtattatcctcagggatgactttgacagttatcatcagttgcaactaaatcctaacatctgggtcgagtgcaacaattgcgagacaggggaacagtgtggcgccatcatgcacggaaacgccgtgactttttgtgagccctacggaccgagggaactcattaccacaggcttgaacacgaccacagcctcagtactgcagttctccatcggatccggctcatgccgcttctcctactcggacccctctattatcgtcctttatgcaaaaaataattcagctgattggatacaactggagaagatcagagccccctcgaacgtgtcaacaattatacacatactgtatctccccgaagatgctaagggcgaaaacgtgcagttccaatggaagcaggaaaatctcagagtgggcgaggtctacgaggcctgttgggcccttgataatatcctgattatcaatagtgcacaccgtcaggtagtcctggaggactcactggaccctgtcgacacaggaaattggctatttttccctggagcgacagttaagcactcctgtcaaagcgacggcaactcaatctacttccacggaaatgagggttccgagtttaatttcgccaccaccagggacgtggatctgagcactgaagatatccaggagcaatggtccgaggagtttgagagtcagcccaccggatgggatgtacttggcgctgtcattggcaccgagtgtggcacaattgaaagcgggctctccatggtcttcctgaaagacggtgaacgaaagctgtgtactcctagtatggatacgactggatacggcaatctgcgattttacttcgtcatgggaggcatttgcgacccagggaacagtcatgagaacgatataatcctttacgctaagattgagggacggaaagaacacattaccctcgataccttatcttatagttcctacaaggtaccatccttggtctctgtcgtcataaacccagagctgcagacccctgccaccaaattctgtctccggcagaagaatcaccagggccacaacaggaatgtgtgggctgttgattttttccatgtgctcccagtgcttccctccactatgtcccatatgatccagttcagcatcaacctaggatgcggaactcaccagcctggcaactctgtgtctctggaattcagcactaatcacggccgatcatggtctcttttacatacagaatgccttcctgagatttgcgctggcccccacctacctcacagtaccgtttattcttccgaaaattactccggctggaatcgtattacaatcccactgccaaatgctgccctgacgaggaacactagaatccggtggagacagactggaccaatactaggcaatatgtgggcaattgacaatgtgtacattggtccttcgtgcctcaaattttgttccgggcgcggtcaatgcacacgccatggctgtaaatgcgatccaggattcagtggccccgcatgcgaaatggcaagccagacgtttcctatgtttatcagtgagtccttcggcagttcccgcctctctagctaccacaatttctacagcatccgcggtgccgaggtctcatttgggtgtggtgtgcttgccagcggcaaggctctggtgttcaataaggatggccgtaggcagctaatcacttcctttctggacagtagccagagtaggttcttgcagtttacccttcggttaggtagcaaaagcgtgctcagcacatgccgcgcccccgaccagcccggagaaggcgtgctcctccactactcctatgacaatggcatcacctggaagctattggagcactactcctatctgagctaccatgaacctcgtattatttctgttgagctgcctggagatgccaaacaattcggcatccagttcagatggtggcagccttaccactccagccagcgtgaggatgtctgggccatagatgaaattataatgacaagcgtcttgttcaattcaatttcccttgatttcacaaacctcgtggaggttacccagtcactcgggttctacttgggaaacgtgcagccgtattgtggccatgactggaccctgtgttttaccggagacagcaagcttgcatcttctatgcgctacgtggaaacccaaagcatgcagattggagcctcttacatgattcagttcagcctggtgatggggtgcgggcagaagtacacccctcatatggataaccaagtcaagctggaatactctacaaaccacggcctcacatggcatctcgtgcaagaggagtgtttgccttcaatgccatcctgccaggaatttacttctgctagcatctatcacgcctcagagtttacccagtggcgccgagtcatcgtgctactgccacagaaaacgtggtcttctgccacccgtttcagatggagtcagtcctattacactgcccaggatgaatgggcccttgactctatatacattgggcaacagtgccctaacatgtgttccggccacggctcctgtgaccacggcatatgtcggtgcgaccagggctaccaggggacagagtgccacccagaagccgctttgcctagtaccattatgtcagactttgaaaatcagaatgggtgggagagcgattggcaggaggtcattgggggcgagatcgtaaagcccgagcaggggtgtggcgtaattagttccgggtcttcactgtacttcagcaaagctgggaaaaggcagctggtgagctgggacctagatactagctgggtggactttgtgcagttctatatccagattggtggagagagcgcctcctgcaataaaccagactctagggaagaaggcgttcttttacagtatagcaacaacggaggcatccagtggcatcttttggccgagatgtatttctccgacttttccaagcccagattcgtgtatttggagctgcctgcggctgcaaagacaccttgtaccaggttccgctggtggcaacccgtgttttcgggcgaggactatgatcagtgggcagttgacgatatcatcatcctttcagagaaacagaagcaaataatacctgtcatcaatccaaccctacctcaaaacttctacgaaaaacctgcatttgactacccaatgaaccagatgtctgtttggctaatgcttgcaaacgagggaatggtcaagaacgagaccttttgtgcggcaaccccaagcgcaatgatctttggtaagagtgatggcgaccgttttgccgtcacaagggatctgacactgaagcccgggtacgtcttacagttcaaactcaatattggctgcgccaatcagttctcatccacagcccctgtgcttctgcagtatagccatgacgctggcatgagttggttcctcgtgaaggaggggtgctatccggcttctgccggtaaaggctgtgaaggcaattcacgagagctctcggagccaacaatgtaccacactggagatttcgaggaatggacgaggattactatagtcatcccacggagcctggcctctagtaaaaccaggtttcgttggattcaagaatcctccagccaaaaaaacgtgccgcccttcggcttggatggggtgtacataagcgaaccgtgtccttcatattgctccggtcacggggactgtatcagcggcgtgtgtttttgtgacctggggtacactgctgcccaaggcacttgcgtgtcaaacgtgccaaatcacaatgaaatgttcgacagatttgaaggaaagctgagtcccctgtggtacaaaatcacaggagcccaggtaggcaccggttgcggcaccctaaatgacggcaaaagcctatattttaatggccccgggaaacgcgaggcgaggaccgtgcctttggacacacgaaatatcaggctggtgcagttttacatccagatcgggagtaaaacatccgggataacatgtattaaacctcggactaggaacgagggcctgatagttcaatatagcaatgataatggcatcctctggcatctgctccgagagctggatttcatgtccttcttggagccccagattatcagtatagatcttccgcaggacgccaagactccagcaacagcgtttagatggtggcagccgcagcatggcaagcactccgcccagtgggcgctggacgacgtccttattggtatgaacgattcatctcagacaggattccaagacaagtttgatggcagcatcgatctccaggctaactggtacaggattcagggtggccaggtagatatcgactgtctctccatggataccgctctcatctttactgaaaacataggaaagccacgttatgctgaaacatgggacttccacgtctccgcttctaccttcctgcagtttgaaatgtctatgggatgtagcaaaccattttcaaacagtcacagcgttcagctgcagtatagcctgaataacggtaaagactggcacctggtgacagaggagtgtgttcctcccacaatcggttgtcttcattacactgagtccagtatatacacttcagaaagattccaaaattggaagcgaattactgtgtaccttcctctgtccaccatctcaccccgaactaggtttagatggattcaggccaattacaccgtgggggcagattcctgggctatagataatgtggtgcttgcatctgggtgtccatggatgtgctccgggcggggcatttgcgacgctggccgatgcgtgtgcgatcgagggttcggaggtccatactgtgtgcccgtggtccccctacccagcatccttaaagacgacttcaatggcaatttacacccggatctgtggccggaagtgtatggggctgaacggggcaacctgaacggggaaaccattaagtccgggacctccctgatattcaagggggagggtctgcgtatgctcatttcacgcgatttggattgtaccaacaccatgtacgtacagtttagtctccgcttcatagcgaagagcactccagaacgaagtcattccatcctgctgcagttctctatctccggcgggatcacatggcaccttatggatgaattttatttcccccagaccacaaacattttgttcattaatgtgcctctgccatatactgcccagaccaatgcaacacgcttcagactgtggcagccatacaataacgggaaaaaggaggaaatttggatcgtggacgacttcattatcgatggcaacaatgtcaacaacccagtgatgctccttgatacattcgacttcggcccgagggaagacaactggttcttctaccccggaggcaacattggattatattgcccttactcctctaagggtgccccagaagaggactccgccatggtctttgtttctaatgaagtgggcgaacatagtataacaaccagagaccttaatgtgaacgagaacactattattcaatttgagatcaacgtagggtgttctacagacagtagttccgcagatccagtgaggctggaatttagtagggatttcggagccacttggcatttgctgcttcccctctgttaccactcttcctcccacgtgagctccctctgctcaacggagcaccacccgagctcgacctattacgccggaaccatgcagggatggcgcagagaggtggtgcatttcgggaaactacatctctgcgggtccgttaggttcagatggtatcagggtttctatccggctggctcccagcccgtgacatgggccattgacaatgtctacataggcccacagtgcgaggaaatgtgtaacggccagggctcttgtattaatggcacgaaatgcatctgcgatcccggctatagcgggcccacctgtaaaatttctacaaagaaccctgacttcttgaaggacgactttgagggacaactggagtccgacagattcttgttaatgagcggcggtaagccatcacgcaagtgtgggattctatccagtgggaataacctcttctttaatgaagacggcctacggatgctgatgactcgagatcttgacctgtcgcacgcccgttttgtgcagttctttatgagactaggctgcggaaaaggcgtacctgatccaaggagccagcccgtgctgctccagtacagtctcaacgggggtctgtcctggtccctgctgcaggagttcctgttcagcaacagcagcaatgtcggtaggtacatcgctcttgagattccccttaaggctaggtcaggttccacaaggctcagatggtggcaaccatctgagaacggccatttctactccccttgggttattgaccagatcctgataggtggcaacataagcggcaatacagtgcttgaggacgacttcacaacactggactcacgcaaatggctgctgcaccctgggggcactaagatgcccgtatgcgggagcacaggcgatgcgctggtattcatagagaaagctagcacccggtacgtggtgtcaactgacgtagccgtcaacgaggactctttcctgcaaatcgactttgctgcctcatgcagcgtgactgactcctgctatgctatcgagttggagtactccgtcgacctggggttatcttggcacccactggtgcgggactgcctgccaaccaatgtcgaatgtagccgataccatctgcagagaatcctcgtgagtgacacattcaataagtggactaggatcactctccctctgcctccttatactagatctcaggccaccaggttcagatggcatcagcccgcgccctttgacaagcagcaaacctgggcgatcgacaacgtatacattggcgatgggtgtatcgacatgtgcagcggacacggcagatgtatccaggggaattgcgtgtgtgacgagcagtggggtggtctctactgcgatgatcccgagacgtcactgcccacacaactgaaagacaattttaaccgggccccgagctctcagaattggctgacagttaacgggggtaaactgtcaactgtgtgcggtgccgtggccagtgggatggcactgcactttagcggaggctgttcgcggctgctcgtaacagtcgatctcaatctgacaaatgcggaattcatccaattttatttcatgtacggctgcctgattacacccaacaatagaaaccagggcgtcctgctggagtacagcgtgaatggaggaatcacgtggaacctgctgatggaaattttttacgatcagtacagtaagcccggcttcgtcaacattctgctcccccccgacgctaaagagatagccaccagatttaggtggtggcagcctcgacacgacgggctcgaccagaacgactgggcgatcgataacgtcctgatcagcgggtctgccgatcagaggaccgtgatgcttgataccttctccagcgctccggtgcctcagcacgaacgaagtcccgcagacgctggccctgtgggcaggatcgcgtttgatatgtttatggaagacaagacatccgttaacgagcactggctttttcatgacgactgcaccgttgaaagattttgcgattctcctgatggggtgatgctgtgtggctctcacgatggacgcgaggtgtacgcagttacacatgatctgacccccaccgagggatggattatgcagttcaaaatcagcgtgggctgtaaagtcagtgaaaagattgctcagaaccaaatccacgtgcagtattctaccgattttggcgtctcatggaactacctggtccctcagtgcctacctgccgaccctaaatgcagtgggtccgtgtcgcagccatccgtgttcttccccaccaagggttggaaacgaatcacctatcctctgccagaatctctcgtaggaaaccctgttaggttccgattctatcagaaatactctgacatgcagtgggccatcgataacttctacttgggacccggctgcctggataactgtcgaggccacggcgactgcctgagggagcagtgtatttgtgaccccgggtactccggcccgaattgttatctgactcatacacttaagacctttcttaaggaaagattcgattccgaagagatcaagccggacctgtggatgagtctggaaggcggctcgacatgcactgaatgcgggatcctagcagaggataccgcactctacttcgggggttctactgtcagacaggcagtcactcaggatcttgacttgagaggcgctaaattcttacagtactgggggcgcataggaagcgagaacaacatgacaagctgtcatcgccccatctgcagaaaagaaggcgttctattagattacagtaccgacggagggatcacgtggactcttttgcatgaaatggattatcagaaatacatcagcgtccggcatgattatatcctccttcctgaagacgcccttactaacacgaccaggttgcgatggtggcaacccttcgtgatctccaacggtattgtggtgtcgggcgttgaaagggcgcagtgggctttggacaatatcctcattgggggcgctgagataaacccctcccagttggtggatactttcgacgatgaggggaccagccacgaagagaactggtcattctaccccaatgccgtgcggaccgcagggttttgcggcaacccatcgtttcacttgtactggcctaataagaagaaagacaagactcataacgccctgtcaagtcgggagctgatcatccagccgggctacatgatgcagtttaaaatcgttgtagggtgcgaggctacatcgtgtggcgatttgcactctgtgatgttggaatacactaaggatgcccggtccgattcctggcaactggtacaaacacagtgcctgccatcctcaagcaactccattggctgttccccctttcagttccatgaggcaaccatttataacagtgtgaacagtagtagttggaaacgaatcactatccagctcccagatcatgtgtcttcttccgcgacacagtttcggtggatacaaaaaggggaggaaaccgaaaagcaaagctgggctattgaccacgtttacatcggcgaagcatgccctaaactttgtagcggccatggatattgcaccaccggcgccatctgtatttgtgatgagtcttttcagggagatgactgctccgtgttcagtcacgacctgcctagttatatcaaagacaacttcgagagtgctagggtaactgaggccaactgggagacaatccagggaggcgtcattgggagcgggtgtgggcagttggccccttatgctcatggagactctctatatttcaatgggtgtcagatcaggcaggccgctaccaaacccctggatttgacaagggcaagcaagatcatgttcgttttgcagatcggatctatgagccagacagactcctgcaacagcgatctttcagggccgcacgctgtggacaaggccgtgctcttacagtatagtgtcaataatggtataacttggcatgtcatcgcgcagcatcagcccaaggatttcacacaggcacagcgggtgtcttacaacgtgcccctggaggcgagaatgaagggcgtgctgctgagatggtggcaaccccggcataatggcaccgggcatgatcagtgggccctcgatcacgtcgaagttgtgctatttagcacccggaagcagaactatatgatgaatttttccaggcagcacggtctgcgccatttctataacagaaggcggagatcactgcgacgctacccctag

SEQ ID NO: 17125 - DNA, 2934 bp, Artificial Sequence
  Description of Artificial Sequence: Synthetic coding sequence
atgtgctcgggtcacggacggtgtattcaaggtaattgcgtctgcgatgagcagtggggcggcctttactgtgatgacccggaaaccagtctacctacgcagctaaaagacaattttaatagggcaccgtcctcccagaattggctaacggtcaacggaggaaaactttcaactgtgtgcggcgctgtggcatctggaatggcgcttcacttttccggcggctgttcccggctccttgtcacagtcgacctgaacctgaccaacgcggaattcattcaattttactttatgtacggctgcctcatcacaccaaataaccgtaatcagggcgtcttgctagaatattccgtcaatggaggcatcacgtggaacctcttaatggagatattctacgaccagtatagtaagcccggtttcgtgaacatacttctcccgccagacgccaaagagattgctacaaggtttcgatggtggcagcctcggcacgacgggcttgatcagaacgattgggccatagacaatgtgctgatctcaggctccgcagaccagaggaccgttatgcttgatacgttctccagtgcgcctgttcctcagcatgagagatcgcctgctgacgccggccccgtcggccgcattgctttcgatatgttcatggaggacaagacatccgtgaatgaacactggctgtttcatgacgattgcaccgtcgaaaggttctgtgattctccagacggtgtaatgttatgcggtagtcacgatggaagggaagtgtacgccgtgacacacgatctgaccccgactgaaggctggattatgcagtttaagatctctgtgggatgtaaggtttccgagaagattgcacaaaatcagattcacgttcaatacagcacggactttggagtgtcttggaattacctggtcccccagtgcctgcccgcagacccgaagtgtagtggttctgtgtctcagccgtctgtcttttttcctacaaaaggttggaaacgcataacttatccactgcctgaaagcctcgttgggaaccccgtaagattcagattttatcagaagtactccgacatgcagtgggcaatcgacaatttctacctggggcctggatgtctggacaactgcagaggacatggggactgcttaagagagcagtgcatctgtgatccgggttattctggacctaattgttatctcacgcacacactcaaaacattcctgaaggagcggttcgattccgaagagatcaagccagatttatggatgtcattagagggtggatccacctgtacagagtgtggaattttggctgaggataccgccctgtattttggtggctccacggtcagacaggccgtgacacaggacctcgatctacgtggtgccaagtttctgcagtattgggggagaattggaagtgagaataacatgacttcctgccacaggccaatctgcaggaaggagggcgtgcttctggattatagcaccgatggcgggattacgtggacacttttacacgaaatggattaccagaagtatatttctgtccgtcatgactatattttattgcctgaagatgccctgaccaacacgacacggctccgttggtggcaaccctttgtaattagcaacggtatagtcgtttctggagtcgaaagggcccagtgggccctggataacattctgataggtggtgccgagataaaccctagtcagctggtggacacttttgatgacgagggtacatctcatgaagagaactggtctttctaccctaatgctgtgagaacagccgggttttgtggaaaccctagcttccatttgtattggcccaacaaaaaaaaagacaaaacacacaatgcattaagctctagagagttaatcatccaaccagggtatatgatgcagtttaagatcgtggtgggatgcgaggcgaccagttgcggagatttgcactctgtcatgctcgagtatacaaaggacgctcggagcgactcttggcaactggtgcaaacacagtgcctgcccagcagctccaattctattggttgcagtcccttccaattccacgaagccacaatttacaatagcgtgaacagtagcagttggaagaggattacaatccagctgccagatcatgtgtcatccagtgccacccagttccgctggatccaaaagggagaggaaaccgagaaacagagttgggccattgaccatgtgtacattggggaggcgtgccccaagttgtgtagtggccacggatactgcacaactggcgctatatgcatttgcgatgaaagctttcagggcgacgactgctccgttttctcgcatgatctcccatcttacataaaggataatttcgagagcgcgcgggtgacagaagccaactgggagaccatccagggaggagtaattggtagcggatgtggacagcttgcgccttacgctcacggcgactcactctacttcaacgggtgtcagattcggcaggccgctactaaaccactcgatctcacgcgagcgtcaaaaatcatgttcgttctgcaaatcggttccatgagccagacggactcctgtaactccgacctgtccggacctcacgccgtagacaaggccgtgctgctgcaatattccgtcaataatggcattacttggcacgtgattgctcaacaccagccgaaggattttactcaggcccagcgggtgagctataacgtcccgttggaggctcggatgaagggcgttctactgcggtggtggcagcctcgacataacggaaccgggcacgaccagtgggccctggaccatgtggaggtggtactggtgactacacggaagcagaattacatgatgaatttttcaaggcagcatggtctcaggcacttctataacagaagacggcggtcattgcgcagatacccatag

SEQ ID NO: 17126 - DNA, 10383 bp, Artificial Sequence
  Description of Artificial Sequence: Synthetic coding sequence
atggagcgtagtgggtgggcgcgacagacatttctgcttgctctgctacttggggccacactgagagctcgggcagcagccggctattatccaaggttttcccccttcttttttctttgtacacaccacggagaactcgagggggacggcgagcagggcgaggtgctgatttcactgcatatcgcaggcaatcctacctattatgtgcctggtcaagagtaccatgtgaccataagcacatccaccttctttgacgggctcctggtcaccgggctctataccagcactagcgtgcaggctagtcagtccatcggaggatcttcagctttcggtttcggcatcatgagtgaccatcagtttggaaaccagtttatgtgtagtgtcgtcgcttctcatgtgagccacttaccaaccaccaacttaagctttatatggatcgctcccccagctggcacggggtgtgtgaattttatggctacagctacccataggggacaggtcatttttaaggacgccctggcacagcagctgtgcgagcaaggtgcaccaaccgatgtcaccgtgcaccctcatctggctgagattcatagcgacagcatcatcctacgtgatgattttgacagctaccatcagctccagctgaacccgaacatttgggtggaatgtaataactgtgagacaggggaacagtgtggcgcaatcatgcatgggaatgccgttactttttgcgagccatacggaccacgtgaacttattacaaccgggctgaacaccacaaccgcgagcgttctgcagttttcaatcggatccggcagttgcagattttcctacagcgatccgtcaatcatcgttctgtatgctaagaacaacagcgctgattggatccaactagagaagattagggccccctccaacgtgagcaccattatccacatcttgtatctgcctgaggatgccaaaggtgagaatgtgcagttccaatggaagcaagagaatttgagggtgggtgaggtctacgaggcgtgctgggccctggacaatattctgataattaatagcgcacatcgccaggttgtcctggaagactctctcgacccagtagacacaggaaattggctgttcttcccgggcgccacagtgaagcactcttgccagtccgacggaaacagcatctactttcacgggaatgagggctctgagttcaattttgctacaacacgggatgtggacctgagtactgaggatatccaggagcagtggtcagaagagttcgagtcccagcctactgggtgggacgtcctgggagccgtgatcggaaccgaatgtggtactattgaatctggtcttagcatggtgtttctgaaagacggcgagcgcaagctgtgtaccccctcaatggacactacgggctatggtaatctccgattctatttcgtgatgggcggcatctgtgatcccggcaacagtcatgaaaatgatataatcctttacgctaaaatcgaagggcggaaggagcatattacactcgacaccctgagctactccagttacaaggtgcccagcctggtatcggttgtgatcaaccccgagctacaaactcctgcaacaaaattttgtttgaggcagaagaaccaccagggacacaaccgaaacgtttgggctgttgacttcttccacgtgctcccggtcttgcctagcacaatgtctcatatgattcagttctctattaacctgggatgcggaacacatcagcccggcaatagcgtctcattggagttttctactaatcatggccgctcctggtcgctgcttcacaccgagtgtctgccagaaatctgtgcaggcccacacttaccacactcaaccgtctattctagcgaaaattacagcggctggaatcgtatcacaataccactgcccaatgctgccctgaccaggaacacccgcataaggtggagacagactgggccaatacttggcaacatgtgggctatcgacaatgtctacattggacctagctgtctgaaattctgttctggacgcggccagtgcactagacatggctgtaagtgtgatccggggtttagcggacccgcctgcgagatggcttctcagacattccctatgtttattagtgaatccttcgggtcatcgcgcctgtcttcttatcacaatttttactccattaggggcgctgaggttagtttcggatgtggcgtgctggcttcaggaaaagccttagtttttaacaaagacgggcgcagacagcttataacctcatttctggattcaagccagagcagatttctgcagtttacccttcgactgggcagtaagtcagtcctgagtacgtgcagagcccccgatcagcctggtgagggagtccttctccactattcctacgataacggcatcacgtggaaattgcttgaacactattcttacctcagctaccatgaacctaggataatcagcgtagaattgccaggggacgcaaagcaattcggtatacaattccgatggtggcagccttaccactcttcccagcgagaagatgtgtgggccattgatgagatcatcatgacttcagtactctttaattctatctctctagacttcaccaatctggttgaagtgacccagtctttgggattttatcttgggaatgtgcagccctactgtggacacgactggactttatgttttacgggtgacagcaagctggcaagtagcatgagatacgtcgagacccagtctatgcagattggggcctcatatatgatccagttttcactggtgatggggtgcggtcagaagtacacgccccacatggacaatcaagtgaaactggagtattccacaaaccacggattgacttggcacttagtgcaagaggaatgcttgccttctatgccctcatgccaggagtttacttcggcatccatttatcacgctagcgagttcacccagtggcgcagagtgattgtattgctccctcagaagacgtggagctcagctacacggttccggtggtcccagagttattacaccgcccaagacgagtgggccctggattcaatttatataggccagcaatgccccaacatgtgctccggtcatggatcttgcgatcacggaatctgtcggtgtgaccagggctatcagggcaccgagtgccacccagaagcagccttaccaagtaccatcatgtctgatttcgagaaccagaacggttgggagagcgactggcaggaagtaatcggcggcgaaatcgtaaaacccgagcaaggctgtggagtcatcagctcgggttcctccttgtatttttccaaagccgggaagagacagttagtgtcctgggatttagatacctcctgggtcgattttgtgcaattctacatccaaatcggcggagagtctgctagttgcaacaaacctgacagccgtgaggagggagtgttgctgcaatactcaaataatggcggaatccagtggcacttgcttgccgagatgtatttcagtgacttcagcaaacccagattcgtgtacctagagttgcccgctgccgctaaaaccccatgtactaggttccgatggtggcagcccgtattctctggggaggactacgaccagtgggctgtggatgacatcattatcctgtctgaaaagcagaaacagatcatacccgtcattaatcctaccctaccccagaacttctatgaaaaacctgcctttgactacccaatgaaccagatgtctgtgtggctgatgctcgcaaacgagggaatggttaagaacgaaaccttctgcgccgccactcccagcgccatgatcttcggcaaaagtgatggagataggttcgcagtcacaagagacctcaccctgaagcccggctatgtgttgcagttcaagctgaacattggctgtgcaaaccaattcagctccacagcgccagttttactgcagtattcccatgatgcgggaatgtcttggtttttggtgaaagagggatgttacccagcttctgcaggcaaaggatgcgaagggaattctcgagaactgtcagagcctacaatgtaccatacaggtgatttcgaagagtggacacggattaccatagtgatccctcggtcactggctagttccaagacccggtttagatggatccaagaaagttcaagccagaaaaatgtgccacctttcggactcgacggagtatacattagcgagccctgcccaagctactgctcaggccatggcgactgcatatccggagtctgcttctgtgatcttggctacaccgccgcccagggcacatgcgtgtctaacgttccaaaccacaacgagatgtttgaccgttttgagggaaaattaagtccgctgtggtacaagattaccggcgctcaagtagggactggctgcggcacactcaacgacgggaaaagcctatatttcaacggcccaggcaaacgcgaagcccgcactgtgcccttagacacacgcaacataaggctcgtgcagttctatattcagatcggctctaagacatctggaattacctgtattaagccccgcaccagaaacgagggtctgatagtccagtattctaacgacaatgggatcctgtggcatctccttagggagcttgatttcatgtctttcttagagccacaaattatttcaattgacctacctcaggatgctaagacgcctgcaactgcttttagatggtggcagccacagcacggtaagcactcagcacaatgggccttggacgacgttcttatcggaatgaatgattcttctcaaaccggatttcaggacaaatttgatggctctattgatctccaagccaactggtaccgcatccagggcggacaggtggatatcgactgcctgtcaatggacacagccctgatatttacagaaaacatcggaaaacccagatatgcagagacatgggatttccacgtttccgcatccacgttcttacagtttgagatgtcgatgggctgttccaagccgttctccaactcccattcagtgcaattacaatacagtctcaataacggcaaggattggcacctcgtcacggaggaatgtgtgccgcccactatcggctgcctccactacaccgagtcgtctatatacacttccgagcggtttcagaactggaagcgtattaccgtctacttaccgctgagtaccatctcccctaggactagattccgctggatccaggcaaattacactgtaggagctgactcctgggcaatcgacaacgtcgttttagccagcgggtgcccttggatgtgctcgggacggggcatatgtgatgccggcagatgcgtttgcgaccgtggctttggtgggccgtactgcgtccctgtggtgcctttgccaagtatcctgaaggacgacttcaatggtaacctgcaccctgacttatggccagaagtgtacggcgccgaaaggggtaatctgaatggtgagaccatcaaaagcgggacttctctgatctttaagggtgagggtctgaggatgctcataagtcgtgatcttgactgtactaacaccatgtatgttcagttctcactcagattcattgccaagtccacccctgagagaagccattcaattctgctccaattctccatatcaggcggcatcacatggcacctcatggatgagttttactttcctcagaccacgaatatcctctttatcaatgttccacttccatataccgctcagaccaatgctactcgatttagactctggcagccatacaacaacggaaagaaagaagaaatttggatcgtggacgattttattatcgacggtaataacgttaataatcccgtgatgctgctggacacattcgattttggaccgcgtgaagacaattggtttttttatccgggtgggaatatcgggctgtactgcccatactccagtaagggggccccggaggaagacagcgccatggtgtttgtgtctaacgaggtgggcgaacactccataacgacccgcgacttgaacgtgaacgagaacactattattcagttcgagattaatgtgggctgtagtacggatagctcaagcgcagatcccgtgcggctggaattcagtagggactttggtgccacctggcacctgctgttaccactgtgttatcactcttcatcacacgtgtccagcctctgtagtactgagcaccacccatccagtacatactatgccggcacgatgcaggggtggcgccgggaagtggtgcattttgggaagctgcacctgtgcggcagcgtaaggttccgctggtaccagggcttctacccagctggctcccaaccagtaacttgggccatcgacaacgtctacataggtcctcagtgcgaggagatgtgcaatggtcagggtagctgtatcaatgggactaaatgcatctgcgaccccggttattccgggccaacctgtaagataagcaccaagaacccggactttctgaaggatgattttgagggccagctggaatccgaccgcttcctgctgatgagtggaggcaagccgtcccggaagtgcggaattctttcttctggtaacaaccttttttttaatgaagatgggttacgcatgctgatgacgcgcgatctggacctaagccatgcacgctttgttcagtttttcatgaggctggggtgtggcaagggggtccctgaccctagaagccagcctgtgctccttcagtattctctgaacggtggcctatcgtggagcttgctgcaggaatttctgttctctaacagttcaaacgtcggaagatacattgctttagagattccattaaaggccagaagcgggtccaccagactgcgctggtggcagcccagtgaaaatggacacttctattctccctgggtgattgatcagatcttgatcggagggaacatcagtggcaacacggtgctggaagacgacttcaccacattggactctcgtaaatggctgctacaccccggcggaacaaaaatgcctgtgtgcggtagtacaggagatgcactggtcttcatcgagaaggcttctactaggtatgtagtatcaaccgacgttgccgttaacgaggatagctttctccagattgattttgctgcctcatgctccgtcaccgacagttgttacgccatagagcttgagtattccgtggacctcggcctgtcttggcatcccttagtaagagattgcctgccaacaaacgtagagtgttccagataccatctgcagcgaattctggtgtccgatactttcaataagtggacccggataacgttaccattgccaccttatacccgatctcaggccaccaggtttcgttggcatcagcccgcaccttttgacaagcaacagacatgggctattgataatgtgtacatcggggatggctgcattgacatgtgtagtgggcacggtcgttgtatacagggcaattgcgtgtgtgatgagcaatggggcggcctctactgtgacgatcccgagacttccctcccgacacagctgaaggataacttcaaccgcgcacccagctcccagaactggctgaccgtgaacggtggcaagcttagtacagtatgtggggcagtggcctctgggatggccctgcatttcagcgggggttgctccaggctgctcgtaactgtggacttaaacttgactaacgcagaattcattcagttctattttatgtatggttgcctgattacacccaacaacaggaaccagggcgtgctgcttgagtatagcgttaacggaggaattacatggaatttgctgatggaaattttttacgatcagtatagcaagccaggctttgtaaatatcctcttgccacccgatgcaaaggagatcgctacccggtttagatggtggcagccccgacacgacggtctggaccagaacgactgggcgatcgacaacgtccttatcagcggatcagccgaccagagaactgtgatgcttgacaccttttccagcgcaccagtgccccagcacgaaaggtctcctgctgatgctgggccagttggcagaatagctttcgatatgtttatggaggataagaccagcgtaaacgagcactggctgtttcacgatgactgcactgttgaaagattttgtgatagccccgatggggttatgctgtgtggttcccacgacggccgcgaggtgtatgctgtaactcacgacctcacacccacagagggctggatcatgcaattcaagatcagcgtgggctgtaaggttagcgagaaaattgcacaaaatcagatccacgtccaatacagcaccgattttggtgtgagctggaattaccttgtgccacagtgcctcccagccgaccctaagtgcagcggctctgtgtcacagccttcggtgttctttcctaccaaggggtggaaacggattacatatcccctgcctgagtccttggtgggtaacccagtgagatttcgcttttaccagaagtattctgacatgcaatgggctatcgacaacttctatctgggacccgggtgtctggacaattgtcgcggacacggcgattgtctgagggaacagtgtatttgcgatcccggatactccggacctaactgttatctaacccatacactgaagacctttctgaaagagagatttgatagcgaggagattaagccagacctctggatgagcctggagggcggttccacatgtactgagtgcggcattctggccgaggacacggccctgtatttcggggggtccacagtgagacaagcagtgacccaggacctggacttgagaggcgcgaagtttttacagtattggggcaggatcggttcagagaacaacatgaccagctgtcataggccgatctgtagaaaagaaggcgtgttgttggattatagtaccgatggggggatcacctggaccctgctacacgaaatggactatcagaagtacatctccgtgcggcatgattatattctgctccccgaagatgctctgacgaatactactcgactgcggtggtggcagccttttgtcatcagcaacgggatcgtcgtatcgggcgtggagcgggctcaatgggcactagataacattctaatcggcggtgctgagattaatccctctcagctggtggatacattcgacgacgaggggacctcccatgaggaaaactggagtttttacccaaatgccgtgcggacagcaggattttgtggcaatccctcatttcacctgtactggccaaataagaaaaaagataaaacacataatgcactgtcatcaagggaactcattatccaaccgggttacatgatgcagttcaagattgtcgtgggttgcgaggctaccagctgcggcgacctccacagtgttatgttagaatatactaaggatgcccggtccgattcctggcagctcgtccaaacacagtgcctcccctcgtcttcgaactctatcggatgctccccatttcagtttcacgaggctacaatatacaattccgtgaatagttcaagttggaagaggattactatccagctccctgaccacgttagttcatcagccacgcagtttcggtggattcagaagggagaggagaccgaaaagcagtcatgggccatcgaccacgtgtatataggcgaggcgtgtcccaaactctgctctggacacggatactgcaccactggggctatatgcatatgtgacgaatcctttcagggggatgattgttctgttttttcacacgacctgccaagctacattaaggacaattttgagtcggcacgggtgaccgaggccaactgggagaccatccagggaggcgtgataggatccggctgcgggcagttggctccctacgcccacggcgactctctctatttcaatggctgtcaaattagacaagcggctacgaaaccgctggatctgacaagagctagcaagataatgtttgtcctccagattggctccatgagtcagactgactcttgcaattcggatctgagtggcccccatgccgtggataaagccgtgctccttcagtacagcgtgaacaacggtatcacctggcatgtgatagcacaacaccagccaaaagacttcacccaagctcagagggtttcatataatgttcccctggaagctagaatgaagggagtcctgctcaggtggtggcaacctaggcacaatgggactgggcacgaccagtgggcactggaccacgtcgaagtagtcctggtgagcacccggaaacagaactacatgatgaattttagcagacaacacgggctgagacatttttataataggcgccggcgctcactgagacgctacccatag

SEQ ID NO: 17127 - DNA, 10284 bp, Artificial Sequence
  Description of Artificial Sequence: Synthetic coding sequence
atggaacggtctggatgggcgaggcagactttcctgctggcactgcttctaggggctacactaagagccagagccgcagctggttattatccgcgcttttcaccatttttctttctgtgtacccaccacggcgaactggagggcgacggagaacagggggaagttttgatctctcttcacattgccggtaatcccacatattacgtgcccggccaggagtaccacgttactattagcacctcaaccttcttcgatgggctcctggtcacggggctgtataccagcacatcggtgcaggccagccagtccattggagggtcctctgcctttggattcggcatcatgtcagatcaccaatttggcaaccagttcatgtgtagcgttgtagccagtcatgtatctcacctgcctactacgaacctgtctttcatttggatcgcgcctcccgcaggcactggatgtgttaattttatggccactgccactcacagagggcaagtaatttttaaggatgctttggcacagcagctgtgtgagcagggcgctccaacagacgtcaccgtgcacccacatttggccgaaattcactccgattcaatcattctcagagatgatttcgactcttaccatcagcttcagctgaaccctaacatttgggtggaatgcaacaactgcgaaactggagaacagtgtggcgctatcatgcacggcaacgcggtcactttctgtgagccatacggtccacgcgagttgatcactacgggcctcaacacaactacagccagcgtcctccagttctctataggttcaggatcttgtcggtttagttactctgacccttccatcatcgttctctacgccaaaaataactcagccgactggatccagctcgaaaagataagggcaccctctaatgtgagtactatcatccatatcttgtacttgcctgaggatgcaaagggagagaatgtgcagttccagtggaaacaggagaatctcagggtaggagaagtatacgaggcctgctgggccctcgacaatattctaataatcaactctgcacatcgtcaggtcgtgctcgaggacagtctggatcctgtggataccgggaattggttattcttccccggggccacagtcaaacacagttgccagagtgacggaaatagtatctactttcacgggaacgaaggttctgagtttaattttgctaccactagagacgtggacctgagtacagaagatattcaagagcagtggagcgaggagtttgagtcccagccaactggctgggacgtcctgggcgctgtcattggcacagaatgtggcacaatcgaaagcggtctaagcatggtattcctgaaagatggtgagaggaagctgtgtacgccgtcgatggacaccacgggatatggaaatctcaggttctacttcgtgatgggaggcatctgtgaccccgggaacagccacgagaacgatatcatactttatgcaaagattgaaggcagaaaagaacacatcaccctggacacactttcatacagctcctacaaggtgcccagtctagtgagcgttgtgatcaatccggagcttcagactcctgccaccaagttctgcctgcggcagaagaaccaccagggccataatcggaatgtgtgggccgtcgatttcttccacgtactgccggttctgcctagcaccatgagtcacatgatccaattctctattaacctcggatgtggcacccatcagcctggaaactctgtgagcctcgagttcagcacaaatcatggacgctcctggagcctattgcacaccgagtgtcttcccgagatttgtgcaggaccacatctaccccattccactgtgtacagctccgagaattacagtggctggaatagaataactataccattgccaaatgcagccctgacccgaaacacacgtattcgctggcgacagaccggaccaattttagggaacatgtgggctattgataatgtgtacatcggacccagttgcctgaaattttgcagcggacgggggcagtgcaccaggcatgggtgcaaatgcgaccctggttttagcgggcctgcctgcgagatggcctcccagactttcccaatgtttatttccgaatcatttgggtcctctcgcttaagctcctatcacaacttttacagcattcggggcgctgaagtatcatttggatgtggcgttctcgcgtccgggaaagctttagtgttcaataaagatggtagaaggcagcttatcacctcttttctggatagcagccaaagcagattcctccaatttaccctgaggctcgggtccaaatccgtcttgtccacatgtagagcaccggaccaacccggggaaggagtgcttctgcactattcctacgacaatgggatcacctggaagttgctagagcactactcgtacctgtcatatcatgagccaagaatcattagcgtggagctgcccggtgatgccaagcaattcggcatccaatttagatggtggcagccttaccacagttctcagagggaagatgtgtgggcgatcgacgagattatcatgacctccgtactctttaatagcatttcactagatttcacaaacttagtggaggttacacagtctcttggattttacctaggaaatgtgcagccctactgcggacacgattggacactgtgttttacaggggattccaagttggcgagctcaatgcgttatgtcgaaactcagagtatgcagataggagcctcctacatgatccaattctccctcgtcatgggttgtggacagaagtatacaccacacatggacaaccaagtgaaactcgaatattctactaaccacggactcacctggcaccttgttcaggaggagtgtctcccgtcgatgccctcatgccaggaattcactagtgcctcaatctaccatgcgtctgagttcacccagtggcgaagagtcattgtcctgctgccgcagaaaacttggtctagtgcaactaggtttaggtggagccagtcgtactataccgcacaagatgaatgggcccttgactctatttacatcggccaacagtgcccaaatatgtgctctggtcacggtagctgtgaccacggaatctgccgatgtgatcaggggtatcagggcactgaatgccacccagaagcagcactgcctagtacaattatgtcagattttgagaatcaaaatggttgggagtccgattggcaggaagtgattgggggggagattgtgaaacccgagcaaggctgtggagtaatcagtagtgggtcaagtttatactttagtaaggctggcaagcggcagctagtcagctgggatctggataccagctgggtggactttgtgcagttttatattcagataggaggcgagagcgccagctgcaacaaaccagactcccgcgaggaaggtgttctgctgcagtattctaataatgggggcattcagtggcacctgctcgccgagatgtatttcagcgatttctcaaagcctagattcgtttacctcgagctcccggctgccgcaaaaaccccctgcacccgtttcagatggtggcagcccgtctttagcggtgaagactatgatcagtgggccgtggacgacatcatcatcctttcagaaaaacagaagcaaatcattcctgttattaatcctacactgccacagaacttctacgagaaaccagcgtttgattatccaatgaatcaaatgtctgtctggctcatgctggccaacgagggcatggtgaaaaacgagacattctgtgccgccacaccatccgccatgatctttgggaagagcgatggtgatcgcttcgcagtgacacgcgatttgactctgaagccaggctacgtgctgcagtttaaactgaatattggctgtgccaaccagttctccagcacagcgccagtgttgttgcagtactcgcacgacgccggcatgtcctggttcctcgtgaaagaaggctgctaccctgcaagtgccggaaaaggctgtgagggaaattccagggaattgtccgaacccacaatgtatcataccggcgacttcgaggagtggactcggataactatcgtaatcccgcggtctctggctagcagtaagacccggtttcggtggatccaagaatcctccagccaaaagaacgtccctcccttcgggcttgacggcgtctatatctcagaaccttgcccctcatattgttccggccacggggattgtatctctggcgtctgcttctgtgatctcggatatactgccgctcagggaacatgtgtgagtaacgtgcccaaccataacgaaatgttcgaccgcttcgaaggtaagcttagcccgctctggtataagatcactggtgcacaggttggaactggttgcggaacactcaatgacggcaagtcactctatttcaatggaccagggaagcgcgaagctcggactgtgcctctcgacacccgcaatatcagactggtgcaattctacatccagatcggcagtaagacatccggaattacctgtattaaacccaggacccgaaatgagggtttaattgttcagtacagtaacgataacggaatcctttggcacctgctcagggagctcgactttatgagtttcctggaaccacaaattatatccatcgacctgccacaggatgccaagacacccgcaaccgcctttagatggtggcagccacaacacgggaaacacagcgctcagtgggccctggacgatgtcttaattggaatgaatgattccagccaaaccggcttccaagataagtttgacgggtctattgaccttcaagcaaattggtatcggatccaaggcggccaagtcgacatcgactgcctgtctatggataccgccctgatctttacagaaaatatcggcaagcctcggtacgccgaaacatgggatttccatgtctccgccagtacatttctacagtttgagatgtccatgggatgtagcaagccctttagcaactcacactccgttcaactgcagtactccctcaataacggaaaggactggcacctggtgacagaagagtgcgtacctcctacaataggctgcttgcactacactgagagctccatatacacctcagagcggttccagaactggaaaaggatcacggtgtaccttccattgtctactatttccccaaggacacgcttcagatggattcaggccaactatactgtcggagccgacagttgggccatcgataatgttgtcctcgcatccggctgcccatggatgtgttctgggagaggcatatgcgacgcgggcagatgcgtgtgtgatagaggcttcggaggtccgtattgcgtgccggtcgtgcccctgccttctattctgaaggacgatttcaatggtaacctgcatccagacctatggccagaagtgtatggcgctgaacgcggaaatctgaatggggagactattaaatctggaacatctctcatttttaagggggaggggctccgcatgcttatctcccgagatctcgactgcactaataccatgtatgtccagttctctctgagattcatcgcgaaatcaacacctgagcgctcccactccatcctgcttcagttttccatttcgggcggtattacctggcatcttatggacgaattttacttcccgcaaaccacgaacatcctgtttattaatgttccacttccatatactgcccaaacaaacgccacccgcttcagactgtggcagccctataataatgggaaaaaagaagaaatctggatcgtagacgattttatcatagatggcaataacgttaacaatcccgttatgctactagatacattcgatttcggcccacgagaggacaattggtttttctacccaggaggaaatatcggcctctactgtccttattcatctaaaggcgctcctgaggaagattcagctatggtgtttgtttctaatgaagtcggcgagcacagtataacgaccagggatcttaacgtgaatgaaaacacaattattcagttcgaaatcaatgtcggatgttcaacggactccagttcggcggatcccgtgcgcctcgagttttccagagatttcggcgctacgtggcatctgctgctgcccttatgctaccattcttcctcacatgtaagcagcctgtgtagcactgagcaccaccccagtagcacgtactatgccggcaccatgcagggatggcgtcgggaggtggtgcatttcggcaagctgcacctctgcggcagcgttcgatttcgctggtatcagggattctaccccgccggatcccagccggtgacctgggccatcgacaatgtttacatcgggcctcagtgtgaggagatgtgtaatggtcagggtagttgcattaatgggactaaatgcatttgtgatcctggctactccgggcctacttgtaaaatatcaacaaagaaccctgattttctgaaggatgatttcgaaggtcagttggaaagcgatcgattcctgctgatgtccggtggcaaaccatctagaaaatgtggcatcttgtcttccggaaacaacctgttttttaatgaagatgggttgagaatgttgatgacacgcgacctcgacctcagccacgccagattcgttcaattctttatgcggctgggttgcggaaagggagtcccagacccgcgctcccaacccgtgctccttcaatattcacttaacgggggcttaagttggtcactgctgcaagaatttctgttcagcaatagtagtaatgttggacggtacattgctcttgagattcctctaaaagcccggagtggcagcactagactccggtggtggcaaccttccgagaacggacacttctattccccatgggtaatcgaccaaatactgatcggcggaaatatttctggaaacactgttctcgaggacgacttcactactctggacagcagaaaatggctgctccaccccggcggtactaaaatgcctgtctgtggctccacgggagacgcgttggtgtttatcgagaaggcctccacgaggtacgtggtgagtaccgatgtcgccgtcaacgaggactcttttctacagatcgactttgccgcctcctgtagcgtgacggactcttgctacgctatcgaactcgagtattccgtggaccttggattaagctggcacccactagtaagggattgtttgcccacgaatgtggagtgttctcgctaccacctccagcggatcctggtgagtgatacattcaacaagtggaccagaatcactcttcccctgccgccttacactcgatctcaggccacacgctttcggtggcaccagcccgcaccttttgataaacagcagacctgggccatagacaatgtgtatatcggggatggatgtattgacatgtgcagcggccacggtcgctgcatccagggaaattgtgtctgcgacgaacaatggggtggactttattgtgatgaccctgaaacaagccttcctactcagctcaaggacaacttcaatcgcgccccgagctcccagaattggcttaccgtgaacggggggaagctttctaccgtttgcggagctgtagccagcggcatggccctccatttttccggcgggtgctcaaggctcttagtgaccgtcgatctcaacttgaccaacgccgagttcatccagttctacttcatgtatggctgccttattacgcccaacaataggaatcagggtgtcctcctggagtattcagttaatggcggcattacctggaatcttcttatggaaattttttacgatcagtactccaagcccggatttgtgaatatcctccttccaccagatgccaaggagatcgctacccgcttcagatggtggcagccgagacatgatggcttggatcagaacgattgggctattgataacgtactgattagtggttccgctgatcagcgtacagttatgctggatactttcagttctgctcccgtgccgcagcatgaaagatcccccgccgatgccggacccgtggggaggatcgcattcgacatgttcatggaagacaaaacctcagttaatgaacactggttgttccatgatgattgcacagtagagcggttttgtgatagtcccgatggagtgatgttgtgcggatcccacgacggccgtgaggtttacgccgtcactcacgacctcaccccaaccgagggctggataatgcaattcaaaatttccgtgggttgtaaagtttcagagaagattgcccagaatcagattcatgtgcagtactccacggactttggagtctcatggaattacctcgtgccgcagtgtctgcccgccgaccctaagtgcagcggaagtgtgtctcagccatccgtctttttccccaccaaaggctggaagcggatcacctaccctttacccgagagcctcgtggggaacccggtcagattccgattttatcagaaatacagcgacatgcagtgggccatagacaacttttacctgggcccaggctgtctcgataactgcagaggtcatggagactgcctgagagaacagtgcatctgcgatccaggctacagcggaccaaattgctacctcacacacacactcaaaactttcttgaaagagcggttcgatagcgaagaaattaagcccgatctctggatgagcctggaaggcggttcgacatgcacagagtgcggcatcttggctgaggacaccgctctttattttggggggagtacagtgcgacaagccgtgactcaggacctagacttgagaggggctaaatttctgcaatattggggccgcattggtagtgagaacaatatgacatcttgtcaccggcccatctgccgcaaagagggagtactgcttgactactctaccgacggcggcatcacttggaccctcctgcatgaaatggactaccaaaaatacatatccgtgaggcacgattacatactcctcccagaagacgctttgactaacaccacaaggctacgctggtggcagcccttcgttatctctaacggcattgttgtctcaggtgtggagcgggcccaatgggccctggataatatcctgatcggcggggcagagataaacccctcccaacttgtagatacttttgacgatgagggcacgtcgcacgaggagaactggagcttctacccaaatgctgtgcgaactgccggcttttgtggaaatcccagcttccatttgtattggcctaacaagaaaaaggacaagactcataacgcactgagcagcagggagttgattatccagcctggatacatgatgcagttcaagatagtagtcggatgcgaggccaccagttgcggcgacctgcactccgtgatgttggagtatacaaaggatgcgagatctgactcctggcagcttgtgcagacacaatgcctaccctcttcatcaaattccatcgggtgcagcccttttcagttccacgaggctaccatctacaactccgtgaactcttcgtcatggaagcggatcactatccaactccctgatcatgtgagttcttcagccacccagttccggtggatccaaaagggggaagagacagaaaagcagagctgggctatcgatcacgtctatattggcgaagcctgccccaaactctgctcaggacacggatattgtacaacaggcgccatatgcatctgtgacgaatctttccagggtgacgactgtagcgtgttctcgcacgatctgccaagttacattaaagacaacttcgagtccgcgcgggtcacggaggccaattgggagacgatccagggcggtgttatagggagtgggtgcggtcagcttgcaccctacgcacacggcgattcattgtattttaacggctgtcaaataaggcaggcagcgaccaagccgctggatctcactcgggcttcaaaaattatgttcgtgttgcagataggcagcatgagccagacggacagctgcaacagtgacttgagcggaccccacgccgtggacaaggctgtgctcctgcaatactccgtgaacaacggcataacatggcacgtgattgctcagcatcagcctaaggacttcacgcaggcacagcgcgtgtcctacaacgtcccactcgaggcccgaatgaaaggggtgctcctgcggtggtggcagcctcggcataatggaacaggacacgaccagtgggcactggatcatgtcgaagtggtgctgtag

SEQ ID NO: 17128 - DNA, 1668 bp, Artificial Sequence
  Description of Artificial Sequence: Synthetic coding sequence
atgaaaaagcacgattttgctgaaaacctgcccagtagcctgctgattattatcctcgtgattttcacgctctcagggtcgaagttcgggaggggaaccggtcttactcaaccttctcagcgtaccagtgcccgcagaagtttcggccggtccaaaagatttagcatcactaggtccctggatgatcttgagagcgcaaccgtttctgacggggaactgaccggagcggacctaaaagattgcgtcagtaataatagcctgtcttctaatgcctccctcccaagtgtccagtcttgccggcgccttcgcgagcgtcgcgtcgcatcatgggctgtttcgtttgaacggctcttacaggacccagttggagttcgttatttttcagattttctgagaaaggagttttcagaagaaaatattctgttctggcaggcctgcgaatacttcaaccacgttcctgctcacgataaaaaggaactctcatatagagcaagagagatattttcaaagttcttgtgctctaaggcaaccactccagtcaatattgattcccaggctcagttggcagacgatgtgttaagagctccccacccagatatgttcaaggaacagcaactccagattttcaaccttatgaaatttgacagctacacaaggttcctgaagtcccctctgtatcaggagtgcatccttgcggaagtggaagggcgagcgcttcccgattcacagcaggtaccctctagcccagcttctaagcactctcttggctcagatcacagttccgtcagcactcccaagaagttgtccgggaagagcaaatccggccgcagcctgaatgaggaactgggggatgaggattctgaaaaaaaaagaaagggagcattcttctcctggtcccggactcgatcaactggcagaagccagaaaaagcgagaacatggagatcatgccgacgacgcactgcacgccaatggaggactttgccgtagagagagccagggatctgtctcctctgccgggtccctggatctcagcgaagcgtgccgcacattagcacctgagaaagacaaggcgactaagcattgctgcattcatctgccagacggcaccagttgcgtggttgctgtgaaggccggcttctctattaaggacatactgtcgggtctatgcgagagacacggaattaatggggccgccgctgacttgtttctcgtgggaggcgataaacctctggtgctgcatcaggacagcagcattcttgagtctcgcgaccttcggttagagaagcggaccctgtttagactagatttagtgcccataaaccggtctgtcgggctgaaagccaaacccactaagccggtgaccgaggtcctgaggcccgttgttgccaggtacgggctcgacctttcagggctgttggttcggctgagtggagagaaggaaccgcttgatctgggagctcctatctcttccctggacggtcaaagggtcgttttggaagaaaaagacccttcccggggcaaggccagtgcagacaaacagaagggcgtccccgttaagcagaataccgctgtgaactcctcctctcgcaatcatagtgctacatcttttctttccttatttccaaagcttcgtgcaaccgagcagatgaccaatgtgggatgctag

SEQ ID NO: 17129 - DNA, 4131 bp, Artificial Sequence
  Description of Artificial Sequence: Synthetic coding sequence
atgtttcgcgccggagaagcctccaaaaggccattacccggcccgtcccctcctcgggtgcggtccgttgaagttgctcgcggacgagccgggtacggcttcaccttgagcgggcaagctccctgcgtgctctcttgcgtaatgcggggctcccccgccgacttcgttgggctgcgagctggtgaccagattctcgctgtgaacgagatcaacgtcaaaaaggccagtcacgaagacgtagtgaagttgatcgggaaatgctccggagtcctgcatatggtgattgctgaaggcgtgggtcggtttgagtcctgctcttctgacgaagaaggcggattatatgaggggaaaggttggctgaaacccaaacttgacagtaaagcacttggtataaatagagccgagagggtggttgaggagatgcaatcaggagggatctttaacatgatatttgagaaccccagcctgtgcgcctcaaacagcgagcccctgaagttgaagcaacgtagtctatccgaatccgctgctacgcgcttcgacgtaggccatgaatccattaataacccaaatcctaacatgctgtctaaagaggagatttctaaggtaattcacgatgattcagtgttctccataggtctggagtcccatgacgattttgcgctggacgcatcgatcctgaacgtggcgatgatcgtcggatatctgggctcaatcgaactgccatctaccagtagtaatctggaatctgattccctccaggccattagaggctgtatgagacggctgcgagctgaacagaaaatccatagtctggtcaccatgaagatcatgcatgattgcgtgcagctgagcacagataaggcaggcgttgtggccgagtatcccgctgaaaaacttgctttcagtgctgtctgccccgatgacaggcgcttttttggattagtcaccatgcagaccaacgatgatggctcacttgcacaagaggaggagggtgcgttacgtacatcgtgtcatgtgttcatggtcgaccctgatctgttcaatcacaaaattcaccaaggaatcgctaggcgcttcggatttgagtgtaccgcggacccggacaccaatgggtgcctggagtttcccgccagcagcttaccagtcctgcagttcatcagcgtgctatatcgggacatgggagagttgatcgaaggtatgcgcgctagagcctttcttgacggtgatgccgacgctcatcagaacaacagcacatcaagcaacagtgacagcggaataggcaatttccaccaagaggaaaagtctaaccgggtgttggtggttgatctgggcggatctagtagtaggcatggtccagggggaagcgcatgggatggggtgggaggcagaggagctcagccctggggcgctccttggacaggtccgttttgtcctgaccctgagggctctccaccatttgaggcagcccatcaaacagatcgattttgggacctgaacaagcatttgggccccgctagcccagtggaagtgccacccgcctcactgcggagtagtgttcctccttccaagcgcggcactgtgggcgccggctgtggattcaatcagaggtggcttccggtgcacgtgctacgcgagtggcagtgtggccacacctccgaccaggatagctatacagatagcacagatggctggtcttcaatcaattgtgggaccttgccgcctcctatgagtaagattccggccgaccgatacagagtcgagggatccttcgcgcagccccctcttaatgctccaaaacgggagtggagccgcaaggcatttggtatgcaatctatttttggcccccaccgaaatgtgagaaaaacaaaggaggacaagaaagggagcaagtttgggagagggaccggtctgacacagcccagtcaaagaaccagcgctcgacgcagcttcggccgctccaaacggttcagcataaccaggtcactcgacgatctggaaagtgccaccgtcagcgacggtgagctaacaggtgcggatctgaaggactgcgtgtccaataacagtcttagcagtaacgcttcactgccaagcgtgcagtcatgtaggcgcctgcgggaacgcagagtagcttcttgggctgtgagtttcgagaggttattacaggatccagttggcgtgcgctactttagcgactttctgaggaaggagttcagcgaggagaatatattgttctggcaggcttgcgaatatttcaatcacgtccctgcgcacgataaaaaggagctgtcttatcgcgcccgcgagatcttcagcaaattcctgtgctccaaagcaacaactccggtgaatattgactcccaagcgcaattagccgatgacgtattgcgggcccctcaccctgacatgtttaaagagcagcagctgcaaattttcaacctgatgaaatttgactcctacacacggttcctgaagagtcccttgtatcaggaatgcatactggccgaagtggagggacgggccttgcctgattcacagcaggtgcctagctccccagcttctaagcattcactgggctcagatcacagcagcgtgtccacaccaaaaaagctgtctggcaagtccaaatccggtcgctccctgaatgaggaactgggtgacgaggattcagagaagaagagaaagggggccttttttagctggtcacgaacgcggtctactggccgctcccagaagaagagggagcatggcgaccacgcagacgacgctctacatgccaatgggggcctctgtcgcagggaaagtcagggcagcgtaagctcggcaggatcccttgatctgagtgaggcttgcaggaccctagcgcctgagaaggacaaggccacaaaacattgttgcatccatctcccagacggaacgagctgtgtagttgccgtgaaggcaggcttctccataaaggacattcttagtgggttgtgtgaacggcacgggatcaacggcgcggcggcagatctattcctggtcgggggagacaaacctctggtgctgcaccaggatagttcaatcctcgaatcaagagaccttcggctggagaaacggacactgttcagactggatctcgtgcctataaatcgtagcgtggggctcaaagcaaagccaactaagccagttaccgaagtgctgcggccagtcgtggcccgttacggactggatctttctggtttgctggtccgactaagcggggagaaggaacctctggatcttggggctccgatatcctccctggacggtcagcgcgtggtccttgaggagaaggatccaagcagaggcaaggcaagcgccgataaacaaaaaggcgtgccagtgaaacaaaatactgcagtcaatagcagtagtcggaaccacagtgccactggggaagagcgaacactcggaaaatctaacagcatcaagatcaaaggggagaatggaaagaatgcacgggatccacgattaagtaagagagaggaaagtatcgccaagatcggcaagaagaaatatcagaaaattaacttagatgaggcagaagagtttttcgagcttatcagcaaggctcagtcaaacagggccgatgaccaacgaggcttgttgagaaaagaagatttagtgctgccagaattcttgcgtcttcccccggggagtaccgagctgacgcttcctacccctgctgccgtcgcaaaaggctttagtaaaaggtccgccactggcaacggcagggagtctgccagccagccaggcgagcagtgggagccagtccaggaatcttctgatagtcctagtacgtcccccggatctgcgagttctccaccaggccctcccggcaccactccaccgggtcaaaagtctccctccgggcccttttgcacgccccaatctcccgtgagtcttgcccaggagggcacagctcaaatttggaagcgccagagccaggaagtcgaggcaggcggcatacaaacagtggaggacgagcacgttgccgagttaacccttatgggagagggtgatattagcagccccaacagcaccctcctgccacccccaagcaccccgcaagaggtgccaggaccgagtaggccagggacttcacgcttctag

SEQ ID NO: 17130 - DNA, 2400 bp, Artificial Sequence
  Description of Artificial Sequence: Synthetic coding sequence
atgaatcttggtaaagagcttagcaacgagactcatgtctctaatgatcaacagagtgctactgtgtccgacggtgagttgaccggcgccgacctgaaggactgcgtctctaataatagcttatctagcaatgcatccctgccatcagttcagtcctgccgtagactaagagaacgcagggtcgcgagttgggcggtctccttcgaaaggcttcttcaggacccggttggggtcaggtacttctctgacttcttaagaaaggaatttagcgaggagaacatattattctggcaggcttgtgaatacttcaaccacgtgcctgcccatgacaaaaaggagctgagctaccgagcccgagagatctttagcaagttcctgtgtagcaaggctacaactcctgtgaacatcgactctcaggcgcagcttgctgatgacgtgctgagggctccccacccagacatgtttaaagaacaacagttgcagatctttaacctgatgaagttcgacagctatacccgcttcctgaaatcacccctttaccaagagtgtattctcgctgaggttgagggccgtgcattgcccgatagtcagcaggttccgagcagcccagcttctaaacacagcctgggatcagaccactcaagcgtaagtaccccaaagaagctgtccgggaagagtaagtctggtagatcgctgaatgaagagcttggcgacgaggactctgagaaaaaacggaagggagcttttttttcctggtctagaacacggagtacaggccgctcccagaagaaacgcgagcatggcgatcacgcggacgacgctctgcacgctaatggagggctctgtaggagagaaagccaggggtctgtcagttccgcgggttcactcgatcttagcgaagcctgtcgcacgttggctccagaaaaagataaggcaacaaagcattgctgtatccacctgcctgatggcacaagctgtgtcgtcgccgtcaaggccggcttttctatcaaagatatattgagcggtttatgcgagcggcatggtatcaatggagccgccgccgatttatttctcgtgggaggcgacaagccactggtactgcaccaggactcaagtattctggaatctagggacctccgtctggaaaaacggactctattccgtctggacctggtaccaattaatcggagtgttggactcaaagcgaagcccacaaagcctgtgaccgaagtcttaaggccagttgtggcaaggtatggactggatctgtcaggcctcttagtccgtctgagcggggagaaggaaccgctggatcttggcgctcccatttctagtcttgatggtcagcgcgtggtacttgaggaaaaagatccttcacgtggaaaagcatctgctgataagcagaagggtgttcctgtgaagcaaaacacagctgtgaactcctctagccggaaccactccgcaactggcgaagagagaacactgggcaagagtaacagtattaagatcaagggtgaaaatggcaagaacgcacgcgacccaagactttctaagagagaggagagcattgctaagatcggcaaaaaaaagtatcaaaagataaacctcgacgaagccgaagagtttttcgaactgatctctaaggcacaatcaaaccgagcggacgatcagaggggcttacttaggaaagaggacttggttctccccgagtttttgcgactaccccccggcagcacagaattgacattgccaacgccggccgctgttgctaagggtttctccaagcgctcagcaacggggaacgggagggaaagcgccagtcaaccaggagagcaatgggagcctgttcaggaatctagtgacagtccatccacctcaccggggagtgcgagctcaccacccggccctcctggcacgacacctcccggacagaagagcccatctggccccttttgtacaccccagtcccctgtgagcctagctcaggaaggcaccgcacagatctggaagcgtcaatcccaggaggtggaggcagggggaatccagaccgtcgaggacgagcacgtcgcagaattaactctgatgggggaaggcgacatcagcagccccaacagcacgctgctaccccctccctccacgccgcaggaagttccaggcccctcccggcccggatcggggacacatggatcccgagaccttccggtgaatcgtattatagatgtggatcttgttacggggagcgctcccgggagggatggaggtatcgctggagctcaggccggcccaggaagatcccaagcgtctgggggtccacctacatccgacctcccaggcctggggcctgtccccggtgagccagcaaaacccaagacctccgcccatcacgccacattcgtctag

SEQ ID NO: 17131 - DNA, 4344 bp, Artificial Sequence
  Description of Artificial Sequence: Synthetic coding sequence
atgttcagggccggcgaggcttcaaaaagacctttgccaggtccatcaccacctcgcgtgcgctccgtggaggttgctcgcggaagggcaggctatggattcacgctgagcggccaggcaccatgcgtactcagttgcgttatgcgcggtagccccgcggactttgtgggactgcgggcaggggaccagattctcgcagttaacgaaattaacgtgaagaaagcctctcacgaggatgtggtaaaattaattgggaagtgctccggtgtgctgcatatggtgattgccgaaggcgtcggtcggttcgaaagttgttcatccgatgaggagggcgggctctacgagggcaaagggtggctgaagccaaaattagacagtaaggccctcggcattaacagagcagagcgggttgtggaggaaatgcagtccggaggtatatttaacatgattttcgagaatccaagtctgtgtgcaagcaattccgaaccacttaaactcaagcagagatctctcagtgaaagcgcggctactcggttcgatgtgggccacgagtcgataaacaatcccaacccaaatatgctcagtaaagaggaaatcagtaaggtaatccatgacgattccgtgttcagtattggtctggaatctcacgatgatttcgcacttgacgcttccattttgaatgtggccatgattgttggatatctggggtctatcgagctgcccagtacgagttcgaatctcgagtcagatagtctccaggctatcagaggctgcatgagacgcctgcgagctgaacaaaaaatacattcccttgtcaccatgaaaattatgcatgactgtgtccagctcagtaccgacaaagctggcgtcgtggcagaatatcccgcagaaaaactcgctttctccgccgtgtgcccagatgatcgtagatttttcggacttgtgacgatgcagacaaatgacgatggtagtttggcccaggaagaagaaggggcactgagaacatcatgtcacgtgtttatggtcgacccagacctatttaaccacaaaatacaccagggcatcgcccggaggtttggctttgagtgcaccgcagatccagataccaacggatgcctggaatttccagcatctagcttgccagtccttcaatttatcagcgtactatatcgagatatgggggaactgatagagggcatgcgggccagagccttcttggatggagacgccgatgctcaccaaaataactctacatcttctaacagcgatagcggcatcggaaatttccaccaggaagaaaagagcaatagggtactcgtcgtggatctgggaggtagttcaagccggcacgggccaggaggaagtgcctgggacggcgtgggcggacgcggcgcccaaccctggggcgcaccttggactggtcctttctgtcctgatccagagggttctccaccctttgaggctgcacatcagacggaccgtttttgggaccttaataagcacttgggcccagctagcccagtggaggtaccacccgcgagcctgcgctcaagcgtgcctccttctaagagggggacagtcggcgcaggctgcggattcaaccagagatggctgcctgtgcacgtgcttagagagtggcaatgtggtcacacatctgaccaggacagctatacagactctactgatggctggagctcaattaattgcggcacactcccccctccgatgtcaaagatcccagccgacagataccgggttgaaggatcctttgcccagccacctttgaacgcccccaaaagagagtggtcccggaaagctttcgggatgcagagtattttcggtcctcatcggaatgtccggaagaccaaagaggacaaaaaaggttctaagttcggtcggggcacagggttaacccaaccatcacagcggacctccgccaggcgatcttttgggcgtagtaagcgcttctcaatcaccagaagcttggatgacttagagagcgccacagtatcagacggggagctcaccggcgctgatttaaaggattgcgtgtctaacaattccctcagtagcaacgcctcccttccttccgtgcagtcatgtcggcgtcttagagaacgacgggtggcttcctgggcagtatccttcgagagactcctgcaagatccagtgggcgtgcgatacttttctgatttcctccgaaaggaattctctgaagaaaatattctgttttggcaggcgtgcgaatattttaaccacgtgcctgcccacgataagaaggagctgagctacagggcgcgtgagatttttagtaagttcctctgctccaaagcaacaaccccagttaacatagactcccaagcccaactcgcagacgacgtgctgcgggcaccccaccccgatatgtttaaagagcaacagctgcagatctttaacttaatgaagtttgatagctacaccaggttccttaaatcaccgctataccaagaatgtattttggcggaggtagaagggcgagcgctccccgactcccagcaagtgccttctagtccggcttcgaaacactcactgggctccgaccattcatccgtgtctacaccaaaaaagctcagcgggaagtcaaaaagcgggcgaagcctgaatgaagaactgggtgatgaagatagcgagaaaaagaggaaaggagctttcttctcttggtctagaactaggagcaccggtcggagccaaaagaagagggaacacggcgaccacgccgatgatgcactgcacgcgaacggcggcttatgtaggcgcgaaagccaaggttctgtgagttctgctggaagtcttgatcttagtgaggcttgcagaaccttagctcctgaaaaagacaaggccactaaacattgctgtattcatctccccgatggaacctcttgtgttgttgccgtgaaggccggcttttccatcaaagatattcttagcggtctttgtgaaaggcacggaattaacggcgccgctgccgatctgttcctagtgggcggagataagccactggtactgcaccaagacagttcaatcctggagagtagagatctcaggctggagaagagaactctgtttcgtctggatctagtcccaattaataggtccgtgggccttaaggctaagcctaccaaacctgttaccgaagtccttcggcctgttgtggctagatatggactggaccttagcggactgttagtaaggctgagcggcgaaaaagagccccttgacctgggtgccccgatttcctccttggatggacaacgggtcgtcttagaggagaaggatccatcccgaggcaaagcttcggcggacaaacagaagggagttcccgttaagcaaaacacagcagttaatagttcctccaggaaccacagcgccaccggtgaagaaaggactctgggcaagtccaactccataaagatcaaaggcgagaatggtaaaaacgcccgcgaccctcggttgagcaaacgcgaagaatctattgcaaaaattggcaagaagaaataccagaagattaacctagacgaggctgaggagtttttcgagttgatctcaaaggcccagagcaatcgcgccgacgatcagaggggtctgctgaggaaggaagacctggtcctgcctgaatttctcaggcttcctcccgggtccaccgagttaaccctcccgacccctgcagcagtggccaaaggtttctctaagcgctccgccactgggaacggaagagagtcagcctcccagcccggagagcagtgggagcccgtgcaagagagcagtgattccccatcaacttctcccggctccgcgtccagtccaccgggcccccctggcaccacccccccaggacagaaatctcccagtgggcccttctgcacgccacagtctcccgtgtccctcgcccaagagggtaccgcccaaatttggaaaaggcaatctcaggaggtagaagctggcgggatacagactgttgaggatgagcacgtggccgagctgactttgatgggagaaggtgatatcagcagccccaacagcacccttctccctccgccctctaccccccaagaggtacctggtccaagcagacccggttccggcacgcacggctctcgcgacctgcccgtcaatagaatcatcgacgtggacctcgtgacaggatccgctcccggccgtgacggtggtattgcaggcgcacaggccggtcctgggcgctcacaagcaagtggagggcccccgaccagcgatcttccaggacttggcccagtgccaggggaacccgctaagccaaagacaagcgcccaccacgcgaccttcgtgtag

SEQ ID NO: 17132 - DNA, 4131 bp, Artificial Sequence
  Description of Artificial Sequence: Synthetic coding sequence
atgtttcgtgccggcgaggccagcaaacgccccctccctgggccgtctcctccaagagtcaggtcagtggaggtggcccgcgggagggcaggctacgggttcaccttgtccggacaggccccttgcgtgctttcctgtgtcatgcgtggatcaccagcagatttcgtgggcctgagggcaggagaccaaattctcgccgtcaacgagatcaatgttaaaaaggcgagccacgaagatgtggtgaaattgataggcaagtgttccggggtgctccacatggtaatcgccgagggggttggcaggttcgaaagttgttctagcgacgaagagggtggcctgtacgaaggcaaggggtggctgaagccaaagctggacagcaaggcattgggaattaacagagctgaaagggtggtggaggaaatgcagagcggaggcatctttaatatgatttttgagaatccaagtttgtgcgcttctaacagcgaacccctcaaattgaagcagcgcagcctgagcgaaagcgcagcaactagatttgatgtggggcatgagtctatcaataaccccaatcccaacatgctatctaaagaggaaatcagtaaggtcattcatgacgactccgtttttagcatcgggcttgaaagtcacgacgactttgccctggatgcatcaattctaaacgtcgctatgatcgtgggttatctcggatccattgaactgccttccacaagttccaatctcgaaagtgattcgctgcaagcaatcagagggtgtatgcggcgattgagagccgagcaaaaaatccactcactagttaccatgaaaataatgcacgactgcgtgcagttgagtactgacaaagcgggggttgtggcagaatacccggccgaaaaattagcatttagcgctgtgtgtcctgatgacagacggttcttcgggttagttacaatgcagactaatgatgacggcagcctggcccaggaggaagaaggagcactgcgcacttcctgtcacgtcttcatggtggacccagacctgtttaaccataagattcaccagggcattgcgaggcggttcgggtttgagtgcaccgcagatcctgacaccaacggttgtcttgagtttccagcgtctagcctccctgtcctccagtttatcagtgtcctgtaccgggatatgggcgaactgattgagggcatgagagcccgcgcctttctggacggagacgcagacgcacatcagaataactctactagtagcaactcagattccgggatagggaactttcaccaggaggagaagagtaaccgggtccttgtggtggatctgggtggcagcagtagcagacacggtccagggggttctgcatgggacggcgtggggggccggggcgcacagccttggggggccccctggacaggacctttttgtcccgaccctgaaggcagtcccccatttgaggccgctcatcagacagacagattctgggatctgaacaagcacctgggccctgcatctcccgtcgaggtgcctccagcgagtttgagaagcagcgtgcccccttccaagagaggcacggtcggagccggctgcggctttaatcaaagatggctgccagtccatgtcctgcgcgaatggcagtgtgggcatacctccgatcaagattcttataccgactctacggacggctggagcagtatcaactgtggtaccctaccccctcctatgagtaagataccagcagatcggtacagagtggaaggtagttttgctcagccacccctgaacgcccctaagagagaatggtcacgtaaagcatttggaatgcagagtatctttggcccccatagaaatgtgcgcaaaacaaaggaagataagaaaggcagcaagttcggacggggaacaggactgacacagccatcccagcggacgagtgccagaaggtctttcggaagatccaagagattcagcataacccgatcactcgacgatctggaaagtgctacagtgtctgacggtgagcttacaggcgcagatctgaaggattgtgtgagcaataattctctgagctctaatgcttctctcccttccgttcaatcatgcaggaggctccgagaaaggcgtgtggctagttgggctgtgagtttcgaacgactgctgcaggatcctgtgggtgtgcgctatttctctgactttctaagaaaagaattttccgaagagaacatccttttctggcaggcatgcgagtacttcaaccacgtgcctgcccacgacaagaaggaactttcttatcgagcccgggagatttttagtaaatttctctgcagtaaggccaccacaccggtgaatatcgattcacaagctcagctggcagatgatgtgctgagggcacctcatccagatatgttcaaggaacagcagctgcagatcttcaacctgatgaaattcgatagctatacccggtttctgaagagccctttgtaccaggaatgcattctagctgaggtcgaaggaagagcgttacccgacagtcagcaggttccaagctcacccgctagtaaacacagcttgggttctgaccacagctctgtctctactcccaagaaattgagtggcaagagtaaatcggggagaagcctaaacgaggagctgggcgatgaagacagcgaaaaaaaacgaaaaggtgccttcttcagttggtctaggacccgcagcactggccgctctcagaagaagcgagaacacggagaccacgccgacgatgcccttcacgcaaacggcgggctatgccggagggaaagtcaaggatctgtcagctcagcgggtagtctcgatctctcggaggcttgccgcacactggcgcctgaaaaagataaggcgacaaaacattgttgtatccacctaccagacggcacgagttgcgtggtggctgtgaaagccggcttcagtattaaagatatcctgtccgggctgtgtgagagacacggcatcaacggcgcagcagctgacctgttcttggtggggggagacaaacctttggtactacaccaagactcctccatactcgagtctagggacctccgccttgaaaaaaggactcttttccgactggacttggtccccatcaatagaagcgtgggcctgaaagccaagcctacaaagcctgtgaccgaagttctgcggcctgtagttgcaaggtacgggctggacttatctgggcttttggtgcgcctgtccggagagaaggaaccactggatttaggggctccaatttcatctctggacggtcagcgagtagtgctcgaggagaaagaccctagcaggggaaaagccagcgcagacaagcagaagggcgtgcccgtgaagcagaatactgctgttaacagcagtagtcgcaatcattccgctaccggagaagagcggactcttggaaagtctaactcgattaagataaagggtgaaaacggtaagaatgcgagggatcccagactgagcaaaagagaagaaagcatcgccaaaatcggtaagaaaaaataccaaaagatcaacttagacgaagcggaggaatttttcgaacttatttctaaagcacagtcaaaccgagcagatgaccagaggggtctgctcaggaaggaggatttagtgctccccgaattccttcggctccccccagggtctaccgaactgaccctgccaacaccagccgccgtagctaagggtttcagtaagcgcagcgctacaggtaacggacgggaatccgcaagccagccaggtgaacagtgggagccagttcaagagagttcagactctccctccactagtcctggctccgcctcctcacctccaggaccacccggaactacaccccccggccaaaaaagccccagtggacctttctgtacaccacagtcacccgtaagccttgctcaggagggcacagctcagatctggaagcgacagagccaagaggtggaggccggaggcatacagacagtggaagacgagcacgtcgcagaactgaccctcatgggcgaaggagatatttcatcacctaactcaacacttctccctccaccctctacaccccaggaagtgcccggcccctctcggcctggcaccagtcgcttctag

SEQ ID NO: 17133 - DNA, 1500 bp, Artificial Sequence
  Description of Artificial Sequence: Synthetic coding sequence
atgtcgttgtcactgtttttccagagcgcaactgtgagtgatggcgagctcactggagccgacttgaaagactgcgtgtcgaataattcactgagctccaacgctagtctaccttccgttcagtcctgccgtcgcctgcgtgagcggcgtgtcgcctcttgggctgtgtctttcgaaagactgctccaggaccctgttggggttagatatttctccgactttttaaggaaagagttctcagaggaaaatattttgttttggcaggcttgtgaatatttcaaccacgtacccgcccacgacaagaaagagctgtcttatagggcccgagagatattcagtaagttcctgtgctccaaggctacaactccggttaatatcgacagtcaggcacagctcgctgatgatgtgttgcgagcaccccatcccgatatgttcaaagaacagcaactgcagatcttcaacctgatgaagttcgattcttatactcgctttttgaagtcacccctgtaccaagagtgcatattagccgaagtggaaggcagggcactgccggattctcaacaggtgccatccagccccgcctcgaaacattccctcgggtctgatcacagttccgtgagcactccgaaaaaactgtctggaaaaagtaagagtggacgcagtctcaacgaggaactaggtgacgaagatagcgaaaagaaaaggaaaggagcctttttcagctggagcaggactcgcagtactggccggagccagaaaaagcgggagcacggagaccacgcggatgacgctctacatgccaacgggggactatgtcgccgagaatcacagggatctgtgagcagtgccgggtccctggatctatctgaggcctgcaggacactagcccctgagaaagacaaagcaacgaaacactgttgcatccatctacccgacggaacctcttgtgtcgtggccgtgaaagccggtttcagtattaaagatatcctcagtggattatgcgagcgacacgggatcaacggagctgctgctgatctgtttttagtgggcggggacaaaccactagtgctgcaccaggactcatctatccttgaaagccgcgatctccggttagagaaacgaaccttgttccgcctggacttagtgccaatcaatagaagtgttgggttgaaggccaagcctactaaacctgtgaccgaggttctgagaccagtcgtagctagatacggactggacttaagcgggttgctcgtgaggcttagcggtgagaaggagcctctcgatctcggtgcaccaatctcaagtctggacgggcagagagttgttctagaggagaaggacccctctcgtggtaaggcctctgcagataagcagaagggcgtcccagttaagcagaacacagctgtcaattcatcctctagaaaccattccgccacttctttcctgtcactctttcccaaactccgcgccactgagcagatgaccaatgtaggatgctag

SEQ ID NO: 17134 - DNA, 2004 bp, Artificial Sequence
  Description of Artificial Sequence: Synthetic coding sequence
atgtttagagccggcgaggcatctaagcgacccctgccgggcccgtctcctcctagagtacggtccgtggaggtggcccgaggacgagctgggtacgggtttacgctctctggacaggccccctgcgtactcagctgcgttatgcgcgggtccccagctgattttgtaggcctccgcgctggagatcaaatacttgccgtgaatgagattaacgtcaaaaaagcgtcccacgaagacgtagttaaactaatagggaaatgttccggtgtgctgcatatggtcatcgccgaaggagtcggtcgcttcgagtcttgttcctctgacgaagagggagggttgtacgagggcaagggctggctgaagcccaaactggacagtaaggccctcggaatcaatcgcgcagaaagggtggtggaggagatgcaatctggtggcatctttaatatgatctttgaaaacccttcattgtgtgcgtctaacagtgagccactgaagctaaagcagcgatcattgagtgagagcgctgctactcgcttcgacgttgggcatgagtccatcaataatcctaacccgaacatgctgagcaaagaagagattagtaaggtgattcatgacgactctgtgttctctatcggcctggagagtcacgacgacttcgcgctagacgcgtcaatcttaaacgttgccatgatcgtgggctatctaggctctatcgaacttcccagtaccagctcgaatctggagagtgattccctccaggccattcgaggatgcatgcgacggttgcgggctgaacagaaaattcactctctggtgacaatgaagataatgcatgattgcgtgcagctctccacggacaaggctggcgttgtggccgagtatccagcagagaaactggccttctccgccgtttgtccagacgaccgtagattctttggactggtgacaatgcagaccaatgacgacgggtccctggcacaggaggaagaaggcgccctgaggacatcttgccatgttttcatggtagatccggacctcttcaatcacaaaatccaccagggcatcgctcgccgctttggatttgagtgcaccgcagaccccgacacaaatgggtgtctggagttccccgcgtccagccttcctgtgctgcaatttattagcgtgctatatagggacatgggcgagcttatcgagggaatgcgggcaagagccttcctcgacggcgacgcggatgcccatcagaataactctactagcagtaatagcgacagtggcatcggaaattttcatcaggaagaaaaatctaatcgagttctcgttgtggacttgggaggtagtagtagcagacacggccccggcggctctgcctgggacggcgtgggcggcagaggggctcagccttggggggcaccctggacagggccattttgtcccgatccagagggttcaccacccttcgaagcggcccatcagactgacaggttttgggacctgaataagcacttgggacccgctagtcctgtggaagtgcctcctgcttccctgcggtcttcggtgccaccgtccaaacgcgggacggtaggcgccggctgtggttttaaccagcggtggctccccgtccatgtcctgagggaatggcaatgtggacatacatcagaccaggacagctataccgattctactgacggatggtcatctatcaattgcggaactctcccccccccaatgagcaagatcccggcagatcgttaccgggttgagggatcattcgctcagccaccgctgaacgcacccaagcgtgaatggagccgcaaagcctttggcatgcagtcaatttttggcccacaccggaacgtgaggaaaactaaggaagataaaaaggggtccaaatttggaaggggcaccgggcttactcagcccagccagaggacaagtgccagacgatccttcggacggtctaaacgattctccatcactcgcagtttggatgacttagaatcctag

SEQ ID NO: 17135 - DNA, 636 bp, Artificial Sequence
  Description of Artificial Sequence: Synthetic coding sequence
atgcagagcgccatgttcctggctgtgcagcatgattgccggcccatggataagagcgcgggctccggtcataaatccgaggaaaagcgtgaaaagatgaagaggactctgctcaaggactggaagactcgcttgtcatacttcctgcagaatagcagcacccctggcaaaccaaaaactggtaaaaagtctaagcagcaagctttcatcaagccatctcccgaggaggcacagttatggagcgaagctttcgacgagctgctggcaagcaagtatggccttgctgcttttagggcattcctgaagtccgagttctgtgaagaaaatatcgaattttggctggcttgtgaagacttcaaaaaaaccaagagtccccagaagctcagctccaaggctaggaagatctatacagattttatcgaaaaggaagcccctaaagagattaacatcgattttcagacaaagactttgattgctcaaaatattcaggaggccaccagcggttgtttcaccaccgcgcagaagcgagtctactccctaatggagaacaactcttatccaaggtttttagagagcgagttttaccaggatttatgtaagaagccacaaattactacggagccacatgcaacctag

SEQ ID NO: 17136 - DNA, 4203 bp, Artificial Sequence
  Description of Artificial Sequence: Synthetic coding sequence
atgccgaaaattgtattgaacggagtgacagttgacttccccttccagccctacaagtgccagcaagagtacatgaccaaggttctggagtgcctccagcaaaaggtgaatggtattttggaaagccctacaggaacaggtaagactctgtgccttctgtgcactactctggcatggcgggagcacttgcgcgatggaatctcagcccggaaaattgcagaacgagcgcagggcgagctgttcccagaccgggccctgagcagctgggggaacgcagccgcggccgcgggggatcctatagcctgctatacagatatcccaaaaattatttatgccagccgcacccatagccagttgacacaagtgatcaacgaattacggaatacgagttatcgtcccaaagtctgcgtactggggtccagggaacagctctgcattcatcctgaagttaagaagcaggagagcaatcatttgcagatccacctttgccgcaagaaggtcgcctctcggtcctgccacttttacaataacgtggaggaaaagtcactggagcaggaattggccagcccaatcctcgacatcgaggacctcgtcaagtcaggttccaagcatcgggtgtgtccttattacttgtcccgaaacttgaaacagcaggccgacatcatttttatgccttataattacttgttggatgctaagtcccgacgtgcccacaacatcgatcttaagggcactgtggtcatctttgatgaagcccacaatgtggagaagatgtgcgaggaatctgcctcatttgatttgactccccatgatctcgcctctggtctggatgtgatcgaccaggtgctcgaagaacagaccaaagctgcgcaacagggggagcctcaccccgaatttagtgcagactccccgagtcccggtctgaacatggaactggaggatatagctaaattgaagatgattttgctccggctggaaggggccattgacgccgtggagttgccaggcgatgattcgggggtgacaaaacccggctcgtatatctttgaacttttcgccgaagcccagattacttttcagacaaagggctgcatacttgacagtctggatcagatcatccagcacctggccggaagggccggcgttttcaccaacacagccggcctccagaagttggcagacatcattcagatcgttttctctgtggacccatctgaagggtcccctggctctccagctggtctgggcgccctgcagtcctataaagtgcacatccaccctgatgctgggcatagacgcactgctcaacggtccgatgcatggagcactaccgccgctcgtaaacgcggtaaggtcctctcatattggtgtttcagccccggccacagcatgcacgaactggtgaggcagggagttcgcagcctcatcctcaccagtggcactctcgctccagtgagcagctttgcgctggaaatgcagatcccttttcccgtgtgccttgagaatccgcacataatcgacaaacatcagatttgggtaggagtcgtaccgaggggccctgatggcgcccagctttcgtccgctttcgatagacgattctcagaagaatgtctgtccagtctggggaaggctctcggcaatattgccagggtcgtcccatatggcctcctgatctttttcccgtcttacccggtaatggagaaatccctcgagttctggcgggcccgtgatttagcccggaagatggaagctcttaaaccattgttcgtcgaacctaggtctaagggcagcttctctgaaaccattagcgcctattacgctcgggtcgctgcgccgggcagcacaggggcgacctttctagctgtctgcaggggcaaggcatcggaaggcctcgactttagtgatacaaatggcaggggtgttatagtgaccggcttgccctacccaccacggatggacccccgcgtagtgctgaagatgcagttcttggacgagatgaaggggcagggcggtgccggtggccagtttctgagtggacaagaatggtaccggcagcaggcgtcccgtgccgttaaccaggccatcggacgggtgattcggcacagacaagactatggcgctgtctttctctgcgatcataggttcgccttcgccgacgctcgtgcccagctgccgtcctgggtccgaccccacgtgagagtatacgataactttggtcatgtaatacgggatgtcgctcagtttttccgagtcgccgagcgtactatgccggccccagcccctagggccactgcaccttccgtacgcggcgaggacgctgtgagcgaggccaaaagccccgggccctttttctctacgcgtaaagccaagtcccttgacttgcacgtgccgtctctgaagcagagatcgtctggaagcccagcagccggcgacccggaatctagcctttgcgtggagtacgagcaggagccagtgcccgcaaggcaacggccaagggggctattggctgctctggaacattccgagcagcgggctggtagcccaggcgaagagcaggcgcactcttgttctacacttagcctgttgagcgaaaagagaccagccgaggaacctcgaggcggacgaaaaaagattcgactggtgtctcatccagaggaaccggttgccggtgcacagacagaccgcgcaaagctcttcatggtcgcggtcaagcaagagctgagccaagccaattttgccacgtttactcaagctctgcaggactataaaggtagcgatgacttcgcggccctcgccgcctgcctgggacctctgtttgcagaagatcctaagaaacataacctcttgcagggcttctaccaattcgtgaggccacaccataagcagcagttcgaagaagtttgtatccagctgaccggccggggttgtggttacaggcccgagcactcaatcccgagacgtcagcgcgcacagcccgtactggatccaacagggagaacggctcccgacccaaaattaaccgttagtaccgctgctgctcagcaactggatccccaggagcatcttaaccaaggccgcccacatctgtcacctaggcctccacccacgggtgatcctggctcccagccacagtgggggagtggggtgccacgtgctgggaaacagggacagcacgctgtaagcgcttatctggccgatgccagaagggcactcggctctgcgggatgctctcagctgctggcggccctgaccgcctacaaacaggacgacgatttagataaagtacttgcagtgctggctgcactgactacggcaaagcctgaggactttccactccttcatcggtttagcatgttcgttcgccctcatcataagcagagattctcacagacctgtaccgatcttacagggaggccctacccagggatggaaccacctgggcctcaggaggagagattagcggttccgcccgtcttgacccacagggcccctcagccgggcccttccagaagtgaaaaaaccgggaaaacccagtcaaaaataagcagcttcttgaggcagcgtcccgctggcacggtgggtgccggtggtgaagacgccggcccgtcccagtcgtctgggccgcctcacgggcctgcagcgagtgaatggggtgagcctcacggacgcgacatcgccggacaacaggcaacaggcgcccccggtggccccctaagcgctggttgtgtctgtcaaggttgcggggccgaggatgtcgtccccttccagtgcccagcatgtgacttccaaagatgccaagcatgttggcaaagacacctgcaggcttcccgcatgtgtccggcttgccataccgcaagccggaagcagtctgtgatgcaggttttctggcccgagccccataaagatcacgagggcgccggcggagctcgccccgtggccgcagtgcctggcgtgggggcagcctgtcccgccgcaggcgccggatgcactcgtagcggcaggaacacacatttgcctcttgctggccgtcgcgataggggcgcagctggcgtgcgcccggtcccaccgaggcacttgtgtgctgccgctgtccctccccggcaacctcacgatgtgtggccagtcagcacagcgccactccatgcagtccttgagcttcctcgcgccctcccactcctacaacgccccctgcgtggtgcctag

SEQ ID NO: 17137 - DNA, 1638 bp, Artificial Sequence
  Description of Artificial Sequence: Synthetic coding sequence
atgcctgcaccagccccccgagcaacagcaccttccgtacgcggcgaggacgcagtaagtgaggccaagtctccgggaccgttcttctctacccgaaaggcgaaatcacttgatctccatgtaccaagcctgaaacagcgcagttctggaagccctgctgcgggggatcccgagagttccctgtgcgtggaatatgagcaagagcccgtcccagcccgacagcggccaagaggcttactggccgcactagagcactcagaacagcgtgcaggatcccccggggaggaacaggcccactcctgctctacactgtctctattaagcgaaaagcggccagcagaggagccacgagggggacgcaaaaaaatccgcctcgtgagccatcccgaggaacccgtagctggcgctcagacggacagagctaagctgtttatggtcgcggtaaaacaggagctcagccaggcaaacttcgcgacgtttacccaggcattgcaagactataagggaagcgacgattttgccgccctggccgcttgcttgggccccctgtttgcagaggacccgaaaaagcataatctcttgcagggattctatcagtttgtcaggcctcatcataagcaacagttcgaagaggtgtgtatacagctgaccggtcgcggctgcgggtaccgaccagagcattctattcccaggcgacagcgggcacagccagtcctagatcctaccggacgtactgcacccgaccccaagttgactgtttcaacagcagctgcgcagcagctggacccccaggagcatttgaaccagggaagacctcacttatcccctcgcccgccacccacaggcgatcccggctcccaaccgcagtggggcagcggggtcccgagggccggcaaacagggacagcacgctgtgagtgcttacctggctgatgcccggcgggcactcggcagcgccggatgctctcagctgctggccgctttaacggcttacaaacaggacgatgacctggataaagttttagccgtgctggcggccctcacaaccgcaaaacccgaggacttccccctgttgcacaggtttagcatgttcgtgaggcctcaccataaacaaaggttttctcagacttgcaccgatcttaccggaaggccatatccaggcatggaacctcccggacctcaagaagaacgcctagccgtacctcctgtgttgacgcatcgggccccccagcccggcccttcccggagcgagaagactgggaagacacagagtaagatttctagcttcttgcggcagaggccagcaggcactgtgggggccggtggcgaggatgccgggcccagccaaagcagcggaccccctcacggcccagcagcctcagagtggggcgagccacacggcagagatatagcaggccaacaggcgaccggcgcaccagggggacccttgagcgccggatgcgtatgtcagggctgcggcgcggaagatgtcgtcccttttcagtgccccgcttgtgattttcaaagatgccaggcgtgttggcaaagacatctgcaggcatccagaatgtgcccagcatgtcacaccgcctctcgcaaacaatcagtgatgcaagtgttctggcctgagccacagtag

SEQ ID NO: 17138 - DNA, 3660 bp, Artificial Sequence
  Description of Artificial Sequence: Synthetic coding sequence
atgcctaagattgtgctgaatggggtgactgtggatttcccttttcaaccatataagtgccaacaggaatacatgaccaaagtgctcgagtgtctccaacagaaagtgaatggcatattggagtcacctaccggtactggtaaaactctgtgtctactgtgcaccacactggcctggcgcgaacacctcagagacgggatttcggcacggaaaatcgcagaaagggctcagggggagctgtttcctgaccgcgccctgtcctcctggggaaatgctgccgccgcggccggggaccccatcgcctgttatacagatattcctaagatcatctacgcttcccgaacccactcccagttgacacaggtgataaatgaactccgtaatacaagttacaggcctaaggtgtgcgtattaggctctcgggaacagctctgcatccatcctgaagttaaaaaacaggaaagcaaccatctgcagattcatctctgtcgcaagaaggtggcgtccagatcttgccatttttacaataacgtggaggaaaaaagcctggaacaggagttggctagcccaattctggacattgaagatctggttaagtctgggagtaagcatagagtttgtccatactatttatcgagaaacttaaaacaacaagccgatattatcttcatgccttataattatttgctggatgcgaagtcccggagagcccataacatcgatctgaaaggaacggtggtgattttcgatgaagcacacaatgtggaaaaaatgtgtgaggaatccgcctcttttgatttaactccgcatgacctggccagtggcttggacgttatagaccaggtccttgaggaacagacaaaagctgcccaacaaggagaaccgcaccctgagtttagcgctgactctcccagtcctggacttaacatggagctggaagacatcgctaagttgaagatgatcttactccgcttggagggggccatcgacgcagtagagcttcccggggatgatagcggagtaaccaagccagggtcctacatatttgagttgttcgcagaggcccaaattacgtttcagactaaggggtgcatcttggactcattagaccagatcattcaacatttagccggtcgagctggagtgttcactaacactgctggcctgcagaagctcgctgatattatccagatagtgttctctgttgacccaagtgaagggtctcctggatcccccgccgggctgggagcactgcagagctacaaagtgcacatccatcctgacgcgggacaccgccgtacagcacagagatcagatgcttggagcactacagcagctaggaaaaggggcaaagtgctttcttactggtgtttctcaccgggccatagtatgcacgagcttgtgcgccagggcgtgagaagcctcatcttaactagcggcacactcgcgcctgtgagctcttttgcactggagatgcagataccttttcctgtgtgtttggaaaacccacacatcatcgataagcatcagatctgggtcggcgtggtgcccagagggccggacggcgcacaattaagctctgcattcgaccgcaggttttccgaagagtgcctctcgtctctcggaaaagccctggggaacatagccagagtggtcccatacggactgctgatttttttcccctcttaccctgtcatggagaaatcgcttgagttttggcgggctcgcgacttagctcgcaagatggaggcgctgaaacccctgtttgtagaaccacggtcaaaggggtccttttcagagactatctctgcatattacgcccgtgtcgctgctcccggctctacgggagcaacgtttctggccgtgtgtagggggaaggcttcagagggcttggacttctcagacacaaacggccgaggagtgatagtcaccgggctgccttatcctcccagaatggatccacgcgtggtgctaaagatgcagttcttggacgaaatgaaagggcaaggaggtgccggcggacagtttctttctgggcaagagtggtaccggcagcaggcctcccgggccgtgaaccaggccattggaagagtgatcagacaccgtcaagattacggggccgtcttcttgtgcgatcatcgcttcgcattcgcagacgcaagagcacagctgcctagttgggtgagacctcacgtaagagtgtatgacaatttcggtcatgtaatccgcgacgtcgctcagtttttcagggtggcggagaggaccatgcctgcgccggctccacgcgcgaccgcgccttcggtccgtggggaagacgctgtcagtgaagcaaaaagcccaggcccctttttcagtacccgaaaagccaaatctctggatctgcacgtaccctctctcaaacagaggagctccggcagtcccgctgccggggatcccgaatcttctctgtgtgtggaatatgaacaggagccagtccccgcacgacagaggccgaggggacttttggccgcactcgagcattccgagcaaagggccggtagccccggtgaggaacaggctcactcttgtagtaccctttctcttctaagtgagaagaggccagccgaagagccgcgcgggggcagaaagaaaatcagattggtgagccaccccgaagaaccggtggctggagcccagacagacagggccaagttgttcatggttgcggttaagcaggagctttctcaagccaatttcgccacctttacacaagcactccaggattacaaggggtcagatgactttgctgcactggctgcctgtctgggccctctgttcgctgaagatccaaagaagcacaatctgctgcagggcttctatcaattcgtacgcccacaccataagcagcaattcgaggaggtgtgcattcagctgactggcaggggctgtggttaccggcctgagcacagtatccccaggaggcagagagcccagccagtgctggaccccaccggccgcacagcccctgacccaaagctgacagtgagcaccgcagctgctcagcagctcgacccccaagagcacctgaaccagggaagaccacatctgtcaccacgccctcctcccactggcgatccgggttcccagccccagtggggttcaggagtgcctcgggctgggaaacaaggccaacatgcagtgagtgcttatttggcagacgcacggcgggcacttggatccgccggatgctcacagctgttggcagctctgacagcctacaagcaggacgatgacctggacaaagtgttggccgtgcttgccgccctgactaccgccaaacccgaggattttcccttgctgcaccggttctctatgttcgtgcgccctcaccacaagcagagattcagccaaacctgcacggatctaaccggcagaccctatccaggcatggaacccccaggtccacaggaagaacggctggccgtcccaccagtgttgacgcaccgtgcgcctcagccggggccttctaggagcgagaaaaccgggaagacacagtcgaagatcagttcatttctcaggcagaggcctgcaggtaccgtgggggctggcggcgaagacgcaggcccatcacagtcctcgggcccccctcacggccctgccgcctctgagtggggtttgtag

SEQ ID NO: 17139 - DNA, 3732 bp, Artificial Sequence
  Description of Artificial Sequence: Synthetic coding sequence
atgcctaagatcgtgctgaatggagttacagttgattttcccttccagccttacaagtgtcagcaggaatatatgaccaaggttctcgagtgtttacagcaaaaagtaaatggaatcttggaatcgccaactggcacagggaaaaccctgtgtctcttgtgtaccactttagcttggagggaacacctcagagatggtatcagcgcacggaagattgcagagcgggctcagggcgagttgttcccagatcgagcgctgagcagttggggcaacgctgccgccgctgctggcgatcctatcgcatgttataccgacatccctaaaattatttatgcctccaggacccattcccagctcactcaagtcattaatgaactgagaaatacctcataccggagtcgctgccgagcaactttgtgggtgctggagactgccccacccaggcctacagtgctaagtcctacaagacccaaagtctgcgtgctgggcagtcgggaacagctatgcattcatcctgaagtgaaaaaacaagaaagcaaccaccttcagattcacttgtgtcgcaagaaagttgcgtcgcgctcgtgccatttttacaacaacgtagaagagaaatccttggagcaggaactggcttcgccgatcttggatatcgaggacctggtgaaaagcggcagcaagcacagagtgtgtccttattacctaagcagaaaccttaagcagcaggctgacattatctttatgccatacaattacctcctggacgccaaatcgaggcgtgcccacaacattgacttgaaaggcaccgtggtgatcttcgatgaagcccacaacgtggaaaagatgtgcgaagaatctgccagcttcgatctgaccccccatgacctggcctctggcctggacgtgatcgatcaggtactggaggagcagacaaaggccgcccagcagggagagccacatccagaatttagcgcagattcaccctcccccggactaaatatggagcttgaggacatagcaaagctgaagatgatccttcttagactggaaggcgctatagacgccgttgagcttcccggggacgattccggagtgacgaagccgggcagttacatcttcgagctcttcgccgaagcacagattactttccaaaccaagggatgcattctcgattctctggaccagataatacaacacctggccggtcgagccggagtgttcaccaacacagctggacttcagaaactggccgatatcatccagatagtcttctccgttgatccttccgaaggaagccccggatcccctgccggcctcggcgccttacaatcatataaggtccacattcaccctgacgctggtcacagacgaactgcccaaagatcggatgcctggtctaccacagccgcaagaaaaagggggaaagtgttaagctattggtgtttctcccctggccactcaatgcatgagctcgtgcggcagggagtgaggagtctgatattgacctctggaaccttggccccggtgtcgagtttcgctctcgagatgcagatcccattccctgtctgcctggaaaatccccatatcattgacaaacaccagatctgggtgggcgtggtcccacgcgggcccgacggggcacagctgtcctccgcgttcgacagaaggttttctgaggagtgcctgtcctctttggggaaagcgctgggaaacattgccagggtcgtgccatatggcttactgatcttctttccctcatatcccgtaatggaaaaatccttagaattctggagagcacgagacctggccagaaaaatggaggccttaaaaccgctgttcgtagagccccgttctaagggctctttctccgaaacaatctctgcttattacgcgagggtcgccgcccccgggtccactggagccacatttctcgccgtttgcagggggaaagcatctgaaggcctggactttagcgacaccaatggccgtggtgtcattgtgaccggactgccatatcccccccgtatggatccgagggttgtgctaaagatgcagtttttggatgagatgaagggacagggcggcgcaggcgggcaatttctttcaggtcaggagtggtatcgtcagcaagcgtcccgcgccgtcaatcaggctatcgggagggttattcggcaccggcaggactatggcgccgtgtttctgtgcgatcaccgatttgcctttgctgacgcaagagcccaactccctagctgggtgcgaccgcatgtccgtgtttacgacaatttcgggcatgtcattagggacgtggctcagttttttagggtagctgaacggaccatgcccgcccctgcccccagagccaccgccccttctgtccgtggcgaggacgccgtctcagaagcaaaatcacccggcccattcttctccacgcgaaaagcaaaatctctggacctgcacgtcccctccttgaagcaaagatccagtggtagtcccgccgcaggcgacccagagtcctcgctatgtgtggagtacgaacaggagcctgtccctgcaaggcaaagacctagagggctgcttgctgccctagagcattccgagcaacgcgcagggagtcccggggaggagcaggctcatagttgctcgacactctctttgctgtctgagaaaagacccgctgaggagccacggggaggaaggaagaaaatccggctcgtctcccatcccgaggagcccgtcgctggggcacaaactgatcgggccaagctcttcatggtagcagtcaaacaagaattatcccaggcgaacttcgcaacctttacgcaggctttgcaggactacaaggggagcgatgacttcgctgccctggctgcctgtttgggtcccctatttgcagaggaccctaagaagcataatctgctgcaaggcttctatcaatttgttagacctcatcacaagcagcagttcgaagaggtctgtatccagctcactggaagaggttgtgggtacagacctgaacactctatccctcgtaggcagagggcccaacctgtcctggaccccaccgggaggactgccccagatccgaaactgactgtgagcacagcagctgctcaacaactggacccacaggaacatttaaatcagggccgcccccacctgagccctagaccacctccgaccggcgaccctggttctcaaccccagtggggcagtggcgtgccaagagctgggaagcaggggcagcacgccgtaagtgcgtatctcgctgacgcccgtagagcgctgggcagcgcagggtgtagccagttactagccgcacttaccgcatataaacaggacgacgacctcgataaagtgctggcagtgttggccgcgctgaccacagctaaacctgaagacttccccctgctgcactctaactcaatgttcgtgcgaccacaccataaacagcgatttagccagacatgcacagaccttacaggaagaccataccctgggatggagccccccggtcctcaggaggagaggctggccgtaccaccagtcctcacacacagagctccccagccaggaccctcacgctccgaaaagacagggaagactcagtcaaagatctcctcttttctgaggcagaggccggcgggcacggtgggggctgggggagaggacgcaggccctagtcaatccagtgggccaccccatggacccgctgcctcagaatggggactttag

SEQ ID NO: 17140 - DNA, 3444 bp, Artificial Sequence
  Description of Artificial Sequence: Synthetic coding sequence
atggatatcaggaagtttttcggcgtgattccgagtggcaagaagctcgtcagcgaaaccgtaaagaagaacgaaaaaacaaagtctgatgaggagactctaaaagccaagaagggcatcaaagagattaaggtgaacagctcccgaaaagaagacgacttcaagcaaaaacagcctagcaagaagaaacgaataatttacgactcagatagcgaatccgaggaaaccttacaggtgaaaaacgcaaagaagcccccggaaaaactgcccgtgtcttccaagccaggaaaaatatcccggcaggaccccgtcacctatatctctgagactgacgaggaggacgacttcatgtgtaaaaaggcagcctctaagtctaaggagaatgggaggtccaccaactcccaccttggcacttcaaacatgaaaaagaacgaggaaaacactaagaccaagaataagcctctgagtcctattaagctgaccccaacatcggtgctcgattacttcggaaccgggagtgtgcaacgtagcaacaagaagatggtcgcatcgaagaggaaagagcttagtcagaacaccgatgaaagtggtttgaacgatgaggccatagcaaagcaactacagctcgatgaagacgctgaactcgaaaggcaacttcacgaagatgaggagtttgccagaactttggccatgctggatgaggagcctaaaactaagaaggcccggaaggacaccgaagccggagagaccttcagctccgtacaggctaatctgagcaaggctgagaagcacaaatatccccataaagtgaagaccgctcaggtctccgatgaaaggaaatcttactcccccagaaaacagagtaaatatgaatcctcaaaagagtcccaacagcattccaagtcttctgccgacaagatcggtgaagtgagcagcccaaaggccagtagcaaactcgcaatcatgaaaagaaaggaagaaagcagttataaggagatcgagcctgtggcttctaagaggaaagagaatgcgattaaactcaaaggggaaacaaagactccgaaaaagaccaaatccagccctgctaagaaagagagcgtgtctcctgaagattccgaaaagaagaggaccaactatcaagcgtaccgttcttatctgaatagagagggacccaaggctctcggctccaaagagatccccaaaggggctgaaaactgtcttgaaggcctcatttttgtgattaccggggttctggagtccatcgaacgagacgaagcaaagtctctaatagaacggtacgggggcaaggtgactggcaacgtgagcaagaaaaccaattacctggtgatgggtcgtgacagcggacaatccaagagtgacaaggccgccgctctcgggacaaaaataatcgatgaggacgggcttctcaacctgattcgcactatgcccggtaagaagagcaagtacgagatcgccgttgagaccgagatgaagaaagaaagcaagctcgagcgaaccccccaaaaaaatgtgcagggcaagcgcaaaatctctcccagtaaaaaagagagcgagagtaagaaaagcaggcccacgtctaagagggacagcctggcaaagactatcaagaaggagacagacgttttctggaaaagtctggattttaaggaacaggtcgcagaagagacctccggggactcaaaggctagaaacctggccgacgatagctctgagaataaggtggaaaatctgctctgggtcgataaatacaagcccacctccttgaaaacaattatagggcagcagggtgaccagagctgtgcaaacaagctattgagatggcttagaaactggcagaaaagctcttcggaggacaagaagcatgcaaagttcggaaaattctccggaaaggacgacggctcttccttcaaggcggccctcctttcaggcccccccggcgttgggaagactacaactgcttccctggtttgccaggagctaggctactcttatgtagagcttaatgcctccgatacccggagcaagtcctcacttaaggccatcgtagccgaatccttgaataataccagtataaaaggattctacagtaacggggctgcatcctctgtcagcactaagcatgcattgattatggacgaagtagatggtatggccggcaatgaggaccgcggaggcatccaggagttgatcggcctaattaagcacaccaaaattccaattatttgcatgtgcaacgaccggaaccatcctaaaataaggtccctggtgcattattgcttcgacctgagatttcaaagaccaagggtggagcagattaagggagccatgatgagcatagcttttaaggaaggcctgaaaattccaccacccgctatgaacgagatcattctgggcgctaaccaggacattaggcaggtactgcataacctttccatgtggtgtgcccgttccaaggcattgacctatgaccaggctaaagccgactctcatagggccaaaaaggacatcaagatgggaccgtttgacgtggcacggaaggttttcgccgcaggtgaggagacggcccacatgtccctggttgacaagagcgacttgtttttccatgactacagcattgcacctctcttcgtgcaagagaactacatacatgtgaaacccgtcgcagccggaggagatatgaagaagcatttgatgctattgtcgcgtgccgccgatagtatttgcgacggcgacctggttgattctcagattcgatccaagcaaaactggagccttttgcctgctcaagcaatctacgcatccgtgctgcccggtgaactgatgagggggtacatgacacagttccccacttttccatcctggctgggcaagcactcctccactggaaaacatgaccggatagttcaggacctggcactgcacatgtccctgcgcacgtacagttccaaaaggaccgtgaacatggactatctgagcttactacgcgatgcgttggttcagcctcttaccagccagggggtcgacggggtgcaagatgtggtggctctgatggacacctattatttaatgaaagaggattttgagaacatcatggaaatttcatcatggggaggcaagccaagcccgttttccaaactggacccgaaagtgaaagcagccttcacgcgcgcctataacaaggaagctcacctaaccccctatagtctccaagccattaaggcctctagacactcaacatctccatccttggacagcgaatacaatgaggaactgaatgaggacgactctcagtctgacgaaaaggaccaggatgcaattgagacagatgccatgatcaaaaaaaagaccaagagctctaaaccttccaagcccgagaaggacaaggaaccgcggaaaggcaagggcaaatcaagcaagaaatag

SEQ ID NO: 17141 - DNA, 3447 bp, Artificial Sequence
  Description of Artificial Sequence: Synthetic coding sequence
atggatattagaaaatttttcggagtcatcccatccggcaagaaactcgtcagtgaaactgtgaaaaaaaacgagaagacaaagagcgacgaggagactctgaaagccaaaaagggtatcaaggagatcaaggtgaacagcagccgtaaagaggatgattttaagcagaaacaaccctcaaagaagaaacgaattatctatgatagcgattccgagtcagaagagacactccaggtgaaaaacgctaaaaagcctcccgagaaactgccagtctctagcaaacccggtaagataagtcggcaggacccagtgacttacatttccgaaactgacgaggaagatgattttatgtgcaagaaggcagcatccaagtctaaggagaacgggcgtagtacaaactcacatctaggaacatccaacatgaagaaaaacgaagagaacactaagaccaaaaataaacctttgagccccatcaagctgacacccacaagcgtgctggattactttggcacaggttctgtccagcgctccaacaagaaaatggtcgcttctaagcgcaaggagctgtctcaaaacaccgatgagtcaggcctcaatgacgaagccatcgccaagcagctacagttggacgaagatgctgagcttgagaggcagctacatgaggacgaggagtttgccagaaccctcgctatgctagatgaggagcctaagacaaagaaggcacggaaggatactgaggcaggagaaaccttctcctccgtgcaggccaacttgtcaaaggccgagaagcacaagtacccacataaggttaagactgctcaggtatccgacgagaggaagagctactctcccagaaagcagtccaagtacgaatcctcaaaggaatctcagcagcatagcaaaagctcggcagacaagattggagaagtgtcatctcctaaggcaagctctaaactggccatcatgaaaaggaaggaagagagttcttataaggagatagagcctgtggcttcaaagaggaaggaaaacgcgatcaagttgaagggagagaccaaaacgccaaagaagaccaagtcttcgcctgccaaaaaagagagcgtgagtccagaagactccgagaagaagcggactaattatcaggcctatcgctcctatttgaacagagagggacctaaggctttggggtccaaggagatccctaaaggcgcagagaactgcctggaaggtttaatcttcgtcatcaccggagtgctggagagcatcgagcgcgatgaggccaaatccctgatcgagcgttacggggggaaagtgacaggaaatgttagcaagaagacgaattaccttgtcatgggtcgcgattctgggcagtctaagtcggataaagcggctgccctcggtacaaaaattatcgacgaagacggactgctgaatctgatccgaaccatgcccgggaagaagagtaaatacgagatcgccgtcgaaacggagatgaagaaggagagtaagctggagcgaaccccccagaaaaatgtgcagggcaagcgcaagattagcccaagcaagaaggaaagcgaaagcaagaagtcgagacccacatcaaaaagagattcactcgccaagacaatcaagaaggagactgatgtattttggaaatctcttgattttaaggagcaggtggccgaagaaacttctggcgattccaaggctaggaacctcgctgacgactcaagcgaaaataaggtggagaacttgctttgggtggacaagtacaagccaactagcctcaaaaccatcatcggccagcaaggcgatcagagctgcgccaataagctcctcagatggctgagaaattggcaaaaatccagctctgaagacaagaaacacgcagctaagttcgggaaattttcagggaaagatgatgggtcttcttttaaggctgcactgctgtcaggcccccccggggtaggcaagacgaccaccgcttccttggtctgtcaggagctgggatactcctacgttgaattgaatgcatccgacacaagatctaagtcaagcctgaaggctatcgttgcagagagcctcaataatacatctatcaagggattttattcaaatggcgccgccagttctgtcagtactaagcacgctttaatcatggatgaagtcgatggcatggccgggaacgaggaccgcgggggcatccaagaactcattgggctgatcaagcacaccaagataccaattatatgcatgtgtaatgaccgcaatcaccccaagattcgctctctggtccattactgctttgacctgcggttccagcggccgcgtgttgaacaaatcaagggggccatgatgagcatcgcattcaaggaggggctaaaaatccctcctcccgctatgaatgaaatcatactgggcgctaaccaggacatccggcaggtgctacacaacctctccatgtggtgtgccaggtctaaggcactaacttacgaccaagccaaggctgattcccacagggccaaaaaggacattaagatgggcccctttgacgttgccaggaaggtgtttgctgcaggcgaggaaaccgcccacatgagtctagtggacaagtcagatctgtttttccatgattactctattgcacctctgttcgttcaggagaattatatccatgtgaagcccgtcgcggctggtggtgacatgaagaagcacctgatgctcctgtcacgggccgcagactccatttgcgatggagacctcgtggactcacaaattaggagcaaacagaattggtctctgcttccagctcaggctatctatgcatcagtgctgcccggtgagctgatgcggggatatatgactcagttccccacgttcccttcttggcttggcaagcacagttcaactggcaaacatgataggatagtgcaggaccttgccctgcacatgtctctgagaacgtactcatcaaagcggaccgtcaatatggactatctgtctctcttgagagacgcactcgtgcagccgttaacttctcagggtgtagatggcgtccaggacgttgtagcactgatggatacatactatctgatgaaggaagacttcgaaaatatcatggagatttcatcatggggcggaaagccatcccctttttcaaagttggatcctaaggttaaggctgcattcacacgggcctacaacaaggaagcacacctgactccatactcactgcaagccatcaaagcctcccggcactctacatccccctccctggactcagagtacaacgaagagctcaatgaggacgactcacagagtgatgagaaagaccaggatgcaatcgagaccgacgccatgatcaaaaaaaagacgaaatcctcgaagccgtcgaagccggaaaaggataaagagccccgtaaaggtaaggggaagagcagtaaaaagtag

SEQ ID NO: 17142 - DNA, 564 bp, Artificial Sequence
  Description of Artificial Sequence: Synthetic coding sequence
cccgaagattcagagaaaaaacgcaccaattatcaggcttatcgctcttacttgaacagggagggccctaaagcgttagggtctaaagaaatcccaaaaggagcggagaactgtttagaaggccttattttcgtaataaccggcgtgttggagagtatcgaaagggacgaagccaagtctctcatcgaacgctacggcggaaaagtgacggggaacgtaagcaagaagacaaactatctcgtgatgggcagagattctggccagtcaaaaagcgataaggccgcagctctgggtaccaaaataattgatgaggacggccttcttaacctgattcgtacaatgcctgggaagaagtctaaatacgaaattgctgtggagactgaggagttggggtattcatacgtagagctgaatgcctccgatacccggtctaaatcctccctgaaggcgatcgttgctgaaagcttgaacaacacgagtattaaaggcttctatagtaatggtgcagcctcgagtgtcagtaccaagcatgcccttattatggacgaagtggacggtatgtag

SEQ ID NO: 17143 - DNA, 1851 bp, Artificial Sequence
  Description of Artificial Sequence: Synthetic coding sequence
atggtgggccagctgtctgaaggcgcaattgcagccatcatgcagaagggtgatacgaatattaaaccaatcctccaggttataaatattcggccgataaccacagggaactctccaccgaggtaccgcttgcttatgtctgacggtctcaacactctgtcaagctttatgctcgccacacagctgaaccccttagtagaagaagagcaactcagctccaattgcgtctgccagatacacagattcatagtgaataccctcaaggacggcaggcgggtcgtgattctgatggaattggaggtgctgaagagcgccgaggccgttggtgttaagatcgggaaccctgtgccctacaacgaaggcttgggacagccacaggtggctccgcccgctccagctgcctctcccgcggcttcatctcggccacagccgcagaatggtagctccggcatgggctccacagtctctaaggcctacggtgcaagcaagacatttggcaaggccgctggaccgtcgctgagccatactagcggtgggacacagtcgaaggtggtgccaatcgcttccttgaccccctatcaatccaagtggaccatctgcgctcgggttaccaacaagtcacagattaggacctggtcaaactctaggggagaggggaagttattctccctcgaactcgtggacgagtctggcgagattagggcgacagcattcaacgaacaggtcgacaagttcttccctctaatcgaagttaataaagtatactacttcagtaagggcacactgaagatcgccaacaagcaattcaccgccgtcaaaaacgactatgagatgaccttcaataatgagacttctgtgatgccatgcgaggatgaccaccaccttccgaccgtccaattcgactttacaggcattgacgacctcgaaaacaaaagcaaagactccctcgtggacattatcggaatttgcaagtcttacgaagacgcgaccaaaatcactgtgagatccaacaatagggaagtggcaaagaggaacatttacctgatggacacttctggaaaggtggtgaccgcaaccctatggggcgaagatgctgacaaatttgacggctctaggcagcctgtgcttgcgatcaagggcgcaagagtgagtgacttcgggggacgcagcctgtccgtcttatcttccagcacgatcattgccaaccccgacattccagaggcctacaagttgcggggatggtttgatgccgagggccaggcacttgacggggtgagcatcagtgacctgaagtctggcggtgtgggaggctccaacactaattggaaaacgctttatgaagtcaagtcagagaatttagggcaaggtgacaagcctgactacttcagctccgttgcgacagtggtctatctgcgaaaagagaactgtatgtaccaagcctgcccaacacaggattgcaacaaaaaagtcatcgaccaacagaacgggctctataggtgcgagaaatgtgatactgagttcccaaatttcaagtataggatgatcctgagtgtgaatattgctgattttcaagagaaccagtgggtgacttgtttccaagaatccgcagaagccattctgggccaaaacgccgcttacttaggggagctgaaggacaagaacgaacaagcttttgaggaagtattccaaaacgcaaatttcaggtcttttatcttccgcgtgagggttaaagtggaaacatacaatgacgagagtagaattaaggcgacagttatggatgtcaagcctgttgactatcgagaatatggccgaagactagttatgtccatccgcagatcggcgctcatgtag

SEQ ID NO: 17144 - DNA, 2217 bp, Artificial Sequence
  Description of Artificial Sequence: Synthetic coding sequence
atgacctcctccggcccgggtcctcgcttcctgttgctactgcccttgctgcttccccccgcggcctctgcctccgaccggcccagagggagggaccccgtgaatccagagaagctgctcgttatcaccgtggctacggccgaaacagaaggttatcttcggtttctaaggagcgccgagtttttcaactacacagttcgcacactgggcctcggggaagagtggcgagggggcgacgttgccagaaccgtgggaggtggccaaaaggtgcgttggctgaagaaggaaatggaaaaatatgccgatcgggaagatatgatcatcatgttcgtcgactcctatgatgtgattctggctggttcacccacagaactgttgaagaagttcgtgcagagcggcagtcgcctgctatttagtgcagagtcattttgctggccagaatgggggctcgcggagcaataccctgaagtgggtactggtaaacgatttcttaattccggcgggtttattggcttcgccacgaccatccatcagatcgtccggcaatggaagtacaaggacgacgatgacgaccagttgttctacacccgactgtacctggatcctggactcagggagaagctgtccctgaacctggatcacaagtctcgcatcttccagaatctgaatggcgctcttgacgaggttgtgctgaagtttgacaggaaccgggtccgtatacgcaacgtggcttacgacacgctgcctatcgtagtgcacgggaatggtcccacaaagctccaactgaactatcttggaaactatgtgccaaacggatggacaccggagggcggctgtgggttttgtaatcaggacaggaggactctccccggcggccaaccgccaccccgggtgtttctggctgtcttcgtagagcagcctactcctttcctgccacgattcttgcagcgtttattgctgttagactatccccccgaccgggtcactctttttctacacaataatgaagtgtttcatgagccgcacatcgcagactcttggccccaactgcaagatcatttcagcgcagtcaaactggtaggccctgaggaagccttgagccccggggaagcccgtgacatggccatggacctgtgccgccaggatccagaatgcgaattctacttttctctcgatgccgatgcggttttaacgaacctgcagacgcttagaatactgatcgaagaaaaccggaaagttatagccccaatgctatctaggcacggcaagttgtggtcaaatttctggggggcactttcccccgacgaatactacgctaggtctgaggattacgtcgaactggtccagaggaagagagtaggggtatggaatgttccatatatctcacaggcatatgtgatccgaggagacacactccggatggagttgccgcagagagatgtgttctctgggagtgataccgatcctgatatggccttttgcaaaagctttagagataaaggcattttcctgcatctctcaaaccagcacgaattcggaaggcttttggccacgagcagatatgatacagaacatctccatcccgatttgtggcagattttcgataaccccgttgactggaaagaacagtacattcatgaaaactactccagggccttagagggggagggcatagtggagcagccctgtcctgacgtgtactggttcccactgctaagcgagcaaatgtgcgatgaactggtagcggaaatggagcactacggacagtggtccggaggccgccacgaggatagcagactggccggtggctatgaaaatgttccgactgttgatatccacatgaagcaggtggggtacgaggaccagtggcttcagctcctacggacgtacgtcgggcccatgacagagtctttgtttccaggctaccatacaaaggcccgggctgtgatgaattttgtggtcaggtacagaccggacgaacagccctccttaagacctcaccatgactcctccacattcactttaaatgttgctctaaatcataaaggtctagattatgaaggaggaggctgcagatttctgagatatgactgtgttattagtagtccacgcaagggctgggctttactgcacccaggtaggctcacacactatcatgaggggctacccaccacttggggtactaggtacatcatggtatccttcgtggacccctag

SEQ ID NO: 17145 - DNA, 366 bp, Artificial Sequence
  Description of Artificial Sequence: Synthetic coding sequence
atggtggacatgatggatctgcccagatccaggatcaatgccggcatgctagcccagtttatcgataaaccagtctgttttgtgggccgcttggaaaagatccatcctacagggaaaatgtttattctgtccgatggcgagggtaagaacggtaccattgagcttatggagcctctggatgaagagatttctggaatcgtggaggtggttgggagggtgaccgccaaagccaccatcctctgtacgagttatgtccagttcaaagaggattctcaccctttcgacctgggtctgtacaatgaggcggtcaagataattcatgattttccgcagttttatcccctggggatagtccagcatgattag

SEQ ID NO: 17146 - DNA, 2787 bp, Artificial Sequence
  Description of Artificial Sequence: Synthetic coding sequence
atgccacctaagactccgaggaagacagccgctaccgcagcggcggctgccgctgagcctcccgctccacctccaccccccccaccagaggaggaccctgagcaggattccggaccagaagacctgcctctggtgagactggaatttgaagagactgaagagcctgatttcactgcattgtgtcaaaaactgaagattccggatcacgtgcgggaaagagcatggttgacttgggaaaaggtaagctctgtggacggggtactgggcggatatatacagaagaagaaagagctgtggggtatctgtatcttcatcgccgcagtggacctggacgaaatgtctttcaccttcaccgagctccagaaaaatatcgagatttccgtacacaaattcttcaacctgctgaaagaaatcgatactagcaccaaggtcgacaacgccatgagtcggcttttgaagaagtacgatgttcttttcgctttgttttcaaagctcgaacgaacgtgtgagctcatctaccttacacagccatctagttccatatccactgagattaactccgctttggttcttaaggtttcttggattaccttccttctggcgaaaggcgaggtccttcagatggaggacgacctggtgatttccttccagttgatgctgtgcgtgctggattacttcattaaactctctcctcctatgctgctgaaggagccctacaaaaccgcagtgatcccgattaatggaagccctaggaccccacgacgaggtcagaacaggtcagctaggatagcgaaacagttggagaatgatacacgcattatcgaagttctgtgcaaagaacatgagtgcaatatcgatgaggtcaaaaacgtatatttcaagaactttataccattcatgaacagtctgggcttggtgacctccaatgggctgccggaggttgagaacctgagtaaaagatatgaagagatctaccttaaaaacaaagacctagatgcccgtctctttctggaccacgacaagacccttcaaaccgacagcatcgattctttcgaaacccaacgcacccccaggaagtccaacttggatgaggaagtgaatgtaatccctccccacacacccgttaggactgtcatgaatactatccagcagcttatgatgattctaaactccgccagtgaccagccaagtgaaaatctcattagctatttcaataattgcacagttaatccaaaggaatccatccttaagagagtgaaggacatcggctacatctttaaagaaaaattcgctaaagctgttggacagggctgtgtggaaattggaagtcagagatacaaattaggtgtgagattgtactatcgtgtaatggagtcaatgcttaaaagtgaagaagaacggcttagtatccagaacttctcaaaactgttgaatgacaatatattccacatgagccttctcgcttgcgctctggaagttgtgatggcgacttattcaagatccacatcccagaatctggactctggcacagatctaagcttcccgtggatcttgaatgttctgaatcttaaggcttttgatttttataaggtgatcgagagctttataaaagccgaggggaacctgacacgcgaaatgatcaagcacctggaaagatgcgagcataggattatggaaagtctggcctggctgagcgacagccctctatttgacctgatcaagcaatccaaggatcgtgagggtcctactgaccacctggaaagtgcgtgtcctttgaacctgccactacagaataatcacaccgctgccgacatgtacctgagccccgtaagatcaccaaaaaagaagggttcaactacgcgcgtcaatagtaccgccaatgccgagacgcaggctacttcggccttccaaacacagaagccactgaagtccacctcacttagcctcttttacaagaaggtctaccgtctggcttacttaagattaaacaccctatgtgaaaggttgctgtccgagcaccccgaactagaacacattatttggactctgtttcagcatacgctccagaacgaatacgagctcatgcgcgataggcatctggatcaaattatgatgtgtagtatgtacggcatttgtaaggtgaaaaacatcgatctgaagttcaaaatcatcgttacagcatataaggaccttccccacgccgtacaagaaactttcaagcgcgtactgatcaaagaggaagagtacgacagtataatcgttttctacaatagtgtgttcatgcagagactgaagaccaacatcctgcaatacgcctccaccagaccacctacgttgagccccataccccacattccaaggtccccttataagtttccctctagccccttgcgtatccctggcggcaacatctatatctccccactgaagagtccctacaagataagcgaggggctgcccacacccaccaaaatgacacccaggtcccggatcctggtgagcatcggagaatcattcggtacgagtgagaaattccagaagatcaaccagatggtctgcaacagcgaccgggtgctgaagcgctctgcggagggaagcaacccacccaagcctttgaagaagctaagatttgatattgaggggtctgacgaggctgatgggtcaaaacacctgccaggcgagagtaagttccagcagaagctagcagagatgacctccaccagaaccagaatgcagaaacagaagatgaatgattccatggacacaagtaacaaagaggagaaatag

SEQ ID NO: 17147 - DNA, 162 bp, Artificial Sequence
  Description of Artificial Sequence: Synthetic coding sequence
atgcctcccaagacaccaagaaagactgcagctaccgcggcagctgcagccgctgagcccccggccccccctcctcccccccctcctgaagaggatcccgagcaggattctggaccagaggacttacccttagtccgcggttccattacaaatggccggtag

SEQ ID NO: 17148 - DNA, 2724 bp, Artificial Sequence
  Description of Artificial Sequence: Synthetic coding sequence
atgcctcctaagaccccaccacctgaggaggacccggagcaggacagtgggcccgaagatttgccgctggtgcgcctcgagtttgaggaaacagaggaacctgacttcaccgcgctctgccagaagctgaagattcctgatcatgttagagagcgagcctggctgacatgggagaaagtttcatccgtggacggagtccttggcggctacattcagaaaaagaaagagctgtgggggatttgtatctttattgctgcagtagatttagacgagatgagctttacattcacggaactacagaaaaatatcgagattagcgttcataagttttttaacctgctcaaggaaattgatacctcaactaaggtggacaacgcgatgtcccgccttctcaagaaatacgacgtgctgttcgcccttttttccaagctggaaagaacctgcgagcttatttacttgacacagccctcctcctctatttctacagagattaattctgcactggttcttaaggtttcttggatcactttcctactggccaagggggaggttttgcagatggaagacgacttggtgatcagttttcagttaatgctctgcgtgctggattactttattaagctcagccctcctatgctgctcaaggaaccctataaaaccgcggtgataccaataaacggttccccacggaccccccggcggggacaaaaccggtctgccagaatcgccaaacaactggagaacgacacacgtatcatcgaagtcctgtgcaaagaacatgagtgtaatatcgacgaggtgaaaaatgtctactttaagaatttcattcccttcatgaactcgctaggactagtgacatctaacggccttcctgaagtagagaacctgagtaaacgatacgaagagatttacctgaaaaataaagaccttgatgcccggttgttcttggatcacgacaaaacactgcagactgattccatcgacagctttgagacacagagaaccccccggaaaagtaatttggatgaagaggtgaatgtgatcccccctcatacgcccgtccgtaccgtgatgaatacaatacaacaactcatgatgatcctgaattctgcctcggatcagccatccgagaacctgatttcatacttcaacaactgtaccgtcaatcccaaagagtcgattttgaagcgggttaaggatattggatatatatttaaggagaaatttgccaaggctgtcggtcaagggtgcgtggagattgggtcccagagatacaagctgggagtccggctctactacagagttatggaaagcatgctaaaatctgaggaggaaagactttcaattcaaaacttctcaaagctgttgaacgataacattttccacatgtccctactggcctgcgcattagaggtcgtcatggccacttattctcgttccacaagtcagaaccttgatagcggtactgacctgtcatttccttggattctaaatgttcttaatctcaaggcctttgacttttacaaagtcatcgagtcctttattaaggctgaaggcaatctgactcgggagatgatcaagcacttggaaagatgtgagcaccgcataatggagtccctagcctggctcagcgacagtccattgttcgatcttatcaagcagtccaaagatcgggaggggccaactgaccatcttgaaagcgcttgtcctctcaacctccccctccagaataatcatactgcagccgacatgtatctctcaccagttcggtccccaaagaagaagggctctactacaagggtcaattccaccgcaaatgcagagactcaggctacgtctgcctttcaaacccagaaacccttgaaaagcacctctttgagcctgttctataagaaggtgtatagactggcctacctccgtctaaacacattatgtgagcgcctcttgtccgagcatccagagctggagcatattatttggaccttgtttcagcatactttgcagaacgagtacgaactgatgagggatagacacctggaccaaatcatgatgtgttcgatgtatggtatttgcaaggttaaaaacattgacttgaagttcaaaatcattgtcaccgcttataaggaccttcctcacgccgtgcaggaaaccttcaagagagtgttgattaaggaagaagagtacgattctattatcgtgttttacaacagtgtgtttatgcagagactgaagaccaacattctgcagtatgcctcaacaagacctcccactctctcccccatccctcatattccacggtcgccatacaaatttccatcgagtccccttaggatccctggcggtaatatttacattagtcctctgaaaagcccatacaagatcagcgagggcctgccaacccctaccaagatgactccgagatcacggatcctcgtgtcgataggggagagcttcgggacatcagagaagtttcagaagatcaatcagatggtatgtaattccgaccgcgtgctgaaacgatccgccgaagggagcaaccctcccaaaccactgaagaaactgcgctttgacattgaagggagcgatgaggctgacggatcaaaacaccttccaggggagagcaagtttcagcagaagctcgcagagatgaccagcaccaggacaaggatgcagaaacaaaaaatgaatgattcgatggatacttctaataaagaagaaaagtag

SEQ ID NO: 17149 - DNA, 2694 bp, Artificial Sequence
  Description of Artificial Sequence: Synthetic coding sequence
atgaacatctccggcagcagctgtggttcccctaattcggccgacaccagttctgacttcaaggacctatggactaagttaaaagaatgccatgaccgcgaagtgcagggcctgcaggttaaggtcacgaaactgaaacaggagaggatactggacgcacaacgactggaagagttcttcacaaagaatcagcagcttagggagcaacagaaggtgctgcacgagacgattaaagtgctagaggatcgcttgcgcgcgggcctctgtgaccgctgtgctgtgaccgaggagcacatgcgcaaaaaacaacaggaatttgagaacattagacagcagaaccttaagttaatcaccgaacttatgaatgaacgaaacaccctccaggaagaaaacaagaagctgtctgaacaacttcagcagaagattgaaaatgaccagcagcatcaggcggcggagctcgaatgcgaagaggatgttatcccagactcccctattacggcgttttccttctcgggagtgaaccggctcagacgaaaggaaaatccccatgtgcgatacatcgagcaaacccacacgaaactcgagcactctgtttgcgcaaacgagatgaggaaggtcagcaaaagctccacacacccccaacacaatcccaacgagaatgagatcctggtggccgacacttacgaccaaagtcaaagccctatggccaaggcccatgggacttcatcttatacaccagataagagtagtttcaatcttgccacggttgtcgcagagacgctaggcctgggcgtccaagaagaatccgagacccaggggccgatgagcccactgggcgacgagctttatcattgtctggagggcaaccacaagaagcaaccgttcgaggagtcgacacgaaatacagaggattctctgcgatttagcgacagcactagtaagacccctccccaggaggagttgcccacccgagtgtcttctccagtgttcggagccacctcgtccataaaaagtggcttggatctcaacacctctctctcacccagtctactccagccagggaagaaaaagcatcttaagaccttaccctttagtaatacttgtatcagcaggcttgagaaaacaaggagtaagtcagaggactctgccctgtttacacatcactccctcggcagcgaggtcaataagatcatcatccagagcagtaacaaacaaatcctcattaataaaaacatctcggagtcccttggcgagcaaaaccgcacagagtatggaaaggactccaataccgacaagcatttggagccactcaagtcgctgggtggccggacctcaaagagaaagaaaaccgaagaggagtcagaacatgaggtaagctgtcctcaagcttcgtttgacaaagagaatgcttttccattcccaatggacaaccagttctctatgaatggagattgcgtgatggacaaaccgcttgacctgtccgatcgcttcagcgccatacagcggcaggagaagtcccagggaagcgagacttccaagaacaagttccgacaggtgactctgtacgaggccctgaagaccatccctaagggcttcagctcctctcgaaaggcttcggatgggaattgcacattgccaaaggactcacccggcgaaccgtgctcacaagaatgcattattctccagccactgaacaagtgctccccggataacaagccgtccctccagattaaggaagaaaatgcagtgtttaaaatccccctgcgcccccgcgagtcactcgaaaccgagaatgtcctcgatgatattaagtctgccggctcccatgagcctatcaaaatccagacaaggtccgatcacggtggctgtgaactcgcttctgtactccagctcaacccttgtcgcacaggaaaaatcaagagtcttcagaataaccaggacgtgtcctttgaaaatatccagtggtcgattgacccgggcgctgatctgtcccagtacaagatggacgtgaccgttattgatacaaaggatggtagtcaatctaaactgggaggggagacagttgacatggattgcaccctcgtatctgaaacagttctcctgaaaatgaagaagcaagaacagaaaggagagaagagctccaacgaggagcggaaaatgaacgacagccttgaagatatgttcgaccggaccacccatgaagaatatgagtcatgtttggccgactccttcagtcaagcggccgacgaagaagaggaactttcaactgcaactaaaaagttgcatactcacggtgacaagcaggataaagttaagcagaaggcctttgtcgagccctattttaaaggagacgagcgggaaactagtttgcagaattttcctcacattgaggtggtgcgcaaaaaagaagaacggcggaagttgttgggccatacttgtaaggaatgtgaaatttactacgcggacatgccggcagaagagagagagaagaaattggcaagctgttcacgccaccgattcaggtacattccaccaaataccccagagaacttttgggaagttgggtttccatctacccagacttgcatggaacgcggatacatcaaggaggacctcgatccatgtcccaggccgaagcgccggcagccttacaacgccatcttttcacccaagggcaaagaacagaagacctag

SEQ ID NO: 17150 - DNA, 2709 bp, Artificial Sequence
  Description of Artificial Sequence: Synthetic coding sequence
atgaatataagcggctcgtcgtgtggttctccgaacagcgcggacacaagcagcgatttcaaagatttgtggactaagctgaaggagtgccacgaccgagaagttcagggcctgcaggtgaaagtgacaaaactgaagcaggagcggatcctggacgcccagaggctggaagaattctttactaaaaatcagcagctacgggagcagcaaaaagtattacacgaaaccattaaggtgcttgaagaccgcctccgagcagggctctgtgatagatgcgccgtgaccgaagagcatatgagaaaaaaacagcaagaattcgaaaacattcgccagcaaaacctcaaacttataaccgagctgatgaacgagcggaatacactgcaggaagagaacaaaaagctgtcagagcaactgcagcagaaaatcgaaaacgatcagcagcatcaagctgcagagctggagtgtgaagaggacgtcatcccagacagccccattactgcattcagtttctctggcgtaaaccgattgcggagaaaagaaaaccctcacgttcggtacatcgaacagacccataccaaattggaacactctgtctgtgctaacgagatgaggaaggtttccaagagctccacccaccctcagcacaaccccaatgaaaatgaaatactagtcgccgacacttatgatcagtcccaatcccctatggctaaggcacacggaacaagctcatacacacctgacaagagctcctttaatctagctacagtggtggcagagaccctgggccttggagtgcaggaagaaagcgagacgcagggaccaatgtcacctctaggggacgaactctatcattgccttgaaggcaatcacaaaaagcagcctttcgaagagtcaaccaggaatacagaggatagcctccggttctccgactcaacaagcaagactcccccccaggaagaactgcccacgagagtgtcctctccggtgttcggcgccacatcctcgatcaaaagcggtctggacctgaacaccagcctgtcccctagtttgctgcaacccggcaagaagaaacacctgaaaaccctgcccttctcgaatacgtgtataagcaggttggaaaagactagaagtaagagcgaggattccgccctcttcactcaccacagccttggcagtgaagttaacaaaattatcatccagagctctaataaacagatcctaatcaacaaaaacatttccgaatctttaggggagcagaataggacagagtacggaaaagattcaaacaccgataagcatctggaacccctaaaatcactaggcgggaggacatccaagaggaaaaaaacagaagaagagtcagaacatgaggttagctgcccccaggcatcatttgacaaagagaacgcattcccttttccaatggataaccagttcagtatgaacggggactgtgtcatggataaaccactggacctgtctgatagattctcagctatccagaggcaggagaagtctcagggtagcgaaacctccaaaaacaaatttcgccaggtgactctgtacgaggcactcaagacgatccctaaagggttttcgagctcaagaaaagccagtgatggaaattgtacactgccaaaagacagtccaggtgagccgtgtagtcaggagtgcatcattctgcagcctcttaataaatgcagtcccgataataaaccatcattgcaaatcaaggaggagaacgcggtgtttaagattcccctgcgcccaagagagagtcttgaaaccgaaaatgtgctcgacgacatcaaaagcgcgggcagtcacgaacccattaaaattcagacccgctctgaccatggcgggtgtgagttggcatccgtactccagctgaatccttgtagaaccggaaaaattaaaagcctgcagaacaaccaggacgttagctttgagaacattcagtggtctattgacccgggagctgatctctcccaatataaaatggatgtgacggtaatagacaccaaggatgggagccagtccaagcttggtggagagaccgttgatatggattgtaccctagtctccgaaacagtcctgcttaagatgaagaagcaggagcagaaaggagaaaagtcctctatgctattttacatcgatgaggagagaaagatgaacgactcccttgaagatatgttcgataggaccacacacgaagaatatgaaagttgtctggctgactcgttcagccaggcggccgatgaggaagaagaactctccacagcaaccaaaaaacttcacacacacggcgacaaacaggataaggtgaagcagaaagctttcgtggagccctatttcaaaggagatgagcgagagacgagcctgcagaactttcctcacatcgaagtggtgcgcaaaaaggaggagagaaggaaattactagggcatacatgcaaagaatgcgaaatttattacgcggacatgcccgctgaggagagggaaaagaagcttgcaagctgcagtcggcacagatttagatacatcccacccaacacaccggaaaacttttgggaagttggcttcccttcaacacagacctgcatggagagaggctatattaaggaagacctggacccatgtcccagacccaaaagacgtcagccttacaatgccatattctcccccaaaggcaaggaacaaaagacatag

SEQ ID NO: 17151 - DNA, 2598 bp, Artificial Sequence
  Description of Artificial Sequence: Synthetic coding sequence
atgaatatttctgggagctcctgcggtagccctaattcagcggatacgagcagcgatttcaaagatctgtggacaaagcttaaagagtgtcacgaccgggaggtacaaggattacaggtgaaagtgaccaagctgaaacaggaacgtatactcgatgcccagagactggaggaattcttcaccaagaaccagcagctgagagagcagcagaaggtgctacacgaaaccataaaggtccttgaagatcggctccgagctgggctctgtgatagatgcgctgtgacagaagagcacatgcgaaagaaacaacaggagttcgagaatattaggcagcaaaatcttaaactgataaccgagttgatgaacgagcgcaataccctgcaggaggagaataagaagctcagcgagcaacttcagcagaaaattgagaacgatcagcaacaccaagctgctgagttggagtgcgaagaagatgtgatccccgactcccctattaccgctttttcattttctggggtgaacaggttgaggcggaaggagaaccctcatgtccgctatattgagcagacccacaccaagcttgaacatagcgtgtgtgccaacgaaatgaggaaagtgtctaagtcgtccacccacccccagcacaaccctaatgagaacgagatcttagtcgctgacacctacgatcagtctcaatcgccaatggcaaaggcacacggaacgtcttcctatacccccgacaagagcagtttcaatcttgcaactgtagttgccgagacccttgggcttggggtccaagaagagtccgagacacagggccctatgagccccctgggcgacgaactttatcactgtcttgaggggaaccacaaaaagcagccgttcgaggaatctacccgaaacaccgaagatagcctccggttctcggacagtacctctaagactcccccacaagaggaactgcccaccagagtttcctccccagtctttggcgccaccagcagtattaagtctggactagacctcaatactagcctgagcccctctctgctgcagcctggaaaaaagaagcacttgaaaaccttgcccttctccaacacctgcatcagtcgattggaaaagacgaggtctaaaagcgaggactcggcactgtttactcaccatagtctaggcagtgaggttaacaaaataatcatccagtcgagcaacaaacagatactcataaataaaaatattagcgagtccctcggggagcagaaccggactgaatacggcaaggatagcaataccgataagcacctggaacctctgaaaagcctgggagggcggacttcaaaaaggaaaaaaactgaagaggagtccgagcatgaggtcagttgcccgcaagcctcatttgacaaagaaaatgcattcccatttcctatggataatcagttctccatgaatggagactgcgtgatggacaagcctctcgacttgagcgataggttcagtgctatacaacgtcaggaaaaatcacagggctcagagacgagtaagaataaattccgacaggtgacattgtacgaggccctgaagaccatccctaaggggttttcaagcagtcgaaaagcaagcgacggaaattgcactcttcctaaggattcgcctggagagccctgttctcaggaatgtatcatcctccagcctctgaataagtgttcaccagacaataagcctagcctgcagatcaaggaggaaaacgcggtcttcaagattccccttcgcccacgagagagcctcgaaacagaaaacgtcctggacgacattaagagtgcagggtcccatgagcctatcaaaatccagacccgcagcgatcatggaggctgtgagcttgctagcgtgttgcagctcaacccatgccgcaccggcaagatcaagtctctgcagaacaaccaggacgtgagttttgagaatatccaatggtcaatcgatcctggcgcggatctgagtcagtacaagatggatgtcacggtgatcgatacaaaagatggctcccagtcaaaactggggggggagaccgtcgatatggattgtacgctagtgtcagagacagttctgctcaaaatgaagaagcaagaacagaaaggcgagaagagttcaaatgaggagcgtaaaatgaacgattcactggaagatatgttcgatcgcactacgcacgaggaatatgagagttgcctcgctgatagcttcagccaagccgccgacgaagaagaggagctaagcacagccacaaaaaagctgcatacacacggcgataaacaggataaggtgaaacagaaagctttcgtggagccttacttcaagggcgacgagagcataatgcagatttgtcagcaaaaaaaggaaaaaaggaactggctaccagctcaggatactgattctgctacattccatccgacacaccagcgcatttttgggaaactggtgtttcttccacttagattagtttggaaggaagtaattctgagaaaaatcctgatcctcgtactggtgcagaaggatgtgtcactgacaacccagtacttcttacagaaggcacggtcacggcggcattag

SEQ ID NO: 17152 - DNA, 2694 bp, Artificial Sequence
  Description of Artificial Sequence: Synthetic coding sequence
atgaacatctcaggaagcagttgcggatcaccgaattccgcagacacaagtagcgattttaaggatctgtggactaagctgaaagaatgtcatgatcgcgaggtgcaggggctgcaagtcaaagtgactaaactgaagcaggagcgtatactggatgcacaacgactcgaagagttttttacaaagaatcagcagctccgagagcaacagaaagtgctgcatgagacgatcaaagttctggaggacaggctccgcgctggattatgtgatagatgcgcagtaacagaggagcatatgcgtaagaagcaacaggaatttgagaacataagacaacagaatctgaaattgattactgaactaatgaacgagcgcaataccctacaggaagaaaataagaaactgtccgagcagctccaacagaaaattgagaacgatcagcagcatcaagctgcagagctggagtgtgaggaggacgtaatccctgactcccctatcacggccttcagcttcagtggggtgaacagactccggcggaaagagaatccacacgtacgttatatcgaacagacccataccaaactcgagcatagtgtctgcgccaacgagatgcgtaaggttagcaagtcctcgacacacccccagcataacccgaacgaaaatgagatcctagttgcggatacctacgatcagtcgcagagccctatggctaaggcacacgggacaagtagttatacaccggataagtcctccttcaacctggcaacggtggtggcagagacactcggactgggcgtgcaggaggagtccgagactcagggacctatgtcacctctcggcgatgaattgtaccattgtctcgaaggcaaccacaagaagcagccctttgaggaatctacacgtaacactgaggatagtttgcgatttagtgactccaccagcaagacgcctccgcaagaagagctacccaccagagtgagcagcccagtgtttggcgccacgagctcaattaagtcagggctggatctaaacacctcactgtcccccagcctgctgcaacctggaaagaagaagcatttaaaaacactcccattcagcaatacatgcatttcacgactggaaaaaacccgtagcaagtccgaggattcggccctgttcacccaccactctctaggcagcgaagtcaataaaattatcatccagagttccaataaacagatactaattaataaaaatattagcgagagtttaggggagcagaaccgaaccgaatatggtaaagactccaatactgataaacacctggagccgttaaaatccctcggagggcgcacgagtaagcgtaagaagacagaggaagaatccgagcacgaggtcagctgccctcaggcaagctttgacaaggaaaatgcattcccgtttccaatggacaatcagttctccatgaacggtgattgtgttatggataagcctctggacttgtccgataggttcagcgccatccagcgacaggagaagtctcagggctcggagacctcgaagaacaaattccgacaggtgaccctgtacgaggcactgaaaaccatccctaagggatttagctcttcacgcaaagccagcgatggcaattgcactctgccaaaggacagtccgggcgaaccctgttctcaggagtgtattattctgcagcccttgaacaagtgtagcccagacaataagccgagcctccagattaaggaggagaatgccgtgtttaaaatcccattgagaccccgcgaatcactagaaactgaaaatgtgttggatgacatcaaaagtgcaggatcacatgagccaattaagatccagaccagaagtgatcacggtgggtgcgagctggcgagcgtcctgcaactgaatccatgtaggacaggcaaaattaagtctctgcagaataatcaggatgtgtctttcgagaatattcagtggtccatagaccctggcgcagatctctcgcagtacaaaatggacgtcactgtgatcgataccaaggatggctcccagtcgaagctgggaggagagaccgttgatatggattgtaccctggtcagcgaaaccgtgctgctcaaaatgaagaagcaagaacagaagggcgagaagagtagcaacgaggaaagaaaaatgaacgactccctggaggacatgttcgataggactacacacgaggaatacgaatcttgcttggcagactcgtttagccaggcagccgacgaggaagaggagctgagcactgctaccaaaaagctccacacacacggcgataagcaagacaaggtaaaacaaaaagctttcgtggagccttactttaaaggcgacgaaagggagacctccttacaaaactttccacatattgaagtggtgcggaaaaaagaggaacgccggaaactgttgggccacacatgtaaagagtgcgagatttactatgcagatatgcctgcagaagagcgcgagaaaaaattggcctcatgctctcggcacagatttcgatacatcccaccaaatactccagagaacttttgggaagtcggattcccctcaacgcagacctgtatggaacgaggttacatcaaggaggatctggatccgtgccctaggccaaagaggcgccagccctataacgccatcttttctcctaagggcaaggaacagaaaacctag

SEQ ID NO: 17153 - DNA, 2604 bp, Artificial Sequence
  Description of Artificial Sequence: Synthetic coding sequence
atgaacatttctggctctagctgcggttcaccaaacagcgctgacacgtcttcagactttaaagatctgtggaccaagctgaaagaatgtcacgacagagaggtgcagggtctgcaggtaaaggtgaccaaactgaagcaagagagaatcctggacgctcagagattagaagagttttttaccaagaatcagcagttaagggagcaacagaaggtactgcatgagactatcaaagtcctggaggataggctccgcgccggactgtgcgaccgatgcgccgtaactgaggagcacatgaggaagaagcagcaggagttcgagaacattagacagcaaaaccttaagctcattaccgagcttatgaatgagcgaaacactctgcaggaagaaaataagaagctgtcagaacagctccagcagaagatcgaaaatgaccaacagcaccaggccgcggagcttgaatgcgaagaggacgtgattcctgatagtccgataacagctttctcgtttagcggggtcaaccgactgcgtagaaaggaaaatcctcacgtgagatatattgaacagacgcatactaagctagaacactcagtgtgtgccaacgaaatgcggaaagtgtccaagtcctcaacccacccccagcataacccgaatgagaacgaaatccttgtggccgatacctatgaccaaagccagtctccaatggctaaagcacacggtacatcgagttatactccagataagtccagtttcaacctcgctacagttgtggccgaaaccttaggcctgggcgtgcaggaggagagcgagacacagggtcctatgagtccacttggagacgagttgtaccactgcctggaaggaaatcataagaaacagccattcgaagagtcaacaagaaacaccgaagactcacttagattctcagacagtacaagtaagacacctcctcaagaagagctgcccacgcgcgtgtcttctccagttttcggagccacgagctcaattaaatcaggcctagacctgaataccagtctgagcccctccctacttcagcctggcaagaaaaagcatctcaagaccctcccgttttccaatacatgtatcagtcgcttagagaaaacacgctctaagagtgaggattcagccctctttacccaccatagtctgggaagcgaagtgaataaaataatcatccagtcaagtaataagcaaatcctgattaacaaaaacatctccgagtcgttgggagaacagaatagaacagagtatgggaaagattctaatacagacaagcacctggaaccactgaaaagtttgggcgggcgcacctctaagagaaagaaaacagaggaagagtccgaacatgaggtatcctgccctcaggcctcttttgataaagagaatgcatttcccttccctatggacaaccagttttccatgaatggggactgtgtgatggataagcctttagacctgtctgaccgatttagcgccatccaacgacaggagaagagtcagggctcagaaacttctaagaacaaatttcggcaggtcacgctttatgaggcacttaagacaatccccaaaggcttctcaagtagtagaaaggctagcgacgggaattgcaccctgccaaaggacagtcccggcgagccctgctcacaggagtgcattattcttcaacccctcaataaatgttcacccgataacaagccaagcctgcaaataaaggaagaaaacgcagtctttaagatcccactacggccaagagaaagcctggaaaccgaaaacgtgttagacgacatcaagagtgccggctcgcatgagccaattaagatccaaacccgctccgaccatggaggctgtgagctcgcctctgtcctacaactcaatccatgcagaaccggcaaaatcaagtcgctacaaaacaatcaggatgtctcattcgaaaacattcagtggtctattgatcccggggcagatctgtctcagtataaaatggatgtgactgtgatcgacacgaaggatggctctcagagcaagctcggaggggagactgttgacatggactgtaccctcgtctcagagaccgtcttgctcaagatgaagaagcaggagcagaagggggaaaaatcaagcaatgaagaacgaaagatgaatgactccttggaggacatgtttgatcgtaccacacatgaggaatatgagagttgcttggcagactcattcagtcaagccgctgacgaggaagaagagctgtccaccgccaccaagaagctacacacccatggggataagcaggataaggtgaaacaaaaggcttttgtcgagccctactttaaaggcgacgagagcataatgcaaatatgccaacagaagaaggagaaaagaaactggctacctgctcaagacacagacagcgccacatttcatccgacacatcagcggatttttgggaagctggtgtttctgccactcagattggtttggaaagaggtaattctcaggaaaatcctgatccttgtcttggtgcagaaagacgtgtccctcacgacacaatactttctgcagaaagcaaggtctcgtcgccaccgccggtag

SEQ ID NO: 17154 - DNA, 3045 bp, Artificial Sequence
  Description of Artificial Sequence: Synthetic coding sequence
atgtttgaagacaaacctcacgcagaaggtgcagccgtggttgccgccgcgggggaggctcttcaggcgctgtgccaagaattgaatctggacgaggggtcagcagcagaagccctggatgattttacagcaatacggggaaattattctttggaaggcgaagtcactcactggttagcttgttcgctgtatgtagcttgccgcaaatctatcatccccacagtggggaagggaatcatggagggcaactgtgtctcgctgactcggatcttgaggagcgcaaaattgagtctgatccagttttttagtaaaatgaaaaagtggatggatatgtctaatctgccgcaagaattcagagagcgcatagagcgcctagagcggaatttcgaggttagtaccgttatcttcaagaaatatgaaccgatctttttggatatctttcaaaatccttatgaggagcctcccaagctgcccagaagcaggaaacagcggcgcatcccctgcagtgtgaaagatctgtttaatttttgctggaccctgttcgtctacacaaagggaaattttcggatgataggagatgatctcgtgaacagttaccacctcctgctctgctgtttggacctcatcttcgcaaatgcaattatgtgccctaacagacaggatctgttgaatccgagcttcaagggactccctagtgacttccatacagccgacttcactgcatccgaagagcctccttgtatcatcgcggtgctctgcgagctgcatgacggccttttggttgaggccaagggaataaaggaacattacttcaagccatatattagcaaactgttcgatagaaaaattcttaagggcgagtgccttctagacttatccagctttacggataactctaaagcggtcaataaggagtatgaagagtatgtactgacagtaggtgatttcgacgaacggatatttctgggagcggatgctgaggaagagattgggactcccaggaagttcacgcgtgacacgccgctcggaaagctgacagcccaggcgaatgtggagtataatttacagcagcacttcgagaagaagagatcattcgcgccatcgaccccactgactgggaggcgatatctgagggagaaagaggccgtcataacaccagtggcctccgccactcagtctgtctcccgattgcagtctatcgtggctggtttgaaaaatgccccatctgatcagctgataaacattttcgaatcttgcgtgcgtaaccctgttgagaacatcatgaaaatactgaaagggatcggagaaacattctgccaacactacacccagagcaccgacgaacagcctggctcacacatcgatttcgcagtgaacagacttaagctggccgaaatactgtactacaagatactggagaccgtgatggttcaagagacccgacgtcttcacgggatggatatgtcagtgctgctggaacaggatatttttcatcgcagcttgatggcctgttgtctagagatcgtgctgttcgcttactcatctcccaggaccttcccctggattattgaagttttaaatctacaaccattctacttctacaaggtcattgaggttgtgattcgcagcgaagaaggcctgtctagagatatggtcaagcatcttaactctattgaggagcaaattttggaaagtctggcatggtcgcacgacagcgcgctttgggaagccctgcaggtgtctgccaataaagtgcctacttgcgaagaagtcatctttcctaacaactttgaaacaggcaatggcggaaacgtgcagggtcacctgcctctgatgccgatgagtccacttatgcaccccagagtgaaggaggtgagaaccgattctggatcacttagacgtgacatgcagccactgtcccctataagtgttcacgaaagatatagtagccctacagctggcagcgccaagcgtcggctgttcggcgaagaccccccaaaggaaatgttgatggataaaattattactgaaggcacaaagctcaaaatagccccatcaagctcgataaccgcagagaatgtgtctatccttcctggacaaacccttctgactatggccaccgctcctgtcacaggcacaactggacacaaagttacgattcctctgcatggcgtggccaatgacgcaggagagattacactaatacctctctcaatgaatactaatcaggaatcgaaagtcaagagcccggtctcacttacagcacacagcttgatcggagcctctcctaagcagacaaatctcacaaaggcccaggaggtgcatagcacaggtatcaaccgtccgaaaaggacaggctctcttgccctcttctacaggaaagtctaccatttggcaagcgtgcgactgcgagatctgtgcctgaagttggacgtgtcaaacgagttgcggagaaagatttggacctgtttcgaattcactctcgttcattgtcctgacctaatgaaggatagacacctggatcagctgcttctctgcgccttctatatcatggctaaggttaccaaggaggagcggaccttccaagagattatgaaaagttataggaaccagcctcaggctaattcccatgtgtacaggagtgtccttcttaaatcaatcccccgagaagtggttgcctataacaaaaatatcaacgacgatttcgagatgattgactgtgatctggaggatgctaccaagaccccagactgttcgtccgggccagtgaaggaagaacgcggagacctgattaagttttacaacaccatatacgtaggtcgcgtgaagagctttgctttaaagtacgacttggcgaatcaggaccacatgatggacgctccccctttgagcccttttccacatattaaacagcaacccgggtctccgaggcggatctctcagcagcactccatctacatttcaccccacaaaaatgggtccggtttaaccccacggtccgccctgctgtacaaattcaatgggtccccatcgaaagtgcggtag

SEQ ID NO: 17155 - DNA, 3207 bp, Artificial Sequence
  Description of Artificial Sequence: Synthetic coding sequence
atgtttgaagacaagccgcatgccgaaggcgctgctgtggtagccgccgccggagaagcattgcaagcgctgtgccaggagctgaacttggacgagggcagtgcagccgaggcgctggatgattttaccgccatccgaggcaattatagtttagaaggcgaagtgactcactggctcgcttgttcactgtatgtggcctgccgaaaatctattatcccaaccgtgggtaaaggcattatggagggaaattgcgtgagtctcacaaggatattgaggtctgctaaactgagcctaatacagttcttttctaagatgaaaaagtggatggatatgtctaacctgccacaggagttcagagagcggatagagcgactcgagagaaatttcgaagtgtcgactgtgattttcaagaagtacgaaccaattttcctcgatatctttcagaatccctatgaggagcctccaaagctgcctcgtagcagaaagcagcgtcgcatcccctgtagcgtcaaggacctgttcaatttttgttggacgcttttcgtctacactaaaggaaatttccgcatgatcggggatgacttggttaattcttatcacctgcttctgtgttgcctagatctaatcttcgccaacgcaatcatgtgtcctaatcgccaagacctgctgaatccatccttcaaaggactaccatctgattttcacaccgccgactttacggcatccgaggagcctccatgcatcattgcggtgttgtgcgagcttcatgatgggttattagttgaagccaaaggcataaaggagcactattttaaaccttacatctctaagctatttgaccggaaaatcctgaagggtgaatgcttgctggatctctcctcgtttaccgacaacagtaaagccgtgaacaaagaatatgaagagtatgtgctgaccgtgggagacttcgacgagcggatttttctcggggctgatgcggaggaggaaatcggcacccctcgaaagttcacccgggacaccccactgggcaaattgaccgcacaggcgaacgtggaatataatttacagcagcatttcgagaaaaagcggtcattcgcccccagcacccctctgaccggacgccgctatctgcgcgaaaaagaggcagtcattacccctgtcgcctcagcaactcaatcagtatcccgccttcagtctatcgtggccggactgaaaaacgctccatccgaccaactgatcaacatatttgagtcatgtgtccgaaacccggtcgaaaacatcatgaaaattcttaaggggattggggaaactttctgccagcactatacacaatctactgatgagcaacccggcagccacatagattttgccgtgaaccggttgaagctcgcggagattctgtactataaaattctggagacagtaatggtccaggaaacccgcaggctccatggcatggatatgagcgtgctgctcgaacaggacatttttcaccgtagcctgatggcttgttgccttgaaatagtgttgttcgcatatagctccccacgcacctttccctggattatagaggttctgaatctccaacctttttatttttataaagtgatagaagttgtgatccgatccgaggagggtctatcccgggatatggtcaagcacctcaattccatcgaagagcagatcttggagtcactggcatggagccacgatagcgctctatgggaggccttacaagtaagtgccaacaaggtgcctacctgcgaagaagtaatctttccaaataatttcgagacaggaaacggtggtaatgtgcagggccaccttcctctgatgccaatgagcccactgatgcatcctagagtcaaagaggtaaggaccgattctggtagcctgcggagagacatgcaaccactctcaccaatatccgtccacgagcgctacagctctccaaccgccggttctgcaaaacgccgcctgttcggagaagaccctccgaaggaaatgctaatggacaagatcatcactgagggcaccaaactgaaaatcgccccctctagttcaatcaccgccgaaaatgtcagcattcttccaggccagaccctgctgacaatggcaaccgcacctgtgacaggcaccactgggcacaaagtcacaattccattacatggagtggccaacgatgctggggaaatcaccttgatcccactcagtatgaacactaatcaggaatctaaggtcaagagccccgtatcgctcacagcccactcactgataggggccagccccaagcagactaacctgacaaaggcccaggaagtgcactccacaggcatcaacagacccaagcgtaccggctccctcgccctcttttataggaaggtttaccacctcgcctcggttcgactgcgcgacttgtgtctgaaacttgacgttagtaatgagctccgcagaaagatctggacctgcttcgaattcacgttagtgcactgtccggatctgatgaaggaccggcacctcgatcagctgttactttgcgccttttatataatggcgaaggtgacaaaggaggagcggactttccaggagattatgaaatcctacagaaatcagccccaagccaatagtcacgtctaccgcagtgtgcttctcaagtccatccctcgcgaagtggttgcatacaataagaacataaatgatgacttcgagatgatcgactgtgacctggaggacgccacaaagactccagattgcagctccggtcccgtgaaggaggagaggggggacctgattaagttttacaacacaatatacgtaggacgtgtgaagagcttcgccctgaagtacgatcttgctaaccaggaccacatgatggatgcaccaccactgagtccttttccccatatcaagcagcagcccggttcacccagaaggatcagccagcagcacagtatttatatctccccccataagaatggatccggcctgacgcctcgctccgccctcctttataagtttaacgggagcccgagcaaaagtctaaaagacatcaataacatgattcgtcagggagagcagcgcaccaaaaagagagtgatagcgatcgattccgatgcggaaagccctgcgaaacgggtgtgccaagagaacgacgacgtcctccttaagagattacaggatgtggtgtcagagcgagcaaatcattag

SEQ ID NO: 17156 - DNA, 3420 bp, Artificial Sequence
  Description of Artificial Sequence: Synthetic coding sequence
atgccatccggcggcgaccagagtcccccccccccaccaccccctcctgctgctgcggcgtccgacgaggaagaagaggacgatggcgaggcagaggatgccgctccacccgctgagtcccctactcctcagattcaacaaagatttgatgagctttgttctcggctcaacatggacgaggctgcccgtgcagaagcctgggattcctatcgttctatgagcgagagctatacgctcgaggggaacgatctgcattggcttgcatgcgcgttgtatgtggcatgccgaaaaagcgttcccacagtatcaaagggtactgtcgagggtaactatgtaagccttactagaattctgaaatgtagcgagcagtccctgatagagtttttcaacaaaatgaaaaagtgggaagacatggccaaccttcctccccactttcgagagcgcacagaacgccttgagcgcaatttcacagtgagcgctgtgatattcaaaaaatacgagcccatctttcaagacatattcaagtatccacaggaagagcagccccggcaacagagggggcgtaaacagcgccgacagccatgtacagtaagtgaaattttccatttttgttgggttcttttcatctatgcaaaaggaaacttccctatgatttccgatgaccttgtgaactcttaccatctgctcctctgtgctctggatctcgtttatggcaacgcattacagtgctcaaatcgcaaggaattagtgaaccccaattttaaaggcttgtccgaagactttcatgcgaaagacagtaagccaagcagcgacccgccctgtattatcgaaaaattgtgctccctgcatgatgggcttgttttggaggctaaaggcatcaaagagcacttctggaagccgtacataaggaagctatatgagaagaaactgttaaagggaaaggaggagaacctcaccggatttttggagccaggaaatttcggagagagcttcaaagccatcaataaagcgtacgaggagtatgtgctgagcgtgggcaacctggatgagaggatcttcctgggggaggacgcagaggaggagatcgggacactcagtcgctgtctgaatgctggaagcggcacagaaaccgcggagcgagtgcagatgaagaacatcctccagcaacacttcgataaatcaaaggccctccggatttctacaccactaactggtgtccgttacattaaagaaaactctccctgtgttacacctgttagtacagcaacacactcactgtcacgcctgcacacgatgctgacaggattgaggaatgctccatcagagaaacttgagcaaattctgcgaacatgtagcagagacccaactcaggctatagctaataggctcaaggaaatgttcgagatatatagtcaacatttccaaccagacgaggacttttctaactgtgccaaagagatcgcttctaaacactttcgatttgctgaaatgctgtactataaggttctcgaaagcgtgatcgaacaggagcaaaaacgactcggggacatggatctgagcggcatcctggagcaggatgcgtttcacaggagcctgttagcctgttgtctggaggtggtaacgttctcctacaagcccccaggcaatttccccttcattactgagatatttgatgttccactgtaccacttttataaggtcatcgaggtatttattcgcgcagaggacgggctgtgcagggaggtcgtcaaacatctgaatcagatcgaggagcaaatcctggaccaccttgcttggaaaccagagagcccattgtgggagaagatccgcgacaatgagaatcgggttcctacctgcgaggaggtaatgcctccacagaacctggaacgcgctgatgaaatttgcatcgccgggagccctctcactccccgtagagtgaccgaggtgcgcgccgacacaggaggccttggacgaagtattacctctcccaccactttatacgatagatattcttctccacccgcatctactaccaggagaaggctgttcgtcgaaaatgattccccctcggatggcgggacaccggggcgcatgcctcctcagcctctggtcaacgcggtgcctgtccagaacgtgagtggcgaaacagtttcagtgacacccgtgcccggccaaacacttgtgactatggcgacagcaaccgtgacagcaaataacggccagacggtgaccattcctgttcaaggtatagccaatgagaatggggggatcacttttttcccagtccaagtgaacgttggtggacaggcgcaggccgttacggggagtattcaaccactcagtgctcaggcactggcgggtagtttatccagtcaacaggtcactgggacaaccctccaagtaccaggccaggtagctatccagcagatctctccgggcggtcagcagcagaaacagggccagtctgtgacaagcagctcaaaccgccctagaaaaacaagctcgctttcgctgttctttcgcaaagtgtatcacctggcagcagtgcggctccgcgacctgtgtgcgaagctggacatttctgatgagctgcgcaagaaaatctggacctgctttgagttctccatcattcagtgcccagaactaatgatggacagacatctggatcaactgctgatgtgcgcaatttacgtgatggccaaggtcacaaaggaggataagagtttccaaaatattatgcggtgttaccgtactcagcctcaagccaggagccaggtttatcggtcggttttgataaagggcaagcgcaaacgaaggaattctggttccagtgatagccgctcacatcagaacagcccgactgagctgaataaagacagaacttccagggattcaagtccagtgatgcgaagctccagtactctcccggtacctcagccatcttctgccccaccaacccctacgcgcctgaccggtgcaaatagtgatatggaagaagaagaaaggggggatcttatccagttttacaacaacatttacatcaaacagatcaagacctttgccatgaagtattcacaggcaaacatggacgcccccccacttagcccttatccctttgtgcggaccggaagtcctcgtaggatacagctgtcccagaaccacccggtttacatttctccccataagaatgaaacaatgttatcgcctcgggaaaagattttctactacttctccaactccccttccaaacgcctccgagagataaatagcatgatccggaccggcgagactcctactaaaaaaaggggtattttacttgaagatgggtccgaaagtccggccaaacgcatctgcccagagaaccactcagccctcctgagaagactgcaggatgttgcaaatgaccgaggatcccactag

SEQ ID NO: 17157 - DNA, 2550 bp, Artificial Sequence
  Description of Artificial Sequence: Synthetic coding sequence
atggaaagcagatgcgtggcgcaggctggaatgcagtggcacgacttgggctctctgcagccgctgcccccacggttcaagaggtttttctgcctttcattactcagctcttgtgaatacagcaaggccattaacaaagcctacgaggagtatgtcctctctgtggggaacctggacgaacggatcttcctgggtgaggacgctgaagaggaaatcgggacactgtctagatgtttgaatgcaggcagcgggaccgagaccgcggaaagagtccaaatgaagaatatccttcagcagcactttgacaaaagcaaagcattgcgcataagtacccctctcacgggagtaagatacatcaaggaaaactctccatgtgtgactcctgtttcaacagcaactcattcactgagcagattgcacacgatgctcacaggactgcggaatgcacccagtgagaagctagaacagatcctgcggacctgctccagggacccaacacaggctatcgcaaatcgcctgaaggagatgtttgaaatttacagtcagcacttccaacccgatgaggacttttcaaattgcgccaaggagattgcctccaaacactttaggttcgctgagatgctctactataaggtgctggaaagcgtgatagagcaggagcagaagcgcctcggtgatatggacctgtccggcatcctggaacaggatgcttttcacaggtcactgcttgcctgctgtcttgaggtggtgactttctcgtataaaccccctggcaacttccccttcattactgagattttcgatgtgccgctgtaccacttttacaaggtaattgaggtgttcatccgagccgaagatggtttatgtagggaggtagtaaaacacctaaaccagatagaagagcagattctggatcacttagcctggaaacctgaaagccccttgtgggagaaaatcagggacaatgagaaccgggtgccaacctgtgaagaggtgatgcccccccagaacctggaacgggcggatgaaatttgcatcgctggaagtccactgacgcccaggcgtgtcacagaggtgagagccgacacgggaggtctgggtaggagcatcacctccccaactaccctctacgaccgatatagttcgcctcccgcctctacaaccagaagaagactgttcgtagagaacgattcccccagtgacggcgggacaccaggacgcatgccaccacagccgttggtaaacgcagtgcctgtgcagaacgtcagtggcgagacagtctctgtcactcctgtgcctggccagaccctcgtaacaatggccacagccacagtgacggccaacaatggccagacagtaaccatccctgtccaggggatagccaacgagaacggagggattacatttttccctgtccaagtgaatgtggggggccaagcccaagctgtgaccggtagcatacagccgctcagcgctcaggccttagccgggtcgctttcatcccagcaggtgacaggcacaactctgcaagtgcccggtcaggtcgctattcagcagatttctcctgggggccagcagcaaaagcaaggccagtctgtgacaagttccagcaaccgccctcggaaaacctcctctctgagtctgttcttccgaaaagtgtaccatctcgcggccgtcaggctgagggacctgtgcgccaaactggacatttcagacgagctgagaaagaaaatttggacttgctttgagttctcaatcatacagtgtcccgaactgatgatggatcggcatctcgatcaactgctcatgtgcgcgatctacgtgatggccaaagtgactaaagaggacaagagttttcagaatattatgcggtgctatcgcacacaaccacaggcacgtagccaggtctatagaagcgtgctgatcaaaggaaaacgtaagcgaagaaatagtggctcatcggatagccgctcacatcaaaatagcccgaccgaattgaacaaggacaggaccagtagggactcttcccccgtcatgcggagctcctctaccctgcctgtgccccaaccgtcttccgcccctccgacaccaacacggttgacgggagccaattcagacatggaggaggaggagcgcggggatctaatccaattttacaataatatttacattaagcaaatcaagaccttcgccatgaaatatagtcaggccaacatggacgccccaccactaagcccttatccttttgttagaacaggctcacccagacgaattcagctgtcccagaatcatcctgtgtatatatcaccgcacaagaacgagacaatgctgagccccagagagaaaatcttctactacttctctaactcgccatccaagcgactcagggagattaactccatgataagaacgggcgaaactcccaccaagaagcgcggaatcctgctggaagacgggagtgaaagtccagctaaacggatatgcccggagaaccattctgcactgttgcgacggctgcaggatgtagccaatgaccgggggtcccactag

SEQ ID NO: 17158 - DNA, 1668 bp, Artificial Sequence
  Description of Artificial Sequence: Synthetic coding sequence
atgcagtcactgacaaagggaaatgatctgcactggcttgcatgcgcgctgtatgtcgcgtgcaggaagagtgtccccaccgtgtctaagggtactgtagagggcaattatgtgtccctcacccgcattctaaagtgctctgaacagtccctcatcgagttttttaataagatgaaaaaatgggaggacatggccaatctccccccacatttccgcgagcggacagaacggcttgaacgcaactttacagtgtccgcggtaatttttaagaaatatgaacctatattccaggatatcttcaagtaccctcaggaggagcagccccgacagcagcgaggccgaaagcaaagaaggcagccttgtactgtgtctgagatcttccatttctgctgggtgctgtttatttacgcgaaaggaaactttccgatgatctcagatgatctggtcaactcataccacctcctactttgcgcactggacctggtctacggaaatgcactgcagtgttcgaacaggaaggaactcgtaaatccaaactttaagggactctctgaggactttcacgcaaaagattctaagcctagtagtgaccccccttgcataatcgagaaactgtgtagtctccacgatggactggtgctggaggccaaggggatcaaagagcatttttggaaaccatacatcaggaaactatatgagaagaagcttctcaaaggcaaagaggaaaatctgaccggcttcctggaaccgggaaacttcggggaatcatttaaggccatcaataaggcatacgaagagtacgtgttatctgtgggcaatttggatgaaaggattttcctgggcgaagatgcggaggaagaaatcggaaccctgtcgcggtgtttgaatgccggatcaggaaccgagacggccgagcgtgtgcagatgaaaaacatactgcagcagcacttcgacaaaagtaaggccctgcgaatttccacacccctgaccggtgtccggtacatcaaggagaattcaccttgtgtgaccccagtcagtacagccacacacagcctctcccggctgcacactatgctaacagggctgcgcaacgcccctagcgaaaaactagaacaaattctcaggacctgttcccgtgaccccacccaggcaatcgcaaatcgcctgaaggaaatgtttgaaatctattctcagcattttcagcccgacgaagacttttctaattgtgcaaaagaaattgccagcaaacattttcggttcgccgaaatgctctactataaagtactcgagtccgtgattgagcaagagcaaaagagactgggagacatggacctttctgggatcttggaacaggatgcattccatcgatccttacttgcctgctgtctggaggtggtcacctttagctacaagccacctggtaatttcccgttcatcacggagatttttgatgtccccctgtaccatttttataaggtgattgaagtatttatccgtgccgaagatgggctgtgccgggaggtcgtgaaacatctgaatcagattgaagagcaaatcttggatcatctggcgtggaagccagaaagtcctctgtgggagaaaataagagataacgaaaaccgcgttccgacctgtgaagaggtgatgccacctcagaatcttgaatag

SEQ ID NO: 17159 - DNA, 1557 bp, Artificial Sequence
  Description of Artificial Sequence: Synthetic coding sequence
atgatctctgacgacctcgtaaattcctaccaccttctgctgtgcgcgttggatctggtgtatggaaacgcactgcagtgctcaaaccggaaagaactggtcaatccaaacttcaaggggctctcggaggattttcacgctaaggactcaaaacccagcagtgaccctccatgtataatcgaaaaattatgttccctccatgatggtttagtcctggaggccaaggggatcaaagagcatttttggaagccttatattcgcaaactctacgaaaaaaagctccttaagggaaaggaggagaatctcaccggcttcctggagcctgggaactttggagagagcttcaaggctattaataaagcctatgaagagtacgtgttgagcgtgggcaacctcgatgagaggatttttctcggagaggatgctgaggaggaaattggcacattgagcaggtgcttgaacgctggaagtggcactgaaacggctgaacgcgtacagatgaaaaacattcttcagcagcactttgataaatccaaggcactcagaatttccacaccactcacaggcgtgcgctacattaaggagaattccccgtgtgtcacacccgtgtccacagcaactcacagcttaagcagattacataccatgctaaccgggctccggaacgcaccgtccgaaaaactggaacagatcttacgtacctgcagcagagaccctacccaggcaatagccaacagactcaaggagatgttcgagatctattcacagcacttccagccagatgaggattttagtaattgtgccaaggaaatcgccagcaagcactttcgctttgccgagatgctatactataaagtgctggagagcgtcatcgaacaggagcaaaaaaggctgggggatatggatctttcagggatcctggaacaggacgcgttccacagatccctccttgcctgttgtctggaagttgtcaccttttcatataagcctcccgggaacttcccttttataaccgagatcttcgacgttccattgtatcacttttacaaggtgatagaagtgtttatccgtgcagaggatggactgtgcagggaagttgtgaagcacctaaatcagatcgaggagcagattttggaccatctggcctggaaaccggagtcgcccctatgggagaaaatccgggataatgaaaatcgtgtaccaacatgcgaagaggtaatgccccctcagaatttggaacgagctgatgagatctgtatcgccggctccccacgtaggatccaactgtcacagaaccaccccgtttacatttcaccccacaagaatgagaccatgctgtcaccgagagaaaaaatattttactacttctcgaattcgcccagtaaacgcctgcgcgagattaacagcatgatcaggactggcgagacacccacaaaaaaacgcgggatcttactcgaagacgggagtgaaagcccagccaagaggatctgccccgaaaatcattccgcgctgctcagaagactccaagacgtcgcaaatgaccgcggcagccactag

SEQ ID NO: 17160 - DNA, 1347 bp, Artificial Sequence
  Description of Artificial Sequence: Synthetic coding sequence
atgtttgattgcatggatgtgttgtcagtgagccccggacagatcctggatttctacacagcctcaccaagttcctgtatgttacaagagaaagccctgaaggcctgtttcagcggcctgactcaaacagaatggcaacatcgccacaccgcgcagtcaatagagactcagtctacatcttctgaagaactggtgcccagcccccccagccccttgcccccccctagggtctacaagccttgcttcgtttgtcaggacaagtcttctggatatcactacggtgtcagcgcatgtgagggatgcaagggttttttccgcagatccatccaaaaaaatatgatttacacctgtcacagggataagaactgcgtcatcaataaggtcacacgaaatcggtgtcaatattgcaggctgcagaaatgtttcgaggtcgggatgtcaaaggagagtgtccggaatgatagaaataagaaaaagaaggaaaccagcaaacaagaatgcactgaaagctacgagatgactgccgaattagacgatttaactgagaaaatccgtaaagcacatcaagagacatttccttctctgtgtcagctcggcaaatataccacaaactcttcggccgatcatcgagtgaggctggatctgggtctgtgggataagttcagtgaacttgctacaaagtgtatcataaaaatcgtggagtttgcaaaaaggcttcccggattcaccggccttaccatcgctgatcaaatcaccttgctgaaagcagcctgcctagacatactgatcttgagaatctgtacaaggtacactccagagcaggacacgatgactttttctgacggtctgactttgaataggacccagatgcacaacgcaggcttcggccctcttaccgaccttgtattcactttcgctaatcagttgcttcctctggagatggatgatacggagacgggtctgctgtccgccatctgcctcatttgcggtgaccggcaggaccttgaagagccgaccaaggttgacaagctgcaggaaccactgctggaggccctgaagatttatattcggaagagaaggccatctaagccccacatgttcccgaagatcttaatgaaaatcacagacttgagatctatctctgcaaaaggggcagagcgcgtaatcactctaaagatggagattccaggatctatgcctcccctcatccaggagatgctggagaacagcgagggccatgaaccactgactcctagcagttcgggaaacacagccgaacactcaccctcaatcagtccatcctctgttgaaaactctggcgtctcgcagtcgccactggtccagtag

SEQ ID NO: 17161 - DNA, 1368 bp, Artificial Sequence
  Description of Artificial Sequence: Synthetic coding sequence
atgacaacttccggtcatgcctgtcccgtacccgccgtgaatggacatatgacacactatcctgcaaccccttacccactcctgttcccccccgtcatcggggggctcagcctaccaccccttcacgggctacacggacacccccccccatcaggctgcagcacgccctccccggccaccattgaaacccagagtactagttccgaggaactcgtacccagccccccttccccgctcccccctcccagggtatataagccctgttttgtgtgccaagacaagtctagcggatatcattatggggtctcagcttgcgagggatgtaaagggttcttcaggcgctcgattcaaaaaaacatgatatatacatgccatcgggacaagaactgcgtgataaataaggtgacgcgcaaccgctgccaatactgtcgtcttcagaagtgctttgaagttggcatgtctaaagaatctgttagaaacgatcggaataagaagaagaaagagacaagtaaacaggagtgcactgaatcctacgaaatgactgctgaactggatgatctaactgagaagattcgcaaggcacaccaagagacctttccctcactttgtcagctgggaaagtataccaccaacagctcagctgaccatcgcgttcgcctggacctgggcttgtgggataagttcagtgaactcgctactaaatgtatcatcaaaatcgttgaatttgccaaaagactgcccggcttcaccggtctgacaatcgctgaccaaatcacccttctgaaagccgcgtgcttggacattctgatactgagaatttgtacacgctatacccctgaacaggatacgatgacattttcagacggcctcacattaaacaggacccagatgcacaacgctggctttggtccactgactgacctcgtctttactttcgccaaccagctgctcccactggaaatggatgacactgagaccgggcttttgtcggctatctgcttgatctgcggagaccggcaggatctggaggaaccaaccaaagtcgataaattgcaggagccccttctagaagctctgaagatctatatacgcaaacgaagaccatccaaacctcatatgttcccaaaaattctgatgaagataaccgacttgaggagtatctctgcaaagggagcagagagggtgattacactaaagatggagatccctgggtccatgccaccccttattcaggagatgttggagaatagtgagggtcatgaacccctgactccatcatcttccggcaacaccgctgaacacagtccatcaataagcccgagttccgtggaaaattccggggtgtctcaatcccctcttgtgcagtag

SEQ ID NO: 17162 - DNA, 1011 bp, Artificial Sequence
  Description of Artificial Sequence: Synthetic coding sequence
atgatctacacctgccatagggataagaattgtgtaataaacaaagtaacacgcaaccgctgccaatattgccgactgcagaagtgcttcgaggttggtatgtcaaaggagtccgtgagaaatgaccgcaacaagaaaaagaaggagacgtccaaacaggagtgcacggaaagctacgaaatgaccgctgagctcgacgatttgacggaaaaaatccgtaaggctcatcaggaaacctttccctctttgtgccagttgggcaagtacactaccaattccagcgcagaccatcgggtacgacttgatttaggcctttgggacaagttttccgaactcgcaactaaatgtattattaagattgtggagttcgcaaagcgacttccaggattcaccggcctgacaatcgctgaccagattacactgctaaaagcagcatgcctggatatcctcatattgaggatctgcactaggtacacacctgagcaggacacaatgactttctccgatggtcttaccttgaacagaacgcagatgcataacgctggattcgggccactgacagacttggtttttaccttcgccaaccagttactgcctttggaaatggacgatacagagactgggctgctatccgcgatttgcctgatctgcggcgatagacaggatctggaggagcccactaaagtggacaagctgcaagaaccattgctcgaggccctaaaaatctacatcaggaagcgacgcccaagtaagccccacatgtttcccaaaatccttatgaaaataaccgacctcagatccatcagtgcgaaaggagcagagcgggtcatcactttaaagatggagatacctgggagcatgccccctcttatacaagaaatgttggagaacagcgagggccatgaacctcttaccccctctagttccggtaacacagccgagcacagccccagtatttccccctcttctgtcgagaactctggagtgagccaatcacctctggttcagtag

SEQ ID NO: 17163 - DNA, 1011 bp, Artificial Sequence
  Description of Artificial Sequence: Synthetic coding sequence
atgatttatacatgccatcgggacaaaaattgtgtcattaacaaagtgactagaaatagatgccagtactgccgtctacagaagtgctttgaggtgggcatgtcaaaggagtccgtgcgcaacgatcgaaacaagaagaaaaaggagaccagcaaacaagaatgcacggagtcttatgagatgactgccgaactcgacgacctcacagaaaaaattcgtaaggcccaccaggagacctttccctctttatgccagctcggcaagtacacaaccaacagcagcgccgatcacagggtgaggttagatctcggcctgtgggataagttttcggaactcgctaccaaatgtatcatcaagatcgtcgaattcgcgaaaagattgcccggcttcacggggctgaccatagctgatcaaatcactcttctgaaggccgcttgcttagacatcctgattctgcgcatttgcacgcgctatacacctgagcaggacactatgacgtttagtgatggcttgacactgaatcgaacacaaatgcacaatgctgggtttggccccctgacagatctggttttcacatttgcgaaccagctcctcccccttgaaatggacgatacagaaacggggctcctgtcagccatttgtctaatatgcggtgatcgccaggacttggaagaaccgactaaggtagacaagttacaggaacccctgttagaggcgcttaagatctatatacgcaagcgcagacctagtaaaccacacatgtttccgaaaattttaatgaagatcaccgacctacggtccattagcgctaaaggggccgagagggtgatcacactgaagatggagattccagggagtatgccaccactgatacaggaaatgctcgaaaacagtgaagggcacgagccgctgacacccagttcttccggaaatacagctgaacactctccgtctatcagtcccagttctgtggagaactctggcgtaagccaatcccctctggttcagtag

SEQ ID NO: 17164 - DNA, 1326 bp, Artificial Sequence
  Description of Artificial Sequence: Synthetic coding sequence
atgaccacctccggccacgcctgcccagtgccagccgtcaacggacacatgacccactaccccgccacaccttacccactcctgtttcctcctgtcattggcggcctgtccttacctcctctgcacggactgcatgggcatccacctcctagcggctgctccacaccaagtcctgccaccattgagacacagtctaccagctctgaagaattagtgccatcccccccatctccccttccaccccctcgtgtgtacaagccgtgcttcgtgtgccaagataagtctagcggttatcattatggcgttagcgcttgtgaaggctgcaaaggtttcttccgccgatctatccaaaaaaatatgatatatacttgtcacagagacaaaaattgcgtgataaataaggtaacccggaacagatgtcaatattgtcgcctccagaagtgtttcgaggtggggatgtcaaaggaaagcgtccgtaacgacagaaacaaaaagaaaaaagagacctctaagcaggaatgtaccgaaagctatgagatgacagcagagctggatgatctcaccgagaagattcgaaaggctcaccaggaaacgttcccttccctgtgtcaactggggaagtacactactaattcatcagccgatcaccgggtaagactcgacctgggactgtgggataagttttcagaactggccactaaatgcattattaagatcgtggaattcgcgaaaagactcccaggtttcaccggactgaccatagctgatcaaatcacactcctgaaagcagcatgcttggacattctgatactccggatctgcacacgttataccccggaacaggatactatgacattttccgatggactgacgctgaaccgcacccagatgcacaacgctggttttggaccgctaactgacctagtgttcacattcgctaatcagttgctgcctctcgagatggatgatacagagactggactgctttctgccatctgcttgatatgtggggacaggcaagacctcgaagaaccaaccaaggttgacaagctccaggaacctctgctagaggctttgaagatctatattaggaagcggagaccgtctaaaccgcacatgttccccaagatcctcatgaaaatcaccgacttacgatcgatctctgcaaaaggcgcagagagggttatcaccctgaaaatggagatcccagagggccacgaacccctgacaccttcatcctcaggaaacaccgcagaacattcacccagtataagcccatcctcggtagagaattctggagtgtcccagtctccgctggtgcagtag

SEQ ID NO: 17165 - DNA, 462 bp, Artificial Sequence
  Description of Artificial Sequence: Synthetic coding sequence
atggaccctccagctgggttcgtgagagccgggaatcccgctgtggccgctccacagtctcctctctctcccgagggggcccactttcgggccgcccaccacccccgttctaccggatctcggtgccctgggtccctgcagccttctaggccactggttgccaactggctgcagtctctacccgagatgccagtggatttcacaggctactggaagatgttggtgaatgagaatttcgaggagtacttgcgcgccctagacgtgaacgtggccctacggaagatcgcgaacctgctgaaaccagataaagagattgtccaggacggggatcacatgatcatccgaacattatctacattccgaaattacattatggatttccaggttggcaaggaattcgaagaagacctgacgggcattgacgatcgtaagtgcatgagcgaaactggctttagctcttag

SEQ ID NO: 17166 - DNA, 405 bp, Artificial Sequence
  Description of Artificial Sequence: Synthetic coding sequence
atgaccagagatcagaacggcacctgggaaatggaatctaatgagaactttgaaggctatatgaaggcgctggacatcgattttgcaacgagaaaaattgctgtgcgattgacccagactaaggtcatagaccaggacggcgacaatttcaaaacgaagaccaccagcacttttaggaactatgacgtggattttaccgtcggcgtcgagtttgatgaatatacaaaatcactcgataaccgccatgtgaaggcgcttgtgacatgggaaggcgatgttctcgtatgtgttcaaaagggagaaaaggagaatcgaggctggaaacaatggattgaaggggataagctgtacctggagttgacatgtggcgatcaggtttgtcgtcaggtctttaagaaaaaatag

SEQ ID NO: 17167 - DNA, 474 bp, Artificial Sequence
  Description of Artificial Sequence: Synthetic coding sequence
atggaccctcccgccgggtttgtgagggccggcaatcccgccgtggccgcaccccagtctccacttagcccagaaggcgcacactttagggctgcccatcatccccggtcaacaggaagtcggtgtcccggctctctccaaccctcccgtcctctagttgcgaactggctccaatcactcccagagatgcccgtagacttcaccggatactggaagatgctcgtgaatgaaaacttcgaggagtatctacgggctctggatgtcaacgtggcactgcgaaaaatagcaaacctgctgaaacccgataaggagatagtgcaagatggagatcatatgataatccggacattatcgacctttcgcaactacatcatggacttccaagtggggaaagagttcgaggaagacctgacgggcatcgatgataggaagtgtatggccggagtacagtcgagagacttgagcagtctgtag

SEQ ID NO: 17168 - DNA, 3756 bp, Artificial Sequence
  Description of Artificial Sequence: Synthetic coding sequence
atgagacgcggaggatggagaaaaagagcagaaaacgatggatgggagacctggggcgggtatatggcagccaaagtccagaaattagaggaacaatttcgatccgacgcagccatgcagaaagacggcacatcttcgacgatctttagtggtgtggccatttacgtcaatggatatacggatccctctgccgaggaattgcggaagcttatgatgctccatggggggcaatatcacgtatattattctagatctaaaaccacccacattattgcgacgaacttacctaatgccaaaatcaaggagcttaagggcgaaaaggtcatcagaccggaatggatagttgaatcgataaaagccggtaggctgctgtcatacatcccgtaccagctttacacaaaacaaagtagcgtacagaaggggttaagctttaatcccgtatgcaggcctgaggaccccttacctggaccatccaatattgcgaaacagctgaacaacagggtgaaccacattgtgaagaaaattgaaactgagaacgaagtgaaggttaacggcatgaattcttggaatgaggaagatgagaataatgactttagttttgttgatctggaacagacgtcccctggaaggaagcaaaacggcattcctcacccacggggatctactgccatttttaatggccacacgccctcctccaacggtgccctgaagacccaggattgtctggttcccatggtgaacagtgtcgctagccgcctcagccccgccttttctcaggaagaggacaaagctgagaagagttctactgattttcgcgactgcactctgcagcagctgcagcagtcaacaagaaacactgatgcattgcgtaatcctcacaggacaaatagtttttctctgagtccactgcacagcaatacaaaaattaatggagctcaccattccacggtgcagggtccctccagtacgaagtctacttcatctgtttcaactttcagcaaagcggcaccatccgtacctagtaaaccatcagactgtaatttcatctcaaatttttacagtcactcaaggctccaccacataagcatgtggaaatgtgagctcacggagttcgtgaacacactgcagcggcagagcaatgggatcttccccgggagggagaagctgaagaagatgaaaaccgggagaagcgccctggtggtcaccgacaccggcgatatgagtgtgctgaatagtccacgccaccagtcatgtatcatgcatgttgatatggactgcttcttcgtgagcgtggggatccgtaatcgaccggacctcaaggggaaaccggtggctgtaacctcaaataggggtacagggagggccccgctccgacccggtgctaatccgcagctggagtggcagtactaccagaacaaaattctgaaaggtaaggccgccgacatccctgattcctccctctgggagaatcctgattccgcccaggctaatggtatagacagcgtcttgagccgcgccgagatagcctcttgttcatatgaagctcgccagctgggaatcaaaaatggcatgttctttgggcatgccaagcagctatgccctaacctgcaggccgtcccctacgattttcacgcctacaaggaagtggcgcagacactttatgagactttagcatcttatacccataacatcgaggcagtcagctgcgacgaggccctggttgacattactgagatacttgcagaaaccaaactcaccccagacgagttcgctaacgccgtcaggatggaaataaaagaccagaccaagtgcgccgctagcgtggggatcggatccaacattctgctggcccgtatggcaacccgtaaagctaagcccgatggccagtaccacttgaagccggaggaagtggacgattttatcagggggcagctggttactaaccttcccggagtcgggcatagcatggagagcaagctggccagtctcggcataaagacttgtggagatcttcagtacatgacaatggctaagctgcagaaggagtttggtccgaaaaccggccagatgctataccgattctgccgtggccttgacgatagaccagtccgcacggagaaagaacggaagtcggtctcggctgagattaactacggcattaggttcacccagccaaaagaggcagaagccttcctgctgtccctcagtgaagagatccagaggaggctggaggcaacgggcatgaagggcaagcggctaacacttaagattatggtccgaaagcctggggccccagtcgaaacggccaagttcggggggcatgggatctgcgacaacatcgcccggacggtgaccctggaccaggctaccgataacgctaaaatcattggcaaagcaatgctgaatatgttccatacgatgaaattgaatatcagtgatatgcggggagtcggtattcacgtgaaccagctggtgcccaccaatctgaacccctctacatgcccttctcgcccttccgtccaatcctctcactttccaagcggatcttactccgtgagggacgtgttccaagttcagaaggctaagaaatcgactgaggaggaacataaggaggtctttcgtgcagctgtggacctggaaatcagttcagctagcaggacatgcacctttctgcctcctttccctgcacacttgcccaccagtccggacaccaacaaagccgagtcttctggcaagtggaacgggttgcacacgccagtgtccgttcaaagtaggttgaacctgagtattgaagtacccagtccctcccagttggaccaaagcgtacttgaggccctcccccccgatttgagggaacaggtggaacaggtttgcgccgtgcaacaggcagagtcccacggcgataagaaaaaggagcccgttaacggatgcaataccggaatcttgccccaacccgtgggtacagtcctgttacagatccccgagccccaagaaagcaactcggacgcagggatcaatctgattgccctgccagccttttcccaggtggatcccgaggtattcgccgctttgccagcagaactgcagcgcgagttaaaagccgcatatgaccagcgccagaggcagggagaaaattccactcaccagcagagcgcctcggcaagcgtgcccaaaaatcctctgctccatttgaaggctgctgttaaagaaaagaaaagaaacaagaaaaagaagaccattgggtcccccaagcgaatccagtccccgcttaacaacaaactgctaaactcccctgccaagacccttccgggggcatgcggctctccccagaaattgatagacggctttcttaaacatgaggggccacccgctgagaagccactagaagagctctccgcgagcacatccggggtgcctggcctgagtagcttgcaaagcgaccccgccgggtgcgttaggccaccagctcctaacctggctggggccgtggagttcaacgatgttaaaacactcctccgggagtggataaccactatttccgatcccatggaggaggatatcttgcaggtagtgaagtactgtacagacctgatagaagaaaaggacctcgaaaagctcgatctcgtgattaaatatatgaaacggctcatgcagcaatccgtggagtccgtttggaacatggctttcgattttatactcgacaacgtgcaggtagtattgcaacagacgtacggtagtactcttaaggttacatag

SEQ ID NO: 17169 - DNA, 3753 bp, Artificial Sequence
  Description of Artificial Sequence: Synthetic coding sequence
atgcgaagggggggctggaggaagcgggcggagaacgacggctgggagacgtggggcggctacatggctgctaaggtgcaaaaattggaggagcagtttcgatctgacgcggccatgcagaaagacggcacctcttcaacgattttttcaggcgtcgccatttacgtcaatggttacactgaccccagtgcagaagagctccgtaagcttatgatgctccacggcggccagtaccacgtgtactactcccgcagcaagactacacatataatcgcaactaatcttccaaatgccaagattaaggagctaaaaggcgaaaaagtgatcagaccggagtggatagtggagtccatcaaagcaggccgattacttagctatataccataccagttgtacaccaaacaaagttcggtgcagaaaggactcagtttcaatcccgtgtgccgcccggaagatccactgccaggtcccagtaatattgctaagcagctgaataacagggtaaaccacatcgtgaagaagatcgaaacagagaatgaagtcaaggtgaacggcatgaactcctggaacgaggaagacgagaacaatgacttctcatttgtggatcttgaacagacatcacctggtagaaaacagaacggcataccacatccccggggttccacagcaatttttaacgggcatacgccatcttcgaatggcgccctcaaaacacaggattgtctggtgcccatggtcaattccgtggcttcgcggctatcccctgctttttcacaggaggaagataaagccgagaaatccagcaccgacttcagagattgcacgttacagcagctgcaacagagcacacggaataccgatgccctcagaaatccccatagaactaatagcttctccctatcacctctccacagcaacacgaaaattaacggcgctcaccatagcaccgttcagggccctagctctacaaaatctacgtctagcgtgagtaccttcagtaaggccgcacctagtgtgccttccaagccttccgattgtaacttcatctccaacttttattcacatagccgcctccaccatatctctatgtggaagtgtgagttgaccgagttcgttaacaccctccagcgccaatctaatggaatatttccagggagggagaagctaaagaaaatgaagactggccgttctgcactggtcgtaactgacaccggagacatgtcggtcctcaactcaccccggcatcagagctgtattatgcacgtggacatggactgcttttttgtatctgtagggataaggaaccgaccggatctcaaaggtaagccagtcgcagtgactagtaaccggggaaccggtcgcgcgcccctgcgtccaggagcaaaccctcagctggagtggcaatattatcagaataagatactgaaagggaaagctgatatcccagattctagtttgtgggagaatcctgactccgcgcaggccaacggcattgactcagtgctgtcgcgcgccgaaatcgcctcttgtagctacgaagcccgtcagctgggcatcaaaaatgggatgttctttggacacgccaagcagctctgccctaatctgcaggctgtaccttacgacttccacgcttacaaggaagtagcccagacactctatgaaacactagcaagctatactcacaatatcgaggccgtaagctgcgacgaggccttagttgatatcacggagattctggctgagacaaagctgacccccgacgagttcgctaacgccgtgcggatggagatcaaggatcagacaaaatgtgctgcatcagtgggcattggctccaatattttgcttgcacgtatggctaccagaaaggcaaagccagatggccagtaccacctgaagcccgaggaggtcgacgactttatccgtggacagctggtgactaacctgcctggagtgggtcacagcatggagagcaaattggcgtcactcggtatcaagacatgtggggatctgcaatatatgacaatggctaaactgcagaaggaattcggacctaagacgggacagatgctgtatcgcttttgccgtggcctggatgatcggcctgtcagaactgaaaaggaacggaagtctgtctctgctgagatcaactacggcatccggttcacccagccgaaggaagccgaggcttttttactctccctcagcgaagaaatacagcggaggctggaggcaacaggaatgaagggaaaaagacttactctgaagatcatggttaggaaaccaggggcccctgtggagactgcgaaatttggcggccatggcatatgcgacaatattgccaggacggtgactttggatcaggccactgacaacgctaagatcatcggcaaggcaatgctgaatatgttccacaccatgaagctaaacatttccgatatgcgcggggtgggcatacacgtgaatcagcttgtccctaccaacctcaacccctccacatgcccatcaagaccaagcgtccagtctagccatttcccctctggtagctattcagtgagggatgtgtttcaggttcagaaggctaaaaagtccactgaagaagaacacaaggaggtgttcagagctgccgtggatttggaaatatcatcagcctctcgtacctgcacctttctgcctccattccctgctcatctgcctaccagcccggacacaaacaaagccgagagcagtgggaagtggaacgggctacacactcccgttagcgtgcagagccggctgaacctgtctattgaggttccatcaccctcccaactagaccaatcagtccttgaggcccttccgcctgatctgcgggaacaagtcgagcaggtttgtgccgttcagcaggccgagagccatggcgataaaaagaaagagcccgttaacgggtgtaataccgggatcctgcctcagcccgtgggaactgtgttgctgcagattcccgagccccaagagagcaatagcgacgctggcatcaacctcattgccctacccgctttttcacaggtcgacccagaggtgttcgccgcattgccagcggagttgcagagagagctaaaggccgcatatgaccagagacagcgccagggtgagaactctacacatcagcagtccgcttcggcatctgtcccaaaaaatccacttctgcacttaaaagctgcagtgaaggagaaaaagcgtaataaaaagaagaaaacgatcgggagccccaagaggatccagagtccattgaacaacaagctgctcaatagtccagcaaaaaccttgcccggggcttgcggatcccctcaaaagcttattgacgggttcctgaaacatgagggcccacccgctgagaagccactagaagagctatcagcttctacaagtggtgtgcccgggctgagctcccttcaatcagaccctgcggggtgtgtgaggccaccagctcccaacctcgccggtgcagtcgaatttaatgatgtcaagacccttctacgcgaatggattacaacaatcagcgatcctatggaagaggacatacttcaggtggtgaagtattgtaccgatctgatcgaggaaaaggacctggagaaactcgacctcgttatcaaatatatgaaaagattgatgcagcagtcggtggagtctgtgtggaatatggccttcgactttatcctggataacgtgcaggtggttctacaacagacttacgggagcactctcaaggttacctag

SEQ ID NO: 17170 - DNA, 2916 bp, Artificial Sequence
  Description of Artificial Sequence: Synthetic coding sequence
atggctaccgtgcgcgcatctctaaggggagcactgctactgcttctggccgttgccggagtcgctgaagtggccggtggcctggcacccggtagtgcgggggcgctgtgttgcaatcacagtaaagacaaccagatgtgcagggatgtgtgcgaacagatattttcatctaaatctgagagccgcttaaagcatttgctgcagagggcgcccgactactgccccgagacgatggtggagatttggaactgcatgaactcctctctccccggcgtgttcaagaagtcggacggctgggtgggtctgggttgctgtgagctggcaatcgctctggagtgtcgacaggcatgcaaacaggcaagctcaaaaaatgacatctcaaaagtatgtcggaaagaatatgaaaacgccctcttcagctgtatcagccgaaacgaaatgggatctgtctgttgttcttacgcagggcatcacactaattgccgcgaatactgccaggcaattttccgcaccgactcatcaccgggaccctcccagatcaaagccgtggagaattactgtgcttctatctcaccacagttgatacactgtgtcaacaactacacccagagttaccctatgaggaatccgaccgactctctttattgttgcgacagagccgaggatcacgcttgccagaacgcatgtaaacggattttgatgagcaaaaaaaccgagatggaaatagtggacggcttgatcgagggttgtaaaacccaacctctccctcaggacccgctgtggcagtgcttcctggagtcctctcaaagcgtgcatcccggagtaacagtacatccaccaccgtcaaccggactggacggagctaaactgcattgttgctcaaaggctaatacctctacatgccgtgagctatgcactaagctctattccatgtcgtggggaaatacacagtcttggcaggaattcgaccgcttctgtgagtacaatcccgtagaagtcagtatgcttacatgcttggcggacgttagagagccctgccaacttgggtgcaggaatctcacctattgtaccaactttaataaccgaccgacggagctctttcggtcatgtaacgcccaatccgaccagggtgcaatgaatgacatgaagttgtgggaaaaaggtagcattaagatgcctttcatcaatatacccgtgcttgatatcaaaaagtgtcagccagaaatgtggaaggctattgcctgcagtctgcagattaagccctgtcatagtaagtctaggggctccataatctgtaagagtgattgtgtcgagatcctgaaaaaatgtggagatcagaacaaatttccggaagatcataccgctgaatcaatctgcgagctgctatcgcccaccgacgatctgaagaattgtatccctctggatacctatcttcggccttccacactgggcaatatcgtggaagaggtgacccatccatgcaacccaaatccgtgccctgccaatgagctttgcgaagtcaatcgcaagggctgtccatccggagacccttgtctcccatacttttgcgttcaggggtgtaaactaggggaagcatcagatttcatcgttcgccagggcacactcatacaggtgccttcttctgccggggaagtgggttgctacaagatctgctcgtgtggacaaagcgggctcttggagaactgtatggaaatgcattgtatcgatctgcagaagagctgtatagtcggtgggaaacggaaatctcatggaacctctttctctatcgactgcaatgtgtgcagctgcttcgctggcaatctagtatgcagcacccgactttgcctgagcgagcactcctctgaagacgacagaaggacgttcaccgggctaccgtgtaactgtgctgatcaattcgtccccgtctgtggccaaaatggccgtacttatccatcggcctgcattgcacggtgcgtgggcttgcaggatcatcagtttgagttcgggagctgcatgtctaaagatccttgcaacccgaatccttgtcaaaaaaaccaaagatgtataccaaagcctcaagtgtgtctcaccaccttcgataagttcggctgctcgcaatatgagtgcgttcccagacagctcgcatgtgaccaggttcaagatcctgtgtgtgatacagatcatatggaacacaataacttgtgcactctgtatcagcggggtaaaagtctgtcctataagggcccatgccagccattctgccgggccaccgaacctgtgtgcggtcacaacggcgaaacttatagcagcgtctgtgctgcctactccgatcgggtggccgtagattactacggcgattgtcaggccgttggcgtcctgtctgagcacagctccgtggctgaatgcgcttccgtgaagtgtccgtccctgttagccgccggctgcaaacccattataccccctggagcttgttgtccactgtgcgccggcatgcttcgcgtcctctttgataaagagaagcttgacactattgccaaggtgaccaacaaaaagccaattaccgtcttggaaatccttcagaagattaggatgcacgtgtctgtcccccagtgtgacgtgtttggttatttctcgatagagtctgagatcgtgattcttattattcctgttgatcattatcccaaggctctgcagattgaagcctgtaataaggaggccgaaaaaattgaatctctaatcaattccgattctccgactttagcctcccatgtcccgctgtctgcgctgatcatctcacaggtgcaagtcagctcttcagtcccttcggccggcgttagggctagacccagctgccattctttgctgctgcccttaagcttggggctggctctgcacctcctctggacctacaactag

SEQ ID NO: 17171 - DNA, 735 bp, Artificial Sequence
  Description of Artificial Sequence: Synthetic coding sequence
atgaaagagcgcagagctagtcagaagctcagttcaaaaagcataatggacccaaaccagaatgtgaagtgcaaaattgtagtggttggtgacagccaatgtggtaaaactgctcttttgcacgtgttcgctaaagattgcttccccgaaaactacgtgccaacagtgtttgaaaactacactgccagttttgagattgacactcagcgcatcgagttgtccctgtgggataccagtggaagtccttactacgataatgtcaggccgcttagctacccagattctgacgccgtgctgatttgtttcgacatcagccggcccgagaccctggatagcgtcctgaagaagtggaagggcgaaattcaagagttctgcccaaacaccaaaatgttgttggtgggatgtaagtctgacttgaggacagatgtttcgaccttagtcgagctttccaaccaccgccagacccccgttagctacgaccagggcgccaatatggctaaacagataggggccgccacctatatagagtgttcggcgctacaatctgaaaattcagtcagagatatattccatgtcgccaccctggcttgcgttaacaaaacaaacaaaaatgtgaaaaggaataaatcccagagagctactaaacgcatatctcatatgccatcccgccccgaactaagtgctgtagctacagatctgcggaaagacaaagccaaaagctgtacggtgatgtag

SEQ ID NO: 17172 - DNA, 735 bp, Artificial Sequence
  Description of Artificial Sequence: Synthetic coding sequence
atgaaagagcggcgagcaagtcagaaactgtcttctaagtccatcatggatccaaaccaaaatgtgaaatgcaaaattgtggtagtcggggacagccagtgcggcaagacagctcttctccacgtgttcgccaaagattgctttccagagaactacgtgcctactgtctttgagaactatacagcatccttcgagatcgatacccagaggatcgagctgagtctatgggacacaagcggcagtccatattacgacaatgtgcgccctctgtcctatcccgactcagatgctgtgttgatctgtttcgatatcagccgccctgagaccttggactccgtcctcaagaaatggaaaggggaaatccaggagttttgccctaacactaaaatgctgctggtgggctgtaaatccgacctcagaaccgacgtctcaactttagtagaattgtctaatcatcggcagacccccgtttcttacgaccaaggagccaacatggctaagcaaattggcgctgccacttatatcgagtgttctgccctgcagtctgaaaactccgtgagagatatctttcatgttgccactctcgcatgcgtcaacaaaaccaacaagaacgtgaaacggaacaagagccagagggcgaccaagcggatatcccacatgccatcaaggcccgaactctccgcagtcgcaacggaccttagaaaggataaggccaagtcttgtacagtcatgtag

SEQ ID NO: 17173 - DNA, 348 bp, Artificial Sequence
  Description of Artificial Sequence: Synthetic coding sequence
atgctcctcgttggctgtaaaagcgacctgcgaacggatgtaagcactctggtggagctgtcaaaccacagacagaccccagtgtcttacgaccagggtgccaatatggccaagcagattggggctgccacctatatcgaatgcagcgccctacagagcgagaatagcgttagggatattttccacgttgcaaccctggcttgtgtgaacaagactaataagaatgtcaaaagaaataagtctcagcgcgccacaaagcggataagtcatatgccaagccggcccgagctttcagcagtagcaactgatctccgcaaagacaaagccaagtcatgcactgtgatgtag

SEQ ID NO: 17174 - DNA, 351 bp, Artificial Sequence
  Description of Artificial Sequence: Synthetic coding sequence
atgaaggaacgccgagcctcccagaaattaagctctaagtccatcatggatccgaatcagaatgtgaagtgtaagattgttgtggtaggagattcacagtgcggcaaaacggcccttcttcacgtctttgctaaagactgttttcctgaaaactacgtccctactgtgttcgagaattatactgctagttttgaaatcgatacacagcgcatcgagctcagcctatgggacacttctggttctccatactatgataatgtccggccactatcttaccccgattccgacgcagtactcatctgctttgacatcagtagacccgagactcttgactcggtcctaaagaagtag

SEQ ID NO: 17175 - DNA, 351 bp, Artificial Sequence
  Description of Artificial Sequence: Synthetic coding sequence
atgaaagagagacgggcgtcccagaagttgtcgtcaaaatctatcatggatcctaatcagaatgtaaagtgtaagattgtggtcgtcggggactcacagtgcggtaagacagcactgctccacgtattcgcgaaggactgttttcctgaaaattatgtgccgactgtgtttgagaactataccgcctctttcgagatagacacccagcggatcgaactttcgctgtgggacacatctggctccccctattatgacaacgtccgtccccttagttacccagactcagatgcggtgctgatttgcttcgatatcagtcgtccggaaacactcgacagcgtgctcaaaaagtag

SEQ ID NO: 17176 - DNA, 615 bp, Artificial Sequence
  Description of Artificial Sequence: Synthetic coding sequence
atggccgagcaggagcccactgctgaacagttggctcagattgcagcggagaatgaggaagatgagcattcagtgaactacaaacctcccgcgcagaaaagcatccaagaaatacaagagctcgacaaagacgacgagtccctgcgaaagtacaaagaagcactgctgggcagagtggccgtgtccgccgatccaaatgtgccaaacgtggtcgttacaggcttaacgctcgtatgttccagcgcacccggcccattggagctggacctgacgggggatctggagagtttcaaaaaacagagtttcgtgctgaaggagggagtcgagtatcgcattaagatttctttcagagtcaaccgcgaaattgtgtccggtatgaagtacatccagcacacataccgtaaaggcgtgaaaatcgacaagactgattacatggttggatcatacggacctcgtgcggaggaatacgagtttcttaccccggtagaggaagcacccaaaggtatgctggcacgggggtcctacagcatcaagtctagattcaccgatgatgataagaccgatcacctctcttgggagtggaatctgacaataaagaaggactggaaagattag

SEQ ID NO: 17177 - DNA, 537 bp, Artificial Sequence
  Description of Artificial Sequence: Synthetic coding sequence
atggcagagcaggagcctacggcagaacagctggcccagatagcggcagagaatgaagaggatgagcattccgtaaattataaaccacccgcgcagaagagcatccaagagatccaggaactggataaagacgacgaatctctccggaagtataaggaggccctgctcgggagggtcgcagtctccgccgatccaaacgtacctaatgtggtggtcaccggactgaccttggtctgctctagtgcccctggccctctggagttagatctgacaggggacctcgaatccttcaagaaacaaagcttcgtccttaaagagggcgtggaatacagaataaagattagcttcagagtgaaccgagaaatagtttctggaatgaaatacatccaacatacttaccgcaagggcgtaaagattgataaaaccgactacatggtgggctcctatagcatcaagtcgcggttcaccgacgacgataagaccgatcatctgtcctgggaatggaatttaactatcaagaaggactggaaggactag

SEQ ID NO: 17178 - DNA, 615 bp, Artificial Sequence
  Description of Artificial Sequence: Synthetic coding sequence
atggcagagcaggagcccaccgctgaacagctggcacagatcgcagccgagaatgaggaggacgaacatagtgtcaattacaagccaccagcacaaaagtctattcaggagatccaggaactggataaggacgatgagagcctccggaaatacaaggaggcactcttggggagagtcgccgtgtcagctgatcctaatgtgccgaacgtcgtggtaactggtcttacgcttgtgtgttcctctgccccgggccccctagagctcgacctcaccggggacctcgagtcttttaaaaaacagtcttttgtacttaaggaaggcgtggagtatagaattaagattagctttcgggtcaatcgcgagattgtgtccggcatgaaatacattcagcacacctatcggaaaggcgtcaagatagacaagacagattatatggtgggttcctatgggccccgggcagaagaatatgagttcttaactccggtcgaagaggccccgaaggggatgctcgctcgcggttcctactcaattaaaagcagattcaccgacgatgacaagactgaccatctgtcttgggagtggaacttaacaattaaaaaggactggaaggactag

SEQ ID NO: 17179 - DNA, 3576 bp, Artificial Sequence
  Description of Artificial Sequence: Synthetic coding sequence
atggaagcgatgtccccacagcaggaaactttggggggacagcctggtcgctccagctctctcacaggggtctctaggcttgccggtggctcctgcaccaagaagaagatgaaaaccctcgcagagcgtaggcggtccgctccaagcctgatactggacaaggccttgcagaaacgacccacaactagagactctccatcagcaagtgtggatacctgtacttttctgtcctccctggtatgctccaatcgcacattactgattgatggacgagcagaactgaagagaggcctgcagcgccaggaacgccatttgtttctcttcaatgacttgtttgtggtagcaaagattaagtacaataacaacttcaaaattaaaaataaaattaagctgacggacatgtggacggctagctgcgtcgacgaagtcggggagggaaataccaacgctatgaaatcctttgtgctgggatggcctacagtcaatttcgtggccactttttcatctccagaacagaaagataagtggctgtctctgcttcagaggtatataaatctcgagaaagagaaggactaccctaaatccattccactgaagattttcgcaaaggacatcggcaattgcgcttatagtaaaacaataacggtgatgaatagtgacaccgctaacgaagtgattaacatgagtctccccatgctcggaattactggaagtgaacgagactaccagctgtgggtgaacagtggcaaagaagaagccccttatcccctaattggccacgagtacccttacgggatcaaaatgtcccatctacgggactcagctctccttacccccgggagtaaggattctactacgcctttcaacctgcaggaacccttcctgatggagcagctcccgagggagatgcagtgtcagttcatactgaagccctctaggctggctgcggctcagcaactctccgatagcgggcacaaaaccttcaaaaggcgacgtagtattataaactgggccttctggaggggctcatcaacgcatctcgacaacctgccttctagtcccactagtccaatgccaggacagctcttcggaatatccctgcccaatatctgcgaaaatgacaatctgccgaagccggttctggatatgctgttcttcctgaaccagaagggccccctgaccaaaggcatctttaggcagtcggctaacgtcaagagctgccgggagctgaaggaaaaactgaattctggagttgaggttcaccttgactgtgaatctatcttcgtcattgccagtgttcttaaagattttctgcgcaacattccggggtccatatttagctccgacttgtacgaccactgggtcagcgtgatggatcagggcaacgacgaagaaaaaatcaataccgtgcaaagacttctggatcagttacctcgtgccaatgttgttttactgagatacctcttcggggttcttcataacatcgagcagcacagcagttcaaatcagatgaccgccttcaatctcgccgtttgcgtggctccctctattctgtggcctccagcctcctccagtcctgagctggaaaatgagtttactaaaaaggtaagtctcctcatccagtttttaatcgaaaattgtctgcggattttcggagaagaaataaccagcctgttcagagaggtgtccgttagatgtgatacgagggaaaatgcaagtgacatctcttgcttccaactgaatgatagctcctatgactcactggagaacgaactgaacgaagacgtcgacgcaccctgttcagatcttgttaaaaagttggggcaagggagccggtcgatggactctgtgttaacactcagtgattatgatctggaccagccagaggtggagggcctgcttaccctttcagactttgaccttgcccactctaaggacgaggatgttcaaatgaaaagaccactagaatctaagcccgtgaatatcttagtttacactaaaattcctttaagagatcacgcccgtgccccatccgccatgtgcacaccctcgtacctgtccacagcagcagccaacgcagcgaaaagtctccgtaggcataggcgctgtagcgaaccgtctatagactacctggattccaagctcagttatctgcgggaattctatcaaaagaagttgcggaagtcatcctgcgacgctatactgtcccagaaagatgaagactacctgaagcagaaccagcccctgcaggaggaaggaaagacatgctttaagcagtccttggtgacggggaccgatgtatctaagaagaacgctaccactcagaacaccaaaaagaagagcctgtccggctccgagggaaatcacgtcaagctttttcccaagagcaagccagtagctatttccgtggctagctattcacccatgtctagtcaggatcacagtaaaaaccagccttttgatgtcaacacatcgggatattccccaccgcacacagccgacgctcttaagggacctcgaactcatagaagatgttctgaacctaatattgaggaccagaacaggaagctgacatacctgagaggtatctattccaaaaagcaacacaagacgtcatgcgaagcagggctgttgcacggcgaggaggattatctgaaaaggcataagtctcttcagatggagggccagaagctgataaatcagtccctggtgatgggcattgaggttggcaagagttcggctaccaaccagaatactgagaaagttctccctcctagactgaacctctgccctaggaccagctatagctcactgagctcgcctgggacatctccatctggttctagcgtgtcttcacaggatagcgcatttagccagataagcgaacactcagtttttacacctacagagacctcatcgccgatcgactgtaccttccaggcacagcggaagagggaagatctgagccctgacttttctaacgcctcgcacgtgagcggcatgcccgggccaagtagcggccaggcctgcagccgcccagcttataccaaaaaggatacaatggagtggcattcccagatgcattccgttacgcttcacccttcaacatggctcaggaacggcgtggcttcccttaaaaattggagcctaaaaaagaaggccaaagcagcccgccctgaggaagagaagatagcctctccaaagggacccctggagccgcctcctcacgcttccggcgtgcctgaggcgaatagcctgcaggaggagcagaaagatttgcccctgagagccgccgaggggctgagtccagttcaatccgcccagcgctgttcctcaagtccattccaggactccgagcgccattgttcttccccgttctccctggttgaaagtagactcaagctctgcatgaaatcccacgaggaaattgagccagggagtcagtcttccagtggctccctgccatgggaacgggcctccgcttcctcatggaccctggaagacgcaacctctcctgactcaggtccaaccgtggtatgcgatatcgaggacagatacttgactaaggacatttag

SEQ ID NO: 17180 - DNA, 3498 bp, Artificial Sequence
  Description of Artificial Sequence: Synthetic coding sequence
atgactttctggatcatcattaataagaagatgaaaactcttgcagaacgacgacgcagcgcccccagcctgatactcgacaaggccctacagaaaaggccaaccacacgcgattcacctagcgcaagcgtggatacctgcactttccttagttcgctggtatgttctaaccgcaccttactgattgacgggagggcggaattgaaacgcggcctgcagagacaggagaggcacctgtttttgtttaatgatctgttcgtggttgcgaagatcaaatacaataataactttaagattaagaacaaaatcaaattgactgacatgtggactgccagctgtgtggacgaggtgggcgagggcaataccaacgcaatgaaatcattcgtgctggggtggcccacagtgaattttgtggccactttttcctcgcctgaacaaaaggacaagtggctgtctctgctacaacggtacattaatctcgagaaggagaaagactatccaaaaagcatcccactgaaaatcttcgccaaggatatcggcaactgcgcatattctaagaccatcactgtcatgaatagtgatacggctaacgaagtcattaacatgagcctgcctatgctgggaattaccggatccgaaagggactatcagctgtgggtaaactcaggaaaagaagaggccccttatccactgatcggacatgagtatccctacgggatcaagatgtcacaccttagagactcagcactcctgactcctggcagtaaagattccactacccccttcaacttgcaggaaccttttctgatggaacaattaccaagagaaatgcagtgccagttcattctcaagcccagtagattggctgccgcacaacagctgtctgactctggtcacaagacattcaaaagaagaagaagcatcattaattgggctttctggcgggggtcttccacccaccttgacaacctaccttcctcgcctacaagtccgatgccaggccagttgtttgggatatccttacccaacatctgcgaaaatgataatctaccaaagccagtgctcgatatgctcttctttttgaaccagaaagggcctttgacgaaggggatttttaggcaatcggctaatgtcaagtcctgcagagaactgaaagaaaaactgaatagcggtgtggaggtccacttggactgtgaatccatcttcgtgattgccagcgtgcttaaagacttcttaaggaatatccccggtagcatcttttctagcgatctttatgatcactgggtaagtgtcatggatcaggggaatgatgaggagaagataaatacagttcagaggttactagaccagctccctcgggccaacgtggtgctcctgagataccttttcggagtgctgcacaatatcgaacagcatagttcctcgaatcagatgactgcctttaatctggctgtgtgcgttgcacccagcatcttatggcccccggcaagtagtagtccggaactggagaatgaatttaccaagaaggtttctctcctcatccaatttcttatagagaattgtctgaggatattcggagaggagatcacgagtttgtttcgcgaagtgtctgtccgatgtgatactcgagagaacgcaagtgatatatcctgcttccagctaaacgatagtagctacgactcactggagaacgaactgaatgaagacgttgacgccccatgctctgacttggtgaagaaacttggccagggtagtagaagtatggattctgtgttgacactctctgactacgacttggaccagcctgaagttgaggggctgcttacactgagcgatttcgacctagcccattcaaaggacgaggacgtgcaaatgaagcgcccgttagagagcaagccagtgaacattctggtgtatactaagataccgctacgagatcatgccagagccccgtccgccatgtgcacgccatcctaccttagcactgctgcagcaaatgcggcaaaaagcctgcgcaggcaccgcagatgctctgaaccaagcatagattatctcgacagcaaactgagctatttgagagaattctaccagaaaaaactgcgaaaatcttcttgtgacgcaattctgagtcagaaagatgaggattacctaaagcagaaccagccactccaggaggagggcaaaacctgctttaagcagagcctggtgacagggacagacgtgtcaaagaagaatgctacaacccaaaacactaaaaagaagtcactgagcggcagtgagggcaatcatgtgaaactgtttccgaagtcaaagccagtcgccatttcagtggcaagttattcacccatgtcttcacaagaccacagtaagaaccagccgtttgatgtgaacacctctggttactcccccccacacactgcagacgcactcaagggcccacgtacccatcgacgttgctccgagcccaacatcgaagatcaaaaccgtaagctgacgtatctgcgtggcatatacagtaaaaagcagcacaagacatcctgcgaagcgggcctcctgcacggagaggaggactatctgaagcgtcataagagcttacaaatggaagggcagaaattgatcaatcagtccctggttatgggaatcgaggtgggcaaatccagcgctactaaccagaacacagaaaaagtgttgcctcctagactcaacctgtgtccacgcacctcctacagttcgctaagctctcccggtacatcaccatcaggaagcagcgtatcctcgcaagatagcgccttcagccagatttcagagcactcggtattcacacctactgaaacttctagccctattgactgtacattccaggcacagaggaaacgggaggacctgtcaccagacttttctaatgcttctcacgtttccggcatgccggggccttccagcggccaagcttgcagcagacccgcgtatactaagaaagacaccatggaatggcatagtcagatgcactccgtaactctccacccaagtacatggctgaggaacggcgtggcctctctcaaaaattggtctctgaaaaaaaaggccaaggccgcgaggcccgaggaggaaaagatcgcttcacccaagggtcctctagagccccccccccacgcgagcggggtgcccgaggcaaattccttgcaagaggagcagaaagacttgcctcttcgagcagcggaggggttaagcccggtccaaagcgcccaacgctgctcatcttcccctttccaggactccgagcggcactgcagtagtccattcagcctggtagagtctcgtttgaaactgtgcatgaagtcccacgaggaaatcgagccaggctctcagtcttcaagtggatcattgccctgggaaagagcaagcgcatcaagctggacccttgaggatgccacaagccctgatagcgggcccacggtggtttgtgacatcgaggaccgctatctgactaaagatatctag

SEQ ID NO: 17181 - DNA, 3507 bp, Artificial Sequence
  Description of Artificial Sequence: Synthetic coding sequence
atgagcgccagagagcgtcaaccagccctcaaaaaaaaaatgaagacactcgctgagcgacggaggtctgctcctagtcttatcctggacaaggctctacagaaacgaccgactacacgcgattcaccctccgcctcggtagacacatgcacgtttctcagtagtctggtgtgctctaatcggacactgctgattgacggaagggctgaacttaagcggggacttcaaagacaggaacgtcacctctttctgttcaatgacctgtttgtcgtagctaagatcaagtacaataataatttcaaaatcaagaacaaaataaaactgacagacatgtggacggctagttgcgtggatgaagttggcgaaggaaatacaaacgcaatgaagtcctttgtccttggctggccaacggttaatttcgttgcaacattctcttctcccgaacagaaagacaagtggctgagcctcctgcagaggtatatcaatcttgaaaaggagaaggattacccaaaaagtatccccctcaagatctttgcaaaagatatcgggaactgtgcctacagtaagactataactgtgatgaatagcgacacggctaatgaagtgatcaacatgagcctcccaatgctcggaattactgggtcagaacgagattaccagctctgggtgaattcaggaaaagaggaagccccctatccactgattgggcacgagtacccatatgggataaagatgagtcacttgagagattccgctctgctgacccctgggtctaaggactctacaacaccctttaacctgcaggagccattcttgatggagcagctccccagggagatgcagtgtcagttcatcctcaaaccgagcaggctggcagcggcgcaacaactaagtgacagcggccacaaaactttcaaacggcgccgttctatcattaactgggccttctggagagggagcagtacgcacctggataatctgccaagctcgccaacctctcccatgcccggtcagctgtttggtatttctttgcccaacatctgtgaaaacgataatttgccaaagcccgtgctcgacatgctgtttttcctcaaccagaaaggtcccctgaccaagggcatctttcggcagtctgctaatgtcaaatcctgccgcgagttgaaggagaagttgaatagtggagtagaggttcatctggattgtgaatccatctttgtcatcgcctcagtgttgaaggatttcctcaggaacattccagggtccattttctcttccgatctatacgaccattgggtttcagtcatggatcagggtaatgacgaagaaaagataaatactgtgcagagactcctggaccagcttccaagagccaacgtggtgcttttgcggtacttgtttggagtgctgcacaacatcgagcaacacagtagctctaatcagatgacagctttcaatcttgccgtctgcgtcgcaccttctatcttgtggccccctgcttcttcatcacctgaactggaaaatgaattcactaaaaaagtttcattactcatccagttcctgattgaaaactgtttaagaatctttggtgaggagatcacatccctgttcagagaggtcagcgtgcgatgtgataccagagaaaacgccagcgatattagctgtttccagctcaacgatagttcgtatgattctctcgagaacgagttgaatgaagacgttgacgccccctgctccgatctggtgaagaagctggggcagggctctcggtctatggatagcgtcctgactttatctgactatgacctggatcagcccgaggtggaaggcctcctgaccctctctgactttgatctggctcactctaaggatgaggacgtccagatgaagagacccctggaatccaaacccgttaacatcctggtgtataccaagatccccctgagggaccacgccagagctccaagtgccatgtgtaccccatcttacctgagtacagcagccgcaaatgcggccaaatccctccgacgtcaccggaggtgctccgaaccatccatagattatctcgacagcaaattgagctatttaagggagttttatcagaagaaactgcgcaaatccagctgtgacgccatcctgtcacagaaagatgaagattaccttaaacaaaatcagcctctgcaggaggaaggcaaaacttgctttaaacagagcctggtgactggcaccgatgtaagtaaaaaaaacgctacaacccaaaacaccaaaaaaaagagtttgtcagggtcagaaggtaaccacgtgaaactgttccccaagtctaagcctgtggccatcagcgtggcgtcctacagtcccatgagctctcaggaccactctaaaaaccagcctttcgacgtcaatacaagtggttacagccctccacatactgccgacgctctgaaaggtcctcgcactcatcggagatgctctgaacctaatatcgaggaccagaatcggaagctgacatatctgcggggaatttactctaagaaacagcataaaacatcatgtgaagctggcctactgcatggagaggaggattatctcaaacgccataaatctttgcaaatggaaggacagaagttaattaaccagagcctggtgatggggatcgaagtcggaaaatccagcgcgacgaaccagaacaccgaaaaggttctgccgccccgactgaacttgtgtccacgcacatcatacagctcactgtctagcccaggtacaagtccttccggatcgtctgtttcatctcaagattcagcctttagccaaatctccgagcatagcgtgtttactcccactgaaaccagcagcccaatcgactgcaccttccaggcccagcgcaagcgagaagatctgtcaccagacttttccaatgccagccatgtcagtggcatgcctgggccaagttctggacaggcctgctccagacctgcctacacaaagaaagacaccatggagtggcactcccagatgcactcggtcacactgcacccttccacctggctgcgcaacggagtcgcttctctgaaaaactggtccctgaaaaaaaaggccaaagcagcccggcctgaggaggagaaaatcgcctctccaaagggccccctggagccaccaccgcatgctagtggcgttccggaagccaattctttgcaagaggagcagaaggatctacccctgagagctgcagaaggactatctccagtgcagtcagcccagagatgctcttccagtccattccaggatagcgaaagacactgtagttccccattctcgcttgtcgagagtaggcttaagctgtgtatgaagtcacatgaggagatcgaaccagggtcacagtcttcgtccggctcactgccttgggagagggcttctgcatcaagctggacactcgaagatgctactagccccgacagcggtcctaccgtcgtgtgtgacattgaggatcgatatcttacaaaagatatctag

SEQ ID NO: 17182 - DNA, 3468 bp, Artificial Sequence
  Description of Artificial Sequence: Synthetic coding sequence
atgaagacactagctgaaagaaggaggtctgctccgagcctcatcctcgataaagcactccaaaaacggcccacaactagagattctccaagcgcctcagtcgatacttgtaccttcctctcatcactggtgtgcagcaatcgcacccttctgattgatggccgtgctgagcttaaaaggggcctgcagagacaggaacgacatctcttcctcttcaacgacctgttcgttgtggccaagatcaaatacaacaataactttaagatcaaaaacaaaatcaaactgaccgacatgtggactgccagctgtgtggatgaggtgggagaaggaaacacaaatgcaatgaaaagctttgtacttggctggcctacagtgaatttcgttgcaacctttagtagtcccgagcaaaaagataagtggctaagcttgctgcaacgatacatcaatttagagaaagaaaaagactatcccaagagtatacccctcaaaatcttcgcaaaagatataggaaattgtgcatatagcaagactataacagtgatgaacagtgatactgcaaatgaggttattaacatgtcattgcctatgctgggcatcactgggtccgagcgcgactaccagttatgggtgaactcgggtaaggaagaggccccctaccctctgattgggcatgagtatccatacggaattaagatgtcacatcttcgcgacagtgccctgcttaccccaggttcaaaagattccactacccccttcaatcttcaggagccttttttaatggaacagctgcctagggaaatgcaatgccagttcatcctcaaaccctccaggctggcggcagcccagcagctttccgattctgggcacaagactttcaagcggcggagatcaatcatcaattgggctttttggaggggaagcagcacacacctggacaacttgccaagttccccaacttcacctatgccaggccagttgttcggaatttctctgcctaacatctgcgaaaacgacaatctgcctaagcccgtgttggatatgttattttttttaaaccagaagggtcccctaactaagggaatattcaggcagagcgccaatgttaagtcatgtagggagctaaaggaaaaattgaattctggggtcgaagtacacctcgactgcgaatccatctttgtgattgcttcagtgctgaaggatttcctgcgaaatatccctggaagcattttctcctcagacttatatgatcattgggtgtcggtgatggaccagggaaatgatgaagagaagatcaatacagtgcagaggctgttagatcaactgcctagagctaacgttgttctgctcagatatctgttcggtgtactacacaacatcgagcagcactcatcctccaaccagatgaccgccttcaacctggcggtatgcgtggccccatctattctctggccccccgctagtagctcacctgaactggaaaatgaattcaccaagaaagtgagtctccttatccaatttctcatagagaactgtctccgaatattcggcgaggagattaccagcctgtttagggaggtctcagtgaggtgtgacacacgagagaacgcctctgacatcagctgttttcagcttaacgactcttcttatgactcattggagaatgagcttaatgaagatgtggacgctccttgcagtgacctcgttaaaaagctgggccagggctccaggtcaatggattctgtactgacactctcagattatgatctggaccagccagaggttgaaggcctattaaccctgagcgacttcgatcttgcccactctaaggatgaggacgtacagatgaagcgccccctcgaatcaaaacccgttaacattttggtttatacgaagatccctctgcgggaccacgcccgagctccatcagctatgtgtaccccctcatacctgtccacagctgctgccaacgccgccaagtctttgcggcgccaccgacgttgcagtgagcctagtattgactacctggacagtaagttgtcttacctgcgcgaattctaccaaaaaaaactgcgcaagtcttcatgcgacgctattctctcgcagaaagatgaagattatctgaagcagaaccaaccactgcaggaagagggaaaaacatgttttaaacaaagtctggttactggcacggacgtcagtaagaaaaacgccactacccagaacaccaaaaagaagtctcttagcgggagtgaaggaaaccacgtaaagttattcccgaaaagtaaacccgtagctattagcgtagcatcttactcccccatgtcttcgcaagatcacagtaaaaaccagccttttgacgtcaacacatccggatattcccctcctcatactgcggatgctttgaaaggcccccgcactcaccgccgttgctctgaacctaacattgaggatcagaaccgaaagctgacgtatttacggggaatctatagtaagaaacagcataaaacaagttgtgaggccggactgctccacggcgaggaggattaccttaagagacacaagtccctgcagatggaggggcagaagctcatcaaccagtccttggttatgggcattgaagtcggtaaatcctcagctacaaaccaaaatacagaaaaggtcctgccgccacgtctgaacttatgcccgcgcacatcctatagctcactatcttcccctgggacgtctccgtccggtagttccgtgtcctcccaggatagcgcattctctcaaatttctgagcactcagtcttcacaccaacagaaactagctccccaatagactgcacatttcaggcccagagaaagcgggaagatctgtcccctgacttttcaaacgctagtcacgtgtccgggatgcctgggccatcgtcaggacaagcatgctcaagaccggcgtacaccaaaaaggacacaatggagtggcactcacagatgcattctgtgaccttgcaccctagtacatggctgagaaacggcgtggcgtcactcaagaattggagtctcaagaaaaaggcaaaagcagcccggccagaagaagaaaagattgccagtccaaaaggccccctagagccccctccccatgcatctggcgtgcccgaggctaacagccttcaggaagaacagaaagacctcccattgcgggctgcagaggggctgtcacccgtgcagagcgctcagcgttgcagttcatctccattccaggactctgagcggcactgctcaagcccattctctctggtggaatctagactcaagttatgcatgaagagtcatgaagaaatcgaacctggaagccaaagcagttctggaagcttaccttgggaacgggcttctgcctcatcctggactttggaggatgcaacgagcccagattcaggtcccacagtggtctgcgatatcgaggaccgctatttgaccaaagatatatag

SEQ ID NO: 17183 - DNA, 3468 bp, Artificial Sequence
  Description of Artificial Sequence: Synthetic coding sequence
atgaaaaccctggccgagcgtcgcaggtctgctcccagtctgatactggataaggccctgcagaaaagaccaaccacaagagactctccttccgcctcagtagacacgtgtaccttcctgtcttcgctggtttgttcaaatagaactctgcttatagatgggcgggccgagctcaagcggggtttgcaaaggcaggagagacacctgttcttgttcaatgacttgtttgttgtcgctaagattaaatataacaacaattttaaaatcaagaacaagatcaaacttactgatatgtggactgccagctgtgtcgacgaagttggggagggtaatacaaatgcaatgaagtcatttgtcctgggatggcctaccgtgaatttcgtggccactttttcgagcccagagcagaaggacaaatggctgagcttgctgcagaggtacatcaacttggaaaaagaaaaggattatcctaaaagcattccccttaaaatcttcgccaaagatattggaaactgcgcatacagcaaaactattaccgtgatgaatagtgataccgccaatgaagtgattaatatgagcctgcccatgctcggcatcactggttctgaacgggattaccaactttgggtcaatagtggtaaagaggaagctccttacccactcattgggcacgagtacccctatgggatcaaaatgtcccatctgagggattcagccttacttacacccgggtctaaggacagcaccacgccatttaatctgcaggaaccctttcttatggaacagctgccccgggagatgcagtgccagtttattttgaaaccctcaaggctcgccgccgcccagcagctgagtgacagcggccataaaacattcaagcgaaggagaagtattatcaactgggctttctggcggggcagctccacccacctggataatcttccttcttcccccacttcccccatgcccggccagctatttggcatcagtctgcccaacatctgcgagaacgacaacttaccaaagccagtgctggatatgctcttttttcttaaccagaaggggcccctgaccaagggcattttccgccagtctgccaatgtgaaaagctgcagggagctcaaagaaaaacttaactccggggttgaggtccacttagattgcgagtctatcttcgtgattgcctctgttctgaaagactttcttagaaatataccagggtcaatcttttcaagcgacttgtatgatcactgggtttccgttatggaccagggcaacgacgaggagaaaatcaacacggtgcaacgcctgttggaccaactgccaagagcgaatgtggtccttcttcggtatctgttcggtgtgctgcacaatatagagcagcattcctcttcgaatcaaatgacggcgttcaatctcgcagtgtgcgttgccccatcgatcctgtggcccccagcttcatccagccctgagctcgaaaacgagttcaccaaaaaggtgagtctgcttatacagttcctcatcgaaaactgcctccgtatcttcggtgaggaaatcacctcactcttccgtgaagtctccgtacgctgcgacacccgtgaaaatgctagcgatattagctgcttccagctcaatgactctagttatgattccctggaaaacgagctgaatgaggacgtggatgctccttgctccgacctcgtcaagaagctggggcaggggagcagatccatggacagcgtcctgaccctgagcgactacgatctcgatcagcctgaagtagagggtttgcttacgctttccgatttcgacttggcacactctaaggatgaagacgtgcagatgaaaaggccactggagtcgaaacctgtgaacattctcgtctacactaaaatccctctaagagatcatgctagagcgccgagcgctatgtgcaccccatcttatctcagtaccgccgcagctaatgccgccaagtctttgcgtagacataggcgctgcagcgagccctccatcgactatttagatagtaagctctcctacctacgcgagttctaccaaaagaagttgcgcaagtcaagttgtgacgcaatcctttcacagaaggacgaagactatttgaaacagaatcagcctctgcaggaagaaggcaaaacttgttttaaacaaagtctggtcaccggcaccgacgttagcaagaagaacgcgacgacccagaataccaagaagaagtcactgagcgggtccgaaggtaaccacgtgaagctgttccctaagagcaaacctgtcgctatctcagttgctagctattctcccatgtcaagtcaagatcactccaagaatcagccctttgacgtcaatacctccggatactcaccaccgcacacagcggacgctctgaagggcccccggacgcacagacgttgctctgagcccaacatcgaggaccaaaacaggaagctgacatatctgcgcggcatctacagcaagaaacagcacaagacctcctgtgaggccggcttgctgcacggagaagaagactatctgaagcgccacaaatccttacagatggagggtcaaaagctaattaaccagagcctggtaatggggatcgaggtggggaagtccagtgccactaaccaaaacactgagaaggtgctccccccacgtctgaacctgtgtcctcggacttcctatagcagccttagctcacccggtacttctccctccgggagtagcgtgtctagtcaggatagtgcgttctctcagataagcgagcatagtgtgtttacaccaactgaaacatcctctcctatagattgcacattccaggcacagcgcaagcgcgaagatctgtcacccgacttcagcaatgcctcacacgttagtggcatgcccggcccaagtagcggccaggcttgctctcggcccgcctataccaagaaggacaccatggagtggcacagtcagatgcattctgtcacgctgcatccatccacgtggttgcgtaacggcgtggccagcctcaaaaactggagtctgaagaaaaaggccaaagctgcacgcccagaggaggaaaagatagcctctcccaaaggacctctggaaccacctccacacgcatcaggggtgccggaggccaactcactgcaagaagagcaaaaggatctgccacttcgtgctgccgagggtttgtctccagtgcagtccgctcagcgctgttcgtcatctccatttcaagactctgagcgccactgttcctccccttttagcctcgtggaaagtcggcttaagttgtgtatgaaaagtcacgaggaaatagagcccggaagccagtccagctctggctcccttccttgggagagagcctccgccagcagctggactctcgaggatgcgacctccccagatagtggccctaccgtcgtgtgtgacatagaggaccgctatctgactaaggatatctag

SEQ ID NO: 17184 - DNA, 2196 bp, Artificial Sequence
  Description of Artificial Sequence: Synthetic coding sequence
atggaccagggcaatgatgaggaaaaaataaacacagtacagcgcctgctggatcagcttcctagagctaatgtcgtgctcttgagatatctgtttggagtactacacaatatcgaacagcacagttcttctaaccagatgaccgcctttaatctggcggtgtgcgtcgctccttccatcctgtggccgccagcctcctcaagccccgaactggaaaacgaattcaccaaaaaagttagccttctgattcaattcttgatagaaaattgtcttcggatttttggggaagaaattaccagcctttttagagaagtgagcgtccgctgcgacacaagagagaacgcaagtgatatcagctgctttcaattgaatgattcctcgtacgacagcctggagaatgagttaaatgaagacgtggacgccccctgttccgacctcgtgaagaagctcggccagggatcgcggtccatggattcagtgttaactctgagcgactacgatctggatcaacctgaagtagagggcctgctcactctgtccgactttgatcttgctcattccaaggacgaagatgtccaaatgaagcggccacttgagagcaaaccggttaatatactcgtctacactaagatacctctgcgggatcacgctcgggcgccatcagccatgtgcactccatcctatctatctaccgccgctgccaacgccgccaagagtctgaggagacataggcgttgctccgagccctcaatcgattaccttgatagtaagctgtcatatctacgcgaattctaccagaagaagctgcgcaaatctagttgtgacgccattctgtcgcaaaaggacgaggactatctcaaacagaatcagcccctgcaagaggagggcaagacctgcttcaaacagagtctggtcacaggcacggatgtgagcaagaagaacgctactactcaaaataccaagaagaagtcactctccggaagcgagggaaaccatgtgaaattatttcccaagtcgaaacccgtggctatctccgtcgcgtcttatagcccaatgagctcccaggaccacagtaagaatcaaccattcgacgtgaataccagcggatattcacctccgcatacggccgacgcactcaagggccctcggacacaccgccgctgttctgagccaaatatcgaagatcagaatcgcaagctgacgtatttgcggggaatctatagtaagaaacaacataaaaccagttgtgaagcgggcctgctgcatggagaagaggactacctgaagcgacataaatcactccagatggaaggacaaaagctgatcaaccagtccctggtcatgggaattgaggtgggaaagtccagcgctaccaatcaaaacacggagaaggtgctgccaccccggctgaatctctgccctagaacgtcttactcctcccttagttctccgggcacttctcccagcggatcatcagtgtcctctcaggacagcgcgttttcacagatatcagagcacagtgtattcactccaaccgaaacctcatccccgatcgattgcaccttccaggctcagcgtaaaagagaggacctgtccccagactttagcaatgctagccatgtcagcgggatgcctggcccaagctcaggtcaggcctgcagccgacccgcttatacaaagaaggatacaatggaatggcattcccagatgcactcagttacgctgcatccatctacttggctgaggaacggcgtagccagtctgaagaactggtcccttaaaaagaaagctaaggctgctcgccctgaggaagagaagatcgcaagcccaaaggggccattggaaccccccccacacgctagtggcgtgccagaggcaaactctctgcaagaggagcagaaagatttgccccttcgggccgccgaaggacttagtcctgtccagtcagcacagagatgctcctcttccccattccaggatagcgagaggcactgctcaagtcctttctctttagttgagagtcggctcaagttgtgcatgaagtcccatgaggaaatcgaacctggctcacagagctcgagtggcagcctgccctgggaacgagcaagtgctagcagctggacgctggaggatgctacatctccggactcaggacccacagtggtatgcgacattgaagaccggaactgctgttag

SEQ ID NO: 17185 - DNA, 3498 bp, Artificial Sequence
  Description of Artificial Sequence: Synthetic coding sequence
atgaccttttggatcatcatcaacaagaaaatgaagaccctggcggagcgcaggcgctcagcgcctagtctgatattggacaaagccctccaaaagaggcctactacgagggactctcccagcgccagcgtggacacctgcacattcttgtcctcactggtctgtagtaaccgcactctcctcattgacggaagagccgaactcaagaggggactccaacggcaggagaggcacctgtttttgtttaacgatctgtttgtggtcgccaaaatcaagtataacaacaactttaaaataaagaacaaaatcaaactgaccgacatgtggacagccagctgcgtcgatgaagtaggcgaaggcaatacgaacgcaatgaagagcttcgtacttggctggcccacagtaaactttgtggccacattttcaagccctgaacagaaagacaaatggttgagtctattgcagcgctatatcaatctggagaaagagaaagattaccctaaatccatacccctgaaaatcttcgcaaaagacattggcaactgtgcctacagtaaaaccatcactgttatgaatagcgatacagccaacgaggtgattaatatgagccttcctatgttgggcatcactgggtccgaaagggattaccagttgtgggtgaactcaggcaaggaggaggccccatacccactgatcggacatgagtatccctacggcattaagatgagtcatctgagggattctgcacttctcaccccgggaagcaaagactctacaactccctttaacctgcaggagccatttcttatggaacagctgccaagggaaatgcaatgccagttcattctgaaacctagccgactggccgccgctcagcagctcagtgactctggacataagacgtttaagcgtaggagaagcatcatcaactgggccttttggcgcggctcgtccacgcatcttgacaatcttccaagtagccctacctcccccatgcctgggcaactgtttgggattagcttgcccaacatctgcgaaaatgataatcttccgaagcctgtgctggacatgctgttcttcctgaaccagaaagggcctctgacaaaaggaatatttcgtcagagcgccaatgttaaaagctgtagggagttaaaagaaaaactcaactccggtgtggaagtccatctcgactgtgagagcattttcgtgatcgcctccgtgctgaaagatttcttaagaaacatcccagggtcaatcttcagttccgacctatacgaccattgggtgtccgtcatggaccagggcaatgacgaagagaagatcaataccgtccagcgtctattggaccagctccctcgcgccaacgttgtgctcctgcggtatctgttcggggtgctgcacaacattgagcagcatagcagtagtaatcagatgactgcttttaatctggcggtctgtgttgcgccgtccattctttggccacccgcctccagttcacctgagcttgaaaacgaatttactaagaaagtgagcttgctgatccagttccttattgagaactgcctgcgaatttttggggaagagataacctccctgttccgtgaagtctctgtacgctgcgatacccgcgagaacgctagtgacatttcctgttttcagcttaatgattcctcttatgatagtcttgagaacgagctgaacgaggatgtcgatgcgccctgctcagacctggttaaaaaactcggtcagggcagcagatctatggacagtgtgctaacactgtcagactacgaccttgatcagcccgaagttgaggggctgttgactcttagcgactttgacctggcacacagcaaggacgaggatgtgcagatgaaacggccactggaaagtaagcctgttaatatcctggtgtataccaaaattccccttagggatcatgcacgtgctccctccgcgatgtgcacaccatcctacctttcaacagccgctgctaatgcagctaagtctctgagaaggcaccgccgttgcagcgaaccttcaatcgattatttagatagcaaactgtcgtacctcagagagttctaccagaagaaattacggaagagctcatgtgatgccatcctcagccaaaaggacgaagattacctgaagcagaaccagccactgcaggaagagggaaagacctgttttaaacagagtctcgtgaccggcacggacgttagcaaaaaaaacgctacaacccagaacaccaaaaaaaaatccctctctggctctgagggaaaccatgtcaagctgttcccgaagtctaagcctgtagctatctctgtggccagttattctcctatgagctctcaagaccatagcaagaaccagccatttgatgtgaataccagcgggtatagcccaccccacaccgctgacgctctaaaggggcccagaactcatcggcggtgttcagagcctaatatcgaggaccagaatcgtaagttgacgtatctccgcggaatctacagcaagaagcagcacaaaaccagctgcgaggcaggtcttcttcacggagaggaggattatcttaagagacacaaatcactccagatggaggggcagaagttaatcaaccaatctctggtaatgggcatagaggtaggtaaatctagcgcaaccaaccagaacacagagaaggtcctaccaccccgcctgaacctgtgccctcggacgtcctacagttccttaagctcacctggtaccagtccatccgggagctccgtgtcctcccaagattccgctttctcacagataagcgaacactcagtgttcactccaactgagaccagtagcccgatagactgcacgttccaagcccagagaaagagggaggatctcagcccagacttctcaaacgcatctcacgtttccggaatgcctggcccatccagcggacaggcttgctcaaggccggcgtatacaaagaaggacaccatggagtggcactctcagatgcactcggttactttgcacccaagtacctggttgaggaacggtgtggccagtctcaagaattggagcctgaaaaaaaaggctaaagcagcacgcccagaagaggaaaagatagcaagcccgaagggccctctcgaaccaccaccacatgcttccggagtacctgaggccaattctctgcaggaggagcaaaaggatctgcccttgcgcgccgcagagggcctgtcccctgtacagtccgctcagcggtgctcatcctccccctttcaggactcagagagacactgctcttctcccttcagtctggtcgaaagcagacttaagctatgtatgaagagtcatgaagagattgagccaggctcgcaatcatccagcggtagtttaccctgggagcgagctagcgcctcaagctggaccttggaagacgctacgtctccagactcagggcctactgttgtgtgtgacatagaggacaggtacctgaccaaagacatatag

SEQ ID NO: 17186 - DNA, 4542 bp, Artificial Sequence
  Description of Artificial Sequence: Synthetic coding sequence
atgatgatggccagaaagcaggatgtgcgaattcccacatataatattagtgtagttgggctgagcggaaccgagaaagagaaaggccaatgtggcatcggtaagagttgcctatgtaaccgcttcgtgaggccctccgctgatgagttccatcttgaccatactagcgttctgtctacgtctgactttggaggtagagtggtcaacaatgaccacttcttgtattggggcgaggtatctagaagcttggaggactgtgtagaatgtaagatgcatatcgtagagcagacagaattcatcgatgaccaaacctttcaaccgcatcgctccaccgctctgcagccttacattaaaagggctgctgcgacgaaattagcgtccgccgagaagctcatgtacttctgcacagatcagctaggactggagcaagatttcgagcagaagcagatgcccgacggcaaactgctagtcgacggttttttgcttggcattgatgtctctcgcgggatgaaccggaacttcgacgaccagctgaaatttgtgtccaatctatataaccagcttgctaagactaaaaagccgattgtagtcgtgctgactaagtgtgatgaaggtgttgaacgttatatcagggatgctcacacctttgcattaagtaaaaaaaacctgcaggtcgtggaaacaagcgccagatctaatgtgaacgtggatctggctttttctaccttagtccaactgattgataaatcccggggcaaaactaaaatcataccctatttcgaagccctgaaacagcagtcccaacagattgctaccgctaaagataaatacgaatggctggtgtcaagaattgtgaaaaatcataatgagaattggttaagcgtgagcagaaaaatgcaggcaagcccagaatatcaggattacgtttacctggagggcacccagaaagctaagaagttgtttttgcagcatatccaccgcctgaagcatgaacacattgagcggcggaggaaactctacttagcagcgctgcccctggcttttgaagccctcatccctaacctcgatgagattgatcacctgagctgcattaaagcaaaaaagctgctggagaccaaacccgaatttctgaaatggttcgtcgtacttgaggagaccccgtgggacgctacgagtcacatcgataacatggaaaatgaacgcatcccattcgatctcatggataccgtgcctgcggagcaactgtacgaagctcatttagaaaaattgcggaacgagagaaaaagggttgagatgaggcgggcctttaaggagaatctcgagacttcgccgttcattactcctggtaagccgtgggaggaagctagatcctttatcatgaacgaggatttttatcagtggcttgaagagtcagtctatatggatatctacggcaagcaccagaagcagatcatcgataaggctaaggaggagtttcaggagctcctactcgaatacagtgaactgttctatgaattggagctggacgcaaagccttccaaggaaaagatgggcgtcatacaggatgttctgggggaggaacagcggtttaaagcactccaaaaacttcaggcagaacgagatgccttaatcttaaagcacatccatttcgtgtaccaccctacaaaggaaacgtgtccaagctgccctgcatgcgtggatgctaaaatagaacatctcataagttctagatttatccgcccgagcgatcgtaaccaaaaaaatagtctcagtgaccccaacatcgacaggattaatcttgtcatcctcggtaaggacgggttggccagagagctggcaaacgaaatccgtgctctctgtaccaacgatgataagtacgtcattgacggaaagatgtacgagctgtctcttcgccccattgagggcaacgtccggctgcccgtcaattccttccagaccccaacgttccagcctcacggatgtctttgtctgtataattccaaagagtcactatcatatgtggttgaaagcatcgagaaaagccgcgaaagtacccttggccggcgcgacaaccacctggtccacttgccactgacattgatcctggtaaataaaagaggagatacatcaggggagaccctgcattccctgatacagcagggtcagcaaattgccagtaagttgcagtgtgtgtttctggaccctgcctccgctgggatcggctatggccggaacattaacgagaagcagattagccaggtcttgaaaggcctcctggactctaaaagaaatctgaacctcgttagctcaaccgcaagtatcaaagacctcgcagacgtagatctgcggattgtcatgtgtctgatgtgcggggatcccttttccgccgatgatatcctatttcccgtgctgcagtctcagacctgcaagagtagtcattgtggcagcaataactcagttctgctggaattgccaatcgggctgcacaaaaagcgtattgagttgtcagtgttgagctatcactcgtctttcagcattcgtaaaagccggctggtccatggttatatcgtgttctatagtgccaaacgaaaggcaagtctcgcaatgttgcgcgccttcctgtgtgaagttcaagacattatccctatacagcttgtcgctctcacagatggcgctgtagacgtgctggacaacgatctatctagggaacaactgacggagggcgaagagatcgcccaagagatcgacgggcggttcacgagcatcccgtgttcccagcctcaacacaaactggaaatctttcatccattttttaaggacgtcgttgagaagaagaatattatcgaagccactcatatgtatgataacgcagcagaagcttgcagcactaccgaagaagtattcaattctccaagggctggcagccccttatgcaattcaaatttacaggatagcgaggaggacatcgagccttcttattccctgttcagagaggacaccagcctgccatcactgtctaaagatcattccaagctcagcatggagctcgagggaaacgatggcttgagttttatcatgagtaactttgaaagtaagctaaataacaaagttcctcctcctgttaaaccgaagccgcccgtccacttcgagatcactaagggcgatctgtcttacctcgaccagggtcatagggatggccagcgaaaatccgtatccagctcgccgtggttgccccaggatggcttcgacccctccgactacgctgagcctatggacgcagttgtgaaaccaaggaatgaggaggagaatatttattcagtgcctcatgattcaacacagggaaagatcatcacgatccgcaatattaataaagcgcaatccaatggcagcggcaatgggtccgatagcgagatggacacttccagcctggagcgaggtcggaaggtatcgatagtgtctaaacccgtgctgtacaggacgagatgtacacgccttggcagatttgcatcttatcggacttctttcagcgtggggtctgacgacgagctcggacccatccgcaaaaaagaggaagatcaggcatcccagggatacaaaggcgacaatgcagtcatcccatacgagactgacgaggatcccagacgcaggaacatccttaggtctctgagacgtaataccaaaaagccaaaacccaagcccaggccttccatcaccaaggccacttgggaatccaattacttcggtgtaccactgaccacagtagtgacaccagagaaacctattccgatattcatcgaaaggtgcatcgaatacatcgaggccactggattgtctactgagggaatctacagagtgagtggcaataaaagcgagatggagtcccttcagcggcagttcgatcaagaccacaacctggacctggctgagaaggattttactgtaaacaccgtggctggagcgatgaaatcattcttctccgagttgcctgaccccctggtgccatataatatgcagattgacttagtcgaagctcacaaaataaatgatcgtgagcaaaaactccacgcattgaaggaagtgctgaaaaaattccccaaggaaaaccacgaggttttcaaatacgtaatcagtcatcttaacaaggtttcccacaacaataaagtaaatctgatgacttctgagaacctttctatatgcttctggccaaccctaatgagaccggacttcagtaccatggatgcccttactgctacgaggacctatcagaccatcattgaattattcatccaacagtgtcctttctttttttacaacagacccatcaccgaacctcccggtgctcgcccgtcctctccatcagcagttgcttctactgtccctttcctcacgtcgacccctgtgacatcacagccgtctcccccccagtctccgcctcccacaccacaaagccctatgcagccactgcttcccagtcccctgcacccacatagacccacgccacagccctccaggaatatcccttggcaaacaaaagagcactag

SEQ ID NO: 17187 - DNA, 4500 bp, Artificial Sequence
  Description of Artificial Sequence: Synthetic coding sequence
atgatgatggcgcgaaaacaagatgtgagaatcccaacatacaatatatcggtggtgggcctgagtggcaccgagaaggaaaaaggacaatgtgggatcggtaagtcctgcctctgtaacagatttgtccggccttccgccgatgagtttcacctagatcacacttcagtcctctccacaagcgatttcggaggccgggtcgtgaataacgatcactttctctattggggtgaggtcagcagatccctggaagactgtgtggaatgcaagatgcacattgttgagcagacagagttcatcgatgaccaaacattccagccacaccggtcaactgcacttcagccatacattaaacgggctgctgcaacaaagctggcctcagctgagaagttgatgtatttctgcaccgaccagctaggactggagcaggattttgaacagaagcagatgcctgatggaaaacttctcgtcgacggcttcctgttggggatcgacgtaagtagggggatgaaccgcaatttcgacgaccagctgaaattcgtgtctaatttgtacaaccagctggctaagaccaagaagccaattgtggtggtgttaacaaagtgtgatgagggggtggagaggtacatccgagatgcccacacatttgctctgagcaagaaaaatctgcaggtcgttgaaacttctgcccgctctaacgtgaatgtcgacctcgcgttcagcacactggttcagcttatcgacaaaagccgtggtaagacaaagatcatcccctatttcgaggcccttaagcagcaatcacagcagattgccacagctaaagacaagtatgagtggctggtttctaggattgtgaagaaccataacgagaattggctatctgtgtcccggaagatgcaggcttcccctgagtatcaggattatgtttatcttgaaggtacacagaaggcgaaaaagttgtttctgcagcatatacatagactgaaacatgagcatattgaaaggagacgcaagttatacctcgccgccctgccactcgcttttgaggctttgatccctaatcttgacgaaatcgaccatttgtcatgtatcaaagccaagaaactcctagaaaccaaaccagagtttttgaagtggttcgtcgtgctggaggagaccccatgggatgctaccagccatattgacaacatggagaatgaacggataccatttgatctgatggatacagtgccggctgaacagctttacgaagcgcacctggaaaaactccggaatgagcggaagcgcgtggaaatgagacgcgcatttaaggagaatctagagacaagcccgttcataacgcctggaaaaccatgggaggaagcgagaagctttataatgaacgaggacttttaccaatggttggaagagagcgtctatatggacatttacggtaagcaccagaagcagataatagacaaagcaaaggaggagttccaggaactcctgctggaatacagcgagctgttttatgaactggagctcgatgccaagccttccaaggagaagatgggcgtgatacaagacgttctgggagaggagcagaggtttaaagcccttcagaagttgcaggccgagcgcgacgcccttatcctcaaacacattcacttcgtatatcatcctacaaaagaaacttgtccatcttgtcccgcatgcgtggacgcaaagatcgaacatttaatttcatctcggtttataagacctagtgaccgcaatcagaaaaattcactgagtgatcctaacattgacaggattaaccttgttattcttggtaaagacggactggctcgggaactcgcaaatgaaatccgtgctttatgtactaatgacgataagtacgtcatcgatggaaaaatgtatgagctgagcctacgccctatcgagggcaacgtgagactgcccgtgaacagctttcagacgcccacatttcagcctcatgggtgcctttgcctgtacaactctaaggagagtctttcctacgtggtcgaaagcatcgaaaagtcacgtgagtcaacacttggaagacgggacaatcatctagttcatctgccgctgaccctgatcttagtaaacaaaagaggcgacacctctggagagactctccattccttgatccagcaaggccagcaaattgcaagcaagctgcaatgcgtgtttctagatcccgcaagcgctggtatcggatacggtcgcaacatcaatgagaagcagataagccaggtcctcaagggcctgctggactccaagagaaacctaaatctggtgtcttctactgcgagtataaaagacctcgccgatgtagacctgaggatagttatgtgtcttatgtgtggcgatcctttctcagccgatgatattctgttccctgtcctccagtcacagacttgcaagtcatcacattgcgggtcgaataacagtgtgctgttagagctccctataggtcttcacaagaagcgcatcgaactcagcgtgctgtcgtatcatagtagcttctctattagaaagtcgagactggtccatgggtacattgtgttctacagcgcgaaacggaaggcctctctggcaatgctgagggcctttctttgcgaggtgcaggatataattcctatacagttagtggcccttactgacggggccgtcgatgtgctcgacaacgatctgtcacgagagcagctgactgaaggcgaagagatcgcacaggagatagatggcagattcacatccatcccttgtagtcaacctcaacacaagcttgaaatcttccatcccttctttaaggacgttgttgaaaagaaaaatataatcgaggccactcacatgtatgacaatgccgccgaagcctgttccactaccgaagaggtcttcaactctcctcgagccggtagcccgttgtgcaacagcaatctgcaagattccgaggaggacatcgagccatcgtattccctgtttcgggaagatacctccctcccaagcttgagtaaagaccacagtaaactctctatggaattggagggcaacgacggtttatcgttcatcatgagcaattttgagtctaagctgaataataaggtaccccctccggtgaagccaaagcctcctgtgcacttcgaaattactaagggtgacctatcctacctggatcagggacacagagacggtcagcggaaaagcgtaagctctagtccatggctgccacaggatggtttcgatccctccgattatgccgagccaatggacgcggtggtcaagcctcgaaacgaggaagaaaatatttactcagtgccccatgattcaactcaaggaaaaattatcactattagaaacataaacaaggctcagtctaacggttctggaaacggctccgattcggagatggatactagctcactggaaagaggccggaaagtgtccatcgtgagcaaaccagtgctgtacaggacccgctgtactagactgggtcgttttgcgtcgtataggacctcattcagtgtgggctcagatgacgagttgggtcctataagaaagaaggaggaggaccaggcctcccaggggtataaaggggacaatgctgtcattccttatgagacggacgaagatccccgacgacgcaacatcctgagatccctcaggagaaatactaagaaacccaagccgaagcccagaccctcaatcactaaggccacctgggaaagtaattatttcggcgtgccgttgacgactgtggtaacgcctgagaaaccaatccccatattcatagaacgatgcatcgaatacatcgaggcgacggggctgtcaactgagggaatttatcgggttagcggaaacaaaagtgagatggagagtctgcagcggcaatttgatcaagaccacaacctcgacctcgcagagaaagacttcactgtgaatacagtcgccggagcaatgaagtctttcttctccgaattaccagatcctctggtgccatataacatgcagattgatctcgtggaggctcacaagattaacgatagagaacagaaactgcacgccctaaaggaggtgctcaagaagttccctaaggagaatcatgaggtgtttaagtatgtaatttcccacctaaacaaggtgtcacacaacaacaaagtgaaccttatgaccagtgagaatctgtctatctgcttttggcctactcttatgagaccagatttttcaaccatggacgcgctaaccgcgacacgcacctatcagacaatcatcgagctctttatacagcagtgccccttcttcttttacaaccgccccatcacagaaccgccaggcgctcgcccctcttccccatctgcagtcgcctcaacagtcccttttctcaccagtactccggtaacctctcagccttctcccccccagtctccacctccaactcctcaatccccaatgcagcccctgttgccaagccagctccaagccgagcacacactctag

SEQ ID NO: 17188 - DNA, 2250 bp, Artificial Sequence
  Description of Artificial Sequence: Synthetic coding sequence
atgatgatggccagaaagcaggacgtgagaattcctacctacaatatttccgtagtcggtttgtcaggtacagagaaagagaaagggcagtgcggtattgggaaatcttgtctgtgtaacagatttgtgcgcccatccgctgatgagttccacctcgaccacacatccgttcttagtacatctgacttcgggggtagagtagtgaacaacgaccacttcctgtattggggcgaagttagcagatctcttgaagactgcgtggagtgcaagatgcacattgtcgaacagactgaattcatcgatgatcagacgttccaacctcatcgctccaccgccctgcagccgtatataaaacgtgctgctgccacaaagctggcctctgcggagaagctcatgtacttctgtaccgaccagcttggattggaacaggactttgagcaaaagcaaatgcctgacggcaagctgttagtcgacgggttcctgctgggaattgacgttagcaggggcatgaatcgcaattttgatgaccagctgaagtttgtctccaacctatataaccagttagccaagacgaaaaagcctatcgttgtggtgttaaccaaatgtgacgaaggggtcgaacgctacatccgcgacgctcacaccttcgccctcagcaaaaaaaaccttcaggtggtcgagacctctgctcggtctaacgtcaatgttgacctagctttctcgactctggttcaactgatcgataagtcacgtgggaaaactaagatcatcccatatttcgaggccttgaaacaacagtctcagcagattgcaaccgccaaggacaagtatgaatggttggtgagccggatagtaaagaaccataacgagaattggctgtccgttagtcgtaagatgcaggctagccccgagtatcaggattacgtgtatttggaaggcacacaaaaggcgaaaaagctcttcctgcagcacatacaccggctcaaacatgagcacatcgaacgccggcggaagttgtacttagcggcactgccccttgcctttgaagcgttgatccctaacctagatgagattgatcacctctcttgcataaaagcgaagaagctcctggaaacgaaacccgagttccttaagtggttcgtcgtactggaggaaaccccatgggacgctacatcgcacattgataatatggagaatgaaaggataccttttgatctgatggacaccgttccagccgaacagctgtatgaggcacacctggagaagcttcgcaacgaaagaaaacgcgtcgaaatgcgtagagcattcaaagagaatttggagacgtccccttttatcactccgggcaaaccttgggaggaagctcggtcctttataatgaacgaggacttctaccagtggctggaggaatccgtctacatggatatttacggcaagcaccagaaacagataatcgacaaggccaaggaggagtttcaggagttgctcctcgaatactctgagttgttctacgaactggaactcgacgctaagccatccaaagagaaaatgggcgtgattcaggacgtgctgggcgaagagcaacgtttcaaggctcttcagaaactgcaggccgaacgagatgcactgatccttaagcatatccacttcgtgtaccacccaaccaaagaaacttgtccatcatgtcctgcttgtgttgatgcgaagattgaacacttgatcagttctcgattcatacgtccatcagaccgaaatcagaagaactcgttgtccgatccaaacattgaccgtatcaacctggtaatcctgggtaaagacgggttagcgagagaactggcgaacgaaattagggccctctgtaccaacgatgacaagtatgtcattgatggcaagatgtatgaactaagcttgcggcctatcgaggggaatgtgcggttgccagtgaatagtttccagaccccaaccttccagcctcacggatgcctatgcctatacaatagtaaggagtcactgtcttacgtcgtggaaagtatcgaaaagtcaagggaatctaccctgggaaggcgggacaatcatctggttcacctcccgcttactctgattctggtaaataagaggggagatactagcggagagacgctgcactcactaattcaacaggggcagcagattgcgagcaaactgcagtgtgtgtttctggatccggcctccgccggcgctgcagacctgtcctggctaggacctatctag

SEQ ID NO: 17189 - DNA, 978 bp, Artificial Sequence
  Description of Artificial Sequence: Synthetic coding sequence
atggacatgtggaccgcccttctgatcctgcaggcactactgctgccttctctggccgatggcgccacaccagcactaagattcgtggccgtgggagactgggggggtgtccccaatgccccctttcacacagcccgtgagatggcaaatgctaaggagattgcccggactgtgcaaattttgggagccgacttcatcctgagtctgggcgataatttttacttcacaggcgtgcaggacatcaatgataagagattccaggagaccttcgaggatgttttcagtgaccgctccctacgaaaagtcccctggtacgtacttgccggcaaccatgatcacctggggaatgtgtctgctcagattgcttattccaagatttcaaaacggtggaattttccgtccccattttaccggctgcattttaagattcctcagacaaacgtgtctgtggctattttcatgctggacaccgtgacactgtgtgggaactctgatgacttcctgtcccaacagcctgaaaggcctcgggatgtgaagcttgccaggacacagctgtcttggctcaagaaacaactggcagctgcccgcgaggactatgttctcgtcgccgggcactaccctgtctggtccattgcagagcacggaccaacccattgtctggtaaagcagctgagacctttactggcaacttatggggttaccgcatacctctgcggccacgatcataatctgcagtacctccaggacgagaacggggtcggatatgtgctcagtggcgcaggcaactttatggatcctagcaagagacaccagcgcaaagtacctaacggatatctgaggttccattatggaacagaagacagcctcggggggtttgcttatgtcgaaataagttccaaggagatgacagtgacatatatcgaagctagcgggaagtccctgtttaaaacccggctcccaagacgcgctcgcccatag

SEQ ID NO: 17190 - DNA, 2349 bp, Artificial Sequence
  Description of Artificial Sequence: Synthetic coding sequence
atgaattcagccgagcagacagtaacctggctgattacactcggcgttttagaaagtccaaagaagactatcagcgatccagaggggttcctccaggccagccttaaggatggagtggtactgtgtaggctactagagaggttgctgccaggcactatcgaaaaggtgtaccccgagcccaggagtgaatcggagtgtctatcgaacatccgtgaatttctccggggatgcggagcatctctgagactggaaacgtttgacgcaaacgacctgtatcagggtcagaacttcaacaaagtcctttcatccctggtgacactgaacaaagttacagctgacattggattgggaagtgacagtgtctgcgcaagaccctcctctcacaggatcaagtcttttgactcgctggggagccagtcactccacacgcgaactagtaagttgttccagggacagtaccggagtctggatatgaccgataacagcaataatcaattggttgtccgcgcgaagttcaactttcagcaaactaatgaagacgagctgtctttttcaaaaggtgatgtgatacacgtgaccagagtagaggagggggggtggtgggaaggcacactgaacgggcgcacagggtggttcccatcaaattatgtgcgagaagtcaaggcttcagaaaaacccgtgtcccccaaatcaggcacgctaaagagcccaccaaagggctttgatacgaccgcaataaataagtcctattacaacgtggttcttcagaacatcctggagacagagaacgaatattcaaaggagttgcagacggttctcagcacctacctgcggcctctgcagacatccgagaaactctcgagcgctaatatctcatatctcatgggcaatctggaggaaatctgctcttttcagcagatgctggtgcaaagcttggaagaatgcacaaagctgccagaagctcagcagcgtgtagggggttgcttccttaatttgatgccgcagatgaagaccctgtatctgacttactgcgctaaccacccatccgcggtgaatgtgctgactgaacacagcgaagaattgggcgaattcatggagacaaagggggcctcatcgccaggaatcctggtgcttacaaccggcttatctaaaccctttatgagattggacaagtatcctaccctattgaaagaactcgaaaggcacatggaagattaccacactgatcgacaggatatccaaaaatcaatggcagcatttaaaaacctgagtgcccagtgtcaagaggtccgaaagaggaaagagcttgaacttcagattttaactgaggctatacgcaactgggaaggggacgatattaaaaccctaggaaatgttacgtatatgagccaggtgcttatccagtgcgccggcagtgaggaaaaaaacgagcgatacctcctgctctttcccaacgtgcttctcatgttatctgctagccccagaatgtccggctttatataccaaggtaagctgcctactaccggcatgacaattaccaagcttgaagactccgaaaaccaccgtaacgctttcgagatttctgggtccatgattgagagaatcctggtctcctgtaataatcagcaggatttacaagaatgggtggaacatctccaaaagcagacaaaggtgacgagcgtcggcaatcctaccatcaaaccccattcagttccttcacatactttacccagccaccccgttacaccatcctcaaaacacgcagattccaaaccagcaccactcacccccgcctaccatactttgccccatccatctcaccatgggactccgcataccacaatcaactggggacccctggagcctccgaaaacacccaaaccttggagcctgagttgcctgcggcccgcgcctccccttcgcccctccgccgccctgtgctataaggaagatctttctaagagccccaagactatgaaaaaattgcttcccaaacgcaagccagagaggaagccctccgacgaagagtttgcctcgcgaaagtccactgctgccctggaagaggatgcccagatcctgaaggtgatcgaggcgtactgtacgtctgcaaaaacgaggcagaccctgaattccacctggcagggaaccgaccttatgcataaccacgtcttggccgatgacgaccagccctcacttgattcattagggcggagatccagcctgagtcgcttggagcctagtgatctttccgaagactctgactatgattccatctggacagctcacagctacaggatgggatcaaccagccgtaaatcctgctgtagctacatctcacatcaaaattag

SEQ ID NO: 17191 - DNA, 2196 bp, Artificial Sequence
  Description of Artificial Sequence: Synthetic coding sequence
atgaactcagctgagcagacagtaacttggttgatcactctgggcgtccttgagtcgcccaagaaaacaataagcgacccagaaggcttcctccaagcctctcttaaggacggagtggtgctgtgtcgactgcttgagagacttctgcccggcaccatcgaaaaagtctaccccgaaccccggtctgaaagcgaatgccttagcaacattagagagtttttgcgcggctgtggcgcctcccttagattggaagacatgaccgataatagcaataaccaattggttgtcagagctaagttcaactttcagcaaactaatgaggacgaactgtccttctctaagggcgacgtgattcatgttaccagggtcgaagaaggtggatggtgggaggggaccttgaatggaaggactggctggtttcccagcaattacgtcagagaagttaaggcatcggagaagcccgtgtcccctaaaagcggcactcttaagagccctcccaagggatttgatacaacggccatcaataaatcgtactacaacgtggtgctccagaatatcctggagaccgagaacgagtactccaaggagttgcagacagttttatctacatatcttcgccccctacagaccagcgagaaattaagctccgctaacattagctacctgatgggtaaccttgaagaaatctgtagctttcaacagatgcttgttcagtctctagaagaatgtacaaaactgccagaagcccagcagagagttggaggctgtttcctgaatttaatgccccagatgaagactctctacttgacttattgtgcaaaccatccatcagcagtcaatgtattaaccgagcactcggaggaacttggcgagttcatggaaacaaagggcgccagtagccccggcatattggtcctgacgaccggcttgtctaagcctttcatgcggcttgataagtacccaactctcttaaaagaactggagcgccacatggaggactatcatacagatcggcaagacatacagaaaagtatggccgcatttaagaacttatctgcccagtgccaagaagtacgcaagcgcaaagaattggagctccaaatcctgacagaggcaatcaggaattgggagggagacgatatcaaaacacttggcaatgtgacatacatgtcacaggtgctgatacaatgtgccggaagcgaagagaaaaatgagcggtacctgctccttttcccgaatgtcctgttaatgctgagcgctagcccccgcatgtcaggcttcatctatcagggaaagttacccaccaccggaatgacaatcactaagctggaggattccgaaaaccaccgtaatgcctttgagatttcagggtcaatgattgaacgcatccttgtctcgtgcaacaatcagcaggacctacaggagtgggttgagcatctccaaaaacaaacaaaagtaacgtctgtcggaaatcccacgatcaagcctcacagcgtgccttcgcatacactgccatcccaccccgtaaccccctctagtaagcatgcagattctaaacccgctccgttgacgcctgcctaccacacacttccccatcctagtcaccacggaactccccatacaacaatcaattgggggcctctggaaccacccaaaactcccaaaccttggtccttgtcctgcctgcgcccggcgccccccctgaggccaagtgctgctctgtgctacaaagaagatcttagcaagtcacccaaaactatgaagaagctcctaccaaagcggaaaccggaaagaaaacccagcgatgaagagttcgcgagtaggaaatctaccgcagccttagaggaagacgctcagatcctgaaggtgatcgaggcctactgcacatcagccaaaaccagacaaaccctcaactccagctcaagaaaggagtcggccccgcaagtactcctgcctgaggaggaaaagatcatcgtcgaggaaacaaaatctaatggtcagacagtcatcgaagaaaagagtctggtcgacacagtgtacgccttgaaagacgaagttcaggaactgaggcaggataacaagaaaatgaagaaatccctcgaagaggagcaaagggcccgaaaggatctagaaaaactggtgcgcaaagtcctcaaaaacatgaacgacccagcctgggacgaaacgaacttgtag

SEQ ID NO: 17192 - DNA, 1878 bp, Artificial Sequence
  Description of Artificial Sequence: Synthetic coding sequence
atgaccgacaattccaataaccagctggtagttagagccaaatttaacttccagcagactaacgaagatgagttgtccttctccaaaggtgatgtgattcacgtgactagggtggaagaaggcggctggtgggagggcacactgaatggtcgcacaggttggttcccctccaattatgtgcgggaggtcaaggcatctgagaagcccgtgtcccccaagagcggaacactcaaatcacctccaaaggggttcgatactacagcaatcaataagagctactacaacgttgtgctccagaatatccttgagactgagaacgaatactctaaagaactgcagacagtcctctcaacttatcttcggccacttcagaccagcgagaagctgtcttccgcgaacatcagctatttaatgggcaatttggaggagatctgcagttttcagcagatgttagttcagagcttggaggagtgtacaaaactgcctgaggcgcagcaacgggtcggcggctgctttctgaatctcatgcctcaaatgaagactctgtacctgacttactgcgccaaccacccttctgccgtcaacgttttaaccgaacacagcgaggagctaggagaatttatggagacaaaaggcgcaagttcaccaggcatcctggtcctgacaacgggtctgagcaaacctttcatgcggctggacaagtatccgaccctgctcaaggagttggagcggcacatggaagactatcatacggatcgccaggacattcagaagtccatggccgcatttaagaaccttagcgcacagtgccaggaagtaagaaagaggaaggagctggagctgcagattctgaccgaagccatcagaaattgggagggcgacgatattaaaactcttggtaatgtcacctacatgagccaggttctcattcagtgcgcaggatccgaggagaagaatgagcggtacttgctgctctttccaaatgtgctcctgatgctatcagcctcaccccggatgtccggattcatttatcaggggaaactacctaccacgggaatgaccataaccaagctagaggacagcgagaatcatagaaacgctttcgagatctccgggagtatgatcgagagaatacttgtgagttgcaataatcaacaggatttgcaggaatgggtggagcacctgcagaaacagacaaaggtcacttcagtcgggaatccaaccatcaaacctcacagtgtgccttcccatacactgccctcccacccggtcacgccatcttccaagcacgcagacagcaagcccgcaccgcttaccccggcctatcataccctgccccacccttctcatcacggaacaccacatacgacaatcaattggggacccctcgagccgcccaagactcccaagccctggtctctgtcctgcttgcgccccgccccgccccttcgtccttctgccgctctctgttacaaggaagatctgtcaaagtccccaaagaccatgaagaagctgctgcctaagagaaagcccgagagaaagccttccgacgaggaattcgcatccaggaagagcacagccgccttagaggaagacgcccagatactgaaggtcatcgaagcctactgcacgtcagccaagacgcgtcagactttgaatagcacttggcaggggactgatctgatgcataatcacgtgctggccgacgacgaccaaccaagcctagactccctgggtcgaagaagtagtctctctcggctggagcctagcgatctctctgaggacagcgattatgacagcatctggaccgctcacagctacaggatgggctctacttctcgcaaatcgtgctgttcctacataagtcaccagaattag

SEQ ID NO: 17193 - DNA, 1941 bp, Artificial Sequence
  Description of Artificial Sequence: Synthetic coding sequence
atgaccgataatagcaacaatcagctcgtcgtaagagccaagttcaattttcagcagaccaatgaagatgagctttccttctccaagggcgacgtcatccacgtgacacgcgtggaggagggtgggtggtgggaaggcacactaaacggcagaactgggtggttccctagtaactacgttcgtgaggtgaaagcgtccgagaaacctgtgagtccaaaatctgggaccttgaagtctcctcctaaagggtttgatactacagccatcaataaaagctactataacgttgtcctgcaaaacatcctcgaaaccgaaaatgagtattcaaaggagctgcaaaccgtgttatctacctatctgagacccctgcagacttctgaaaagctatcctcggcgaacatcagctacctcatgggcaatctggaggagatctgttcttttcagcagatgcttgtacagagtctggaagagtgtactaagctcccagaggctcagcagagagtcggagggtgcttcctgaatttgatgcctcagatgaaaactctctatctgacgtattgtgccaaccatcctagcgccgtaaacgtgctgaccgagcactcagaagagttgggcgagttcatggaaaccaagggggccagtagccctggcatcctagttctgaccacagggttgtccaaaccattcatgcggctggataagtaccccactctgttaaaagaactggagcggcacatggaggactaccacaccgaccggcaagacatacagaagtctatggccgcgttcaaaaacctgtctgctcagtgccaagaagtccgcaaacgaaaggagctggagctccaaatcctgaccgaggccatccgaaattgggagggggacgacatcaaaacactgggtaacgttacttacatgtcgcaggtactgattcagtgcgccgggtcagaagagaagaatgagcgctatctgctgctctttccaaatgtccttctgatgctttcagcctccccccgcatgtccggtttcatctatcagggtaagctcccaactacaggaatgaccatcactaaacttgaagattcagaaaatcatcgcaatgccttcgagatctccggctccatgattgaaagaatcctggtgagctgtaacaaccagcaggatctccaggaatgggtcgagcacctgcagaagcagaccaaagtgacttctgtgggaaatccgaccatcaagccccattctgttccttcccacacattgccatctcaccctgtgacaccgtcttctaagcatgccgactctaagcccgcacccctgacaccagcctatcacacacttcctcacccatcacaccacggtacaccgcacacaactataaattggggaccactcgaaccccctaagacaccaaaaccatggtcactgagttgcttgagacccgcgccacccctcaggcccagcgctgccctgtgttacaaggaggatctgtcaaaatcaccaaaaaccatgaagaagcttttgccgaaaaggaaaccagaacgaaagcccagcgatgaggagttcgcttctcggaaatctaccgctgctctggaggaggacgcccaaattcttaaagtcattgaggcgtattgcacttcagcgaaaactcggcagaccttgaattccagtagccgcaaggagtcagccccccaagtgttgttacccgaggaagaaaaaatcatagttgaggaaacgaagtctaacggccagactgtcatcgaagaaaagtctctggtagatacagtatatgccctgaaagacgaagtgcaggagttgcggcaggataacaaaaagatgaaaaaatccctggaggaagagcagcgggctagaaaagacttggagaagttggtgcggaaagtgttgaaaaacatgaatgatcccgcatgggacgagactaatctctag

SEQ ID NO: 17194 - DNA, 2166 bp, Artificial Sequence
  Description of Artificial Sequence: Synthetic coding sequence
atgaagacctttgacgccaatgatctgtatcagggtcagaatttcaataaggttctttcctctctggtgacccttaacaaagtgacagccgacatcggtttagggagtgacagtgtgtgcgcccgcccttcaagccataggatcaagagttttgatagtctcgggagccagagcttacacactagaacctctaagttattccagggccaataccgttctttggatatgactgataacagtaacaatcagctcgtggttagggccaaattcaatttccagcagacaaatgaagacgaattgtctttttcaaagggcgacgttatccacgtaacacgggtggaagaaggaggatggtgggagggtaccttgaacggtcgcaccgggtggttccccagcaactacgtgagggaggtcaaggctagtgaaaaacctgttagccccaaatctggtacactgaagtctccaccaaagggcttcgacacaaccgctattaataaatcctattacaatgtggtactgcagaacatcttagaaacagagaatgagtatagcaaagaattacagacagtgttgtcaacatacttgcggcccctgcagacctcggagaagctgtccagcgcaaacataagctacctgatgggtaacctcgaggagatttgtagctttcagcaaatgttggtacagagtctcgaggagtgtactaagttgcccgaggctcagcaaagggtgggaggctgcttcctgaatctcatgcctcagatgaagacactctacctgacctactgcgccaatcacccatcggctgtcaacgtactgaccgaacattctgaagagctcggagagttcatggaaaccaaaggtgcttcctcccctggaatcttagttctgacaacaggcctgtccaagccttttatgcgcttggacaagtatcccacgctgctaaaagaattggaaaggcacatggaagactaccacactgacagacaagacatccagaagtctatggcggcatttaagaatctgtccgcacagtgccaagaagtgcgtaaacgcaaagagctggaactgcagatcctgacagaggctatcagaaactgggagggcgacgacatcaagacacttgggaacgtgacatacatgtcccaggttctgattcagtgtgccgggagcgaagaaaaaaacgagcggtacctcctgctgttccctaacgtactgctgatgctgagtgcctccccacggatgtcggggttcatctatcagggaaaacttccaacgacagggatgactatcactaagctagaagatagcgaaaaccacaggaacgctttcgagatcagtggttcaatgattgagcgaattctcgtatcgtgcaataatcagcaagatctccaggagtgggtagagcatctgcagaaacagactaaggtcacaagcgtgggcaaccccacaatcaaaccacacagtgtgccaagccatacattgcccagtcaccctgtcaccccttcctccaaacacgccgacagtaagccggcaccactcactcccgcttaccatacgctaccacacccttcccaccacggcactccacacactaccatcaattggggcccactcgaacccccaaaaactcccaagccgtggagtctatcatgcctaagacctgctccccccctccggccctctgccgccttatgctataaagaggacctgtctaaaagcccaaagaccatgaaaaaattgctccctaagcgaaagcctgagcggaaaccatcagacgaggagtttgcctcgcggaagtccaccgcagctctcgaggaggacgcccagatactgaaagtcattgaagcctactgtacaagcgccaaaacccgacaaactctcaacagttctagtcggaaagaatccgcccctcaggtattattacccgaagaggaaaagatcattgtggaagaaactaagtcgaatggccaaaccgtcatcgaagagaagagcctggttgatacggtgtacgcgctgaaagatgaggtccaagagttgcgacaagacaacaaaaagatgaaaaagtccttggaggaggaacagcgtgcccgcaaggatctagaaaagcttgtacgcaaagtgttgaaaaacatgaatgacccggcctgggatgagacaaacctttag

SEQ ID NO: 17195 - DNA, 2262 bp, Artificial Sequence
  Description of Artificial Sequence: Synthetic coding sequence
atgaattctgcggaacaaacagtcacttggttgataacattaggggtccttgaatcacccaagaagactatcagcgaccccgaagggtttctgcaggcatctcttaaggatggggttgtattgtgcagactcctggagcgcttgctgcccggtacaattgaaaaaacttttgatgccaatgacttgtaccaaggtcagaattttaacaaggtgctctcgtccttggtgaccctgaataaggtgaccgcagacatcggcctcgggtccgatagcgtgtgcgctcgcccctcttcacatagaatcaagagctttgatagtttgggttctcaatctctccatacccgtaccagtaagctctttcagggacagtatcgctcactcgatatgactgataattccaacaatcaattggttgtgcgggcgaaattcaattttcagcagacaaacgaagatgagcttagttttagtaaaggggacgttatccatgtgacgcgcgtcgaagagggaggctggtgggaaggaactctgaacgggcggactggatggtttccaagcaattacgttcgagaagtaaaggcaagcgaaaagccggtgagcccaaaatcaggaactctgaaatcgccgccgaaaggattcgataccactgctatcaacaagagctactacaacgtggtactgcagaacattctggaaaccgaaaatgagtatagtaaagaactacagactgtcctgtccacctatttgagaccactgcagacgagtgaaaagctatctagcgcaaacatctcctacttgatgggaaatctggaagaaatttgctcgtttcagcaaatgctcgtacaatcacttgaggagtgtactaaacttccggaagcccagcagagagtgggaggatgttttttgaacctgatgccccagatgaaaacactttacctgacatactgtgccaatcacccctctgcagtcaacgtcttgactgaacattcagaggagcttggtgaatttatggagaccaaaggcgcctcctctccgggcatactggtcctcaccacgggtctgagcaaacccttcatgcggcttgacaagtatcctacactcctgaaggaattagaaaggcatatggaggactaccataccgacagacaagatatacagaagagcatggccgcatttaagaatctgagcgcccagtgccaggaagtcaggaagagaaaagaacttgaacttcaaatacttactgaggctattcgcaattgggagggagacgatattaaaaccttggggaacgtgacctacatgagccaagtcctaattcagtgcgccggcagtgaagagaaaaacgaacgctacctattgctcttcccaaatgtgttgctaatgttgtccgcctctccaagaatgtctggcttcatttaccaaggcaagttgcctacgaccggaatgacgataactaagttagaggactcagaaaaccataggaatgccttcgagattagcggaagcatgatcgagcgtatactcgtcagctgtaataatcagcaggacctccaggagtgggtggagcatctgcaaaaacagactaaggtgacgtcagtgggcaatcccacgatcaaacctcattctgtgcccagtcatactctgcccagccaccctgtcactccatcctcaaagcacgctgactcaaagcctgcccctttaacaccagcctatcatactttacctcatcctagccatcacggaacacctcacacgacaatcaattgggggcccctggagccaccgaagaccccaaaaccttggtcccttagttgtttgcgacctgccccacccctccgtcccagcgccgcactgtgttataaggaagaccttagtaagagtcctaaaacgatgaagaagctgctgcccaagcgaaaaccggagagaaaaccaagtgacgaggagtttgccagccggaaatccaccgcggcattagaggaagatgcccagatcctcaaggtcatcgaggcgtattgcacatccgccaaaacgaggcagaccctgaactctacatggcagggcacggatctcatgcacaaccacgtgcttgctgacgacgaccagccctctctggattcacttggaagacgttcatctttgtctaggctcgaaccctctgacctaagcgaagatagcgactacgacagcatttggaccgcgcatagctatcgaatggggtcaacaagcaggaagtcgtgctgttcgtatatttcacaccagaactag

SEQ ID NO: 17196 - DNA, 2412 bp, Artificial Sequence
  Description of Artificial Sequence: Synthetic coding sequence
atgaatagtgccgaacagactgtgacttggctaattacactgggtgtattggagtcccccaagaagaccatttccgatccggaggggttccttcaggcatctctcaaagatggcgtcgtgctctgcaggctcctggagcggctgctccccggcacgattgagaaagtgtatcccgagcccaggtctgaaagcgaatgcctgtcaaacatccgcgagtttctgaggggatgtggagctagcctgcgcctggaacttctttttccaccatcgcagcccccccaacatctcgtgacgacaatactgttaagcgcctccactttcgacgctaatgacttataccaaggacagaatttcaacaaggtcctgagtagccttgtgacattaaacaaggtcactgcagacatcggactgggttctgactccgtctgcgcaagaccttcctcacaccggattaagtcatttgacagtctcgggagccagtccctgcataccaggacttccaaactgttccagggccagtataggtctctggacatgaccgacaatagcaataaccagctggtggtgagggccaagttcaatttccagcaaaccaatgaagatgaactgagcttctccaagggcgatgttattcacgtaacaagagtagaagagggcggctggtgggagggcactctgaacgggaggactggctggttccctagcaactacgtccgcgaagtgaaagcctcagagaaaccagtgtctcctaaatctggaacgttgaaatccccgccgaaaggattcgacacgacggcgataaacaagagctattataatgtagtactgcagaatatcttggagacggagaacgaatattctaaggagctgcagactgtgctgagcacctatctcagacccttgcagaccagtgaaaaacttagcagtgctaatatttcctatctgatgggcaacctcgaagaaatatgcagcttccagcagatgctagtgcagagcttggaagagtgcacaaaactgccagaggcccaacagagagtaggtgggtgctttttgaatctgatgcctcagatgaagaccctgtaccttacttattgcgccaaccacccctccgccgtgaatgtgttgacagagcactcagaggaactgggtgagtttatggagaccaagggcgctagtagccccggaatcctcgtgcttaccacaggcttgtccaagcctttcatgcggttggataagtatcctacactgcttaaagagctagagagacacatggaggattaccacactgataggcaggatatacaaaagtctatggctgcttttaaaaacctttccgcccagtgccaagaagttcggaaaagaaaggaactcgagctgcagatattgaccgaagcaataagaaattgggaaggcgacgacataaaaacactgggtaatgttacatatatgtctcaggtgctcatccagtgtgccggctctgaggagaagaacgagaggtaccttttgctcttccctaacgtgctgctaatgttatccgcgagcccacgaatgtccgggttcatttaccagggtaaattaccaacaacaggaatgacaataacgaagctggaggactccgagaaccacaggaatgctttcgagatcagcgggtccatgatcgaaagaatactggtgagctgcaacaaccagcaagacctccaagaatgggtagaacacctccagaaacagacgaaggtcacctcagtgggaaacccaacaatcaaaccccactctgtcccgtcccacactctgccgtcacatcccgtgacccccagtagtaaacacgcagattccaaacctgctcctcttacccctgcatatcatacgctcccgcaccccagtcaccacggcactccgcacacaactatcaactggggtcccctggaacccccaaaaacccccaagccctggtctttgtcatgcctgcgtcccgcgccaccactccggccttccgccgccttgtgctacaaagaggatctgtcaaagtcccccaagaccatgaagaagctgctgcctaagaggaaacccgagcggaagccgagtgatgaggagtttgcaagccggaaaagtacggctgcattagaagaagacgcccaaattctgaaagttattgaggcctattgcacttcggccaagaccagacagaccctaaattccacttggcagggaaccgacctcatgcacaaccatgttctagccgatgatgatcagcccagtctcgacagcctggggagaagatcatccctgagtagactcgaaccttctgacctctcagaagacagtgattatgacagtatctggacagcgcattcatatcggatgggctccacaagccggaagtcttgttgttcttacatatcacatcagaattag

SEQ ID NO: 17197 - DNA, 1941 bp, Artificial Sequence
  Description of Artificial Sequence: Synthetic coding sequence
atgacagacaactccaataaccaacttgttgtgagagctaaatttaactttcagcagacgaacgaggacgaactgtcgttctcaaagggcgatgttatccatgtaacgcgtgtggaagaaggaggatggtgggagggtactctgaacggccggacaggttggttcccgtccaactatgttcgcgaggtgaaagcctcagagaaacctgtcagtcccaagtccgggaccttgaagagcccaccaaaaggcttcgatacaaccgctataaataagagctattacaacgtggtgctccagaacatcctcgagactgaaaatgagtactcaaaggagctgcaaactgtcctgtcaacatatttgagaccactgcagacatccgaaaaactgtcatcagccaatatcagctatctcatgggcaatcttgaggagatttgtagttttcaacaaatgcttgtgcagtctctggaggagtgcaccaaactaccagaagctcagcaaagagtagggggctgcttcttgaatctgatgccacagatgaaaaccctatatttgacttattgcgccaatcatcctagcgccgtaaatgtgcttacagaacactcggaggaactcggcgagttcatggaaacgaaaggtgcatcgagccctggtatacttgttctcaccaccggtctgagcaaaccctttatgaggctggacaaatatcccacgctgctcaaagagctcgagcggcacatggaggattatcatactgaccggcaagacatccagaaaagcatggccgcgtttaaaaatttgtcagcccagtgtcaggaggtgaggaaaaggaaggaactggagctgcaaattttaacggaggcaatccggaattgggagggagacgatattaagacattgggtaatgtgacctatatgtctcaagtgctcatacagtgcgccggttcagaagaaaaaaacgagagatatctactgttgttcccgaatgtcctgcttatgctaagcgccagtccccgaatgagtggttttatctaccaggggaaattaccgacgactgggatgaccattaccaaactggaagactccgagaaccaccgcaacgctttcgagatcagcgggtcaatgatcgaaaggatcctggtatcttgcaacaaccagcaggatctccaggagtgggtcgagcatctccaaaagcagaccaaggtcacctcagtgggcaacccgaccatcaagccacatagcgtgccctctcatacattaccttctcacccagttaccccatcgagtaagcacgccgacagcaagcctgctcccctgaccccagcttatcacaccttgccacacccaagtcatcacgggacaccacatacgacaatcaattggggcccgctggagccaccaaagacaccaaagccatggagtctgtcatgtttaaggccagcccctcccctaaggcctagcgctgccctctgctacaaggaagacctttcaaagagcccaaaaacgatgaagaagctccttcccaaaaggaaaccggaacggaagccaagtgatgaggaattcgcttcccgcaagagtactgccgccctcgaagaggatgcccaaattctgaaggtcatcgaagcctactgcacctcggctaaaacccggcagactcttaacagtagcagtcgaaaggaatccgccccacaggtgttactgccagaagaggaaaaaatcatcgtggaggagaccaagtctaatggtcaaacagtgatcgaggagaagtccctcgtggacacagtctatgcccttaaagacgaggtgcaggaactacgacaggacaataagaaaatgaagaagtcgcttgaggaggagcagcgtgctagaaaggatctggagaaacttgtgcgaaaggtccttaaaaatatgaacgacccagcatgggacgaaaccaatctgtag

SEQ ID NO: 17198 - DNA, 201 bp, Artificial Sequence
  Description of Artificial Sequence: Synthetic coding sequence
atgacagacaattccaataaccagttggtcgtgagagccaagttcaacttccaacaaacaaacgaggacgagctctccttctccaagggcgatgtcatccacgttactcgggttgaggaggggggatggtgggagggtaccttgaatgggcggacggggtggtttccttctaactacgtgcgagaagtgaaagcatcatag

SEQ ID NO: 17199 - DNA, 1344 bp, Artificial Sequence
  Description of Artificial Sequence: Synthetic coding sequence
atgacagacaactccaacaaccagttggttgtccgagctaaattcaatttccagcagaccaatgaggacgagttgtctttttctaaaggtgacgttattcacgtcactagagtagaagaggggggatggtgggagggcactctcaatggacgcactggttggttcccgtctaactacgtccgcgaggtcaaagcatctgagaagcccgtttccccaaaatccggcacactaaaatcacccccaaaaggattcgatacaactgctattaacaaaagctactacaacgtggttctgcagaacattctggagaccgaaaatgagtattctaaggaacttcagaccgttctctccacttatctccggcctctgcagacgtctgaaaagctttcctcagccaacatcagttacctaatggggaacttggaggaaatatgcagtttccagcagatgcttgtgcagagtctagaagagtgtactaaactccctgaagcccagcagcgcgttggcggatgtttcctgaatttgatgccacagatgaaaaccctttacctaacatactgcgctaatcatccttctgcggtgaacgtgctcaccgaacacagcgaggagcttggtgagtttatggagaccaagggcgcatcatctccgggaatactcgtgttgacgactgggctgagcaagcctttcatgcgattggacaaatacccgaccctccttaaggaactggagaggcacatggaagactatcatacagacagacaggatatccagaagtctatggcagccttcaagaacctcagtgctcaatgccaagaagtgagaaagcgcaaagagctagagctccagatcctcaccgaagccatcaggaactgggagggggatgatattaagactctgggtaatgtgacctatatgtcccaggttcttatccagtgcgccgggagtgaagagaagaacgagcgttacttgcttctgtttccaaacgtcctactcatgctctctgcatccccccggatgagcggctttatataccagggcaaactgcccactactggaatgactatcactaagcttgaggactccgaaaatcatcggaatgcatttgagatatccggatcaatgatcgagaggatcctggtttcttgtaacaatcagcaggacctgcaggaatgggttgaacacctgcagaagcagacaaaggtgactagcgtgggcaatccaactattaaacctcatagcgtgccatctcacaccttaccaagtcacccagtgactccaagctcgaagcacgccgatagcaaaccagctcctctgacacctgcttatcacaccctccctcactag

SEQ ID NO: 17200 - DNA, 186 bp, Artificial Sequence
  Description of Artificial Sequence: Synthetic coding sequence
atgacggataattccaacaatcagctggtggttagagcaaagtttaatttccagcagaccaatgaagacgagctctcctttagtaaaggagatgttattcacgtgacgcgtgtggaggaaggaggctggtgggaaggcacgctgaacggcaggaccggatggttcccgtctaactatgtccgttag

SEQ ID NO: 17201 - DNA, 120 bp, Artificial Sequence
  Description of Artificial Sequence: Synthetic coding sequence
atgacggataatagtaataaccagctggttgttcgcgcaaaattcaacttccagcaaaccaatgaggacgaactgtctttcagcaagggggatgtcatacacgtcaccagagtggaatag

SEQ ID NO: 17202 - DNA, 546 bp, Artificial Sequence
  Description of Artificial Sequence: Synthetic coding sequence
atgtgcttcccccgcagctccgtcactacggacgatcatcagctggatggtattaagtcgacacgggcacctgcccctgggtgctgctgctgcccctcggaaactctgcggtcaggtgaggtagcgcgatctagcgccgaatccaggagactcctgttcaagccagatgctactgatgaaaatccagttcctcacgttctatgtcagagccctttctgtagcgagtgtcctcacggaacccaggactaccataccgaccgtcaggatatccagaagagcatggcggcttttaaaaacctgagcgcccagtgccaggaggtacggaaacggaaggagctcgaactccagatattgacggaagctattagaaattgggagggagacgacattaaaacgctgggcaatgtgacctatatgagccaagttctgatccagtgtgccggctccgaggaaaagaacgagcggtacctcctgctatttcccaacgttcttctcatgctttctgctagtccccgtatgagtgggttcatctaccagggcgcgtag

SEQ ID NO: 17203 - DNA, 2070 bp, Artificial Sequence
  Description of Artificial Sequence: Synthetic coding sequence
attccccccagtaagcccctcagaggttcgagcctatgggggtgctggagtagacccaagacaatctccgatcctgagggcttcctgcaggcctccctgaaggacggcgtggtgctctgccgcctgctcgagcgtctcctgcctggtaccattgagaaagtctatcctgagccccggtccgaatctgagtgcctttcaaacatccgtgagtttctgagggggtgcggcgcaagcctgaggctggaaaccttcgatgctaatgatctctatcagggtcagaatttcaataaagtgctctctagcctggtgacactgaacaaggttaccgccgacattggcctgggatctgactccgtgtgtgccaggccttccagccatcggatcaaatcattcgacagcctgggatcacagagcctgcacacaaggactagtaagctctttcaggggcaatatagatctctggatatgacagacaatagtaataaccagctcgtggtgcgggctaagttcaattttcaacagacaaacgaggatgaactcagttttagtaaaggcgacgtgattcacgtgacgcgggtcgaagaagggggttggtgggagggtacacttaatggcagaaccggatggtttccgtctaactacgtgcgagaggtgaaggccagcgaaaaaccggtgtcccccaagtcgggtacactcaagtccccacccaagggatttgacacgaccgccataaacaagtcatactacaacgtggttctccaaaatattctggagacggaaaatgaatatagcaaagaactccagaccgtattaagcacctatctgagaccactgcagactagcgagaaactatctagcgccaacatctcgtatttaatgggcaacctcgaagaaatatgctccttccagcaaatgcttgtgcagtccctggaggagtgtaccaaactacccgaggcacagcagcgggtgggaggatgttttctcaacctgatgccccagatgaaaacactttatcttacctactgtgctaaccatcccagtgcagtcaatgtacttacagagcactctgaagagcttggtgagttcatggagactaaaggcgcaagctcccccgggatcctggtattaactacggggctcagcaaaccttttatgaggctcgataaataccctacccttttgaaggagctcgaacgtcatatggaggattaccataccgatcgccaggatatccaaaaaagtatggccgcttttaaaaacctcagtgctcagtgccaggaagtgcgaaaaagaaaagagctagagctacagattcttaccgaagctattcggaactgggaaggggacgacataaaaaccctgggtaacgtcacatacatgtctcaggtcctgatacaatgcgctggctctgaggaaaagaatgagcggtaccttctcctgttccctaacgttctcctgatgctgtcagcttctccccgcatgtctggattcatataccagggaaagctgccaacgaccggtatgaccataacaaagctggaggactccgagaatcaccgcaacgcattcgaaatctctggatccatgatcgagcgaatcctcgttagttgtaacaatcagcaggacctgcaggagtgggtagaacacttgcaaaagcagacgaaggtcacttccgtggggaacccaacaatcaagccacacagcgttccatcccatacactgccgtctcaccccgttaccccatcgtcaaaacatgccgacagcaaacccgcccccctgaccccggcctatcacacccttcctcatccatcacaccacggtacccctcataccacgattaattggggcccgctggagcccccgaaaacgccgaaaccctggagcctgagctgcctgcgcccagctcctcctctaaggccatcagctgccttatgttacaaagaagacctgtctaagtctcctaaaacaatgaagaagcttctgcctaagaggaaaccagaaaggaagccaatgcgctcgagtaggccaggtaaggcccaactcctatggaaaaaaatgctgcgtttttag

SEQ ID NO: 17204 - DNA, 4065 bp, Artificial Sequence
  Description of Artificial Sequence: Synthetic coding sequence
atgagcactggagattcatttgaaacaaggtttgaaaaaatggacaacctactgcgggacccaaaatccgaggtcaactccgattgtctgcttgacggcctagacgcactggtatacgacctcgatttccccgcactgcgcaagaacaaaaatatcgacaacttcctgtctcggtataaggatacgattaacaaaataagggatcttcggatgaaagcggaagactatgaagtagtgaaggtgatcggtaggggggcattcggagaggttcaactggtgcgtcacaaaagtactagaaaagtgtacgccatgaagttgctctcgaagttcgaaatgataaagaggagtgactcagccttcttctgggaagagagggatattatggccttcgccaactctccttgggtcgtgcagctcttctatgcctttcaggacgacagatatttatacatggtgatggagtatatgccaggaggtgacctggttaatcttatgtctaactacgacgtgcctgagaaatgggcccggttctacacagccgaggtggttttggcgctcgatgcgatccactctatgggattcatccatagagacgtgaagcctgacaacatgctgctggacaagtccgggcatctgaaacttgccgactttgggacgtgtatgaaaatgaataaagaaggcatggtcaggtgcgataccgcagtggggacaccagattacattagccctgaggtccttaagagccagggaggggatgggtattatggaagggagtgcgactggtggtccgtgggggtgttcctgtatgaaatgctggtcggcgacactcccttttatgcagattcactagtagggacatacagtaagatcatgaatcacaaaaattcactcacgttccctgacgataacgacatcagcaaagaagcgaagaatcttatctgcgcctttttgacagacagagaggtgaggcttggccggaacggcgtggaggagataaaacggcatctgttttttaaaaacgaccaatgggcatgggagactctgcgggatacagtggcacccgtggtgccagacctgtcatccgacatcgatacttctaactttgacgatctcgaagaggataaaggggaggaagagacctttccaatccccaaagcattcgtgggcaaccagctcccatttgtcggtttcacctactactctaaccgcaggtatctctcgtcagcaaacccgaacgacaataggactagcagcaacgctgataagagtctgcaggaaagcctccagaagaccatttacaaacttgaggaacaactgcacaatgagatgcaactgaaggacgaaatggaacaaaagtgccggacttctaacatcaaactggacaagatcatgaaggaactggatgaagagggtaaccagcgaagaaacctggagtctaccgtgagccaaatcgaaaaagaaaagatgctgttacagcatagaattaacgagtaccaaaggaaagccgagcaggaaaacgagaagaggcggaatgtggaaaacgaggtgagtacgctgaaggaccagctggaggacctgaaaaaggtatctcagaacagtcagctggcgaatgaaaagctgagtcagttgcagaaacagctggaggaggcaaatgacctgctccgcactgaaagtgacacagctgtgagactgcggaaaagccacaccgagatgtcaaagtctattagtcagttggaaagcttgaatcgcgagctgcaggaaagaaatcggatcttggagaatagcaagtcccagaccgacaaagattactaccaactacaggccatcctcgaggcagagcggcgggatcgggggcatgactccgaaatgattggggatctgcaggcaaggatcacctcgctgcaggaagaagtaaaacacctcaagcacaatcttgagaaggtagaaggggaacgtaaggaggcccaggatatgctaaatcactctgagaaggagaagaacaatctcgagatagatctgaattataaacttaagtctctgcagcagcggctggagcaggaagtgaatgagcataaagtgaccaaagcgaggcttaccgataaacaccaatcaattgaagaggctaaaagtgttgccatgtgtgagatggagaaaaagctgaaggaagaacgagaggcccgcgagaaagccgaaaatcgcgtcgttcagattgagaagcaatgttcaatgctggatgttgaccttaagcagagtcagcagaaattggagcacctgaccggaaacaaagagcgaatggaggacgaagtgaagaacctcactcttcagcttgaacaagagtcaaataaaaggctgctccttcaaaatgagctcaaaacccaagcttttgaagcagacaacctaaagggtctggagaaacagatgaaacaggaaataaacaccctgctcgaggccaaaaggctcctggaattcgaattggctcagctcactaaacagtatagggggaatgaagggcaaatgagagagctgcaggatcagctcgaggccgaacaatatttcagcacactttataaaactcaggtgaaagaactcaaggaggagattgaggaaaagaaccgggagaatctcaaaaaaattcaggaactccaaaatgagaaggagacactagctacccagcttgatctcgcggagaccaaggccgagtcagaacagttggctaggggactgttggaggagcagtactttgaacttacccaagagtccaaaaaggctgcttcccggaaccgccaggagatcaccgataaagatcacaccgtgtctcgcctggaggaggcgaattctatgttgacaaaagacattgaaattttgagacgtgaaaacgaggaactcacagagaagatgaaaaaggccgaggaagaatacaagcttgagaaagaggaggaaatcagcaatttaaaagcagccttcgagaagaatataaatacagagcgtaccctcaaaacgcaggccgtgaacaaacttgccgagattatgaataggaaggacttcaagatcgaccgaaagaaggcaaacacccaagaccttcgaaaaaaagagaaggagaaccgaaaactccaactggagctgaatcaggaaagggaaaagtttaatcagatggtagtcaaacaccagaaagaactgaatgatatgcaggcccagttggtggaggaatgtgcccatcgcaatgaactccagatgcagctggcaagcaaagagagcgacattgagcagctccgggccaagttgctggacctgtccgattccacgagtgttgcttccttcccctccgctgatgaaaccgacggtaatctccccgaatcaagaatagaaggctggctttccgtgcctaataggggcaacatcaaacgctacggatggaagaagcagtacgtcgtagtgtcctctaagaagatcctcttctacaacgacgagcaagacaaggagcagagcaacccgtccatggtcctggacatcgacaagctgtttcacgtccggccagtgactcagggcgacgtgtaccgcgcagagactgaggagattcccaagatctttcagattctgtatgccaacgagggcgaatgcaggaaggacgtcgaaatggagcctgtgcagcaagccgaaaaaacaaatttccagaatcacaaaggccatgaattcattccgacactctatcattttccagctaattgtgatgcatgtgctaagccactgtggcatgtgttcaaacctccccctgccctcgaatgccggagatgtcatgtgaagtgtcacagagaccacctggataaaaaggaagaccttatctgtccatgcaaggtttcatatgatgtcaccagtgccagggatatgctcctgctcgcttgttctcaggacgagcagaagaaatgggtgacccacctggtgaaaaaaataccaaagaacccccctagcggtttcgtccgcgcctccccgagaacactgtcgactcggtcgacagctaaccagagtttccgtaaggtcgtgaaaaatacctctgggaagacaagctag

SEQ ID NO: 17205 - DNA, 471 bp, Artificial Sequence
  Description of Artificial Sequence: Synthetic coding sequence
atggcgccagcgagagctgggttctgcccacttttgctgcttcttctcctgggactgtgggtcgccgagattcctgtcagtgctaaacccaagggcatgaccagcagccagtggtttaagatccaacacatgcagccgtcgccacaggcatgcaactccgcgatgaaaaacattaataagcacacgaaaaggtgcaaggacctcaatactttcctacacgaacctttctcttccgtggccgcgacatgtcagacaccaaagatcgcgtgtaagaacggggataagaattgtcatcagagtcatggagccgtgtccttgacaatgtgtaagctcacaagcggtaaacaccccaactgcagatataaggagaaaaggcagaacaaatcgtacgttgtcgcgtgcaaaccaccacagaaaaaggatagccagcagtttcatcttgtaccagtccacctggaccgggtgctgtag

SEQ ID NO: 17206 - DNA, 471 bp, Artificial Sequence
  Description of Artificial Sequence: Synthetic coding sequence
atggcgccggcccgcgcggggttctgtccacttctgctgctcctcctactgggactttgggtggccgagattccagtgagtgcaaaacccaagggcatgacttcttcacagtggttcaaaattcagcacatgcaaccatcaccccaggcctgcaactccgccatgaaaaatatcaacaaacacaccaagcggtgcaaggacctgaatacttttctgcacgagccattctcgtccgtcgccgccacctgtcagacaccgaagattgcttgtaagaacggagataaaaactgtcaccagtcacatggcgctgtttccttaactatgtgcaagctgacttctggaaagcatcccaattgcagatacaaagagaagagacagaacaagtcctacgttgtcgcatgtaaaccgcctcagaaaaaagactctcagcagtttcatttggtgcccgtccacctggatcgggtgctctag

SEQ ID NO: 17207 - DNA, 831 bp, Artificial Sequence
  Description of Artificial Sequence: Synthetic coding sequence
atgctgcagcaggactccaatgacgatactgaggacgtgtcactgttcgatgctgaagaagaaactactaataggccccgcaaagccaaaatacgccacccagtcgcctcatttttccatctctttttccgcgtgtccgctatcatcgtgtgtttgttgtgtgagctgctaagttcctcctttatcacctgcatggtgactattatcctccttctgtcgtgcgacttttgggcagttaaaaacgttactggtcgcctcatggtcggactgcggtggtggaatcatatcgacgaagatggaaaatctcactgggtttttgagagccgcaaggaaagcagccaagaaaataagacagtgtccgaggcggagagtaggattttctggctcgggctcattgcctgttctgtgctttgggtcatttttgccttcagcgccctgtttagttttactgtcaagtggctccggcgcagtagacacattgctcagacaggactgaaagtgttgggatcccgcgaccccccagcctcagcgtttcaatccgcaggaattaccggggtcagccgctgtcccggtcacccaagcaggaagtttcaccaggtcgacatcaactcttttacacgcattaccgatagagcgctttactggaaacctgcccctcgcctctcatctcctcctcttcgcgctgctccaggcaactgtcagcagatggctccagctcgcctgtttctctcgcttaggctgtgggcttggagaggtgggggggagagcccaaattcaagaggcacaggagaaccaggacctaagttccatctcgccagtggtatgcactag

SEQ ID NO: 17208 - DNA, 1419 bp, Artificial Sequence
  Description of Artificial Sequence: Synthetic coding sequence
atggatcatgggggggtgggtccgtatgagctgggaatggagcattgtgaaaagttcgaaatctcggagacgtccgtcaaccgggggcccgaaaagattcggccagagtgcttcgagcttctgcgtgtgttgggtaaggggggatatgggaaagtctttcaggtccggaaagtgacaggcgcaaacactggcaagatcttcgcaatgaaggtcctcaagaaagcaatgatagttagaaacgctaaagacacggcacacacaaaagccgagagaaacatccttgaggaagtgaagcatcctttcatcgtggacctgatctatgcattccagactgggggcaaactgtacctgatcctggagtatctgtccggcggagaactttttatgcagctggagagggaggggatttttatggaggacacagcctgtttctacctggccgaaatctctatggctttggggcatctgcaccagaaagggatcatttatagggacctcaaacctgagaatatcatgttgaatcaccagggacatgtcaagctcactgacttcggcttatgtaaagaatcaattcacgacggcacagtcactcacactttttgtggtacgatagagtatatggccccagaaattctcatgcggagcggccacaatcgggccgtggattggtggagtttaggagctcttatgtatgacatgttgaccggcgcccccccctttacaggtgagaatagaaagaagaccattgacaagatcttgaaatgcaagctgaacctccccccatatctgactcaggaggccagggacctactgaagaaactgctgaaacggaacgcagcttcgcggctcggggctggaccaggtgacgccggcgaggttcaagctcacccctttttccggcacataaattgggaggaactgctggctcgaaaggtggagcccccattcaagcctctcctgcagagtgaagaggatgttagccaatttgattctaagtttactagacaaactccagtggacagccccgacgacagtacactgtccgaaagtgccaaccaggtcttccttgggttcacctatgttgccccgagtgtcctagagtcagtgaaggaaaagttcagctttgagcctaagataagatcacccagacggttcattggtagccctaggaccccagtctcacctgttaagtttagtcccggggacttttggggccgcggtgcaagtgctagcaccgccaatccccagactcctgtcgaataccccatggagactagcggcattgagcaaatggatgtaactatgtcaggagaggcatctgcccctttgcccatccggcaaccaaactcagggccttataaaaagcaggcgttccccatgatttccaagaggcccgagcatctacgcatgaatctctag

SEQ ID NO: 17209 - DNA, 1356 bp, Artificial Sequence
  Description of Artificial Sequence: Synthetic coding sequence
atgcgcaggcggaggcgtagagacggtttctacccggctccggatttccgcgaccgcgaggcggaggatatggctggagtgtttgatattgatcttgaccagccagaagacgccggaagcgaggacgagctggaagagggaggtcaactgaacgagtctatggaccatgggggcgttggaccttatgagctgggcatggagcattgcgaaaagttcgagataagtgagacgagcgtaaacagagggcctgagaagatccggcccgaatgcttcgaactccttcgtgtgctgggaaaggggggttatgggaaggtcttccaggtccgcaaggtcaccggcgctaatactggcaagatctttgcaatgaaggttctcaagaaggcaatgattgtccgaaatgctaaagatacagctcacactaaagccgaacggaacattctggaagaggtcaagcacccattcattgttgatctgatctacgccttccagaccggaggaaaattgtaccttatacttgagtatctaagtggaggcgaactgttcatgcagcttgaaagggagggaatcttcatggaagatacagcctgcttttatctggctgagatttctatggctcttggacacctgcaccagaagggaattatctaccgcgatctcaagccagaaaatatcatgctgaaccaccaagggcacgtgaagttaaccgactttggtctctgcaaggagtccatccacgatgggactgtgacccataccttctgtgggactatcgaatacatggctccggagatactaatgagatccggacataatagggccgtggactggtggtccctgggtgccctgatgtatgatatgcttaccggcgctccgccattcactggcgaaaacaggaagaagacaatcgacaaaattctcaaatgcaaacttaatctgcctccatatctgactcaggaagccagggatctgctgaaaaagctgctcaagagaaatgcggcatcacggctgggtgcaggccccggtgatgctggtgaggtgcaagctcatccctttttccggcatatcaactgggaggaacttctggcccggaaggtagagccccctttcaagcctctgttacagagcgaagaagacgtgagccagtttgacagcaagtttacccggcagaccccggtggacagccccgatgactccactctctccgaaagtgccaatcaagtcttcctcgggttcacatacgtggcgcctagcgtactcgaatcggtcaaagagaaattctcttttgaacctaaaatccgctcacccaggcggttcattggatcacccaggacccccgtgtctacagccatgtgctag

SEQ ID NO: 17210 - DNA, 1509 bp, Artificial Sequence
  Description of Artificial Sequence: Synthetic coding sequence
atgcgaaggaggagaaggagagacggcttttaccccgcccccgactttcgcgatagagaagccgaggatatggctggcgtgtttgacattgatcttgaccagcctgaagacgctgggtcagaggatgagcttgaggagggaggtcaacttaacgaaagcatggatcacggaggcgtcggcccttatgaactcggcatggagcattgcgagaaatttgagatttctgagacgtcagttaaccgcgggccagaaaagattcgtcccgaatgtttcgagctcctcagggtgctcggaaaggggggatacgggaaggctatgattgttaggaatgctaaggacactgctcacactaaagctgaaaggaatattttggaggaggttaaacacccatttattgttgatttaatatacgcgtttcagactggcggcaaactctacctgatcctggagtatctctctggcggcgaattgtttatgcagttggagcgcgaggggatatttatggaggatacagcttgtttctacttagccgagatcagtatggctctagggcatctccaccagaagggcatcatctatcgcgacctgaaacctgagaacatcatgctgaaccaccagggacatgtgaagctgacagactttggtctctgcaaagagtctattcatgatggcacggtgactcacactttttgtggaactatcgagtacatggctcccgagatactcatgcgctccggccacaacagagcggtggattggtggtctctgggggccctcatgtatgatatgctcactggagcgcctccctttacaggagaaaacagaaaaaaaactatagacaaaatccttaagtgcaaactgaacttgcccccttatctgacacaggaagcacgtgacttgctgaagaagcttctgaaacgaaacgccgcatcacggctgggcgctgggcctggagacgccggagaggtgcaggcccaccctttcttccggcatatcaattgggaggagctcctggctcgaaaggtcgagcctccatttaaaccacttctccagtccgaggaggacgtgagccagtttgatagcaaatttactcggcagacccccgtagactcacccgatgactccaccctgtctgaaagcgctaatcaggttttcttggggtttacatatgtggcaccttctgtgctggagtcagttaaagaaaagttcagctttgaacccaagattaggtctccacgacgattcatcgggtcacctcgcacccccgtatcccctgttaaatttagtcctggtgacttttgggggcgtggcgcatcagcgagtacagctaatcctcagacacccgtggagtacccaatggagacttccggcatcgaacagatggatgtgactatgagcggggaggctagtgctccactgcctatccgtcagccaaactccggcccatacaagaagcaggcgtttcccatgatctccaagcgcccggagcacctgcggatgaacctgtag

SEQ ID NO: 17211 - DNA, 1932 bp, Artificial Sequence
  Description of Artificial Sequence: Synthetic coding sequence
atgaaggttctcaagaaggctaccctgaaagtcagagaccgggtgaggacaaagatggaacgagatatcttggccgatgttaaccacccctttgtggtgaaactgcactatgccttccagaccgagggcaaactttacctcatactggattttctgagaggaggtgacctgttcactcgcctctcaaaagaagtgatgtttactgaggaagacgtgaaattttacctagccgagctcgcgctcggtctggaccatctccattcgctgggcattatctatcgcgacctgaaaccagaaaacattcttctcgatgaggaggggcacataaagcttacagactttggactttctaaagaggctattgaccacgagaagaaagcctacagtttctgtgggactgtagaatacatggctcccgaggttgtgaaccgacagggacatagccattctgcagattggtggtcctacggcgtgcttatgttcgaaatgcttacagggtctcttccgttccaagggaaggatcggaaggagactatgacactgatcttgaaagccaaactggggatgccgcagtttctatcaacggaggcacagtctctcttgcgcgctttgtttaagcgcaacccagccaaccgccttggatctggaccagatggcgccgaggaaattaagaggcacgtcttttactccacaatcgattggaacaagctttacaggcgcgagattaaacccccctttaaacctgctgtggcccagcccgacgacacattttactttgatacggaattcacaagccggacacccaaagactctcctggcattccacctagcgcgggggcacatcagttattcaggggttttagctttgtggctaccgggcttatggaggacgatggcaaaccccgcgccccccaggcaccacttcactcagtggtccagcagctgcatgggaagaatcttgtctttagtgatggctatgtagttaaggagaccattggggtgggcagctatagcgaatgcaagcgctgcgttcacaaagcgactaatatggagtatgccgtgaaggttatcgataagagtaagagagaccccagcgaggaaattgaaattttgcttcgatacggacaacatcctaatatcataaccctgaaggatgtttacgacgacggtaaacacgtgtacctggtgaccgaactaatgcgcggcggggagctattggacaaaatcctcaggcagaagtttttttctgaaagagaagcaagtttcgtcctccacactattggcaaaaccgtggagtacttgcactcacagggcgtcgtccatcgtgaccttaagccctccaacatattatatgtggatgaatccggaaacccagagtgtcttcggatttgtgactttggtttcgccaagcagctgcgcgcagagaacggactgttgatgacaccctgttatactgctaactttgtggcacccgaggtcttgaaaaggcaaggatacgacgagggatgtgatatttggtcacttggtattttgctgtacaccatgttggccgggtatacccccttcgccaatgggccgtctgacacccccgaagagatcctgacccggattgggtccggtaagttcactctatccggaggaaattggaataccgtatccgaaactgctaaggacctcgtgagtaagatgctgcacgtcgatcctcatcagcgcctgactgccaagcaggtgctccagcatccatgggttactcagaaggacaagctccctcaatcccaactgtcacaccaggatctccaactagtgaagggagcaatggcagctacgtactctgcgttaaactcctctaaaccaaccccccagctgaagccaattgagtccagcatcctcgcccagcggcgcgttcgtaaattacccagtaccacactgtag

SEQ ID NO: 17212 - DNA, 687 bp, Artificial Sequence
  Description of Artificial Sequence: Synthetic coding sequence
atgccgcagttcctgtccacagaggcccaatcgttattgcgcgccttgtttaaacggaaccccgcaaaccgactaggctcaggccccgacggggccgaagaaattaagaggcacgtgttctattccactatagactggaacaagctttatagaagggaaattaaacctccattcaagccagctgttgcacagcccgatgatacattttactttgatacggaattcacatcgcggacaccaaaggattcacccgggatccctccgtcggccggcgctcatcaactgtttcgcggcttttccttcgtagcgacaggactaatggaggatgatggaaaacccagagcacctcaagcccccctgcatagcgtggtgcaagtgattgacaagagcaaacgtgaccctagcgaggagattgaaattctgttgcgctatggacaacaccctaatatcatcactcttaaggatgtctatgatgatggtaaacacgtgtacctcgtcaccgaactgatgcgcggcggagagcttctcgacaagattctgagacagaaatttttctccgagcgcgaggcatcctttgtgctgcatacgatcggaaaaactgtggagtacctgcatagtcaaggagtagtccacagagatcttaagcctagcaacattctttacgttgacgagtctggtaacccttag

SEQ ID NO: 17213 - DNA, 2208 bp, Artificial Sequence
  Description of Artificial Sequence: Synthetic coding sequence
atgcccctggctcagcttaaggagccctggcccctaatggagctagtccctctggacccagagaatggccagacaagtggagaagaggccggcttgcagccctctaaggatgaaggagtgctaaaagaaatctcaatcacccatcatgtcaaggctgggtctgagaaggcagaccctagccatttcgaattgctgaaagtcttgggccagggatcttttggcaaagtgttcttagtaaggaaagttacaaggccagactctggccacttgtatgcaatgaaagtcctcaaaaaggccactctgaaggtacgcgaccgagtcagaactaaaatggaacgagatatcctcgccgatgttaatcatccatttgttgttaagctacactatgcattccagacagaggggaagctgtacctgattctggattttctgcgtggcggagacttgttcactcgcttgagcaaagaggtaatgttcaccgaggaagacgtcaaattctaccttgctgagctcgctctcggcctggatcacctgcattctctgggcattatttatcgggatctgaagcctgaaaatatcctgttggatgaggaggggcacattaagctcaccgatttcgggctgtctaaggaggctatcgaccacgagaagaaggcctacagcttttgcggtaccgtggagtacatggcaccagaagttgtgaaccgtcagggacattctcactccgccgattggtggtcatacggcgtcctgatgtttgagatgctaaccggcagcttacccttccagggtaaggacagaaaggagaccatgaccctgatcctgaaggccaagctggggatgccccagtttctgtcaacggaggcgcaaagcttgctcagggcgctttttaagaggaaccctgctaaccggctggggagtggaccggatggagcggaggaaatcaaacgccatgtcttttattcgacaatcgactggaataaactctatcggcgcgagatcaagcccccatttaagcccgctgtggctcagcccgacgacacattttattttgacacagagttcacctcaagaacacccaaagatagccccggcatcccaccttctgctggcgctcaccagctgttcaggggatttagctttgtcgcaacggggctgatggaggatgacggcaaacctcgcgcaccacaggccccactccattccgtagtgcaacaactgcatgggaaaaatcttgtgttctcagacgggtatgtggtgaaggaaacaattggcgttggatcctactccgagtgtaagcggtgtgtgcataaagctaccaatatggaatacgctgtgaaagtcatcgacaagtccaaaagagacccatcggaagagatcgagattttgctgcgatatggtcagcatcccaatataatcacactgaaggacgtctacgacgatggaaagcatgtgtatctggtgactgaattgatgcgtggaggagaactgcttgacaaaatcctgcgtcaaaagttcttcagcgagcgcgaggccagtttcgtgctgcacaccattggaaagacagtggagtatctacactcacagggcgtcgttcatagggacctgaaaccctccaatattctgtatgttgatgagagtggaaacccggagtgtctgcggatctgcgacttcggttttgccaaacagctccgtgcggagaatgggctcctgatgaccccatgctataccgcgaattttgtcgctcccgaggtcctgaaacgacaggggtatgatgaaggatgcgatatctggtccctggggattctactctacaccatgctagcagggtacactccattcgccaatggaccttccgacaccccagaagagattctcacaaggatcggctcaggaaagtttaccctttctggaggtaattggaataccgtcagcgaaactgccaaggatttagtgagcaagatgttgcacgtggatcctcatcagagattgacagcaaagcaggtgctgcagcatccttgggtgactcagaaagataagctaccacagtctcagttgagccatcaggacctccagctggtgaaaggggcaatggccgccacttattcagctctcaactcatccaaaccaacccctcagttaaaacccatcgaatctagcattctcgctcagcgtagagttcgcaaactcccaagtactactctctag

SEQ ID NO: 17214 - DNA, 501 bp, Artificial Sequence
  Description of Artificial Sequence: Synthetic coding sequence
gcacagcccgatgacacgttctactttgataccgaattcacttcgcgcacccctaaggatagccctggcattccgccaagcgcaggcgcacatcagctttttcggggcttcagctttgtggctacagggctcatggaggatgatggaaagcccagggctccgcaggccccacttcattctgtagtgcaagtgattgacaaatcaaaacgggatcctagcgaggaaatcgagattcttctgcgttatgggcagcatcccaatatcataacgctcaaggatgtatacgacgatggaaagcacgtctacctggtgaccgagttgatgcggggtggagaactcctcgacaaaattctgagacaaaagtttttttccgagagagaggcttctttcgtcctgcataccatcggaaaaacagtggaataccttcactcccagggggtggtgcaccgagatttgaagccctcaaatatcctgtatgtggacgagtccggcaacccttag

SEQ ID NO: 17215 - DNA, 2160 bp, Artificial Sequence
  Description of Artificial Sequence: Synthetic coding sequence
atgcagaccccagctgatttccctcgagtggaaagagaccttgttccttgcccaagaaaggatgagggggttctgaaggaaatttctattacacatcacgtcaaggccggttccgaaaaagccgacccctctcacttcgagctcctcaaggtgctcggccagggcagctttggcaaggtgttcttggtgcgaaaagtaactaggccggacagcggacatctgtacgcgatgaaagtgctcaagaaggcgaccttaaaagtccgtgacagggtgcgaactaaaatggagagggatatcctcgctgacgtgaatcacccgttcgtggtgaagctgcattatgcttttcagaccgaaggcaaactctacctgatcctagatttcctcagaggaggcgatttgttcacacggctgtccaaggaagtgatgttcacggaagaggacgtgaagttttatctcgccgagctggctctgggcctcgaccatctacacagtctgggcattatctaccgggaccttaagcccgaaaatattctgttagacgaagaggggcatatcaagctaaccgatttcggcctgagcaaagaggcgatagatcatgagaagaaagcctactctttctgtgggaccgtagagtacatggctccggaggttgtcaaccgccagggtcacagccactctgcagattggtggtcctatggcgtgctgatgttcgaaatgctcacgggctccttacctttccagggcaaggacaggaaagaaacaatgactcttatcctaaaagccaagctgggcatgccgcagtttctgtctaccgaagcacagagcctgttgcgggccctgttcaagcgcaatcctgccaatcgcctgggctctggacccgatggcgcggaagaaatcaagaggcatgtgttttactctaccattgactggaataaactgtacagacgggagatcaagccacctttcaaaccagcagtggcgcaaccagatgacactttttactttgacaccgaattcactagccgcacaccaaaagacagccctgggatccctccctccgccggggctcaccagcttttcagaggattctcgttcgtggccaccggcctcatggaggacgatggtaaaccgcgcgcaccgcaggcgcccctgcactctgtagtgcaacagttgcatggaaaaaatctggtcttctctgatggctatgtcgtgaaagaaactatcggagttggatcatatagcgagtgcaaacggtgtgtgcataaagctactaatatggagtatgccgtgaaggtgatcgacaaaagcaaaagagacccctccgaggagatcgagattctgctgcgctacggccagcatccaaacatcatcactctgaaggatgtgtacgacgatggtaagcatgtgtatctagtgacagagcttatgcgaggaggtgagctgctggacaagatcctgcggcagaagtttttctctgagcgagaggctagctttgtactgcatactattggtaagacagtggagtatctccacagccaaggcgttgtgcacagggatctgaagccgagcaacattctttatgtcgacgaatcaggaaatcctgagtgcctccgcatttgcgattttggtttcgctaaacagctgcgagcagagaacggcctgctcatgaccccatgttatactgcaaattttgtcgctccagaggtgctgaaacgccaagggtacgatgagggttgcgacatctggtctcttggaatactcctgtacaccatgctggccggatacactccgttcgccaatggacctagcgacactcccgaagagattctgactcggataggctcaggtaagttcacgttatcgggcggtaattggaatacggttagcgaaaccgctaaagatctcgtttccaaaatgctccatgtcgaccctcatcagagattgaccgccaaacaagtcctgcagcacccttgggtgactcagaaggataagttgccgcagtctcagctctcacaccaggatttgcagttagtaaagggggcgatggccgcaacgtactccgccctgaactcgtctaagccaaccccacagttaaagcctattgagtccagtatactggcacaaaggagagttcgtaagttgccctccaccacattatag

SEQ ID NO: 17216 - DNA, 2202 bp, Artificial Sequence
  Description of Artificial Sequence: Synthetic coding sequence
atggacctgtctatgaagaaatttgcagtgagaagattttttagtgtgtacctcaggcgcaagagccggagcaagtctagttcactgagtcggctggaagaagagggggtggtaaaggaaatcgacattagccatcacgtgaaagaagggttcgaaaaagcagacccgtcccagttcgaactgctgaaagtgctcgggcaaggctcttatggaaaagtcttcctcgttcggaaagttaaaggtagcgacgcaggacagctgtacgccatgaaggtgctgaagaaggctacactcaaggtcagggatcgcgtgcgatcaaaaatggaacgtgatattctcgctgaggttaatcacccctttatcgtgaaattacattatgcttttcagaccgagggcaaactatacctcattctggatttcctccgaggtggcgacctcttcactagacttagcaaagaagtcatgtttacggaagaggatgtcaagttctacttagcggaactggcccttgctctggaccatctacacagtttggggatcatctacagggatctcaagcccgaaaacatactcttggatgaggagggccatattaagattactgatttcggcctgagcaaggaggccatcgatcatgataaaagggcttattccttttgcggtaccatcgagtatatggctcccgaagtggtcaaccgccgtggccacactcagagcgccgactggtggtcattcggcgtcttgatgtttgagatgctcacgggttctcttccttttcaaggcaaggaccggaaggagactatggctctcatacttaaagcaaagctgggcatgccgcagttcctctccggggaggcccagagtctgctgagagcactcttcaagcgcaacccatgcaataggctgggcgccggcattgatggggtggaggagataaaacgccacccgttctttgtcacaattgattggaataccctataccgcaaagagattaagccaccgttcaaaccagccgttgggcgccccgaagataccttccattttgatccggagttcactgcaaggaccccgaccgattcgcctggcgtacccccatcagccaatgcccaccacctcttccgaggatttagcttcgtggcttcctctctgatccaggagccaagccaacaggatctacacaaagtacctgttcacccaattgttcaacagctgcacggaaataacatccacttcactgatgggtacgaaataaaagaagacataggtgtagggagctacagcgtgtgcaagcgctgtgtccacaaagccaccgatacagaatatgctgtcaagatcattgataagagtaaaagagatccatccgaggaaatcgagattctgctcaggtacggccaacaccctaacattataaccttgaaggatgtctatgatgatgggaagttcgtgtacctagtcatggagttgatgcgggggggggagttgttagatcgtatcttgcgccaaagatacttcagtgaacgagaagcctccgatgtgctgtgcacgattacaaagactatggactacctccacagccagggtgtcgtccacagagaccttaaacctagcaacatactgtaccgagacgagagcggcagtccggagtcaataagagtatgtgatttcgggttcgccaagcagcttcgcgcgggaaacggtctcctgatgacgccatgttacaccgcaaactttgtggcccctgaggttctgaagcggcaaggctatgacgcagcatgcgacatctggtctctgggaattttgctgtacacaatgctagctggttttaccccgttcgcaaatggacccgatgatactcccgaagaaattctcgctagaatcggatctggcaagtatgcgctctctggcggcaactgggactccatcagcgacgctgccaaggatgttgtgagcaagatgctgcacgtagaccctcaccaaagactgaccgctatgcaggttctgaaacacccgtgggtggtgaatagggagtacctcagtcccaaccaactgagtcggcaagatgtgcacctggtgaagggggcaatggctgccacgtatttcgcactgaacaggacaccacaggccccccgcttggagcctgtcctgtcttccaatctagcccagcgcagaggcatgaagcgcctcacctcaacacggctgtag

SEQ ID NO: 17217 - DNA, 501 bp, Artificial Sequence
  Description of Artificial Sequence: Synthetic coding sequence
atgttcactgaagaagacgtcaaattttacctcgctgagctggcacttgctttagatcatcttcatagcctggggattatctacagagacctgaagccagagaacatcctcctcgacgaggaggggcacatcaaaattacagatttcggcctctcaaaagaggctatcgatcacgataaacgggcttattctttctgtgggactatagagtacatggcacctgaagttgtgaacagacgcggacacactcagtctgcggattggtggagttttggagtgctgatgttcgagatgttgaccggctcactgcctttccagggcaaggataggaaggagacaatggcacttatcctcaaagccaagttggggatgcctcagttcctctcaggcgaagcccaatctctgctgagagcattatttaagcggaatccctgcaaccggttaggggagaagaccgccttgtgtccacgcgtgagctgctcccgactgttaggcttttag

SEQ ID NO: 17218 - DNA, 1935 bp, Artificial Sequence
  Description of Artificial Sequence: Synthetic coding sequence
atgaaagtcctgaaaaaggccacattgaaagtgagagacagggtgaggagcaagatggaaagggatattcttgctgaggtgaaccatcccttcatagtaaaactgcactacgcgtttcagaccgaaggtaaactgtatctcatcttagacttcctgcggggtggtgatctgtttaccaggctctccaaagaggtaatgttcactgaggaggacgtgaaattctacttggcagagctggcccttgccctggaccatctgcattctctgggcatcatctaccgcgatttgaagccagaaaacatcctacttgacgaagagggacacatcaagatcacagattttgggctgtcaaaagaagccatcgatcacgataaaagggcgtactccttttgcggaactatcgagtatatggctcccgaagttgtgaacagaagagggcacacacagtccgccgactggtggtccttcggggtgttaatgtttgagatgttgacgggctccttgccatttcaggggaaggataggaaagaaactatggcccttatccttaaggcaaaacttgggatgcctcagttcttgtccggagaggcccagtccctgctcagagccttattcaaaaggaacccttgcaatcggctcggcgctgggatcgacggcgtagaagaaatcaagaggcaccccttttttgttaccattgattggaatacattataccggaaggagattaaaccacctttcaaacccgcagttggccgacctgaagacacattccactttgaccctgagttcactgccaggacccctactgactcccccggggtgccaccttcggctaacgctcatcacctgtttcgcggatttagctttgtcgcctccagcctcatccaagaaccctctcagcaggatttgcacaaggtgccagttcaccccattgtgcagcagctgcatggcaacaatatccacttcactgatggatacgaaataaaagaagacatcggggtcgggtcctactctgtctgtaaacggtgtgtccataaggctactgacaccgagtatgccgtgaagatcattgataaaagcaagcgagatccctccgaagagatagagattctgctcaggtatggccagcaccctaatataatcacactcaaagacgtgtacgacgacggcaagttcgtttacctggtgatggagctcatgcgtgggggtgagctcctggaccgaatactgcgtcagcgatatttttctgagagagaagcaagtgacgtcctctgtaccattaccaaaaccatggattaccttcattctcagggcgtcgtgcacagggacctgaagcctagcaatattttatacagagatgagagtggaagtcccgagagcatccgcgtctgcgactttgggtttgctaagcagctccgggcgggaaacgggctgctcatgaccccctgttacacagcaaatttcgtcgcgccggaggtgctgaaacggcaaggctacgacgcagcttgcgacatctggtccctcggtatcctcctgtacaccatgctcgccggctttacccccttcgccaatggacctgatgacacccccgaagaaatcctggcgaggataggcagtgggaagtacgcactgtcgggtggtaactgggattccatttccgacgcagctaaagacgtcgtgtcaaagatgcttcacgtcgatccacaccagcggctgaccgctatgcaggtactaaagcacccatgggtcgtgaatcgggaatatctgtcacctaatcaactgagcaggcaagacgtgcacttggttaaaggggccatggccgccacttattttgctctgaacagaacacctcaagctcctagattagaacctgtactgtcatctaacctcgcccagcgtagaggaatgaaacgcttaacaagcaccaggctttag

SEQ ID NO: 17219 - DNA, 1935 bp, Artificial Sequence
  Description of Artificial Sequence: Synthetic coding sequence
atgaaagttctgaagaaggcgacattaaaagtccgtgacagagtgcggtcaaaaatggagagagacatcctggcagaggttaaccatcccttcattgtgaaactgcactacgcctttcagaccgagggcaaactctatttaatcttggactttctgcgcggtggagatctgttcactcggttgagcaaagaggtgatgtttacggaagaagacgttaaattttatctggctgagctagctctggccttggatcatctccattcactgggcattatttaccgcgacctcaaacccgaaaatattctgctggatgaagaaggccacatcaagatcacagactttgggctatccaaggaagctattgatcacgacaaaagagcttatagtttttgtggaaccatcgaatacatggcccccgaggtcgtgaatcggagaggccatacccagagcgccgattggtggtcatttggtgtgctgatgttcgagatgttgacgggcagcctcccattccagggcaaagacagaaaagagaccatggcattaattcttaaggcaaaattaggaatgcctcaattcctctccggggaggcccagtcattgctgcgcgccctctttaagagaaatccttgcaatagactaggcgccggcatagacggagtggaggaaatcaagagacatccgttctttgttactattgactggaataccctgtacaggaaggagataaaaccccccttcaagcccgctgtgggtcggcctgaggacacatttcattttgacccagaattcaccgcgcgcacaccgacagactctccaggtgtgcccccttctgcaaatgcacatcacctcttcagaggctttagttttgtcgcaagctccctgatccaagaaccatcacaacaggatctgcataaagttccagttcaccctattgttcagcagctccatgggaataatatccacttcaccgacggctatgaaattaaggaagatatcggggtcggcagctatagtgtctgcaaacggtgtgtgcacaaggcaaccgataccgaatacgccgtcaagatcattgacaagtctaagcgggatccatccgaagaaatcgaaattctcttaagatacgggcagcacccaaacatcatcactctcaaggacgtgtacgatgacggaaagttcgtgtatctggtgatggagctgatgcgcggcggcgagctgttagatcggatactgcgccagagatacttcagtgagcgggaggcatccgatgtgctgtgtaccattacaaagaccatggattatctccatagccaaggggtggttcaccgagatctgaaaccatcaaatattctgtatcgagatgagtccggctcgcctgaaagtattcgggtgtgcgacttcggatttgccaagcagctccgggctggaaatggccttctcatgaccccatgttacacagccaatttcgtggcgcctgaagtgctgaagcgccaagggtatgatgcggcctgtgacatatggagccttgggatcctcttgtacaccatgcttgccgggtttactccattcgcaaatggacccgacgacacgcccgaagagatactagcgcgcatcggcagcgggaagtacgcgttgagtggtggcaattgggacagcattagtgatgcggccaaggatgtggtgagcaagatgctgcacgtggatcctcaccaaagattaactgctatgcaggttctgaagcatccttgggtggtgaatcgcgaatacctgagccctaaccagctgtcccgacaagatgtccacctggtaaagggagccatggccgctacctacttcgctcttaacaggactcctcaggcaccaagactggaacctgtgttatccagcaacctggcccaacgaagagggatgaagcgcctaacctcaactaggctgtag

SEQ ID NO: 17220 - DNA, 2226 bp, Artificial Sequence
  Description of Artificial Sequence: Synthetic coding sequence
atgcctatcgctcagctattggagttgtggaaaaagatcgaagtggaacccatggagattgagactaccgaagaagacttgaatctggatgtggagccaactaccgaggataccgcagaggaggaagagggagtcgtgaaagagatcgatatcagtcatcatgtgaaggagggattcgagaaggccgaccccagccaatttgaattgctgaaagtgctaggccagggcagctacgggaaggtgttcttggttcggaaagtgaaaggaagcgacgctggccaactttacgccatgaaggtgctgaaaaaggccaccctcaaggtgcgtgatcgggtgcgctccaagatggagagggacatcctggccgaagtgaatcaccctttcattgtgaagcttcattacgccttccaaaccgaggggaaactgtacctgatcttggattttttgaggggcggagatttgttcactcgtctgtcaaaagaggtcatgttcaccgaagaagacgttaagttttatctggccgaactggctttggcactcgatcatctgcactctctggggataatctatagagacctgaaaccagagaacatccttctggacgaagagggccatataaagatcacagactttggactttcaaaggaagccatcgatcatgacaagcgggcctactcattttgtgggacaatagaatatatggcgcccgaggtcgtgaaccggaggggacacactcagtccgccgactggtggagttttggagtgctgatgtttgagatgttgaccggatccctcccgttccagggcaaagacagaaaagagaccatggccctgatactaaaagccaagctcggcatgccacagtttcttagcggagaagcccagagcctgcttcgggccctctttaaaagaaacccatgtaatagactgggtgcaggcattgacggagtcgaggaaataaagcgccacccatttttcgtgacaatcgactggaatacactgtatcgtaaagagattaagcctcctttcaagccagcagtgggccgtcccgaggataccttccattttgatcctgagtttactgcaagaacacctaccgatagccctggcgtgcccccttcagccaatgcccatcatctgttcagggggtttagcttcgtggccagcagccttatccaggaaccatcacagcaggatttacacaaggtaccagtgcatccaattgtgcagcagctgcatggcaacaacattcattttacggatggctacgaaattaaggaggacatcggagtgggtagttattccgtgtgtaaacggtgcgtccacaaagccacagatacagagtacgctgtgaaaatcatcgacaagtccaaaagagatccctcagaagaaatcgaaatattgttgcgctatggacagcaccccaacatcattaccctgaaggacgtctacgacgacggcaaatttgtgtacttagtcatggaactcatgcgcggcggtgagctgctggaccgtatcctgaggcagagatactttagtgaaagagaggcgtcagacgtgttgtgtacaattacaaaaaccatggactatctgcactctcagggtgtggtccatagggacctgaaaccctctaacatactgtaccgcgacgaatccggctcacccgagagcattcgcgtgtgtgactttggctttgcaaagcagctgcgggcagggaatgggctactgatgacaccgtgttacacagctaattttgtagcaccagaagtcctcaagagacaaggttacgatgccgcatgcgacatctggtccctgggaatcctactttacacaatgctggctggattcactccttttgctaacggtccagacgacacacccgaagagattctggctcggattggatccggtaaatacgccctcagcggtggcaactgggacagtatcagcgacgctgctaaggacgtcgtatcaaagatgctccacgtagatcctcaccagagattgaccgctatgcaggtccttaagcatccatgggtggtgaaccgcgagtacctgtcacctaaccagctgagcagacaggacgtccacctggtcaagggcgccatggctgcaacttatttcgctctcaatcggacacctcaggcccctaggctggaacccgtactgtccagcaatcttgctcagaggaggggcatgaaaaggctgactagcacccggctctag

SEQ ID NO: 17221 - DNA, 516 bp, Artificial Sequence
  Description of Artificial Sequence: Synthetic coding sequence
atgccgattgctcaattgctggaactgtggaagaagatagaagtggaaccgatggagatcgaaactacagaggaggacctgaatctcgacgtggagcccactaccgaagatacagcagaggagggaaaatccgacagtgccgcctgcaaaacaaaggttgctgggagcgtggaggaggaaggggtggttaaagagattgatatatcacaccacgttaaggaggggttcgaaaaggctgaccctagccagttcgagctacttaaggtgttaggtcaaggcagttacgggaaggttttccttgtaagaaaggttaagggctctgatgccggccagctgtacgcgatgaaggtgttaaaaaaggccacactgaaggtacgtgatagagttagaagcaaaatggagagggatattttagccgaggtgaatcacccgttcatcgttaaactgcactatgccttccagacagagggcaagctgtacctcatcctggacttcttgagagggggagacctgtag

SEQ ID NO: 17222 - DNA, 2277 bp, Artificial Sequence
  Description of Artificial Sequence: Synthetic coding sequence
atgcccattgctcagctcctggagttgtggaagaagatcgaggtggaacctatggaaattgaaaccaccgaggaagatctgaacctggacgttgagcctacgacagaggatacagcagaggagggtaaatcggacagcgcagcctgtaaaacaaaagtggctggatcagtggaggaggagggggttgtcaaagagatagatataagccaccacgttaaagagggctttgaaaaggccgatcctagtcagttcgagttactgaaagtgctggggcaaggatcttatggaaaggtctttttagtacgaaaggtaaaaggatctgacgccggacagctttatgctatgaaagttctgaagaaagccactctgaaagtcagagacagagttcggagtaaaatggaaagggacatcctggcggaagttaaccacccattcatcgtgaagctccactacgctttccagactgaaggcaaactgtatctcatcttagactttctgcgggggggcgatctattcacacggctgtccaaagaggtgatgttcaccgaagaggacgttaaattctatctggcggagctcgccctagcgctggaccacctgcactcactgggaattatctacagagacctgaagccagagaatatccttttggatgaggaagggcacattaaaatcacagattttggactttcaaaagaggccattgaccacgacaagcgagcatattcattttgtgggaccatcgagtatatggctcctgaagtggttaatagacgtggacacactcagtcagccgactggtggagtttcggcgttctgatgttcgagatgctgacggggagtctcccttttcaaggaaaggacaggaaagagaccatggccctcatactcaaagcaaaactgggcatgccacagttcttgagcggcgaagctcaatccctgctgagggcactcttcaaaagaaatccctgcaaccgattgggagcaggcatagatggggtcgaagagatcaagcgccacccttttttcgtgacaatagattggaatactctctaccgaaaggaaatcaagccccctttcaaaccagcagtaggacgccctgaagatacctttcatttcgatccagaatttacagctaggaccccaactgactcacctggcgtaccccccagtgctaatgctcaccatcttttccgaggattctcctttgtggcctccagcctgattcaggaaccatcacagcaggacctgcacaaagtccctgttcatcccattgtccaacagctgcacggaaataatattcactttactgacggctacgaaatcaaggaggatattggcgtgggtagttatagcgtgtgtaaacgctgtgtgcataaagcgacagacactgagtacgccgttaagattatcgataaatctaagagggacccttcagaagagattgagatcttgctacgctatggccagcaccctaacattatcaccttgaaggatgtgtatgatgatggtaaatttgtatatctggtaatggagctgatgagaggaggagaactgctggaccgaattctccgacagcgatatttcagcgagagagaagcaagtgatgtgttatgcacgattaccaagaccatggattatttgcactcccagggtgttgtgcaccgcgatttgaaaccctccaatatcctgtacagggacgagtctggatcccctgaatctataagggtgtgtgacttcggattcgccaaacaacttcgtgccggaaacggtctgctgatgaccccttgttatactgccaattttgtggcccctgaggtcctgaagagacaggggtatgatgccgcttgcgacatttggagtctcggtatcctgttgtataccatgctggcagggttcaccccctttgctaatggtccggacgacacgcctgaggaaatcttggctcgcatcggttctggcaaatacgccctctccggagggaactgggactcaatttcagatgcagctaaggatgttgtgagcaaaatgctgcatgtcgacccacaccagcgcctgacagccatgcaggtgctcaaacatccatgggtcgtaaatcgggaatacctctctccaaatcagctctcccgccaggacgtccatttagtaaaaggcgctatggccgcaacatatttcgccctcaatagaaccccccaggccccccggctggagccagtgctgagtagcaatctcgcacagagaagaggaatgaaacggctgactagcaccagactgtag

SEQ ID NO: 17223 - DNA, 888 bp, Artificial Sequence
  Description of Artificial Sequence: Synthetic coding sequence
atgagtggagccctggacgtgttgcagatgaaagaggaggatgtcctcaagttcctggctgcaggcacccacttaggagggacaaatctcgattttcaaatggagcagtacatctacaaacgaaaaagcgacgggatatatatcattaatttgaaacgaacgtgggagaaactgttgctcgccgctcgagccatcgtagcaatcgaaaatccggccgatgtctcagtcatctcctccagaaacacaggtcagcgggccgttctaaagtttgcggccgccaccggagccaccccaatagctggacgtttcacgcccggcactttcacaaatcagattcaggctgcttttcgcgaaccaaggctgctcgtggtgactgatccaagagccgatcaccagccgcttactgaggctagctatgtaaatctgcccacaatcgcgttatgcaacaccgactccccactccgatatgtcgacatcgccatcccatgtaataacaagggagcccattctgtgggtctgatgtggtggatgctagcccgtgaagtacttagaatgaggggaaccatatcacgcgagcacccctgggaggttatgcctgacttatacttttatcgcgacccagaggaaatcgaaaaggaagagcaagccgcagccgaaaaggcagtgaccaaagaagagttccaaggagaatggaccgctcctgctcctgaatttacggcaacacagcccgaagtggctgactggtcagaaggagtgcaggtcccaagcgtgcccattcaacaattccccaccgaagattggtccgctcagccagctacggaagattggagcgccgcccctacagcacaggccaccgaatgggttggagcgactaccgactggtcctag

SEQ ID NO: 17224 - DNA, 795 bp, Artificial Sequence
  Description of Artificial Sequence: Synthetic coding sequence
atgtcaggcgctctggatgtccttcagatgaaggaagaagacgttctcaaatttttggctgcagggacccatctgggcgggacaaacctggattttcaaatggagcagtacatctataagcgcaaatctgatggaatatatattattaatttgaagaggacgtgggaaaaactgttgctcgcagcgagggctattgtggccattgaaaaccccgcagacgtgtctgtcatcagctcccggaacacaggacaaagggctgtgttgaagttcgctgcggccaccggcgctacccccatcgccggcaggttcacacccgggacttttactaaccaaatccaggccgccttccgagaaccacgcttgctggtggtcacggatcctcgggccgatcaccaaccccttacagaggcctcttatgtgaatctgccaaccatcgccctgtgtaatactgacagcccgttaaggtacgttgatattgctattccctgcaataacaaaggcgcccactccgtggggttgatgtggtggatgctggcccgggaggttcttcgcatgcgcggcaccatcagccgagagcacccctgggaagtcatgcctgatctgtacttttatagggatccagaggagatcgagaaggaggagcaagcagctgctgagaaagccgtcacaaaagaggaatttcaaggtgagtggactgcaccagcacccgagtttactgcgacgcaacctgaggtggcagactggtctgagggagtgcaagttccctccgttccgatacagcaatttccaacgtag

SEQ ID NO: 17225 - DNA, 1458 bp, Artificial Sequence
  Description of Artificial Sequence: Synthetic coding sequence
atgggggagcctgggttcttcgtaactggagatcgggcaggtggaagaagctggtgtctccggcgggtcggcatgtcggccgggtggcttcttctcgaggatggctgcgaagtgaccgtgggccgcggattcggcgttacctaccagctggtaagtaagatttgccctctaatgatcagtagaaaccactgcgtgttgaagcagaaccctgagggccaatggactattatggataataaatcactgaatggcgtgtggctgaaccgggctcgattggaaccgctgagagtgtattccattcaccagggggactacatccagctgggtgtcccactcgagaacaaagaaaacgctgaatacgagtatgaggttaccgaagaggactgggaaacgatctatccctgcctctcgcccaaaaatgatcagatgatcgaaaaaaacaaggagctgcgtaccaagaggaagttcagcctggatgaattagcaggtcccggcgcagaaggacccagcaatttaaagagcaaaattaacaaggtctcctgtgagagcggccagcccgtcaaaagccaggggaaaggcgaggtggcaagtacaccgtctgacaacctggatccgaagctcactgcccttgagccgtctaaaaccaccggggccccaatctaccccggatttcccaaggttactgaagttcaccatgagcaaaaggcatctaattccagtgccagtcagagatctctacaaatgtttaaggtgactatgagtagaatcctacggctgaaaattcaaatgcaagaaaagcatgaggccgttatgaatgtgaaaaagcaaactcagaaaggaaactccaaaaaggtggttcagatggagcaggagctccaggatttgcagtcacagctgtgtgccgagcaggcgcagcagcaggccagagtagaacagctcgaaaagacatttcaggaggaagaacagcacctacagggcctagaaattgcccagggtgaaaaggacctgaaacagcagttggcacaggcactgcaggagcactgggcccttatggaggaactaaatcgtagtaagaaggattttgaggccattatccaggcgaaaaacaaagaactggagcagaccaaagaagagaaggagaaaatgcaggctcagaaagaggaggtcctgtctcacatgaacgacgtgcttgagaacgaacttcagtgtattatatgttccgagtacttcatcgaagcagtgactctgaattgtgcccattccttctgttcatactgcatcaacgagtggatgaaaaggaaaatcgaatgtcctatatgtcgcaaggacattaaatcgaaaacttactcattggtgttggacaactgtatcaataaaatggtgaacaacctttcctcagaagtcaaagagagacggattgttctcataagggagcgcaaggccaaaagactcttctag

SEQ ID NO: 17226 - DNA, 297 bp, Artificial Sequence
  Description of Artificial Sequence: Synthetic coding sequence
atgggagagcctggttttttcgttactggagacagggccggggggcgctcttggtgcctgcgtagagtgggaatgtccgccggatggctgctgctggaagacggttgcgaggtgacggtcgggcgagggtttggcgtgacatatcagctcgtgtctaagatttgtcccctcatgatctctagaaaccattgcgtcctaaaacagaaccccgagggtcagtggaccatcatggacaacaaatcctttccttccgaaaaggccgaggacttcactgccgccggggaacggttcctctag

SEQ ID NO: 17227 - DNA, 1347 bp, Artificial Sequence
  Description of Artificial Sequence: Synthetic coding sequence
atgggagaacccggctttttcgtgaccggagaccgagccgggggcaggtcctggtgcttaagaagagtgggaatgtctgcaggctggcttctgctggaggacggatgtgaggtgacagtgggccgtggctttggggtcacctaccagctcgtctcaaaaatctgccctctaatgatatcgcggaatcactgcgtcctgaaacaaaaccccgagggacagtggacaattatggacaacaagtcactgaatggggtatggttgaatcgcgcccgcctcgagcccctgcgtgtgtattccatccatcagggggactacattcagctgggagtacctctggagaacaaggaaaacgccgagtacgaatacgaggttaccgaggaagattgggagaccatatacccatgtctcagcccgaagaacgaccagatgatagaaaaaaacaaagaactgagaacgaagaggaagtttagcctggatgagcttgctggcccaggcgccgaggggccctctaatctgaagtctaagattaacaaagtctcatgtgagagtggccagcccgtcaaatctcagggaaaaggagaagtggctagtacgccatctgataatctagatccaaaacttacagccctggagccttcaaaaacaactggtgccccaatctatcctggttttccaaaggtcaccgaagttcaccacgagcagaaggctagtaattcaagcgccagtcagagatcgctgcagatgttcaaagtcactatgtccagaatcttgaggctgaagatccagatgcaggaaaaacatgaagctgttatgaacgttaaaaaacagactcagaagggtaattcgaagaaagtggtacaaatggagcaggagctgcaagacctgcagagccagctgtgcgccgagcaggctcagcagcaggctcgagttgagcagctggaaaagacattccaggaagaggagcagcacctccaaggactcgaaattgctcagggcgaaaaagacttgaaacagcagctagcccaggctttgcaggagcattgggcacttatggaagagctaaatagatctaagaaggacttcgaggccatcatccaggccaaaaacaaggagctggagcaaacaaaggaggaaaaagagaaaatgcaagctcagaaggaagaagtgctgtctcacatgaatgacgtcctggagaatgaactgcagtgtatcatttgcagtgagtacttcatcgagcagcgcgattgctcagaggatcgggcgctgcgtgcatttgagcgccttcctgggagtgcctcacttcgctggtccggagggttttcattagccgtcactccgctcctctag

SEQ ID NO: 17228 - DNA, 1593 bp, Artificial Sequence
  Description of Artificial Sequence: Synthetic coding sequence
atggcagacgacatcgatatcgaagccatgctggaggccccctacaagaaagatgagaataaattgagcagcgcgaatgggcacgaggagagatcaaagaagcgtaagaagtccaagagtagatcccgctcgcatgagcggaaacggagcaaatcaaaagaacggaaacgatcccgggaccgtgaaaggaagaaatctaagtcgcgggagcgtaagaggtccagatctaaagaaaggcgtaggtccagatccagaagtagagacagacggttccgaggtcggtatagatccccctattcgggacctaagttcaactccgccattcgtgggaagataggactcccacactcaatcaaactgagcagaagacggagtcgatcaaagagccctttccggaaggacaaatctcccgttcgagagcccatcgataacctgacgcccgaagaaagagacgcccgaacggttttttgtatgcagttagctgctcgcattcggcctcgcgatctcgaagagtttttctcaacagtgggtaaggtgagggatgtcagaatgatctctgacaggaattctaggcgtagtaagggtatagcttatgttgagttcgtggatgtgtccagtgtgcccctcgctataggcctcacagggcaacgggtgcttggggtgcccatcattgtacaggcctctcaggccgagaaaaatagggcagccgcaatggcgaacaacttacagaaaggatctgccggacccatgcggctatacgtcggcagcctgcatttcaatatcacggaagatatgctaaggggaatcttcgaacccttcgggcgaattgagtcgatccagttaatgatggatagtgagactggacggagtaaagggtacgggttcatcacattctctgattcggaatgcgctaagaaagctttggaacagctgaatgggtttgaattagctggcaggcctatgaaggttggacacgtcactgaacgtaccgatgcctcgagcgcctcgagttttctggacagtgacgaattggagaggaccgggattgatttgggtactactgggaggctgcaactgatggctagactcgccgaaggcacgggcctacagattccacccgctgcccagcaggccttgcagatgagcgggtctttggcttttggggctgttgctgagttcagctttgtgattgacctacaaacaagattatctcagcagacggaagccagtgccctggctgccgcagcatcagtccagccattagcaactcagtgctttcagttgtctaacatgttcaatccccagacagaagaggaggttggttgggatacagaaatcaaggatgatgttatagaagaatgtaacaaacacggaggtgtaattcatatttatgtggacaagaacagcgcccagggtaatgtgtacgtcaagtgccccagcattgctgcagccattgctgccgtgaacgcacttcacggaagatggtttgccgggaagatgatcacggcagcatatgttccgctgcccacttatcataacctgtttccagacagcatgacggcaacccagctgctcgttccctcccgtagatag

SEQ ID NO: 17229 - DNA, 1272 bp, Artificial Sequence
  Description of Artificial Sequence: Synthetic coding sequence
atggctgatgatatagacatcgaggccatgctggaagctccatacaagaaggacgaaaacaaactgtcatccgctaatgggcatgaggagaggtccaagaagcgcaaaaaaagcaagtcgcgctctagatcacacgaacggaagagaagcaaatctaaggaaaggaaaagaagtcgcgatagagaacggaagaagagcaaatcccgggaaaggaagcggagccggtccaaagagcgtagaagaagccgtagccgtagtagagaccgacgttttcgcggtcgctatagaagtccatatagcgggccaaagttcaattctgccattcgtggcaagatcggactccctcacagcatcaagctaagccgaagacgatctcgctccaagagcccatttcggaaagacaagagtccagtgcgggagccgattgacaacttaacgccagaggagcgcgatgctagaaccgtcttttgcatgcaactcgccgcccgcattcgaccgcgggatctagaggaatttttttcaactgtgggcaaggtgcgggatgtgaggatgatctccgaccgcaacagtcgccgaagcaagggtattgcctatgtggagttcgttgacgtatcatccgtgccactcgcgatcgggttaaccggccagagggtgctgggtgtgcctattattgtacaggcttctcaggccgaaaagaaccgcgcagcagccatggccaacaacctacagaaggggagtgcggggccgatgaggctctatgtggggtctctgcactttaacatcaccgaggacatgctcaggggcatattcgagccctttggccgcattgagtccattcagttgatgatggactcggagaccggtcgttcgaaggggtacgggtttattaccttttctgacagtgagtgcgctaaaaaggccctggaacagctgaacggcttcgaactggctgggcgccccatgaaagtgggccatgtcaccgagaggaccgacgccagtagcgcttcgagctttctggattccgacgagctggaacgaaccggaatcgacttggggacaacgggacgcctgcagctgatggcacgcctcgcggagggtacagggctccaaattccaccagctgcgcagcaggcgttgcagatgagcggctcgttagcgtttggagccgtcgccgacctgcagacacgacttagtcagcagaccgaggctttgttcgtgattatgttctggaacgaaatttggtctgacaacatgatcaccctgcaactctag

SEQ ID NO: 17230 - DNA, 1575 bp, Artificial Sequence
  Description of Artificial Sequence: Synthetic coding sequence
atggccgacgacatcgacattgaggccatgctggaggccccatataaaaaagacgaaaataaattgtccagcgctaatgggcatgaagagagatccaaaaagcggaagaagtccaaatcaagatcacggtcccacgaaagaaaaaggtccaagagtaaggaaaggaaacggtctcgggaccgggagaggaaaaagagcaaatcacgagaaagaaagagatcccgctcaaaagagcgtcggagatcccgctcccgcagcagagatcgacgatttcgggggaggtaccgaagcccttactcggggcccaagtttaacagcgcgattagggggaaaatcggactgcctcacagcattaagttgagtcgcaggcggagtcgctctaaatctccctttcggaaggacaagtctcccgttcgggagcccatcgataatctgacgcctgaggaaagagacgcaaggacagtgttctgcatgcagctcgctgctcgtattcgaccccgggatctggaggagtttttctccacggtcgggaaagtgagggatgtgcggatgatatcagaccgcaatagccggaggtccaagggcatagcctacgttgaatttgtggatgtgagtagtgtccccttagctatcggcttaacaggacaacgagtcctgggagtgcccataatcgtccaggcttcccaggccgaaaagaatagagctgctgcaatggcaaacaatctccagaagggctctgctggacccatgagactgtatgtgggaagcctgcatttcaacatcacagaggatatgctcagaggcatttttgaaccgttcgggcgaattgagagcattcagctcatgatggattcagaaaccggcaggagtaaggggtacggatttattacattcagcgacagcgaatgcgctaagaaagcactcgaacagttgaacgggttcgaactggctggacgacccatgaaagtgggtcacgtgaccgaacggacagacgccagctccgcttcatcattcttggactcagatgaacttgagaggacgggaatcgatctgggcaccaccggtagactgcagttgatggcccgcctggcagagggaaccgggctgcagattcccccggctgcccaacaggcgcttcagatgagcggcagcttagcattcggcgctgtagccgacctccagactcgcctgagccaacagaccgaagcttctgctttagccgcggcagcttccgttcagcctctggccacccagtgcttccagctgtctaatatgtttaatccacagactgaggaggaagtggggtgggatacagaaataaaggatgatgtgattgaggagtgtaacaagcacggaggcgttatacacatctatgtggataagaatagcgctcagggaaatgtttacgtgaaatgcccttctatcgcagcggcaatcgctgctgtgaatgccctgcacggcagatggttcgccggcaaaatgattacagccgcctacgtccctcttcctacttaccacaatcttttcccagactctatgacagcgacacaactcctggtgccgtcgaggaggtag

SEQ ID NO: 17231 - DNA, 696 bp, Artificial Sequence
  Description of Artificial Sequence: Synthetic coding sequence
atggccgacgatatcgacattgaagctatgttagaggcaccttataaaaaagacgaaaacaagctgtcttcagccaacggccacgaggagagatctaagaagcgcaagaagtctaagtccaggtcaaggtctcatgagcgcaaacggtccaaatccaaagagaggaaaaggtctcgcgaccgggagaggaagaaatctaaatcacgggagaggaagcgatcccggtctaaagaaagaaggcggtctcggtcaaggagcagagataggcgattccggggacgctacaggagtccctacagtggacctaagttcaatagcgccattcggggaaaaatcggcctgccacacagcataaaactaaggcggcgaagccgcagcaaatctcccttccggaaggataagagcccagtgcgcgaaccaatagataatttgaccccggaggagcgggatgctcgaaccgtgttttgcatgcaattagccgctaggattcgaccaagagacctcgaggaattcttttccaccgtgggcaaggtgcgcgatgtgagaatgatctcagataggaactccagacggtcaaagggaatagcttatgtcgagttcgtcgatgtgtcaagcgtgcccctggccattgggctcaccgggcagcgagttctgggcgtgccaatcattgtgcaggcaagtcaggcagagaaatag

SEQ ID NO: 17232 - DNA, 1122 bp, Artificial Sequence
  Description of Artificial Sequence: Synthetic coding sequence
atgcagctcgcagcccgcataagaccacgagacttagaggagtttttcagcactgttggaaaggtgcgagatgtacggatgatctctgaccggaactctaggagatctaaaggaatcgcttatgttgagtttgtcgatgtatcctccgtgcccttggcgataggcctcaccggacagcgcgtcctcggggtgcctattatcgttcaggcctctcaggctgaaaagaacagggccgctgctatggccaacaaccttcagaaaggatccgctggacccatgcgcctgtatgtcggaagccttcacttcaacataactgaggacatgctccgcggaattttcgaaccattcgggcgcatcgagtctattcagctgatgatggattccgaaacgggtaggtccaagggttacgggttcataacgttttctgacagtgagtgtgcaaaaaaggcgcttgaacagctcaatggcttcgagctggccggacggcctatgaaagttggtcacgtcaccgagcggacagacgcctcctccgcatcgtccttcctggactccgacgaactggagagaaccggcatcgacctggggaccactggtaggctgcagctgatggctaggctagcagaggggacgggactacaaatccctccagccgcccagcaagctctgcaaatgtctggcagccttgcattcggcgccgtggcagagttctccttcgtgatcgatttgcaaacacggctgtcacaacagaccgaagcgtcagccttggctgctgccgcgtcggttcagcctctagctacacagtgtttccaactcagcaacatgtttaatccccagactgaagaagaagtgggatgggatactgagatcaaggatgatgttattgaggagtgcaataaacacggaggcgtaattcacatttacgtagacaaaaactctgctcagggtaatgtttacgtcaaatgtccctctatcgctgccgccatcgcagctgtgaatgcactacacggtagatggtttgctggcaagatgattacagccgcctatgtacctctccccacttaccataacctcttccctgattctatgaccgcgactcagctattagtaccgtcccggagatag

SEQ ID NO: 17233 - DNA, 582 bp, Artificial Sequence
  Description of Artificial Sequence: Synthetic coding sequence
atggccgatgatatcgacattgaagcaatgttggaagccccatacaagaaagatgaaaataaactgtctagcgccaacggccatgaagaaaggtccaagaagcggaagaagtctaagagccgcagccgatctcacgagcgcaagcgtagcaagtccaaggagaggaaacgcagtcgcgaccgtgagagaaaaaagtcaaaaagcagagagcgtaagagaagccggagtaaggagcgcagacggagccggagcagaagcagagacaggagatttcgaggcaggtatcggtccccatattcaggacccaagttcaactcggcaatacgcgggaaaatcgggctgccacattcaatcaagctgtctcggagaaggtcacgctctaagtctccattcaggaaggacaaatcacccgtccgtgagcctattgataatctcaccccagaagagagggatgctcgtacagttttctgtatgcagctggccgcccggatccgaccccgggatctagaagaattcttctctacagtaggtaaggtgcgggatgtccgaatgatcagcgacaggaatagccgcaggtcatag

SEQ ID NO: 17234 - DNA, 1014 bp, Artificial Sequence
  Description of Artificial Sequence: Synthetic coding sequence
taatcaccattcagaaaagacaaatcacccgtgagggagcccattgataacctgaccccagaagagcgcgatgctcgcactgttttctgcatgcagctggccgcgagaattcgcccaagggatctggaggagttcttcagcacggtcgggaaagtgcgtgatgtgaggatgatttctgaccggaattcccggcgcagtaaaggaattgcatacgtggagtttgtagatgtgtcatcagttcctctcgccatcggcctgaccggacagagggtgctcggcgttccaatcattgtgcaggcctctcaggctgagaagaatcgtgccgccgctatggcaaataacttgcagaaaggctcagcaggcccgatgcgactctacgtagggtccctgcacttcaatataactgaagacatgctcaggggtattttcgaaccattcggcagattctccgactcagagtgtgccaagaaggccctggagcagcttaacgggttcgagctggccggacgcccaatgaaagtgggacacgtgacagaaaggaccgatgcatctagcgcctcttccttcctggactctgatgaactcgagaggaccgggattgacctcgggactacgggacgcctgcagctaatggcgcggttggcggagggcaccggcctccagattcccccagccgcacaacaagccctccagatgagcggcagtcttgcattcggtgcggtggcggaattttcattcgtcatcgatctgcaaacccgcctgtcgcagcagaccgaagcttctgcgcttgccgctgcagcttctgttcagcctctcgccacacaatgttttcagctcagcaacatgttcaacccgcagaccgaagaagaggtcggctgggatacagagataaaggatgatgtgatcgaagagtgtaacaagcacgggggtgtcatacatatatatgtggataagaatagcgcgcagggcaatgtctatgtgaaatgtcccagcattgcagctgccatagcttag

SEQ ID NO: 17235 - DNA, 1527 bp, Artificial Sequence
  Description of Artificial Sequence: Synthetic coding sequence
atggccgatgatatcgatattgaagccatgctcgaagctccgtacaagaaggatgaaaacaagctctcatcggccaacggacacgaagagcgctcaaagaaaagaaagaagagtaagtcccgctcccgttcgcacgagcggaaaaggagcaagagcaaggaaaggaaaagatctagggatcgtgagcgaaagaagtccaagagtagggagcggaaaagatctagatcgaaggaaaggcggcggagtaggagcaggtcacgggatagacgtttcaggggcaggtacagaagtccctatcggcgaagatcccggtcaaagtctccatttcgtaaggacaagtctcccgtgcgagagccaatagataatctgactcccgaagagcgagacgctcgcaccgtcttttgtatgcaactcgcagcccggatccgccctcgagatctggaggagtttttctcgaccgtcgggaaggtgagggacgtgcggatgatttccgatcgcaattcgcgtaggtcaaaaggtatcgcctatgtcgagttcgtggacgtttcttccgtaccactggcaattgggcttacaggccagcgagtcctaggcgtgcctatcatagtgcaggcctcacaagcagagaagaaccgagccgctgccatggccaacaatctgcagaagggctccgccgggcccatgagactgtacgttggttccctgcattttaatatcacagaggatatgctgagaggcatctttgagccgtttgggcgcatcgaatccattcagctcatgatggattccgaaacaggacgaagtaaaggttatggttttatcaccttctctgactccgagtgtgcaaagaaggccctggagcagctcaatggcttcgaattggcgggcagaccgatgaaagtgggccacgtcacagagaggaccgacgcctcatccgcatctagcttccttgactcagacgagttagagcggactggcatcgatctgggcaccacgggacggctccagttaatggccaggctggccgaaggcacgggcttacaaatcccacctgcggctcagcaggctctccagatgtcaggatccctggcctttggagctgtggccgaattctcttttgttattgatctgcagactagactgtcccagcagacagaagcctctgccctggccgccgccgcttccgtgcagccgctggccacacagtgcttccagttgagtaacatgtttaacccgcagactgaagaagaggtgggatgggacacagagatcaaagacgatgtgattgaggaatgcaacaagcacggaggcgttatccatatttatgtggacaagaacagtgcacagggaaatgtttacgtgaagtgcccgtctatcgctgccgcaatagccgccgttaacgccctgcatgggcgctggttcgcggggaagatgattactgccgcttatgtgccccttcctacataccacaacctctttcctgattctatgactgccacccagctgctggtcccatcccggcgttag

SEQ ID NO: 17236 - DNA, 1176 bp, Artificial Sequence
  Description of Artificial Sequence: Synthetic coding sequence
atggtggaggctgatcggcccggtaagctttttatcggcggtttgaacaccgaaacaaatgaaaaagctctggaggccgtcttcggaaagtatggccgaatcgtcgaagtcctgctgatgaaggaccgtgaaaccaataaaagccgaggcttcgccttcgtgacattcgaatctcctgccgacgctaaggatgccgcccgggatatgaacgggaaaagcctagacgggaaggccattaaagtcgagcaggcaacaaagccctctttcgagtcaggccgacggggcccaccgcccccccccaggtccaggggacctccaaggggcctgaggggggggaggggtggatcgggcggcacaagaggccctcctagccgaggaggccacatggatgatgggggatattcaatgaatttcaatatgagttccagtagagggcccctaccagtaaaacgaggcccgccccctagatccggggggcctccccctaaaagatctgctccctcgggccctgtacgctctagctctgggatgggtggccgcgccccagtgtctagagggagggactcttatggtggtccaccaaggagagagccactgccctcaaggcgagacgtctatctatccccaagagatgatggttatagcactaaggactcatacagcagccgcgattatccgtcctcaagagacacgagagactatgcccccccacctagagattatacttacagggactatggccattcctcttctagggatgactatccttcgagagggtacagtgacagagatggatacgggagggatagggattattctgaccaccccagcgggggcagctaccgcgatagctatgaaagctatgggaacagcagatcggctcctccaactaggggaccaccgccaagttatggaggatctagcaggtacgacgattattcatccagccgggacggctatggcggaagtagggactcttatagttcttctcgctccgacctgtatagctcgggaagggatcgggtaggacggcaggagcggggactgcctccttctatggagcggggctacccccccccaagggactcctactcctcgagctccagaggcgcccctcgcggcggcgggcggggcggtagccgaagtgatcgcggtggaggtcgtagccggtactag

SEQ ID NO: 17237 - DNA, 309 bp, Artificial Sequence
  Description of Artificial Sequence: Synthetic coding sequence
tgaatgttcatatgtccccaagagatgatgggcatcttactgaaaacagccatccaggccgagatcacacaagttctcgttatcctagagattatgcatcatcatcatgagattatcctgaccgtgattatggtgatccccgtccacgtgatgaccattcatcaggaggacattgctatcgagatggacatggtggtgatagtgacaattcagattatccaagtggaggttcctaccgagatccatatgcgggttatggtgggagatttcgcccactacggcaggggtgtactgattgactcccaatag

SEQ ID NO: 17238 - DNA, 591 bp, Artificial Sequence
  Description of Artificial Sequence: Synthetic coding sequence
atggtggaagcagatcggccagggaaactgtttattggggggctgaatacagagactaatgaaaaagctctcgaggccgtgttcggtaaatacggccgcatcgtcgaggtgttgctcatgaaagatagggagactaataaaagcagaggattcgcatttgttactttcgagtctccagccgacgcaaaggacgccgcaagggacatgaacggcaaactgttataccacgtggaagagatagtaatggaagtgcatctcgagggcaaccgatgcccattggtggagatgtttatctgtccacaggaaatgatgggtatcttactcaagacagctatacaggctgagattactcaggtattagtgatcctggagataatgcaccatcaccacgaaatcattctgactgttatcatggttatcccagtgcacgtgatgaccattcaccaggaggatatcgcgattgaaatggacatggtcgtcatcgtcacgattcagatcatccaagttgaagtgcccactgagatacatatgagggtcatggtgggagactttgctcactacggtcgaggggtgctgatcgactcccagtag

SEQ ID NO: 17239 - DNA, 1137 bp, Artificial Sequence
  Description of Artificial Sequence: Synthetic coding sequence
atggtggaggccgaccgacctgggaagctcttcatcgggggcttgaataccgaaacgaacgaaaaggccttggaggcggtcttcgggaaatatggaagaatcgtggaagtcttactcatgaaggatagagagtctcccgcggatgccaaagatgccgctcgggacatgaacggcaagagcttggacggaaaagcaattaaggtcgagcaggcaactaaacctagtttcgagagtggccgtcgcgggccacccccacccccccgctcccgcggtccccctagaggcttacgcggtggccggggcggctcgggaggtaccagaggtccgccgagccgcggtggccatatggatgatggcgggtattccatgaactttaacatgtcctcctctcggggccccctgccagtaaagaggggaccccccccccggagtggcgggcctccccccaagcggtctgctccctccggccccgttagatcgtcatcaggcatgggcgggagggctccagtttcgagaggccgagattcttatggcggcccccctagaagggagcctctccctagtagaagagatgtctatctatcgcccagagacgatggctatagcaccaaggactcatattccagccgggactatccatcttcgcgcgatacaagagattacgcacctcctcctagggattatacataccgagattacggtcattcaagttcccgggatgactatcctagtcggggctactccgatcgagatgggtacggccgtgaccgcgactactccgatcatccatcgggtggctcctacagagattcatacgaatcgtacggcaattcccgctccgcaccacccactcggggtcctcctcccagttacggcgggagttcgagatacgatgattacagttcatcccgcgacgggtatggagggtcccgcgacagctatagttcaagtaggagcgacctgtatagttccggcagggatcgtgttggtcgccaggagcgcggcctgcctcccagtatggaaaggggctatccaccccctcgtgactcatattccagttcctcccgtggggctccccgcggcgggggtagaggcggatcccgttctgaccgcggcggcggtaggtcacggtactag

SEQ ID NO: 17240 - DNA, 1443 bp, Artificial Sequence
  Description of Artificial Sequence: Synthetic coding sequence
atggccagcgacagtatttttgaatcattccctagttaccctcagtgtttcatgcgcgaatgcatcttaggtatgaatccaagtagagacgtccacgacgcaagtacctcccggcgctttacacccccatctaccgccctgtctcccggcaagatgtctgaggctttaccgcttggcgccccggatgctggcgctgctctggccggcaaactccgtagcggagataggtccatggtagaggtgctcgccgatcatcctggagagctggtgcggaccgactctccaaactttctatgcagcgtgctgcctacacactggaggtgcaacaagaccctgcctatcgcgttcaaggttgtagcactcggagacgtgccagatgggacgctagtgaccgtgatggcaggtaacgatgaaaattattccgccgaactccggaacgccaccgccgccatgaaaaaccaggtggcaagattcaacgatctgaggttcgtcggcaggagtggaaggggaaaaagcttcacgctaactattaccgtgtttaccaatcccccacaggttgccacctatcacagagccatcaaaatcacagtagatggcccaagagagccccggcggcatcgacagaagctggacgatcagacaaagcccggctcactgtcattttcggaaaggctgagtgagctggaacagctgcggcgcactgccatgagagtatcccctcatcatcctgctcccactccaaatcctcgcgcatccctgaatcacagcaccgccttcaaccctcagccacagtctcagatgcaggatacaaggcagattcagcccagtcccccatggagttacgatcagtcttatcagtatttgggctctattgcctccccaagcgtgcaccccgccactcccatctcgcctggccgtgcttccggcatgaccaccctcagcgccgagttgtctagcaggttgtccaccgctcctgacctcacagcatttagcgaccctaggcagtttcccgctctgccaagcatcagcgatcctagaatgcattaccctggagcattcacgtatagtccaacaccagtcactagcggaatagggatcggcatgagcgcgatgggatccgctacacgctaccatacctacctgcccccgccttaccctgggagttctcaagctcagggcgggcccttccaggcctccagtccgtcttaccatctgtactatggcgcaagtgctgggtcctatcagttttcgatggttggcggagagagatcaccgccacgaatcctccccccttgtaccaacgcatctacaggatccgccctgctcaaccccagtcttccaaatcagtcagatgtcgttgaagccgagggtagtcacagcaatagcccgacaaacatggctcccagtgccagactggaagaagcagtgtggaggccttactag

SEQ ID NO: 17241 - DNA, 1407 bp, Artificial Sequence
  Description of Artificial Sequence: Synthetic coding sequence
atgcccgctgcacctcgcggccccgcacaaggcgaagccgcagctcgaaccaggtccagggatgcgagtacgagtaggagatttactcctcctagtaccgcgctttctcctggtaagatgtccgaagctttgcccttgggtgcgcctgatgccggcgccgcattggcaggaaaattgagatctggcgatcggtcaatggtggaggtactggcagatcaccccggcgagctggtcagaaccgacagcccaaactttctgtgttcagtcctgcccacacactggagatgtaacaagaccctccccatcgcgttcaaagtggtggcactcggagacgtgccagacggcaccctagtgaccgtgatggcgggtaatgacgagaattattccgccgaactgagaaacgcgacagcagcgatgaagaaccaggtcgcccggttcaatgatctgcgtttcgtaggacgctccgggaggggcaagtcgttcactctaacaatcacagttttcaccaacccccctcaggtggccacatatcacagggccataaaaatcacggtcgatggcccccgggagcctagacggcaccggcagaaactagacgaccaaacaaaacctggcagcctctcattttctgaacggttaagtgaattggagcaattacggagaaccgccatgcgggtctctccacatcaccccgctcccactccgaatccccgagcctcactgaatcacagcacagcatttaacccacaaccacagtcgcagatgcaggatacgaggcagatacagccaagtcccccatggtcctatgaccagagttaccagtatcttggttccatagctagcccttccgtccaccccgccacaccaatctctcccgggcgcgcgagtgggatgaccaccctgtcagcagagctgtccagtcgcctgtcaactgcgccggatttgacagccttctctgacccccggcaattcccagcattgccgagcatttcagaccctcgcatgcattatcccggtgcgtttacgtacagcccgacacccgtcacttctgggatcggcatagggatgtctgccatgggctccgctacccgctaccatacgtatctgccacctccatatcctgggtctagccaagctcaggggggaccgttccaggcctcatccccgtcgtaccatctgtattacggcgcatcagccggctcctaccagttttctatggtgggcggagagcggtcaccccccagaatcctgcctccttgcactaatgcctctaccggatcagccttacttaatccatccctccctaaccagtccgacgttgtggaggcggagggaagccactctaatagtcctaccaatatggctccctcggctcgtcttgaggaggctgtgtggcgtccttattag

SEQ ID NO: 17242 - DNA, 1362 bp, Artificial Sequence
  Description of Artificial Sequence: Synthetic coding sequence
atgagaataccggtggacgccagcacctcaaggcgctttactccgcctagcaccgctctgagtccaggcaagatgagcgaggctctgccactgggcgcccctgatgctggcgctgctctggccggaaagctgcgctctggggacagatcaatggtggaggtcctggccgaccaccccggcgaattagtgaggacagacagtcccaattttctatgcagcgtgctcccaactcactggaggtgtaacaagactctcccgattgcttttaaagtggtggccttaggagacgtaccagatggcacactcgtaaccgtcatggcgggcaacgatgagaattactccgcggaactgcggaatgcaactgccgcaatgaagaaccaggtagcgcgcttcaacgacttgaggttcgtgggccgctctgggcgtggcaaaagttttacactgactatcaccgtgtttactaaccctccccaagttgcaacctaccacagggcaattaaaattacagtagacggcccccgggaaccaaggcggcacaggcaaaaattggatgaccagacgaaaccaggctccctttctttctccgagcggctgagtgaattggaacagctcagacggactgcaatgcgcgtgtcaccacaccaccctgcccctactcctaatccccgcgcctctttgaaccattccacagcatttaaccctcagccacagtctcagatgcaagatacgaggcaaattcagccatcccctccatggtcttacgaccagtcttatcaatacctcggatcgattgcaagcccgtcagttcatcctgcaactcctattagcccaggaagagcttccggcatgactacactgagtgcggagttgagcagccggctgagcactgctccggacctgaccgcgttttcagacccccgccagttcccagctctcccctccatatctgacccgcgaatgcactacccgggggctttcacttactcccctaccccagttaccagtggaatcggcattggcatgtccgccatgggaagcgctacccggtaccacacttaccttccacccccataccccggaagctcccaagctcagggcgggcccttccaggccagtagcccttcgtaccacctttactatggcgccagcgctgggagttaccaattctctatggtcgggggtgagagatcgcctcctagaattctgcccccctgcaccaatgcttccacaggctccgcattgttgaaccccagtctcccaaaccagtcagatgtagtcgaagcggaggggtcacactccaacagccctactaatatggcgccctccgcacgcctagaggaagccgtctggcgtccttactag

SEQ ID NO: 17243 - DNA, 1428 bp, Artificial Sequence
  Description of Artificial Sequence: Synthetic coding sequence
atgaatccctcaagggatgtgcatgatgctagtacgtcccgcaggttcacgcctccttccaccgccctgtcccctggtaagatgtctgaggccctgcccctaggggctcccgacgccggggctgctttagctggaaagctgcgctccggggaccgatccatggtggaggttctagctgaccaccctggggagcttgtgcggacagacagccctaatttcctgtgcagtgtgctaccaacacactggaggtgtaacaagacccttcccatcgcgttcaaggtggtagctttgggggatgtgcccgacggaacactggttaccgtcatggcagggaatgacgaaaactactctgctgagctgcgcaacgcaacagccgcaatgaaaaatcaggtcgcccggttcaacgatctcaggtttgtgggccggagcgggcggggcaagtcattcacacttacaattacggtatttaccaatcccccgcaggtggcgacataccacagggcaattaagatcactgtcgacggtccccgggaacctcgacgacatcgccaaaaacttgacgatcaaaccaagccgggaagtctttcatttagcgaacgactgtctgagctggaacagctgcggcgcaccgcgatgagggttagtccacatcaccctgcacctacacccaatcccagagccagcctgaatcacagcaccgccttcaacccgcagcctcaaagccagatgcaggataccaggcagattcagccatcccctccatggtcctatgatcaaagttaccagtatctgggctcgatcgcctccccatctgtgcacccagcgacccccatctctcctggacgggcctcaggcatgaccaccctttctgctgaactgtcctcaaggttaagcactgccccagatttgaccgcattttctgaccctcgacaatttccagcattgcctagtataagcgaccctcgcatgcactatccaggcgcctttacttatagccctactcccgtgacatccgggatcggtatcggaatgagtgcaatgggatctgccacacgctatcatacatatctaccaccaccttatcctggttcttcccaggcccagggaggcccatttcaggctagcagtccgtcttatcacctgtactacggggccagtgccggcagctatcagttctctatggtcggaggggagagaagcccgccccgcattcttccaccttgcactaatgcctccacaggttccgccttgttaaacccgtctctacccaatcagtctgacgttgttgaagccgaggggagtcactctaattcgccaaccaacatggcgcgggccagttgtagccgccaggcacgcagggatccagggccctgggcacggcccccttcgtgggggcgaggcagaccaacagccagaataagcctttag

SEQ ID NO: 17244 - DNA, 99 bp, Artificial Sequence
  Description of Artificial Sequence: Synthetic coding sequence
atggcgtcagacagcattttcgaatctttcccatcctaccctcagtgcttcatgcgggagtgcattcttgggatgaatcccagcagagacgtgcactag

SEQ ID NO: 17245 - DNA, 414 bp, Artificial Sequence
  Description of Artificial Sequence: Synthetic coding sequence
atgcaggatactagacagatacaaccgagcccaccctggagctacgatcagagctatcagtacctgggttccatagcctccccatccgtgcaccccgcaacgccgattagccctggacgagcgtccggcatgaccacgcttagcgctgagctcagctcacgtctgtctacggcccctgacttgactgcattttcggatcccagacagttccctgccttgccaagtatctcggacccacggatgcattatccaggtgcgtttacttattcccctacacctgttacctccggcattggtattggaatgagcgctatggggtcagcaactcgataccatacttacctgcctccgccataccccggtagctcgcaggctcagggggggccgttccaggccagctccccctcatattag

SEQ ID NO: 17246 - DNA, 1443 bp, Artificial Sequence
  Description of Artificial Sequence: Synthetic coding sequence
atggcatctgattccatatttgagagcttcccaagctacccacaatgctttatgagagaatgtatcctcgggatgaacccatcaagagacgtgcacgacgccagcacttcgcgccggtttacaccgcctagtacagctctgtctcctggaaagatgtccgaggctctgccactgggagcacccgacgcaggcgccgctcttgcagggaagctccggagcggggatcgcagcatggtggaagtgttggcagaccatcccggcgaactcgtccgcaccgattcccccaattttctgtgctccgtgctccccacgcattggagatgtaacaagaccctccctattgcatttaaggtcgttgctctcggagacgtcccagatggcactttggtcactgtaatggccggaaacgatgaaaactatagcgctgagctgcgcaacgccacagcagcgatgaagaaccaagtggcccgctttaatgatctgcggttcgttggacgcagcgggcgaggtaagagcttcacgctgacaattactgtttttaccaatccaccgcaggtggccacctatcaccgcgccattaagattaccgtggacgggccacgagagcctcgtcggcatcggcagaagctcgatgaccaaacaaaaccaggaagcctcagtttttcggaacgtctgtcagagctggaacaacttaggcggactgccatgagggtgtcccctcatcaccctgcccccacccctaacccgcgggcctctttgaatcatagtacagccttcaacccacagccccagagccagatgcaggacactaggcagatccagccctctccgccatggagttacgatcaatcttaccagtatttgggcagcatcgccagtccatccgttcatcctgccacgcctatttctcctgggagagcctctggtatgactactctctccgctgagctgtcttccaggcttagcacagccccggatctcaccgctttttccgatcccagacagttcccggccctgcctagtattagtgacccccgaatgcactaccccggcgcctttacgtattctcctacgccagtgacctccggcattggaatcggtatgagcgcgatgggctcagcgaccagataccatacttacctgcctccaccctaccctggatccagccaggcccaaggagggccatttcaggctagcagcccctcatatcatttatattacggcgccagcgccggctcctatcagttctccatggtgggcggtgagaggagtccccctcggatcttacctccttgtacaaacgctagcaccggaagcgccttgctgaacccctcgctccctaaccagtctgatgtagtcgaagcagagggctctcacagtaatagcccaacaaacatggccccttccgcaaggctcgaggaggccgtttggagaccctattag

SEQ ID NO: 17247 - DNA, 576 bp, Artificial Sequence
  Description of Artificial Sequence: Synthetic coding sequence
atgaatcctagccgggacgtccatgatgcctccacaagtcgcagatttactccaccctccactgctcttagtcccgggaagatgtccgaggcacttccattaggggcccccgatgccggggcagcattggccggaaagctcagatctggtgataggtcaatggtggaggtcttggctgatcatcccggagagctagtgagaaccgacagccccaacttcctatgttccgtgctgcccacccactggcggtgcaataagacacttccaatagcattcaaggtggtggctctgggagacgtccctgacggtacgctggtgaccgtcatggccggtaacgatgaaaattacagtgccgagttgagaaatgcaaccgcagctatgaaaaaccaggtggccaggtttaacgatctccggttcgtggggaggtcaggccgcgggaagtccttcacactgacgatcactgtgttcaccaacccaccgcaggtggcaacctatcaccgcgccattaaaattacagtcgacgggccacgggagccacgcaattctctgacatggccgcgctatccccacatctag

SEQ ID NO: 17248 - DNA, 753 bp, Artificial Sequence
  Description of Artificial Sequence: Synthetic coding sequence
atgcggatccctgtggacgcgagcacaagcaggcggtttacacccccttctaccgcactgtctccaggcaaaatgtctgaggccctgccattgggcgcccccgacgcaggagcggctctggccggtaaattaagatcaggcgatcgcagtatggtggaggtcctcgccgatcaccccggggagctcgtcaggacagactcgcccaactttctttgcagtgtcctgcctacgcattggcggtgcaacaaaacattacctatcgccttcaaagttgtagcccttggagacgtgccggacgggaccctggtaactgtgatggccggcaacgacgaaaactatagcgcggagcttcgcaatgcgaccgctgctatgaaaaaccaagtagccagattcaatgacttgcgcttcgttggtagatccggaagaggaaaatccttcactctcactataacagtgttcaccaatccgccgcaagttgcaacctatcatagggccattaaaattaccgtggatggtcctcgcgaacctcggcgccacagacaaaaattagatgatcaaaccaagcccggttccctcagtttcagtgaaagactatctgagctagagcagctacgtcggactgctatgcgtgtgtccccacaccatcctgcccccacccctaacccaagagcctcattaaatcacagcaccgcctttaatccccaaccacagtcacagatgcaagaggaagacacagcaccttggaggtgttag

SEQ ID NO: 17249 - DNA, 1770 bp, Artificial Sequence
  Description of Artificial Sequence: Synthetic coding sequence
atgctgcactccccacacaaacaacctcagaaccataagtgcggagccaattttctccaagaggactctaagaagtcattagtgttcaagtggctgatttcagccggacactaccagccacccagacctaccgagtcgttcaaagcagcatcctcaatatataataggggatacaagttctatctaaaaaagaagggagggacaatggcctctaacagcctgttttccacagttactccgtgccagcagaatttcttctgggacccttctacaagcaggaggttttcccccccaagttcctcactgcagccaggaaagatgtcagatgtgtcccccgtggtggccgcccagcagcagcagcaacagcagcagcaacagcagcagcagcagcaacagcagcagcaacagcaacagcaggaggcggcagctgccgccgccgcggcagctgctgccgccgctgccgctgccgccgtccctaggctgagacctccccatgataatcggactatggtcgagattatcgcggaccatcccgcagaacttgtccggactgatagccccaacttcctatgtagcgttttgccatctcactggcgatgtaacaagacactacccgtggcatttaaggtagttgcgcttggagaggtgccagacggcacagttgtgactgtcatggctggcaatgatgaaaattatagtgctgagctcaggaatgcttctgccgtcatgaagaatcaggtagcgagatttaacgaccttcggttcgtcggtcgtagtggccgtggcaagtccttcaccctgaccatcaccgtgttcaccaatccgccgcaggtggccacctatcatagggccatcaaagtcaccgtggatggaccgcgcgagccccggcgacaccgacagaagctcgatgactccaagcccagcctgttttcggaccggctgtctgatctaggaagaatccctcaccccagcatgcgcgtgggagtcccgcctcagaatccaagaccaagcctgaactccgctccatctcctttcaatcctcagggccagagccaaattaccgatcctcgccaagctcaaagcagcccaccttggtcctacgaccaaagctacccgagctatctgagtcagatgacttctccctccatccactccacaacccccctctcttcaacccggggcacaggcctaccagccattacagacgtgcctaggagaatcagcgatgacgatacggctacatccgacttctgtctgtggccctccacactgtcgaagaaatctcaggcgggagctagtgaactgggccctttttctgacccgcggcagtttccctccatttctagcctgactgagagcagattttcaaatcctcgaatgcactatcctgcaacatttacttatacccctcctgtcactagcggcatgagtctgggtatgagcgccacaacccattaccatacatacctgccacctccctatcctgggtcatcacagagccagtctggaccgttccagacatcttccacgccgtacctgtactacggtacgtccagcggatcttatcagtttcctatggtgcctggaggagaccgctctccctcaaggatgctgcccccttgcacaactacttctaatgggtcgactctgcttaacccgaacctgccgaaccagaatgatggggtcgacgctgatggatctcactcgagctcccctaccgtgttaaactcctccgggagaatggacgaaagcgtgtggcggccttactag

SEQ ID NO: 17250 - DNA, 1524 bp, Artificial Sequence
  Description of Artificial Sequence: Synthetic coding sequence
atgagaatccctgtggaccctagtacgagccgtcgattttcacccccttccagctccctccagcccggtaaaatgtccgatgttagccccgtggtagcagcccaacagcaacagcagcagcagcagcagcagcagcagcagcagcagcagcaacagcagcagcagcagcaagaggctgccgccgctgctgctgcagcagccgctgccgcagccgccgctgccgccgtccctcgcctccggccaccgcacgacaaccgcacaatggtagaaatcattgcggatcaccctgccgaactggttagaactgacagcccgaatttcctatgtagcgttctgccgagccactggaggtgcaataagacactaccagtggcctttaaggtggtggcactgggagaggtgcctgacgggacggttgtgacagttatggcaggtaacgacgagaattacagcgccgaactgagaaatgcatctgccgtcatgaagaaccaggtggccaggtttaacgacctccgattcgtcggaagatcagggaggggtaaaagctttacccttaccatcaccgtgtttaccaatcctccccaggtggccacataccacagagcaattaaggttaccgtggatggccctagagaaccgagaagacacagacaaaaattagacgattcaaagccaagcttattttccgaccggctctcggacctgggtcggatcccccacccaagcatgagagttggcgtcccaccccaaaacccaagaccctccttaaactccgctcctagcccgtttaacccgcaaggacagtctcagatcacagaccctcgacaggcccagtccagtccaccatggtcttacgatcagtcttacccttcctacctctctcagatgaccagcccctccatacactccaccacacctctgtcctccacaaggggcaccggattgccagcaatcacagatgtacctcggaggatttctgatgacgacactgccactagtgatttttgcctgtggccatctactctgtctaaaaaatctcaggccggcgctagcgaactcgggcctttcagcgaccctcgccagttcccgtccatttctagtttaaccgaaagccgctttagcaatccacggatgcactaccccgccaccttcacctacactcccccagtaacttctggtatgtcactgggtatgtccgccaccactcattatcatacatatctgccgcccccatatccagggagcagccagtctcagagcgggccattccaaacatctagcactccttacctgtactacgggacctctagcggatcctatcagttccccatggttccgggcggcgatcggtcaccatctcgtatgctcccaccatgtactactacctctaacggctcaacattactgaatcctaatctaccaaaccaaaacgacggggttgacgcggatggctcccattcctctagtccaactgtgctaaactccagtgggagaatggatgaatccgtgtggcgtccctactag

SEQ ID NO: 17251 - DNA, 1458 bp, Artificial Sequence
  Description of Artificial Sequence: Synthetic coding sequence
atgcgcatccccgttgatccctctacctcacggcgcttctccccaccaagtagctcactccagcctggcaaaatgtcagatgtgagcccggtggtcgcagcgcagcagcaacaacagcagcagcagcagcagcaacagcagcagcagcaacagcagcagcagcaacagcaggaggcagcagctgccgccgctgctgcggcagccgcagcagcagccgccgcagctgtaccaaggttacgcccaccccacgataaccgtaccatggtggagattattgccgaccaccccgctgagctggtccggacagactcccccaacttcctatgttctgtgctgcctagtcactggcgatgtaacaagactctgccggtggctttcaaagtggtcgcgctgggcgaagtgccagacggaactgttgtgaccgtgatggccggcaatgacgagaactacagtgcagagcttagaaatgcctccgccgtgatgaagaaccaggtggcaaggttcaatgaccttcgcttcgtgggaaggagtggtaggggtaaatcctttacgctgactattaccgtgtttactaatcctccgcaagtggccacctatcaccgggccatcaaggtgactgtcgatgggcccagggagcctcgacggcaccggcagaaattggacgactccaaacccagtctattcagcgacaggttatctgacctcggccgcattccacatcccagcatgagggtaggcgtccctccccaaaatccgaggccatcactgaattcagctccaagtcctttcaatccccagggccagtcgcagatcactgatcctaggcaggcccagtccagtcccccgtggagctatgatcagtcttacccatcatacctgagccagatgacaagtccaagcatacactctacaacccctctcagttccactaggggaacaggcctccccgctataactgacgttccccggagaatcagtggcgcctccgagctagggcctttttcagatccaagacagttcccaagcatctcaagcctgaccgaatccagattcagcaatccccgcatgcattatcccgctacatttacctatacacctcccgttacaagcgggatgtctctgggtatgtccgccactacgcactatcacacctatctccccccaccctaccccggaagctctcagtcacagagcgggccgttccagacttcaagtaccccatacttgtattacgggacttcttctggaagctatcaatttccaatggtccctggtggggaccgttctccgtcccggatgctgcccccatgtaccaccaccagcaacgggtctaccctcctcaatccaaaccttcccaatcagaacgatggagttgatgctgacgggtcacactcttcttctcctaccgtgcttaacagttctgggcggatggatgaatccgtgtggcggccatactag

SEQ ID NO: 17252 - DNA, 1500 bp, Artificial Sequence
  Description of Artificial Sequence: Synthetic coding sequence
atggcttcgaattcattgttctccacagtgaccccttgtcagcagaatttcttctgggacccttcaacttctaggcggttttctcctccttcttcctcactgcagcccggaaagatgtctgacgtctcccctgtggttgccgcccagcagcagcagcagcagcagcaacagcaacagcaacagcagcagcagcagcagcagcaacaacagcaggaggccgctgcggccgcggccgctgccgcagcggcagcggcggcagcagccgcagtaccaagactccgccccccgcacgataatcggacgatggttgaaatcatcgcagaccaccctgccgagcttgtgagaacagactcccctaattttctctgtagcgttctccctagccattggcgctgcaataaaacactcccagtggcatttaaagtcgtggctctcggagaggttccagatggcacagttgtgacggttatggcgggcaatgatgagaactactccgccgaactgcgcaatgcttcagccgtgatgaagaaccaggtcgcccgttttaacgatctacgtttcgtcggtaggagtgggagaggtaaatctttcaccctgaccattaccgtgtttaccaaccccccccaggtggccacttatcaccgggccattaaagttaccgttgatggccctcgggagcctcgaaggcaccgccaaaagctcgatgattcaaaaccgtccctttttagtgatcgattgagtgaccttggccggataccccatcccagcatgcgcgtgggcgtgcctccacaaaatcccagaccttcgcttaattccgcccccagcccattcaatcctcaaggccaaagtcagattactgatccaaggcaggcacaatccagccctccctggtcttatgaccagtcatatccctcctacctgagccagatgacgtccccatcgatccactccactactcccctctcttccaccaggggcactggacttcctgccataacggacgtcccccgacggatctcaggggccagcgaactgggcccctttagtgaccctcgacagtttcctagtatcagtagtctgaccgaatctagattttccaatccacggatgcattatccggccacctttacctacacccccccggtaacctccggaatgtccctgggtatgtccgccaccacccactaccacacatacctgccacccccttaccccggctcctcccagagtcagagcggtccattccaaacatcatccaccccatacctgtattatggcacgagctccggatcataccagttccccatggtcccaggtggcgatcgctctccctctcgaatgctacctccttgcaccactacgtcaaatggaagcaccttgttaaacccaaacctgcctaatcagaacgacggggtagatgcagacggaagccacagttcctcaccaacagtcctgaattcttctggccgcatggatgagtccgtatggcgcccttactag

SEQ ID NO: 17253 - DNA, 1566 bp, Artificial Sequence
  Description of Artificial Sequence: Synthetic coding sequence
atggcaagcaattccctgtttagcacagtgactccttgtcagcagaacttcttctgggatccgtctacctccagaaggttctcaccaccctcaagttcactgcagccaggaaagatgtccgacgtcagcccagtagtggctgcccagcaacagcagcagcagcaacagcagcagcaacagcagcagcaacagcaacagcagcagcaacagcaggaggcggctgccgccgctgccgccgctgccgcggctgccgctgccgccgccgccgtccccagattgagacccccacatgacaaccgaacgatggtggaaatcatcgctgaccatccggctgaactcgtaagaacggactcccccaactttctttgcagcgtccttcccagccattggcgatgcaataagactctacctgttgcgttcaaagtggtggctttaggcgaggtacctgacggcacggtcgtgactgtgatggcaggcaacgatgaaaattactccgcagaattgagaaacgctagcgccgttatgaagaaccaggttgctagattcaatgatctgcgtttcgtgggtagaagtggccgaggcaaatcctttacattgactataactgtctttactaatcccccacaggtcgcgacataccaccgtgcaattaaggtgacagtcgacggaccacgggaaccccggagacaccgacagaagctcgacgactccaagccctccctgttttcagatcgcttgtctgatctggggaggatcccgcacccatccatgcgagtgggagttccacctcagaatcctagaccttccttaaacagcgccccctcccctttcaaccctcagggccagtcccagattacagaccctcggcaggcccagtctagcccaccttggtcatacgaccagagttacccttcatacctatcccaaatgacttctccctctatccattctaccaccccactgtcctccactcgaggcaccggcctgcctgcaatcacagacgtgccacgccggatatcagatgacgacacagccacctccgacttttgcctctggccgtccaccctcagcaagaagagccaagccggcgcttcggaactcgggccattttcagaccccagacagtttccatccatatcttcgctgaccgagagtcggttttcaaaccctaggatgcactatccagcaacatttacgtacactccaccagtgacctccggcatgtccttaggcatgtccgcaactacccactatcatacgtatctgccgcctccataccccgggtcctcacagagtcagtcagggcctttccaaacatcaagcacaccctacctgtactacggcacatcaagcggtagctatcagtttcccatggttcctggtggcgatcggtccccgtctagaatgctgcccccttgtaccacgacctccaatgggagtactttgttgaatccaaatctgcctaatcagaatgacggtgtggacgcagacggatctcactcatcgagtccgactgtgctaaattcttctggcagaatggacgaatcagtgtggaggccctactag

SEQ ID NO: 17254 - DNA, 1566 bp, Artificial Sequence
  Description of Artificial Sequence: Synthetic coding sequence
atggctagcaatagtctcttctcaactgtgactccatgtcaacagaattttttctgggatccatctacttcaaggcggttctcgcctccctcatcctcccttcagcccggtaagatgtcagacgtaagcccggtggttgccgcccagcaacagcaacaacagcagcagcagcaacagcagcaacagcaacaacagcagcagcagcagcagcaggaagcagccgccgcggcggcggctgccgccgccgccgcagccgcagccgcagcagttcctaggttgcggcctcctcacgacaatagaacgatggtcgagattattgccgatcatcccgccgaactcgtcagaactgattccccgaacttcttgtgctccgtcctcccttctcattggaggtgtaataaaacactcccagtcgccttcaaagttgtcgccctgggagaagtccccgacggtaccgttgtgacagtaatggccggaaatgatgagaactacagtgccgagttgcggaacgcttcagccgtgatgaaaaatcaggtcgctcgcttcaatgacctgagattcgtcggaaggagtggaagaggcaaatcctttactctcaccattacagtcttcactaacccaccacaagttgctacttatcaccgagccatcaaggtgaccgttgatggacccagggagccccgccgccaccgccagaagctggacgatagcaagccaagcctgtttagcgatcggctctcagacctcggaaggatcccacacccgtcaatgagagtaggagtcccgccacagaatccgagaccaagcctgaattccgcaccctcccccttcaacccccaggggcaatcacagattacagaccccaggcaggcccagtccagccctccctggagttacgaccaatcttatccgagctatctttctcagatgacctctccatccattcacagcactacccccctgtccagtacgcgcggtacaggactccctgccatcaccgatgtgccacggagaatttccgatgacgacaccgccacctccgatttctgcctttggccttccacactgtcgaagaagagccaagccggcgccagtgagctgggtccgttcagcgatccgcgacagttcccctctatttcatctctcaccgaaagtaggttttcaaacccaagaatgcattatccagccacctttacctatactccccccgttacttctggtatgtctcttggaatgagtgctactacacactaccacacctacctccctccgccttaccctgggagcagccagagccaatccgggccctttcagacaagttcaaccccctacctctattacggcacgtcatccgggagttaccagttccctatggtgcccggtggagacaggtcccccagccgaatgcttcctccatgtaccacgacatccaatgggtctactttactgaatccgaacctgcctaatcagaacgacggagtggacgcagacggctctcactcatcaagccccaccgttctgaacagctctgggagaatggatgaatccgtgtggcgaccgtattag

SEQ ID NO: 17255 - DNA, 1704 bp, Artificial Sequence
  Description of Artificial Sequence: Synthetic coding sequence
atgctccattccccccacaagcagccccagaaccataagtgtggcgcaaatttcctccaagaggattcaaaaaagagcttagtgtttaagtggctgatttccgcaggacattatcaacccccacgacccacagaatcctttaaggctgcatctagcatttataataggggatataaattctacctgaagaagaagggaggaactatggcctcaaactcactgttcagtacagtaacgccctgtcaacaaaactttttctgggatccaagtactagcaggcgcttcagcccaccttcttcctccttgcagccaggtaagatgtcagatgtctcccccgtggtggctgctcagcaacagcaacagcagcagcagcagcagcaacagcagcagcagcagcagcagcaacagcagcagcaggaggccgccgcagctgccgccgccgcagccgccgccgccgctgctgccgcagctgtgccccggctgaggcccccacacgacaatagaacaatggtggagataatcgccgatcacccagcagagctggtaagaacagactctccgaacttcctgtgctccgtcttgccctcccactggaggtgtaacaaaactctacctgtcgctttcaaagtcgtagctttgggcgaggtgcccgatggcacagtggtgactgtgatggctggaaacgatgagaattacagtgccgagttgaggaatgccagcgccgtgatgaagaatcaggtggcacggttcaacgatcttcggtttgtgggccggagcggaagaggaaagtcatttaccctgaccatcacagtgttcacaaatcctcctcaagtggccacctaccatcgagccataaaggtgaccgtggatggcccgcgcgaaccacggagacacaggcaaaagcttgacgacagtaaaccttcgctgttttcagacagactgtcagatcttgggaggatccctcacccctcaatgcgcgtgggagtccccccccagaatcctcgtccctccctgaactctgctcctagtccgtttaatccgcaagggcagagccagataacagatcctcgccaggcacagtcctctccgccttggagttatgaccagtcttaccccagttatttatcgcagatgacgtctccctccattcacagtacaacaccactctctagtacgaggggaacagggctgcctgccatcactgacgtgcccaggagaattagcggagcgtctgagctcggaccattcagcgacccaagacaatttcccagcataagttctcttaccgaaagccgcttttctaacccacgtatgcactatcccgccacttttacctacacacctcccgtcactagcggcatgagcctcggcatgtcggccaccacacactaccacacctatttgcctcccccctaccctggcagtagccagtcacagtcaggcccctttcaaacttcttccaccccctacctctactatgggacaagctccggctcttatcagttccccatggtcccaggcggagataggtcacccagccgtatgttgcctccctgcacgaccacgtcaaacggcagcaccttgctgaacccaaatttgccaaatcaaaacgacggcgttgacgcggatggatcacacagctcctcccccactgttctgaacagctccgggcgtatggacgagagtgtgtggcggccctactag

SEQ ID NO: 17256 - DNA, 1248 bp, Artificial Sequence
  Description of Artificial Sequence: Synthetic coding sequence
atgagaattcccgtcgatccatctacaagtcggcgcttcaccccccccagccctgctttcccatgtggtggagggggaggcaaaatgggagaaaacagcggagctctgtctgcacaggcggctgttggacccgggggaagagccaggccagaagtgaggtctatggtggatgtcctcgctgatcacgctggggagcttgtcagaacggactcgcccaatttcttatgttcggttctgccctcccattggcggtgtaacaagacgctgccagtggccttcaaagtggtcgctctgggggacgtgccggacggcacggtcgttacagtaatggcaggcaatgatgaaaattattcagcagagctgcgaaacgctagtgctgtgatgaaaaatcaggtggccagatttaacgaccttagattcgtcggacggtcaggcagaggaaagtcattcaccctcacaattaccgtttttaccaaccctacccaggtggctacttaccacagagctattaaagtgacagttgacggtccgcgtgaaccacgacggcatcggcagaagctggaagaccagactaagccattccctgaccggtttggagatcttgagaggctccgcatgcgggtgacaccctccacgcccagcccccgaggctcactcagcaccacctcccacttcagctcccaaccccagactcctatacaagggacatccgagctcaatcctttctcagaccccaggcagtttgaccgttcgttcccgacccttcctacgctcacagagagccggtttcccgatcctcggatgcactaccccggcgccatgtccgccgctttcccgtattctgctaccccatcaggcacctcaatctccagtttgtcggttgcgggaatgccagccactagtcggttccatcatacctatctgcctccgccttatccgggagccccacagaaccaaagtggacccttccaggccaatcctagtccgtatcatctgtactatggcacctcgagtgggtcctaccagttctccatggtggccgggagcagctcaggtggagataggtcaccaacacgaatgcttgcatcctgcacatcctcagcagcatccgttgcagctgggaacttgatgaacccatccctgggaggacagtcagacggtgtggaggccgacggctcccattcgaacagccctactgcgctgtctacccccggccggatggacgaagcggtgtggcgcccatactag

SEQ ID NO: 17257 - DNA, 1290 bp, Artificial Sequence
  Description of Artificial Sequence: Synthetic coding sequence
atggctagcaatagcattttcgactcatttcccacatacagtcccacttttatacgagacccctccacctctcgacggtttacaccccctagtcccgcattcccttgtggaggaggaggcggcaaaatgggtgaaaattctggggcattgagtgcccaagccgccgttggccctggggggcgggcgcgaccagaggtgagatctatggtagacgtccttgcggatcacgctggcgagttagtgagaacagatagccctaattttctgtgttccgtgctgccatcccactggagatgtaacaaaacgctgcctgtcgcgtttaaggtggttgcgcttggtgacgtacccgacggcacagtcgtcacagtgatggcaggcaacgatgaaaactatagtgcggagttgagaaatgcctctgctgtgatgaaaaatcaggtggccaggttcaacgacctgcgatttgtcggcaggtctggcagaggtaagagttttactctgactattacggtatttacaaatcccacccaggtcgcgacatatcatagagctataaaggtcacagtggatggaccaagggaaccccgaagacataggcagaaacttgaggaccaaacaaagcctttccctgacagatttggcgacctagagaggctccggatgcgggtgactccaagtacgccttctccacgagggagcctctcaaccacatcacacttttccagccaacctcaaacacctattcaagggacttccgaactcaatccctttagcgatccccgccagttcgatcgaagctttccgactcttccaaccctgaccgaaagtcgtttccccgatccgcggatgcattatcccggggccatgagtgctgcgttcccttatagtgctaccccatcagggacgtccatttcttcactgtccgtagccggtatgccagcaacttctagatttcaccacacctacctgcccccaccttatcccggtgcccctcaaaaccagtcaggaccattccaagcaaacccaagcccataccatctttactatggcacatcctcaggctcctaccagttcagcatggttgctggtagtagctctgggggtgacagaagccctaccagaatgctggcgagttgcacatctagcgcggcaagcgtagccgctgggaatttgatgaaccctagtttgggcggccagtccgatggcgtcgaagcggatggaagccacagcaatagccctactgcactgtccactccggggcggatggatgaggccgtatggaggccatattag

SEQ ID NO: 17258 - DNA, 1290 bp, Artificial Sequence
  Description of Artificial Sequence: Synthetic coding sequence
atggcttcaaattccatattcgatagcttcccgacatatagtcctacttttatccgggacccttccacctctaggcgctttacccccccctccccagcttttccatgtggtggtggaggcgggaagatgggagagaatagcggagctctatcagctcaggcagctgtgggcccagggggtagagcaaggcccgaagttcggagcatggtggacgtactagcagaccacgctggcgaactggtgcggacagacagtcccaactttctgtgtagcgtcctcccatcccactggaggtgtaacaagacactccctgtcgcgttcaaggtcgtcgccctgggcgacgtgccagatgggacagttgtgacagtaatggcagggaacgacgaaaactacagcgccgagctgagaaacgcctccgctgtgatgaaaaaccaggtggctagatttaacgatttacggtttgttggcagatctggacgaggcaaatctttcaccttgacaatcacagtattcactaacccaacccaagtggccacttatcaccgagccatcaaggtgaccgtagatggcccaagagagccacgacgtcacagacagaagctggaagatcagacgaagccctttccagaccggttcggggacctcgaacggctgagaatgcgtgtaacaccttcaacgcctagcccacgggggtcgctaagtaccacctcccatttcagctcgcagcctcagactcctattcagggtacctcagagcttaaccctttctcagaccctcgccagtttgataggagtttcccgacccttcccaccctcacagaaagtcgattccccgaccctcggatgcactacccaggagccatgagcgctgcctttccgtacagcgcgaccccgtccggcacctctattagttctctgtccgtcgccggaatgcccgccacctcacgttttcaccacacataccttccacctccctaccctggcgcacctcagaatcagagcggtccatttcaggccaatccctctccctaccatctgtactatggcacatcatccggcagctatcaattctctatggtggccggcagttcttccggaggcgatagatctcctactcgtatgctggcgagttgcacctcttctgccgcgtctgtggcggctggaaaccttatgaacccttccttaggcggccaatcggacggtgtcgaggccgatggatctcacagtaacagccccacagcactgagtacgccaggccgcatggatgaagcagtgtggcgcccctactag

SEQ ID NO: 17259 - DNA, 1089 bp, Artificial Sequence
  Description of Artificial Sequence: Synthetic coding sequence
atgagaataccagtggatccttccaccagtaggaggtttactcctccctcacccgcctttccctgtggaggcggcggtggaaagatgggcgagaactcaggggccctctctgcacaggccgcggtgggacctgggggtcgggctaggcctgaggtccgctctatggttgacgtgctcgccgatcacgccggagagcttgtccgtacagacagccctaatttcctgtgttcagtccttccttcccattggagatgtaacaaaacactcccagtggccttcaaggtggtcgctttaggtgacgtacccgacggaacggtcgtgacagtaatggccgggaatgatgagaactactcagcagagctccgtaacgcctcggctgtgatgaaaaaccaagttgctcgcttcaacgacctgaggttcgtcggccgatctgggagaggaaaatcgtttacactgacaataactgtcttcacaaaccccacccaggtggctacgtaccaccgggctatcaaggtcaccgtggacgggcctagagagcctcgccgaacatctgaactgaatcccttttccgacccgcgccaatttgacagaagcttcccaactctccccaccctaaccgagagccgattccctgacccgagaatgcactaccctggggctatgtccgccgcattcccatacagcgccacaccctctggaacttctatatcttctttgagcgtcgctggcatgcctgcgacttcaagattccaccatacctaccttccgcctccttatcccggagccccgcagaatcagagtggaccgtttcaggccaacccttctccctatcatctctattacggaacaagctcaggttcctatcaattctccatggtggccggttccagttccggtggcgaccgtagccctacgagaatgctggcatcttgcacatctagtgccgccagcgtggcagctgggaatctgatgaatccgagccttggcggtcagtcagatggcgtggaggccgatggcagtcactccaactcacccacagcactctcgactcctggaagaatggacgaggcggtgtggcgaccatactag

SEQ ID NO: 17260 - DNA, 969 bp, Artificial Sequence
  Description of Artificial Sequence: Synthetic coding sequence
atggtcgtagctctcggcgacgtgccggacggcactgtggtaacagtgatggctgggaacgacgaaaattattctgcagaactccgcaacgctagcgccgtgatgaagaaccaggtggctaggtttaacgatctgagattcgtgggtaggtctggcagagggaagtccttcacactgaccattactgtgttcaccaatccaacccaggtggcaacttaccaccgtgcaataaaagtgactgtcgacggaccacgcgaacctaggcgtcaccggcagaaattggaggaccagacaaaaccattccccgaccgctttggggaccttgagcgcttgcgcatgagggttacgcccagcaccccatcccccagagggagcctgtcaactaccagccatttctcttctcagcctcagacacctatacaggggaccagcgagcttaatccgttctcagacccacgccaattcgatagatcatttcctacgctgcccacactcaccgaaagccggtttcctgaccctagaatgcactaccctggcgccatgtccgccgcgtttccctatagcgccactccaagtggaacgagcatttcttcgctgtcagtggctggcatgcctgcaactagtagattccaccacacatatctgccaccaccgtatccaggggcaccacagaaccagagcggccctttccaggccaacccatcaccctatcacctctactacggaacctcttcgggatcttatcagtttagtatggttgcaggaagcagcagtggtggggatagatcacccacccgtatgctggcaagctgtaccagtagcgccgccagcgtggcagccggtaatttgatgaatccatcattgggcgggcagtctgatggcgttgaggctgatgggtctcactctaattcccctacagccctctccacaccaggcaggatggatgaagcggtatggaggccttactag

SEQ ID NO: 17261 - DNA, 2439 bp, Artificial Sequence
  Description of Artificial Sequence: Synthetic coding sequence
atggactttagccggctgcatatgtatagtccccctcaatgcgtgcccgagaatacaggttacacatatgccctatcctctagctacagcagcgacgctctggactttgagacagaacataagcttgacccagttttcgatagcccacgcatgagtcgaaggtctctcaggctcgccaccacggcgtgtacgctgggcgatggggaagcagtcggggcagactccggaacctcctccgccgtcagtctcaagaacagggccgcccgcacaacgaagcagcgacgctctacgaacaagagtgcattttccatcaaccacgtgtcccggcaggtgacctcttccggcgtcagccatggtggcacagtgtccctgcaggacgcagtaactcgtcggcctcccgtgctggacgaaagctggatccgcgaacagaccaccgtggaccacttttggggtctcgacgacgacggcgatttgaaaggcggcaataaggctgccattcaaggcaacggagacgtgggggccgcagccgccacagcacacaacggcttttcctgtagcaactgtagcatgctgtccgaacgtaaagacgtcctcacagcccatcccgcagcccccgggccggtaagtagagtttactcaagggacaggaatcagaaatgcgacgattgtaagggcaaacgacacctggacgcccacccgggccgcgcggggaccttgtggcacatctgggcttgcgctggttactttttgctgcagattctgagacggataggggccgtgggacaagcggtgagtcgaaccgcctggtccgcattgtggctcgctgtagtggctccaggcaaggctgcttctggtgtgttttggtggctgggcatcggctggtatcagttcgttaccctgatcagctggcttaacgttttcctgctcacccgatgtcttagaaatatttgtaagttcctagttctcctcatcccgctcttccttcttctggccggactgagtctgcgcgggcagggtaacttcttttcctttctgcccgttctgaattgggcatctatgcacaggacccagcgcgtagatgacccccaagatgttttcaagcctactacaagcagactgaaacagcctctgcaaggcgattccgaagccttcccatggcactggatgtccggtgtcgaacagcaggtggcttccttgagtggccagtgccatcatcatggagaaaacctgagggagctaaccacactactgcaaaagctgcaggctcgcgtggaccagatggagggtggagccgccggaccatctgcatctgttcgcgacgccgtggggcagcctcccagagagaccgatttcatggcttttcatcaggaacacgaggttcggatgagtcacctagaggacatccttggaaaactgagggagaagtccgaagccatccagaaggagctggagcaaacaaagcagaagaccatttccgcggtgggcgaacaactgcttcctactgtcgagcatctccagctggaattagaccagttgaagtctgagctttcctcttggcgccacgtgaaaacaggttgcgaaaccgtggacgccgtgcaggaacgagttgatgtgcaggtaagagagatggttaagcttctgtttagtgaagaccagcagggaggctctctggagcaactcctacagaggttctcatcccagttcgttagtaaaggcgatttgcagaccatgcttagggatctgcagctccagatactcagaaatgtgacacatcacgtctcagtgaccaagcagctacctacgtcagaggccgtagtctcagcagtgtccgaagccggcgccagtgggattaccgaggcccaggcccgtgccatagtgaatagcgccttaaagctgtactcccaggataagactggcatggtggattttgccctggagtcaggaggcggaagcatcttgtccacaaggtgtagcgagacctatgaaaccaagacggcgcttatgtcactctttggcatccctctatggtattttagccagtcccccagagttgtcatccaacctgatatttacccaggcaattgctgggccttcaaagggtctcagggttacctagtcgtgcgcctaagcatgatgatccatcctgccgcttttacactcgaacatattcctaagaccctgtctcctaccggcaacatctcatctgcacccaaagactttgcagtgtacggcttggagaatgagtatcaagaggagggacagctgctgggtcagttcacttacgaccaagatggtgaatccctgcagatgttccaggccctgaagcgcccagatgacaccgcgtttcagatagttgaactcaggatattctcaaattgggggcaccccgaatatacttgtttgtaccgattcagagtccacggtgaacccgtcaaatag

SEQ ID NO: 17262 - DNA, 2109 bp, Artificial Sequence
  Description of Artificial Sequence: Synthetic coding sequence
atgtctcggcgcagcctgcgcctggctacaacggcctgtacactgggagacggcgaagcagtgggagctgattccgggaccagcagtgccgtgagcctgaaaaacagagcagccaggacaaccaagcagaggagatccaccaacaagtcagccttctctatcaatcatgtgagccgccaagtcacgagcagtggcgttagccacggcgggacagtttctctccaagacgcagtaacacgccgcccacctgtgctcgatgaaagctggatcagagaacaaaccacagtcgaccatttttggggcctggatgacgatggagatctcaagggcggcaataaagctgctattcaggggaacggtgatgttggcgccgccgcagctaccgcccacaacggtttctcatgctcaaactgcagcatgctctccgaacgtaaggacgttctgacagctcaccccgctgcccctgggcctgttagcagggtgtacagtcgggataggaaccagaagtggaaagccgcgtccggggtgttttggtggctgggtatagggtggtatcagttcgtgacacttatttcgtggctcaatgtgttcctgctgactcggtgtcttagaaatatctgcaagtttctcgtcttgctgatcccgttgtttcttctgctggcgggcttaagtctgcgcgggcagggaaatttcttctctttcctgcccgtcctgaactgggcaagtatgcaccgcacccagcgggtggatgacccacaggatgtgttcaaacccactacttcccgtttaaagcagcctcttcaaggggatagtgaggccttcccctggcactggatgtccggagtcgagcagcaggtggcttctctgagcggccagtgccaccaccatggcgaaaaccttcgggagcttacaactttgttacagaaactgcaggcgcgcgtcgatcaaatggaggggggagcggcgggtccctctgcgtcagtccgagacgccgtgggccaaccccctagagaaactgatttcatggcatttcatcaggagcatgaagtaagaatgtcacacttggaagatatcctgggcaagcttagggaaaagagcgaggccatccagaaggagctcgaacagacaaagcagaaaactatttcggctgttggcgaacagctgcttcccaccgtggagcatttgcagctggaactcgatcaattaaagagtgagctaagtagctggagacatgtgaaaacagggtgcgaaactgttgacgctgtgcaggagagagttgatgtgcaggtccgagaaatggtcaagctgctcttttcagaggaccaacagggcggctcattggagcagctgctgcagcggttcagctcccagttcgtgagtaagggagatcttcagactatgctgcgggatttgcagctccaaatccttcgaaatgtcacacaccacgtttcagtcactaagcaactacctacgtcagaagccgtggtctcagctgtgagcgaggctggtgccagcgggattacagaagctcaggcccgcgctatcgttaattccgccctgaaactgtactcccaggataaaaccggcatggtggactttgctctcgagtcaggcgggggctcaatcctctccactcggtgcagcgaaacgtacgagacaaagactgcgttgatgagcctttttggaattcccctgtggtattttagccagtctcctcgggtagtcatccagcccgatatttatcctggcaactgttgggccttcaaaggatcccagggttacctggtcgtaagactgagcatgatgatacacccagccgcatttacgctggagcatataccaaagacactgtcacccaccggcaatatctctagcgcccccaaggattttgctgtgtatggcttggaaaatgagtatcaagaggaaggccaactgttggggcagttcacctacgatcaagacggggagtcactgcagatgtttcaggcactaaagcggccggacgacacagcctttcagatcgtcgagctccgtattttctctaattggggacaccctgagtacacctgcctgtatagatttcgggtgcatggcgaacctgtcaaatag

SEQ ID NO: 17263 - DNA, 2358 bp, Artificial Sequence
  Description of Artificial Sequence: Synthetic coding sequence
atggactttagcagactgcatatgtatagccccccacagtgcgttccagagaacacagggtatacgtacgctctcagtagctcctactcctcagacgcgctcgacttcgaaaccgagcataagctggaccccgtgtttgattctccacgcatgagcaggaggtccctgagactggccactactgcttgtaccctaggggatggagaagccgtcggcgccgactccggaacttcctctgctgtgtctttgaagaatagggcagcccgcaccaccaagcagcggcgatcaaccaataagtcagcattcagtatcaaccatgtgtctcggcaagtaacatcgtctggggtgagccacggtggaacagtcagtctgcaggacgccgtgacaagaagacctcccgtcctagatgaaagctggatccgggaacagactactgtggatcacttttggggcctcgacgatgatggcgatctaaaggggggcaacaaagccgccattcaggggaatggagatgtgggagccgctgccgccactgcacacaatggcttctcttgtagtaattgttccatgctcagcgagaggaaggatgtcctgacggcccatccagccgcccccgggcctgtgtcccgagtgtatagccgggaccggaaccagaagtgctattttctgctacaaatcctgaggcgcatcggggccgtgggccaggctgtgtcccgtaccgcatggagtgcgctctggcttgctgttgtagcccccgggaaagccgcatccggagtattttggtggctgggcatcggctggtatcagtttgtgacactgattagttggttgaacgttttccttcttacacggtgcctccgaaatatatgtaagttcctcgtccttctcattcctctgtttctactactggccggtctctccctgcggggccaggggaattttttttctttcctgcccgttcttaattgggcttcaatgcacagaacccaaagagtagacgacccccaggacgtgttcaagcctacaacctccaggttgaaacaaccactccagggggacagcgaggcgtttccgtggcactggatgtctggagtggaacagcaggtcgcgtccttgagcggccaatgccatcaccacggcgaaaatctcagggaactcactaccctgctgcagaagctgcaggcgcgtgtagaccagatggagggcggggccgctgggccaagtgcatcagttcgcgatgccgtaggccagccccccagagagacagactttatggcctttcaccaggaacacgaggttagaatgagtcatctggaagacatactggggaagttgcgagaaaaatctgaagcaattcaaaaagagttggaacaaacgaagcagaaaacgatttccgctgtgggcgagcagctgctccccaccgtcgaacacctgcagctggagttagaccagctgaaatcagaactgtcgagctggcggcatgtcaagacaggatgtgagaccgtggacgcggtccaagaaagggttgatgtgcaggtaagggagatggtgaaattactgttctccgaagaccaacagggaggatcgttggaacagctcttgcaaaggttttccagccagtttgtcagcaaaggggatttgcagaccatgctgcgcgatctgcagctccagattttgcgcaatgtgacacaccatgtctctgttactaagcagctgccgacctccgaggcagtggtgtctgccgtttctgaggctggcgctagtggaataacagaagcccaagctcgagctatcgtgaactccgcactaaagctgtacagccaggacaagacgggaatggtggattttgcactggagtctggtggaggctccatactgagtacccgatgctcagagacatatgagaccaagacagcacttatgagcttgttcgggatcccattgtggtacttcagccaatcccccagagtagttatccagccagacatttaccccggaaattgctgggcctttaagggctctcagggatatctcgtggtccgactgagtatgatgattcacccggcagccttcaccctggagcacatcccaaaaaccttgtcgccgaccggcaatatatcatccgcccccaaggacttcgcagtttacggactggaaaatgagtaccaggaggagggacagctgctcggccaattcacttacgaccaggatggagagagcctccagatgtttcaggctctgaagagacccgacgatacagccttccagattgtggaattacgcatttttagcaactggggacaccccgaatatacatgcttatatcggttcagggtgcatggcgagccagtaaagtag

SEQ ID NO: 17264 - DNA, 774 bp, Artificial Sequence
  Description of Artificial Sequence: Synthetic coding sequence
atggacttctccaggctccatatgtactcacctccacagtgcgtgcctgagaataccggctacacctatgcactctcgtccagctattcctccgacgccctggacttcgagacagaacacaagctggatccggttttcgattcaccgaggatgtctcggcggtctttaagactggcaactacagcatgcaccttaggggacggcgaagcagtcggcgccgattcaggcactagtagtgccgtctcactaaaaaaccgcgcagcccgtacaacaaaacagcgccgatccaccaataaatcagcctttagtatcaatcacgtctcccggcaagtgacatcctccggagtgtcccacgggggcacagttagtcttcaagatgctgtcactcgacgacctccagttctcgatgagtcgtggatccgggagcagactactgtggatcacttttggggcctggacgatgacggggatctgaaaggtggcaacaaagccgccattcagggcaacggcgatgtgggggccgccgctgctaccgcccataatggcttttcctgttccaattgttccatgttgtccgagaggaaggacgtactcacagcacacccagctgccccgggccccgtaagccgggtctacagccgagaccggaaccagaaatgcaaaagccaatcatttaagacccagaaaaaagtgtgtttccccaacctgatctttcccttttgcaagtcccagtgcctccattatctgagttggcggctgaagatcatcccttag

SEQ ID NO: 17265 - DNA, 2469 bp, Artificial Sequence
  Description of Artificial Sequence: Synthetic coding sequence
atggatttcagtcgcctgcatatgtatagcccccctcagtgtgtgccggagaataccgggtacacttacgccctctcaagttcgtactcttcagatgcattagatttcgaaacagaacacaagctggaccccgtcttcgactcgcccaggatgagtcggaggagtttaagacttgcgactaccgcctgcactctgggggacggtgaggcagtgggtgccgacagcggtacatcctctgctgtctcgctgaagaaccgggccgccaggaccactaaacaacggaggagcacaaataaaagtgctttctccataaaccacgtatcccgccaggttacttcaagcggcgtgtcccacggcggaaccgtgtcactacaggatgctgtgacccgacgcccccctgtcctcgacgagagttggatacgtgagcagaccactgtcgaccacttttggggccttgacgacgatggagacctgaaaggaggcaataaggcagcgatccagggtaatggcgacgtgggtgcagcagccgctaccgctcacaatggtttctcttgcagcaattgcagcatgctgtctgaacgaaaagatgtgctgacagcgcaccccgccgcccctggacctgtgtctcgggtctactcgagggacagaaatcagaagtgtgatgattgcaagggcaagcggcatctggatgcccataccgcagcacatagccagtccccccgcttgcctgggcgagcggggaccttgtggcacatctgggcttgcgcagggtatttcctcctccagatactgaggcgcattggggcagtgggtcaagccgtgtcgagaacagcgtggtctgccctttggctggccgtggtggctcccgggaaagccgcctcgggagtcttctggtggttaggaattggctggtaccagttcgtgacactgatttcttggctgaatgtattccttctcactcggtgtcttcggaatatctgcaagtttctggtgcttctcattccattgtttctcctactcgccggtctgtctctcagaggtcaagggaactttttcagctttctccctgtgctgaactgggcatccatgcaccgaactcagagagtggacgacccccaggacgtgtttaagcccaccaccagtcggctaaagcagcctttgcagggcgactctgaggcttttccatggcactggatgtcaggtgtggagcagcaggtagcttccctatcaggacagtgccaccatcatggcgaaaatctacgagagctaaccacactgctccagaaactgcaggcacgcgtggaccagatggagggcggtgctgctggcccttctgccagcgttcgggatgctgttggccaacctcctagggagacagatttcatggcttttcaccaggaacacgaagtccgaatgagccacctagaagacatcctgggaaagttgcgagagaaaagcgaggctatacagaaggaactggaacagacgaaacagaaaacaatctcagccgtgggggagcagctccttccaaccgttgaacatttacagctggaactagaccaactgaagtctgaactgagctcttggagacacgtcaaaacaggctgtgagactgtagacgccgtgcaggaacgcgtggacgtccaagtgagagaaatggttaaattgctgttttcagaggatcagcagggtggctctctcgaacagttactgcagaggtttagcagccagttcgtctccaaaggggacctgcaaactatgctccgagaccttcagttgcaaatcttgcggaatgtcacacatcacgtttccgtgactaaacagctgccgacttctgaggcggtggtgtcagctgtttccgaggcaggtgcctctggaattactgaagcacaagccagggcaatcgtgaattctgccctgaagttatactcccaggataagacagggatggttgacttcgccctggagtccggggggggatccatattgtccactcgctgctctgagacttacgagactaagactgctctgatgagtttgttcggaatccctctgtggtatttttcgcagagtcctcgagttgtgattcagccagatatataccctggaaactgttgggccttcaaaggatcccagggatacctggttgtgcgattatccatgatgatccaccctgcagctttcacactggagcatatccccaaaaccttgtcaccaacaggcaacatttcctcagccccgaaagattttgccgtttacggcttagaaaacgagtaccaagaagaaggccaactcctgggacagttcacatacgaccaagatggcgaatcccttcaaatgttccaggctctgaaaagacccgacgataccgcattccagattgtagaactgagaatcttctctaattggggccaccctgagtatacgtgcctctaccgattccgagtgcacggggagccagtgaaatag

SEQ ID NO: 17266 - DNA, 1752 bp, Artificial Sequence
  Description of Artificial Sequence: Synthetic coding sequence
atgaagctgagttacgagtctgagaattataaacttaagacccatgagtctaaagattgcgagtcagaatcttataaaagcaagagtcatgagtctaaggcccacgcatcctattacggacggatgaatgtgcgggaggtgcttagagaggacggccacctaagtgtgaatggcgaggctctgtggaaggccgcttccggcgtattttggtggcttggtatagggtggtaccagttcgtaacactgatctcttggctgaacgtcttcctgcttacacggtgtcttaggaacatctgtaagtttctcgtgttactgatacccttattcctgttgctggcgggactgtccttgagagggcaggggaactttttctcctttctcccagtactgaattgggcttccatgcaccggacacaaagagtcgatgacccacaagacgtctttaaaccgacaacaagtcggctgaagcagccactgcagggtgattcagaggccttcccttggcattggatgagcggcgtggaacaacaggtggcttcactgagcggacagtgccatcaccacggcgaaaacctccgcgagctgactaccctgctgcagaaactgcaggcaagagtggaccagatggaaggaggcgccgccggcccttccgcctctacagacttcatggcctttcaccaggagcacgaggtgcggatgagccatctggaggacattctggggaagttacgagaaaagagtgaggccattcaaaaagaactcgagcaaactaaacagaagactataagtgctgtgggagagcagttgctccccacagttgagcaccttcagcttgaactggaccaattgaaatcagagttgagctcatggcgccatgtgaagaccggatgtgagaccgtggatgccgtgcaggaaagggtggacgtccaggttcgggaaatggtgaaattgctttttagcgaggaccagcagggggggtcactcgaacagcttctgcagaggttctccagccaattcgtttccaaaggcgatctgcaaactatgctgagggatctgcagctgcaaattctgcggaacgtgactcatcacgttagcgtcacaaagcaacttcctacgtcagaggccgtcgttagcgccgtcagtgaggccggagctagtgggatcaccgaagctcaggctcgggccattgtaaatagcgccctgaaactttacagtcaggataagaccggcatggtagactttgctttagagagcggaggcggcagcatcctgagtaccagatgctcggagacttatgaaacaaagactgcacttatgtccctcttcggcatcccgctgtggtacttctcccagtcacccagggtggtaatccagcctgatatataccctgggaactgctgggccttcaagggcagccagggttatttagtagtgaggttgtccatgatgatacacccagcggccttcacacttgagcacatacccaaaaccctgagccctaccggaaatatatcgagtgcacccaaagatttcgccgtctatggcttggaaaatgaataccaagaagagggacagctcctgggccagttcacctacgatcaggatggtgagagtctacagatgtttcaggccttaaaaaggcctgatgacacagcatttcagattgtcgagctgcgaattttcagcaattgggggcaccccgaatacacttgtttataccgcttccgggtgcacggagagcctgtaaagtag

SEQ ID NO: 17267 - DNA, 342 bp, Artificial Sequence
  Description of Artificial Sequence: Synthetic coding sequence
atggacttctctagactccatatgtattcccccccgcagtgtgtacctgagaatactggctatacttacgccctctctagcagctatagctcggacgccctggattttgagaccgagcataaactggatcccgtgtttgactcgcctcgcatgagcagacgatcactgcggctcgccacaacagcctgcaccttgggtgacggagaggcagtcggcgcggattcaggcacatctagcgccgtctcactgaaaaaccgggccgcaaggaccaccaaacagcgcagaagtacaaataagtccgcattctcgataaatcacgttagccgtcaggtgacctcatag

SEQ ID NO: 17268 - DNA, 267 bp, Artificial Sequence
  Description of Artificial Sequence: Synthetic coding sequence
atggatttttctaggctgcatatgtattcccctccccagtgtgttcccgagaacaccggctatacatatgcactgtcctcgtcatattcctccgatgccctagactttgaaaccgagcataaactggacccagtgttcgatagccctcggatgtctagacggagtctcaggctggctacaaccgcatgtaccctgggggacggcgaagctgtcggagccgatagcggcacctcgagcgccgtgtcactcaagaacagggctgcatag

SEQ ID NO: 17269 - DNA, 2109 bp, Artificial Sequence
  Description of Artificial Sequence: Synthetic coding sequence
atgtcacggcgtagtctccgccttgctacaaccgcatgcaccctgggcgatggtgaagccgtcggcgcggactctggtacttcttcagccgtctcactcaaaaaccgtgctgcgaggaccacaaaacagcgccgctcaactaacaagtccgcttttagtatcaatcacgtaagccgtcaggtcacatcaagcggcgtgtctcacggcggaacagtgtccctgcaggatgctgtgacacgccgaccacccgtactggatgaaagctggattagggagcagacgacggtggatcacttctggggtctcgacgacgatggagatctgaaggggggtaataaagccgccatacaagggaatggagacgtgggtgccgcagccgccacagcccacaacggcttctcttgctcgaattgttctatgctgagcgaacgcaaggatgtgctcaccgctcatcctgccgcacctggcccagtttcccgtgtgtatagtagagaccgtaatcagaagtggaaggcggcttctggcgtattctggtggctggggattggctggtaccaattcgtcacattgattagctggttgaatgttttcctgttgacccgctgtctgcggaatatctgcaagtttcttgtgctgctgatccctcttttcctgctactcgccggccttagcttgaggggccagggaaacttctttagcttcctgcctgtgctgaattgggcctcaatgcatcgcacacagcgcgttgacgacccgcaggatgtattcaaacccaccacctcacggttgaaacagccactccaaggcgattctgaggccttcccctggcactggatgtcaggggtggaacagcaagtggcctcgctctcaggccagtgtcatcaccatggggagaatctgagagaattgactaccctcttgcaaaagctgcaggcaagagtagaccagatggaaggcggcgctgctgggccatctgcttccgtacgcgatgcagtaggacagccacctagggaaacagacttcatggctttccatcaggagcatgaggttcgcatgtctcatctggaagacatcctgggtaagctcagggaaaagagcgaggctatccagaaggagctggagcagaccaaacagaaaactataagtgccgttggagagcagctgttaccaactgtggagcacctgcagctggaactggatcagctcaagagcgagctgagtagttggagacatgtaaagacagggtgtgagactgtcgatgccgtgcaggaacgagtggacgtccaggttagggaaatggtaaagctcctgtttagtgaagatcagcagggaggctccttagaacagctgctgcagcggttctctagccagtttgtatccaagggcgatctgcagaccatgctgcgcgacctgcaactgcaaattctaagaaatgtgacccatcacgtgtctgtgactaaacaactgcctacttcggaggctgtcgtgagcgccgtgagtgaagctggcgcctccggcataacggaagcacaggcaagagccatcgtcaactccgcattaaagctctattcgcaagataaaaccggaatggtagatttcgcacttgagagcggaggggggtcgatattgtcgaccagatgcagtgagacatacgagaccaagactgcgctgatgtccctcttcggcatccccctctggtactttagtcaatcacccagagtcgtgattcaacccgacatctacccaggcaattgctgggcattcaaggggagtcaaggatatctagtagtacgcctatcaatgatgattcacccagctgcttttaccctggagcacatacctaagacactctcacctacggggaacatctcatctgcccctaaagatttcgctgtgtacggcctcgaaaatgaatatcaggaggagggacagttgctgggacagtttacatatgaccaggacggagagagcctgcagatgttccaggccttaaagcggcccgacgacacagcgttccaaattgtcgagctcaggatcttcagcaattggggccatccagaatatacttgtctttatcggttccgcgtccacggcgagcctgtgaaatag

SEQ ID NO: 17270 - DNA, 525 bp, Artificial Sequence
  Description of Artificial Sequence: Synthetic coding sequence
atggattttagcaggctgcacatgtattctcctccgcagtgtgtccccgagaatacaggctatacatacgcactctccagtagttacagctccgatgccctggacttcgaaacggaacataagctagatccagtcttcgattcaccccgcatgtcccggcggtccctacggttggccacaacagcatgtacgctgggggacggcgaggcggtgggggccgattccggcacttcgagcgccgtaagtctaaaaaacagagctgccaggactactaagcagagaagatccaccaataagtcagccttttctattaatcatgtgagtcgccaggtgacatcaagcggtgtgtcacacggcggcacagttagcttgcaggacgctgttacccggcgccctcccgttctggatgagtcctggatcagagagcagacaaccgtcgatcacttttggggtctggacgatgacggcgacttgaaagggggcaacaaagctgctattcaaggtaatggcgacgtgggcgcctag

SEQ ID NO: 17271 - DNA, 408 bp, Artificial Sequence
  Description of Artificial Sequence: Synthetic coding sequence
atggacttcagtcgattgcatatgtacagtcctccccagtgcgtcccggagaacacaggatacacctacgccctgagttcgagctatagttcggacgccctggatttcgagacagaacataaactggatcccgtatttgactctccacgcatgagtcgtaggagcctgagactggctaccacagcatgtacccttggcgatggagaggctgtgggcgccgacagcggaacgtcctccgccgtttcattaaaaaaccgcgctgcccgcaccacaaagcagcgcaggagtactaacaaatctgctttttcaattaaccatgtttcccgccaggtcacctcatccggggtctcgcatggaggcactgtgagcctgcaggatgcggtgactcgacggccacccgtgctatag

SEQ ID NO: 17272 - DNA, 267 bp, Artificial Sequence
  Description of Artificial Sequence: Synthetic coding sequence
atggacttcagtcgcctgcatatgtattcaccacctcagtgcgttcctgaaaacacggggtatacttacgccctctcaagttcttacagctcggacgctcttgattttgagaccgaacacaaactggatccggtttttgattctccaagaatgtcaaggagaagtctcaggctcgccacaaccgcttgtactctgggggatggagaggctgtcggagcagacagcggtacctcgtccgccgtgagcctgaaaaatcgcgctgcatag

SEQ ID NO: 17273 - DNA, 2049 bp, Artificial Sequence
  Description of Artificial Sequence: Synthetic coding sequence
atggatttctcacggttgcacatgtatagtcctccacagtgcgtgccagaaaacaccggctatacgtacgccttatcttcatcttattccagcgacgcccttgacttcgagaccgaacacaaattagaccctgttttcgattctccacgcatgtccaggagatctttacgtctggctacaacagcctgcacattgggcgacggtgaggcagttggcgccgattcgggaacgtccagtgcagtcagccttaagaaccgagccgcccggactacgaaacagaggcgaagcactaacaagtctgctttctcaatcaaccacgtgagtaggcaagtgacttcttctggcgtctcccacggcgggactgtgagtctgcaagatgccgttacccgcagaccccccgtgctggacgagagctggatcagagagcagactactgtggatcatttttgggggaaagccgcttcaggggtgttttggtggctgggtatcggctggtaccagttcgtgaccctgatctcctggctcaatgtatttctgctgactcgatgcctgcgcaatatttgcaagttcctggtcttgctgattcctttattcttgttgcttgggctctcactccgggggcagggaaatttctttagttttctgccggtgttgaactgggcttcgatgcacagaacacagagagttgacgatccacaggacgtcttcaagcccactacctcaaggctgaaacaaccccttcagggcgactccgaagccttcccatggcattggatgtcgggtgtggagcagcaggtggcatcgctgtctggccaatgtcaccaccacggcgagaatctccgcgaactgacaaccttattgcagaagttgcaggcgcgagtcgaccagatggaaggaggcgcagctgggccatcggcctccgtccgcgacgccgtggggcaacctcccagggagacggatttcatggcgttccatcaggagcatgaagtccggatgtctcaccttgaagacattctcggaaagctgagagaaaagagtgaggcgatccagaaggagttggagcagaccaagcaaaaaacaatttcggctgtcggtgaacagctgttacccaccgttgagcatctgcagctggagctcgatcaactcaaaagtgaactttcttcctggagacacgtgaagacaggctgcgaaaccgttgatgccgtgcaggaaagagtagatgtacaggtacgcgagatggtgaaactgctgttcagcgaggatcagcagggtgggtccctcgaacagctcttgcaaaggttttcatcccagtttgtgagcaagggggatctccagacaatgctgcgcgatttgcagctgcaaatcctgcggaatgtgacccaccatgtcagcgtaactaaacagctgccaacgagcgaagcagttgtctccgccgtgtccgaggctggcgcaagcggaatcaccgaggcacaggcccgcgccattgtgaacagtgcacttaaactgtatagccaggataagactggcatggtggattttgcgctggaatctggcgggggatccattttgtctacaagatgctctgaaacatacgagaccaaaacagctctgatgagcctgttcgggatccccctttggtacttctcccagagccccagagtcgtgatccaacctgatatctacccgggcaactgctgggccttcaaaggaagccagggatacctggtggtccgcctgtccatgatgattcaccccgccgcctttactttagaacatatccctaaaacgctttctcctaccggcaacatttccagcgcacccaaagattttgccgtttacggtctcgaaaatgagtaccaggaggagggtcaactgttgggccagttcacttacgaccaggatggtgagagtctgcagatgttccaggcactcaaaaggccggacgatacagcctttcaaatagtggagctgcggattttttctaactgggggcaccccgagtatacatgcctgtatcggttcagggtgcacggcgagccggtaaagtag

SEQ ID NO: 17274 - DNA, 2925 bp, Artificial Sequence
  Description of Artificial Sequence: Synthetic coding sequence
atgggggacgtccgcaaagccaaagaagctctggctgaggttcaaattcctccaccagatgctggccccagccccagatgtaagccaccgcccgccgaacgccttctggggccaggcagaaggcgcaggggcctgaggagacgacgagaggcagtgtggtttgaggtggtgaatatggacttcagtcgattgcacatgtattcacctccacagtgcgtgcctgaaaacaccggttatacctatgccctaagctcctcatatagcagcgacgccttggactttgagaccgaacacaaacttgacccagtcttcgacagtccacgcatgtctcgtcggagcctgagactggccaccacggcttgcaccctgggcgacggggaggctgtaggagctgatagcgggacatcatccgctgttagcttgaaaaaccgcgctgccaggacaacgaagcagcgtcggtcgacgaataaatcagcattcagcatcaatcacgtctctagacaggtgactagttctggggtttctcatgggggcaccgtgtctctacaggacgccgtcacccggagacctcccgttctggatgaatcctggattcgggagcagacaaccgtggatcacttctggggattagacgatgacggcgatctaaaaggcggtaacaaggcggccatccagggcaatggagatgtgggagctgctgctgccacagcacataacggcttctcttgttctaactgcagcatgttgagtgagcgcaaggatgtccttacagctcatccagccgctcctgggcccgtgtctagagtgtattctcgagacagaaatcagaaatgtggggcatctttctacgtgaatcgcatcctgtggttagcaaggtacactgcgtcctcattttcatcattcctggtccagctgtttcaggttgtgttaatgaagttatcttatgaatcggagaactataagttaaaaacccacgaatcaaaggattgcgagtctgaatcatacaagtcaaagtcacatgagtctaaagctcacgcctcttactacggccgcatgaacgttcgagaggtcctgcgggaagatgggcatctctccgtcaacggggaggccctttgcgacgactgtaagggcaagcgccacttggacgcccacaccgcagctcattctcagagccccaggctgccaggtcgggccgggaccctctggcacatctgggcctgcgcgggatactttttgctgcaaattttgagacgcatcggagctgtcggccaggccgtaagccgaacggcctggtccgccctgtggcttgccgtggtcgctcctggcaaagccgctagtggagtattctggtggctggggattggttggtaccaatttgtgaccctcattagctggctgaatgtttttctgctgaccaggtgccttaggaatatctgcaagtttttggtgctgctaatcccactgtttctcctgcttgcgggattgtctctgcgaggacaagggaacttcttctcttttttaccagttttaaactgggcgtccatgcatcggacacaacgcgttgatgaccctcaggatgtttttaagcctacaactagcagattaaagcagcctctccagggggacagcgaggcatttccgtggcactggatgtcaggggtggagcagcaggtggcctctctgtccgggcagtgccaccatcacggcgagaatctgcgggagctgacgacgctgcttcagaagttacaggcccgagtggatcagatggaagggggagccgccgggccttccgctagcgttagagacgcggtgggccagccaccccgcgaaaccgattttatggcttttcaccaggaacatgaggttaggatgtcccatcttgaggatatactaggcaagctgcgcgaaaagtccgaggcaatacagaaggaactggagcagactaagcagaagacaatcagtgcagtgggtgaacagctgctccctacagtagagcacttacagctggaactggaccagctgaagtcggaattatcaagttggcgccacgtcaaaactggttgcgaaactgtcgatgccgtccaggagagagttgacgtacaagtacgcgagatggttaagctgctcttcagtgaggatcagcagggtggcagcttggagcagctgctgcaacgttttagctcccagtttgtttccaagggtgatctgcagaccatgctccgggacctgcaactacagatcctgcggaacgtaactcatcatgtaagcgtgactaagcaactgccaacgtccgaagctgttgtgagcgcggtgagtgaagcaggcgcaagtggtatcactgaagctcaggccagagctatagtgaactcagctctgaagctgtacagccaggataaaacgggcatggtggacttcgccttggagagtggggggggcagcatattgtctaccagatgctctgagacttacgagacgaaaacagcccttatgtccctcttcggaattcccctctggtatttctcccagtctccacgcgtggtaatccagcccgatatctacccgggtaactgctgggcttttaagggatctcaggggtacctggtggtgagacttagtatgatgatccatcctgccgcttttacgctcgagcatattcctaagacattgagcccaacaggcaacatctcctcggccccaaaggactttgctgtgtatggcttagagaacgagtaccaagaagaggggcaactactgggacagtttacttatgatcaggacggagagagcctccagatgttccaggccctcaaaaggcctgatgacacagcatttcagattgtggagctacgaatatttagtaattgggggcacccagagtatacttgcctgtaccgttttagagtgcacggggagcccgtcaagtag

SEQ ID NO: 17275 - DNA, 837 bp, Artificial Sequence
  Description of Artificial Sequence: Synthetic coding sequence
atggggcggatatctccgggtagcccaggcctgcctcggacagtctggtttgaggtggttaatatggattttagcagactgcatatgtattcacccccccagtgcgtgccagagaataccgggtacacatacgccctctcctcttcgtactcatccgatgccctcgatttcgaaacagagcacaaacttgacccagtttttgattcccccagaatgagccggcgctcccttaggctcgctaccacagcctgcactctgggcgatggagaagctgtcggagctgactcaggtacttctagtgcagtgagcttaaaaaatagagcagctagaactaccaaacagcggcgctccaccaacaagtcagcattctctatcaatcacgtctccaggcaggtgacgagctcaggagtctcgcacggcggaacggtctctctgcaggatgccgtaacccggaggccaccagtgctagacgagagctggattcgcgaacaaacaaccgttgaccacttttggggcttggatgacgacggggaccttaaggggggcaacaaggcggccatccaaggcaacggtgacgtaggcgcggcggcagccacggcacacaacggcttttcatgtagcaactgctcaatgctctcagagcgcaaggacgtgcttacagcccatccagcagcacccggcccagtctcacgagtttactcccgcgacaggaaccaaaagtgcaaatcccagagcttcaaaactcagaaaaaggtatgctttcctaacctgatctttccgttttgcaaatctcaatgcctccactatctctcctggaggctcaaaattattccatag

SEQ ID NO: 17276 - DNA, 360 bp, Artificial Sequence
  Description of Artificial Sequence: Synthetic coding sequence
atggatttcagtcgcctgcatatgtactcaccaccccagtgcgttcccgaaaatacaggctacacgtatgctctgtcaagttcctatagctccgacgcgttagacttcgaaaccgagcacaaactggatccagtcttcgacagcccccggatgagccggcgttccctaagactggccacaacagcttgcacactcggggacggggaggcagtcggtgctgacagcggcaccagttctgcggttagcttgaagaacagggccgcacggacaaccaagcagcggcggtccacaaacaagagtgcctttagcattaaccacgtaagcagacaggtgactagcagcggcgtgagccatggttag

SEQ ID NO: 17277 - DNA, 2352 bp, Artificial Sequence
  Description of Artificial Sequence: Synthetic coding sequence
atggtgataatgtctgagttttctgctgatcctgccggccagggccagggacagcagaagccccttcgtgtcggcttttacgacatcgagagaacgctcggcaagggcaacttcgccgttgtcaaactggcccgacatcgcgtgaccaaaactcaggtagccatcaagatcatcgataaaactagacttgatagtagtaacctagaaaagatctaccgcgaagtgcaactgatgaaattgctcaatcacccccacattattaagctctatcaggtgatggaaacgaaagatatgctttacatcgtaaccgagttcgcaaaaaatggggagatgtttgactatctcacctctaacggtcatctgtctgagaacgaagcacggaagaaattttggcaaattttgtctgccgtggagtattgccacgatcatcacatcgtgcacagagaccttaaaacggagaacctgctgctggacgggaacatggacatcaagttggccgacttcgggttcggcaatttctataaatccggcgagccactctccacttggtgcggaagccccccctacgcagcacccgaggtgttcgagggtaaggaatatgaaggtcctcagttagacatatggagcctgggagtcgtgctctacgtcctcgtctgcggaagcctgccattcgacggccctaacctgccaacgctccgacaaagggtgttggagggtagattcaggatcccattttttatgtcccaggactgtgaaagcctgatcagaagaatgctggtcgtggacccagccaggcgcatcaccattgctcaaatcaggcaacaccggtggatgagggcagagccctgcctcccgggccctgcctgcccagccttttctgctcacagctacacaagcaatctgggggactatgacgagcaggcacttggcattatgcagacattgggcgtcgatagacagaggacagtcgagtccttgcagaattcctcttacaatcactttgcggccatttattacttattgctcgaaagactgaaggagtaccggaacgcgcaatgtgctcgtcctgggcctgcacggcagccccgcccacgttcatctgacctgagcgggctggaggtaccacaggaaggcttgtcgacggatccctttagacccgccctgctctgtcctcaacctcaaaccctagtgcagtccgtgctacaggctgagatggattgcgagctgcagagctcactgcagtggccactattcttccccgtcgacgcctcctgctcaggggtcttcaggcctcgtcccgtgagcccttcctctctgcttgatactgccatctccgaggaagcccgccaaggtccaggacttgaggaagaacaagatacacaggaaagcctgccctcttcaacaggcaggagacacacacttgctgaagtgtcaacccgcttaagccccctgacggccccatgcattgtcgtgagcccctccacaaccgccagtcccgcggaggggacctcatccgacagctgtctgacattctcggcctcgaagagccccgcaggcctctccggtactccagctacgcagggcctgctgggggcatgttcacctgtccgcctcgcctctccctttctgggcagccaaagcgccacgcccgtactacaggcccagggaggactgggcggtgcggtgctgcttcctgtgtccttccaggaggggagaagagccagcgatacatctctcacgcagggcttgaaagcgttccggcagcagctgaggaaaacgactaggactaaaggttttctgggccttaacaaaatcaaaggccttgccaggcaggtgtgtcaggcgccagctagtagagcaagtcgcggcgggctttcccccttccacgctcctgctcagtctccagggctccatggaggggccgccggatctcgagagggttggagcctattagaggaggtactagagcagcagcgcctgcttcagctgcagcaccaccccgccgccgctcccggatgtagccaggcaccacagccggcccccgctcctttcgtgatagcgccctgcgatggcccgggagccgccccacttccgtcgaccctcctgacctctgggcttccgctgttaccgccaccactgctgcaaacaggagcgagtcctgtagccagtgctgcccagctgctagatacccacctccacattgggactggaccaactgcgctccccgcagtgcccccgccccgactagcacgtctcgcccctggatgcgagccactcggccttctacaaggggattgcgagatggaggaccttatgccatgctccttgggaacattcgtcctagtgcagtag

SEQ ID NO: 17278 - DNA, 3744 bp, Artificial Sequence
  Description of Artificial Sequence: Synthetic coding sequence
atggaggacgctggggccgccggccctggaccagagcccgagcctgagccagagccagaaccagagccggccccggaacctgaaccggagcccaagccaggggccggtacgagcgaggccttttcacgactttggaccgacgtcatgggcattctggatggcagcctcggcaacatcgacgacctcgcgcaacagtacgcggattattataacacatgctttagcgatgtgtgcgaacggatggaagagttacgcaagcggagggtcagccaggatctcgaagtggaaaaacctgacgcctcccccactagcctgcaactgcggtcccagattgaggagagtcttggcttctgcagtgcagtgtcaactcctgaggtagagcgtaaaaatcccctgcacaagagcaactcggaagactccagcgtgggcaagggagactggaagaagaagaataaatacttctggcagaacttccgcaagaaccaaaaaggcattatgaggcagacttcaaaaggggaagatgttggttatgtcgcttccgaaataaccatgtccgacgaggagcggatacagctgatgatgatggtgaaggaaaagatgatcaccattgaggaagcacttgctcggttgaaagaatatgaagcccagcaccgacagagtgccgcactggatcctgccgactggccagacgggtcctacccgactttcgacgggtccagtaattgtaacagccgcgagcaaagtgacgacgagaccgaggaatctgtgaaattcaaacggcttcacaaacttgtgaacagcacccggagggtgcggaaaaagctgatccgggtggaagaaatgaagaaaccctcaaccgaagggggggaggagcatgtgtttgagaattctcctgtgctcgatgagaggtcagcactgtattcaggggtgcataaaaaacctctttttttcgacgggtcccccgaaaagcctcctgaggatgacagcgatagcttgactacttcaccctcgtcttcttcactggatacctggggcgcgggtcgcaaactcgtcaagaccttctccaagggggagagccgaggcttaattaagccaccaaaaaagatgggaacctttttcagttatcctgaagaggagaaggcccagaaggtgtccagaagcttgaccgagggggaaatgaagaagggacttggcagcctcagtcacggacggacatgttccttcggggggtttgatctgacaaatcgatcattacatgtcgggtctaataactcagaccccatgggaaaggagggtgatttcgtctataaagaagtgattaagagtcccacggccagccgcatttcgctgggcaagaaggtgaaatcagttaaggaaaccatgcgcaaaaggatgagtaaaaagtactctagctcagtatctgagcaggattccggcctcgatggtatgccagggagccctcctccttctcagccagatcctgaacatctggataagccgaagcttaaggccgggggatccgtggagtccctcaggagcagcctttccggacaatcgagcatgtcgggacaaacagtctcaacaaccgattcaagcacaagcaatcgagagtcagtcaaatccgaggacggtgacgacgaagagccaccctatagaggacctttttgcggcagggcacgggtacacaccgatttcaccccctcaccatacgacacggatagcctgaagttgaagaaaggcgacatcatcgacattatcagtaaacccccaatgggaacatggatgggactattaaacaacaaagtgggaacatttaaatttatatacgtggatgttctgagcgaagatgaagaaaagcctaaacgtcccactaggcgcaggcgcaagggcaggcccccacagcccaaatctgtcgaagatctcctcgatagaattaacctcaaggaacatatgcctacttttctgttcaacggttatgaagacctggataccttcaagcttctggaggaggaggatctcgacgagctgaacattcgcgaccctgagcatagggctgtgttgttgacggccgtggaactcttgcaagagtacgacagtaactctgatcagtccgggtcccaggagaaacttctcgtcgactcacaaggcttgtcggggtgctctcccagggactcaggatgttatgaaagctcagaaaatttagagaatggcaagactagaaaggcttcgctcctgtccgctaagagctcaacagaaccttcacttaagtcttttagtaggaatcagcttggaaactaccccacacttcctctgatgaagtccggggacgcgctcaaacaagggcaggaagagggccggttgggaggggggctcgcccctgacacaagtaagagctgcgacccccctggggtaactgggctgaataaaaacaggagatcactcccggtgtctatttgccggtcttgtgagacactggagggtccacagactgtggatacctggcctcggagtcattcactggatgatttacaggtggaaccaggggccgaacaggacgtccctaccgaagtaactgaaccgccgccgcaaattgtgcccgaagtgccacagaaaaccacagcgagtagcactaaggctcagcccctggaacaggattctgcagtggacaacgccctcctgctgacacagtctaagcgattcagcgagcctcagaaactcaccacaaaaaagctggaaggctccatcgctgcctcggggcgtgggctgtctcctcctcagtgcctgcccaggaattatgatgctcagccaccaggtgccaagcacggactggcgcgtactccccttgaaggtcaccggaaagggcatgaatttgaggggactcaccacccactcggtaccaaggagggcgtggacgcggagcagagaatgcaacccaaaatcccttctcagccccctcctgtcccagcgaagaagtcccgcgaacgcctggccaatggcctgcaccccgtccccatgggaccttcgggcgccctcccatcaccagatgctccttgtttgcccgtcaaaaggggatctccagcctctcctacttcgcccagcgattgcccccccgcgcttgccccacgcccgttgtccggacaagcacccggctcaccaccatccacgagacctccaccttggctgtccgaattgcccgagaatacttcattgcaggagcatggcgtgaaactcgggcccgcactcacccggaaagtgagctgtgccagaggtgtcgacctggagacactgacagagaataaactgcatgctgagggtatcgatttaaccgaagaaccctattcggataagcacgggcgctgcggaatccccgaggccctggtgcagagatacgccgaggatctcgaccagccagaaagagatgtggccgctaacatggaccagatcagggtaaaacaactgcggaaacaacatagaatggccatcccaagcggagggcttaccgaaatctgtcggaaacctgtgagcccaggttgtatctcatcagtgtccgactggctcataagcattggtttgcctatgtatgccgggacattgtctacagcaggctttagtactctctcgcaggttccttcactgtcgcatacctgccttcaggaagcaggcatcactgaggaaagacatatccgcaagttgctatctgccgcgcgacttttcaagctgccgcctggtcctgaggcaatgtag

SEQ ID NO: 17279 - DNA, 255 bp, Artificial Sequence
  Description of Artificial Sequence: Synthetic coding sequence
atggaagaacaagactgcagagatggatccctcggcaatatagacgacctcgcccaacagtacgctgattactataatacgtgcttttctgacgtctgtgagcgtatggaggagttgcgtaagcggcgagtctcccaggacttggaagtggagaagcctgacgctagtccaacctcactccagctgcggagccaaatcgaagagtcactgggtttttgctccgccgtgtcgacgcccgaagtggagcggaaatag

SEQ ID NO: 17280 - DNA, 249 bp, Artificial Sequence
  Description of Artificial Sequence: Synthetic coding sequence
caggcacaggatttcaaggacgggagccttggaaacatcgatgacctggctcagcagtacgcggactactataacacctgtttttcagatgtatgcgagcgcatggaagaactcagaaagagaagggtctctcaggatctcgaggttgaaaagcctgacgctagtccaaccagccttcagctcagaagccaaattgaggaatcactggggttttgcagtgccgtgagtaccccagaagtcgagcgatag

SEQ ID NO: 17281 - DNA, 2091 bp, Artificial Sequence
  Description of Artificial Sequence: Synthetic coding sequence
atgccgaagcctagtagagagcaatccgatgatgagacggaagagagcgtgaaattcaagcgattgcacaagctggttaacagtacccgccgggtcagaaaaaagcttattagagtggaggagatgaagaaaccctccacggagggcggtgaggaacacgtctttgaaaacagccccgtgctggatgagagatctgctttgtattctggcgtgcacaagaaacccctgtttttcgatggatcacctgaaaagccgccagaggatgattcagactctcttaccacatctcctagtagctcatctctggatacctggggggctggaaggaaacttgttaagacattcagcaagggcgagtccagaggcctgatcaagcccccgaagaagatgggaactttcttcagctaccctgaggaagagaaggctcagaaggtcagtcgcagcctcaccgagggggagatgaaaaagggattaggctctctctcacatggtaggacttgctcattcggcggctttgacctcactaatcggtcactccatgtagggtctaataacagtgatccaatgggaaaagagggcgactttgtatacaaggaagtgattaaaagccccacagccagtaggataagcttagggaagaaggtgaaatccgtgaaggagactatgaggaagcggatgtccaagaagtattcaagtagtgtgtccgagcaggacagtggcctggacggcatgcccggctcaccgcctccttcacagccagacccagagcacctggataagccgaaactcaaagctgggggttccgtcgaaagcctcaggagtagcttatctggccaaagtagcatgtcggggcagaccgtcagtaccacagattctagtactagcaacagggaatcagtgaaaagcgaagatggcgacgacgaagagcccccatatagggggccattttgtgggcgggcacgcgtgcacactgattttacgcctagcccatatgatactgactcactcaagctgaaaaagggagacataatcgacataatatctaaaccaccaatggggacctggatgggccttctgaataataaggtcggtacgttcaaattcatatacgtggatgtcctcagcgaggacgaggagaagccaaagcgacccaccaggaggaggaggaagggtagacctccgcaaccgaaatcggtcgaagacctgctcgaccgaatcaatctgaaggaacacatgcctacgttcttgtttaacggctatgaagatctggatacgttcaagcttctcgaggaggaagacctggatgagctgaacattagggatcctgaacacagggctgtgctgctcaccgccgtcgaactacttcaggagtatgatagtaattccgaccaatctggctcacaagaaaagcttcttgttgactcccaggggctgagcgggtgtagcccacgagacagcggctgctatgaatcttcagaaaatctggagaatgggaaaactagaaaagcctccctgctctctgccaagtcctccaccgagccgagcctaaaaagttttagccggaatcagctgggtaactatcctactttgcccctaatgaaatcgggggatgccttgaagcagggacaggaagaggggcggttgggcgggggcctcgctccagacacatctaagtcctgtgatccccccggtgttacagggctcaacaaaaaccggagatcgttgccagtctccatctgtcgctcctgcgagaccctggagggtccacaaaccgtggatacttggcccagatctcactcactggatgatcttcaagttgaacccggggccgagcaggacgtgcccacagaggtaaccgagccaccaccccagattgttcccgaagttccgcagaaaaccactgcctcctctaccaaggcccagcccctcgagcaggacagcgctgtggataacgccctactcctcactcagtccaagcgtttctccgagccccaaaaactaactactaaaaaactcgaggggtccattgccgcttcaggccgcggcttgtcccctccacagtgtctgcccaggaattacgatgcacagtag

SEQ ID NO: 17282 - DNA, 1974 bp, Artificial Sequence
  Description of Artificial Sequence: Synthetic coding sequence
atgggcacctggatgggactgctgaacaacaaagttggcacattcaaatttatttatgttgatgtgctttccgaagatgaggaaaaaccgaagagaccgaccaggcgtagaaggaaggggcgacccccacagcctaagtccgtggaggatcttctggacaggatcaatctcaaagagcatatgcccacattcttgttcaatgggtacgaggacctcgacacatttaaactccttgaagaggaggatctggacgaattgaacattcgggatccggagcaccgagctgtcctgctgactgccgtagagctgctgcaggagtatgattcaaacagcgatcagagcggtagccaagagaaacttttagtggacagccagggactctcgggatgctcccccagagatagcggctgctatgagtcctccgaaaaccttgagaatggcaagactaggaaagctagtctgctgtcagctaaatcaagtaccgagccatcactgaaatctttcagtagaaatcaactcggaaattaccccaccctgcccctgatgaagtccggggatgcacttaaacagggacaggaggaggggcggctgggaggtggcctagcccccgacactagcaagagttgtgatcctcccggcgtgacggggctcaataagaatcgccgctcactgcccgtaagtatatgtcgatcgtgcgaaacgctcgagggcccccaaacagtggatacttggccccgctcacattccctcgatgacctgcaggtggagcccggtgcagagcaggacgtgcccactgaggtcaccgagccccctccacagatcgtaccagaggtccctcagaagaccacagcgagcagcaccaaggcgcaaccactggagcaagactcagccgtggacaatgccctacttctgacccagtccaaacggttttcagagccccagaagttaacgacaaaaaagctggaggggtccatcgctgcctcaggaagaggtctaagccctccacagtgcctccctaggaattacgatgcacagccaccaggggccaagcacgggctggctaggacccccctggaaggtcacaggaagggtcacgagtttgaaggtacacatcatccgctgggaacaaaagagggagttgacgctgagcagcgaatgcagccaaaaatcccatcacagccgcctccagtcccggcaaaaaagtctagagaacgcctggccaatgggctgcatccagtgccaatgggacccagcggagcactccctagtccagatgctccatgccttccggtaaagcgcggcagccccgcttcaccaaccagccccagcgattgtcctcccgctctggcccctagaccattatctgggcaggccccgggatctccccccagcacacggccccccccctggctgtcagagttgcccgagaacaccagcttgcaggaacacggtgtgaaactgggacccgccttgaccagaaaggtatcctgcgctagaggagtcgatttagagaccctgacagagaataaactgcacgccgaaggcattgatctgaccgaggagccctatagtgacaagcatggaagatgcgggatcccagaggcattagtgcagcgttatgccgaggatctggaccaaccagagcgagacgtggccgctaatatggatcaaattagagtgaaacagttgaggaaacagcacaggatggcgatcccttctggaggactgacagagatctgtcgcaaacctgtttctccaggctgtatctcatctgtcagtgactggttgatctcaataggactgccaatgtacgccggaaccttatcaaccgcagggtttagcacattgagccaggtgcctagcttaagccacacctgcctccaggaggctggcattacagaggagcggcacatacgtaagcttctttcagctgccagactcttcaagcttccacccggtcctgaagcaatgtag

SEQ ID NO: 17283 - DNA, 621 bp, Artificial Sequence
  Description of Artificial Sequence: Synthetic coding sequence
atgctgccccctgctatccacttctaccttctgccactcgcctgtattttgatgaaatcgtgtctggcattcaagaacgatgcaactgaaatactgtacagccatgtcgttaagccagttccggctcacccttcttccaacagcacccttaatcaagcgagaaatgggggtcgacacttttcaaataccgggctggaccggaacacccgagtacaggtaggatgtagagagctccggagcacaaaatacattagcgatggacagtgcacgtcaattagccccctcaaggaactggtgtgcgcaggggagtgcctgcctcttccggttctgccaaactggataggcggtggttatggtaccaagtactggagcaggaggagttcacaggagtggcgatgcgtgaatgacaagacacgcacacagcgcatccagctgcaatgtcaagacggaagcacccgaacttataagatcactgtagtcaccgcgtgtaagtgcaagcgctatacccggcagcacaatgagtcgtcacacaattttgaatctatgagtccggccaaacctgtacagcatcacagggaaagaaagcgggcatcaaaatcctccaaacacagcatgtcatag

SEQ ID NO: 17284 - DNA, 693 bp, Artificial Sequence
  Description of Artificial Sequence: Synthetic coding sequence
atgctgccacccgcgattcacttctacctgctgcccttggcctgtattctcatgaaatcatgcttagctttcaagaacgacgcaaccgaaatcctctattcccacgtcgtgaagcccgtgcccgcacatccctctagtaattcaacactgaaccaggccaggaacggcgggcgccacttctccaatactggactcgatcgcaataggactgagtccctgaccaggcagaactatttttggctgtttcccggtgcctttttgagacagctacaggaagctagggtccaggttggctgtcgggaactgagatctactaaatatatctcagatgggcaatgtacctcaatttctcccttgaaggaactcgtttgtgctggagagtgcttgccccttcctgtgctgccaaattggattgggggaggttacggaactaaatattggagcagaagatcaagccaggagtggagatgcgtgaatgataagacaagaacccagaggattcagttgcagtgccaggatggtagcacacggacttataaaattacagtcgttactgcctgcaaatgcaaaaggtacactaggcagcacaacgagtctagtcacaatttcgagtctatgtctcctgctaagcctgtccagcaccatagggagcggaagcgcgctagcaagagtagtaagcactcaatgtcttag

SEQ ID NO: 17285 - DNA, 2229 bp, Artificial Sequence
  Description of Artificial Sequence: Synthetic coding sequence
atgggatctgagaacagtgctctgaaaagctatacactcagagaacctccttttactctgccttcagggctggctgtgtaccctgccgtgttgcaagacggaaagttcgcgtcagtgttcgtctacaagcgtgaaaacgaggataaggtcaataaggccgcaaagcatctgaagactctgagacacccttgccttctaagattcctgtcttgcacagtggaggctgacggaattcatctggtcaccgagcgagtgcagccactggaagtagcactagagaccctatccagcgccgaggtttgcgctggaatctatgacatcttgttggccctgatcttcctccacgaccgcggacatcttactcataacaatgtctgtctgtccagtgtattcgtttctgaagacggtcattggaaattgggcggaatggagacggtgtgcaaagtgtcacaagccactccagaattcctgcgatctattcaaagtatccgcgacccagcctcaattcccccagaggaaatgagtcccgagttcactactcttccggaatgccacgggcacgctagagacgcattcagcttcggaacccttgtcgagtcactccttactattttaaatgagcaggtttcggctgacgtgctcagttcattccagcagacgctccattccacgttgctgaatccgattcccaaatgccgccctgcactgtgcactttgctcagccacgacttcttcagaaacgactttctggaggtcgttaactttctaaagagcctcaccctcaagtctgaggaggaaaaaaccgagttcttcaagttcctgctagatcgtgtgtcctgcctgagcgaggagttgatcgcttccagactcgtcccactgctgctgaatcagctcgtgttcgccgaaccggttgcagtgaaaagcttccttccctacttacttggaccaaagaaagatcatgcacaaggggaaacaccctgtctgttgtcaccagccttgtttcagtcccgggtgataccagtcctcttacagttgtttgaggtgcacgaggaacacgtgagaatggtgctactgtcacatattgaagcctacgtggagcactttactcaggaacagctcaagaaggtgatccttcctcaggtgttgctgggtttgagagatacatccgacagcatagtagcaatcacccttcacagtttggccgtgttagtgtcacttctcggtcccgaagtggttgtaggcggagagcgcacgaagatcttcaaaaggaccgctccaagtttcacgaagaacacggatcttagcctggaagatagcccgatgtgcgtggtctgttcacatcattcacagattagccccatcctagaaaaccctttctccagcatctttccaaagtgctttttcagcggctccaccccgatcaatagcaagaagcacatccagagggattattacaacacgctgctacagaccggtgaccccttctcacagccgatcaaatttccaataaatgggctcagtgacgtcaagaacacttccgaggatagtgaaaatttcccttctagttccaaaaaaagtgaagaatggcccgattggtcggagccagaggaaccagagaatcagacagtgaatattcaaatttggcctcgtgaaccgtgtgacgatgtgaagtctcagtgcaccaccctggacgtagaggagagctcctgggatgactgcgaaccgtcgtcactggataccaaggttaatcccggggggggcatcacagccacaaaacccgtaactagcggcgagcaaaagcctattcccgcattgctcagcttgaccgaggaatctatgccctggaagtcctcgttgccacagaagatttccctggtgcagaggggagatgacgccgaccaaatcgagccccctaaggtctcatcccaggagagaccgctgaaagtaccatccgaattggggttaggcgaagaattcaccatacaggtgaaaaagaagccagttaaggatcccgagatggactggtttgccgatatgatccctgaaattaaaccctctgctgcctttctcattctgcctgagctccgaacagaaatggttcctaagaaagacgacgtgtcccctgtgatgcagttctcctccaagttcgcggcggcagaaatcactgagggtgaagctgaagggtgggaggaagaaggagagttgaactgggaggataacaactggtag

SEQ ID NO: 17286 - DNA, 2067 bp, Artificial Sequence
  Description of Artificial Sequence: Synthetic coding sequence
atgggatccgaaaactctgctctcaaatcatataccctgcgggaacccccttttacacttcctagcggcttagcagtgtacccagctgtccttcaggacggcaagtttgcttctgtgtttgtttacaaaagggaaaatgaagataaggtgaacaaagcagccaagcacctcaaaacgttgaggcatccctgtttactgaggttcctttcctgcacagtggaggctgatggaatccaccttgtgacagagagagtgcagcctcttgaggttgcactggagaccctctcatccgctgaggtatgtgcaggcatctacgatatacttctggctctgatctttctacacgacagagggcacttgacgcataacaatgtctgcctatcgtccgtctttgtatccgaggatggacattggaaattgggcggcatggaaacagtgtgcaaggtcagccaggctacacctgaatttctgagatctattcagtctatccgggacccggctagcatccctcccgaggaaatgtcacccgagtttaccactttgccagagtgtcatgggcacgctcgggatgctttttcatttggcaccctggtggagagccttctcacaattctcaacgagcaggttagtgccgatgtgctcagctcttttcaacaaactctccatagtaccttacttaacccaattccaaaatgtcggccagcactctgtaccctgctatcacatgacttcttccggaatgactttctcgaggtggtaaatttcctgaagtcacttaccttaaaaagcgaggaagagaagaccgaattctttaagtttcttctagaccgcgtaagttgcctttccgaggagctgatcgcttctagactggtgccactcctactgaaccagctagtgtttgccgaaccagtagccgtgaaaagttttctgccttacctgcttggtcctaaaaaagatcatgcccagggagagactccctgcctgctctccccagctctctttcagtcccgtgtgattcctgttcttctccagcttttcgaggttcatgaagagcatgtgcgcatggtcctcttgtcgcatatagaagcgtacgttgagcacttcacccaagagcagctcaaaaaggtgatcctgcctcaggtcttgttggggttgcgggacacatccgatagcattgttgcaataaccctgcacagcctcgcagtcctcgtcagcttacttgggccagaggtcgtggttgggggagagcgcaccaaaatctttaaacgcacagcgccttcgtttacaaagaacactgatttatccctggagggcgaccccttctcacagcccatcaagttccctattaatgggctctctgacgtgaaaaacacctccgaggattccgagaacttcccgtcaagcagcaagaagagtgaagagtggccagactggtccgagcccgaggaacctgagaatcaaaccgtaaacatccagatctggccacgcgagccctgtgacgatgtgaagagtcagtgcacaacactggacgtggaggaatcaagctgggacgattgtgagccaagctcactcgacacaaaggtgaatccgggcggaggcattaccgctacaaaacccgttaccagcggagaacaaaaaccgatccccgcgttattatcactcacagaggaatccatgccttggaaaagtagtctcccacagaagatctcgttggtccagaggggagatgacgctgaccagattgagccaccgaaggttagtagtcaggaacgtcccctcaaggtaccgagcgaactgggattgggagaagaatttacaatccaggtgaaaaaaaaacctgtgaaggatcctgagatggattggttcgccgatatgattcctgagatcaaaccatccgcagctttcctcatcctaccggagctcagaacagagatggttcccaaaaaggacgacgtctctcctgttatgcaattctccagcaaatttgcagccgccgaaatcaccgagggcgaggcagaggggtgggaggaggagggagaactcaattgggaagataacaactggtag

SEQ ID NO: 17287 - DNA, 2229 bp, Artificial Sequence
  Description of Artificial Sequence: Synthetic coding sequence
atggggtctgagaactccgcccttaaaagctatacactgcgagagccaccattcaccctgccctcgggcctggctgtttacccggctgttcttcaggatggaaagtttgcgagtgtcttcgtgtataaacgggagaatgaagacaaggttaataaagccgccaagcacttaaagaccttgagacacccttgtctgctgcggtttctcagctgcacagttgaagccgacggtatccatctggttacagaaagggtgcagcccttggaggttgccttggagaccctgtcctctgccgaggtctgtgcgggtatctacgacatactacttgctctcatctttttgcacgaccgtggtcacctcactcacaataacgtgtgtctgtccagtgttttcgtgagcgaagacggccactggaagctgggcggaatggagacagtgtgtaaggtctctcaagccacaccagaattcctacgctccattcagagtattagagatcccgctagtatccctcccgaggaaatgagccccgagtttacaacactaccagagtgccacggacatgcaagggatgcgttcagtttcggcaccctggtggaaagtctgttaaccatcttaaacgaacaggtgtctgctgatgtgttgtcttcgtttcagcagactctccactcgacacttttaaaccctatccctaaatgtaggcctgctctatgcacactcttgtcacacgatttcttcagaaatgattttctggaagtggtgaatttcctgaaatctctaaccttgaagtccgaggaggagaagaccgaattcttcaagtttctgctcgatcgggtgtcctgcctgtcggaggaactgatcgcatcaaggcttgtaccacttcttctcaatcaattggtgttcgctgagccagtggcagttaagtctttcctcccttacctgctgggacctaaaaaagatcacgctcagggagagactccttgcctcctttccccggcgcttttccagtcgcgagtgattcccgtgctcctgcagctttttgaagtccatgaagaacacgttaggatggtgttattgtcacacatagaggcatatgtggaacacttcacacaggagcaactaaagaaagtgattctgccccaagtattactggggctgagagacacatccgatagtatcgttgccatcaccctgcattccctcgcagttctcgtcagtcttctgggcccagaggtggtagtcggtggggaaagaactaaaatctttaaacgcactgctcctagtttcacgaagaatacagatctgagcttggaagactcacctatgtgcgtggtatgcagtcaccacagccagatcagtcccatccttgaaaatccctttagcagtatatttcctaagtgtttcttttcaggcagcacacccatcaactcaaaaaagcatatacagagggactactacaataccctgctgcaaacaggggaccccttttcgcagcctattaaattcccaatcaatggcctgagcgatgtgaaaaatacatcagaggactcagagaatttcccaagctccagtaagaaatctgaggagtggcctgattggtccgaaccagaagagcctgagaatcagacggtaaacatccaaatttggccacgcgaaccatgcgacgacgtgaagagtcaatgcactactctggacgtggaggaatcaagctgggacgattgtgagcccagctctttggacaccaaggtaaacccgggcggaggcataaccgcaacgaagccagtgacctctggagaacagaagcccatccctgcgctgctgtcgctgaccgaggagtccatgccatggaaatcttcgctaccccagaaaataagcctcgtacaaaggggagatgacgccgatcagatcgaaccccccaaagtcagttcccaggagagaccccttaaggtgccatctgagttgggcctcggggaggagttcacgatacaagtaaagaaaaaacctgtcaaggaccccgaaatggattggttcgcggatatgattccagaaatcaaaccgagcgcagccttcctgatcctgccggagctccgcactgaaatggtgcccaagaaggacgacgtctccccagtgatgcagttttcaagtaaatttgcggccgctgaaattactgaaggagaggcggaagggtgggaggaggaaggcgaactgaactgggaggacaacaactggtag

SEQ ID NO: 17288 - DNA, 1767 bp, Artificial Sequence
  Description of Artificial Sequence: Synthetic coding sequence
atgggctctgaaaacagtgctttgaagtcatacacactccgtgaaccccctttcactttgccttcgggcttggcggtttaccctgcagttctgcaggatgggaagttcgcatccgtgtttgtgtacaaaagggaaaatgaggataaggtgaacaaggcggcaaagcacttgaagacactgcgtcatccctgtctgttgcgtttcctgtcttgcacggtggaggcggatgggatccatctcgtaaccgagcgtgtgcaacctctcgaggtcgccctcgaaactcttagctccgccgaggtgtgcgccggaatatacgatattctgttagctctgatatttctgcacgacagaggccatctcacacacaataacgtttgcttgtcctctgtgttcgttagcgaagatggccattggaagcttgggggaatggagactgtttgtaaggttagccaagccacccctgaattcctgcgctccattcagtccatccgggaccccgcttctatcccgcctgaggagatgtcccccgagtttacgactctgcctgagtgtcatggtcacgcacgggatgcttttagctttggtacgctagtcgagagcctgcttacaattctcaacgagcaggtgtctgccgatgtactgtcctcatttcagcagacactccacagtacacttttgaatccgatcccaaaatgtcggcccgccctctgtacactgctatcacacgatttcttcagaaatgatttcttggaagtagtcaacttcctgaagtccttaaccctgaagagcgaggaggaaaagacagaattctttaagtttctcctcgatagggtgagttgcctctctgaggaactcatcgcgtctaggcttgtgcccttgctgctgaaccagctagtcttcgccgagcccgtagccgtgaaatcttttctgccgtacctgctgggcccaaaaaaggaccatgctcagggcgaaacaccctgtttactcagccctgcactatttcagtctcgcgtgatcccagtgctactacagctgttcgaagtccacgaggagcatgttcgaatggtgctcctgagtcatattgaggcttatgtggaacacttcacccaagaacaactgaagaaggtcattctgcctcaggtattgctggggctcagagacacgtccgacagtattgtagctataactctccactcactggccgtcctggtgtccctgctgggccccgaggttgtggtgggcggagaacgaaccaaaattttcaaaaggaccgcgccaagcttcacaaagaacaccgatttgtcattagagggagacccattttctcagccaattaaatttcccataaatggcctgagcgacgttaaaaacacaagtgaggacagtgagaacttcccctctagctccaagaaatccgaagagtggcccgattggagtgaacctgaggaacctgaaaaccagacagtgaacattcagatttggcccagagaaccgtgcgacgacgtcaagtctcagtgcaccaccctggatgtcgaggagtcctcctgggatgactgcgagccatctagcctcgacaccaaagtgaatccagggggaggcattacggccacaaagcccgtgaccagtggtgagcagaagcccatacccgcactgttgagcctgacagaagagagcatgccatggaaaagttccttaccacagaaaatctcactggtgcagcggggcgatgatgctgatcagatcgaaccccccaaagtgtcaagctag

SEQ ID NO: 17289 - DNA, 1008 bp, Artificial Sequence
  Description of Artificial Sequence: Synthetic coding sequence
atgaagttaccagcccgggtgtttttcactttaggtagcagactcccgtgcggccttgctccacgaaggttcttctcatatggaacgaagatcctatatcagaataccgaggccctgcaatccaagtttttttccccccttcagaaggcaatgcttccaccgaactcatttcaaggaaaggtggcgttcataactggcggcggtacagggctgggaaagggcatgaccactctgctatcgagcctgggcgctcagtgcgtcatagccagtcgtaagatggatgtcctaaaggccaccgctgagcaaatctcgtcgcagaccggcaacaaggtacatgccattcagtgcgatgttagggatcctgacatggttcagaacacagtttccgagcttatcaaggttgctggacacccgaacatcgttattaacaatgcagccgggaatttcattagcccaaccgagcggctctctccaaacgcttggaaaacaatcacggacatagtgctgaacggaaccgccttcgtgactttagaaatcggaaagcagcttattaaggctcaaaagggcgcggccttcctttcaataacaaccatatacgcggagacaggatccggcttcgtggtgccttccgcttcagccaaggctggagtggaggccatgtcaaaaagtctcgccgccgaatgggggaaatatggcatgcgctttaacgtaatacagcccggtcctattaagacaaaaggcgcattttcccgcctggaccccacaggcacctttgaaaaggagatgatcgggagaatcccctgtggtagactgggcaccgtggaagagctagcaaatttggccgctttcctctgctccgactatgcttcctggattaacggagctgtgatcaaatttgatgggggtgaggaggtcctgatcagtggcgaattcaatgaccttagaaaagttaccaaagaacagtgggacactattgaggagctgatacgaaagacaaaagggtcctag

SEQ ID NO: 17290 - DNA, 945 bp, Artificial Sequence
  Description of Artificial Sequence: Synthetic coding sequence
atgggtattggccgctcagagggcggacgccgtggcgctgcgctgggagtgctgttggccttaggcgcggctttactggccgtgggctccgcgagcgaatacgattatgtgtcgttccaatccgatatcggtccataccagtccggtcgattttacacgaagcctccacagtgtgtagacatccccgcagatctccggctgtgccataatgtcgggtacaaaaaaatggtgcttccgaatcttctggagcatgagacgatggccgaagtcaagcagcaggcctcctcctgggtcccattgttaaataaaaactgtcacgcaggcacacaggttttcctgtgctcattgtttgctccggtttgtcttgaccggccgatatatccatgtagatggttatgcgaagccgttcgcgactcctgtgagcccgtcatgcagttcttcggcttctattggccggaaatgctgaagtgcgacaaattccccgagggcgacgtctgtatcgcaatgacgcctcctaatgcaaccgaggccagtaagccccagggtacaaccgtctgccctccctgcgacaatgaactgaagtccgaagcgattatcgaacacctttgtgcaagcgagttcgctctgcggatgaagattaaagaggtcaaaaaggaaaacggcgataagaagattgtgcccaagaagaaaaaacctctcaaactcggaccaataaagaagaaggacctaaagaaactcgtgctgtacctgaagaatggagctgattgcccttgccatcagctggacaacttgtcccatcatttcctaattatggggcggaaggtgaagtcccagtacttattgaccgcaatccacaagtgggataagaagaacaaagaattcaagaacttcatgaaaaaaatgaaaaatcatgagtgtcccacatttcaatccgtgttcaagtag

SEQ ID NO: 17291 - DNA, 1041 bp, Artificial Sequence
  Description of Artificial Sequence: Synthetic coding sequence
atgtttctctccattctggttgccctgtgtttatggctacatctcgccctgggggtgcgcggcgcaccctgcgaagccgtgagaatccccatgtgtcgccacatgccttggaacataaccagaatgccaaatcacctccaccactctacccaggagaacgctatccttgcaattgagcagtatgaagagcttgtggacgtaaactgttctgcagttctcagattcttcctttgtgccatgtacgccccgatttgtaccctagagtttctgcacgatccaattaagccatgcaaatcggtatgccaaagggccagggatgattgtgagccgctgatgaagatgtacaaccacagctggccggagtcactggcctgtgatgaacttcctgtctacgaccgaggcgtctgtatcagtcccgaagcaatcgtgacagatctccctgaggatgtcaaatggattgatatcacacctgatatgatggtgcaggagagaccactcgacgttgattgcaaaagactgagccctgacaggtgtaaatgcaaaaaggtaaaaccaaccctggctacttacctgagtaaaaactactcctacgtgatacatgcaaagattaaagctgtgcagcgctctggatgcaacgaagtgaccacagtggttgacgtaaaagagatctttaaaagctcctctccaattcctaggacacaagtgccattgattacaaacagtagctgccaatgcccacatatcctgccacaccaggatgtcctcattatgtgttacgaatggagatcgagaatgatgttgctcgagaactgtcttgtcgagaagtggcgtgaccagctctccaaaagaagcattcagtgggaggagcggctacaggagcaacgtaggacagttcaagataaaaaaaaaaccgccggtcggacctcgcgatccaacccaccgaagcccaaaggcaaacctccagcacccaaaccagcaagtcctaagaaaaacattaagaccagaagcgcccagaaacggaccaaccccaaacgggtgtag

SEQ ID NO: 17292 - DNA, 1032 bp, Artificial Sequence
  Description of Artificial Sequence: Synthetic coding sequence
atgcgcgtggcaggccgggaaggccggttcctgtccgcaggagttgctgcgagggaaggtagcgccatgttcctgtccatacttgtcgcactctgtctctggctgcacctggccctcggggtcagaggcgcaccttgtgaagctgtgcggatcccgatgtgccggcacatgccttggaatataacaaggatgccaaatcatcttcaccattcgacgcaggaaaacgctatgtatgcccccatctgtactctggagtttcttcacgaccctatcaagccttgtaaaagtgtctgccagcgagcccgtgatgattgtgaacctttaatgaaaatgtataaccatagttggccggaatccctggcctgcgacgagttgccggtctatgatcgcggagtatgcattagtcccgaagccattgtgaccgacctgccagaagacgttaaatggatcgacatcacccctgatatgatggtacaggagaggcctctcgatgtggactgcaaaagactaagtcctgacagatgcaagtgcaaaaaggtgaaaccaaccctcgcgacatatttgagtaaaaactacagttatgtcatccacgcaaaaatcaaagcagtccaacgttcgggctgcaacgaagtgactacagtggtagacgtgaaagaaatcttcaagtcaagtagtcccatccctcggacacaggtgccgctgattaccaattctagctgccagtgccctcatatcctaccccatcaggacgtcctgatcatgtgctatgagtggaggtctcgcatgatgctcctggaaaattgtcttgtagagaaatggagggaccagttatccaagcggagcatccaatgggaggaacggctgcaagagcaacgtagaaccgtgcaggataagaagaaaaccgccggaaggacttctagaagcaaccctccaaaaccgaaagggaagccgcccgctccaaagcctgccagtcctaagaagaacataaagactagaagcgcgcaaaagcggactaatcccaaaagagtgtag

SEQ ID NO: 17293 - DNA, 954 bp, Artificial Sequence
  Description of Artificial Sequence: Synthetic coding sequence
atgagagccgccgccgcgggaggtggcgttcgaaccgctgccctagcactgttactgggtgctcttcactgggcacctgctcgttgcgaggagtacgactactatggctggcaggcggagcctctgcacggacgtagttattctaagcctccccagtgtctggatatcccagctgacctgccactgtgtcatacagttggctacaagcggatgcggctaccgaatctcctggagcatgaatccttagcagaggtgaaacaacaagcatccagctggcttcctctcttggctaagcgttgccacagtgatacccaggtttttctctgctcactctttgcccccgtctgcctggatcgccctatctacccatgccgcagtctgtgcgaggccgtccgggccgggtgcgcccccctgatggaggcatacgggtttccttggccagaaatgctgcactgccacaaatttcccctggataatgatctatgtatcgccgtgcaatttggccatctgccagccaccgctccgcctgtgacaaagatctgcgcccaatgcgaaatggaacacagcgctgacggactcatggagcagatgtgttccagcgatttcgtagtcaagatgcgaatcaaggagattaaaatcgagaatggagaccgcaaactcataggggcccagaagaaaaagaaactcttgaaacccggtccccttaaaaggaaagataccaagcgactggtgttacatatgaagaatggcgctggctgcccgtgtccccaactggatagtctggccgggtcattcctggtgatgggtaggaaggtcgatggacagctgctgctcatggccgtctatagatgggacaaaaagaataaggagatgaaatttgcagtgaagtttatgttcagctacccatgttccctctattacccttttttctacggggcggcggaacctcactag

SEQ ID NO: 17294 - DNA, 903 bp, Artificial Sequence
  Description of Artificial Sequence: Synthetic coding sequence
atgcggatcgccgtcatctgtttctgcctcctgggcataacctgcgcaattcccgtgaaacaagcagactccggtagtagcgaggagaagcaactatacaataagtatcctgatgcagtagcgacatggctcaaccctgatccctcccagaagcagaatctactcgcacctcagaccttaccctccaaaagtaatgaatcccacgaccatatggatgacatggacgatgaggatgacgatgaccacgtagacagccaagacagcatcgattcaaacgactctgacgacgtagatgatacagatgattcccatcaatccgatgagagccaccactcagatgaaagtgatgagctggtgaccgacttccctaccgatctccccgcaacggaagtcttcactccggtggttcccactgttgacacttatgacggtcgcggagattcagttgtgtacggcctgagatccaagagtaagaagtttcgaaggcccgatattcagtacccagatgcgacagatgaagacatcacttcccatatggagagtgaggagctgaatggcgcttacaaggccatccctgtggcacaggacctgaatgcaccgtctgactgggattcccggggaaaagacagctacgagacctcgcagctcgacgaccagagcgctgagacccattctcacaagcaatctcgcctctacaagagaaaagcaaatgacgaaagcaacgaacattccgatgtgattgattcacaagaactaagtaaagtttccagagagttccattcgcatgagtttcatagtcatgaagatatgctggtcgtcgatccaaagtcaaaggaagaggataagcacctcaagttcagaatctcacacgagctcgattctgcatccagtgaagtcaattag

SEQ ID NO: 17295 - DNA, 879 bp, Artificial Sequence
  Description of Artificial Sequence: Synthetic coding sequence
atgcggattgctgttatttgcttttgcttgttaggtataacgtgtgccattcctgtgaaacaggcggattctggttcctccgaggaaaagcagctctacaataagtacccagatgcagtcgccacctggcttaaccctgacccatcacagaaacagaacctgttggctcctcaaaatgccgtatcatcagaggagaccaatgattttaaacaggaaacacttccctccaaatctaacgagtcccatgaccacatggatgacatggacgacgaggatgatgacgaccaccagagtgacgaatcccaccatagcgacgagtccgatgagctcgtgacagactttcctaccgacctccctgctaccgaggtctttactcctgtggtaccgactgtcgatacatacgacggaagaggagatagcgttgtatatgggctcagatctaagagcaaaaaatttcgtcgtcccgatatccagtaccctgacgcgacagacgaggacatcaccagccacatggagagtgaagagctgaatggtgcctacaaggcgatccccgtggctcaggatttaaacgccccctctgattgggattctcgagggaaggacagctatgaaacatctcagttagatgaccaatcggcagagactcattcccataagcaaagcagactttacaaacgaaaggccaacgacgagtcaaatgaacactctgatgtcatcgatagtcaggaactcagtaaggtcagtcgcgagtttcacagccacgaattccacagtcacgaggatatgctcgttgttgacccaaaaagtaaagaagaagataaacacttgaagttcagaatttcccacgagctcgactccgccagctcagaggtgaactag

SEQ ID NO: 17296 - DNA, 864 bp, Artificial Sequence
  Description of Artificial Sequence: Synthetic coding sequence
atgcgcatcgctgtgatttgcttctgccttctgggcatcacctgtgccattccggtcaaacaggctgacagcgggagtagtgaggagaaacaaaatgccgtttctagcgaagaaacaaacgatttcaagcaggagacactgcctagcaagtcaaacgagagccacgatcatatggatgacatggatgacgaggatgacgacgaccatgtggatagtcaagattcaatcgactcaaacgactctgatgacgtggatgatactgatgattcacaccaaagtgatgagagtcaccattccgatgaatccgatgaattagttactgattttccaactgatttgccggcaacagaggtttttacccccgtagttcctacggtcgatacatacgatggaaggggcgattccgtggtgtacgggttgaggtccaagagcaaaaagtttagacggcctgacattcagtaccccgatgcaaccgatgaggacatcacctcacacatggaatccgaggaactgaatggcgcctataaagcaatccccgtcgcacaggatctgaatgcaccatcagattgggacagcagggggaaggatagctatgagacttcccagcttgacgatcagagcgccgagactcatagtcataaacagtctcgtctgtacaagagaaaggctaacgatgaatctaatgagcattccgacgtaatcgacagtcaggaactcagcaaagtatctcgtgaatttcatagtcatgaatttcatagccacgaggatatgttagttgtggaccctaaaagtaaggaggaagacaagcacttaaagttccggatatctcacgagcttgactcagcctcctccgaggtgaactag

SEQ ID NO: 17297 - DNA, 945 bp, Artificial Sequence
  Description of Artificial Sequence: Synthetic coding sequence
atgcgcatcgccgtgatttgtttctgtctgctgggcattacctgcgccatcccggtcaagcaggctgactcgggttcaagcgaggagaaacagctgtataacaaatatcctgacgctgtggccacatggttaaatcctgatccgtcgcaaaagcagaatctgctcgccccacaaaacgccgtgagcagcgaggagacaaatgattttaagcaggaaactttgccttcaaaaagtaacgagtctcacgatcatatggacgatatggacgatgaggatgacgacgatcacgtggattcgcaggactcgatcgatagcaacgactctgacgatgtagatgataccgacgacagccatcaatccgacgagagccaccactccgacgagagtgatgaactggtgaccgactttcccaccgatctgcccgcgaccgaagttttcacacccgtggtgccaacagtcgacacttatgacggacgcggcgactcagttgtgtacggcctgcggtcaaagagcaaaaaattcagacgaccggacatccagtatcctgatgctaccgacgaggacataacatcacatatggagtctgaggaactcaacggcgcatataaggcaatccctgtcgcccaagacctcaacgctccttccgattgggactctaggggaaaggatagttacgaaaccagtcagttggatgatcagagcgccgagacccacagtcataagcagtctcgcctgtacaagagaaaagctaatgatgagtcaaacgagcacagcgacgtgatcgattcccaggaactgtcaaaagtgagccgggagttccactctcatgagttccacagtcacgaagacatgctcgtggtcgatcccaagagtaaagaagaggacaaacacctgaagtttagaatttcacatgagttagactcggctagtagcgaggtgaactag

SEQ ID NO: 17298 - DNA, 822 bp, Artificial Sequence
  Description of Artificial Sequence: Synthetic coding sequence
atgaggatcgcggttatctgtttttgcctgttggggattacctgcgccatccctgtgaagcaggctgattccggctcgagcgaggaaaagcagaccctgcccagtaagagcaacgagtcccacgaccatatggatgacatggacgatgaggacgatgacgaccatgttgattcgcaggacagcatagactcaaacgatagcgacgatgtcgacgacaccgacgactcacatcaatcggatgagtcccatcactcagacgaatcagacgagctggtgacagacttccccacagacctgccagcgacggaggtcttcactcccgtggtccccacagttgatacctacgatggacgcggcgactcagttgtgtatgggctgcgcagtaaatcaaaaaaattcagaaggcctgacatccagtacccagacgctactgatgaggatatcacatcccacatggaaagcgaggagctgaacggagcctataaggccattccggttgcccaggacctcaatgccccaagtgattgggattccaggggcaaggactcttacgagaccagtcagctcgatgaccaatccgccgaaacccacagccacaagcaaagtcggttatataaaaggaaggccaatgacgagagcaacgaacacagcgacgtgatcgactcacaggaactgagtaaagtgtcaagggagtttcatagccatgagttccatagtcacgaagatatgctggttgtagacccaaagtctaaagaggaagataagcaccttaaattcaggatctcccatgagctagactcagcctctagtgaggtaaattag

SEQ ID NO: 17299 - DNA, 2370 bp, Artificial Sequence
  Description of Artificial Sequence: Synthetic coding sequence
atgcggacctatcattatatcccgttgttcatttggacatatatgttccatacagtagatacaatcctgctgcaggagaagcccaacagctacctttcctccaaaaaaatcgcaggcctgactaaagacgacggaaaaatgctgcggagaaccaagagaggttggatgtggaatcagttttttctactcgaggaatataccggcactgacacccagtacgttggtaaactccacaccgatcaagacaagggagacggtaacctcaaatatatcctgaccggcgatggcgccggatcactattcgttatcgacgaaaatacgggagatatccacgccgccaagaaactggatagggaagagaaatccctctatattctgcgtgccaaagcaatcgacaggaagaccggaagacaggttgagccagaaagtgagtttattatcaagatacatgatattaacgacaacgagcccaagtttacaaaggatttgtataccgcatcagtacccgaaatgagtggcgtgggaacttctgtgattcaagtgaccgccacagatgccgacgatgccaattacggaaactcagccaaagttgtgtacagcattttgcagggccaaccctatttctctgttgaccctgagtcaggcatcattaagaccgctctgcctgatatgtcacgcgagaatcgcgagcaataccaggtggtgattcaggccaaagatatgggtgggcagatgggcggcctcagcgggaccactacagtgaacattaccctaaccgatgtaaataataacccaccacggttcccacaatcaacctatcaattcaattcacccgagagcgttccattgggcactcatttagggagaattaaagcaaatgatccagacgtgggagagaacgccgagatggaatacagtatcgccgagggagacggagcggatatgtttgatgttattaccgataaagacacacaggaaggaattattacagtcaagcaaaatctcgattttgaaaatcagatgctctacaccctaagggttgacgcaagcaatacacacccggatccacgcttcctccatctgggcccttttaaagacacagcagttgttaagatcagcgtagaagatatcgatgaacctccagtgtttactaaagtcagctacctgatcgaggtggatgaggatgtgaaggaggggagcattattggccaggtcaccgcctatgatccggatgcccggaataatcttataaagtacagtgtggatcgccacaccgacatggacaggatcttcggaatacactccgagaacgggtctatcttcactctgaaagctctggaccgcgagtcatccccctggcataacattacggtcacggcaaccgagataaacaatcccaagcagagtagccacattcccgtgtttatcaggatactggacatcaatgatcacgccccagagttcgcgatgtactacgagacattcgtatgtgaaaacgctaagcctggccagttgatccagacggtctctgtgatggataaagatgatccccctcgtggccacaaattcttttttgaaccggtccccgagtttaccctcaatcccaacttcacaatcgtcgataataaagataatacagccggtatcatgactagaaaagacgggtactcccgaaacaagatgagcacctaccttctgccaattctgatctttgacaacgattaccccatccagagtagcactgggaccctgacaatccgggtctgtgcgtgcgacaaccagggaaatatgcagtcttgcacggcagaggctctgattctgtccgctggcctgtccacaggtgccctggtggccattcttctctgcgtacttattctcctaatcctggtcgtgttatttgccgccttgaagcgccaacgtaaaaaagaaccactgatcatctctaaggatgatgtgcgggacaacattgtgacatacaatgacgaaggcggtggcgaggaggacacacaagccttcgacattggaaccctgaggaatcccgaagctagagaggactccaaactccgcagagatgtcatgcccgaaacaatcttccagatcagacggaccgtgcctctatgggaaaacatcgatgttcaagatttcatccacagacggttgaaagaaaatgacgcggacccctccgcacctccatatgactcactcgctacttatgcttacgaaggcaacgattccatagcagatagtctgtctagcttggagagtctcactgccgattgcaatcaagattatgattacctgtctgattggggaccccgcttcaaaaagctcgccgacatgtatggaggggacgattctgacagagattag

SEQ ID NO: 17300 - DNA, 162 bp, Artificial Sequence
  Description of Artificial Sequence: Synthetic coding sequence
atgcgagcgtggatctttttcttgctgtgtctcgccggcagggccttagccgccccccaacaggaggccctacccgacgaaacagaggtcgtagaagagacagttgccgaggtcacagaggtgtccgtaggcgctaaccctgtgcaggtggaggtagggtag

SEQ ID NO: 17301 - DNA, 336 bp, Artificial Sequence
  Description of Artificial Sequence: Synthetic coding sequence
atgagagcatggatcttcttcttgttgtgcctggcaggcagagcgcttgctgcaccccagcaggaggctctgccagacgaaactgaggttgtggaggaaaccgttgccgaagtaactgaggtatctgtgggcgctaaccctgtacaggtcgaggtcggtgagttcgacgacggagcggaggaaacggaggaggaagtcgttgcggaaaatccgtgtcaaaatcatcattgtaaacatggcaaggtatgcgagctggatgagaataacacacccatgtgtgtctgtcaggatcctacaagctgtccggctccaatcggggagtttgagaaagtctag

SEQ ID NO: 17302 - DNA, 276 bp, Artificial Sequence
  Description of Artificial Sequence: Synthetic coding sequence
atgaagctggctgtgaccctgacacttgtgacacttgccctgtgttgcagcagtgcctccgccgagatatgcccgtcttttcaacgcgtgatcgagactcttctaatggacactccttcttcttatgaagctgctatggaactattctcccccgaccaggatatgagagaagcaggcgctcagctgaagaagctggtggacactctgccacaaaagcctcgggagtctatcataaaactcatggaaaagattgcccaatcgagcctgtgcaattag

SEQ ID NO: 17303 - DNA, 1380 bp, Artificial Sequence
  Description of Artificial Sequence: Synthetic coding sequence
atgattaaaaggtttctcgaggacacaactgacgatggcgagctgtcaaagttcgtaaaagatttctccggcaatgcctcgtgtcaccccccagaagcaaagacctgggcaagtaggccccaagtgcctgaaccaaggccccaagcccccgacctctacgacgacgatttggaatttcgccctccctctcgcccccagtctagtgataaccaacagtacttctgtgccccagctccactgtctccttccgcaagaccgcgctccccgtggggcaagctggacccgtatgacagctccgaagacgataaagaatatgtaggtttcgccaccttgccaaatcaggtacatcggaagtcagtaaagaagggtttcgattttaccctgatggtcgccggcgagagtggcctcggcaagtccaccctagtgaattctctattcctaactgacctatacagggacagaaagctcctcggtgctgaagaacgcatcatgcagacagtggagattaccaagcacgccgtggatattgaggaaaaaggggtaaggctcagattaaccattgtggacacccccggtttcggagacgctgtcaataacactgagtgttggaagcccgtcgcagaatacatcgaccagcagtttgagcagtattttcgtgacgaaagtggacttaatagaaagaatattcaggacaatcgtgtccactgttgtctttacttcatttctccgtttggccatgggttacgcccactggatgtcgaattcatgaaagctctccatcaacgggtgaacatcgtgcctatcctcgcaaaggcggacacgctgacccctcccgaagtcgaccacaagaaacggaagatccgggaggaaatcgaacacttcggcattaagatctaccagtttccagactgtgactccgacgaggatgaagactttaagttgcaagaccaggccttgaaggagtcgatcccatttgcagtgatcggctcgaatactgtcgttgaggcccggggacgccgggtccgtggccgattgtacccctggggtattgtagaggttgaaaatccaggacattgcgatttcgtcaaactgaggaccatgcttgtacggacacacatgcaagatctgaaagatgtgaccagagagacacactatgaaaattacagggcacaatgcatccagtctatgactcgactggttgtgaaggaacgaaatagaaacaagctcacgcgtgaatccgggactgattttccaatccctgccgtcccgcctggcactgaccccgagactgagaagctgattcgcgagaaggatgaagaactgcggcggatgcaggagatgctgcataagatacagaagcaaatgaaagaaaattactag

SEQ ID NO: 17304 - DNA, 1437 bp, Artificial Sequence
  Description of Artificial Sequence: Synthetic coding sequence
atggatcgaagcctcggctggcaaggaaactcagttcccgaggatcgtacagaggccgggatcaagagattcctggaagatacgacagacgacggcgagctgagtaagtttgtgaaagacttttccggtaacgccagctgtcacccgcccgaagctaagacgtgggcctctaggccgcaagttcccgagcctcggcctcaggccccagacctttacgacgatgacttggaattcagaccgcctagccgcccacagagtagtgacaatcagcagtatttttgcgcacccgcgccactctccccaagcgctaggcctcgatctccgtggggcaaactcgatccttatgatagttccgaggacgacaaagagtatgtgggtttcgccaccctgccaaatcaggttcatcgaaaatcggtgaaaaaaggtttcgattttacgctgatggtggccggagaatccggactgggtaagtccaccctagtcaatagtttgtttctcaccgacctctatcgggaccgaaaactgcttggagctgaggagcggattatgcagaccgttgagatcaccaagcacgccgtggatatcgaagaaaagggcgtcaggctgagactgaccatagtggatactcccggcttcggggacgctgtgaacaacacagaatgttggaagcccgtggccgaatacatagaccagcagttcgaacagtacttccgggacgagtcgggcctgaatcgaaaaaatattcaggacaatagggtgcactgctgtctgtactttatttcgccatttggtcacggcctgcgccccctagacgtggagtttatgaaggccttacaccagcgcgtgaacattgttccaatccttgccaaagccgacacattgactccccccgaagtcgaccacaagaaacgtaagattagagaagaaatcgagcacttcggaatcaagatttatcaattcccagactgcgattccgacgaggatgaggactttaagctccaggaccaggctctcaaggagtccatcccctttgcagttattggaagtaacactgtggttgaagccagggggagaagggtgagaggccggttatatccatgggggatcgtcgaggtggaaaatcctggacattgtgacttcgtcaagctgcgaacaatgctggtacggacacatatgcaggatttgaaggacgtgactcgcgaaacacactacgagaactatagagcccagtgcatccagtcgatgaccagattggttgtcaaagagcggaatcgcaataaattaacaagggaaagcggtacagattttccgatacccgcagtgccccctggaacagaccccgagaccgagaagctaatccgggagaaagatgaagagctgcgccggatgcaggaaatgttgcataagatacaaaagcagatgaaggaaaactattag

SEQ ID NO: 17305 - DNA, 1380 bp, Artificial Sequence
  Description of Artificial Sequence: Synthetic coding sequence
atgattaaacgctttctggaggatactactgacgacggagagttatcaaagttcgtgaaagatttttcagggaatgcatcatgccaccctcctgaggccaagacgtgggcaagcagacctcaggttcccgaaccgcgtccccaggcacccgatctctacgatgatgacctggagttccgtcctccctcaaggccacagtcatctgacaaccagcagtacttctgcgcccctgctccattgtctccttctgcacggccgcgtagtccctgggggaagctggacccctacgactccagcgaggacgacaaggaatatgtgggcttcgctactctgcctaatcaggtgcaccgaaagtcagtaaagaagggatttgattttactctgatggtagccggtgagtctggattgggcaaaagtactcttgtgaactctctgtttctgacagatttgtaccgggatcgcaagttactcggcgccgaagaacgaatcatgcagaccgttgagatcactaagcatgcagttgatatagaggaaaagggagttaggctgagattgacaattgtggacactccagggttcggggatgccgtgaataacacagagtgctggaaacctgttgccgaatacatcgaccagcagtttgagcagtatttcagagatgagtcaggattaaaccgcaagaatattcaagacaacagggtccattgctgcctttacttcattagccccttcgggcacggccttaggcctctggacgttgagtttatgaaggccctgcaccagcgggtgaatattgtacccatcctcgctaaggcagacactttgacccctccagaggtggaccacaaaaagcgtaagattagggaagaaatcgagcactttggtataaagatctatcaatttccagactgtgattctgatgaggacgaggattttaagctgcaggatcaggctttgaaagaaagcatcccatttgccgtcattgggagcaacaccgtcgtcgaggctagaggccggcgtgtgaggggacgtctgtatccttgggggattgtcgaggttgagaatccgggtcactgcgattttgttaaactccgaacaatgctggttaggactcacatgcaggacctgaaggatgtaacgagggaaacacattacgagaactacagggcccagtgcattcagtcaatgacacgtctggtcgtgaaggaaagaaatagaaacaagctcacccgggaaagtggtacggatttcccaatcccagcggtgccaccaggaaccgatcctgagacagagaagctcatccgagaaaaagacgaagaactgcgccgaatgcaggaaatgttgcacaaaatccaaaagcagatgaaggagaattactag

SEQ ID NO: 17306 - DNA, 1413 bp, Artificial Sequence
  Description of Artificial Sequence: Synthetic coding sequence
atgcccggcttttacagcgtgatgaccgacgaggaaatcaagcgcttcctggaagacacaacagatgacggagagttgagtaagttcgtcaaggacttctctgggaacgcgagttgtcacccgccagaggctaaaacctgggcctcaaggccacaggtgccagaacccaggccccaggccccagacctttacgacgacgacctagagttccgcccaccctctagaccacagagttccgacaatcagcagtatttttgcgcccctgccccactatcaccaagtgctcgtccacgcagcccatggggcaaactcgacccgtatgatagtagcgaggacgacaaggaatacgtagggttcgctacacttcccaaccaggtgcataggaagtcggtgaagaagggtttcgatttcaccctcatggtggcaggcgagtctggtcttgggaagtctacgcttgtgaattccctgtttctcacagacctatatcgcgaccgcaagctcctcggcgctgaggaaagaatcatgcagaccgtggagattacaaaacacgctgtcgatattgaggagaaaggagtgcggctccgacttacaattgttgatacgccaggatttggggatgcggtcaacaacactgaatgctggaagccggttgcagaatatatcgaccagcagtttgagcagtatttcagagatgaaagcggtttgaatagaaaaaacatccaagataatcgcgtccactgttgcctgtacttcattagcccctttgggcacggcctgcgccccctggatgtcgaattcatgaaggcactgcaccaacgcgtgaatattgtgccgatcctggcgaaggcggacaccctgactccccccgaggtggatcataagaaacggaagataagagaggagatcgagcatttcgggatcaaaatataccagtttcctgattgcgatagtgatgaagacgaagacttcaagctgcaagaccaggccctgaaagaatcgataccattcgccgtgataggctcaaataccgttgttgaagcacgggggcgacgggtacgcggcaggctttacccatggggaatcgtggaagtggagaaccctggacattgcgattttgtgaagttacgtaccatgctcgtgcgcacccatatgcaggacttgaaggacgtgacgcgtgaaacacactacgagaattaccgagcccagtgtatacagtccatgacaaggctggtcgtgaaggaacgaaatcggaataaactgactagagaatcaggcactgacttcccgattcccgccgtgccccccggcaccgacccggagacagaaaagctgattagagagaaagacgaagaactgcgaaggatgcaggagatgctacataaaattcagaagcagatgaaggagaactactag

SEQ ID NO: 17307 - DNA, 825 bp, Artificial Sequence
  Description of Artificial Sequence: Synthetic coding sequence
atgattaagagatttctcgaagacaccactgacgatggggaactgtctaagttcgtgaaagatttctccggcaacgctagctgtcacccccccgaggccaagacttgggcatctcgtccacaggtgcctgaacccaggcctcaggcccctgatctgtacgacgacgatctggagtttagacctccaagccgaccccagtcatccgataatcagcagtacttttgcgcgccagcgccactgagcccctccgcacggccaaggtccccttggggtaagctcgacccatatgactcaagtgaggatgataaggagtatgtcggttttgccaccctcccaaatcaggtacatcggaagtcagtaaagaaaggcttcgatttcacactcatggtagctggagagtcgggcctcggaaagtcaaccttggtgaactcactctttctgactgacttgtatcgggatcgtaagctgctgggggccgaggagaggatcatgcaaacagtggagattaccaagcatgccgtggatattgaggaaaaaggtgttcgcctacgactgacaatcgtagatacccctggttttggagacgctgttaacaacaccgaatgctggaagccagtggctgagtacatagatcagcaatttgagcagtactttagggacgaatctggccttaatcggaagaatattcaggacaatcgggttcactgttgcctgtacttcatcagcccatttggtcacgggtatgggccaagtctccgcctcctggcccccccaggcgccgtgaaaggtaccggccaggagcatcagggccaagggtgccactag

SEQ ID NO: 17308 - DNA, 1479 bp, Artificial Sequence
  Description of Artificial Sequence: Synthetic coding sequence
tattcttcaccagctctatttagttcccgggctgcaccacagaaaccgcgcaaagagggctcccaagccgctggcctcttggtttttagcgatagccttgagataaagcgtttcctcgaggacaccactgatgatggcgaactgtccaaattcgtgaaggatttcagcgggaacgcctcctgtcacccgcctgaggccaagacttgggcatctaggccacaagttccagagcccaggccccaggcccctgacttatatgatgacgaccttgagttccgaccaccttcaaggccacagtccagcgacaaccaacagtacttttgtgcacctgcgcccctctctccgtccgctaggccaagatccccatggggcaagctcgacccttatgacagcagcgaagatgataaggaatacgtgggtttcgccaccctgccaaatcaagtgcacagaaaatccgtgaaaaagggatttgatttcacactgatggtcgccggcgagtcagggctgggtaagagtacacttgtgaatagtctgttcctcacagacctgtatcgagacaggaaactgctaggtgccgaggagcgcatcatgcagaccgttgaaataacaaaacacgcagttgacatcgaagagaagggagtgcggctgcgcctcacaattgtggatacccctggcttcggcgacgccgtgaacaatactgagtgttggaaacccgtggccgaatacattgaccagcaattcgaacaatattttagagatgaatctggcctgaaccgaaagaacattcaggataatagggtacattgctgcctctactttatctccccttttgggcacgggttacggccactggatgttgaattcatgaaggcactacaccaaagagtgaacatcgtgccaattctggctaaggcggatacgctaacaccgccggaggttgatcataagaaaagaaagatcagggaagaaattgagcattttggcataaagatttaccagttcccagactgcgacagcgacgaagatgaagactttaagctccaagaccaggctctgaaggagtctattccgttcgctgtcattggcagcaacacagtggtcgaggccaggggcagacgggtgcgagggcggctctacccatggggcatcgtggaggtagagaatcccggtcactgtgatttcgtgaaattgagaaccatgctcgtgagaacccacatgcaagacctgaaagacgtgacccgcgagactcattatgaaaattaccgagcccagtgcattcagagtatgacgcgtctggtcgtaaaggagcgcaaccggaataaactcactcgggagagtggaacggactttcctattcctgcagtaccaccaggtacggatccagagacagagaaactgattcgggagaaagacgaggagctcagacggatgcaggagatgctacataaaatccaaaagcaaatgaaagagaactactag

SEQ ID NO: 17309 - DNA, 996 bp, Artificial Sequence
  Description of Artificial Sequence: Synthetic coding sequence
atggtcgcgggggagtctgggcttggcaaaagtacactagtgaacagcctttttcttacagacctgtatagggacagaaagctgctgggcgcagaggagcgaataatgcagacagtggagatcacgaagcacgccgttgatattgaggaaaagggggtgcggctccgccttacaattgtggatactccaggctttggtgacgccgtgaataacactgaatgctggaaaccggtggccgagtacattgaccaacagttcgagcaatatttccgggacgagagtggccttaatcggaagaacatccaagacaaccgcgttcattgttgtctctactttatctcaccattcgggcacggattgaggcccctggatgttgaatttatgaaagctttacatcaacgggtgaacatcgttcccatcctggcaaaggccgacaccctcacaccacctgaggtcgatcacaaaaagagaaaaattcgtgaggagattgagcacttcggaattaaaatctaccagtttcccgactgtgacagcgacgaggacgaggacttcaagttgcaggaccaagctctgaaggaaagcattcccttcgccgttatcggtagcaacaccgtcgttgaggcaagaggacgccgggttagaggccgcctttatccctgggggattgtggaggtcgaaaacccaggccactgtgacttcgtgaagctgcgcacgatgctagtccgcacacacatgcaggatcttaaggatgtgacccgtgaaacacactacgaaaattatagagctcagtgtattcagtctatgacgcgcctcgtggtgaaggagcgaaatcgcaataaactgacacgcgagtcagggacagacttccccattccagcggtgcctcccggaacagacccagaaacagagaaattgatccgcgagaaagacgaggagcttcgaaggatgcaggagatgctgcacaaaattcagaagcagatgaaggagaactattag

SEQ ID NO: 17310 - DNA, 1311 bp, Artificial Sequence
  Description of Artificial Sequence: Synthetic coding sequence
atgagcgtgtccgccagaagtgccgcagcagaggaacgttcagtgaatagcagcacaatgggccagcagaagaatctggaaggttacgtcggttttgccaatctccctaatcaggtatacagaaagtctgttaagagaggattcgagtttactctcatggtggtaggtgaatccgggctaggcaaatccactctgattaatagcctttttttaacagatctatacagccccgagtatccgggcccatcacacagaattaagaaaaccgttcaagtggagcagtctaaagtgcttatcaaagaaggcggtgtgcagttgctgttgactatagttgatacacccggattcggagatgctgttgacaactccaactgctggcagccagtaattgattacatagacagcaagttcgaagactatcttaatgcagagagccgggtaaacaggagacagatgcctgacaatcgagtgcagtgttgcctttatttcatcgcccccagtggccacgggctgaaaccgctggatatagagtttatgaagagacttcatgaaaaggtaaacataatacctctcatcgccaaggccgacacccttaccccagaggagtgtcagcagtttaagaagcagatcatgaaagagattcaagaacacaaaatcaaaatatatgaatttcccgagactgacgatgaggaggagaataagctggtcaaaaaaatcaaagataggctccctctggccgttgtgggctcgaatacgatcatcgaggtgaacggcaagagagtaagaggccggcagtatccgtggggcgtagctgaggtagaaaatggcgagcactgcgacttcaccattctgagaaacatgcttattagaacacacatgcaggacctgaaagatgtgacaaataatgtgcactacgaaaattatcgctccaggaagctggccgccgtgacatacaatggcgttgataataacaaaaataagggtcaattgactaagtctccgctggcacaaatggaagaggagcgtcgtgaacatgtggcaaagatgaaaaagatggagatggaaatggagcaggtctttgagatgaaagtgaaggaaaaagttcagaagttgaaggactccgaggcagaactgcaaagacgccatgaacagatgaaaaaaaaccttgaagcacagcataaagagctcgaggaaaagagaaggcagttcgaggatgagaaagctaattgggaggcacagcagcgcatactggaacaacaaaactccagtcggactctggagaagaataaaaagaagggaaagatcttttag

SEQ ID NO: 17311 - DNA, 1317 bp, Artificial Sequence
  Description of Artificial Sequence: Synthetic coding sequence
atgtctgttagcgccaggtccgcggcagctgaagagcggagcgtgaattcgagtaccatggaggttgctcagcagaagaatctcgaagggtacgtgggattcgctaatctgcctaatcaggtctaccgcaagagcgtgaaaagggggtttgaattcacactgatggtggtgggagagagcgggttaggaaagtctaccctgatcaactctctttttctcacggatctgtattcgccagagtatcccggtccaagccaccggatcaagaagaccgtgcaagttgagcagtctaaggtgctgataaaagagggtggagtgcaacttctactcaccatagttgacactcctggctttggcgatgctgtggacaactcaaactgctggcaacccgtcatcgattatattgacagcaagttcgaagattacctcaatgcagagagccgggtgaaccgccggcagatgcctgataaccgcgtgcagtgctgtctttattttatcgccccatccggacatggcctgaagccgttggacatagagttcatgaagcgcttacacgaaaaagtgaacataatccctttaatcgctaaagccgataccctcacccctgaggaatgtcagcagttcaaaaaacagatcatgaaggaaattcaggaacacaagattaaaatctacgaatttcctgagaccgatgacgaggaggagaacaagctcgtgaagaaaattaaagaccggcttcccctggctgtcgtgggcagcaacaccatcatcgaggttaatggcaaaagagtgagaggtaggcagtacccttggggcgtcgctgaagtggaaaacggggaacactgtgatttcactatcctgcggaatatgctcatacgaacccacatgcaggatctgaaggatgtgaccaataatgtgcattacgagaactataggtctcggaagttggcggctgtaacttacaatggggtggacaacaataagaataaggggcagcttacgaaatcccccctggcccagatggaggaggagcgaagggagcatgttgcgaaaatgaagaagatggagatggagatggaacaggtgttcgaaatgaaagtgaaagagaaagtgcagaagcttaaggactcagaggccgagctgcagagaaggcatgagcagatgaaaaagaatctcgaggcccaacataaggagctggaggagaaacgtcgacagttcgaggatgaaaaggcgaattgggaggctcaacagcggatacttgaacagcagaacagcagtcgcacccttgaaaaaaataagaagaaggggaagatcttctag

SEQ ID NO: 17312 - DNA, 1311 bp, Artificial Sequence
  Description of Artificial Sequence: Synthetic coding sequence
atgtctgtttcagcgcgctctgccgcagcggaagagcgaagcgtgaattctagcaccatggtacaacagaagaacttggaagggtatgtcggctttgccaacctacctaatcaggtgtaccgcaagagtgtcaagcgcgggtttgagttcaccctgatggtggtgggggagagcggactgggtaagagcaccctgattaacagtctgtttcttacagatctgtactctccagagtatcctggtccatctcatcggattaaaaaaaccgtccaggtggaacaatccaaagtgctcattaaagaaggtggagtgcagctcttactgactatagtggacacaccaggcttcggagacgcagttgacaactctaattgctggcagcccgtaattgattacatagacagcaaatttgaagattatctcaatgcagaatctagggttaatcgaagacagatgccagacaatcgggttcagtgctgtctgtactttatagcaccaagcggccacgggctgaaacccctggacatcgagtttatgaaacggctccacgagaaagtgaatataatccccctgatcgccaaagcagataccctgaccccagaggaatgtcaacagtttaaaaagcagatcatgaaggaaattcaggagcataaaattaagatatacgagttccctgaaaccgacgacgaggaagaaaataagctggtgaaaaagattaaggacaggctgcccctggcagtggtcgggagcaataccataattgaggtgaatggcaagagagtgcgggggagacagtacccctggggcgtggctgaagtggagaacggagaacattgcgacttcaccatcctccgaaatatgctcattcggacccacatgcaggatttgaaggatgtgacgaataacgttcattatgagaattaccgcagtcgaaaacttgccgcggtgacatacaatggcgtggataacaacaagaacaaaggacagctgaccaagagcccactcgcccagatggaagaagaacggcgggaacacgtggcaaagatgaaaaagatggagatggagatggaacaagtcttcgaaatgaaagtgaaggaaaaggtacagaagctgaaggatagcgaggccgagctccagaggagacacgagcagatgaaaaagaacttagaagctcaacacaaggagcttgaggagaaaaggcggcagtttgaagacgagaaagccaattgggaggcgcagcagcggattcttgaacagcaaaacagtagtagaaccctggaaaaaaataagaagaagggcaaaattttttag

SEQ ID NO: 17313 - DNA, 267 bp, Artificial Sequence
  Description of Artificial Sequence: Synthetic coding sequence
atgaagaagatggaaatggagatggaacaggtcttcgagatgaaagtcaaggaaaaagtacagaagctgaaagactccgaggcagaactccagcgacgccatgagcagatgaaaaagaaccttgaagctcagcataaggagctggaggagaagaggcgccaattcgaagacgagaaagcaaattgggaggcccagcagaggatcctggagcaacagaactcgagtcggaccctggaaaagaataagaagaaaggcaaaatcttttag

SEQ ID NO: 17314 - DNA, 1155 bp, Artificial Sequence
  Description of Artificial Sequence: Synthetic coding sequence
atggtggtcggcgagtccggcctggggaaatcgaccctcatcaatagcctcttcttgactgacctgtactccccagaataccccggacctagccacagaatcaagaagaccgtccaagtggagcagagcaaggtgcttatcaaagaggggggcgtccagctgctgcttactatagtggatactcctggatttggggacgccgtggacaacagcaattgctggcagccggtcatagactacatcgatagcaaattcgaggattatctcaatgccgagtctagggtgaacaggagacagatgcccgataatcgggtgcagtgctgcttgtacttcatcgctcccagtggtcatggacttaaaccactcgatattgaattcatgaaacgtctccatgaaaaggtgaacattatcccactgattgcgaaggccgacacactcacaccagaagaatgccaacagttcaagaagcaaatcatgaaggagatccaggagcacaaaatcaagatatatgagtttccggagacagatgatgaggaggagaataagcttgttaagaaaatcaaggaccgattgcccttggcagtcgtggggagcaatacgattatcgaagtcaatgggaaacgagtgcggggccggcagtatccttggggtgtcgctgaggtggaaaatggggaacattgtgattttacaattcttaggaacatgctgattcgtacgcacatgcaagatttgaaggatgttacaaataacgtgcattacgaaaactacaggtcacgaaaattggcagccgttacatataacggggtcgacaataataagaataagggccagctgaccaaaagcccacttgctcagatggaggaggaacggagagagcacgttgccaagatgaagaagatggagatggaaatggagcaggtgttcgaaatgaaagtgaaggagaaggtacaaaagctcaaagactcggaggctgaacttcagcgacggcacgagcagatgaagaaaaacctggaggcgcagcacaaggagctggaagagaagcgtaggcagtttgaggatgaaaaagcaaactgggaggcacagcaacgaatcctggagcaacagaatagctctcggaccctggaaaaaaacaagaagaaagggaagattttttag

SEQ ID NO: 17315 - DNA, 708 bp, Artificial Sequence
  Description of Artificial Sequence: Synthetic coding sequence
atgtcagtctctgctcggtctgccgccgcagaggaacgttcagttaattccagcaccatgggccaacagaaaaatctggaaggatacgttggatttgccaatttaccaaatcaggtctataggaagtccgtgaagagagggttcgagttcactctgatggtggtcggggagagcggactcggaaaatctactttaataaacagtctcttcctgactgatttgtattcaccagaataccccggcccatcacatcgcattaagaaaaccgtgcaggtcgaacagtctaaggtcctcatcaaagaaggcggagtgcagctccttctgaccatcgtggacactccaggattcggagacgcggtggacaactccaattgttggcagccagtcatcgattatatcgactcaaaattcgaggattacttaaatgccgagagtcgagtgaaccgccgtcaaatgccagacaatcgcgtccagtgctgcctttacttcatcgcgccctcaggtcacggtctgaaacctctcgatattgagttcatgaaaaggctgcacgagaaggtgaacatcatccctctgatcgccaaggccgacaccctaacacccgaagagtgtcagcaatttaaaaagcagatcatgaaagagatacaggaacacaagataaagatctacgagtttccagaaacagccaagaagaagaagaaaaagaaatag

SEQ ID NO: 17316 - DNA, 1155 bp, Artificial Sequence
  Description of Artificial Sequence: Synthetic coding sequence
atggtagttggcgaatccggactgggaaaatccactttaattaattccttgttcttgactgacctttactctccagaatacccaggcccgtctcatcggatcaagaagactgtacaagttgaacagtccaaggttctaatcaaggaagggggcgtgcagcttttgttaaccattgttgatacccctggctttggcgatgcagtggataacagtaattgctggcaaccagtgattgattacatcgattctaagtttgaggactatctgaacgcagagtctagagtgaataggcggcagatgccagataacagagtgcagtgttgtctgtattttatcgccccatccgggcacggcctgaagcctctggatatcgagttcatgaagcgtcttcatgaaaaggttaacattattcccctgatcgcaaaggccgacacattgacacctgaagagtgtcagcaatttaagaaacaaatcatgaaggagatccaggaacataaaatcaagatttacgagtttcctgaaacggatgacgaggaggaaaataaactggtgaagaagatcaaggaccggctgccgcttgctgttgtaggcagtaacaccatcatcgaagttaatggcaagcgtgtacgcggacggcaatatccttggggcgtggctgaagttgagaacggcgagcattgcgacttcacaattttgagaaacatgctaatcaggactcatatgcaagatctcaaggacgtcacaaataatgtccactacgaaaactaccggagccgaaaactggccgctgtcacctacaatggcgtcgacaacaacaaaaacaaaggacagctcactaagtcgcccctcgctcagatggaggaagaaaggagagagcacgtggctaagatgaagaagatggaaatggagatggagcaagtctttgagatgaaggtcaaggagaaagtacaaaaattaaaagattccgaggccgagctgcaacgccgacatgagcaaatgaagaaaaatttggaggcccagcataaagaactcgaggagaaaaggcggcagtttgaggacgagaaggctaactgggaggcccagcaacgaatcctggagcagcagaactcatcaagaaccctcgaaaagaataaaaagaaaggcaaaattttttag

SEQ ID NO: 17317 - DNA, 1146 bp, Artificial Sequence
  Description of Artificial Sequence: Synthetic coding sequence
gtcacgcatgagactattgtggagcaacagaaaaacctcgagggctacgtcgggttcgccaatttgccaaaccaagtctatcggaaatcagtcaaacgggggtttgaatttaccctaatggttgtgggtgaatctggtttgggtaaaagtacgctgatcaattctctgtttctcacagacctctactctccagagtacccagggccctctcacaggatcaagaaaacggtacaagtcgaacagagcaaagtgcttatcaaggaaggaggagtccagctgcttctcacaatcgttgacactccaggtttcggtgatgcagttgataatagtaactgctggcagcctgttattgattacatcgactccaagttcgaggactatctgaatgccgaaagccgcgtcaataggagacaaatgcccgataatcgagtccaatgttgtctctacttcatcgctcctagtggccacggactcaaaccactggacatcgaatttatgaagcgcttgcacgaaaaagtgaacatcattcctctaatcgccaaagctgatacccttacaccagaggaatgccagcaattcaagaagcagattatgaaagagattcaggagcacaagatcaagatctatgagtttccagaaacagacgacgaggaggagaataagttagttaagaaaattaaggacagactgcccttggctgtcgtggggtccaatactattatcgaggtgaatggtaagagggtgcggggacggcaatacccttggggtgtggcggaggtggaaaatggggaacactgcgactttactattctccgcaatatgttaattcgcactcacatgcaggaccttaaggatgtgacgaacaacgtgcactatgagaactacaggtccagaaaacttgcggccgtcacatacaacggcgtcgacaataataaaaacaaaggtcaacttaccaagtcacccctggcacagatggaggaggagaggagagagcacgtggcaaagatgaaaaagatggagatggaaatggagcaggtcttcgaaatgaaggtaaaagagaaggtccagaagctgaaggactccgaagccgaggttattagcctgatttcccacctgctcgccgacatcgtattcctgttcaagtag

SEQ ID NO: 17318 - DNA, 1149 bp, Artificial Sequence
  Description of Artificial Sequence: Synthetic coding sequence
atgggggaatccggcctgggcaagtcaactttgatcaattctctgttcttgacggacctctactccccagagtatccagggcctagtcaccgcattaaaaaaaccgtgcaagttgaacagagcaaggtgctgataaaagaggggggtgtgcaattgctcctgaccatcgtggacaccccgggctttggcgacgcggtcgacaattcaaactgctggcagcctgtcattgattatattgatagtaagttcgaagactatctcaatgccgagagccgcgtgaaccgcaggcaaatgcccgacaacagagtacaatgctgcttatacttcattgctccatccggccacggcctcaagccactggacatcgaattcatgaagcgtttacacgagaaagtgaatatcatcccactcattgccaaggcggataccttaacccccgaggaatgccaacagttcaagaagcaaatcatgaaggaaattcaggaacataaaataaagatctacgagtttccagaaactgatgacgaagaggagaacaagctcgtgaaaaaaataaaggaccgactacctttagcggttgtgggatccaacactatcattgaagtcaacgggaaacgagtgcggggcagacagtatccttggggcgtggcagaggtggaaaatggcgagcactgcgattttacaatcttaaggaatatgcttattagaacacatatgcaagatctgaaggacgtaacaaataatgtccactacgaaaactatagatcaaggaagctcgcagcagtgacttacaacggcgtggataataacaaaaacaaggggcagcttaccaaatctcctctggctcaaatggaagaggaacggagagagcatgtggcaaagatgaagaagatggagatggagatggagcaggtgtttgagatgaaggtaaaggagaaagttcagaaacttaaggactctgaagcagagctccagcgaaggcacgagcagatgaaaaagaatctcgaagctcagcataaagaactcgaagagaagcggcgtcagtttgaagacgaaaaggctaactgggaagcccagcaacgcatcttggagcagcagaactcctccaggactcttgagaaaaataagaagaagggaaagattttctag

SEQ ID NO: 17319 - DNA, 1302 bp, Artificial Sequence
  Description of Artificial Sequence: Synthetic coding sequence
atggaggtagtcgacccacagcagcttggaatgtttaccgagggtgaactaatgtctgtgggaatggatacgttcattcacagaatcgattctaccgaagtcatttaccagccccgaaggaagagagcaaagttaattgggaaatacctgatgggggacttgctaggagagggctcgtacggcaaggtcaaggaagtactcgacagcgagacgttgtgcagacgagctgtgaagatcctcaagaaaaagaagctgaggcggatccccaatggagaagccaatgttaaaaaggagatacagctgctgcggcgcctgagacacaagaacgtgatccagctggtcgatgttctgtataatgaagagaaacagaagatgtatatggtcatggaatactgcgtctgcggcatgcaggaaatgttggatagcgtgccggagaagcggtttcctgtttgtcaggcacacggctatttttgccagctgatcgatggcttggaatatttacactcccagggcatcgtccacaaggacatcaaacccgggaatttactgctcaccacgggcggcacactcaaaatttctgatctgggagtcgccgaagccctgcatccattcgctgccgacgacacttgtagaacctctcagggatcccctgcattccagccacctgagatcgccaacggactggacacattttctgggtttaaggttgacatttggagcgcaggagtgactctgtacaacatcactacgggactctacccctttgagggagacaatatctataagctcttcgagaatattggaaagggcagctacgccattcccggagactgtggacctccactctccgacctgcttaaaggcatgctggaatacgagccggctaagcgcttctctataagacagattagacagcactcgtggttcaggaagaaacaccctcccgcggaggccccagtaccaattccaccatctcccgataccaaagaccgttggcgttcaatgaccgtggtgccctacttagaggatttacacggggccgacgaagatgaggacttgtttgatattgaagatgatattatttatacgcaggattttactgtgcccggacaagtcccggaggaagaggcaagccacaatggccagcgccgtggcttgcccaaggctgtgtgtatgaacggaaccgaggccgcgcagctgtctactaaatcaagagcggagggcagggctcccaatccggccagaaaagcctgtagcgcctcatcaaaaattaggagactgagcgcttgcaaacagcaatag

SEQ ID NO: 17320 - DNA, 1299 bp, Artificial Sequence
  Description of Artificial Sequence: Synthetic coding sequence
atggaagtcgtagacccccaacagctaggtatgtttacagaaggcgagctgatgtccgtggggatggacacattcatacataggatcgacagcacagaagtaatatatcagcccaggcggaagagggcgaaactcattggcaagtacctgatgggcgatctcctcggagaaggctcctacgggaaagtgaaagaggtcctggattcagagaccctgtgcaggagggcggtgaaaatcttgaagaagaagaagctgaggcgcatacccaatggtgaagccaacgttaaaaaagagatccagctactgcgaagacttaggcataagaacgtgatacaacttgtcgacgtgctctacaatgaggaaaagcagaagatgtacatggttatggagtactgtgtgtgtgggatgcaggaaatgctcgattcggtgcccgagaagagattccctgtgtgtcaagcgcatgggtacttttgtcagctgatcgatggtcttgaatacctgcactcccagggaattgttcataaggatattaaacctggcaacctcctcttgactactggcggaacactgaaaatctcagacctgggggtcgctgaggccttacacccctttgcagccgacgacacctgtcgcacctcccaaggatctcctgccttccagcctccagaaatagccaacgggctcgatacattttcaggattcaaggtggacatttggagtgccggggtgactctgtacaatattaccacgggtctctatccatttgagggggacaacatatacaagctatttgagaacatcggcaaagggtcttatgcaatcccaggcgattgtggccctcccctgagtgatctgctgaagggcatgctagagtatgaaccggctaagcgctttagcattcgacagattagacagcattcatggttcagaaaaaagcatccgcccgctgaagcccctgtccctattccacccagtccagatactaaggacagatggagaagtatgaccgtcgtgccctacttggaggatctgcatggcgccgatgaagacgaagacttatttgacatcgaagacgacatcatctatacacaagactttaccgtgcccggtcaggtgccagaagaagaagcaagtcataatggccagaggcgcgggcttccaaaagcagtctgcatgaatggcaccgaagccgcgcagttatctactaagtcacgggccgaggccggacccccaactctgcctgcccggcctgcagcctctagtaaaattcgaaggcttagtgcttgtaagcagcaatag

SEQ ID NO: 17321 - DNA, 1248 bp, Artificial Sequence
  Description of Artificial Sequence: Synthetic coding sequence
atggaggatctctgtgttgctaataccctgtttgcattgaacctgtttaaacacctggctaaagcttctccaactcaaaatctctttctgagcccctggagcatcagcagtaccatggccatggtgtatatggggagtcgtgggtcgactgaggatcagatggccaaggtcctgcagttcaacgaggtgggagcaaacgcagttacacctatgacccccgaaaactttactagctgcgggttcatgcaacagattcagaaggggagctacccagacgcaatcttgcaggctcaggccgccgacaagattcacagcagttttcggtccttgtcttcagctatcaacgcctcaacgggcaactatttgcttgagtcagtaaacaagttgtttggcgagaaatccgccagctttcgggaagagtatattaggctgtgccagaaatactactcttccgaaccacaggccgtagatttcctggaatgcgcagaggaggcgcgcaaaaagataaatagctgggtcaagacccagactaaaggtaaaatccctaatttgctgcccgaaggatctgtcgacggggatacacgtatggtcctggttaacgctgtgtacttcaaaggaaagtggaagacccctttcgagaaaaagctgaatggcctgtatccattccgggtcaactccgctcaaaggacacccgtgcagatgatgtatctgagggaaaagctgaatatagggtacatagaggacctgaaagctcagattttagagcttccatacgctggcgacgtgtcaatgttcctgctcctacctgacgagatagccgacgtatcaacaggcttggaactgctcgagtcagaaatcacctacgacaaactcaataagtggacgagtaaggacaaaatggccgaagatgaggttgaagtgtacatccctcagttcaagctggaggaacactacgagctaagaagtatcttgaggagtatgggaatggaagacgcgtttaataaaggcagggccaacttcagcgggatgtctgagaggaacgacctttttttatcagaagtctttcatcaggccatggtggatgttaacgaggaagggaccgaagcggcagccggcaccggcggcgtaatgactgggcgtacagggcacggagggccacaattcgttgccgaccacccatttctgtttctcattatgcataagattactaattgtatcttgtttttcggccgtttcagctccccttag

SEQ ID NO: 17322 - DNA, 342 bp, Artificial Sequence
  Description of Artificial Sequence: Synthetic coding sequence
atggaggacctgtgcgtggccaataccttgtttgccctaaatctgtttaagcatctagctaaggcctccccaacccagaatctttttctaagtccttggtccatctcctcaacgatggccatggtgtacatggggtctagaggtagtactgaggatcagatggccaaagtcttgcagttcaacgaagtaggggcaaatgcggtcacccctatgacccccgagaactttacctcctgtggattcatgcaacagatccagaagggcagttatcctgacgcaattctgcaggcacaggccgctgataagatacactccagtttcagatccttaagctcagcttag

SEQ ID NO: 17323 - DNA, 486 bp, Artificial Sequence
  Description of Artificial Sequence: Synthetic coding sequence
atggaggatctttgtgtggccaatacactcttcgccttgaacctcttcaaacatctggcgaaggcctcccctacccaaaacctcttcctgtcaccatggtctatcagctctacgatggcaatggtttacatgggctcccgcggaagcactgaggaccagatggccaaggtattacaatttaacgaggtgggggccaatgccgtgactcctatgacacctgagaacttcaccagctgtggctttatgcagcagatccagaaaggtagctaccctgacgccatcctgcaggctcaggcagctgacaagattcactcctctttccggagtttgtcttccgcgattaatgcctctactggtaattacctccttgagagtgtgaacaaacttttcggcgaaaaaagtgcctcttttcgcgaggagtatatccggctgtgccagaagtactactcttcggagcctcaggccgtcgactttctggagtgctag

SEQ ID NO: 17324 - DNA, 399 bp, Artificial Sequence
  Description of Artificial Sequence: Synthetic coding sequence
atggaggacctgtgtgttgcgaacacactctttgctctgaatttgtttaaacacctagctaaggctagccctacacaaaatttatttttaagcccatggtctatctctagcactatggcaatggtgtacatgggttcccgcggcagcaccgaagatcagatggctaaagttttgcaattcaacgaggtcggggccaatgccgtgacacccatgacccctgagaatttcacaagttgcggcttcatgcagcagattcaaaaaggtagctaccccgacgccatattacaggcccaagccgcagacaaaatccattccagcttcagaagtttaagcagcgccatcaatgctagcactggcaattacctgctcgagagtgtgaataagctgttcggcgagtag

SEQ ID NO: 17325 - DNA, 1248 bp, Artificial Sequence
  Description of Artificial Sequence: Synthetic coding sequence
atggaagatctgtgtgttgctaatacgctcttcgcacttaacctgttcaaacacctggccaaggcctccccaacccaaaatctgttcctgtctccgtggtctattagttccacaatggccatggtctatatgggaagtcgcggttccaccgaggatcagatggctaaggtgctgcagtttaacgaagtcggggcaaatgccgttactccaatgaccccagagaatttcacatcctgtggttttatgcaacaaattcagaagggatcatatcccgatgccattcttcaggcccaggctgctgacaagatccacagcagctttcggtctctgtcttccgccatcaacgcatctaccgggaattacctactggaatcggtcaataaattgttcggggaaaaatctgccagtttcagagaggaatatattagactatgtcagaagtattacagtagcgagcctcaagctgtagacttcctcgagtgtgccgaggaggcacgtaagaagatcaactcatgggtgaagacacagactaaagggaagattcccaacttgctcccggagggatccgttgatggagacactcgcatggttctcgttaatgctgtgtactttaaaggtaagtggaagacccctttcgagaagaagttgaatggcctgtatccgtttagagtgaattccgcgcagcgcacacccgtgcaaatgatgtacttacgggagaaacttaacatcggttatatcgaggatctgaaggctcagatccttgaattgccctatgccggcgatgtctccatgtttctgctgttacctgacgagattgcagacgtcagcaccggactcgaacttctggagtcggaaattacatacgataaactgaacaagtggaccagcaaggataaaatggccgaagacgaggtcgaggtgtatatcccccagtttaagctggaggagcactatgaacttagaagcattctcaggagcatgggcatggaggacgcctttaataagggaagagccaacttctccggcatgtcagagcgaaacgatctgtttctctcagaagtgttccatcaggccatggtggatgtcaatgaggagggaaccgaggccgccgccggcaccggaggagtcatgaccggacgaaccggacatgggggacctcagtttgtggccgaccacccatttctgttcctcattatgcataagataactaattgcatcctgttttttggaagattcagttcaccctag

SEQ ID NO: 17326 - DNA, 2280 bp, Artificial Sequence
  Description of Artificial Sequence: Synthetic coding sequence
atggcaggccttaccttatttgttgggcgactgcccccttcagcgcggtctgaacaactcgaagagctgttttcccaggtgggaccggttaagcagtgctttgtggtcacagaaaagggctccaaagcctgtcgggggtttgggtacgtgacattcagtatgctggaggacgtgcagcgcgcactgaaagagatcaccacctttgaaggctgcaagatcaatgtaaccgttgctaaaaagaaattgagaaataaaactaaggagaaaggaaagaatgaaaattccgagtgccccaagaaagagcccaaagccaaaaaagctaaggtagccgacaagaaggcacggctgatcatccggaatctgagtttcaagtgttctgaggacgatttgaagactgtgtttgcccagttcggggctgtactcgaggtgaacattcctcgtaagcctgatgggaaaatgcgcggatttggttttgttcagtttaagaatctgctggaagccggaaaagctctgaagggcatgaacatgaaggagatcaagggccgaacagttgccgttgattgggcggtcgctaaggacaagtacaaagacacccagagcgttagcgccattggggaagagaagagccacgagagcaaacaccaggaatcagtgaaaaagaaaggtagagaggaagaagacatggaagaggaggagaatgacgacgacgatgatgacgacgacgaggaggatggcgtcttcgatgacgaggatgaggaagaggaaaatatagagagtaaagtaaccaagcctgtgcagatccagaaacgcgctgttaaaaggcccgcacccgcaaagtcttctgaccactcagaagaagactcagatctggaggagagcgactcgatcgatgacggcgaggaattggcgcagagcgatacttccacggaggagcaagaggataaggctgttcaagtttccaacaagaaaaaacggaaattgccttcagatgttaatgaaggtaaaacagtgttcatcagaaatctgagctttgactctgaggaggaagagctcggtgagctgttgcagcagtttggcgagctgaagtatgtgagaattgtgctgcaccctgacacagaacattccaaagggtgcgccttcgcgcagttcatgactcaggaagctgctcagaaatgcctgctggctgcctcccctgagaatgaggccggcgggttgaagttagacggtcgacagctgaaagtggacctggccgtgaccagagacgaggccgccaaactccagacaactaaagtcaaaaaaccaaccggtactagaaacctgtatcttgccagagagggcctcatccgggctggcactaaggctgcagaaggtgtgagcgccgccgatatggcaaagagggaacggttcgaattgctcaaacaccagaagctgaaggaccaaaacatatttgtgtctcgcacaaggctgtgcctgcataatttgcccaaggcagttgatgacaagcagctgcgaaaattgttgctgagcgccacctctggggagaaaggagtgagaattaaggagtgtagggtgatgcgagacttgaaaggtgtgcatggcaatatgaagggacagagcctgggctacgcattcgccgagttccaggagcatgaacacgccttgaaggccctacggcttattaataataaccccgaaattttcggccctttgaaacgaccaattgtggagttcagcttagaagatagaaggaaacttaagatgaaggagctcaggatccagcggtccctccagaagatgcgctccaagccggcaactggcgaaccacagaaaggacagcccgaacctgctaaagaccaacaacagaaggccgcccagcatcacactgaagaacagagcaaagtgcctcccgagcagaagcggaaggcaggctcgactagttggacaggttttcagaccaaggccgaagtggagcaagtcgagctgcccgatggaaagaagagaagaaaggtcctggctttgccctcacatcgcggcccaaagattaggctccgcgacaaaggtaaggtgaagcccgttcacccaaagaagccaaagccccagattaaccagtggaagcaggaaaagcagcagctgagttctgagcaggtcagccgcaagaaagctaagggtaacaagacagaaacgcggtttaatcaactcgtggaacagtacaaacagaaactgctgggtccgtctaagggagcaccattagccaagagaagcaagtggtttgacagttag

SEQ ID NO: 17327 - DNA, 1164 bp, Artificial Sequence
  Description of Artificial Sequence: Synthetic coding sequence
atgcagatgagtccagcattaacctgccttgttctaggactggccctggtgttcggtgagggctcagctgttcaccatccacccagctatgtagcgcaggcctcaaaagaccggaatgttgtttttagcccatatggcgtggcatccgtgcttgcaatgctacagttgacaacaggcggagaaacccagcagcagattcaggccgccatgggctttaaaattgatgataagggcatggctcccgccctccgacatctgtacaaagaactgatgggcccgtggaataaagacgagatctcaacaactgatgctatcttcgtccagagagacctaaagctggtgcaaggttttatgccgcatttctttcgcctgttcaggtcaacagtcaaacaggtggactttagtgaggtggaacgggcgaggttcattattaatgactgggtgaagactcatactaaaggcatgatatccaatctgctcggaaagggagcagtggaccaactcacgagactggtcctggtaaacgccctctattttaatggacagtggaaaacacctttccccgatagctctacccaccgcagactgtttcataagtctgatgggagcactgttagtgtgcctatgatggcccagacaaacaagtttaattacaccgaattcactactcccgacggacattactacgacattttggagttgccctaccacggtgatacattgtctatgttcatagcagcaccctacgaaaaagaggttcctctatccgccctcactaacattctctccgcacagctcataagccactggaagggtaacatgacaagactcccgcgactgctagtattaccgaagttctcgctggagaccgaagtcgatctacggaagccattggagaatctgggaatgaccgacatgtttcgccagtttcaagcggattttacatccttatctgaccaggagcccctccatgttgcccaggcattgcagaaagtcaagattgaggtgaacgaatctggaaccgtcgcaagttccagtaccgcagttattgtatccgcgcggatggcccccgaagagatcatcatggataggccgttcctgttcgttgtccggcataacccaacaggcacagtcctgtttatgggacaggtgatggagccttag

SEQ ID NO: 17328 - DNA, 540 bp, Artificial Sequence
  Description of Artificial Sequence: Synthetic coding sequence
atgatggcccagaccaacaaatttaattacaccgaatttacaacccccgacggtcactactatgatattctggagttgccctaccatggggatacgctgagtatgtttatagcagctccctacgaaaaagaagttcccctgagcgcgctcactaatatactgtctgctcagctcatctctcactggaagggtaacatgacccggttgccaagactcctagtgttacccaagtttagtttagaaacggaagtagacctgcgaaaacccctggagaatttggggatgaccgatatgttccggcagtttcaggccgacttcacatccctaagcgaccaagagccattacatgtggcccaagcccttcagaaggttaaaattgaggttaacgagagtggtactgtggcctcttcgtccacagccgttatcgtgagcgctcgcatggcaccagaggagattattatggaccgcccctttctgttcgtagtacgtcacaacccgacaggcacggtgctgtttatgggccaggttatggaaccatag

SEQ ID NO: 17329 - DNA, 711 bp, Artificial Sequence
  Description of Artificial Sequence: Synthetic coding sequence
atgctctccaaaggtctgaagcgaaagagagaggaggaggaggagaaagagcccctggcagttgattcttggtggctagaccctgggcacactgcagtagcacaggctccgcctgctgttgccagcagctccctgttcgacctctccgtcctgaagctgcaccacagccttcagcaaagcgagcctgaccttcgtcatctcgtgctagtggtcaacacacttagaaggattcaggctagtatggcccccgctgccgcattgccaccggtccctagcccacctgcagccccgtcagtggcagacaatctgctggcgagctccgacgcagccctgagtgccagtatggctagcctgttggaagacctctcacatattgagggactgagtcaggccccacagcccttggccgacgagggaccccctggccgatccatcggtggcgctgccccctccctgggcgccctggacctcctggggcctgcaacgggctgcctcctggacgatgggcttgagggattgtttgaggatatcgacactagtatgtatgataatgaactgtgggcacctgcttccgaagggctcaagcctgggcccgaagatgggccaggaaaagaagaggcccctgaactggacgaagctgagctggattatctgatggacgtgctcgttggtacgcaagccctagaaaggcctccggggcctggccggtag

SEQ ID NO: 17330 - DNA, 1527 bp, Artificial Sequence
  Description of Artificial Sequence: Synthetic coding sequence
atgttacccacccaggcaggagccgcggctgcactcggtaggggctccgctctaggtggcagcctgaaccggacacccaccgggaggcctggaggcggcggaggcacgcggggcgcgaatggggggcgcgtgccaggaaacggggcagggctcggaccaggaagattggagagagaggcagcagccgccgctgcaaccacaccagcgcctactgcaggcgctctttacagtggcagcgagggcgactctgaatcgggagaggaggaggagctcggcgcggagcgccgcgggttgaagcggtctctttcagagatggagatcggaatggtggtgggaggccctgaggctagcgcagctgccaccgggggctatggcccagtttccggggccgttagcggggcaaagccagggaaaaagacccgggggagagtgaaaatcaagatggagttcatcgataataagctacgccggtacacaactttctctaagcggaagactggtatcatgaagaaggcgtatgagctgtctaccctcaccgggactcaagtgctgctcttggtagcatccgagacgggtcacgtgtacacattcgccactagaaaattgcagccaatgattacaagcgaaacgggaaaagcactgattcaaacctgtctgaattccccagattctccgcctcggtcagatcccacaacagaccaacggatgtccgcgaccggatttgaggaaactgacctgacatatcaagtaagcgaatcagattcatccggggaaactaaagacactctgaaacccgccttcaccgtgaccaatctcccagggacgacctcaactatccagaccgcaccgtctacttcaacaacaatgcaggtttcaagcgggccctcttttcccataacaaattatctcgcaccggtgtctgcatctgtgagtcccagtgctgtctctagcgcgaacggtaccgtgcttaagtctactggatccggaccagtttcctcaggaggactcatgcagcttccaacatctttcacgctcatgccgggcggggccgtcgcacagcaggtgcccgtccaggccatccaagtccatcaggctccccagcaggcttcaccgtctagggactcatcaaccgatctaacccaaacttcaagtagcgggaccgtaacattaccagccacaattatgacctcctccgtgccaacgaccgtcggtggtcatatgatgtacccttccccacacgctgtcatgtacgcccctactagcggcctcggagacgggagtttgacggtgttgaacgccttctcccaggccccatcaacgatgcaggtgagtcattctcaggtacaggaacccggtggcgtacctcaggtatttctcaccgctagtagtgggacggtccagattcctgtgagcgcagtgcagctccaccagatggctgtgattggtcaacaggctgggtctagttcaaacctgactgaattacaagtcgtgaaccttgacactgctcacagtactaagtcagaatag

SEQ ID NO: 17331 - DNA, 915 bp, Artificial Sequence
  Description of Artificial Sequence: Synthetic coding sequence
atgatcacctctgaaactggcaaggccctgatccagacctgtctgaactcgcccgattcaccacctcggagcgatccgacaaccgatcaacggatgagcgcaaccggcttcgaagagacagacctgacataccaagtctcagaaagtgactcctctggcgaaactaaggataccttgaagcccgcgtttactgtcacgaacctcccgggcacaacctctaccattcagaccgcaccctcaactagcaccactatgcaggtcagtagtggccctagtttccctatcaccaactatttggctccagtgtccgcaagtgtcagcccgtccgccgtgtccagcgccaacgggaccgtgttgaaatctactggatcaggccccgtcagctctggaggtttgatgcaattgcccacctccttcacgctcatgccagggggtgctgtggcacaacaggttccagtgcaggcgatccaggtccatcaggcgccccaacaggcctctcccagcagagatagttctaccgatctcacgcagactagtagctctgggaccgtaacattgcccgcaaccataatgacctcaagcgtacccaccactgttggtggacatatgatgtaccctagcccccatgcagtgatgtatgctcctactagcggacttggggacggctcactaactgtgctgaacgcgttcagtcaagcaccgtcaacgatgcaggtgagccactcacaggtgcaggagcctgggggagtcccccaagtctttcttaccgcatcttcaggaaccgttcagatcccagtgtccgccgtgcagctgcaccagatggctgttatcggccaacaggccggatccagctccaatttgacagagcttcaggttgtcaacctggatacagctcactcaacgaaatcagagtag

SEQ ID NO: 17332 - DNA, 834 bp, Artificial Sequence
  Description of Artificial Sequence: Synthetic coding sequence
atgagcgcaccagcagccaaggtgagtaaaaaagagctgaactcaaaccacgatggtgcggatgaaaccagcgaaaaggagcagcaggaagctatcgagcacatcgatgaggtccagaatgagattgacagactaaacgaacaggcttcagaggaaatactcaaagtcgagcagaaatataataagctgcgtcagcccttctttcagaaaaggtctgaactgatagctaagattccaaatttctgggtgacaacctttgtgaatcatccgcaggtgagtgctctgctcggggaagaggacgaggaggccctccattacttaaccagggtggaggtgacagaatttgaggacatcaagagcggctatagaatagacttctactttgatgaaaatccatatttcgaaaacaaagtcctctcaaaggaattccacctcaatgagtccggtgacccgtctagtaagtccacagaaattaagtggaagtctggaaaagaccttaccaagcggagctcgcaaacacaaaataaagctagccgcaaacggcagcacgaggagccagagtcattcttcacgtggttcaccgaccattccgacgctggggccgatgagctgggggaagtgattaaagatgatatctggcccaacccccttcagtattacctggtgccagacatggacgacgaggagggcgaaggagaagaggacgacgacgacgatgaagaagaagagggactggaagatatcgacgaagagggagatgaggatgagggtgaggaagacgaggacgacgatgaaggcgaggagggcgaagaggatgaaggtgaagacgactag

SEQ ID NO: 17333 - DNA, 798 bp, Artificial Sequence
  Description of Artificial Sequence: Synthetic coding sequence
atgcctagaagtcaccagcctccaccacccccacacgagaaggagcagcaggaggcaatagagcacatagacgaggtccagaacgagatcgatagactgaacgaacaagccagtgaggaaatcctgaaagttgagcagaagtacaataaacttcgccagccgtttttccaaaagcggtccgaattaatcgcaaaaattccgaatttttgggtcacgaccttcgtcaatcacccccaggtatcagctctcctcggcgaggaggatgaggaagccctacactacttgacaagggtggaggtaactgaatttgaagacatcaaaagtggatataggatcgacttttattttgacgaaaacccctatttcgaaaataaagttctgagcaaggagttccatctgaatgaatccggtgatccatcatccaaaagcaccgagattaagtggaagagtgggaaggacctcacgaagcgaagctcccagacccagaacaaagccagccggaaacgacagcacgaagaaccagaaagtttcttcacatggtttactgaccatagcgatgctggggctgatgagcttggagaggtgattaaggacgacatctggcccaatcctctccagtattacttggttccggacatggacgatgaggaaggcgaaggcgaagaggatgacgatgatgacgaggaagaagagggtcttgaggatattgacgaagagggcgatgaggatgaaggtgaagaggacgaggatgacgacgagggagaggagggtgaggaggatgagggggaagatgactag

SEQ ID NO: 17334 - DNA, 801 bp, Artificial Sequence
  Description of Artificial Sequence: Synthetic coding sequence
atgatgccccgctctcaccaacccccgccgccccctcatgaaaaggaacagcaggaagccattgagcatatagatgaggtgcagaatgaaatcgataggctgaacgaacaggccagtgaggaaatcttgaaggtggagcaaaagtacaacaagctccgccagccattcttccagaagcgctcagagttaatcgcaaaaatccctaatttttgggtcacaaccttcgtcaaccatccgcaggtttcagctttgctgggcgaagaagacgaggaggcactgcattacctcacacgagtggaggtgaccgaattcgaagatataaagtccggctatagaattgacttttattttgacgaaaacccctatttcgagaacaaagttctctctaaagagtttcatctgaacgagtccggggacccatcctccaagtcaactgaaattaaatggaagtctgggaaggaccttaccaaaagatcctctcagacccagaacaaggccagtagaaaacggcagcacgaggagccagaaagtttcttcacttggttcactgatcactccgacgctggggccgatgagctgggagaggtcattaaggatgacatttggcccaacccgctgcaatactatcttgtgccagacatggacgacgaggaaggggaaggagaagaagatgacgacgacgacgaggaggaggaaggacttgaggatatcgatgaagagggagatgaggatgaaggcgaagaagacgaagatgacgacgaaggcgaagagggcgaggaagatgaaggcgaagatgactag

SEQ ID NO: 17335 - DNA, 873 bp, Artificial Sequence
  Description of Artificial Sequence: Synthetic coding sequence
atggcacccaagaggcagtccccactgccaccacagaagaagaagccccgccctcctccagccctcgggcctgaggaaacctcagccagcgcgggcttgcccaaaaaaggtgagaaagagcagcaggaggctattgaacacattgacgaagtgcagaatgagatagatcgcctgaatgagcaagcgagtgaagagatattaaaagtcgagcagaagtacaataaactgcgacagccgttctttcagaaaagatccgaattgatcgccaaaattcccaacttctgggttacgactttcgtcaaccatcctcaggtgagcgcgctcctgggcgaggaggacgaggaggccttgcactacctcacaagagtggaggtcaccgaatttgaagacataaagagcgggtatcgcatagatttttattttgatgaaaacccttacttcgaaaacaaggtgctgagtaaagagttccacctgaacgaatccggcgatccgagcagcaagtccactgaaatcaagtggaagagcgggaaagacctgaccaagaggtcatcacaaactcaaaacaaggccagcagaaaacgccagcacgaagaacctgaatccttctttacatggttcaccgaccactccgacgcaggcgcggatgagcttggcgaagtcattaaagacgacatatggcctaaccccttgcagtactatcttgtacctgacatggatgacgaggaaggcgagggagaagaagacgacgacgacgatgaggaggaagagggtctagaagatatcgacgaggaaggcgacgaagatgagggtgaagaggacgaggacgatgacgagggagaggaaggagaggaggatgagggggaagatgactag

SEQ ID NO: 17336 - DNA, 807 bp, Artificial Sequence
  Description of Artificial Sequence: Synthetic coding sequence
atggggtgtcgggacctgctgccatcactgaagcctactctgctcgaaaaagagcaacaggaagccattgaacacatcgatgaggtccagaacgagatagacagattgaacgaacaggcttctgaggagattctgaaagtcgagcagaaatataacaaattacgtcagccgttcttccagaagagaagcgaactcatagcgaagatcccaaacttttgggtgactaccttcgtgaaccaccctcaggtatcagctctcctgggagaagaagacgaggaggctcttcactacctgacgcgcgttgaggtgacggaattcgaagacattaagtcgggttacagaatcgacttttatttcgatgaaaatccgtattttgaaaacaaggtgctctcaaaggaattccatttaaatgagtccggcgatccatccagcaaatctacagagataaaatggaaatctggaaaggatctcaccaagcggtcatcacagactcagaacaaggcgtcaaggaaaaggcagcacgaggagccggaatcattttttacctggtttactgatcacagtgatgctggggccgacgagctcggcgaagtcattaaggatgatatttggccaaaccctctccaatactatcttgtgccggacatggatgatgaggagggagaaggcgaggaagatgatgacgatgacgaagaagaggagggcctggaggatattgacgaagagggcgacgaggatgagggcgaggaggatgaagacgatgacgagggggaagaaggggaagaggacgaaggggaagacgactag

SEQ ID NO: 17337 - DNA, 99 bp, Artificial Sequence
  Description of Artificial Sequence: Synthetic coding sequence
atggccccgaagcgacagtcccctctgcccccacaaaagaagaaaccgaggccacctcctgccctgggccccgaagagactagcgccagcgcaggctag

SEQ ID NO: 17338 - DNA, 942 bp, Artificial Sequence
  Description of Artificial Sequence: Synthetic coding sequence
atgactgggaaggctacgcccccttccctgtattcatggcgtggagtcctcttcacttgtctccctgccgctcggaccaggaagcggaaagagatgtctagacaaactgctacagctctgcccactgggacaagtaaatgtccaccgtcacagcgcgtccccgcgctgacagggactaccgcaagcaacaacgacctggccagcttgtttgagtgccctgtttgtttcgactatgtcttgccccccattctgcagtgccaatctggacatctggtgtgtagcaattgtcgccctaaactgacgtgctgtccgacctgtcgcggcccactgggcagtattcgcaacttggcaatggaaaaagtcgctaactctgttctgtttccatgtaagtatgccagctccggctgcgagattacactgcctcataccgagaaagcggaccacgaggagctgtgcgagtttcgtccttattcatgcccatgcccgggcgcctcatgcaaatggcaggggtctctggacgccgtgatgccacatctgatgcaccagcataagtcgataaccacgctgcagggggaagacatcgttttccttgccactgacatcaacctcccgggagccgtggactgggtgatgatgcagagctgcttcgggtttcacttcatgctagtcctggagaagcaggaaaaatacgacggtcatcagcaattttttgctattgttcagctgattggcacacgcaagcaagctgaaaatttcgcttatcggctcgagctgaacggacatcggcgtaggctgacgtgggaagcaaccccccgttcaatccacgaaggaattgccaccgctatcatgaacagcgattgtctggtgtttgacaccagcatcgcccagctgtttgccgaaaacggtaacctgggaatcaacgttacaatttcaatgtgctag

SEQ ID NO: 17339 - DNA, 897 bp, Artificial Sequence
  Description of Artificial Sequence: Synthetic coding sequence
atggtcattattattttcctgttacccccctacgtgtttatttctgaaatgagtcgccagacagctaccgccttgcctactggtactagcaaatgtcccccgagccaaagggtgcctgcgttaaccggcactacagcttccaataacgacttggcatccctatttgaatgtccggtttgttttgactacgttctcccaccaattctgcagtgtcagtcgggacatcttgtctgctccaactgccgaccaaagttaacatgctgtcccacatgccgaggccccttaggctccatcaggaatctggcaatggagaaagtagccaacagtgtcctgttcccctgtaagtacgccagcagtggctgtgagattacccttccgcacaccgagaaggcggatcacgaagaactgtgcgaatttcgcccctattcttgcccatgtccaggcgccagctgtaagtggcaggggtccttagatgcagtgatgccccatctcatgcaccagcacaaatccattacaactctgcagggcgaggacatcgtttttctcgccactgatataaatctgccgggcgccgtcgattgggtgatgatgcagtcttgttttggattccattttatgctcgtgctggagaagcaggaaaagtacgacggccaccagcagttcttcgcaatcgtgcagcttattggcacccggaaacaggccgagaactttgcctacaggcttgagctgaacggacacagaagacggctgacatgggaagcgacacctcggtccatccatgagggaatcgcaaccgctatcatgaattccgactgtctcgtcttcgatacatccattgcccaactctttgctgaaaatggcaatctgggtatcaacgttacgatctccatgtgctag

SEQ ID NO: 17340 - DNA, 849 bp, Artificial Sequence
  Description of Artificial Sequence: Synthetic coding sequence
atgtcaagacagacagccacagcgctgccgacagggacttccaagtgcccaccctcacagcgtgttccagccctcactggcacgaccgccagtaataacgacctcgcctccctgtttgaatgtcccgtatgttttgattacgtgcttccccctatcttgcagtgccagagtggccacctagtttgctccaactgtcggcccaagcttacgtgttgcccaacttgcagaggccctctggggtccataaggaatcttgcaatggagaaggtggcgaacagcgtgctttttccatgtaaatatgcatcgagcggctgtgaaatcacactgcctcatactgaaaaggctgaccatgaggaattgtgcgagtttagaccgtacagttgtccttgtcctggggcgagttgtaagtggcaaggctctctggatgctgtcatgcctcacctgatgcatcaacacaaaagcatcacgacactgcagggagaagacatcgtgttcctggctacagacattaatctgcctggagctgtagactgggtcatgatgcagtcctgttttggattccacttcatgcttgtactcgagaaacaagaaaagtatgatggacatcagcagttctttgctatagtgcaactaattgggacccggaagcaggcggaaaactttgcctacaggctcgaactaaatggacaccgacgcagactaacttgggaggctacgccaaggtcaattcacgaagggatcgcgactgcgatcatgaacagcgactgtctcgttttcgacacgagcattgcacagctgttcgctgagaatgggaacctcgggatcaacgtgaccatctcaatgtgttag

SEQ ID NO: 17341 - DNA, 708 bp, Artificial Sequence
  Description of Artificial Sequence: Synthetic coding sequence
atgaccttcgaccttacgaagatcaccaagactagcagcagtttcgaggtgcgtacttgggaccccgagggagtgatattctacggagacactaatcccaaggatgattggttcatgttgggccttcgcgacggccgcccggaaattcagcttcacaaccactgggcccagctgacagtgggcgccggaccaagactcgacgatggcagatggcaccaagttgaggtgaaaatggagggcgacagcgtgctgcttgaggttgacggagaagaggtgcttcggcttcggcaggtgtctggacctctgacctcgaaacggcacccaattatgcggattgccctgggaggtctgcttttccctgcatctaatctgcggctgcccctcgtgccagcactcgatggttgcctgaggcgcgatagctggctggataagcaggcggaaatctcagcgtctgcgccaacatccttgagatcctgtgacgtcgaatccaaccctggcatctttctaccacctggaacgcaggcggagtttaatctgcgggacatacctcagcctcatgccgaaccctgggcattctcgctggacttaggacttaaacaagccgcgggtagcgggcacctgctcgctctcggcacccccgagaaccccagttggctctctttacatctgcaagaccaagagaagaccctgccgcccctgttcgcttag

SEQ ID NO: 17342 - DNA, 1209 bp, Artificial Sequence
  Description of Artificial Sequence: Synthetic coding sequence
atggaatctcgcggccccttggctactagcagactgctcttactgctgcttctgctgctgctacgacacacccgtcagggctgggctctacgaccagtcttgccaacacagtcggctcatgatccgcctgctgtccacctttccaacggccccgggcaagaaccgatcgcggtcatgacctttgacctgactaagataacaaaaacatcaagctcgtttgaggttaggacgtgggacccggagggagtgatattctatggggacacaaatccaaaagacgactggttcatgctcggactgcgggacggacgaccagaaatccaactgcacaatcattgggcccagctcaccgtgggtgcgggtcctcgactggatgacggccggtggcatcaggtggaggtgaagatggagggcgactcagtgctactggaggtcgatggggaggaggtgctgcgactaaggcaggttagtggccctcttacgagtaagaggcaccctatcatgcggatcgcactgggaggtcttcttttccccgccagtaacctgaggctgccccttgtgccagccctggatggctgtcttagacgcgatagttggcttgacaagcaagccgaaattagtgcatctgcccctaccagcttacggtcttgtgatgtggaatccaacccaggcatcttcctgcctcctggtacacaggcagagtttaacctgagggatatccctcagccacacgcagagccatgggcctttagtctggacctggggctgaaacaggccgccggttcaggtcatctccttgccctgggaactcctgaaaacccatcctggcttagcttgcacctgcaggatcaaaaagtagtgctgagtagtggaagcggaccagggcttgacctgccactggtcctggggttacctttacagctaaagctgtcgatgagtcgtgttgtgctttctcagggttccaagatgaaggccttagctctcccccctctcggacttgctcctctcctcaatttatgggccaagcctcagggacgcctcttcctgggagcccttcctggggaagattctagcacctcgttctgcctcaacggtctgtgggcccagggtcagcgtctggacgtcgatcaagccttaaacagatcccatgaaatctggacccacagttgccctcagtcccccgggaatgggaccgatgcatcacactag

SEQ ID NO: 17343 - DNA, 882 bp, Artificial Sequence
  Description of Artificial Sequence: Synthetic coding sequence
atggaaagccggggcccgctggccacgagtcggctgctgcttctcctacttctgctcctgttgagacatacaagacagggatgggccctccggccggtgctgcccacccaatcggcccacgatcctcccgccgtgcatcttagtaatggaccagggcaggaacccattgccgtgatgacgttcgacctgaccaagatcacgaagaccagttcatcttttgaggttaggacctgggatccagagggtgtgattttttatggtgacacaaatcctaaggacgactggttcatgttgggactgcgggacgggcggccagaaatacagttgcataaccactgggcgcagctgacggtgggagcgggtccaagactggacgacggccgatggcatcaggttgaggtgaaaatggaaggggactctgtcttattggaggttgacggggaggaagtcttgcggctccgccaggtctctggtcctctcacctcaaaacgccatcctatcatgaggattgcgctggggggcttgctgttcccggcttctaacttgcggttgcctctggtccctgcactcgacggatgtttgcggcgtgactcttggctagataaacaagcagagatctctgcatcagctccaactagtctgcgaagctgcgacgtagaatcgaatcccggaatctttttacctccgggaacgcaggcagagtttaaccttcgggatataccccagcctcacgccgaaccatgggctttctcacttgacttaggactcaaacaggcggcgggaagcggtcatcttctggctttgggtacccctgaaaacccgagctggttgtccctgcatctgcaggaccaggaaaagaccttgccaccactatttgcttag

SEQ ID NO: 17344 - DNA, 720 bp, Artificial Sequence
  Description of Artificial Sequence: Synthetic coding sequence
atggaatctcggggccctcttgctacgtccagactgctcctcctcctgctcctgctgctgctgagacacacacgccaggggtgggctctccgcccagtcttgcctacccaaagcgcgcacgatccgcctgccgtgcacctgtccaatggaccaggccaggaacctatagctgtcatgacattcgatctgacaaagattactaagaccagtagctctttcgaggtgagaacatgggatcccgaaggcgttattttctatggagacacaaatcctaaagatgattggtttatgttaggactgagggacgggaggcctgaaatccagctgcacaaccactgggcccagctgaccgtgggggcggggccgaggctcgacgatggacgctggcatcaactggttccagccctggacggttgcctgcgaagggactcatggcttgataagcaggccgagatctccgcaagcgcaccgacctctttgaggagttgcgatgtggaatccaaccctggaatctttctccctcctgggacccaggcggaatttaacctacgagatattcctcagccacacgcagaaccctgggccttctctctagacctaggacttaagcaggctgctgggtccggccacctgctcgccctggggactccagaaaatccatcgtggctgtcccttcacttacaggaccaggagaagacactgccacctctttttgcatag

SEQ ID NO: 17345 - DNA, 864 bp, Artificial Sequence
  Description of Artificial Sequence: Synthetic coding sequence
atggaatctcgcgggccactggcaacctctcggttgctattgcttcttttgctactgctgctgagacacactaggcagggttgggcccttcggcctgtgttacccacacagtccgcccacgacccgcccgctgtacacctaagtaacggtcccggtcaagagcccatcgctgtcatgacttttgatcttacaaaaatcacgaaaactagctctagcttcgaggtgagaacttgggaccctgagggcgttatcttttatggtgacaccaatccaaaggacgactggtttatgctcggactcagggacggccgacccgagatccagctgcacaatcattgggcccagctgactgtcggggctggccctcgtctagatgatggacggtggcatcaggtggaggttaagatggaaggtgatagcgtgctcttggaggttgacggcgaggaggtgcttaggttacgccaggtgagtggcccactgacatccaaaagacatcccatcatgcgtatagccttaggcggcttacttttcccggccagtaatctacgcctccctttggtacccgcactagacgggtgtctgaggcgcgattcatggctcgataagcaggctgagatcagtgcatctgcgcctacatcgctccggagttgtgacgtggagagtaacccagggatctttctgccaccagggactcaggccgaattcaatctccgcggagaggacagtagcacgtctttctgtctgaatggactctgggcccagggccagcggctcgatgttgatcaggcactgaatcggagccacgaaatctggacgcatagctgcccacaatcccccggcaatggtactgacgcatcacactag

SEQ ID NO: 17346 - DNA, 423 bp, Artificial Sequence
  Description of Artificial Sequence: Synthetic coding sequence
atggaatcacggggtcctctcgcgacgagcagattattactcctcctattattgttgctgttacgtcatacacgccagggatgggccctcaggccagtgctgcctactcaatctgcccacgatcctcctgccgtgcacctgtctaatgggcctggccaggaaccaattgcagtgatgacatttgacctcacaaagattacaaaaacttcaagcagtttcgaggtgcggacgtgggaccctgagggagtcatcttttatggtgacactaatcctaaagacgactggttcatgctcggattgcgggacggcagacctgaaattcagttgcacaaccactgggcgcagctgacagtgggtgctggcccacgcctagacgacggccgttggcaccaggagaagaccctgcctcccctctttgcctag

SEQ ID NO: 17347 - DNA, 1155 bp, Artificial Sequence
  Description of Artificial Sequence: Synthetic coding sequence
atggagtcacggggcccgttggccaccagtcgactacttctgctcctactgctactgttacttagacacacccgacagggctgggctctgcggcctgtgctgccaactcagtcagcccatgatccacccgccgttcatctcagtaacggacccggacaggagcctatagccgtcatgacatttgatctgacaaagatcaccaaaaccagttcttcctttgaagttagaacttgggaccctgagggagtgattttctacggcgatacgaatcctaaggacgactggttcatgctgggccttcgggatggcaggcctgaaatccaactccacaatcactgggcacagctgactgtcggagcaggcccacgcttagatgacggtcgctggcatcaggtggaggtgaagatggagggggattcggtcttgttggaagttgatggggaagaggtccttagattgaggcaggttagcggaccactaacttcgaagcgacaccccataatgaggatcgctctcggaggccttcttttcccagcttctaacttacggctccctgccgagatctccgcaagtgcccctacctcattaagaagctgtgatgtagagtccaatccagggatttttctgccacctggtactcaggccgagtttaatctccgcgatatccctcagcctcacgccgagccttgggccttttctctcgacttgggcctgaagcaagccgcagggagcggacatctgttggccctgggtacccctgagaatccctcatggctttcacttcacctgcaggaccagaaggtggtactgtcaagcgggagcggaccagggttagatctgcccttagttctcggccttccgctccaactaaagctgtccatgagtcgtgttgttctctcccaagggagtaagatgaaggccttagccctgccccctctcggccttgcccctctgctgaatctgtgggctaaacctcagggacgtttattcttgggcgccctccccggcgaagactcttcaacttcattctgtctgaatgggctttgggcccaggggcagcgattggatgtggaccaggctctcaaccgatcccacgagatttggactcactcatgtccacagtctcctggtaatggaaccgacgccagccactag

SEQ ID NO: 17348 - DNA, 1116 bp, Artificial Sequence
  Description of Artificial Sequence: Synthetic coding sequence
atgtcaccgtcaacgtttcagattaccgacatgacacgccggagttgccagaacttgggctacactgctgctagccctcaagcccctgaggccgcaagcaatactggcaacgccgagcgagccgaagaggttcctggcgaagggtcattgttcctgcaagccgagactagggcttggttccagaagacccaggctcactggctcttgcagcatggcgccgctcctgcttggtttcacggctttatcaccagacgggaggctgaaaggctgctggaacccaagccacaaggctgctatctcgtgcggttctcagaatcagctgtgacttttgtgctcacatacagatcgcgcacctgctgtaggcacttccttctggcgcagctgcgcgacgggcgccatgtagtattaggtgaagactctgcccacgccagactgcaggacttgcttctacactatacggcccatcccctcagcccatacggtgaaaccctgaccgaacctctggcgcggcaaactccagagcctgctggactctcgctccgaacagaggaatcaaatttcgggagcaagtcccaggaccctaacccacagtactcacccattataaaacaagggcaagctcccgtgcccatgcagaaggagggagctggggagaaggaaccatcacaactgttaagaccaaagccccctatcccggccaagcctcagctcccgcccgaagtctataccataccagttcctcggcataggcccgccccccgaccgaagccaagcaatcccatttacaatgagcctgatgagccgatcgctttctacgctatgggcagaggttccccaggcgaagcaccctctaacatctacgttgaagtcgaggacgaggggctcccagcaaccctggggcaccctgttctgcgaaagagctggtctcgacccgtgccaggaggacagaacactggagggtctcagctgcacagtgagaatagtgtgatcgggcagggaccacctctgccccaccagcccccccccgcttggcggcatacgctacctcacaacttatctcgccaggttttacaggatcgaggtcaggcttggcttcctcttggaccacctcagtag

SEQ ID NO: 17349 - DNA, 1170 bp, Artificial Sequence
  Description of Artificial Sequence: Synthetic coding sequence
atggagttcccactagcccagatttgcccccaaggctctcatgaggctccaattcctaccttttctacatttcaaatcacggacatgacacggaggtcctgtcagaacctcggttataccgctgcaagccctcaggccccagaggccgcaagtaacacaggcaacgcagagagggccgaagaagtgcctggggagggctccttgtttctgcaggccgagacaagggcctggttccagaagacccaggcccactggctgctgcaacacggggcggctcctgcatggtttcacggatttatcacccggcgagaagctgaacggctgttggaacctaagccacaaggctgctaccttgtgcgcttttccgaatccgctgtgaccttcgtgttgacttaccggtcacggacttgttgccggcatttcttgctggcacaattgagggatgggcgtcatgtcgtcctgggcgaggactccgcacatgccaggcttcaggatctcctgttacattatacagctcacccactgtcaccctacggagaaactcttaccgaaccactggctcgacagacacctgaacctgccgggttgtcactccggacagaggagagcaattttggcagcaagagtcaggaccctaacccccagtattcacccataattaaacaggggcaggcaccagtccctatgcaaaaggagggcgcgggggagaaggaaccttcacagctcctgcggcctaaacccccaattcccgctaaacctcaactgccaccggaagtctacacaatccccgtaccgaggcatcggcctgctcctcgccctaaaccaagtaatcccatctacaatgagcccgacgagccaatcgcattctacgctatgggcaggggttccccaggcgaggcgccctctaatatttatgtcgaggtggaggacgaaggcttgcctgccaccctggggcatccggttttgcgcaaatcgtggtctcgtcccgttccaggcggccaaaatacaggtggctctcagctgcacagcgagaactcagtgataggccaggggccccccctcccccaccaaccccctccagcctggagacatactttaccccacaacctttcaaggcaggtcctgcaggataggggacaggcctggctgccactgggaccacctcagtag

SEQ ID NO: 17350 - DNA, 1200 bp, Artificial Sequence
  Description of Artificial Sequence: Synthetic coding sequence
atggagttcccactcgcccagatctgtccccaaggctcccacgaggcgccaatacctacatttagcactttccaaatcacagatatgacgagaagatcctgtcagaacttaggatacacagctgctagtccccaggcaccagaagctgcttcaaataccggaaacgccgagagggccgaagaagtccctggcgagggctccttatttctgcaggctgaaacccgagcatggtttcagaaaactcaggcacactggctccttcagcatggggctgcacccgcctggtttcacgggttcatcaccagacgcgtgcggcctccgctttcagtgacacacagagaggctgagcgcctcttagaacctaagccccagggatgctacttggtgagattttccgaaagtgctgtgaccttcgtcctgacctacagatcccgaacatgttgtcgacatttccttctggcacagctgcgggacggccgtcatgtggtcctgggcgaagattctgctcatgcccgccttcaggacctcctcttgcactatacagctcatccgctgagcccatatggagagaccctgacagagcccctcgccagacagaccccagagcccgccggcctgtcgctccggaccgaagagagcaactttggctccaagagtcaggacccgaatcctcaatacagtcctattatcaaacagggtcaggccccagtaccaatgcaaaaagaaggggccggtgagaaggaacccagccagctgctcaggcctaagccacccatccccgcaaaacctcagctcccgcctgaggtgtataccatacccgtaccacggcaccgcccggcccctagacccaagccaagcaacccaatatacaacgaacccgatgagcccatcgccttttacgcaatgggaagaggttctccaggcgaagcgccgtctaatatctatgttgaggtggaagatgaaggcctccctgccacgttggggcacccagttctgagaaagtcttggtctcgcccggttcctggcggtcagaatacaggtggctcccaattgcacagcgaaaattcagtgattggacagggtccccccctgccacatcaacctcctcccgcatggcggcacacgctcccccataatctgtctcgccaggttctccaagacaggggtcaggcctggcttcccctgggacctccccaatag

SEQ ID NO: 17351 - DNA, 2823 bp, Artificial Sequence
  Description of Artificial Sequence: Synthetic coding sequence
atgattttggaacagtatgtggtagtgtcgaattacaagaaacaggagaactccgaactgtctctgcaggctggagaggtcgtcgatgtgattgaaaagaacgagagtggctggtggttcgtcagcacttcagaggagcagggctgggtcccagcaacgtatttggaagcacagaatggaactcgggatgacagtgatattaacacgtctaagacgggggaagaggagaagtacgtcacagtccaaccatacacatcacaaagcaaagatgaaattgggttcgaaaagggtgttaccgtggaggtgatccggaagaacctcgaaggctggtggtacatccgctatctcgggaaggaaggatgggcgccagcttcatatctgaagaaagccaaagacgacctgcctacacggaagaagaacttggctggacccgttgaaatcatcggcaacattatggaaatctccaacctactgaacaagaaagcctcgggcgataaggagacccctcctgctgaaggagaagggcacgaagcccccatagctaaaaaagagattagcctgccgatcctttgcaacgcttctaacggttcagcggttggcgtgccagaccggactgtatcccggctggctcaagggagtccagcagtggcccggatcgctccccagcgcgctcagatatcttctccaaatttgagaacgcgcccaccacccagaagggagtcttcactggggtttcagttgcctaaacctccagaaccgcccagcgttgaggttgaatactacaccatcgccgagtttcaatcctgcatcagcgacggaatcagcttccggggcggccagaaggctgaggttatcgataaaaactccggcggctggtggtacgtccagattggcgaaaaagaaggctgggcgccagcttcatatatagataaaaggaagaagccaaacttgtctaggagaacctccacactgacccgccccaaggtgccaccccctgcacccccttccaaaccaaaagaggccgaggaagggcccacaggcgccagcgaatcccaggatagccctcgcaagttgaagtacgaggaacccgagtacgacattcccgctttcgggtttgattccgaaccagagttatccgaggagccagtagaagacagggcatcgggggagagacgccccgcccagccacacagacccagtcctgcttcctctttgcagagagctcgattcaaagtgggcgaaagctctgaagatgttgccctcgaagaggagaccatctacgaaaacgaaggctttaggccttatgctgaagacaccctcagcgctcgcggctcgtctggggattccgacagccccggaagctcctctcttagcttgacacgcaagaacagtccaaaatcgggctctcccaaatcttcttccttacttaagctaaaggctgagaaaaatgcgcaggctgagatggggaaaaaccattcctccgccagttttagcagcagtattaccatcaacaccacatgttgttcttcctctagctcttcttccagtagcctctcgaagacatccggagatcttaagccacgtagcgcatccgacgcaggcatccggggcacacccaaggttcgagcaaaaaaggacgctgatgccaatgccggtctgactagctgccccagggccaagccatccgtgaggccaaaaccttttttaaatagggccgaaagccaatctcaagaaaagatggacataagcacgctgaggcgccagcttaggcctaccggccagctgcgggggggactaaaaggtagcaagagcgaggacagcgaattgcctcctcagaccgcctctgaggccccgtctgaaggaagccgccgttcttcttctgatctaattactctccctgccacaacacctccctgccctacaaagaaggagtgggaaggcccagcaactagttacatgacctgttccgcctaccagaaggtccaggactctgaaatctcgtttccagccggagtggaggtgcaggtgctcgagaagcaggaatctgggtggtggtatgtcaggtttggagaactcgagggatgggccccgtctcactacctggttttggacgagaacgagcaaccagatcctagcgggaaagagctggatacagtgcccgcgaaaggacgccagaacgaggggaagagcgattccctcgaaaagatcgagagacgggtgcaagcactgaacacagtcaaccagagcaagaaggcaaccccgccaattccttccaagcccccgggaggattcggtaagacttccggtacacccgctgtcaaaatgcgcaacggggtccggcaagttgccgtgagacctcaaagcgtgtttgtgtcccctccaccgaaggacaacaacctcagctgtgccctgaggaggaacgagtcgctgaccgccaccgatggcctgcggggggtgcgccggaacagttccttcagcacagcacgtagtgctgccgccgaagccaaggggaggctcgccgagagggcagcttctcagggcagcgacagtcctctgctccctgcacagagaaattccatccctgtgagcccagtgcgacctaagcctatcgaaaaatctcagttcattcacaacaaccttaaagatgtgtacgtgtctatcgctgactatgaaggcgacgaagagacggccggctttcaagaaggggtcagcatggaagtgctcgagcggaatcccaacggctggtggtactgccagatcttagatggcgtaaaacccttcaaaggatgggtgccatccaactatctggaaaaaaagaattag

SEQ ID NO: 17352 - DNA, 3318 bp, Artificial Sequence
  Description of Artificial Sequence: Synthetic coding sequence
atgctcgcttactgtgttcaggatgcaaccgtggtggatgtggaaaaacggcggaatccttcaaaacactacgtctacattattaacgtgacttggtcagactcaacctcacagactatctaccgacgctatagcaagttttttgacctgcagatgcagttgctcgataaattccccattgagggtggccagaaggatcctaagcagcgaatcattccctttctgcccggcaaaatcctgtttcggaggagtcatatcagggatgttgcagtgaagaggcttaagccgattgatgaatactgtagggctttggtgcggctcccaccccatatctcccagtgcgacgaggtctttagattctttgaagcccgcccagaggatgtcaacccacctaaggaagattatggctcctctaagcgcaagtccgtgtggctgtcgagttgggctgaatctcccaagaaggatgtcaccggggctgacgctaccgctgaaccaatgatcctggagcagtatgtcgttgtgtcaaattataagaagcaagagaatagtgagctctcactgcaggcgggtgaagtggtcgatgtgattgagaaaaatgaatcaggatggtggttcgtcagcacgtctgaggagcagggatgggtgccggccacatacctggaagctcagaatggcaccagggatgactccgacattaatacctcgaagaccggggaggaggaaaaatatgtaacagtacagccctacacctcacagtccaaagatgaaattggatttgagaaaggagttactgttgaggtaatccggaaaaacctggaggggtggtggtacatcagatacctgggcaaagaaggctgggcacccgcctcatacctgaagaaggccaaagatgatctgcctacaagaaagaaaaatctggccggtcccgtggaaataataggcaacattatggaaatctcaaatctcttgaataagaaggcttccggagataaagaaacacccccagcagaaggcgaagggcacgaggcgccaatcgctaagaaggagattagtctgccaatactgtgcaatgccagcaacgggagtgcggtgggggtgcccgacagaacggtcagccggttggctcaggggtccccggcggtcgcgagaatcgctccccagagggcccagatttccagccctaatctgcgcacccgccctcccccgcgcagagagagttcactggggtttcagctgcccaagccacccgaacctccaagcgtggaagtcgagtattacaccatcgccgaattccaatcctgtatctcagatgggatttcttttagaggaggccaaaaggcggaagtcatcgacaaaaattctggcggctggtggtacgtccagattggtgagaaggaggggtgggccccagccagctacattgacaaacggaaaaagccgaatctgagccgtcgtactagtacactgactcgccctaaagtccctcccccagctcccccctctaaacctaaagaggccgaggagggacccacaggagctagcgagagccaggacagtccccggaaactgaaatacgaagagccagaatacgatatccccgcatttgggtttgacagtgagccagagctctctgaggagcccgtggaggatagagctagtggcgagaggcggcctgcccagccccatcgcccgtcccccgctagcagcctgcagcgggcaagattcaaagttggcgagtccagtgaagatgtggcactggaggaggaaacaatctatgagaacgaagggttcaggccttatgctgaggatacattgtctgcaagaggcagcagtggggatagtgacagccctggctccagcagcctctcgctcactcgtaagaactcaccaaagagcggatctcccaagtcctcatccctgctcaagttgaaggccgagaagaatgcacaggccgagatgggaaagaatcactccagcgcaagtttttcttctagcatcaccatcaatacaacatgttgctcctcaagctccagcagttctagctctttgtctaagacaagtggtgacttgaaaccgcggtcagccagcgacgcagggatacgcggtactcctaaagtgcgcgctaaaaaagatgccgatgccaatgcggggctgacgagctgtccgagggctaaaccttccgtgagacctaaaccatttttgaatagagcagagtcccagtctcaagagaagatggatattagcacattgaggaggcagctccgtcctactgggcagctaagagggggtctcaaaggatccaagtcagaggattctgagctccctccccagaccgcttccgaagccccatcagaggggtcccggaggagctctagtgacctcataacattgcccgctaccacccctccctgcccaacaaagaaggaatgggaaggacccgccacaagttatatgacatgttccgcatatcagaaggtacaggacagcgaaatatcgtttcctgcaggggtggaggttcaggtgttggagaagcaggaatccgggtggtggtacgtgcgatttggggagttggaggggtgggctcctagccactatctcgtcctggacgagaatgagcagcccgacccatccggcaaggaactggataccgtccccgctaagggacgccaaaacgagggtaagagcgactctcttgaaaaaatagagaggagggtccaggctctcaacaccgtgaatcagtctaaaaaagccacccctccaatcccctccaagccacctggcggatttggcaagacttcaggaacaccagccgtgaaaatgcggaacggtgtgcgccaggtcgccgtgagacctcagtccgtgttcgtatccccgccccctaaagacaataatttgtcttgtgcacttagacgaaacgagtctcttacagctaccgacggcttgcggggcgttcggaggaattccagtttcagcactgctaggtccgccgctgctgaggctaaaggcagacttgcagaaagagccgcatctcaggggtccgattcacccctgcttcccgcacagcgaaactcgattcctgtgtcccctgtgcgaccaaagcccattgagaaatctcaattcattcataataatctgaaagacgtttacgtgagtattgctgattacgaaggtgacgaggagacagcaggtttccaggagggagtgagcatggaggtcttagagagaaatcccaatggctggtggtactgccagatccttgacggtgtgaagccgtttaaggggtgggttccatccaattatctggaaaagaaaaattag

SEQ ID NO: 17353 - DNA, 3402 bp, Artificial Sequence
  Description of Artificial Sequence: Synthetic coding sequence
atgctagcatattgtgttcaggacgccaccgtggtggacgtcgaaaaacggaggaatccaagcaagcactacgtctacatcattaacgttacgtggtcagattccacttcccagaccatttatcggagatacagcaagtttttcgacctgcagatgcaactgctggataaatttccgatagaaggtggccagaaggatccgaagcagagaattatcccatttctgccaggtaagatcctattccggcgcagccatatacgggatgtcgccgtgaaacggctcaagcctattgatgaatattgtagagctttggtcaggctgccacctcatatctcccaatgtgacgaggtgtttcggtttttcgaagcccgcccggaagacgtcaaccctccgaaggaggactacggctcgtcaaaacggaaatcagtctggttgtcgtcatgggccgagtcccctaagaaggatgtgactggggccgatgccacggccgagccgatgatattggagcagtacgtcgtagttagcaactacaaaaaacaagaaaacagtgaactatctctgcaggccggcgaggtcgtcgacgtgatcgaaaagaatgagagtggttggtggttcgttagcaccagcgaagagcagggctgggtgccagccacttacctcgaagcccagaatggaactagagatgactcagatatcaacacatctaagaccggcgaagtgagcaaacgacgcaaagctcatctgcgcaggcttgaccgccgctggaccctgggtggcatggtaaaccgacagcattctagggaggaaaaatatgtgaccgtccagccatatactagccagtccaaagatgagatcgggtttgaaaagggcgttactgtggaagttattagaaaaaatctagagggatggtggtacattcggtatctgggcaaggaggggtgggcccccgcctcgtacctgaagaaggcaaaggatgacctcccaacccggaaaaaaaacctggctggaccagttgagataattggaaatattatggagatctcgaaccttctgaacaaaaaagccagcggtgataaggagacaccacccgctgagggggagggtcacgaggcccctatcgccaaaaaagagattagtttacctattctgtgtaacgcctcgaacggctcagccgtcggggtgccagatagaaccgtgagccgcctcgcccagggctcacccgcggtcgcaaggatagctcctcagcgagctcaaatctccagccccaaccttcgtacaagacctccaccccgtcgcgaatcatccctgggcttccagctgccaaagccaccagaaccaccctctgtcgaggtagaatactatacgattgctgagttccagtcttgcattagcgatgggatctctttccgcggtggacagaaggctgaagtgatcgataagaatagtggcggatggtggtatgtccagattggcgagaaagaaggatgggcgcctgcctcctatatcgataaacgcaaaaagcctaatctgtctagaaggacaagtaccctgacaagaccaaaagttcccccccccgcgcctcccagcaagcctaaggaggctgaagagggccctaccggggcctccgaaagtcaagactcacctagaaagctgaaatacgaagagcctgagtacgatattcccgccttcgggttcgactctgagcccgaactcagtgaggagcccgtggaagaccgggcctccggcgaaagacgcccagcccagcctcaccggccttcacccgcctcttccttacaacgcgcccggttcaaggtaggtgaatcgtctgaggacgttgccttggaagaggagacaatctatgaaaatgaaggattcagaccctatgctgaggataccctgtctgctcgtggctcctctggcgactccgacagccctggaagttcttccctcagcttgacccgtaagaatagcccgaaaagcggcagcccaaagagctcctctctcttaaagctgaaggctgaaaagaatgcccaggctgagatgggaaaaaatcactcatcagcgtcattttcatcaagtattactattaacacaacatgctgcagtagtagctcctcaagcagcagctcgctgtctaagaccagcggcgatctcaagccgcgctcagcctctgatgctggcatccgggggacgcccaaggtcagagctaaaaaagacgctgatgcaaacgccggcttaacctcctgccccagagctaagcccagtgtgaggcctaagcccttcctgaatagggcagagagccaatcacaggagaaaatggatatcagtacacttcggagacagcttagacctactggccagcttcgcggcggactgaagggctcgaaatctgaagattctgaactcccaccccagactgcgagtgaggctccctccgaggggagtaggcgaagctcatcggacctaatcactctccctgctacaacacccccttgtcctaccaagaaggagtgggaaggtcccgcaacttcctatatgacctgtagcgcgtatcaaaaggtgcaagatagcgagatctcctttcctgcgggggtagaggtacaagttttagagaagcaggagtctggctggtggtacgtgcggttcggcgagttagagggttgggcccccagtcattatctcgtgctcgacgagaatgagcaaccagacccctccggtaaagaactggatactgtcccagctaaggggcggcagaatgaagggaagagtgattccctagaaaaaatcgagcgtcgagtgcaagcactcaacactgttaaccagtcaaagaaagctaccccccctataccttccaagccaccgggtggatttggaaagaccagcggtactcccgctgtcaagatgaggaacggtgtacgccaggttgctgtcagaccacagtcagtgttcgtgtccccacccccaaaggacaacaatctttcctgcgccctgcggagaaacgaatcccttaccgccactgacggtctgcggggggttcgccgaaacagttcattctccaccgcacgatctgctgccgctgaagctaagggaaggctcgccgagagggcagcctcccagggcagcgatagcccactactgccagctcaacgcaactccatccccgtgtcacctgtcagaccaaagccaatcgaaaagtcacagttcatccataacaacctgaaagatgtgtatgtttctattgcagactatgaaggcgacgaagaaactgctggatttcaggaaggcgtctcaatggaggtcttggagagaaatcccaatgggtggtggtattgccagatcttagacggcgttaaaccttttaagggttgggttccaagcaattacctggaaaaaaagaactag

SEQ ID NO: 17354 - DNA, 3183 bp, Artificial Sequence
  Description of Artificial Sequence: Synthetic coding sequence
tgattttttgacttgcaaatgcagttactggataaatttcccattgagggaggacagaaagatccaaagcaaaggatcattcccttcttgccgggtaaaatcctgtttaggagatcgcacatccgggacgtggcagtgaagagactgaaaccaatcgacgagtactgtagggcactggtgcgcttgcctccgcatatcagtcagtgtgatgaggtgttccgtttctttgaagctcgccccgaggatgtgaatccaccaaaagaggactacggatcctccaaacgcaaaagtgtgtggctttccagttgggccgagagccctaagaaagatgttacaggggccgatgccacggctgagcctatgatcctggagcagtacgtagttgtcagcaattacaaaaaacaagaaaattctgaattatcactccaggccggtgaggtggtagatgtcattgagaaaaacgagtcggggtggtggtttgtatctaccagtgaagagcagggatgggtgcccgctacctatttggaggctcagaatgggacccgggacgactctgatatcaacactagtaagaccggagaggaggaaaaatacgtaaccgtccagccctatacgagccagtctaaagacgagatcgggttcgaaaagggagtgacagtggaggtcattcggaagaatctcgagggctggtggtacataaggtatcttgggaaagaaggctgggcgcccgcctcctacctgaagaaagctaaggacgacctcccgacacgtaagaaaaatctcgccggacccgtggagataatcggtaacattatggagatctctaatctgctcaacaagaaggcgagtggcgataaggagaccccgcctgctgagggagagggtcacgaggccccaatagcgaagaaggagatctccctgccaatcctctgcaacgctagcaacggatctgccgttggtgtgccggataggaccgtcagccgactggcccagggaagccccgccgtggcccggatagcacctcagagggcccagattagttccccaaatctgaggactcgacctcctccccggagagagagcagcttggggttccagctccctaaaccccctgagccgccgtcagtggaggtggaatattatacaattgcagagttccagtcttgcatcagcgacgggatcagttttagaggcggccaaaaagcggaagtcatagacaagaactctggtgggtggtggtatgtgcagattggcgaaaaggaggggtgggcacctgctagctacatcgataagcgtaagaaacccaatctgtctaggcgtacgtcaactctgaccaggccaaaggttcccccgcctgccccaccctccaagcccaaggaagcggaggaaggaccgactggagcgtctgaatcccaggattctccccggaagttaaaatacgaagagcctgagtacgacatcccagctttcggctttgattccgaacctgaactgtccgaggaacccgtggaggacagagccagtggagaacgcaggcctgcacagcctcatcgaccttcacccgcatcatccctgcaacgagcccgatttaaggtaggcgagagctcagaggacgtggcgcttgaggaggagacaatttatgaaaatgaaggtttccggccgtacgcagaagataccctcagcgcccggggttcaagcggggacagtgactccccagggtcgtcctcgctgtcattaactcggaagaattcccccaagagcgggtctcccaaatcctcctctctactgaagttgaaggctgaaaaaaacgcgcaagctgaaatggggaagaatcattccagtgcaagcttcagttccagtattaccattaacactacttgttgctcatcttctagttctagcagctcttcgctgtccaaaacctccggcgacctgaagccccgctcagccagcgatgcgggcataagaggaaccccaaaggtgcgagctaaaaaggatgcagacgccaacgcagggctgaccagctgcccacgagccaaaccctcggtgcgcccaaagcctttcctcaatagggcagaatcccaatcccaggagaaaatggacattagcaccttacgtcggcagctgcgtcccacggggcagctcagggggggattgaaaggaagcaagagcgaggattccgagctgccccctcagacagcttcagaagcaccctccgaggggtctaggcgcagctcctccgatctaattacgttgcccgcaaccaccccaccatgtcccaccaagaaagagtgggaaggacctgcaaccagctatatgacatgttcggcctatcaaaaggtacaggactcggagatcagctttcctgcgggagtagaggtacaggttctcgaaaagcaagaaagcgggtggtggtacgtaagattcggcgagttggaggggtgggccccttctcactacctggtcctcgatgagaacgagcagcccgatccgagcgggaaggaactggatacagtgcccgctaaaggcagacaaaatgaggggaagtcagatagtctcgaaaagatcgaacggagagtgcaggccctgaacacagtgaaccagtcaaagaaggccaccccacccatcccatcaaaaccaccaggaggtttcggaaagacttcgggtacccccgctgtgaaaatgcggaacggtgttaggcaagtcgctgtgagacctcagtccgttttcgtgtcacctccgcccaaggacaataatctgtcctgcgctctgcgtaggaatgagtccctgacagctacggatgggctcagaggcgtgagaaggaattcgtccttctcaactgccaggtccgcagcggctgaggcgaagggtagattggctgaaagagctgcaagccagggttccgatagccctctgctacccgcccaaagaaacagcatccccgtgagcccagttaggcccaagcctatcgagaaaagtcagtttatccacaataatctcaaggatgtgtatgtttccatcgctgactacgaaggcgacgaagagacggccggcttccaagagggcgtgtccatggaggtgttagagagaaaccccaatggttggtggtattgccaaattttagacggcgtgaaaccgttcaagggctgggtcccatccaattacctggaaaaaaaaaactag

SEQ ID NO: 17355 - DNA, 1110 bp, Artificial Sequence
  Description of Artificial Sequence: Synthetic coding sequence
atgagcatctgctgctgctttttcttcagggactacgggtctagtaagcgtaaaagcggcgctgacgccaccgcagaacctatgatcctcgagcaatatgtggttgttagtaattacaaaaagcaggaaaactctgagctttccttgcaggccggggaggtggtcgatgttatcgagaagaatgagtccggatggtggtttgtgtctacaagcgaggaacagggatgggtcccggccacatatctcgaagcccagaacggaaccagagacgacagcgatataaatacgtctaagaccggtgaagtatctaaaagacgaaaggcccacctccggagactcgaccgcagatggacactgggtggcatggtcaacaggcaacattctcgagaggagaagtacgtgaccgttcagccctacaccagtcagtcaaaagacgaaatcggtttcgaaaaaggagtgacagttgaggtcatccggaagaatctggaagggtggtggtacattcgataccttggaaaggaagggtgggccccagccagttacctcaaaaaagctaaggacgacctgccaactcggaagaagaacctggccggtcctgtagagataataggcaatatcatggaaatttcaaatctactcaacaaaaaggcatctggtgataaagagacccctcctgctgaaggcgaaggccacgaagcgcctatcgccaaaaaagaaataagccttccaatattgtgcaacgctagcaatggatctgcggttggtgttccggacaggaccgttagccgattagcccaggggtctcccgcggtagctcgtatcgcgcctcagagagcccagatctcttctcccaacctgcgaactagaccacctcctaggagagaaagctccttgacagagagcaggtgtaggcaagctggcgtgcagtggcacgatctgggtagtctgcagtcaccacacccccgtttcaaacgatttagttgcctctcgctgctctcatcatgggatcacaggcacatgccaccgcaccctgccaatttcttgatttttctgattgagacagggttccaccacgtgggccaggacggcctacacctactgacctcctag

SEQ ID NO: 17356 - DNA, 2898 bp, Artificial Sequence
  Description of Artificial Sequence: Synthetic coding sequence
atgcccgtgactgctactgggaagatactttttagacgttcgcatattcgtgacgttgctgtgaaaaggctaaaacccatagacgaatattgccgagcactcgtgaggctgccccctcatatttctcagtgtgacgaagtgtttcgctttttcgaagccagacctgaggatgtgaaccccccaaaagaggactatggtagctcaaaaaggaagtctggcgccgacgctacagctgaacctatgattttggagcagtacgtcgtagtgtccaactacaagaagcaggagaactccgagctctcactgcaagctggggaagtcgtggacgtgattgaaaaaaacgagagcggctggtggtttgtgtccactagcgaggagcaggggtgggtgcccgcaacctacttagaggcccaaaatggtacacgcgatgacagtgacatcaatacaagcaagacaggcgaggtcagtaaaagacggaaggcccatttgaggcgactcgaccgcaggtggacactcggcggcatggtgaatcggcagcactcccgcgaggagaaatatgttaccgtgcagccttacacatctcagagtaaggatgagattggattcgaaaagggtgtcaccgttgaggtgattcggaaaaaccttgagggctggtggtacatcaggtatctagggaaggaaggatgggcccccgccagctatctgaagaaggcaaaggacgatctcccaaccaggaagaaaaacctcgccggccctgtagagattattggtaacatcatggaaatctctaatctcttgaacaagaaggccagtggcgataaggaaacgcctcccgcagagggcgaaggccacgaggcgcccattgcaaaaaaggagatttccctgcctattctctgcaatgcttcaaacgggtccgccgtgggcgtccctgaccgaacagtctcccggctggcacaggggagtcctgccgtagcacgcatcgccccacagcgagcccagattagttcgccaaatctgcgcacaagaccccctccgcggcgggaatcttccttaggcttccagcttcccaagcctccggagcccccatccgtggaggtggaatattacactattgccgaatttcaatcttgtatcagcgacggcatttcattcaggggaggtcagaaggcagaggtgatagacaagaatagtggcgggtggtggtatgtgcagatcggagagaaggagggctgggcacctgcctcatatatcgacaagagaaagaaacctaacctttcacgacgcactagcactcttactcgacccaaggtgccaccacccgcaccgccatctaaaccgaaagaggccgaagagggacccacaggggcttcggaatcgcaagacagccctcgaaagctcaaatacgaagagcctgaatacgatatcccagcttttggttttgacagtgagccagagttgtccgaggaacccgtagaggatagagcaagtggggagaggcggccagcgcagccccaccgcccatctcccgcaagctctttacagcgagcacggtttaaagtcggggagtcgtcggaggacgtggcactggaggaggaaaccatctatgagaacgagggattccggccatatgccgaagacaccctgagcgctcgaggttcttccggggactccgacagccccggttccagttctctgagtcttactcggaaaaattccccaaaaagcggctcccctaagagcagcagcctcctcaagctcaaagctgaaaagaatgcacaggctgagatggggaagaatcactcaagcgcctccttcagcagttccattacaatcaacaccacttgttgctcatccagcagctccagttccagctccctgtcaaaaacctctggtgatctgaagccccgatccgctagcgatgctggtatccggggtacgccaaaagtgagagctaaaaaggacgcagatgccaacgccggcctcaccagctgtcctcgcgccaaaccaagcgtgcggccaaagccgttcttgaatcgggcagaatcgcaatcacaggaaaagatggatatcagtacattgcgaaggcagcttaggcctacaggccaactgcgaggtggcttgaaaggctccaagtcagaagacagcgaactgccacctcagaccgcaagcgaagcgccttctgagggttctagacgttcatcatctgatttgatcactcttccagccacgacacccccctgccccactaaaaaagagtgggagggaccagcgacatcatatatgacatgttccgcttatcagaaagtccaagattcagagatatcatttcctgcaggagtggaagttcaagtgcttgaaaaacaggagagtggatggtggtacgtgaggttcggagagctggagggctgggctccatcacattacctggttctggacgagaatgaacaacccgaccctagcgggaaggaactggataccgttcccgcaaaaggacgccagaacgagggcaagtctgatagcctcgagaaaattgagcgtcgcgtccaagctctgaatactgtgaatcagagcaagaaggctaccccccccatcccttcaaaaccacccgggggttttggaaaaacctcaggaacacccgctgttaaaatgcgtaacggcgtgcggcaagtggcagtccgtcccatagaaaaaagccagttcattcataataacctgaaagatgtgtatgttagcatcgcagattacgaaggtgatgaggagacagcgggttttcaggagggtgtgtcaatggaagtgctggagcgaaatcccaacggctggtggtattgtcagatccttgacggagtgaagccctttaaggggtgggtgccttccaactacctcgaaaaaaagaattag

SEQ ID NO: 17357 - DNA, 2907 bp, Artificial Sequence
  Description of Artificial Sequence: Synthetic coding sequence
atgatcttagagcagtatgttgtggtatctaattacaagaagcaggaaaattctgagctgagtttgcaggccggcgaggtggtggatgtaatcgagaaaaacgagagtggatggtggtttgtctctacatccgaagagcagggatgggttcctgccacctacttggaggcccaaaacggcaccagagatgattctgacattaatacctccaagaccggcgaggtgtccaaacggaggaaagcccaccttcggcggcttgacaggcgatggacactgggcggcatggtcaataggcagcactcccgagaggaaaagtatgttactgtccagccgtacacttcccagtccaaggacgagattgggttcgagaaaggtgtgaccgtggaagttattagaaagaacctggagggctggtggtacatcagatacctcgggaaggagggctgggctccggctagctacctcaagaaggcaaaagacgaccttcctacacgtaaaaagaacctggcaggacctgttgaaattattggcaatattatggaaatctcgaacctgctgaacaaaaaagccagtggggacaaggagacccctcccgccgaaggcgaggggcatgaggcaccaatagcaaagaaggagatatcactgccaatcctctgcaatgcaagcaacggcagtgcagtcggagtgcctgatcggaccgtgtctagactcgctcaggggagtcccgctgttgctaggattgcacctcaaagagcccagatatcgtccccgaacctgagaactcggccaccccccagacgggaaagctcactgggattccagttgccaaagccacccgaaccaccttcggtggaggtagaatattataccatcgctgaattccagtcatgtatttctgacggaatatcgttccggggggggcagaaagcggaggtgattgacaagaattcgggtggatggtggtacgtacaaattggggaaaaagagggatgggccccggcaagttatatcgataagcgtaagaagcctaatctttcccggagaacaagcaccctgaccagaccaaaagtccccccccccgctccccccagcaagccgaaagaagcggaagagggacctactggggccagcgaaagtcaggactcacccaggaagctgaaatacgaggagccagagtatgatattcccgcattcggcttcgactccgagccagaactctctgaagagcccgtggaggatcgagccagcggagaacggagaccagctcaaccacatcgcccctcccctgcttcaagcttgcaacgcgcccgcttcaaagttggcgaatctagtgaagatgtggcactggaggaagagaccatctatgaaaacgagggattccgcccttatgccgaggacacactgagtgcgagaggctccagcggcgattcagatagtcccgggtctagcagcctgtcactcaccagaaagaacagtcctaagtccggatcacccaagtccagcagcttattaaaattgaaggccgagaagaatgcccaggctgaaatgggcaaaaatcatagtagcgcgtctttttcatcatcaatcacaatcaataccacatgttgttcgagttcttcctcttcttcctcaagcctgtcaaaaacatctggggacttgaaaccacgcagcgccagtgacgctggtatccgcggaacaccaaaggttcgcgcaaagaaagatgccgatgccaacgctggcctcactagctgccctagggccaagccctcagtacggccaaagccttttttgaacagagccgaatctcagtcccaggagaagatggatatcagtacactccgccggcagctgaggcctactggccaacttcggggtggtctcaagggaagcaaatcggaagacagcgagttgccacctcagactgccagcgaagctccatccgaaggctcacggcggtcatctagcgatctgatcacactccccgcaacaaccccaccatgccccaccaaaaaggagtgggaaggacctgccactagctacatgacatgctcagcatatcaaaaggtgcaggactcagagatcagcttcccagcaggcgtcgaagttcaggtgctcgagaagcaggagtcaggttggtggtacgtcagatttggtgagctcgaggggtgggccccctcacattacctggtgcttgacgaaaacgaacagccagacccctctgggaaggaacttgataccgttccagcaaaggggcgacagaacgagggcaagtctgactccctggagaaaatcgaacgccgggtgcaggcactcaataccgttaaccagagcaaaaaggccacccctcccataccttcgaagcctccaggcggattcggcaagaccagtggtacgcctgctgtaaaaatgcgcaacggcgtaagacaggtcgccgttcggccacaatccgtatttgtgtcacccccacctaaagataataacttgtcttgcgcacttcggagaaacgagtctctcaccgctaccgatggattacgaggcgttagaaggaattcgagtttctcaacggctcggtccgctgccgcggaggcgaaggggcgcctagccgagcgggctgcctcccagggatctgactccccactgctgccagctcaacgtaacagtatacctgtaagtcctgttcggccgaagccgatcgagaagagccagtttatacataacaatctgaaggacgtgtacgtgtcgatagctgactatgagggagacgaggaaaccgccggctttcaagagggggtctctatggaagtattggagagaaatcctaacggatggtggtactgtcagatactcgacggtgtgaaaccattcaaaggctgggtcccaagtaattatctggaaaagaagaactag

SEQ ID NO: 17358 - DNA, 3003 bp, Artificial Sequence
  Description of Artificial Sequence: Synthetic coding sequence
atgaatggcagcttcctcctgagattactattcccagtggcctctattttgcctgaaaccgtgctgctccgcggggcggacgcaactgccgaacccatgatcttagagcagtatgtggttgtgtccaactacaaaaagcaggaaaatagtgaactctcactacaggccggcgaggtggtcgatgtgattgagaagaatgaatccgggtggtggtttgtttctaccagtgaggaacaagggtgggtgccggccacataccttgaggctcagaacggcacgcgcgacgattccgacatcaacacctccaagacgggagaagtgagcaaaaggcggaaagctcatctgaggcggctggataggagatggacattgggaggcatggtcaacaggcaacacagcagagaagaaaaatacgtgaccgttcaaccctacaccagtcaaagtaaggacgagatcggcttcgagaagggcgtaaccgtggaagtaatcagaaagaacctcgaaggatggtggtacatcagatacctcggcaaggaagggtgggcacccgccagttacctgaagaaagccaaagatgatctccctaccaggaaaaaaaacctggccggaccggttgagattataggcaacatcatggaaatctcgaatttactgaataagaaagcctccggagataaggaaaccccgccggcagagggggagggtcacgaagcaccaattgccaagaaggagattagcctccccattttgtgcaatgctagtaatgggtcggcagtcggggtgccagacaggactgtgagtcgcctcgcccagggttcaccagccgtcgcccgcatcgccccacaaagagcacaaattagcagtccaaaccttaggacacgaccccctcctaggagggagagctcactaggctttcagctgcctaagccaccggagcctccctccgtggaggtcgaatactacaccattgccgagtttcagtcatgcatctctgatggcatctcctttagaggaggtcagaaggctgaggtaattgacaaaaatagcggtggttggtggtacgtccaaatcggggaaaaagaagggtgggcaccagcttcgtacattgataaaagaaagaaaccaaacctgtcaaggagaacttcaacattgacaagaccaaaggtaccgcccccggcaccaccatctaaacccaaagaagctgaggagggtccaacgggagctagcgagagccaagacagtcccagaaaattaaaatacgaggaacctgaatacgacattcctgccttcgggttcgactctgagccggagctgtcagaagagcccgtggaagatagagcttctggcgaacggaggcctgcccagccacaccggccgtcaccagcgagttcactccagagagctcgcttcaaagtaggtgaaagcagtgaagatgtggccctcgaggaggagaccatatacgaaaacgaaggatttcggccgtacgctgaagacacccttagcgccagggggagttcaggcgattcggattctcctggatcttcttccctttctctcaccagaaagaacagccctaaatccgggagccctaaatcttcatcactccttaaactgaaagcagagaagaacgcacaggctgagatgggaaagaatcattcatccgcatcattctcttcctccattactattaacactacgtgttgctctagttcttcttcttcgtcttcatccctcagcaaaacctccggagatctgaaaccaaggtccgcctcagacgcgggcattcgcggaacacctaaagtccgggctaagaaggatgctgatgccaacgctggcctcaccagctgtccccgagccaaaccctccgtgagaccaaagccatttctgaatcgtgccgagtcacagagtcaggagaaaatggacatctccacactgcgccggcagctccgtccgactggccagctgagggggggattgaaagggagtaagagtgaggatagcgagttacctccacagacagcctcagaagctcctagcgaggggagcagaagaagcagctcagatcttattacactgcccgctacgaccccaccctgtcctacgaaaaaggaatgggaaggccctgccacaagctacatgacgtgtagcgcttaccagaaggtccaggattcagaaatctcctttccagcaggcgtggaagtgcaggtgctcgagaagcaggagtctggctggtggtacgtgagattcggcgaactcgagggctgggccccatcccattatctagtcctggacgagaacgagcaaccagaccctagcggcaaggaactcgatacagtgccagctaagggccggcagaacgagggcaagtcagactcgctggagaaaattgaaagacgcgtgcaagcactgaataccgtgaaccagagcaaaaaagcaactcctccaatcccaagcaagccaccaggcgggttcgggaagacaagcgggacaccagccgtgaagatgcgcaatggggtcaggcaagtggctgttagaccgcagtcagttttcgtaagtcctccacccaaggacaataacctgagttgcgctctgcgacgaaatgaaagcctgactgccactgatgggctgagaggggtgagacgaaactcttcattttctactgctcggagcgcagctgcagaagccaagggcaggctcgctgagcgggcggccagccaagggagtgacagcccactcctgcctgctcaacggaatagtatacctgtgtcccctgtaaggcccaaaccgattgaaaagtcacaatttatccacaacaacctaaaagacgtgtacgtgtcgatagccgactacgagggggacgaggaaacagctggatttcaggagggagtctccatggaggttctggaaagaaatcccaacggatggtggtactgccagatcctcgatggggttaaaccattcaaagggtgggttccttccaattacttggagaagaaaaattag

SEQ ID NO: 17359 - DNA, 414 bp, Artificial Sequence
  Description of Artificial Sequence: Synthetic coding sequence
atgaataagctctccgggggaggaggccgccgaacacgggtcgaaggcggtcagttaggcggagaagaatggactcgacacgggtctttcgttaacaagccaacgcggggatggctgcacccaaacgacaaagtgatgggccccggagtatcatatctggtgaggtacatgggatgcgtcgaggtgctccagagcatgagggctttagattttaacacccggacgcaggtgaccagagaagctataagtctggtctgtgaagccgttcctggagcaaagggagcaacacgacggcgaaaaccttgttctagaccactgtctagcattctcggtcgcagcaatctgaagtttgcaggcatgcccatcacactgacagtgtctacaagctctctgaatcttatggctgcggactag

SEQ ID NO: 17360 - DNA, 918 bp, Artificial Sequence
  Description of Artificial Sequence: Synthetic coding sequence
atggccggctttgacggatctgcttgggatgaagaagaagaagaaccccctgaccatcaatactacaacgacttccccggaaaggaaccgccattggggggcgtcgtggatatgagactccgcgagggtgcggctccaggagccgccaggcccaccgccccaaatgcgcagacgccctcccatttaggtgcaacgctgcctgtgggacagcccgtcgggggtgatcctgaggtgcggaagcagatgcctccccccccaccctgccctggccgcgaactgtttgatgacccctcatacgttaacgttcaaaacttggataaggcacgccaagctgttggaggtgcagggccgccgaacccagccattaacggctctgcccctagggacctctttgacatgaaacccttcgaggatgctctgagggtcccaccacctcctcagagcgtgtcaatggcagaacagctccggggcgagccttggtttcatgggaaactgagccgcagggaagccgaagcgctgctgcaactcaacggagatttcctggtaagagagagcactaccaccccgggccagtacgtactgacgggactgcaaagcggccagccaaagcatttgctgctggttgaccccgaaggagttagatggggctttgctatgctccctaagctcttcctgaattccagggcacaggtgatacggctccctaggccgcctcgagttttaggactccaagcccggacaaccatgcccagcctccacatctttttctgtactgtctataccttgcttcgccatgccaactttcttcaggtgaagaagggcgtttattccagccaactgcattcttttcgagcagacgtggcatttgccttctcacattttacggacttgtccattcctactacagtgtctttctag

SEQ ID NO: 17361 - DNA, 1563 bp, Artificial Sequence
  Description of Artificial Sequence: Synthetic coding sequence
atgtcaaacctgaggctggcgaaccctgctggaggaagacctggatccaagggcgagccaggccgagccgctgacgacggtgaaggcatcgtaggtgccgccatgccagatagcggtccgctgccgctgctgcaggatatgaacaaactctccgggggcggaggacggcggactcgcgttgaaggcggtcaactgggaggggaagagtggaccaggcacggctcttttgtaaacaagcccacaaggggctggctccaccccaacgataaggtaatgggccccggggtttcatatttggtcagatacatggggtgcgtagaagtgttgcaatccatgcgcgcacttgatttcaacacaaggacgcaggtgacaagggaagccataagccttgtgtgtgaagcagttcctggcgcaaaaggagcgaccaggcgacgcaaaccctgctctcgcccacttagtagcatcctgggccggtccaatctgaagttcgccggtatgccaataacactgactgtctcaaccagtagcctgaatctaatggctgcagactgcaagcaaattattgccaaccaccacatgcaatccatttctttcgcaagtggtggcgaccccgataccgcagaatacgtggcttacgtggccaaggacccagtgaaccaacgcgcctgtcacattcttgaatgtcctgaggggctggcccaggatgtgatctcaaccatcgggcaggcatttgagctgagatttaagcagtacctgagaaacccacctaaactcgtgactcctcatgacagaatggccggattcgatggaagcgcgtgggacgaagaagaggaggagccccccgatcaccaatactacaatgacttccccggtaaggaaccccccttaggcggcgtcgttgacatgaggctgagggaaggagccgccccgggcgctgctcgccctaccgcacccaacgcacagacccctagccacctgggtgctaccttgccagtcgggcagcccgtgggaggcgacccagaagtcagaaagcagatgccccctccgcccccatgtcccgcagggcgagaactcttcgacgaccctagctacgttaatgttcagaacctggataaggcccggcaggccgtcggaggcgccggacctcccaacccagcaattaatgggtccgcaccccgggacctgtttgatatgaagcccttcgaggacgccctgagggtcccccctccgccacaatctgtctctatggccgagcagctcagaggagagccctggtttcacgggaagctttccagacgggaagctgaagctcttttacagctgaatggagactttcttgttagggaatccaccaccacaccaggccagtacgtattaacaggactccagagcgggcagcccaagcacctcctgctggtggacccagagggggtagtgcgaacgaaggaccaccggtttgaatccgtgtctcaccttattagctaccacatggacaatcacctgcctatcataagtgcagggagcgaactgtgccttcagcagcccgtagagcgtaaattgtag

SEQ ID NO: 17362 - DNA, 1752 bp, Artificial Sequence
  Description of Artificial Sequence: Synthetic coding sequence
atggaccttctaccccctaagcccaaatacaatccactccggaacgaaagtttgtcgtcgctggaggaaggagctagcggttccacacctcccgaggagctcccatctccgtctgctagttccctgggtcccatcctaccaccactgcctggagatgattctccaacaaccctttgttccttcttccccagaatgtctaaccttagattggctaacccagccggggggcgtcctggttccaaaggcgaaccaggcagggccgcagacgacggagagggaatcgtgggggcggccatgcccgactctggtcctttacccctccttcaggacatgaacaaactgagtgggggaggcggtagacggacgcgggtggagggaggccagctcgggggagaagagtggaccaggcatgggagtttcgtcaataagcctaccagggggtggctgcaccccaacgataaggtgatggggcctggagtaagttacctagtccgatatatgggttgcgtggaagttctccaaagcatgagggccctcgacttcaacacccgtacgcaggtaacgcgggaggccatttctctggtgtgcgaggcggttccgggagccaaaggtgccacacggcgacgaaagccatgcagccgaccactgtcttctattctggggcgctccaatcttaagttcgcggggatgcccatcaccctcacagtgtctaccagttcactgaatctgatggctgccgattgtaagcaaataatagccaatcaccacatgcagtccatctccttcgcatcaggcggcgatcccgacactgctgaatacgtagcttatgtggccaaggacccagtgaaccaaagagcctgccacatcctcgaatgtcccgagggtttggctcaggatgtgatttctaccatcgggcaggccttcgagctgcgattcaaacagtatctgcggaacccgcccaagctggtgactccacatgacagaatggccggtttcgacggtagcgcttgggatgaagaggaagaggagcccccagaccaccaatactacaatgacttccctggcaaggagccccctcttggtggagttgtagatatgaggctcagagaaggagctgcgccgggggccgcccgtccaacagcccctaatgcacaaaccccttctcatttgggagccacattacctgtcggccaacccgtggggggggaccccgaggtgcgtaaacagatgcctccaccaccaccttgtcccggacgggaactcttcgacgatccctcttatgtgaatgttcagaacctcgacaaggcacgacaggccgtgggcggtgctggccccccaaatcccgcaatcaatggctcagcccccagggacctattcgacatgaagccatttgaagatgcactccgcgtcccccctccaccccagagcgttagcatggctgagcagctcaggggcgagccatggttccacggaaagctctcccgcagggaagccgaagcattactccagctcaacggagacttcctcgtaagggagtccactaccacacccggacagtacgtgctgaccgggcttcaaagtggtcagccaaagcacctgctactcgtggaccccgaaggtgtggttcgcactaaagatcaccggtttgaaagcgtgtctcatctaatttcataccacatggataatcacctgcccattatttccgccggttccgagttgtgtctgcaacaacctgtggaaagaaagctctag

SEQ ID NO: 17363 - DNA, 1155 bp, Artificial Sequence
  Description of Artificial Sequence: Synthetic coding sequence
atggacttgctgccgccaaagcctaaatataatccgctgcggaatgagagtttgtccatactgggacgtagcaacctcaagttcgctggcatgccaattactttgaccgtgtcgacctcatccttgaatctgatggccgccgattgcaaacagatcatcgcaaatcaccatatgcagtcaatctcatttgcatccggtggagacccggacaccgcagagtacgtggcgtacgtggctaaggatcctgtgaaccaacgagcgtgccatatcctagagtgccccgagggccttgctcaggatgtcatctcaaccatcgggcaggccttcgagctgcgctttaagcagtatctgcgaaatcctccaaagctggtgactccccacgaccgaatggcagggtttgacggcagcgcttgggatgaggaggaggaggaaccgcccgatcatcagtactacaatgattttccaggcaaggagccccccctgggcggggttgtggatatgcgactccgagaaggtgcagcacccggggcggcaaggcctaccgcacccaatgctcaaaccccctcccacttgggggctaccctcccagtgggccagccggttgggggcgatcccgaggtccggaagcaaatgcctccccctcccccttgtccaggtcgcgagttgttcgacgacccttcatatgtcaacgtgcagaacttggacaaggctagacaggccgtgggtggagccggaccacctaaccctgctattaatgggtctgcacctagagacttgtttgacatgaaaccttttgaggatgccctgagggttccaccacctcctcagagcgtgagcatggccgagcagctgaggggggaaccttggtttcacggcaaactgtcccggcgggaggccgaagcacttctgcagctgaatggcgatttcctagtcagggagtctaccacgacacccgggcagtacgttctgactgggctccagagcggccaaccgaagcacctattactggtagatcctgaaggagtggtaaggactaaggaccatagattcgagagcgtgtctcatcttatcagttaccatatggataaccacttacccataatctcagcaggcagtgaactgtgtctccagcagcctgtggaacgaaagctttag

SEQ ID NO: 17364 - DNA, 1422 bp, Artificial Sequence
  Description of Artificial Sequence: Synthetic coding sequence
atgaataagctatccggcgggggcggacggcgcacacgagtcgagggggggcaacttggcggggaagaatggacccgtcacgggtctttcgtcaacaagcctaccaggggatggctgcaccccaatgacaaagtcatgggaccaggagtgtcttatctcgtgcgatacatggggtgcgtggaggttctgcagagcatgcgggccctggatttcaatacccggactcaggtcaccagggaggctatttccctggtgtgcgaggctgtacctggtgcaaagggagcaacaagaagaaggaaaccatgtagcaggcccctgtcatccatcctgggccgctcaaacctgaagttcgcagggatgcccattaccctcaccgtgagcacatctagcttaaatctgatggcggctgattgcaagcagattatagcaaaccaccacatgcagtccatttcgtttgcctcaggtggagaccctgatacagccgaatatgttgcctacgttgccaaggatccagtcaaccagcgtgcttgccacatactcgagtgtccggagggccttgcccaggatgtcatctcaaccatcggtcaggctttcgagttgcgtttcaagcagtatctgcgaaatcctcccaagttagtgacccctcacgaccggatggccggctttgacggctctgcctgggacgaagaggaggaggaaccccctgatcaccagtattataacgactttccagggaaagagccacccctcggtggagttgttgatatgcgcctgagagagggcgcagccccaggggcagccaggccaaccgcccctaatgcccagacacctagtcatctaggggcaaccttgcctgtggggcagcctgtcgggggggacccagaagtgcgtaaacagatgccccctccccccccctgtcccggccgtgagctgttcgatgacccttcatacgtcaacgtgcagaacttggacaaagcgcggcaggcggtcgggggggcgggcccccccaatccagccatcaacggatcagcgcctagagacctgtttgatatgaagccatttgaggacgctttgcgggttccacctccccctcagtctgtgagtatggcagaacagctacgaggcgagccttggtttcacgggaaacttagccggagagaagctgaagccctgcttcagctgaatggggacttcctggtccgggaaagtactactacgcctgggcaatatgttcttacagggctccagtccggtcaacctaaacatctgcttctcgtcgaccctgaaggcgtcgtgcgtacgaaggatcaccgcttcgagtccgttagccatctaatcagctatcacatggataaccacctcccaattatctcagcaggatctgagctctgcctgcaacagcctgtcgaaagaaaactctag

SEQ ID NO: 17365 - DNA, 1425 bp, Artificial Sequence
  Description of Artificial Sequence: Synthetic coding sequence
atgaataagctctcaggtggcggtggtaggcgcaccagggtggagggcggacagctaggcggcgaggagtggacaaggcacggatcctttgtgaataaaccaacacgtggatggctccacccaaacgataaggtcatgggtcccggcgtgtcttacctggtacggtatatgggctgtgttgaagtcctccaatctatgcgggctctggattttaacacccgcacgcaggtgactagggaggccatcagcctagtttgcgaagcggtgcccggcgcaaagggggcgacaagaaggcgcaagccttgcagcagacctctttcaagcatattgggtcgttcaaacctcaaattcgcaggtatgccgatcaccctgaccgtaagcacttcatccttaaacctaatggccgccgactgtaagcagatcatagccaatcaccacatgcagtctatctccttcgcgagcggaggcgaccctgacacagctgagtacgtggcctatgttgcgaaggacccagtgaaccagagagcctgccacatcctcgagtgtcccgagggtttagctcaggacgtgatttctaccattggccaggctttcgaactgcgcttcaaacaatatcttagaaatcctcccaaactcgttacaccacacgacaggatggcaggtttcgacggctccgcatgggatgaagaggaggaggagcctcccgatcaccagtactataacgactttcctggaaaggagccaccactcggaggcgtggttgacatgaggctccgggaaggcgccgcacctggagctgctcgtcccacagctcccaatgctcagacgccttcccatctaggagcgacgttgcccgtgggtcagcctgtcggaggggatccagaggtccgcaaacagatgcctccacctcccccttgtccggctgggagggagctgttcgatgacccttcctatgtgaacgtgcaaaatttagataaagctcgccaggccgtgggaggagcaggtccccctaatccagccatcaatgggagtgcaccacgggacctgttcgacatgaagccctttgaagatgcactgagagttcccccacctccccaatccgtgtccatggctgagcaactgaggggtgagccgtggtttcacgggaaactgagccggcgagaggccgaagcccttttgcagctgaatggcgacttcctggtacgggagagcaccacgacacccggacagtatgtgcttactgggctccaatctggacagccgaagcacttattgttagtagatccagagggggttgtccggaccaaggaccaccgtttcgagagtgtaagtcatctgatatcctatcacatggataatcacctgccaattatttcagcgggcagcgaactctgtttacagcagcccgtggaaaggaaattgtag

SEQ ID NO: 17366 - DNA, 603 bp, Artificial Sequence
  Description of Artificial Sequence: Synthetic coding sequence
atgaacaagctctcaggcggggggggaaggcggactagggtggagggcggtcaactagggggcgaagaatggactagacacgggagcttcgttaacaagcccaccagaggatggctgcatcctaacgacaaagtgatgggacctggtgtgagttacctggtccgctacatgggctgtgtagaagtcctgcagtccatgcgagcactcgatttcaacactaggacccaagtgacccgggaagccatcagtctggtatgcgaagcagtacccggtgccaagggcgctactagacgtagaaaaccttgctctaggcccctatctagcatcctgggaaggagcaacctaaagtttgctggcatgcccatcactctgaccgtttctacatcctccctgaatttgatggccgcggattgcaagcaggatacagccgagtacgtggcatatgtggcgaaggatcctgtcaatcagagagcatgccacatacttgaatgtccagagggcctcgcccaggacgttatatctactattgggcaggcctttgagttgcgctttaagcaatatctaagaaacccccctaaactcgtgacgccccatgatcgctag

SEQ ID NO: 17367 - DNA, 603 bp, Artificial Sequence
  Description of Artificial Sequence: Synthetic coding sequence
atgcccattacattgacagtgtccacttcttcccttaaccttatggcggccgattgcaagcaggacacggcggaatatgttgcctatgtagccaaagacccagtgaaccagcgagcctgtcacatccttgaatgccccgagggactggcgcaggatgttatcagcaccatcgggcaggcattcgaactgcgctttaagcaatatctgcgtaaccctccaaaactggttaccccccacgaccgcatggcaggatttgatggaagcgcatgggatgaggaggaggaagaaccaccagatcaccagtactacaacgacttcccaggaaaagagcctcccctcgggggcgtagttgatatgcgattaagggaaggtgcggctccaggggctgctcggcccacagcacccaatgcccagaccccgtctcatctgggggcaacactccctgtggggcagccagtagggggggaccctgaggtgcggaaacagatgccacctcccccaccatgtcccgccggtcgtgaattgttcgacgacccttcttatgtgaacgtacaaaatttagacaaagcccggcaggccgtgggaggtgctggtcctccctag

SEQ ID NO: 17368 - DNA, 393 bp, Artificial Sequence
  Description of Artificial Sequence: Synthetic coding sequence
atgcctatcacccttaccgtgtcgacttcaagcttaaatctgatggcagcagattgcaagcagatcattgccaaccatcacatgcagtctatctcatttgcttctggcggagaccccgacactgccgaatacgtcgcttacgttgccaaagaccccgtaaaccagagggcttgtcatattctagaatgtcctgagggactcgctcaggatgtgatctctacaataggacaggcctttgaactgcggtttaaacaatacctaagaaatccacccaagttggtgacaccacacgaccgcatggccggattcgacggcagtgcctgggacgaagaggaagaggaaccccccgaccaccagtactacaatgacttcccaggaaaggaaccaccttag

SEQ ID NO: 17369 - DNA, 894 bp, Artificial Sequence
  Description of Artificial Sequence: Synthetic coding sequence
taagatgaagaggaagaggagcctcccgatcatcaatattacaatgactttcccggcaaagaaccgcccttgggtggagtcgtagatatgcgattgcgcgagggggccgccccaggcgctgcccggcccaccgcccctaacgcacagaccccctcgcatctcggtgctaccttgcctgtagggcagcccgtcgggggagaccctgaggtacgaaagcagatgcccccccctcccccttgcccggggcgcgagctgtttgatgatcctagctatgtgaacgtccagaacctagataaggcacggcaggcagtcgggggggcagggcctccgaaccccgccattaatggctcagctccaagagatctgtttgacatgaaacctttcgaggacgctctaagggtgccacctcctccacaatccgtcagcatggccgagcagctgcggggcgagccttggtttcacggtaagctgtctagacgggaggctgaggctctactacagttgaacggagacttcctggttcgtgaaagtactaccactcctgggcagtacgtgctgacgggtctgcagagcgggcagcccaagcacctcctcctcgtggaccctgagggagttagatggggatttgcaatgctgccgaagctatttctcaattcgcgcgcccaggtgattagactgccccggcctcccagggtactcggcctgcaggccaggaccactatgccatccttacatatctttttctgcacagtttacactctcttaaggcatgccaattttctacaagtaaaaaaaggagtctacagtagccaactacattccttccgggctgacgtcgcctttgccttcagccatttcactgatctcagtattcccaccaccgtgagtttttag

SEQ ID NO: 17370 - DNA, 1755 bp, Artificial Sequence
  Description of Artificial Sequence: Synthetic coding sequence
atggacctgctccctcccaaacctaaatacaatccactcaggaatgagtccctctcctctttggaagaaggcgcctctggttccactccgcctgaagaattgcccagtccctcggcttcatctctcgggccaatcctgcctccacttccaggggatgactcccccaccaccttgtgttccttttttccacggatgagcaacctgcgtctcgctaacccggccgggggcaggccagggtctaaaggagagccaggtagggctgcagatgatggagaaggtatcgtgggggcagccatgccagatagcggcccgctgccactcctacaagacatgaataagctgagcggaggcggcggtcgcagaacccgggtagaaggcggtcagctaggtggtgaggaatggactagacacggctcatttgttaataagcctacacgtggatggctccacccaaatgataaagtcatggggccaggagtgtcatacctggtacgttacatggggtgtgttgaagttctccaatctatgcgtgccctggacttcaatactagaacacaggtcacacgggaggctataagtttggtgtgcgaagcagtaccaggcgctaaaggagctacccgcagacggaagccgtgttcccgacccctgagcagtattttaggccgatccaaccttaaatttgcaggaatgcccatcacattaaccgtttcaacctcctccctgaacctaatggctgccgactgcaagcagatcattgccaatcaccatatgcagtcaatctctttcgctagcggcggggaccccgatactgctgagtatgtggcatatgtggcaaaagatcctgtaaaccagagggcctgccacatcttggagtgtcctgagggcctggcccaggacgtcatctcaacaataggccaggccttcgaactgagattcaaacagtacctgagaaacccaccaaagctcgtcacacctcacgaccgcatggccgggttcgacgggtccgcctgggacgaagaggaggaagaacctcccgatcatcagtactacaacgacttcccgggcaaggagcctcccttagggggtgtcgtggatatgcgtctccgggaaggagctgctcccggggcagctaggcctacggcccccaacgctcagacgccgagccacctgggcgccacactgccagtaggtcagcctgtcggaggtgacccagaagtgcgcaaacagatgcctcctcctcccccctgccccgctggacgggagcttttcgacgacccttcatacgtcaacgtgcagaatcttgataaggcacgccaagctgttgggggcgctggcccccctaacccagctattaacgggtccgccccacgtgatttgttcgatatgaaacccttcgaagatgctctgagggtaccaccccctcctcagtccgtgtccatggccgagcagctcagaggggaaccttggtttcacgggaaactatctcgacgagaagcggaagccttattacaactgaatggtgacttcctggtccgtgaatcaactaccacgcccggccagtatgtgcttacaggactccagagcggtcagcccaagcacctgctcctcgttgacccagaaggcgtcgttcgcacaaaggatcacaggttcgagagcgttagccacctgatttcttatcatatggacaaccacctccccataataagtgctggcagtgagctgtgtctccagcaacctgttgagagaaaattatag

SEQ ID NO: 17371 - DNA, 1749 bp, Artificial Sequence
  Description of Artificial Sequence: Synthetic coding sequence
atgacccaggggcccggcggccgggcgcctcctgccccccctgcccctcctgaaccggaggcacctaccactttttgcgcccttctgccgcgtatgccacagtggaagttcgctgccccggggggcttcctgggtagaggcccggcagcagcacgcgccgctggtgcctccggcggcgcggatcctcagcccgagcccgcaggcccaggcggtgttcccgccttggccgcagctgtgttgggagcctgtgagccgcgctgcgctgccccctgccctctacctgctctctctcgttgtagaggagccgggtcaagaggctcgaggggcgggcggggcgcggcaggcagtggtgatgccgctgctgctgcagagtggattaggaagggcagtttcatccataagcctgctcacgggtggctccatcccgacgcgcgggtgctgggtccgggagtgtcctatgtagtaaggtacatgggctgcattgaggtgctgcgatcaatgcgatctttagactttaatactcgcacccaggtgacaagggaggcaattaaccggctgcatgaagcagtccctggggtgcggggatcatggaagaagaaggctcccaacaaggctttagcctccgtgttgggcaaaagcaatttgagattcgcaggaatgagtatctcaattcacattagtaccgatggactcagcctgtccgtaccggccacaaggcaggtgatcgccaaccaccatatgccatcaatctccttcgccagcggaggcgacaccgacatgacagattacgttgcctacgtcgccaaggacccgattaaccagcgggcctgtcacatcctagagtgttgtgagggcttggcccagagtattattagcactgtgggtcaagcttttgagttacgctttaaacagtacttacacagcccaccaaaagtggcactacccccagagagactggcaggccccgaggaatccgcatggggcgatgaggaagacagcctggaacacaattactacaacagtatacccgggaaagagccgccactggggggtctggtcgattccaggctagcactgactcagccttgcgcactgactgctctagatcagggtccctctccaagcctcagggatgcctgctcactgccctgggatgtgggtagcactgggactgctccaccaggggacggctacgtgcaggccgatgctagaggaccccctgaccacgaagagcatctgtatgtgaatacacagggtctcgatgcacctgagcccgaagattcacctaagaaggatttgtttgacatgcgaccgtttgaagacgcgcttaagttgcatgaatgttcagtggccgccggcgtgacagcggcgccactgccacttgaagaccagtggccaagcccgccaacccgccgggcccccgtagcacccacagaagagcagctgcggcaggagccttggtatcacggacggatgtctcggcgtgctgccgaacggatgctgcgcgctgatggagacttcctggtccgggatagcgtcacaaaccccggtcagtacgtgcttacgggtatgcatgccggccaaccaaagcatctcctcctggtagatcctgagggtgtggtgaggacaaaggatgtgttattcgagtcaatctcccacctaatagatcatcacctgcagaacggccaacctatagttgcagccgagagtgagctccacctacgaggagtggtcagtagggaaccgtag

SEQ ID NO: 17372 - DNA, 1833 bp, Artificial Sequence
  Description of Artificial Sequence: Synthetic coding sequence
atgcttgacttctttacaattttcagcaagggcgggctggtcctgtggtgttttcagggggtctctgattcttgtacaggccctgtgaacgccctgatcaggtcagtgttactgcaagtcggctttcagaaaattctgacgttgacttatgtagacaaactgatcgatgacgttcacaggctctttcgcgacaaataccggactgagatccagcagcagagcgctttgtctttactcaatggtacctttgattttcagaacgactttctccggctgcttcgcgaagcagaagagagctctaagatccgggcacccactaccatgaaaaagtttgaagacagcgagaaggcgaagaaacctgtgcggtccatgattgagacccgaggagagaagcctaaggagaaggctaaaaactccaaaaagaaaggcgcaaagaaggaaggttccgacgggcccctggccacttcaaaacccgtaccagccgaaaagagtggcctgccagtcggcccggagaacggcgtcgagctaagcaaagaagagctaatccgcaggaaacgagaggaatttatccagaagcatggcagaggaatggaaaaatccaataaatctaccaagtccgatgccccaaaggagaaaggtaaaaaagctccacgggtttgggagctgggggggtgtgccaataaggaagtgctggactatagcacacccaccaccaacggaactcccgaggcagcattgagtgaggatatcaacctcatccggggcactgggagtgggggacagctacaggacctagattgctcatcatcagacgatgagggtgcagctcaaaatagtactaaaccttccgccaccaaggggaccctcggtggcatgtttggtatgttaaaagggcttgtgggctcgaaaagcctctctcgcgaagacatggagtctgtgctggacaaaatgcgcgatcacttaatagctaagaacgtcgcggctgatatcgcagttcaactgtgtgagtccgtggccaacaagctcgagggtaaggttatgggcaccttttccactgttacttctactgtgaaacaggctctgcaggagtcactcgtccaaatcctgcaaccccagcggcgggtcgacatgctgagggatatcatggacgcccagcgcaggcaaaggccatacgttgtgacattctgtggggtcaatggcgtggggaagagcacaaacttggcgaagatttctttctggctgttagagaacggcttctccgtactgatcgcagcatgtgatacatttcgggctggggcggtcgagcagctgagaacccatacacggagactttctgcgcttcatccacccgagaaacatggggggcgaaccatggtgcagcttttcgagaaggggtacggcaaggacgctgcaggtatcgccatggaggccatagccttcgctcgcaaccaggggtttgacgttgttctggtagataccgctggccgcatgcaagacaatgctcctttgatgacggctctcgccaagctgatcaccgtgaacacccccgatcttgttctgttcgtgggggaagctcttgtcggtaacgaagccgttgaccagctcgtgaaattcaatcgggccttggcagatcactccatggctcagaccccccggctgatcgacggcattgtactgacaaaatttgacacgatcgacgataaggtgggtgccgcaatcagcatgacctacatcaccagcaagccaatcgtattcgttgggaccggtcagacctactgtgaccttaggagtctgaatgccaaagccgtggttgccgcactgatgaaagcatag

SEQ ID NO: 17373 - DNA, 2253 bp, Artificial Sequence
  Description of Artificial Sequence: Synthetic coding sequence
atgtctcagtggtacgagttgcagcaacttgacagcaagtttctcgagcaagttcaccaactgtacgatgactcttttcctatggaaatccggcagtacctggctcagtggctggagaaacaggattgggaacacgctgcaaatgacgtgagtttcgccactatccggttccacgaccttctgtcccagctggacgatcaatactcaaggtttagtcttgagaacaatttcctcctgcaacataacatcaggaagtctaagcgcaacctgcaggacaacttccaggaggatccgatccagatgagtatgattatttatagttgcctgaaagaggagcggaaaatcctcgagaacgcgcagaggtttaaccaagctcagtccggaaatatccagagcaccgtcatgctcgataagcagaaagaactcgactctaaagtgcggaacgtcaaggacaaggtgatgtgcatcgagcacgagattaagagcctggaggacctccaggatgagtatgacttcaaatgtaagacactccagaatcgggagcatgaaacaaatggggtggctaagagcgaccagaagcaggaacaactgctgcttaaaaagatgtacctgatgctcgacaacaaaaggaaggaggtcgtacataagataatagaactgctaaacgttactgagctgactcagaatgccctaatcaatgatgagctagtggaatggaagcgtcggcagcagtctgcatgcataggagggccacctaacgcttgtctagaccagctgcagaattggttcacgatcgtcgctgagagcttacaacaagttcggcagcagctcaagaagctggaagagctggaacagaaatacacttatgagcacgaccctatcacgaaaaacaaacaggtgctctgggaccgtaccttttcccttttccagcagctgatacagtccagctttgtggtggagcggcagccatgcatgcccactcacccacaaagacctcttgtactcaaaactggagttcagtttacagtaaaactccgtctgcttgtgaagcttcaagaacttaattacaatctgaaagtaaaagtgctgtttgacaaggatgtgaatgaacgtaacacggtgaaggggttccggaagttcaacattctcgggacccacacaaaagttatgaatatggaagagtcgacaaacggcagcctggcggccgagtttcgccacttgcagctcaaagagcagaaaaacgcaggcacccgcacaaacgaaggcccacttattgttacagaggagctgcactctttgtcatttgagacacagctttgtcaaccaggactcgtgattgaccttgagaccacttctctacccgttgtggtaatcagcaatgtgtcccagctaccgtctgggtgggcttcgatcctctggtataatatgctggtcgcggaaccccgcaacttaagctttttcctgacccccccatgtgccaggtgggctcaattatcagaggtgctgtcgtggcaattttccagcgttaccaaaagaggactgaatgtggaccagctgaacatgctgggcgagaagctgttgggtccaaatgccagcccagatggtctgataccttggactaggttttgcaaggagaacataaacgacaagaacttccccttctggctgtggatcgagtctatcttggaattgatcaagaaacacttgctgccactgtggaatgatggttgcattatggggttcatcagtaaggaacgcgaaagagctctgctgaaagaccagcagccaggcaccttcctccttcgcttcagcgaaagttctagggagggcgccatcacctttacatgggtggagaggtcccagaacggcggcgagccggacttccatgcagtagaaccatacaccaaaaaggaattgtccgcggttacctttccggatataataaggaactataaggtgatggctgccgaaaatattcccgaaaaccccctcaaatacttgtaccctaacatcgataaggatcatgctttcggcaagtattatagtcggcctaaggaggcaccagaacctatggagctcgacgggcccaaaggcacaggctacataaagaccgagctcattagtgtgtcagaagttcatccgagccgcctccaaacaaccgacaatctcctaccgatgtctccggaggaatttgatgaggtgtctcggatcgtcgggagtgtggagttcgatagcatgatgaatactgtgtag

SEQ ID NO: 17374 - DNA, 2139 bp, Artificial Sequence
  Description of Artificial Sequence: Synthetic coding sequence
atgagccagtggtacgaactgcagcagctagacagtaagttcttagagcaagtccatcagttgtatgatgatagcttccctatggagatccggcagtacctggcgcaatggctagagaaacaggactgggagcacgccgcaaatgatgtttcttttgcaaccatcagatttcacgatctgctatctcagcttgacgatcaatactccaggttcagccttgagaacaacttcctgctgcaacataatatccgaaagtctaaaagaaaccttcaggataattttcaggaagatcccattcagatgtcaatgatcatatattcatgtctaaaggaagagcgaaaaatactggaaaacgcccaacggtttaaccaagcacaatccggaaacatacagtctacagtgatgctagataagcaaaaagaactcgacagcaaggtacgcaacgttaaggacaaagttatgtgtatcgagcatgagattaagagcctcgaggacctccaggacgaatatgatttcaagtgcaagactctccagaaccgggagcacgagaccaacggagtcgctaaatcggaccagaagcaagagcagctgctcctcaaaaagatgtatctgatgctagacaacaaaaggaaggaagtggttcacaagattattgagttgctgaatgttacggaactgacacagaatgccttgatcaacgatgaattggtcgagtggaaacgcaggcagcagtccgcctgtatcggggggccgccgaatgcctgccttgatcagttacagaactggttcacgattgtcgcagaaagtctgcagcaggtgaggcagcaactaaagaaactcgaggaactcgaacagaaatacacctacgagcacgatccgatcacaaagaataaacaggtcttgtgggacaggactttctcccttttccagcaactgattcagagtagcttcgtcgtggagagacagccatgtatgccaactcacccccagcggcctctcgtgcttaagactggcgtacagtttactgttaaactgagactcctcgttaaactacaagaactgaactataaccttaaagtgaaagtcctgtttgataaggacgtgaacgaacgtaacaccgtgaaagggttccgaaaattcaacatactaggcacccataccaaggtcatgaacatggaagagagtaccaacggatccctcgctgccgagttcagacacctgcaactgaaagaacagaaaaatgccgggaccagaactaacgaagggcctctgatcgtgaccgaggagttgcatagcctgagttttgagactcagctgtgccagcctggactcgtaattgatttagaaacaacttccctgcccgttgtcgtgatttctaacgtgagccagctgccctcgggctgggcctcaatcctctggtacaacatgctggttgcagaaccgcgaaacctgagtttttttctaacacctccgtgcgctaggtgggcccagctgtcggaagtgctaagttggcagtttagctctgtcaccaagagggggctgaatgtagaccagctgaacatgctgggtgagaagctcctcggacctaacgccagcccagacggattgatcccgtggaccagattctgtaaagaaaatattaacgataaaaacttcccattttggttgtggatagaatccatcttggagcttattaagaagcatttgctgccgttatggaacgatggatgcattatgggctttattagcaaggagagagaaagggcactgctgaaagatcaacagccaggaacgtttctgcttcgtttcagcgagagcagtcgagagggggctataacctttacatgggttgagcgcagccagaatggcggggagccagactttcatgccgtggaaccctacacgaagaaggagctctccgcggtgacgttccctgatatcatccgtaactataaggtgatggctgctgaaaacatacctgagaatcccttaaagtatctttaccccaatattgataaggatcacgcatttggtaaatactacagtaggcccaaggaagcccccgaaccaatggaactggatggacctaagggaacaggatacattaagaccgaactcatctcagtgagcgaagtgtag

SEQ ID NO: 17375 - DNA, 2145 bp, Artificial Sequence
  Description of Artificial Sequence: Synthetic coding sequence
atgtggatgagccagtggtacgaattgcagcagctggacagcaagttcctcgaacaggtgcaccagttgtacgacgattccttccctatggagattcgccagtatctggcccagtggttagagaaacaggactgggaacacgctgcaaatgacgtgagcttcgccacaatccgctttcacgatctgctctcacaactggacgaccagtactcgagatttagtctggagaacaactttctgctgcagcacaatatccgaaaatcaaaaaggaacctgcaggacaatttccaggaggatccaatccagatgtcgatgattatttactcctgtctgaaagaggagcgcaaaatattggagaacgctcagcgtttcaaccaagcacagtcaggaaacatacaatccaccgtgatgcttgacaagcaaaaggagctggattccaaggtgcggaacgtgaaagataaggtgatgtgcattgaacacgaaatcaagagtcttgaggatctccaggacgagtacgacttcaagtgtaagactcttcagaacagagaacacgaaactaatggggtagcaaagagcgatcagaagcaggagcaacttctgctgaaaaagatgtatttgatgctcgacaataagaggaaggaggttgtgcataagatcatcgaattactcaatgttacagaactgacacagaatgcgctcattaatgacgagttggtggaatggaagcgaagacagcagtcagcgtgcatcggcgggccgccaaatgcctgtttagaccagctgcagaactggttcacaatcgtggctgaatcccttcagcaggtccgacagcagctgaagaaactggaagagctggagcagaaatatacctatgagcatgatccaataacaaaaaacaagcaggtgctctgggaccgcacattttcgctctttcagcagctcatacagagcagttttgtcgttgaaagacagccttgtatgcctacgcacccgcaacggccccttgtgctcaaaacaggtgtacagttcacagtcaaactgaggctcctcgtgaagctccaggaattgaattacaatctgaaggtcaaggttctgtttgataaggacgtaaatgagaggaacacagtgaagggctttcgcaagttcaacatcctggggactcacaccaaggttatgaatatggaagagtcgaccaatggctcactcgcagctgagttcaggcatctccaattaaaggagcagaagaatgctgggaccaggaccaatgaaggtcctctgatagtcactgaagagctccactctctttcctttgagacccagctgtgccagcctggattagtgatcgacctggaaactaccagcctacctgttgtggtcatcagcaatgtatcccagctgcctagcggttgggcctctattctgtggtataatatgctggtggccgagcctaggaacttgagttttttcctgacccccccatgcgctaggtgggctcagctgtccgaagtactcagctggcagtttagtagcgtgacaaaaagaggactcaatgttgatcagctgaatatgcttggtgagaagctgctggggcctaacgccagccccgacggtcttatcccctggacaaggttctgcaaagaaaatatcaatgacaagaatttccccttttggttatggatagaatctatcctggaactgatcaagaagcatcttctcccgctttggaatgacgggtgcattatgggatttattagcaaggagagggaaagggccttgctcaaggaccagcagcccggaacttttcttcttaggtttagtgagtcctcccgtgagggggctatcacctttacatgggttgagagaagccagaacgggggagaaccagacttccacgcggtagaaccctacacgaaaaaagaattgtccgctgtgactttccccgatatcataagaaactataaagtaatggcagccgagaatattcctgagaatcctttgaaatatttataccccaatatcgacaaggatcacgcttttggcaagtattactctaggcctaaagaagccccagaacccatggagctggacgggcccaagggaactggatacatcaagacagaactcatctctgtaagcgaagtctag

SEQ ID NO: 17376 - DNA, 2253 bp, Artificial Sequence
  Description of Artificial Sequence: Synthetic coding sequence
atgtcccaatggtacgagttacagcagctggactctaagttcttggaacaggtgcaccagctgtatgacgacagctttccgatggaaatcaggcagtatctggcacagtggttagaaaaacaggactgggagcacgccgcgaatgatgtgagtttcgcaacaatcagattccacgatctcctgtctcagctggacgatcagtatagtaggtttagtttggagaacaactttttactgcagcataacatcagaaaatccaaacggaatctgcaggataacttccaggaggatcccattcaaatgagtatgatcatatactcctgtctaaaagaggaacggaaaatccttgagaacgcccagcggttcaaccaggctcagagtggtaacatccagtcaaccgtaatgctcgacaagcagaaggaactggatagcaaggtgaggaatgtaaaagataaggtcatgtgtatcgagcatgaaatcaaatccttggaggatttgcaggacgagtatgatttcaaatgcaagaccttacagaacagggagcatgagacgaatggagtggccaagtccgaccaaaagcaagaacaattactgctgaaaaagatgtatctgatgctggataacaagcgcaaagaggtcgtgcataagatcatagaacttctgaacgtcactgagctcacacagaacgcgctgatcaatgatgagttagtggaatggaagcggagacagcagtcggcatgcatcggggggccgccgaacgcatgtcttgaccagttgcagaattggttcacaatcgttgctgagtcactccagcaggtgagacagcagctcaagaaactggaggaactggagcaaaaatacacatatgagcacgatcctattacaaaaaataaacaggtgctgtgggacaggacattctcgctattccagcagctgatccagtcttccttcgtcgtcgaaaggcaaccttgtatgcccactcacccacagcggcctcttgttctaaagacaggcgtccagtttaccgtgaaactcaggcttcttgttaagttacaggagctcaactacaatctgaaagtgaaggtgctatttgacaaggacgtgaacgagaggaacactgttaaaggatttcgcaagtttaatatcctcgggacacacacgaaagtgatgaatatggaagagtccaccaacggttctcttgcagccgaattcagacacctccagctgaaagagcagaaaaacgccggtacccgcacgaatgagggacccctcatcgttactgaggagctgcattccctgagtttcgagacccaactgtgccagcctgggctggtgatcgatcttgaaactacttctctcccggtcgtggtcatcagcaacgtgtcgcaactgccgtccggctgggccagcatactctggtataacatgttggtagcagaacctcgaaacctaagtttttttcttactcctccttgcgcaaggtgggcccaactaagcgaagtgctgtcgtggcagttttctagtgttaccaagcggggcttgaacgttgatcagcttaatatgttgggcgaaaagctgcttggccccaatgcgtcccctgatggtctcattccttggacaagattctgcaaggaaaacattaacgacaagaacttccccttttggctgtggatcgaaagcatcctggagctgatcaaaaagcatctcctccccctgtggaacgatggatgcattatggggtttatttccaaagagagagagcgagccctgctcaaggatcagcagcccggtaccttcctgctacggtttagtgagagttcccgggagggggcaattacttttacctgggtcgagagatctcagaacggtggcgagcctgattttcacgccgtggaaccctacaccaagaaagagcttagcgccgtgacattcccagacataattagaaattacaaggtcatggcagccgaaaatatcccagaaaaccctttgaaatacctctacccaaacatcgacaaggatcacgctttcggtaaatattacagtaggccaaaagaggcgcccgaacccatggagctggacggtccgaaaggtacaggatacatcaaaacagaactcatctccgtgtccgaggtgcacccctcacgcctgcaaaccacggataacctcctccctatgtcccccgaggaatttgatgaggtctcgcggattgtgggaagtgttgaattcgactctatgatgaacaccgtatag

SEQ ID NO: 17377 - DNA, 543 bp, Artificial Sequence
  Description of Artificial Sequence: Synthetic coding sequence
atgtctcagtggtacgagctccagcaactggactctaagttcctcgaacaggtgcaccagctgtatgatgattcgttccctatggaaatccgccagtatctggcacaatggctcgaaaaacaggactgggagcatgcggccaatgacgtgagcttcgctaccattagattccacgacttgctgtcccagttagacgatcaatactcaagattcagcctcgaaaacaacttcttgctacagcataatataagaaaatcaaagcgtaacctgcaagacaacttccaggaagatcctatacagatgtctatgatcatttattcctgtttgaaagaagagcggaaaattctggagaacgctcagcggttcaaccaggcacagtctggcaacattcaatcaacagtgatgttagacaagcagaaagaattggacagtaaggttagaaatgtcaaagataaggtgatgtgtatcgagcacgagattaagagtttggaggatttgcaggatgaatacgatttcaagtgcaagactctccaaaataggtag

SEQ ID NO: 17378 - DNA, 213 bp, Artificial Sequence
  Description of Artificial Sequence: Synthetic coding sequence
atgagccagtggtatgaacttcagcagctggattctaaatttctggaacaggtgcatcagctgtacgatgattcctttcccatggagatccgccagtatttggcccagtggctagaaaaacaagattgggagcacgccgccaacgatgtgagtttcgccacaatccgttttcacgacctcctgtcccaactggatgaccagtacagtcgctag

SEQ ID NO: 17379 - DNA, 582 bp, Artificial Sequence
  Description of Artificial Sequence: Synthetic coding sequence
atgagccagtggtatgaattgcaacaattggactccaaatttctggaacaagtgcaccagttgtatgacgactccttcccaatggaaatacggcagtacctggcccaatggctggagaagcaagactgggaacacgccgccaacgatgtgtccttcgccacaataagatttcacgacttgctgtcacagctggatgaccagtattctcgcttcagcctagaaaacaactttctgctccaacataacatccgtaagtctaaaaggaacctccaagataatttccaggaggacccaatccaaatgtcaatgatcatttactcttgccttaaagaagaaagaaagatccttgagaacgctcagaggttcaatcaggcacagtcaggcaacatacaatccactgtaatgttggacaagcaaaaagaattagattcaaaggtgcggaatgtaaaggataaggttatgtgcattgaacacgagatcaaatccctggaggatctgcaagacgaatacgacttcaaatgcaaaacactgcagaaccggggtagcagctctcaaaataatcgggtggctgagtgtcattag

SEQ ID NO: 17380 - DNA, 453 bp, Artificial Sequence
  Description of Artificial Sequence: Synthetic coding sequence
atgagccagtggtacgagttacagcaacttgacagcaagtttctggagcaggttcaccagttatacgacgactctttccccatggagatccggcagtacctggcccagtggctggagaagcaggattgggagcacgctgccaatgatgtgtcctttgcaaccatccgtttccacgatctgctcagccaactcgacgatcagtattccagattctccctggagaataatttcctgctgcagcataatattcggaagtccaagagaaatttgcaggataacttccaggaggaccctatccagatgagcatgatcatttacagttgtctcaaagaggaaagaaagatcctcgaaaacgcccaaaggttcaatcaggcgcaatccggaaatatccagagtaccgtcatgttggacaaacagaaggagcttgattctaaggtccgaaacgtgaagtag

SEQ ID NO: 17381 - DNA, 582 bp, Artificial Sequence
  Description of Artificial Sequence: Synthetic coding sequence
atgtcccagtggtatgagctgcagcagctggactctaaatttctggaacaggtacaccagttatatgacgattcattcccaatggaaatccgccagtatctcgcccagtggctggagaaacaggactgggaacacgcagctaacgatgtgagtttcgctaccattagatttcacgatctgcttagccagcttgatgatcaatatagcagattctccttagaaaacaattttttactccaacacaacattcggaagagtaaaagaaacctgcaagacaacttccaggaggatccaatccagatgtctatgattatttatagttgtctaaaagaggagcgaaagatccttgagaacgctcagcggttcaaccaagcgcagagcggaaacatacagtccacggtgatgttagacaagcaaaaagagttggactctaaggttaggaatgtgaaggacaaagtgatgtgcatcgaacatgaaattaagtcgctggaggacttgcaagatgagtatgactttaagtgcaagactctgcaaaaccgcgggagctcttctcaaaataatcgagtggcagagtgtcattag

SEQ ID NO: 17382 - DNA, 483 bp, Artificial Sequence
  Description of Artificial Sequence: Synthetic coding sequence
gaatgccacgaggatccaatacagatgtccatgataatttacagctgtttaaaagaggaacgcaagattttggagaatgctcaacggttcaatcaggctcaatccggcaatatacagagtacggtaatgctggacaagcaaaaagaattagactcaaaagtgcgtaacgtaaaagataaagtgatgtgcatcgagcacgaaatcaaaagtcttgaagacttacaggatgaatatgacttcaagtgtaagacccttcagaatcgggaacatgagaccaacggcgttgctaaatccgatcagaagcaagagcagctgctacttaagaagatgtacctcatgctggataacaagagaaaagaagtggtccacaaaataatcgagctgctcaacgtcacggaattaacgcagaacgcccttatcaacgacgaattggtcgaatggaaaagaaggcaacagtctgcatgcattgggggcccgccctag

SEQ ID NO: 17383 - DNA, 2556 bp, Artificial Sequence
  Description of Artificial Sequence: Synthetic coding sequence
atggctcagtgggaaatgctgcaaaatttggatagccctttccaggaccagttacatcaactttactcacattcgctgcttccagtcgacattagacagtacctcgccgtttggattgaagatcagaattggcaggaagccgctctgggatctgacgacagcaaggctaccatgctgttctttcactttctggaccagttgaactacgaatgcggtcgatgctctcaagacccagagtcactgcttttacagcataacctgagaaaattttgcagggatatacagcccttttcacaggatccaacacaattagccgaaatgatatttaacctgctgctggaggaaaagaggattctgatccaggctcagcgagcacaattggagcaaggcgagcccgtccttgagacacctgtcgaatcgcagcagcatgagattgagtcccggattctggacctcagggccatgatggaaaagctggtaaaatcaatcagccagttgaaggatcaacaggacgtgttttgcttccgctataagatacaggccaagggcaagactccctcccttgatcctcaccagaccaaggagcagaaaattctgcaggaaacactcaatgaactggacaagcgaaggaaggaagttttggacgcgtcaaaggcgttgctgggtcgtctaaccacccttatcgagctgctgctgccgaagctggaggagtggaaagcacaacaacagaaagcctgcattcgcgcgccaattgatcacggactcgagcagcttgagacatggtttaccgcgggcgcaaagctgttatttcatttgcgacagctcctgaaggagctcaaggggctgtcttgtcttgtgtcttatcaggacgatccactgaccaagggtgtagatctaaggaatgcccaagtgacagaattgttgcagcgcctgctgcaccgggctttcgtagtggagacgcaaccgtgtatgccacagacgccgcatcgccccctgatccttaagacaggcagcaagttcacagttcggacgaggttgctggttaggctacaggaaggcaacgagtcactgacagttgaggttagcatagatcgcaatccaccgcagcttcaaggtttccggaaattcaatatactgacctccaaccaaaagacactcacccccgaaaaggggcagtcacagggcttgatctgggatttcgggtatctgactcttgtggaacagcgaagtggcggcagtggcaaaggcagtaataagggaccattgggtgtcacagaggagctgcacatcatttccttcactgttaagtatacatatcaagggctgaaacaagagctgaaaaccgacactctccctgttgtgatcatttctaatatgaatcagttatcgatcgcttgggccagtgtgctctggttcaacctgctgtcacctaatctccaaaatcagcaattctttagcaatcctcctaaggctccttggtcgctgttagggccagccctcagttggcagtttagttcatacgtggggcgtgggctaaattctgatcagctgtcaatgctgcgtaataagctgtttggacagaactgcaggacagaagaccccctgctgtcttgggcggattttaccaagagagaatcaccaccaggcaagctacctttctggacctggttggataagattttagagttggttcatgatcatcttaaagatctctggaatgacggcaggattatgggttttgttagccgatcccaagaaagacggttgttaaagaagactatgtcaggcacattccttctccgcttttccgaatcatcagaaggtggtatcacttgttcgtgggttgagcaccaggatgatgacaaggtgcttatttacagtgtccaaccctacaccaaggaagtcttacagtcacttccactgacggaaattatacgccattatcagttgctgaccgaggagaacattcccgaaaatccgctacggttcctatatccgcgcattccacgggatgaggcatttggctgttattaccaggagaaggtgaaccttcaagaacgccgcaagtatttgaaacatcgccttattgtggtgagcaataggcaggttgatgaactccaacaacctcttgagctgaagcctgaaccagagttggagtctctcgagttggagctggggttagtccccgagccagaactaagcttagaccttgaacctctccttaaagccgggttggatctgggtcccgagttggagtcagtcctcgaatcgacactggagcctgttatagaaccgacactatgtatggtatctcagacagtcccagagcccgaccaaggaccggtcagccagcctgtcccagagccagaccttccatgcgatttgaggcacttgaacaccgagcccatggagatttttcgcaattgcgttaaaatagaggaaataatgccaaatggagatccgcttctggccggacaaaacaccgtggacgaagtgtacgtctcgaggcctagccacttttacacagatggaccgctgatgccttcagatttttag

SEQ ID NO: 17384 - DNA, 1383 bp, Artificial Sequence
  Description of Artificial Sequence: Synthetic coding sequence
atggctcagtgggagatgcttcaaaatctagattctcccttccaggaccagctgcaccagctgtacagtcacagtcttctgccagtggacatccgccaatacctagctgtgtggattgaggaccaaaattggcaggaagcagccctcgggagcgacgactccaaggctacgatgctgttcttccacttcctagaccaactcaattatgagtgcgggcgctgcagccaagacccagagtcgctgctgttacagcataaccttcgcaagttttgccgggacatccaagatcccacacagctggccgaaatgatctttaatctgctgttggaggagaaacggatacttattcaagcacagcgtgcacaactcgagcagggagagcctgtactagagacccctgtggaatctcagcaacacgaaatagagtcacgaattcttgacctgagagctatgatggagaaacttgtgaagtcgattagccagctcaaggatcaacaggatgtcttctgctttcggtataaaatccaagccaaggggaaaaccccctcgctcgatcctcaccagacgaaggaacagaagattctccaggaaacacttaacgagttggacaaacggcgaaaggaggtgctggacgcgtctaaggccctcttggggagactgacgactctgattgagctgctgcttccgaagttggaagaatggaaagcacagcagcaaaaagcctgcattagagctcccattgaccatggcctagaacagctagaaacatggttcacggctggcgcaaaactactgttccatctccggcagctgctgaaggagctaaagggcctttcatgcttagtcagttaccaagacgatcctttaaccaaaggagttgaccttcgaaatgcacaggtgaccgagctgctccaaagactactgcatagggcatttgtggttgaaacccagccctgtatgcctcaaacaccccaccgacctctcatactcaaaacggggtccaagttcaccgtccgtacccgcctcctggtcagattgcaggagggtaacgagtccctaacggtggaggtttcaattgatagaaatccacctcagctgcagggatttcgcaagttcaacatcctgacttcaaaccagaaaacactcacccctgaaaagggtcagagtcagggcctcatctgggacttcggctacctgacgctggtggagcagaggtccggcggttcaggcaaaggcagcaataagggcccgctgggtgtcactgaggagctgcacattatctcctttacagtaaaatacacctatcagggcctcaaacaggagctcaaggtaagcgagaacggaggccaaggtgaaaggaagcagttgtggaagaaggcttag

SEQ ID NO: 17385 - DNA, 2544 bp, Artificial Sequence
  Description of Artificial Sequence: Synthetic coding sequence
atggcccagtgggaaatgctccagaacttggactcgccgttccaagatcagttgcaccagttgtactctcactcattacttcccgtggacattcggcaatatctggccgtgtggattgaagaccagaactggcaggaagcggcgctgggctcagatgactctaaggcgacgatgctgttcttccatttcttggatcagctcaactatgagtgcggacgctgctcgcaggacccagagagtctgctgctgcagcataacctgcggaagttttgcagagacatccaggacccaacccagctggcagagatgattttcaacttattactggaggagaaaagaatcctgattcaggcccagcgcgcccagctggagcagggcgagccagttctggagacacctgtggaatctcaacagcatgagatcgagagccggatcctcgatctaagggctatgatggaaaaactggtgaaaagcatctctcagctgaaagaccagcaggacgtgttctgttttcgctacaagattcaagccaagggcaagacccctagccttgacccccatcaaacaaaggaacagaagatcttgcaggagacattgaatgaacttgacaaacgcagaaaagaagtgttggacgcctccaaagcgttgctcggcaggctgacaacactgattgagctcctgctgcctaagttagaagagtggaaagcacagcagcaaaaggcctgcattcgtgccccgatcgatcacggccttgaacagctggagacctggtttacagccggcgcaaagctgttgtttcacctgaggcaactgttgaaggagcttaaaggactgtcgtgccttgtgtcctatcaggatgaccccttaactaaaggggtggacctgagaaacgctcaggtgaccgaactgctgcaacggctgctgcaccgggccttcgttgtcgaaacccagccgtgtatgccccaaacaccacatagaccccttatactaaagaccgggagtaagttcacggtccgcacacgtctattggttaggctccaggaagggaacgaatctttgacagtggaagtctccattgatcggaatcccccccagttgcaaggttttcgaaagtttaatatcctcactagtaaccaaaagaccctgaccccagagaagggacagtctcagggcctgatctgggacttcggatacctcaccctcgttgaacagcggtctggcggatcaggcaagggcagcaataaggggccattgggggtgaccgaggagctacatatcattagctttacagtgaagtacacctaccaagggctgaaacaggagctgaaaactgacacgttaccagtggtaatcatctctaacatgaaccagctgtctattgcctgggccagtgttctgtggttcaacctgctgtctcccaacctgcagaatcagcagtttttcagcaaccccccgaaggccccatggagcctcttgggaccagcactgtcctggcagttctcaagctacgtgggacggggcctgaatagtgatcagctctcaatgttaaggaataaactgtttgggcagaattgccgaacagaggatcctctgttgtcttgggccgattttaccaagcgtgagagcccccccggaaagctgcccttttggacctggctggataaaatcctcgaactcgttcacgatcacttgaaagatctttggaatgacgggagaattatgggctttgtctccaggagccaggagaggcggttactgaagaagacaatgtcgggaacctttcttctgcggttttctgagagttccgagggcggtattacatgtagctgggtggagcatcaagacgacgacaaggtgctcatctatagcgtgcagccttacacgaaggaggtgcttcagtccttgcccctcactgagatcattaggcactaccagctgcttacggaagagaacattcccgaaaatcccctccggttcctgtatccgcggatccctcgtgatgaagcatttggctgttactaccaggagaaggtcaatctccaggagcgccgcaagtacctgaagcatcgcttaattgttgtgtccaatcgccaggtcgacgagcttcaacagccgttagagctaaagcctgagcccgaactagaatccctcgagctggagctgggcctggtccccgaacccgagctgtccctggatttagagcccctgctgaaggcggggctggaccttggcccggagctagagtcagtacttgagtcaactttggaaccagtcatcgaacccactctatgcatggtctctcagactgtgcccgagcccgaccaaggcccggtctctcagcccgtgcccgagcccgacctcccgtgtgacctcaggcacctaaacaccgaacctatggaaatatttagaaactgtgtgaagattgaggaaatcatgccaaatggagacccgttgctggctgggcaaaatactgtcgatgaagtctacgtgagtagaccgtcacatttctataccgacggccctctcatgccatccgacttttag

SEQ ID NO: 17386 - DNA, 2313 bp, Artificial Sequence
  Description of Artificial Sequence: Synthetic coding sequence
atggcccagtggaatcagctgcaacagctggataccaggtatttagaacaactgcaccagctatactctgatagcttccctatggagctcaggcagtttctagctccttggattgagtctcaagactgggcctatgccgcttccaaagagtctcatgcaaccctggttttccacaaccttcttggtgagattgatcagcagtacagcagatttctccaggagagcaacgtattgtaccaacacaacctgcgccggataaagcagtttttgcagtcacggtaccttgagaaacccatggaaatcgcacgcatagtggcacgatgcctgtgggaggaaagtcggttgctacagactgctgctacagccgcacagcaggggggccaagccaatcacccaacagccgctgttgtcacggaaaagcagcaaatgttggaacagcacctgcaagatgtgaggaaacgcgtgcaggacctggagcagaaaatgaaggtggttgaaaacctccaggatgatttcgactttaattataaaactctgaagtcccagggagacatgcaggatttgaatggaaacaatcaatccgtaacacgtcagaagatgcaacagctggagcagatgctgaccgctctggaccagatgaggaggagtattgtaagtgagctggcgggattactgagcgccatggagtatgtgcaaaagacattgacggacgaagagcttgcagactggaaaaggcggcagcaaatagcctgcatcggggggccccctaacatttgtcttgataggctcgagaattggattacatccttagcagagtctcagctgcagacccgacagcagatcaagaagctggaggagctccagcagaaagtgagctataaaggcgaccctatcgtccagcaccgcccaatgctggaagagagaatcgtggagttattccgtaatctgatgaagtcggcatttgtcgtagagcggcaaccttgtatgcccatgcatcctgatcgcccactggtgatcaaaacaggggtgcaattcacaactaaggtgcggctgctggtgaagtttcctgaacttaactatcaactgaaaataaaagtgtgcatcgataaggatagtggggatgtagccgctctgagggggtctcgtaagttcaatatcttaggtacaaatacgaaagtgatgaacatggaggagtcaaacaacggctccctgtccgctgagttcaagcacctgaccctcagagaacaaagatgcgggaatggagggagagctaactgtgatgcctccttaatcgtgaccgaggagcttcacctgattacattcgaaacagaggtgtaccaccaagggctgaagattgacttagagactcacagcctgcccgtagtcgtcatcagcaacatatgccagatgcctaacgcctgggccagtatattgtggtacaatatgcttaccaacaaccccaagaatgtgaacttcttcacgaagcccccgatcgggacctgggaccaggtggctgaagtcctgagctggcagttttccagcaccaccaagcgcggcctgtccattgaacagcttacaactctcgccgaaaagctgctggggccaggtgtgaactacagcggatgccaaattacctgggctaaattttgtaaggagaacatggcgggaaaaggtttctcgttttgggtgtggcttgataacatcatcgacctggttaaaaagtatatactggctttgtggaatgaagggtacataatgggattcatctctaaggaacgtgagcgagcaatcctgtctacgaagccacctggaaccttccttcttaggttcagcgaatcttcaaaggagggtggcgttaccttcacatgggttgagaaagacatttcaggcaagacccagatccagtcagtggagccctacacaaagcaacaactcaacaatatgtctttcgctgagataattatggggtacaaaatcatggatgctactaacatcctggtaagtccgctggtctacctgtacccagatatacctaaggaggaagcctttggcaagtactgcagaccagaaagtcaagagcatcctgaggctgaccccggctctgcagccccatacctaaagaccaaattcatttgtgtgacacctacgacctgttcaaatacaatcgacctcccaatgtcccctcggactctggacagtctcatgcagtttggaaacaatggcgagggggctgaaccatccgccggtggtcaattcgaatctttgacattcgacatggaattaaccagcgagtgcgccacaagcccaatgtag

SEQ ID NO: 17387 - DNA, 2019 bp, Artificial Sequence
  Description of Artificial Sequence: Synthetic coding sequence
atggaaattgccagaatcgtcgctagatgcttgtgggaggagtctcgtttgctgcaaaccgcagctaccgccgctcagcagggcggccaggcgaatcaccctaccgcagcggtcgtgactgagaagcagcagatgctagagcagcacctccaggacgtgcgaaagcgagttcaggatcttgagcagaagatgaaggtggtggagaatttgcaggatgattttgacttcaactacaagaccctgaagtcccagggggacatgcaagacctaaatggtaataaccagtctgtgaccagacagaaaatgcagcagttggagcagatgcttactgcactcgatcaaatgagacggtccattgtcagtgagctggctggtctgctttcggcgatggaatacgtacagaaaacacttacagacgaggagctggccgattggaagaggcgtcagcagatcgcgtgtatcgggggaccccctaacatatgtctagataggctggagaattggatcacatcactagccgagtcgcaactccagacccgacagcaaattaagaaactggaggagttgcagcagaaagtgagctacaaaggagaccccatagtgcagcataggcctatgctagaagagaggatcgtcgagttgtttagaaacttgatgaaatctgcctttgttgtcgagaggcagccctgcatgcctatgcacccagacagacccctagtgattaagactggtgtccagtttaccacgaaagtgcggctgctcgttaaattcccagaattgaactaccagctcaaaatcaaagtttgcattgataaggattccggcgacgtcgcagcactgcgaggaagtagaaagtttaatattctggggaccaacacgaaagtcatgaatatggaggagtctaacaacggctcactgagtgccgagttcaagcacctaactttaagagaacagagatgtggcaacggcggccgagccaactgcgacgccagcttgatcgtgactgaagagctgcacttgatcacattcgagactgaagtgtaccaccaggggctcaaaatagacctggaaactcattccctacctgtggtcgtaatcagcaacatctgccagatgcccaacgcatgggccagcatcctgtggtacaacatgctcacaaataatcccaaaaatgttaactttttcacaaaaccccctattggcacctgggatcaggtggccgaagttctgagttggcagttctcttctaccaccaagaggggcctgagtattgagcagttaactacacttgctgagaagctcttaggcccaggcgtaaattacagcggatgccagattacatgggctaagttttgtaaagaaaatatggccggaaaagggttcagtttttgggtgtggttggacaacattatcgaccttgtgaagaaatatattctggcgctctggaatgagggctacataatgggtttcatcagcaaggaaagggaacgagctattctgagcactaagccccccggcacatttctgctgagattttccgagtcttccaaggaaggaggggtcactttcacatgggtggagaaagacatatcggggaaaacacagattcagtccgttgagccttatacgaagcaacagttgaataatatgtcttttgctgaaattattatggggtacaagatcatggacgccactaatatcctcgtgagccccctcgtatatttgtaccccgacatcccaaaagaagaagcatttggcaaatactgtagacctgaaagtcaggaacaccctgaggcagacccaggatctgctgccccctatctgaaaaccaagtttatatgtgtcacacccacaacttgttcgaatacaatcgacctgccaatgtccccgcggacccttgacagtttgatgcagtttggcaataacggagagggagctgaaccatccgctggcggccagtttgaatcattgacatttgatatggagctgacctcagaatgtgccacctcccccatgtag

SEQ ID NO: 17388 - DNA, 2310 bp, Artificial Sequence
  Description of Artificial Sequence: Synthetic coding sequence
atggcacagtggaaccagctccagcagttggatacacggtatctggaacagctccatcagctctactccgactctttccctatggaactaagacagttcttggcaccttggatcgagagccaagactgggcctacgctgccagtaaggaatcccatgctacgctggttttccataatttactgggcgagatagaccaacagtacagccgatttttacaggagtccaacgtgctgtatcagcacaatctgcgccggatcaagcaatttctgcagtcacgatatctggagaagccaatggagattgctcgcatagtggcaaggtgcctgtgggaggaaagcaggttgttgcagaccgccgccaccgcagcgcaacagggcggccaggccaaccaccccacagctgcggtggttacggagaaacagcagatgctagagcagcaccttcaggacgttcgcaaacgagtgcaggacttggaacaaaaaatgaaggtcgtggagaacctgcaagatgacttcgatttcaactataagactctgaaaagccagggggacatgcaggacttaaatgggaacaaccagagtgtaactcggcaaaagatgcagcagttggagcagatgttgacagctctcgaccagatgagacggtcgattgtgagcgagctcgcaggactgttgagcgcaatggagtatgtacagaagactctgaccgatgaggagctggctgattggaagcgtagacagcagatcgcatgtatcggcggtcccccgaatatctgcctcgaccggctagagaactggattacatcacttgctgagtcacaacttcagactagacagcagataaagaaactggaggaactgcagcagaaagtgagttacaaaggcgatcccatcgttcagcacagaccaatgctcgaagaaaggattgtcgaactatttcggaacctcatgaaatccgcattcgtggtggagaggcagccatgtatgccaatgcacccggatcgtcccctggtgattaaaacaggcgttcagtttactacaaaggtgcggctcttggtgaagtttcccgagctgaattatcagcttaagataaaagtgtgcatagataaggattccggtgatgtggctgctctacgcggcagtagaaagtttaacatcctgggtacaaacaccaaagtcatgaacatggaggaaagtaacaacggctctttgtcagctgaatttaagcacctgacattgagagagcaaagatgtggtaatgggggacgcgcaaattgtgatgcgtcattgatcgtgactgaggaactgcacctgattacatttgagaccgaggtgtatcaccagggccttaagattgacttggaaacccacagtctccctgtggtggtgatcagcaatatctgccagatgccgaatgcctgggccagtatcttatggtacaacatgcttactaacaatcctaagaatgtgaattttttcactaagccacctatcggaacctgggatcaagtagccgaagtcctgtcttggcagttcagcagcaccaccaagcgtggcttgtcaatagaacaactaactacactagctgagaaactcctgggcccgggggttaattactccggatgccagatcacttgggcaaagttctgtaaagagaacatggcaggtaaggggttctccttctgggtgtggttggacaacataatcgaccttgttaagaaatatatcctggccctctggaatgagggctatattatgggtttcataagtaaggagcgggaaagggcaatcctctctaccaagccacccggtacattcctgctccggttcagcgagagctccaaagaagggggagtgacattcacctgggtggagaaggacattagtgggaagacgcaaattcagagtgtggagccctacactaaacagcaactgaacaacatgtcctttgcggaaattattatgggttataagattatggatgccaccaacatcttggtgagccctctcgtgtacttgtaccccgatattcctaaggaggaagcatttgggaagtactgtcgtcctgagtctcaagaacaccctgaggctgaccccggggccgccccttacctaaagacaaaattcatctgtgtgacacccactacatgttctaataccatcgacctgccaatgtccccgcgaacactcgactccctgatgcaatttggaaacaatggtgaaggtgctgagccaagtgctggtgggcaattcgaatcgttaactttcgacatggagctaacaagcgagtgtgcaacgagccccatgtag

SEQ ID NO: 17389 - DNA, 2169 bp, Artificial Sequence
  Description of Artificial Sequence: Synthetic coding sequence
atggcccagtggaaccagttacaacagctggatactcgctatctcgagcagctgcatcagctatactccgactcctttccaatggagctccgtcagtttttagctccgtggatagaatcccaagactgggcatatgcagcctcaaaggaatcgcacgccacactggtgtttcacaatctcctgggcgaaattgatcagcagtatagccgcttcctacaggagtccaatgtcctgtaccagcataaccttcgcaggattaagcaatttctccagtcccgttacctagagaagccgatggagattgcccgaatagtggcacgctgtctgtgggaggagagtaggctactccagaccgctgctacagcagcacaacagggcggacaggccaaccacccaacagcggccgtggtgacagagaagcagcaaatgcttgagcaacacctacaggacgtcagaaaaagggttcaggacctggagcaaaagatgaaagtggtcgagaatctgcaagacgatttcgatttcaattacaagaccctgaagtctcagggggacatgcaagaccttaacggaaataatcaaagcgtgacaagacagaaaatgcagcagcttgaacagatgttgacagccctggatcagatgcggcggagcatcgtatccgagttggccggcctactttctgctatggagtatgtccagaaaacgttaacagacgaggagcttgcagactggaaaaggcggcaacaaattgcttgtattggcggaccacccaatatttgcctcgaccgcctggagaactggattactagcctagcagagtcgcaactgcaaactaggcagcagatcaaaaagctggaagagcttcaacaaaaggtctcatataagggggacccaatagtacagcatcgtcctatgctggaggagaggattgttgagttatttcgtaatttgatgaagagcgcgttcgttgtcgagcgccaaccctgcatgccaatgcaccccgaccgaccgctggtgataaaaaccggggtgcagtttacaacaaaggttcgactgctggtgaagttccccgagcttaactaccagctaaaaataaaggtttgcattgacaaggatagcggagacgtggcggcattaagagggtcacgcaaattcaacattctcggcacaaatacgaaagtaatgaatatggaagagtcaaacaacggctccctaagtgctgagttcaaacatctcaccctgagagagcagagatgtggtaacggggggagagcgaattgcgacgcaagtctgattgtgacagaagaattacatctaatcacatttgaaacggaagtgtatcaccagggactcaagattgatcttgagactcacagcctccccgtcgtcgtgatttccaatatttgccagatgccaaatgcttgggcgagtatcttatggtataatatgctaactaacaaccccaagaatgttaacttcttcaccaaacctcctattgggacctgggaccaggtcgctgaagtgctctcttggcagtttagctcaaccacgaagagaggactttctattgaacagcttacgaccttggctgaaaaacttttaggtcccggggtaaattactccggatgtcagatcacctgggccaaattttgtaaagagaacatggccggaaaggggttctcattttgggtctggctcgataatattatcgatctcgtaaaaaagtatattctggctctatggaacgaaggctatatcatgggctttattagcaaggagagggagcgagctattctgagcacaaagcctcctggaacatttctcctccgctttagtgagtccagtaaggaaggcggcgttactttcacctgggtcgagaaagatatctcgggtaagactcagatccagagcgttgagccttacaccaagcagcagctaaacaatatgtcgttcgctgaaattatcatgggctacaagattatggacgccacaaacattttagtatcccccctggtgtacctgtacccagacatacctaaggaggaagccttcggtaagtattgtcgcccagagagtcaagagcaccctgaggcagaccccggcagtgcagctccgtacctgaagaccaagtttatttgtgtcacccctttcattgatgccgtgtggaaatag

SEQ ID NO: 17390 - DNA, 2247 bp, Artificial Sequence
  Description of Artificial Sequence: Synthetic coding sequence
atgtctcagtggaaccaggtgcagcaactggaaatcaaattcttagaacaggtggaccaattttatgatgacaatttccccatggagatccggcaccttctggcacaatggatcgagaaccaggattgggaggcagccagtaacaatgaaaccatggcaaccattctgctgcaaaatctcctgatacaactggacgagcagttgggcagagtctctaaggagaagaacctccttctgatacacaatctgaagagaattaggaaagtgctgcagggcaaatttcacggtaatccaatgcacgtggctgtcgtgatttccaattgccttcgggaggagcgcagaattctggcagcagctaacatgccagtgcaaggtcccctggaaaaatcacttcagtccagttccgtctcagagagacagcggaacgtggagcacaaggtggcagctattaagaattcagttcagatgaccgagcaagacactaaatatctcgaagacctgcaagacgagttcgactaccggtataaaacaatccagaccatggatcagagtgataagaattccgctatggtcaatcaggaagtgctcaccttacaggagatgctcaactccttggattttaaaaggaaagaggctttatctaaaatgacccagattatacacgagacagatttgctcatgaatacgatgttaatcgaagaactgcaggattggaagcgcaggcagcagatcgcctgcatcggagggccccttcataatggcctggatcaactgcaaaactgttttacattactggcggagagcttgtttcaactcagacgacagcttgaaaaactggaagagcagtcgaccaaaatgacttacgaaggtgaccccatcccgatgcagcgcacccatatgcttgaaagggtgacattcctgatctataacctatttaaaaatagttttgtggtggagagacagccctgcatgcctacccaccctcagcggcctctggtcctcaagactcttatacagttcaccgtcaagctaagactgctgatcaagctgcccgaactcaattaccaggtgaaggtcaaggcttcgatagacaaaaacgttagcacactgagcaacagaaggttcgttctttgcgggactaatgtgaaggccatgagtattgaggagtcatccaatggatccctgtcagttgagtttaggcaccttcagccaaaagagatgaagtcatcagcaggcggaaagggaaacgagggatgtcatatggttaccgaggaactccactctatcacgtttgagactcagatctgtctctatgggctgaccatcgaccttgagactagctccctgcccgtcgtgatgattagcaacgtgtcacagttacctaacgcatgggcttcaataatctggtacaacgtgtctacaaacgatagccagaacttggttttcttcaataatccaccccccgccaccctctctcaactcctcgaagtcatgtcttggcaattcagtagttacgtcggccggggcttgaattccgatcagttgcacatgctggctgagaaactgacggtgcagtcttcttactcagatggccacctgacctgggccaaattctgcaaagaacatctgccaggaaaatccttcacattttggacatggttggaggcgatcttggacctgattaagaaacatattctgcccttatggattgatggatacgtgatgggctttgtcagcaaagaaaaggagcggctgcttctcaaagacaagatgccagggacgtttctcttgagattcagtgagtcccacctgggtggcattacgttcacctgggttgatcatagtgagagcggagaggtgcgttttcactccgtcgagccctacaataaaggcaggctttcggcactcccttttgcggacattctaagggattataaggtgatcatggccgagaatattcctgagaacccactaaagtatctctaccctgatattcccaaggataaggcctttggcaaacattacagttcccagccctgcgaggtgagccggccaaccgaaagaggcgacaagggatacgtgccctcagtgttcatccccatcagtacaatccgatccgacagcacggagccccactccccatccgatctgctgccaatgtctcctagcgtgtacgcagtgctacgggaaaacctgagtccaaccactatagaaacagccatgaaaagtccctactcagccgaatag

SEQ ID NO: 17391 - DNA, 2247 bp, Artificial Sequence
  Description of Artificial Sequence: Synthetic coding sequence
atgagtcagtggaaccaggtccagcagttggaaattaaattcctagaacaggtggaccagttttacgacgataacttccccatggaaattagacacttgctggcacagtggatcgaaaaccaagactgggaagccgcaagtaataatgagaccatggctaccatactgttacagaacttgctgatccagctggacgagcaactcggacgcgtcagcaaggagaagaatctgctacttattcacaacctcaaaagaattaggaaggtcctgcagggcaagtttcacggcaaccccatgcatgtggctgtagttattagtaattgcctgcgtgaggagcgacgcatcctggctgctgcaaatatgccagtgcaggggcccttggagaagtctttgcagtccagcagtgtttcagaacgacaacggaatgtcgagcataaagtcgccgcaattaaaaatagcgtgcagatgaccgagcaggacacaaagtatttggaggatcttcaggacgagtttgactaccggtataagaccattcagaccatggaccagagcgataaaaattctgccatggtgaaccaggaggtactgactctccaggagatgttgaactccctggatttcaagcgcaaagaagctctcagcaaaatgacgcagattatccatgagactgacctgctgatgaatacaatgctgatcgaggagcttcaggattggaagaggcgccagcagatcgcctgtatcggagggccgttgcacaatggactggaccagctccagaattgcttcacccttcttgcagagtcactgtttcagcttcgcaggcagctcgagaaactggaggagcaatccactaagatgacctacgagggagacccaattcccatgcagagaacacacatgctcgagcgcgtgaccttcctgatctacaatctgttcaagaattcttttgttgtggagcggcaaccctgcatgcccacccatccacagagacctctcgtccttaagacccttatacaatttactgtcaagctgcgcttgctgatcaaactgcccgaattgaactaccaggtcaaggtgaaggcctcaatcgataagaatgtgtctacactctctaatcgccgcttcgtcttgtgcgggaccaatgttaaagccatgtccattgaagaatcgagcaatggaagcttgtcagtcgaatttcggcacctccagccaaaggaaatgaaaagtagcgccggcggcaaaggaaatgaggggtgtcatatggtcaccgaagaactgcattctattacttttgagactcaaatatgtctctatgggttgacaattgatctagagactagctccttgcccgtcgttatgatttcgaacgtttcgcagttaccaaacgcctgggcttcgatcatttggtacaatgtgtccacaaacgattctcagaacctggttttcttcaataatccaccacctgctactctgtcccagttgcttgaagtgatgagttggcagtttagtagctacgtcggccgtggactgaactccgatcagctgcatatgttggccgagaaactaacagtccagtcatcttactccgacgggcatttaacgtgggctaagttctgcaaagagcatcttcccggaaaatctttcacattctggacctggcttgaggccatactggatctcatcaaaaagcacatactccccctgtggattgacggatacgtgatgggctttgtgtctaaagaaaaggaacggctcctgttaaaagacaaaatgcctggcacatttctgctccgcttcagcgaatcccatcttgggggaattacctttacatgggtggaccacagtgagtcaggcgaggtgcgctttcactctgtggagccatacaataaaggccgcctaagtgccttgccttttgcagacattcttcgagactataaggtcatcatggccgagaacatccctgaaaacccacttaagtatctataccccgatatccccaaagacaaagcctttgggaagcactactcaagtcagccctgtgaggtctccaggcccaccgaacggggcgataagggatatgtaccttcagtgtttatcccaatttcaaccatcaggtccgattcgactgagccccattccccaagcgatttgctgcctatgtccccctctgtgtatgcagtcctccgggaaaatctctccccaactaccattgagaccgcgatgaagagcccttatagcgctgagtag

SEQ ID NO: 17392 - DNA, 354 bp, Artificial Sequence
  Description of Artificial Sequence: Synthetic coding sequence
atgagccaatggaaccaggtgcagcagttagagattaaattcctggagcaagtcgatcaattctacgacgataattttccaatggaaataagacacctcctagcgcagtggattgagaatcaggactgggaggccgcaagtaacaacgaaactatggccactattctcttacagaatctgctgatccagctggacgagcagctcggtagagtctccaaagaaaagaatctgctcttaatccacaatctgaaaagaatccggaaagttttgcaaagtccaggcctggctacagctcagctgcccttagatagacacggagagacttgtatacaaaggtccaaatcttgcccatag

SEQ ID NO: 17393 - DNA, 78 bp, Artificial Sequence
  Description of Artificial Sequence: Synthetic coding sequence
atgagccagtggaaccaggttcagcagcttgaaataaagtttctggagcaggtagatcaattctacgacgacaattag

SEQ ID NO: 17394 - DNA, 240 bp, Artificial Sequence
  Description of Artificial Sequence: Synthetic coding sequence
atgtcccaatggaatcaggtgcagcagcttgagataaagtttctcgagcaggtggatcagttctacgacgataactttcccatggaaatccgacatcttctggcccagtggatcgaaaaccaggactgggaggccgcgagcaataatgagaccatggctacaatactcctccagaatctcctgattcagctggatgaacagcttgggcgagtgagtaaggaaaaaaacctgctcctgtag

SEQ ID NO: 17395 - DNA, 2385 bp, Artificial Sequence
  Description of Artificial Sequence: Synthetic coding sequence
atggctgggtggatccaggctcagcagcttcagggcgacgctctgcgacagatgcaggtgctgtacggtcaacatttccccatcgaggttcgccattacctggcccaatggattgagtcccagccatgggacgctatcgacttggataatccccaggacagagcccaggcaactcagttactggagggcctcgtgcaggagcttcagaagaaggccgagcaccaggtaggggaggacgggtttttgctgaaaattaagctggggcactatgccacccaactccagaaaacatatgataggtgtccgttagagctggtaaggtgtatcaggcacatcctctataatgaacaacgactggtgcgggaggcgaataattgtagctcccctgcgggtatcctcgtggatgcaatgtctcagaagcacttacaaataaatcagacattcgaagagctgcgcctcgttactcaggacacagagaatgaattaaaaaaattgcagcagactcaggaatatttcattatacaatatcaggaaagcttacgcattcaggcacagtttgcacagcttgcccagctcagtccccaagaacgactctctcgcgaaaccgccctgcaacaaaaacaggtatctcttgaggcatggttacagcgcgaagcccagacactccaacagtatagggttgagctggcagagaagcaccaaaaaaccctgcagctcctgaggaaacaacaaaccatcattctcgatgatgagctgatccaatggaaacgtaggcaacagctggcaggcaacggtggaccaccagaaggctcacttgacgtgctccagagctggtgcgagaaactggctgagatcatctggcaaaatagacagcagatcagaagagccgagcacctgtgccagcaacttccaatcccaggcccagtggaagagatgcttgccgaggtgaatgccacaatcaccgatattatcagtgctctcgtcacatccacctttattattgagaagcagcctccacaagtattaaaaactcaaacgaaatttgcagccactgttcgcctgctcgtcggcgggaaactcaatgttcatatgaatcctcctcaagtaaaggcaacgatcataagcgagcaacaggcgaagtcactgttgaagaacgagaatacccgcaatgagtgctctggggagatcctcaataactgctgcgtgatggaatatcatcaggcgaccggcaccttatcggcacattttcggaatatgtctttgaagcgtattaagcgagccgataggaggggcgctgaaagtgtgactgaggagaagttcaccgtcctttttgagtctcagttctcagtgggatcaaacgagctcgtcttccaggtgaagactctgtctctccccgtggtcgttattgtgcatggcagtcaggaccacaatgccactgccaccgtgctttgggacaatgcattcgcagagcccggcagggtcccctttgccgtgcccgataaagtgctttggccccagctgtgcgaagccctgaacatgaaattcaaagcggaagtacagagtaataggggccttaccaaagaaaatctggtgttcctggcccagaaactgttcaacaactcctcctcacacctggaagactatagtggtctgtctgtcagttggtcccagtttaaccgtgagaacctccccggctggaactatacattctggcagtggttcgatggcgtcatggaagtgctcaagaagcatcacaagcctcattggaatgatggagctatcttgggattcgttaataagcagcaagctcacgatctcctcattaataagccggatggtaccttccttctgaggttctctgacagtgagattggcggcataaccatcgcctggaagtttgactccccggaaagaaacctgtggaatctgaagccattcaccaccagggattttagcatcaggtcgctggccgatcgattaggagacctaagctacttgatttatgttttcccggatcgccctaaagacgaggtattcagtaagtattacacacctgtgctggctaaggcagtggacggttatgtgaaaccgcagataaaacaggtggtgccagagtttgtgaatgcctcggccgatgccggcgggagttccgccacctacatggatcaggcgccatctccagcagtctgtccacaggctccctacaacatgtacccacagaatccagatcacgtgttggatcaggacggcgaatttgatctggatgaaactatggacgtggcccgtcacgtggaggagctcctcagaaggcctatggactctctggacagtagattatcacctcccgcggggctcttcacaagcgcccgcggcagtttatcctag

SEQ ID NO: 17396 - DNA, 378 bp, Artificial Sequence
  Description of Artificial Sequence: Synthetic coding sequence
atggccggctggatccaggcgcagcagctgcagggtgacgcgctgcggcagatgcaggtcctttacggccagcactttcccattgaggtccgccactacttggcccaatggatcgagagccagccttgggatgcgattgacttggataatccacaggatcgggctcaggccacccaacttttggagggactggtccaggagttgcagaaaaaggccgagcaccaagtcggtgaagatggctttctactgaaaatcaagttgggtcactacgccacacaactgcaaaagacctacgatcggtgtccattggagctggtaaggtgcattagacatatactgtacaacgagcagagactcgttagggaggcaaataactag

SEQ ID NO: 17397 - DNA, 2376 bp, Artificial Sequence
  Description of Artificial Sequence: Synthetic coding sequence
atggcaggatggatacaggcacaacaactgcagggggacgccctccgccagatgcaggtgctgtatggtcagcattttcctatcgaggtgagacactaccttgcacagtggattgaaagccaaccttgggatgctatagatttggacaatccccaggatagagcgcaagccacacagctgctggagggcttagtgcaggagctgcagaaaaaggccgaacaccaggttggtgaggacggttttctccttaaaatcaaactcggacactacgccacgcagcttcagaaaacctacgatagatgcccattagagctagtcaggtgcatccgacacattctttataacgagcagagactcgtacgtgaggcgaataattgtagtagcccggcagggatactggtcgacgcaatgtcacagaaacatttacagatcaaccagaccttcgaagagctccgcctggtgacacaggataccgaaaacgaattaaagaagcttcagcagacccaggaatatttcatcattcagtatcaggaaagcctgcgaattcaggctcaattcgcccagctggcccagctgagccctcaagaacgactatcacgcgagactgccttacagcagaagcaggttagtctggaagcgtggttacaaagagaggctcagacgctccaacaatatcgagtggaactggccgaaaaacatcagaagacactgcagctgctgcggaagcagcagacgatcatcttggatgatgagttgatccaatggaaaagacgtcagcaactcgctgggaacggaggaccccccgagggctcactcgatgtcctgcagtcttggtgtgagaagctggccgaaatcatatggcaaaaccgccagcagatccggcgcgctgaacatctctgccagcagcttccaattcccgggccggtcgaagagatgctagccgaagtaaacgcaaccataacggacatcattagcgcactcgtcactagtacattcatcattgagaagcagccaccacaagtcctcaagacccagacgaagttcgccgcaaccgtgcggcttttggtgggtgggaagctaaatgtccatatgaaccctcctcaggtcaaggccaccataattagcgaacagcaagctaagtctctgctgaagaatgagaacacgcggaatgagtgctccggtgagattctgaataactgctgtgtcatggagtatcatcaagcaacggggacgttgagtgctcacttcagaaatatgtccctgaaacggatcaagcgcgcagaccggcgaggggccgaatcagttactgaagagaaatttacagtactgtttgagagccaattctcagtgggcagtaatgagctggtgtttcaggtaaagacgctctccctgcccgtcgtagtgatagtccatggctctcaggaccacaatgctacagcaacggtgctgtgggacaacgccttcgctgaacccggccgtgtgcccttcgcggtccctgataaggtgctatggccccagctgtgtgaggccttaaatatgaagtttaaagccgaggttcaaagcaacagaggtctgacaaaagagaacctcgtatttttggcccagaagctctttaataacagctcaagccacctggaggactactctggcctctccgtctcctggagccagtttaatagggaaaacctccctggatggaattatacattttggcagtggtttgacggcgttatggaagtgttgaagaaacaccacaaaccgcattggaatgacggcgggttcgtcaacaaacaacaggctcacgaccttctcataaacaaacccgatggtacgtttctactccggttttccgatagtgagatcggagggatcaccattgcttggaagttcgattctccagaaagaaatctgtggaacctgaagcctttcactacaagagacttcagcatccgcagtctcgccgacagactcggcgacctctcatatctcatttacgtattccctgaccgcccaaaggatgaggtctttagcaagtactacacgccagtccttgcgaaggcggtagatggatatgtgaaaccacaaataaaacaggtggtcccagagttcgtgaatgcctctgccgatgctggaggttcatctgcaacctatatggaccaggcaccaagtcctgctgtgtgcccccaggcgccttacaacatgtaccctcagaacccagatcacgtactggaccaagacggggagtttgatttagatgagacaatggatgtcgcccgccatgttgaagagttattgcgacgtcccatggattccctggacagcaggctctctccgccagcaggccttttcactagcgccaggggcagtctgtcatag

SEQ ID NO: 17398 - DNA, 2298 bp, Artificial Sequence
  Description of Artificial Sequence: Synthetic coding sequence
actgccatggccgggtggatccaggcacagcaactacagggcgatgccctgcggcagatgcaggtgttgtacggtcagcacttcccgatagaggtgagacattatctggcccagtggattgaaagtcagccgtgggacgctatagacctggataaccctcaagacagagcccaggccacacaactactggagggtctggtgcaggaattacaaaagaaggctgagcaccaagtgggcgaggacggattcctgctcaagatcaagctgggacactacgctacacagctgcagaagacctatgacagatgccccttggaactcgtgcgatgcatccgacatatcctatataatgaacaaaggctggtacgggaagcaaataattgttcctccccggcgggtatcctggttgacgccatgtcgcaaaagcatctccagatcaaccagaccttcgaagaactacgcttggtgactcaggatactgagaatgagctaaagaagctacagcaaacgcaagagtatttcattatccaataccaggagtctttgagaattcaggcacagttcgctcaactagcccagttgagcccgcaagagcgcctttctcgggagaccgcactccagcaaaagcaagtgtccctggaggcatggctgcagcgcgaggctcagacactgcagcagtaccgagtggaattggccgagaagcatcagaagacacttcagctcctgcgaaaacagcaaaccataatcctggatgatgagctgatccagtggaagcgcagacaacagttggccggcaatggaggccccccggagggcagcctggatgtgctccaatcatggtgcgaaaagctagcggaaatcatctggcagaacagacagcagattcgaagagccgaacatttatgccaacagctgcctataccagggccagtggaagagatgttggcagaggtgaacgccactataacagacattattagcgcccttgtgactagtacatttatcatcgaaaaacaacctccacaggtactgaaaacccaaaccaagttcgccgctaccgtcagactactcgtcgggggaaaactcaatgtccacatgaaccctccccaggtaaaagcaactattatcagcgagcagcaggccaagtcactgttgaaaaacgagaatacaagaaacgagtgctcaggagaaattctgaacaattgttgcgtgatggaatatcaccaggcaacaggcacactatccgcccactttaggaacatgagtttgaaaagaatcaagcgcgccgatagacgtggtgcagagtctgtaaccgaggagaagttcaccgtcttattcgagtcacagttttccgtcgggtccaatgagctagtctttcaagtaaagggacgggtgccctttgctgttccagacaaagtgctgtggccgcaactatgtgaggctttgaatatgaagttcaaagctgaagttcagtcaaatagaggcctcacaaaagagaatctagtgttcctggctcagaagttgttcaataatagctcctcccatttggaggattactcaggcctgtccgtctcatggtcccaattcaatagagaaaacttacctggttggaactatacattctggcaatggtttgacggggtgatggaagtactgaagaagcaccacaagccacattggaacgatggcgctattttgggctttgttaataaacagcaggctcacgatctccttatcaataaaccagatggaacatttcttctaagattcagtgattctgagattggcggaatcaccattgcatggaagttcgactcccctgaacggaacctctggaacctgaaaccttttaccaccagggacttctctattagatctctggccgatcgtcttggagatctttcttatttgatatatgttttcccggaccgaccaaaagacgaggtgttctccaaatattacacacccgtactcgccaaggccgtcgatgggtacgtcaaaccacagattaaacaggtcgtgccagagtttgtcaatgcgagcgcggatgcgggcggctcatccgccacatatatggatcaggcaccaagccctgcagtctgtcctcaagctccatataatatgtatccacagaatcctgaccatgttctagatcaggacggggagtttgaccttgatgaaacaatggatgttgcccgacacgtggaggagctactcaggaggcctatggattctctcgatagtaggctgagcccacccgccggtctgtttacttcagcccgcggatccctttcttag

SEQ ID NO: 17399 - DNA, 2295 bp, Artificial Sequence
  Description of Artificial Sequence: Synthetic coding sequence
atggccggctggatccaggcgcagcaactgcagggagacgctcttcggcaaatgcaagtcctgtacgggcagcactttcccatcgaggttaggcattacctcgcacaatggatcgaaagtcagccgtgggatgccattgacctcgacaatccacaggatcgggcacaggccactcaattgcttgaagggctggttcaagaactgcagaagaaggcagaacaccaggtcggagaggatggcttcctgctgaagataaaactcggtcattacgcaacgcagctgcagtgttctagtcccgctggcatccttgttgacgccatgtctcaaaagcatctacagatcaatcagaccttcgaagagctgcgcctggtcacacaggataccgagaatgagctcaaaaaattgcagcaaacccaagagtatttcatcattcagtaccaggaatcccttcgaatccaggctcagtttgcccagctcgcccagttgagtccccaggaacgacttagtcgagaaaccgcgttgcagcagaagcaggtaagccttgaagcctggctgcagcgggaagcacagactctgcagcagtatagggtggagctggcagaaaagcatcagaagaccctgcagttactgcgaaagcaacagacaatcatacttgatgacgagctcatccagtggaagcggcgacagcagctggctggaaatggcgggccaccggagggctcactcgacgttctccagtcatggtgtgaaaaactcgctgagataatctggcagaatcgccagcaaattcggagggccgagcacctgtgccagcagttaccgattcctggtccggtggaagagatgctcgctgaagtgaacgctacgatcaccgatataatttccgcactcgtgacaagtacattcataattgagaagcagcctccacaggtactgaaaacccagacaaagttcgccgcaaccgttcgactgttggtggggggtaaactcaacgttcatatgaatccccctcaagtgaaggctacaattatatccgagcagcaggcgaaaagtctgctgaagaacgagaacacacgcaacgagtgtagcggcgagatcctgaacaactgctgtgttatggagtatcaccaggctacagggacactcagcgcccacttcagaaacatgagcctcaagcgaataaaacgcgcagaccgtagaggcgcagagtcagtaacagaagagaaatttactgtactttttgagagtcaattctcagttgggagcaatgaacttgtgtttcaggtgaagactctgtctctgcctgtggtggtcattgtgcacggcagtcaggatcacaatgccaccgcaaccgttctttgggacaatgcctttgctgaacccggtcgcgttccattcgctgtgccagacaaagtgctgtggccgcagttatgcgaagccctgaacatgaagttcaaagccgaggtgcagagcaacaggggcctaactaaagagaatctggtgttcctggcgcagaaactgtttaacaacagcagcagtcatttggaggactattctggtctgtctgtcagctggtctcagttcaatagagagaatctgccaggctggaactatactttttggcaatggtttgacggtgttatggaggtgctgaagaaacaccacaagcctcactggaacgacggagcaatcctcggctttgtgaacaaacagcaggcacacgacctgctgataaataaacctgatggcacctttctgctgagattctcagattccgagatcggcggtattactattgcatggaaattcgattcacccgaacgaaacctgtggaatctgaaaccatttaccacccgcgattttagtatcaggtctctggctgacagattaggtgatctgtcgtacctcatttacgttttccccgatcgccctaaggatgaggtattctctaaatactatactccagtgctggccaaggccgtggatggttatgtgaaacctcagataaaacaggtcgtgcctgagttcgtcaacgcgtcggcagacgcaggcgggtcatctgcaacctacatggaccaggccccctcccccgcagtgtgcccccaggccccctataacatgtatcctcaaaatcctgaccacgtactggatcaggatggggagtttgacctggacgagacaatggacgtggcacgccatgtagaagaactcttaagacgccccatggacagcctcgatagtaggctcagccctccagccgggctctttacaagtgcaaggggctcactttcctag

SEQ ID NO: 17400 - DNA, 2295 bp, Artificial Sequence
  Description of Artificial Sequence: Synthetic coding sequence
atggcaggctggatccaggcccagcaattgcagggcgacgccctcaggcagatgcaagttctgtacggtcaacactttcccatcgaagtccggcattatctggcgcagtggatcgaatcccagccctgggatgcgattgatctggacaacccacaagacagggcacaggcaacgcaactcctggaaggacttgtccaggagttgcagaaaaaggccgagcaccaagtgggggaagatggattcttgctcaagataaagcttggacactacgcgactcagctgcagtgctcatccccagcaggcattttagtcgatgccatgtctcagaaacacctacagatcaatcaaactttcgaagaactacggctggtgacccaagatacagaaaacgagctgaaaaagttgcagcagactcaggagtatttcatcatccagtatcaggagtccttacgcatccaggcccaattcgcacagttagcccagctgtccccccaggagcggctgtcccgagagactgcgctccagcagaaacaggtgtccttagaagcttggttgcaacgggaggcccagacgctgcagcagtaccgcgtcgagctcgccgagaagcaccaaaaaacactgcagctgttgcggaaacaacagaccataattctcgacgatgagctcatacagtggaagaggcgtcagcagctggctggaaacgggggaccccccgaaggaagcctggacgtcctacagtcctggtgtgagaaactggcagaaataatttggcagaatcggcagcaaattagacgcgctgagcacctgtgccagcagttacccattccaggtcccgtcgaggagatgctggcggaggtgaacgcaacaatcacagacatcatctctgcgctcgttacgtcgacatttatcatagagaaacaacctccccaggtgttgaaaacacagaccaagtttgctgctactgtgagactcctggtgggcggtaagttgaacgtccatatgaatccccctcaagtcaaagctacaatcatatctgaacaacaggctaagagcctgctgaagaacgagaatacccgcaacgagtgttctggcgagatccttaacaattgttgtgtcatggagtaccatcaagcaactggaactttgtcagcacacttccgaaacatgtcactgaagcggatcaagcgtgctgatcgccgtggcgctgagtccgtgactgaggagaagttcacagtcctctttgagtctcagtttagcgtaggctccaacgaattggtcttccaggtgaagaccctcagtctgcctgtggttgtcatcgttcacgggtctcaggatcacaacgccacagcaactgtcctgtgggataacgctttcgccgagcccggccgagtaccctttgccgtcccagacaaagtgttgtggccacagctgtgcgaggctctgaacatgaagtttaaagccgaggtgcaatctaataggggccttactaaagaaaatcttgtttttctggcgcagaaattgtttaacaactctagctcccatctcgaagattactctgggctttcagtgtcgtggagccaatttaatagggaaaatcttccggggtggaattatacattttggcagtggtttgatggcgtcatggaggttctgaaaaagcaccacaagccccactggaacgatggagccatcctcgggtttgtgaacaagcagcaggcccatgacctactgattaataaaccagacggcacattcctactccgtttttccgattcagaaattgggggaatcacgatcgcctggaagtttgacagcccagagagaaacctttggaacctcaagcctttcacaaccagggacttttccattcgttctctggcagatcgcctcggggatcttagttacctcatatacgtctttccggatcggcctaaagatgaagtatttagtaaatactacaccccagtgctggccaaagcagtagacggctacgttaagccacagattaaacaggttgttcctgagttcgtcaacgccagtgccgacgctggggggtctagcgcgacttatatggatcaggcacccagcccagcggtttgtcctcaggcaccttataacatgtacccgcagaacccagatcatgtcctggaccaagatggagaatttgatttagacgagacaatggacgtggctagacacgtcgaagaactgcttagacggcccatggatagcttggacagccggctgtctcctcctgctgggttgtttaccagcgcacggggcagcctgtcctag

SEQ ID NO: 17401 - DNA, 2364 bp, Artificial Sequence
  Description of Artificial Sequence: Synthetic coding sequence
atggccgtttggattcaggcccagcaactacaaggtgaagctcttcaccagatgcaggcactctacggtcagcacttccccattgaggtaaggcattacctgtcccagtggatcgagtcccaagcctgggactcagtggacttggacaatccgcaggagaatattaaagccacccaactcctagaggggctggtacaggagctgcagaagaaggctgaacaccaggtaggggaagacggcttccttctgaaaatcaagctgggccactacgccacacagctgcagaacacctacgacagatgcccaatggaattagttaggtgtattagacatatcctgtacaacgagcagcgtttggtccgggaggcaaacaacggttcttctcctgccggcagcctggccgatgccatgagccagaagcacctccagattaaccagacgtttgaggagctcaggctcgtcacccaggatacggagaatgaactgaaaaagctacagcagactcaggagtattttatcatacaataccaggaatcactgcgcatacaggctcagttcggccccctggcacaactttcccctcaagaacggctgagtcgggaaacggctcttcagcaaaagcaagttagcctagaggcctggttacagagagaggcacagacgctccaacagtatagagtcgaacttgccgaaaagcatcagaagaccttgcaactgttgaggaagcagcaaactattattctggacgatgaactgatacagtggaaacgacgccagcaactcgccggcaacggagggccccccgaaggcagtctcgatgttttgcagtcttggtgtgagaaactggcggagatcatatggcagaataggcaacagatccggcgtgccgaacacttatgccagcagctgcctattcccgggcccgttgaggaaatgctggctgaagtgaatgctacaatcaccgatataatatccgccctggtaacctctacgtttatcatagagaagcagccaccccaagttcttaagactcagactaagttcgctgcgactgtgcgtttgttagtgggcgggaagctgaacgtacatatgaaccccccacaggtgaaggcgacgatcatttctgaacagcaggctaagagccttctgaaaaacgagaacacaagaaatgattacagcggggaaattctaaataattgctgcgtcatggaatatcaccaggcgacggggacactgtccgcccactttcggaatatgagtctaaagagaatcaagcggtccgatcggcggggagctgagtccgttaccgaagagaaattcacgatcttattcgagagccagtttagcgttggcgggaacgaactggtgttccaggttaagaccctctctctccctgtggtagtgattgttcatggcagccaggataataacgctactgccaccgtactgtgggacaacgccttcgctgagcccggacgagtgccatttgctgttccggacaaggttctctggccccagctctgtgaagctctgaacatgaaattcaaggcagaggtccaatctaataggggtctgactaaagaaaatctggtgttcttagcacagaagttgtttaacaactcctctagtcacctggaggattattccggactgagtgtatcctggtctcagttcaatcgggagaatttgcccggcaggaattatacgttctggcagtggtttgacggggtcatggaggtgctgaaaaagcatctaaagcctcattggaacgatggcgcaatcctgggcttcgtgaacaagcaacaagctcatgatctcttgataaataaacctgacggcactttcctgctcaggttctcagactcagagatcggagggatcaccatagcgtggaagtttgactcacaagaacgcatgttctggaacttgatgccgttcactacccgggatttcagcatacgatcgttagccgatagactcggcgacctcaattatctgatctacgtttttccggaccgccctaaagatgaagtgtacagcaagtattatactcctgtcccctgcgagagtgcgaccgccaaagccgttgacgggtatgtgaagcctcagatcaagcaggtcgtccctgaattcgttaatgctagcgcagatgcaggcggcggctctgccacctacatggatcaggctcctagccctgccgtctgtccccaggcccattataacatgtaccctcagaatcccgacagtgtacttgacaccgatggtgacttcgatctcgaggatactatggacgttgcccggcgggtggaggaattgctagggagacctatggatagccagtggattccccatgctcagtcctag

SEQ ID NO: 17402 - DNA, 471 bp, Artificial Sequence
  Description of Artificial Sequence: Synthetic coding sequence
atggccgtttggattcaggcccagcaactgcagggagaagccctgcaccagatgcaagctttgtacggccagcactttcccattgaggtgcgccactacctgtctcaatggatcgaatctcaagcttgggactcggtcgacctcgataatccccaggagaacattaaagcaactcagcttttagagggtttggtccaggagctccaaaagaaggccgagcaccaggtgggagaagacggattcttactgaaaatcaagttgggacattacgccacgcagctgcagaatacctatgaccgctgtccaatggagctggtccgctgcatccgccatattctatataacgagcagcgcctggtgagagaggctaacaatggaagcagtcctgcagggtccctggccgatgccatgagccaaaaacatctgcagatcaatcaaaccttcgaggaactgaggctggtgactcagtag

SEQ ID NO: 17403 - DNA, 534 bp, Artificial Sequence
  Description of Artificial Sequence: Synthetic coding sequence
atgcctcaggccttcctcctggggagtatccacgagcccgctggcgcccttatggagcctcagccatgcccaggctccttggccgaaagctttctggaggaggaactgcgtctgaacgccgagctctcccagttacagttctcggaaccggtaggcattatctacaacccggtcgagtacgcttgggaaccacatagaaattacgtcaccagatactgccagggcccaaaggaggtgttatttctcgggatgaatccaggtcccttcggcatggcccaaaccggcgtacccttcggcgaagtgtccatggtcagagactggctggggatcgtcggtcccgtgctgacaccaccccaggagcatcccaagcgtcccgtactgggcttggaatgcccacagtcagagggccccaggcagagcatgggacacgaaatcaaatcagagctactgatgggcggttgttcatggattcgggggaagatacagtgtgatagggtacaggtgcggcgcccaggtttttcctctcaactgtag

SEQ ID NO: 17404 - DNA, 813 bp, Artificial Sequence
  Description of Artificial Sequence: Synthetic coding sequence
atgccacaggctttccttcttggctctattcatgaacctgccggagccctgatggaacctcagccatgtcccgggtctctggcggaatctttccttgaagaggagctaagactgaacgcagagctgtcgcagctgcagttcagcgaaccagttggaattatttacaatcccgtggagtacgcctgggagcctcatcggaattacgtaacacggtattgccagggccccaaagaggtgctgttcctggggatgaatcccggcccctttggaatggcccagactggcgtgccttttggtgaggtctccatggtgcgtgactggcttgggatcgttgggcctgtgctgaccccaccccaggagcatcctaaacgaccggttctcgggctcgagtgtccccagtctgaggtgtctggagctaggttctggggctttttcaggaacctgtgtgggcaaccagaagtgttcttccaccactgtttcgtacacaacttatgccctcttttgtttttagcaccgagtggtcgtaatctgacccctgcagagctgcctgcaaagcagcgggagcagcttctgggcatctgcgacgcggcactctgtcgacaagtacagctcctgggggtgaggcttgttgtgggcgtgggcaggctggccgaacagagagcaagacgcgctctcgctggcctgatgcctgaggttcaggtcgagggtctgctgcatcccagtccccgaaacccacaagccaataaaggatgggaagctgtggccaaggagagactgaacgagctgggattactgcccttgctcctaaaatag

SEQ ID NO: 17405 - DNA, 813 bp, Artificial Sequence
  Description of Artificial Sequence: Synthetic coding sequence
atgccccaggctttcttattaggctccatccatgaacccgccggggcactgatggaaccacagccttgtcctggctccctggctgagagttttttagaagaggagcttcggttgaatgcagaactaagccagctgcagttttctgagcccgttggaattatctataacccagtggaatacgcttgggaacctcatcgcaattacgtgactaggtactgccaaggacccaaggaagtgttgtttcttgggatgaaccccggcccttttggcatggcccaaactggagtcccttttggcgaggtgagcatggtgcgcgactggcttggtattgtcggacctgtgctgacaccccctcaggaacaccctaaacgaccagttcttggtctggagtgcccccagagcgaagtcagcggtgcacggttctgggggtttttcagaaacctatgtggacagcctgaggtctttttccaccattgcttcgtgcataacctgtgccctctcctgtttctggcaccaagtggacggaatctgacaccagctgaactgcctgctaagcagagggaacagttactcggaatctgtgatgcagcactctgtagacaggttcagctgcttggagtgcgcctggtagtaggagtcggccggttggccgagcaacgagctcggcgcgcactcgccggtcttatgcccgaagtgcaggtagagggcctcctgcatccatcgccacgcaatcctcaagcaaacaaagggtgggaagctgtggccaaagaacgcctaaacgagctgggcctcttgcccctcttgttgaagtag

SEQ ID NO: 17406 - DNA, 249 bp, Artificial Sequence
  Description of Artificial Sequence: Synthetic coding sequence
atgccacaggccttcctcctcgggagcattcacgagccagctggagcactcatggagccacagccatgccccgggtcactggcagagtccttcctcgaggaggaactgcggctcaatgcagaactgagccagttgcagttttccgagccagtgggaatcatttacaatcctgtggagtacgcctgggaaccccataggaattatgtcacccgttactgtcaagggccaaaggaagtgctcttcttatag

SEQ ID NO: 17407 - DNA, 519 bp, Artificial Sequence
  Description of Artificial Sequence: Synthetic coding sequence
atgccccaggctttcctgcttggaagcatccacgaacccgccggggctctcatggaaccccagccctgtcctggaagcctggccgaatccttccttgaagaagaactgcggctgaacgcggagcttagccagctccaattctctgagcccgtcggtatcatatacaacccggttgaatacgcttgggagccacatcggaattatgtgacaaggtactgccaagggcctaaggaggttctgtttctgggcatgaacccggggcctttcgggatggcccagacaggcgttcctttcggtgaggtcagtatggttagggactggctaggcattgtaggtcctgtgttaactcctccgcaagaacaccccaagaggccagtgctcggccttgaatgtccacaaagtgaggtctccggggctaggttttggggcttcttccgcaacctgtgtgggcaacccgaggtcttcttccatcattgttttgtgcacaacctttgtcccctcctgtttctggcaccttag

SEQ ID NO: 17408 - DNA, 291 bp, Artificial Sequence
  Description of Artificial Sequence: Synthetic coding sequence
atgccacaagcattccttctgggatcgatccatgagcccgccggggcactgatggaaccgcagccctgcccggggtctctagctgaaagcttcctggaggaggagctcagactgaacgccgaattaagtcagctgcaattctcagaacctgtggggattatttacaatccagtggaatacgcttgggagcctcatagaaactacgtgacaaggtattgtcagggtccaaaggaggtgctattcctggggatgaatccaggcccattcgggatggcacaaacaggagtctag

SEQ ID NO: 17409 - DNA, 273 bp, Artificial Sequence
  Description of Artificial Sequence: Synthetic coding sequence
atgccacaagcatttctgctgggaagcatccatgagcccgcaggcgcattaatggagccacagccgtgtcctggctctctcgcagagtccttccttgaggaggaactgcgactgaatgcggaattaagccagttgcagttttccgagcccgtgggcatcatctataatcctgtggaatatgcttgggagccccacaggaattacgtgacaaggtactgccagggccccaaggaggttctgtttctgggtatgaacccagggccatttggatag

SEQ ID NO: 17410 - DNA, 534 bp, Artificial Sequence
  Description of Artificial Sequence: Synthetic coding sequence
atgcctcaggcttttctgctcgggtccatccatgaacccgcaggtgccctaatggaaccacagccctgcccaggcagtctagctgagagcttcctggaggaagagctcaggcttaacgccgaacttagccaactgcagttcagcgaaccggttggcataatctataaccccgttgagtatgcatgggagccacacagaaattacgtcacccgctattgccaggggccgaaggaagtgctgtttctgggtatgaatcccgggcctttcgggatggctcagaccggcgttcccttcggcgaggtcagcatggtgagggattggttgggcattgtagggcccgtgttaacacctcctcaagaacaccctaaacgtcccgtccttggccttgagtgtcctcaaagtgagggcccccgtcagagtatggggcacgagatcaagtccgaattactgatggggggctgttcttggatcaggggtaaaattcaatgcgaccgtgtgcaggtccgaagaccaggatttagctcccaattgtag

SEQ ID NO: 17411 - DNA, 327 bp, Artificial Sequence
  Description of Artificial Sequence: Synthetic coding sequence
atgccacaggcattcctgctcgggtctattcacgaacctgccggcgcactaatggaacctcagccctgtccgggttctctcgccgaaagtttcctggaggaagaattgaggctgaatgccgagctgtctcaactgcaattttccgaaccagttggaataatctataatccggtcgagtacgcctgggagccccataggaactatgttacacggtactgccagggaccgaaagaagtactgtttttaggtatgaatcccggcccgttcggcatggcacagacaggagttcctttcggcgaggtgtccatggttagagattggctgtag

SEQ ID NO: 17412 - DNA, 813 bp, Artificial Sequence
  Description of Artificial Sequence: Synthetic coding sequence
atgccacaagcctttctgctgggaagcatacacgaacccgctggggcccttatggaaccccaaccgtgccccgggagccttgcagaaagcttcctggaagaggagctgcgcttgaacgcagagctgagccagctgcaattctcagagccggtgggtatcatttacaacccagtcgagtacgcttgggagccacacagaaattacgtgaccagatactgccagggacctaaagaagtgcttttcctggggatgaatccaggccctttcggtatggcccagaccggagtaccttttggagaagtgagtatggtgcgggactggctcggaatagtcgggcccgttctcacgcctccacaggagcatccgaagcgacccgttctggggctggagtgcccacagtccgaagtgtcaggcgcaagattctgggggtttttccggaatctgtgcgggcaacccgaggtattcttccaccattgtttcgtgcataatctgtgtccactcctctttttggccccctccggtagaaacttgactcccgccgagctgcctgctaagcagagagagcagttgcttggcatttgcgatgcggcgctctgtcgacaagtccaactcctgggcgttcgactcgttgttggggtgggacggctggccgaacaacgcgcacgaagggccctcgcaggactgatgcctgaagtgcaggtcgagggacttttacatccatccccacgaaatccgcaagcaaacaagggatgggaggctgtggccaaggagcgactcaacgagctcggtctcttgccgctccttctgaaatag

SEQ ID NO: 17413 - DNA, 534 bp, Artificial Sequence
  Description of Artificial Sequence: Synthetic coding sequence
atgccacaggcctttctgctaggctccatccacgagccagctggagccctaatggagccacagccttgcccaggatcacttgccgagtccttcctggaggaggagctccgcctgaacgcagagcttagccagctgcaattttctgagcccgtcggcattatctataacccagtagagtatgcctgggaaccccaccgaaattacgtgacccggtattgccaaggacccaaggaggttctgttcctgggaatgaatccgggcccttttgggatggctcagactggcgtgccatttggtgaggtcagcatggtgcgggactggctgggaatcgtcggacccgttttgacacctccacaagagcacccaaagcgaccagtacttggtctggaatgtccgcagtcagagggcccccgacaatctatgggtcatgagataaagtccgaactcctgatgggcggttgctcctggatcagagggaaaattcagtgtgacagagtgcaggtccgccggcccggattctcgagccagctgtag

SEQ ID NO: 17414 - DNA, 534 bp, Artificial Sequence
  Description of Artificial Sequence: Synthetic coding sequence
atgcctcaggctttcttgttaggatcgattcatgagcccgcaggcgcactcatggagccgcagccgtgtcctggaagtctggcggagagcttcctagaggaggagctccgcctgaacgctgaattgtcacagctccaattcagtgagcccgttgggatcatctataatcccgtggaatatgcttgggagccgcatcggaactacgtgacccggtactgccagggacccaaggaggtcctctttcttgggatgaatccaggtccattcgggatggctcagacaggagtcccattcggagaagtctcaatggtgagggactggttaggcatagtgggacccgtccttaccccacctcaggaacacccaaagagacccgttctggggctcgagtgccctcaatctgaggggcctcgccagagcatgggtcatgaaatcaaaagcgaacttttaatgggcggctgcagttggatccgtggcaagatccagtgtgatagggtgcaggtgaggcgacccggcttcagctcgcagctgtag

SEQ ID NO: 17415 - DNA, 1170 bp, Artificial Sequence
  Description of Artificial Sequence: Synthetic coding sequence
atggccgagccagacccatcccaccccttggaaactcaggctgggaaggtgcaggaagcgcaggacagcgatagcgacagtgaagggggagcagccggtggcgaagctgacatggactttcttagaaacctgttctcacaaactctgtcattaggcagtcagaaggagcggttgctggacgaactcaccctcgaaggtgtcgcaaggtacatgcaaagcgaacggtgtaggcgagtcatctgcttggtgggcgctggaatctccacctctgctggcatcccagattttagaagcccatcgacaggcctatacgacaaccttgagaaatatcatctaccttatcccgaggctatcttcgaaatctcttacttcaaaaaacaccccgaaccattctttgctctcgccaaagagctataccccggccagttcaagccaacgatctgccactacttcatgcgccttctcaaggataagggtctgctgttaaggtgctacacccaaaacatagataccttagagcggattgcaggcctggagcaagaggacttagttgaagcccatggaactttttacacaagtcactgcgtatctgcctcctgcagacacgagtatccattgtcttggatgaaagaaaaaatcttctcggaagtcacaccaaaatgtgaagactgtcagagcctggttaagcccgacattgtgttcttcggggagtccctgcctgctcgctttttttcctgcatgcagtctgatttcctgaaggtggacttgttgttagtgatggggacttcccttcaggtgcagccgttcgcatctctgatctctaaggcccccttgtctacccccagactgctgataaacaaagagaaggcagggcagtccgaccccttcctgggcatgattatgggactggggggtgggatggactttgacagtaaaaaagcttaccgcgatgttgcttggcttggagagtgcgaccaggggtgtttggctctcgctgagctgctgggctggaagaaggagctggaggacttggtgcgaagagaacacgccagcattgatgctcaatccggggctggtgtcccaaaccccagtacttcagcatcccctaagaagtctcctccaccagcaaaggatgaggctagaaccaccgagcgagaaaaaccacagtag

SEQ ID NO: 17416 - DNA, 816 bp, Artificial Sequence
  Description of Artificial Sequence: Synthetic coding sequence
atggccgagccggatccgagtcatccccttgagacgcaggctggtaaggtacaagaggcccaagactctgactccgacagcgagggcggcgcagctggcggggaagcagatatggatttcctgcgcaatttgttttcacagaccctatcgctgggatctcagaaagagcggcttctggacgagctgacccttgagggtgtagcccgctatatgcagagtgaacgatgtcggcgggtaatctgtctcgtgggggctggcatttccacctccgccggcatccccgacttccgatctccatctacaggactctacgacaatctggagaagtaccacctgccatacccagaggccatcttcgaaatctcatactttaaaaagcaccccgagccattcttcgcattggccaaggagttatatcctggacaattcaagccgacgatttgtcattatttcatgcggctccttaaagataagggtttgctcttgagatgttatacccaaaatatagacacgctggagcggatcgcaggtttggaacaagaggatctggtcgaggcccacggtacgttttacacttcacactgtgtctccgcaagctgccgccacgagtatcctctgtcgtggatgaaggagaagatattttctgaagtgaccccaaaatgtgaggactgtcaatcacttgtgaaacccgacatcgtgtttttcggggaatcattgccggcccggttcttcagttgcatgcagtcagatttcctcaaagttgacctgctgctagtaatggggacgagcttgcaaggcaggggtctcgcaggctag

SEQ ID NO: 17417 - DNA, 393 bp, Artificial Sequence
  Description of Artificial Sequence: Synthetic coding sequence
atggatttccttcgcaatctattcagtcagaccttgagtcttggctcacaaaaagagagactcctggatgaattaaccctggaaggtgtggcccggtatatgcagagcgagaggtgccgaagagtgatctgcttagtcggggcaggcattagcacatccgctgggattccagactttcgaagtccctccaccgggctgtacgataacttggaaaaataccatttgccttacccagaggcaatcttcgagatttcctattttaaaaagcacccagagcctttcttcgcccttgctaaggaactctatcctgggcagtttaagcccacgatttgtcactatttcatgcggctgctgaaggacaaaggtctgctgctcaggtgctacacacagtag

SEQ ID NO: 17418 - DNA, 1059 bp, Artificial Sequence
  Description of Artificial Sequence: Synthetic coding sequence
atggatttcctgcgcaatctgttctctcaaaccttgtctctcggaagccagaaagaacgccttctggacgaactcactctggagggtgtggcacggtatatgcaaagtgaacggtgccgccgggtgatctgcctggtgggggcaggaatctcaacctccgctggcatccctgattttcggtcgccctcaaccggactgtacgacaatttggagaagtaccacctgccctacccggaagccatcttcgagatctcttattttaaaaaacaccccgagccgttttttgccctagcaaaggaactttaccccggtcagttcaaacctaccatttgtcattattttatgcggctcctgaaagataagggtctcctgctgcgctgctatacccaaaacatcgacaccttggaacggattgcaggtctcgaacaggaagacctggttgaggcccacggtacattctatacctcccactgcgtttccgcgagttgcaggcacgaataccctctgagctggatgaaggagaagatctttagcgaagtgacccctaagtgtgaggactgccagtctctagtgaaacctgacatcgttttctttggggagagtctgcccgcaaggtttttcagctgcatgcagagcgatttcttaaaggttgacctacttctggtgatgggtacttctctccaggttcagccatttgccagcctgatctctaaagctcccctttctaccccaaggctgcttattaacaaagagaaagcaggacagagtgacccttttctgggaatgatcatgggcctggggggaggcatggatttcgactccaaaaaggcgtaccgcgacgtggcttggcttggagagtgtgaccagggttgcttggctttggctgagttgctgggatggaaaaaagaattggaagacctcgttaggcgggagcacgcttctatcgatgctcagagtggggctggcgtgccgaacccctctactagcgctagccctaaaaaaagtcctccccctgctaaagacgaagcaagaacgaccgaacgggagaaacctcagtag

SEQ ID NO: 17419 - DNA, 510 bp, Artificial Sequence
  Description of Artificial Sequence: Synthetic coding sequence
atggactttctgcgaaatttattcagccagactctttcgcttgggtcacagaaggaaagactgctggacgagttgacactggaaggtgtagcccgttatatgcaaagcgagaggtgcaggcgtgtcatatgcctggtcggcgctgggatcagcaccagcgccggcattcctgattttagaagtccctccaccggtctgtacgacaatctggaaaaatatcacttaccttatccagaggcaattttcgagatcagctatttcaagaaacatcctgagccttttttcgccctcgccaaggagctgtacccaggccaattcaagcctaccatctgtcactatttcatgcggctgctcaaggataaaggactactgcttaggtgctatactcaaaatattgatacactggaacgcattgcaggtctggaacaggaggatctggttgaggcgcatggaaccttctatacttcccattgcgtttcagcctcctgccggcacgagtatccgttgtag

SEQ ID NO: 17420 - DNA, 714 bp, Artificial Sequence
  Description of Artificial Sequence: Synthetic coding sequence
atggattttctgcgcaacctgttctcacaaaccctgtctttgggaagccagaaggaaaggcttctggacgaactaaccttagagggtgtcgctcggtatatgcaatcagagcggtgcagacgggtcatatgcctcgtcggagccgggatctccacaagtgccggcataccggacttccggtctccctctaccgggctgtatgacaacctggagaagtatcatttaccatacccagaggccatttttgagatcagctatttcaagaagcaccccgaacctttttttgcccttgctaaggaactttatcctggccagttcaaaccaaccatctgtcactattttatgagactgctaaaggacaagggacttctcctgcggtgctacacgcagaatattgatacactggagcggatcgcggggcttgaacaggaagacttggtcgaggctcatgggacattttacacgtctcattgcgtgtccgcaagctgccgtcacgaatatcctctgagctggatgaaggagaaaattttcagcgaggtcacgcccaaatgtgaggattgccagagtctcgtaaaacctgacattgtcttcttcggggagagcctgccagccagatttttctcctgcatgcagtcggacttcctcaaggtggaccttctgcttgtaatgggcacatcccttcaggtgcagccattcgcatctctcatcagctag

SEQ ID NO: 17421 - DNA, 237 bp, Artificial Sequence
  Description of Artificial Sequence: Synthetic coding sequence
atggactttctaagaaatcttttctcacagacactgtccctcggatcgcaaaaagagcgtctgctggacgagttgacgcttgagggcgtggctcggtacatgcagtctgagcgatgtaggcgagtgatttgtctggtgggggccgggatctctacgtcagcaggcattccggacttccgaagcccatctaccggcctctatgacaacctggaaaaatatcatttaccatatccgtag

SEQ ID NO: 17422 - DNA, 222 bp, Artificial Sequence
  Description of Artificial Sequence: Synthetic coding sequence
atggatttcctccggaacctcttcagtcagactctttctctggggtcccagaaggagaggctgcttgacgagcttaccctagaaggtgtagccagatatatgcagagcgagcgatgtaggcgtgttatctgtcttgttggggccggtatatcgacctccgccggtatcccagactttcgctctccgtccactggtctctatgataaccttgagaaatattag

SEQ ID NO: 17423 - DNA, 1170 bp, Artificial Sequence
  Description of Artificial Sequence: Synthetic coding sequence
atgtcagacgaggcagaggattccgacagcgactccgaagggggcgctgccggcggtgaagcagacatggatttccttcgaaacctcttcagtcagactctgtctctgggctcccagaaggaacgactgttggacgagctgacgctagagggtgtggctaggtatatgcaatccgagagatgccggagggtcatctgtctcgttggcgctgggatttccacgagcgctggcataccagactttagatccccatcaacaggtctgtatgacaatctcgaaaaataccaccttccctatccagaggctatattcgagataagttactttaagaagcaccccgaacccttcttcgccctcgcaaaagaattatatcctggtcagtttaagcctacaatctgccactacttcatgaggctgctgaaagacaagggcctgctgcttcgctgctacacgcaaaacatcgacaccttggagaggatcgccgggttagagcaagaagacctagtggaggcccacggcaccttctacactagccattgtgtgagcgcatcttgccggcacgaatatccgctctcatggatgaaggaaaaaattttttccgaagtcacgcccaaatgcgaggactgccaatccttagtgaaaccggacatagtgttctttggcgaaagtctgccagcccggttcttcagctgcatgcagagcgacttcctaaaggttgacctactccttgtgatggggacgagtctgcaagtgcagccatttgctagcttaatctctaaggcccctctgtccacacctaggttactcattaataaggagaaagctggacaaagtgatccgttcctgggcatgattatgggcctggggggggggatggatttcgattcaaagaaagcatacagagatgttgcttggctgggtgagtgcgatcaaggttgtttagcactcgctgagctgctgggctggaaaaaggagctcgaggacctggtacgcagggaacatgcatcaattgatgcccaaggaggaggcggacctcagcctcagcatttctcgttccctcaggaggtgcctgccacatgccagggcaggggccaggataacagagagggtgagacccccgtcacagcagcgtcccctcgcagggatgcagagctcttgagggactcttag

SEQ ID NO: 17424 - DNA, 1227 bp, Artificial Sequence
  Description of Artificial Sequence: Synthetic coding sequence
atggcggaaaatggtgacaacgaaaagatggcagcgttagaggctaaaatctgtcatcaaatcgaatactacttcggagattttaacctccctcgagacaaatttctcaaggaacagattaagctagatgaaggttgggtgccactcgagatcatgatcaagttcaacaggttaaaccgactgactaccgattttaatgtgatcgtcgaggccctatctaaaagcaaagcggagctgatggaaatctccgaggataagacaaaaatcaggagatctccctcaaagccactaccggaggtgacagacgagtacaagaatgacgtgaaaaaccgttctgtatatatcaagggttttccaacggatgctaccctcgatgatatcaaggaatggctggaggataaaggccaggtcctcaatatccagatgcggcgcactctccacaaggccttcaaaggttcgatctttgtggtgttcgacagcatcgagtctgccaagaagttcgtggaaacacctgggcaaaagtacaaggagaccgatctgcttatactgttcaaggatgactattttgcaaagaagaacgaggagagaaagcaaaacaaagtggaggcgaaactgcgggcaaagcaggagcaggaagctaaacagaagcttgaggaagacgcagaaatgaaatctctggaagagaagattgggtgtctcctgaagttttccggtgatctggacgatcagacctgtcgggaggacctgcatatccttttttctaaccatggggagatcaaatggatcgacttcgtacgaggtgcaaaggaaggtatcatattatttaaagaaaaagccaaggaggcactggggaaggccaaagatgcaaataacggtaatctgcagttaaggaataaagaagtaacttgggaagtgctggaaggcgaagtcgagaaagaggccttgaaaaagatcattgaggatcagcaggagtcccttaataaatggaaatccaaaggaagacggtttaaagggaagggtaaagggaacaaagccgcacaaccgggatccggtaaaggcaaggtgcagttccaaggcaagaagacaaagttcgcctccgacgacgagcacgacgaacacgacgaaaacggagccaccggccccgtgaagagagccagggaggagacggacaaagaagagcccgcgtccaaacagcagaagactgaaaacggagctggagaccagtag

SEQ ID NO: 17425 - DNA, 1086 bp, Artificial Sequence
  Description of Artificial Sequence: Synthetic coding sequence
atggccgagaacggggataacgagaagatggcggcactagaggccaaaatctgccaccagatcgaatactattttggtgactttaacctccctcgagacaaattcctgaaagaacaaattaagcttgacgagggctgggtgccccttgagattatgatcaagtttaaccggctcaacagactgactaccgattttaatgtcatcgtggaagccctctccaagtccaaggccgaactaatggagatttcagaagataaaacaaagattaggcggtccccaagcaaaccgttgccggaggtgacagatgagtataagaacgacgtgaagaaccgttcggtgtatataaagggctttcctacagacgctaccctggacgatatcaaagagtggctcgaggataaagggcaggttttgaatattcagatgaggcgtacgctgcacaaggcctttaaagggtccattttcgtcgtattcgactccattgagagcgcaaagaagtttgttgaaacccctggccaaaagtacaaagagactgatctgctgattctttttaaggatgattacttcgccaagaagaacgaagagcgtaaacaaaacaaagtagaagccaagttgcgggctaagcaggagcaagaggccaagcagaagctggaagaagatgcagaaatgaagtctttggaggagaagatcggctgcctcctgaagtttagtggggatctcgatgaccagacctgtagggaggatctgcacatccttttttcgaaccatggcgaaatcaaatggatagattttgtgcggggagccaaagagggaatcatcctctttaaagaaaaggcaaaagaagcgctcggaaaagcaaaagacgccaataatggcaacctgcaactgcgtaacaaagaggtgacctgggaagtcctggagggagaggtggagaaagaagcattgaagaaaatcattgaagaccagcaagaaagcctcaataagtggaagagcaagggacctgtcaaaagagctcgggaggagaccgacaaggaagaacccgcatccaaacagcagaaaaccgagaacggtgccggagaccagtag

SEQ ID NO: 17426 - DNA, 1227 bp, Artificial Sequence
  Description of Artificial Sequence: Synthetic coding sequence
atggcagagaacggtgacaatgagaagatggccgccttggaggccaagatttgtcaccagattgagtattattttggcgactttaacctgcctcgtgataaatttctgaaagagcagattaaactggacgaagggtgggttcccctggagattatgattaagttcaatcgtctcaatcggctcaccacagacttcaacgttatagtggaggccttgagcaaatcaaaagcagaactgatggagatctcggaagacaaaaccaagattagaaggagtccgagcaagccccttcccgaagtaaccgacgagtataagaacgacgtcaaaaatcggagcgtttatatcaaaggatttcccactgacgcgactctggacgacatcaaagagtggctggaggataaggggcaggtgctgaatatacagatgcgacggactctgcacaaagccttcaaggggtctatcttcgttgtcttcgacagtattgagagcgccaagaagtttgtggagactccggggcagaagtacaaggaaacagatctgctgatattattcaaagacgattattttgctaaaaagaatgaggagcgaaagcagaacaaagtggaagcaaaactccgcgctaaacaggaacaagaagctaagcagaaactggaagaagatgcagaaatgaagagtttggaagagaagatcggatgcctactgaaattctctggcgatcttgacgaccagacctgccgggaggatctacacatccttttcagcaatcacggtgagatcaagtggatcgatttcgtaaggggcgcaaaggagggaatcatcctattcaaggagaaggcaaaagaggccttaggaaaggctaaggatgcaaataacgggaatctgcagttgcgaaataaggaagttacgtgggaagtcctcgaaggggaggtcgaaaaggaggctctgaagaaaatcattgaagaccagcaggagtcactgaacaagtggaagtctaaaggacgaaggttcaagggcaaaggcaagggaaacaaggccgctcaacctggcagcgggaagggaaaggtgcaatttcagggcaagaagaccaagtttgcaagtgatgatgagcacgatgagcatgatgagaatggcgcaaccggccccgtgaagagagcccgagaggaaacagacaaggaggaaccggcctccaaacaacaaaaaaccgagaatggagctggggaccagtag

SEQ ID NO: 17427 - DNA, 405 bp, Artificial Sequence
  Description of Artificial Sequence: Synthetic coding sequence
atggccgagaacggggacaatgagaaaatggctgcactcgaggcgaagatctgccaccaaatcgaatattacttcggcgactttaatctgccaagggataaatttttgaaggaacagataaaactggacgagggctgggtaccactggagatcatgataaagtttaacagactaaatcggctcaccacggacttcaacgtgatcgtggaggccctgtccaagtctaaggcagaacttatggaaataagcgaggacaaaaccaaaataagacgcagcccaagcaaaccactccccgaggtgaccgacgagtataagaacgacgtcaagaataggtcagtctacatctcccacccagtggcacacgttggtgtgcagtggtgtgaccatgggccactccagagttag

SEQ ID NO: 17428 - DNA, 363 bp, Artificial Sequence
  Description of Artificial Sequence: Synthetic coding sequence
atgattaagttcaacaggctcaatcgcctgactacagacttcaacgtgatagtcgaagctctgagcaagtcaaaagctgaattaatggagatcagcgaggacaagaccaagattaggcgctccccttcaaaacctctcccagaagtgaccgatgagtataagaacgatgttaaaaatcggtctgtgtatattaaagggtttccaacagatgctacactagatgatatcaaggagtggttagaagacaagggacaagttctgaacattcagatgaggcgtacattacataaggcgttcaagggctcaattttcgtagtcttcgactccattgagagtgccaagaaatttgtggagaccccttag

SEQ ID NO: 17429 - DNA, 555 bp, Artificial Sequence
  Description of Artificial Sequence: Synthetic coding sequence
atggcagagaatggcgacaatgaaaagatggccgctctcgaagcaaaaatctgccatcagattgaatactactttggtgattttaatctcccccgtgacaagtttcttaaggaacagatcaagctggatgaaggatgggtgccactcgagattatgattaagtttaatcgcctcaatcgcttaaccactgattttaatgtcatagtggaagctctcagcaagtctaaggccgagctaatggagatctctgaggataagacgaaaatccgcaggagcccaagcaagccactgcccgaggtcactgatgagtacaagaatgacgtgaaaaaccgatcagtctatataaaaggatttcccacggacgccacgcttgatgatatcaaggagtggctcgaagataagggccaggtgttaaacatccagatgcgccggactctgcacaaagccttcaaggggagcatctttgttgttttcgactccatcgaaagcgcgaaaaagttcgtcgagacaccaggccagaagtacaaagaaactgacttgctgattctgttttag

SEQ ID NO: 17430 - DNA, 252 bp, Artificial Sequence
  Description of Artificial Sequence: Synthetic coding sequence
atgagaaggactctacacaaagccttcaagggttccatattcgtcgtgttcgacagcatcgagtccgcaaagaagtttgtggagacaccgggtcagaaatataaggagaccgatttgctgatactctttaaagacgactatttcgcaaagaaaaatgaagagagaaagcaaaataaagtagaggccaagttgcgcgctaagcaagagcaggaagccaaacagaaactggaggaggacgccgagatgaaatag

SEQ ID NO: 17431 - DNA, 5505 bp, Artificial Sequence
  Description of Artificial Sequence: Synthetic coding sequence
atgaagctgagcgtcaatgaagcgcagcttggattctatctcggttcactctcacatctgagtgcgtgtcctggcatcgaccctagaagctcagaagaccagccagaaagcctgaaaaccggtcaaatgatggacgagtccgacgaggacttcaaagagctgtgcgcgagctttttccagagggtcaagaagcatggtataaaagaagtgtcaggcgaacgaaagactcagaaagctgcgtccaacggtacccaaattcggagcaagttgaagcgcaccaagcagacagcaactaagacaaagactttgcagggccctgcggagaaaaaaccaccatctgggagccaggctccgagaacaaagaaacagcgggtgacaaaatggcaggcatccgaacccgcacattccgtgaacggggagggcggggtgctggccagcgctccggacccacccgttctgcgcgaaacagctcagaacactcaaactggaaatcagcaggagccctcccctaatctgtcccgcgagaaaacacgcgagaatgtgcctaacagtgattcccagccccctccaagctgcttaacgactgctgtgccttctcccagcaagccaagaaccgcgcagcttgtattgcaaagaatgcagcagtttaaacgtgctgatccagagcggctcagacacgcctcagaagagtgttcattggaagcagccagagaagaaaacgtccccaaagaccctcaggaagagatgatggcgggcaatgtttacggtctggggccacccgccccggagagcgatgctgctgtggcccttactttgcagcaggagtttgcccgggtaggcgcttccgcacatgatgacagtttagaagagaaaggactgtttttctgtcagatctgccaaaaaaatctttccgccatgaatgtgacacgacgggagcaacatgtgaaccgctgcctcgatgaagccgaaaagactctacgtccgtcagtgccgcaaatccccgagtgcccaatttgcggaaagccgttcctgaccctgaaaagccgcacctctcacctgaaacagtgtgcagtgaaaatggaggtgggaccacagctgctactgcaggctgtgaggttgcagacggcacaaccagaggggagctcctctccaccaatgttttcattttcagaccacagtcgtggactgaaaagacgaggcccaacttccaagaaagaaccacgtaaaagaaggaaggtcgacgaggccccttcagaggatcttttggtagcgatggcgcttagcaggagtgagatggaacccggagccgcagtgcccgccctgcgtctggagagcgccttcagtgagagaattagacccgaggctgagaataaatcacgcaagaagaagccacccgtctctccgcctctgctgctggttcaagatagtgaaactacggggcgccagatcgaagatagggtcgctctcctcctgtccgaggaggtagaactgagctctactccacctctgcctgcctctcggatcctgaaggaaggctgggagcgggcagggcagtgcccccccccaccagagcgcaagcaatctttcctttgggagggtagtgccctgaccggcgcatgggcgatggaggacttttataccgctcgactggtgcccccattagtccctcagcggcccgcgcagggtctgatgcaggaacctgtccctcccttagtaccccccgaacatagtgaactgtcggagagaagatctccggcgctccatggaacacctaccgcagggtgtggatccaggggtccctctcccagcgcatcacagagggagcaccaggcacttcaggaccttgtcgatctcgcccgggaaggtctctcggcctcaccttggcctggctccggggggttggctggctcagaggggaccgctggactggacgtggtaccaggtggcctgccactcacaggatttgtagtcccgagccaagataaacaccccgacagagggggccgcacacttttatcccttggtttattggtcgctgactttggcgccatggtgaataacccccacctgtccgacgtgcaattccagaccgactccggagaggtactttatgcccataagttcgtgctatacgcgcgatgccccctgctgatacagtacgtcaataatgagggattctcagcagtcgaggacggggttctaacacagcgcgttctgctgggtgacgtgagcaccgaggctgccaggacgttcctccactatctctacacagctgataccgggctaccgccgggtctcagctccgaactttctagcctcgcccaccgcttcggagtcagcgagctggtccacctctgcgagcaggttcctatcgccacagattctgagggcaagccttgggaagagaaagaggcagagaactgtgaaagtagggcagagaatttccaggaactgctgcggtccatgtgggcagacgaagaagaagaagccgagacattgcttaaatccaaggaccacgaggaggatcaggagaacgtgaatgaagcggaaatggaggaaatctacgaatttgctgccacccaacggaaacttctgcaggaggaaagggcggcaggggccggagaggatgccgactggctagaaggtgggtctccggtctccgggcagctattagctggagtccaagtacaaaagcaatgggacaaagtagaagagatggagcctctggagccaggaagagatgaggctgctacgacttgggagaagatgggccagtgcgccctccctccacctcaggggcagcattccggagctaggggcgccgaggctcccgaacaagaagccccagaggaggctctcgggcactcttcatgtagctccccaagtagggactgtcaggctgagagaaaagagggctcgctgcctcattcagacgacgccggagactatgagcagctttttagtagcactcagggcgaaattagtgaaccgagccagatcactagcgaacccgaggaacaatctggcgcggttcgggagcggggcctggaggtgagccacaggctggcaccatggcaggccagtccaccgcacccttgcaggtttctgttgggaccgccacagggcggatcaccgaggggtagtcaccacacgtctgggtcctccctatcaactcccaggagccgaggaggaacgagtcaggtagggtcacccaccctcctctccccggccgtgccgagcaaacaaaagagagacagaagcattctgacactctcgaaggagccgggacaccagaagggcaaggaacgacgctctgttttggagtgtcgaaacaagggggtgttaatgttccccgaaaaaagtccatctattgatctcactcagtcaaacccagaccacagttctagccgcagccaaaagtccagctccaagctgaacgaggaggatgaggtaatcctgcttctggatagtgatgaggagctagagctggaacagacgaagatgaaatccatctccagcgaccccttagaggaaaagaaggccttggagattagcccacgaagctgcgagctcttttccattatagacgttgacgctgaccaagaaccaagtcaaagcccacccagatcggaggccgtgctgcagcaagaggatgagggcgcactccccgaaaataggggctcactcggacggcgcggcgcaccatggctgttttgcgaccgggaatcctcaccaagtgaagcaagtacaacggacactagttggctcgtaccagccacaccgctggccagcagaagtagggactgttcttctcaaacacagatcagttctctgcgctccggcctagccgtacaggcggtgactcagcacacccctcgcgcttcagtggggaatcgagaagggaacgaggttgcgcagaaatttagcgtgatacgaccccagaccccccctccgcaaactccgagctcctgcctgacgcctgtttctccaggcaccagtgatgggagaaggcaaggacacaggtccccttcccgcccacatccaggtggtcatccccatagtagccccctagcacctcaccctataagcggagatagagctcatttcagccgcaggttcctgaagcatagccctcccggcccctcctttctcaaccaaactcccgctggcgaagttgtcgaggtgggggacagcgatgatgagcaggaagtggcaagtcatcaggccaataggtctcccccgctggacagtgaccctccaattcccattgacgactgctgctggcacatggaacccttatcaccaattccgatcgatcactggaatttggaaagaaccgggcctctgagtacgagttcacccagtcgacgaatgaacgaggccgctgactccagggactgcaggagccccggccttttagacaccaccccaattagggggtcatgcacaacccagcggaaactgcaggaaaaatcttcaggagctggaagtctgggaaacagtagaccttcttttctgaattctgctttgtgggatgtatgggatggagaagaacaacgtccacccgaaaccccaccccctgcccagatgcctagtgctgggggcgcacagaaacctgaaggcctcgagactccgaagggagccaatcgtaaaaaaaacttacctcccaaggtgccgattacccccatgcctcagtattctattatggaaacgcccgtcctgaagaaagagctcgaccgcttcggagtgcgacctctacccaaacggcagatggttctgaagctgaaggagatcttccagtatacacaccaaacgctagacagcgactccgaagatgagtcccaatctagccaacccctactgcaagcacctcactgccaaacgctcgcatcccaaacatacaagccctctcgcgctggggtccatgcacagcaggaggctactacgggccctggtgctcatcgcccaaagggtccagctaagactaagggcccgcggcaccaacgcaaacaccacgaatcaattacccccccctccagaagtcctactaaggaagccccccccggcctgaacgacgacgcccagatacctgccagccaggagagcgtggccacttcagtcgatggctcagatagctcactgagttcccagtcttcctcttcctgcgagttcggcgccgctttcgagagcgccggcgaggaagaaggcgaaggcgaagtgagcgccagccaggccgccgtccaggccgctgacacagacgaagcccttagatgttatattcgctccaaacccgcattataccagaaagttctcctctaccagcccttcgagctgcgcgagctacaggccgaactgaggcagaacgggcttagggtttcatccagacggttactggatttcctggatactcattgcattacatttaccacggcggcaacacggcgggagaagttgcagggacgccgcaggcagccaagaggtaaaaagaaggtcgaacgcaactag

SEQ ID NO: 17432 - DNA, 1404 bp, Artificial Sequence
  Description of Artificial Sequence: Synthetic coding sequence
atgtcctccattctacctttcaccccacctgtcgtgaagcgtctcctcggctggaaaaagagcgctggcgggagcggcggcgccggcggaggcgaacagaatggccaggaggagaaatggtgcgaaaaggccgttaaatctctcgtgaaaaaacttaagaagacaggaagactggatgagctcgagaaagcgatcactacacagaactgtaacaccaagtgcgttaccatcccgtccacatgctccgaaatctggggtctgtcgacacccaacaccattgatcaatgggatacaactggactctattccttctccgaacagacaagatccctggatggccgattacaggtgtcgcatagaaagggcctgcctcacgttatctactgccgactttggaggtggccagatctccacagtcaccatgagttgaaggccatcgagaactgtgagtacgccttcaaccttaagaaagacgaagtctgcgtcaacccataccactatcagcgggttgaaactcctgttctacccccagtgttggttccaaggcacaccgaaattctcacggagctgccacccctggacgattacacccacagtattcccgaaaatactaactttcccgcgggtatcgaaccccagtccaattacatcccagagaccccacctccaggttacataagcgaggatggtgagacatccgaccagcagttgaaccagtcaatggacacaggatctcctgccgagttgtcgcccactactctctctccggtgaatcacagtctggacctgcaacccgtgacttattcagagccggctttttggtgcagcattgcttactacgagctgaaccaacgagtaggggagacttttcatgctagtcagccatccctcaccgtcgatggtttcactgacccatctaatagcgaacgattttgcctgggactgctgtctaacgtaaacaggaatgccactgtagagatgacacgcagacatattggacggggtgtacggttgtactacatcggcggagaggttttcgctgagtgtctgtcggacagcgcaatttttgtgcagagtcctaattgtaatcagagatatggctggcacccagccacagtgtgcaaaattcccccaggctgtaacctgaagatttttaataatcaggagtttgcggcacttctagcccaatccgtgaaccagggctttgaggccgtttatcagctgacacgcatgtgcaccatacgtatgagcttcgttaaggggtggggggccgaataccgacgccagactgtgaccagtacaccctgctggattgaactgcaccttaacggacccctccagtggctggataaagtcctgacacagatgggctctccctcagtccggtgcagctcaatgtcttag

SEQ ID NO: 17433 - DNA, 1314 bp, Artificial Sequence
  Description of Artificial Sequence: Synthetic coding sequence
atgagctctatcctgcccttcacgccaccggtcgtgaagcgactgttagggtggaaaaaaagtgcgggtggctccgggggggcaggaggaggcgagcaaaacggccaagaggagaaatggtgcgagaaagcggtaaaatccctcgtgaaaaagctgaaaaagacggggcgcctcgacgagctggagaaggcaattaccacgcagaactgcaacactaaatgtgtcacaatcccgaggtctttggacggcaggctgcaggtgagtcaccggaaagggctgcctcatgtgatctattgtcggctctggcgctggcccgatctgcactctcatcacgaactcaaagctatcgagaactgcgaatacgcgttcaatctgaaaaaggacgaggtatgtgttaatccttatcactatcagagggtggaaaccccggtgctgccccccgttctggtaccacgccataccgagatcctcacggagctgcctccactggatgactatacccactcaataccagaaaacactaattttccagcaggcattgagccccagagtaattacatcccagaaacgccacctccgggttacatctccgaggacggcgagacctccgatcaacagctgaaccagagcatggacaccgggagccccgcggaactttctcctactaccctgtccccagtaaatcatagtttggatctgcagcctgtaacatatagtgagccagccttctggtgtagtatagcatactacgagctgaaccaacgggtgggggagacattccacgcatctcagccgagtctgactgtggatggtttcacagatcccagtaatagcgaacgattttgcctgggactgctctccaatgttaaccgaaatgccacagtagaaatgactagaagacacatcggcaggggagtgaggctgtattatatcggaggcgaggtatttgcagagtgcttgagcgactcggcgatcttcgttcagagcccaaactgcaatcagcgctacggctggcatcctgctacagtgtgcaagattccccccgggtgcaacttgaagatctttaacaatcaagagttcgctgccctactggcacagagcgtaaatcaaggattcgaagctgtgtaccagttgacccgaatgtgtaccattcgaatgtcattcgtcaaagggtggggtgccgagtacagaagacaaaccgtcacaagtactccatgttggattgagctgcacttgaatggccccttgcaatggctggacaaggtcttgacacagatggggtctccctctgtgcgctgttcttccatgtcatag

SEQ ID NO: 17434 - DNA, 1404 bp, Artificial Sequence
  Description of Artificial Sequence: Synthetic coding sequence
atgagttccatactgccgttcacaccccctgtagtcaagaggcttttaggttggaagaaatcagcagggggaagtggcggagcgggcggcggcgagcaaaacggccaggaagagaagtggtgcgagaaagcagtcaaatctctagtcaagaaactgaagaagacaggaaggttagatgaactggagaaggcaataaccacccaaaattgcaacactaagtgtgtgacgatcccctcaacatgtagcgaaatctggggactgtctacacctaacacaatcgatcagtgggataccactggcttgtattcttttagtgaacagacgcgctccctcgatggaagactgcaggtatcacacaggaaggggttacctcatgtgatttattgcaggctgtggcgctggccagatttgcattctcaccacgaactgaaagcgatcgaaaattgcgagtacgcatttaacctgaagaaggatgaagtgtgcgtcaacccttatcactatcagcgtgtggagactccagtgctgccacctgtgctggtgcctagacacactgagatactaacggagttgcctccattagatgattacacacattccataccagaaaacacgaacttcccagcaggtatcgaacctcagtctaactacatccccgaaactccaccacccgggtatatatctgaggatggagaaacaagtgatcagcagctgaatcagagtatggacacgggctccccagcagagctatctcccactacactctcccccgtcaatcacagcctcgatctccagcctgttacttattctgaaccggcattttggtgttctattgcctactatgagctgaatcagagagttggcgagaccttccacgcctcccagccgtcactcacagtggacggctttactgaccccagcaacagtgagcgcttctgcctgggactgctttcaaacgttaatcggaatgcgaccgtagaaatgacgcgcaggcacatcggaagaggggtgaggctatactacatcgggggcgaagtgttcgccgaatgtctaagtgactctgccatcttcgtccagtcccctaattgcaaccagagatatgggtggcacccagctacagtttgtaagataccacctgggtgtaatttgaagatctttaataaccaggagtttgccgctctcctggcccagtccgttaatcaagggttcgaggccgtgtaccaactcacacggatgtgtaccataagaatgtcctttgtcaagggatggggggccgaatacaggcgacagacagtgaccagtaccccttgctggatcgagctgcatctgaatgggcccttgcagtggctcgacaaagtgttgacacagatggggagtccctctgtacgctgttcatcaatgtcctag

SEQ ID NO: 17435 - DNA, 1278 bp, Artificial Sequence
  Description of Artificial Sequence: Synthetic coding sequence
atgagcagtatccttccgtttaccccccctatcgtgaagcgcctacttggctggaagaagggtgagcaaaatgggcaggaggagaaatggtgcgaaaaggcagtcaagtcgcttgtgaagaagcttaagaaaacaggccagctcgacgagttagagaaggccatcaccactcagaacgtgaatactaagtgcatcacaatacctcgtagcctggacggcaggctgcaagtgtctcatcgcaaaggtttgccacatgtgatatattgccgcctgtggcggtggccagacctgcactctcatcacgaacttcgggcaatggaactttgcgagttcgcctttaacatgaagaaggacgaggtgtgcgtgaacccctatcactatcagcgggttgagacacctgtactgcctcctgtccttgtgcctaggcacacggaaattcccgcagagttcccaccactggatgactattctcatagtatccctgagaatacaaactttcctgcaggaattgagcctcagtctaacattcccgagactccaccaccaggctacttatccgaggatggggagacatccgaccatcagatgaatcattccatggacgcagggtccccaaatctctctccaaatccgatgagccctgcccacaataaccttgatttgcaacccgtcacctattgcgaacccgccttctggtgtagtatatcttactacgagctcaaccagagggttggtgaaacttttcacgcttcccagccgtcaatgactgtggacggctttacagatccctctaattctgagcggttctgcctggggctgctatcaaatgtgaatagaaacgcagccgtggaactcacaaggagacatattggcaggggggtaaggctgtattacatcgggggtgaagtctttgctgaatgcctcagcgatagcgcaatcttcgttcagtcgcctaattgcaatcagcggtatggctggcacccggcaactgtatgcaagattccacctggttgcaacctgaaaattttcaacaatcaggagtttgccgctcttctggcacagagtgtcaaccaaggctttgaagccgtttaccaactcacccgcatgtgtactatcagaatgagcttcgtgaagggatggggcgccgagtatcggcgccagacagtgacgtcaactccatgctggatcgagttgcatttgaacgggcccctacagtggctcgataaagtactgacccaaatgggcagtccgtctattagatgctcctctgtcagctag

SEQ ID NO: 17436 - DNA, 1146 bp, Artificial Sequence
  Description of Artificial Sequence: Synthetic coding sequence
atgagttgccttcaccctcgccagacgtggaaaggagctgccctggtgcataggaaggcctggtggatgggcaggtctctcgatggccggctgcaggtctcgcaccgcaaagggctgccccacgttatatattgccggctctggcgctggcctgatctgcattcacaccacgagctgcgggccatggaactgtgtgaattcgcatttaatatgaagaaagacgaagtttgcgtgaatccatatcactatcagcgcgtggagaccccggtgctgcctccagtgctggtacccagacacaccgagatccctgcggagtttcctcctcttgacgattatagccattccataccagaaaacaccaattttcctgctggaatcgagcctcagtcgaatataccagagacacctcctccaggctacctgagtgaggacggcgaaactagtgaccatcagatgaatcatagtatggacgccgggagcccaaacttgagcccaaacccaatgagcccagcccacaacaacctggacctacaacctgtcacatattgtgaaccagcattttggtgtagtatttcttactatgaactcaatcagcgggtgggcgagacgttccacgcctcacagccgtctatgaccgttgatggcttcaccgatcccagcaactcagaacgcttttgtctcggattgttaagtaacgtaaaccgcaacgctgcagtagaactaaccagacggcatattggccggggcgttaggctgtattatatagggggcgaggtgttcgcggagtgcctgagcgacagcgccattttcgtacaatcacccaattgcaaccaacgctatgggtggcacccggctactgtgtgcaagatcccacctggctgcaatcttaaaatcttcaataaccaggagtttgctgcgttgttggcacagtccgttaaccaggggtttgaggccgtataccaactgacacgcatgtgcactatccgtatgagctttgtcaaggggtggggcgctgagtatcgccgacagacagtgacttctaccccctgttggatcgagctgcaccttaacggaccacttcagtggcttgataaagtcttgacacagatgggcagcccctctataagatgttcatccgtgtcttag

SEQ ID NO: 17437 - DNA, 1278 bp, Artificial Sequence
  Description of Artificial Sequence: Synthetic coding sequence
atgagcagtattttgccatttactccgccaatcgttaaacgcttgcttgggtggaagaagggagagcaaaacggacaggaggagaaatggtgtgagaaagcagtgaaaagcctagtcaaaaagctgaaaaaaaccggccagctcgatgaactggagaaagccatcacgacccagaacgtgaacaccaaatgcataactattccgcgaagcctcgacggacgcctccaggttagccatcgcaaaggtctgcctcacgtgatctactgccggctgtggagatggccagatctccactcccaccatgaacttagggcgatggagttatgcgagttcgctttcaacatgaaaaaggacgaggtttgtgtgaatccctaccactaccagagagtggaaaccccagtgcttcccccggtgttagtgcctcggcatactgaaattcccgccgagttccctccactagacgattatagtcatagcattccagagaatactaatttcccagccggcatcgaaccccagtcgaacattcccgagacccccccccctggatatctgtccgaagacggagagacttcagaccaccagatgaatcacagcatggacgctggctcccctaacctgtctccaaacccgatgagccccgcacacaacaacctggatctccagccggtgacttattgtgagcctgccttctggtgtagcatatcttactacgaactgaatcaacgggtcggagagacgttccacgcaagccagcccagcatgacggttgacgggtttacagatcccagtaattctgaaaggttctgcttaggtctgctcagcaacgttaacagaaatgcggcagttgaattaacacgaaggcatatcggcagaggagtcaggctctattacattggtggcgaggtgttcgcagagtgcctgtccgactcggccattttcgtacagagtcctaactgtaaccagaggtacgggtggcatcccgccaccgtatgtaagattccacctggctgcaacctgaagattttcaataaccaggagtttgcagccctcctggctcagagcgtgaatcaaggttttgaggcggtataccaacttactagaatgtgtaccataaggatgagctttgtcaaaggatggggcgcggaatataggcgccagacggtcactagcactccgtgctggatcgaattacatctaaacggtcctctgcagtggctggataaagtgctgacccagatgggaagcccttccattagatgcagtagtgtgtcatag

SEQ ID NO: 17438 - DNA, 693 bp, Artificial Sequence
  Description of Artificial Sequence: Synthetic coding sequence
atgaatcattcaatggacgccgggagcccaaatctgagcccaaatccaatgtcccctgcacacaataaccttgaccttcagccggttacttattgtgagccagccttctggtgcagcattagctactacgaactcaaccaaagagtgggagaaaccttccatgcgtcacagccttctatgaccgtggatggattcactgatccaagcaatagcgagaggttttgcctcgggcttcttagcaatgttaatcggaacgctgcagtagagctgacccgccgacatatcgggcggggcgtgagactgtattatataggtggagaagtgttcgctgaatgcctgtctgactctgccatcttcgtacagagtcctaactgcaaccaacgctatgggtggcaccccgccacagtctgcaagatccccccaggttgcaatcttaaaattttcaacaaccaagaattcgctgccctgctggcccagtccgtgaaccagggctttgaggcagtataccagttaacacgcatgtgtacaattcggatgtcatttgtgaaagggtggggcgccgagtatcgccgccaaacagtgacatccaccccgtgctggatcgagctgcaccttaacggccccctccagtggctcgataaggtcctgacccagatgggctcaccaagtatccgctgtagcagcgtcagctag

SEQ ID NO: 17439 - DNA, 963 bp, Artificial Sequence
  Description of Artificial Sequence: Synthetic coding sequence
atggagctgtgtgagttcgctttcaatatgaaaaaggacgaggtttgcgttaacccctaccactaccagagggttgaaactcctgtcctgccgccagttctcgtgccccgccacaccgaaatcccggcggagttcccacccctggatgactacagccactccatacctgagaatacgaactttcctgctgggatcgagccccagtcaaacatccctgagacacctcccccagggtatctctccgaggatggggaaacatccgaccaccagatgaatcattctatggacgcgggaagccctaatctgagtccaaatcctatgtccccagctcataataatcttgacctccaacctgttacctattgcgaaccagccttttggtgctccattagctactacgaactcaatcagcgcgtgggtgagacgttccatgctagtcagccgtcaatgaccgtagatggtttcacagacccgtcgaacagcgaaaggttttgcctgggtcttttatccaacgtgaataggaacgctgcagtggagctgaccaggcgccacatcggaagaggcgttagattgtactacattggtggcgaggtgtttgcagaatgcctctctgacagcgctatcttcgtacagtcaccaaactgcaatcagaggtacggttggcatccagcgactgtatgcaagattccccccggctgtaatctgaaaatcttcaacaaccaggagtttgcggcacttctggctcagagcgttaaccaagggtttgaggccgtctatcagctgactcggatgtgcaccataagaatgtcattcgtgaagggttggggggctgaatacaggcgccagaccgtgacatcaaccccctgctggatcgaattacacttgaacggtcctcttcagtggttggacaaggttctgacccagatgggtagccctagcattagatgttcatccgtttcttag

SEQ ID NO: 17440 - DNA, 1281 bp, Artificial Sequence
  Description of Artificial Sequence: Synthetic coding sequence
atgttccgaacaaaaagatccgcgctggtgcgccgcctgtggcgctcgcgtgcgccgggcggagaggacgaagaggaaggcgccggtggagggggaggggggggagagcttcgcggagagggtgcgaccgactcacgcgctcacggcgcgggagggggaggccccggacgcgccggatgttgcctcgggaaagctgtaagaggggccaaaggacatcatcacccccatcctcctgccgccggcgccggtgccgccggaggggccgaggccgatttaaaagcactgacccattccgtgctgaagaagctgaaggaaagacagctggagctgctgttacaagcagtggaatctagagggggcacacgaaccgcttgcctgttgctccccggcagactggattgccgcttggggcctggagcacccgccggtgcgcaaccggcccagcccccttcaagttattcactcccactcttgctgtgcaaggtttttagatggcctgaccttcgacactcctccgaggtgaagcgcctctgctgctgcgagtcttatggcaagatcaaccctgaattagtttgttgtaaccctcatcacctgtctcgcttgtgtgagttggaaagcccacctccaccttactctcgctacccaatggacttcctcaaacccactgcggactgtcctgacgcggtcccctcaagcgctgagactgggggtacaaactacctggctccgggaggcctgtccgattcacagttactgctggaaccaggtgatcggtcccactggtgcgtggtagcctattgggaggagaagacaagggtggggcgattgtattgtgtgcaggagccatcgctggatatcttctacgatctcccccaaggaaatggtttctgtctcggacagctgaattcagataataaaagccagcttgtccagaaagtccggtctaagattggctgtggcatccagcttacccgggaggtggacggcgtatgggtctacaatcggagctcgtacccaattttcattaaaagcgctaccctcgacaatcccgattctcgaacactgctcgttcataaggtcttcccgggcttttccataaaagcctttgactatgagaaagcgtacagcctccagagacccaacgaccacgaatttatgcagcagccttggacaggatttactgtgcaaatcagctttgtcaaaggctgggggcagtgctacaccaggcaatttattagcagctgcccgtgttggcttgaagttatcttcaatagtagatag

SEQ ID NO: 17441 - DNA, 636 bp, Artificial Sequence
  Description of Artificial Sequence: Synthetic coding sequence
atggacttccttaaaccaaccgcagactgccccgatgccgtgccatcctcagccgagaccgggggaacgaactacctggcacccggtggtctgtcggattcccagctactgctcgaaccaggggacagatctcactggtgtgtcgtcgcctattgggaggagaagactagggtgggtcggctgtattgcgtccaggagccatcactggacatcttttatgaccttccgcaggggaacggcttctgccttgggcaactgaattccgataacaagagccagttggtgcagaaagtcaggagtaaaatcggttgcggaattcagcttactagagaagttgacggagtgtgggtttacaataggtcttcttaccccatcttcatcaagtctgctaccttggataaccctgattctcgaactctgctcgtgcataaagtgttcccgggattctcaatcaaggcttttgactacgaaaaagcctattccctgcaaagacctaatgatcacgaatttatgcagcagccctggaccgggtttacagttcagatcagcttcgttaaagggtggggacagtgttacacaaggcagttcatctcttcctgcccctgttggctcgaagttatctttaattcccgctag

SEQ ID NO: 17442 - DNA, 636 bp, Artificial Sequence
  Description of Artificial Sequence: Synthetic coding sequence
atggactttctcaagccaacagccgattgcccagacgccgtgccctcttctgccgagactggcggtacaaattatctagctccaggtgggctatcagactcccagcttctgctggaacccggagatcggagccactggtgtgtagtcgcctactgggaggaaaaaacccgtgtggggagactctactgcgttcaggagccttccctggatatcttttacgatttaccccagggcaatggattctgtttggggcagctcaacagtgataacaagtcacagcttgttcaaaaggtgcggtccaaaatcggctgcggaatccagctgacaagagaggtggacggtgtttgggtgtacaatagaagctcataccctatttttattaaaagcgcaacattggacaacccggattcacgtactctgctggtgcataaagtattccctggtttctctatcaaagccttcgactatgagaaggcttacagcttacagcggcccaatgaccatgaatttatgcagcagccctggacgggcttcactgtgcagatctctttcgtgaaaggctggggccagtgttatacaaggcagtttatcagcagctgcccctgttggcttgaagtcatattcaactctagatag

SEQ ID NO: 17443 - DNA, 270 bp, Artificial Sequence
  Description of Artificial Sequence: Synthetic coding sequence
atgaattcccagcagcagaagcagccctgcacacctcctccccagcctcagcaacaacaggtgaaacaaccatgccagcctccaccccaggaaccttgcatcccgaaaaccaaggaaccttgccatccaaaagttcccgaaccctgccacccaaaagtgccggaaccctgccagcctaaggtccctgaaccgtgtcaaccaaaggtacccgaaccctgcccttccaccgtcacaccagccccagcccaacagaagaccaagcagaagtag

SEQ ID NO: 17444 - DNA, 270 bp, Artificial Sequence
  Description of Artificial Sequence: Synthetic coding sequence
atgaactcacagcagcagaagcaaccgtgcacacctccccctcagccacagcaacagcaagtgaagcagccctgtcagccaccccctcaggaaccttgcatcccaaagaccaaagaaccctgccacccgaaggtgcccgagccttgccaccctaaagttccggaaccctgtcagcccaaggtccccgaaccttgtcaaccaaaggtgcctgaaccctgtcccagcactgtaaccccagcgccggcccagcagaaaactaagcaaaaatag

SEQ ID NO: 17445 - DNA, 4260 bp, Artificial Sequence
  Description of Artificial Sequence: Synthetic coding sequence
atggccgagggactggagcgggttcgaattagtgcttccgaattgcgtggcatccttgcaactttagctccccaggctggaagccgggaaaacatgaaggaactcaaagaagcccgcccacgcaaagataacaggaggcccgaccttgagatatacaagccaggattgtcccgtcttcgaaataagccaaagatcaaggagcctccagggtctgaagaattcaaagatgagattgtcaatgaccgtgactgtagcgctgtggagaacggtactcagcctgtgaaagacgtttgcaaggagttaaataatcaggagcagaatgggccaatcgatccagagaacaatcgcggccaagagagtttcccacggacagccggccaggaggacagatccctgaagataattaagcgaactaagaagcccgacttacagatttatcagccaggccggcggctgcagacagtgagtaaggaatccgcttccagggtcgaagaggaggaggtgctcaatcaagttgaacaactgagagtcgaagaggatgagtgcagagggaatgtcgccaaggaagaggtcgctaataagccagaccgagcagaaatagagaaatcacccggtgggggccgcgtcggtgccgccaaaggagagaagggaaagcggatgggcaagggagagggggttcgtgaaacccatgatgatccagctcgcgggcggccaggctccgctaaaaggtactctaggtctgacaaaagacgcaaccggtaccggacccgctctactagtagtgccggtagcaataacagcgccgaaggagcaggactgaccgacaatggatgtcggcgacgtcggcaggatagaactaaagaacgcccaagacttaagaagcaggtgtccgtctcctccacagacagcctggatgaagatagaatcgatgaaccagatggactgggaccgcggcgcagctctgaaagaaagcgccatctggaacgcaattggtccggcaggggcgagggcgagcagaaaaactctgccaaggaataccgtgggacattacgcgtcacatttgatgccgaggccatgaacaaagagtctccaatggtccgctcggctagagatgacatggaccgggggaagccggataaaggcctgagtagtggcggtaaggggtccgagaagcaagagtccaagaaccccaaacaggagctgcgaggcaggggacgagggatcctgattcttcccgcccacactaccctctctgtaaattctgccggaagccctgagtcagctccgctaggcccccgcctgctctttggtagcgggagcaaaggaagtcgttcctggggccgtggaggaacaacaaggaggctgtgggatcccaataatccagatcagaaacctgctttgaaaacccagaccccacagctgcacttcttagataccgacgatgaagttagccccacctcttggggggactcgcggcaggctcaggcctcatactacaaatttcagaatagtgataacccatattactatcctagaacccccggtccagccagccagtacccttacactgggtacaatcccctccaataccccgtcggcccaaccaacggcgtgtacccaggcccctactatcctggctatccgactcctagtggccaatacgtctgctctccccttccaaccagcactatgagtcctgaagaagtggaacagcacatgaggaacctgcagcagcaggagctgcacagactattgcgcgtggccgataaccaggagctccagctatccaacctcctgtctagagatcgcatctcccccgaagggctggaaaagatggcccagctgcgggctgagttactgcagctgtacgaaaggtgtatactgctggacatcgaattctccgataatcagaatgtggaccagatcctgtggaaaaatgcattctaccaggtgatagaaaagtttaggcagttggtgaaggatccaaatgtcgaaaacccagagcagatcaggaaccgtctcttggaactgctcgatgaggggtctgacttcttcgacagccttctgcagaagctccaggtgacttacaaatttaagctggaggattacatggatggtctggctattaggtctaagccactccgaaaaacggtcaaatacgccctgattagcgctcagagatgcatgatctgccagggcgacattgccagatatagagagcaggcctcagatactgccaactatggaaaagcaagatcctggtacctgaaagctcagcatattgctcccaaaaacgggcgtccatacaaccagctggcgctccttgccgtgtatacccgccgaaaacttgatgcggtgtattactacatgcggagcctggcggcctccaaccctatccttaccgcgaaggaaagcctcatgtccttgttcgaggagacgaagcggaaggcagaacaaatggagaagaagcagcatgaagaattcgatctcagccctgatcaatggcgtaaggggaaaaaaagcaccttcagacacgtgggagatgatactactcgactggagatctggattcatccttcgcatcctcggtctagccaggggacagagtccggcaaggattctgaacaggagaacggattgggctcattgagtccttccgacttaaacaagaggttcatcctgagttttctgcacgcccacggcaagcttttcactcgaatcggaatggaaacctttcccgccgtggctgagaaagtactgaaagagttccaggtgctattgcagcattccccatctcctatcgggagcacccgcatgttgcagttgatgacaatcaatatgttcgccgtgcacaactcccagttaaaagactgtttctccgaggagtgcaggagtgtcatccaggagcaagcagctgcattggggctggctatgttttctttgttggtgaggaggtgcacttgtctgcttaaagaatccgccaaggctcagctctcctcccccgaagaccaagatgatcaggatgacatcaaagttagctcattcgtcccagacttgaaagagctcttgccctcggtgaaggtgtggtcagattggatgctcggttacccggatacgtggaatcccccccccacatccctcgacttgccttctcacgtggctgtggacgtctggagcacccttgcagacttctgcaacattttgacagctgtgaatcagagcgaagtccctctctacaaagaccccgacgatgacctcacactcctaatcctcgaggaggaccgcctcctgtctgggttcgtgcccctcctcgctgcgcctcaggacccttgctacgtggaaaagacaagtgataaggtgatcgccgccgattgtaaacgggtcacggtgctcaagtattttttagaagctctatgtgggcaagaagagcctcttttggcatttaagggcggaaagtacgtttctgtagcccctgtgccggacacaatgggtaaggaaatggggtcacaagagggcacacgactggaagacgaggaagaggacgtggtgatcgaagactttgaggaagattctgaagcagagggcagtggtggcgaggatgacattagagagcttagggcaaaaaaattagcgcttgctcgcaaaattgccgaacagcagcgaagacaggaaaagatccaagccgttctggaagaccattctcagatgcgtcagatggaactggaaattcgaccgctgttcctggtgcccgacaccaacggtttcattgatcacctcgcaagcctggcacgtcttctcgagtctcggaagtatatccttgtggtaccattaattgtgataaacgaacttgatggattggccaagggccaggaaaccgaccacagagccggcggctatgctcgcgtggtccaggagaaggcccgtaaatctatagagtttctcgaacaaaggtttgaatcccgcgactcctgcctgcgcgccctaacatccaggggtaatgaattggagtccatagcattcaggagcgaagacattaccggtcagttgggtaataacgacgaccttatactgagttgctgcttgcattattgtaaggataaagccaaggattttatgccagccagcaaagaggaaccgataaggctgctgcgcgaggtcgttctgctcaccgacgatagaaacctcagggtgaaagcattgactcgaaacgttcccgtgcgcgatatacctgcatttcttacatgggctcaggtcggatag

SEQ ID NO: 17446 - DNA, 993 bp, Artificial Sequence
  Description of Artificial Sequence: Synthetic coding sequence
atgagatttagactctgccatcagaggggatgttgcccacacgaacgcgaaaatacctgcacatgcaaaatgataattagctccctccaggtgatcgccgcagactgcaaacgagtgactgtcctgaaatattttctggaagccctttgcggtcaggaggagcctctcctggcctttaaggggggtaaatacgtgtccgtggctcccgtgcccgataccatggggaaagagatgggctctcaggaaggcacgcgacttgaagacgaagaggaagacgttgtaattgaggatttcgaagaagactccgaagctgaagggtcgggtggggaggacgatattagggagctgcgcgctaaaaagctggctttggcgaggaaaatcgccgagcagcagaggagacaggagaaaatccaagcagtgctggaagatcactctcagatgcgccaaatggagctggaaatcagaccgctgtttttggtgcctgacacaaacggtttcattgaccatttggcatcactggcgcgattgttggagtcacgaaagtatattcttgtagtcccgctgatcgtgatcaatgaattagacggactggccaaaggtcaggaaaccgaccaccgggcaggaggctacgcgagagtggtgcaggagaaggctaggaagtccattgaattcctggaacagcgcttcgagagcagagattcatgcctgagggctcttacctcccgcggaaacgagttagaatcaatagcattccgctccgaagacatcacaggccagctgggaaacaatgacgatctgatcttatcctgttgccttcattattgtaaggacaaagcaaaggacttcatgcccgcaagcaaggaggagcccattcgactgctccgcgaagttgtgctcttaaccgacgacaggaatctgcgggtgaaggccctcaccagaaatgtgcctgtaagggacataccagcattccttacatgggctcaggtcgggtag

SEQ ID NO: 17447 - DNA, 1536 bp, Artificial Sequence
  Description of Artificial Sequence: Synthetic coding sequence
atggagactttccctgccgtcgctgaaaaagtgctgaaggaatttcaggtgcttctacagcattccccctctcccatcggttctacacggatgctgcagctcatgaccataaacatgtttgccgtgcataatagtcaacttaaagactgtttctcagaagagtgccggagcgtgattcaggagcaagccgcggcgctcgggttggcaatgttttcgctcctcgtacgaagatgcacttgcctcctgaaggagtccgcgaaggcccagctgagttcccccgaagatcaggatgaccaggatgacataaaggtttcgtcatttgttcccgatctgaaagagctgctcccctccgtgaaggtatggtctgactggatgctcggttatcctgatacgtggaacccccctcctaccagtctggatctcccttcacacgtggccgtggacgtctggagcacacttgccgacttctgcaacattttgactgccgtaaaccagtctgaggtgccattgtacaaagatcctgacgatgatttgaccctgttgatcctggaagaggaccgcctgctcagcggcttcgtgcctctgctggccgctccacaggatccatgttatgtcgaaaaaacaagcgacaaggtgatcgccgcagattgtaaaagagtgacggtgttgaaatatttcttggaagctttgtgtgggcaagaagaaccactgctcgcgtttaagggcgggaaatatgtgagcgtggctccagtgcccgatacaatgggtaaggagatggggtcgcaggaggggacacgcctggaagatgaagaagaagacgtcgtcattgaggactttgaggaggacagcgaagccgaggggagcggcggtgaggacgatattcgcgaattgagagcgaagaaattggctcttgcccggaagatcgcggagcagcagcgccgtcaggaaaagatccaggcagtcctggaggatcactcacagatgaggcaaatggaactggaaatccggcccttgttcttagtcccggatacaaacggattcatcgaccatctggcaagtttagccaggctgcttgagagcaggaagtatattctggtcgtgccattaatcgtgatcaatgagttagatggcctagccaaggggcaggaaacagatcaccgggctgggggctatgcccgggttgtgcaagagaaggcccgaaaaagcatcgagttcctggaacagcgtttcgagagtagggattcatgcttacgggcactcacgtctagaggcaatgagctggagtctatagctttccgctctgaggacatcacaggccagctcggaaataatgatgacctcatcctaagttgttgcctgcactactgtaaggacaaggccaaggacttcatgccagccagcaaagaagaaccaatcagactactgcgcgaggtcgtgctgctgaccgatgaccgcaatctccgcgttaaagcactcactcgtaacgtcccagtgagggacatcccagcattcctgacatgggcccaggtgggctag

SEQ ID NO: 17448 - DNA, 4167 bp, Artificial Sequence
  Description of Artificial Sequence: Synthetic coding sequence
atgaaagagcttaaagaggctcggccccgaaaggataaccgacgacctgatctcgagatttacaaacccggcctaagtcgcttgaggaacaaacccaagattaaagagccgccaggcagcgaggaattcaaagacgaaatcgtcaacgaccgcgactgcagcgcggttgagaatggaacccagccagtcaaagatgtctgtaaggaattaaataaccaggagcagaacggaccaattgacccagagaataaccgcggccaggaaagctttcccagaactgcaggccaggaggacagaagtctgaaaataatcaagcgcacaaagaaaccggacctccaaatataccagcctggcaggaggctacagacagtaagcaaggagagcgccagccgcgtcgaagaagaagaagttctcaaccaggtggaacaactcagggttgaagaagatgagtgtcgggggaacgtggccaaagaggaggtcgcaaataagccagaccgcgccgagatcgaaaagtccccgggcggcggtcgggtgggggctgctaaaggagaaaaaggtaagcggatgggcaagggtgagggtgtccgcgagacacacgatgacccagccagagggcggccagggtctgccaagagatactcaagaagtgataagcgcaggaataggtataggacccgaagcacatctagtgccgggtctaacaatagtgctgaaggcgccgggctgacagacaacggatgccggcgccgccggcaagaccggactaaggagaggccacgactcaagaagcaggtctccgtgtcttcaactgacagtttagacgaggacagaattgacgagcctgacggcttgggaccaagaaggtcttccgagcggaagaggcatctcgaaagaaactggagcggcagaggtgagggggagcagaagaactccgctaaagagtaccgggggacgctgagggtgaccttcgacgcagaggcgatgaacaaggaaagtccaatggtgagatcagccagagacgatatggaccgtggaaaacctgacaagggtctgtcctccggcggcaaaggcagcgaaaagcaggagtcaaagaaccctaaacaggagcttcggggcaggggccgggggatcttgatcctacccgcccacacaactctctctgtgaactctgctggttcccctgagtccgcaccactcggcccccggttgttattcgggtcgggttctaaaggttcaagatcatggggcagagggggtactacgcgcaggctttgggaccccaataatccagaccagaagccggccctgaagacacagacccctcaacttcatttcctcgataccgacgatgaggtctctcctacatcttggggggatagtcggcaggcacaggcttcatattacaaatttcagaatagtgataacccctattactatccgaggaccccggggcctgcttcccaatatccttatactggctacaatccactccagtaccccgtcggacctacaaacggcgtctaccccggaccatactatcctgggtatcctaccccctcaggtcagtatgtgtgtagcccgttgcctacctctaccatgtcccctgaggaagtagagcagcacatgaggaacctccagcagcaggaactgcaccgcctgttgcgggtggctgataaccaggagttgcagctttccaacctcctgagccgagacagaattagcccggagggattggagaaaatggcgcaactacgggctgaactcttgcagctgtacgagagatgcatccttctagatatagaattttctgataaccagaacgtggatcagatcttgtggaagaacgccttttaccaggtgatcgagaaattcaggcagctcgtgaaagacccaaacgtcgagaacccagaacaaatccgcaacagactgctggagctgctggatgaaggtagtgatttttttgattccctgctgcagaagctccaggtgacttacaaattcaaactggaggactacatggatggcctggccatcagatcaaagccgctccggaaaacagtcaagtatgcactgatttccgctcaaaggtgcatgatatgtcaaggtgacatcgccagataccgagaacaagcgtctgatactgccaattatggtaaggcaaggagttggtacctaaaggcccagcacatcgcaccaaagaatggcaggccttacaaccagctggctctgttggctgtgtatacacgccgtaagctcgacgctgtgtattattatatgcggtcactggccgcatctaaccctatcttaaccgccaaagagtcgctgatgtccctcttcgaggaaacaaaacgcaaagccgagcagatggaaaaaaaacagcacgaggagttcgacctcagccccgaccagtggcgcaaagggaaaaagtcaacctttcgtcatgttggggacgatacaacccgcctggaaatttggattcaccccagccacccccggagtagccaaggcaccgaatctggtaaagactccgaacaagagaacgggttgggctcgctctcgccaagtgacttgaacaaacggttcatcctgagcttcttgcatgcccacggaaagttattcacgcggattggtatggaaacattcccggccgtggctgagaaagtgttaaaagaattccaagtgttgttgcagcactctccttcccctattggcagcacacggatgctacagctgatgacaattaatatgtttgccgtgcacaactcacaactgaaggactgcttcagcgaagagtgtaggtccgtgattcaggaacaggccgcagcccttggtttagcaatgtttagcctcctggtgagacgatgcacttgcctcctaaaggagagcgccaaagcccagcttagctcacctgaggaccaggacgaccaagacgacataaaggtgtcctccttcgttcctgatctgaaggagttgttacccagcgtcaaggtgtggtccgattggatgttgggctaccccgatacttggaaccccccccctaccagcctcgacctgccttcccatgtggctgtcgatgtctggtctaccttggcggacttttgcaatattcttactgccgtgaatcagtcagaagtgccactctacaaggacccggacgatgacctgacgctgctaattctggaggaagaccggttattatcaggcttcgtccctctcctggccgctcctcaagatccctgttacgttgaaaaaaccagcgacaaagtaattgctgctgactgtaaaagagtgacagtgctgaagtatttcctggaggccctgtgcggccaggaagaacctctcctcgctttcaaaggtggtaaatacgtttctgttgcccccgtgccagacaccatggggaaagaaatgggtagccaagaaggaacccgtctggaagacgaagaagaggacgtcgtgatcgaggattttgaagaggactccgaagcagaagggtctggcggagaggatgacatccgggagttacgggcaaagaagctagctctcgcccgaaaaatcgcagagcagcagcgaaggcaggaaaagatccaggctgtcctggaagatcattcacagatgaggcagatggaactcgagatccgcccccttttcctcgttcctgacacgaatgggtttatagatcatctcgcttccctagcccgccttttggagtcacggaagtatatcttggttgttccgttgatagtcattaatgaactggacggactggccaaggggcaggagaccgatcacagggcgggcggatatgcacgcgtggtgcaggagaaagctcggaaatcaatcgaattcctggagcagcgattcgaatccagggactcatgtctgagagccttaacgtctcgggggaatgaactggaatctatcgccttccggtccgaggatataaccggccagctcggcaataacgatgacctcattttgtcctgctgtctccattactgtaaggataaagcaaaggactttatgcctgctagcaaggaggagcctatcagacttttgagggaagtggtcctgttaaccgatgatcggaatttacgcgttaaagccctcaccaggaatgttccagttcgtgatattccggcctttctgacctgggcgcaggtcggctag

SEQ ID NO: 17449 - DNA, 2364 bp, Artificial Sequence
  Description of Artificial Sequence: Synthetic coding sequence
atggcagcggctcggccagcaaggggccctgagctgccactgctgggtctgctcctgctcctattgcttggtgatcctggaagaggagcagcctccagcggtaacgccacaggtcctggacccagatccgcagggggatctgccagacgctctgcggccgtgacagggccccctccaccccttagccactgcgggagagctgccccatgtgagccactgaggtacaacgtctgtcttgggagtgttctgccctatggggccacaagtactctccttgccggtgattccgactcacaggaggaggcacatggtaaactggtgttatggagcggtctccgaaatgccccaagatgttgggccgttatccaaccactgctgtgcgccgtttacatgccgaaatgtgaaaacgatcgcgtcgagctgcccagtcgcacactttgtcaggcgacaagaggcccatgcgcgatcgtggaacgggaaagaggctggcctgatttccttagatgtacgcccgacaggttcccggagggatgcactaatgaagtgcagaacatcaagttcaatagctccgggcagtgcgaagttcccctcgtccggacagataatccgaagtcctggtatgaggacgtcgagggatgcgggattcagtgccagaacccactctttacagaggccgagcaccaggatatgcatagctacatcgcagcatttggggccgtgaccggcctgtgcaccctattcactttggccacttttgtcgccgactggcgaaactcaaaccgctatccagctgtgatcttgttctacgttaatgcctgcttctttgttggcagcatagggtggctggctcagttcatggatggggcacgccgagagatagtctgtagggcggatggcaccatgcgactgggtgaacccacatccaatgagactctgagttgcgtcataatcttcgtcatcgtatactacgccctgatggccggtgtagtgtggtttgtggtgctgacatatgcctggcacactagcttcaaggcgttgggaaccacctaccagccacttagtggaaaaacttcctattttcacctgttgacctggagtctcccgtttgtgcttaccgtggctattcttgctgtcgcccaggtcgacggcgattctgtctcgggcatttgtttcgtgggctacaagaactacaggtatcgggctggatttgtcctggcccctataggcctcgtccttattgtgggagggtacttcctgatccgcggtgtgatgacgctcttttccatcaaatcaaaccatcccggactgctctccgagaaagccgcttccaagattaacgagaccatgctaagactggggatcttcggctttttagcgttcgggttcgtactgattacattcagctgccacttctatgacttcttcaaccaggctgagtgggagcggtctttcagggattatgtgctttgccaggccaatgtgactataggcttgccaacgaaacagccgattcccgattgcgagattaaaaacagaccttccttgctggttgaaaagataaacctgttcgcaatgtttggaacgggtatcgctatgtcaacctgggtgtggaccaaggcgacactcttgatctggcgacgaacttggtgtagactgacaggccagtctgacgacgaacctaagagaataaaaaagtccaaaatgatcgccaaagccttctccaagcgacacgaactgctgcagaatcctggccaggagctgagcttttccatgcacaccgtatcgcacgacgggccagtggccggtctcgcattcgaccttaacgagccaagtgccgacgtttctagtgcatgggcacagcacgtgacgaaaatggtggcccgaagaggcgctatattgccccaggatattagtgtgaccccagtcgctacgccagtcccccccgaggagcaggctaacctttggctcgtagaggccgagattagccctgaacttcagaagcggctaggcaggaagaagaagaggcgtaaacggaagaaggaagtgtgcccattagccccccccccagaattgcatcctcctgcgcccgcgcctagtaccatccctagactgcctcagctgccacgacagaaatgcttggtggcagcaggggcctggggcgccggggatagttgcaggcagggggcctggactctcgtgtcaaacccattttgtccagagccttccccgcctcaggatccgtttctgccctcggccccggcccctgtcgcctgggctcatgggcgccgtcagggcctgggccccatccacagccggacaaatctcatggatacggaactgatggacgcagacagtgatttttag

SEQ ID NO: 17450 - DNA, 231 bp, Artificial Sequence
  Description of Artificial Sequence: Synthetic coding sequence
atgtcagaccaggattcttccgagattcacttcaaagtaaagatgactacacacctgaagaagctcaaagagtcttattgccagcgacaaggcgttcccatgaatagcctgagattcctctttgaagggcagcggattgcagataaccatactcctaaagagttgggcatggaagaggaggacgtcattgaagtgtaccaggaacagaccgggggacactccactgtgtag

SEQ ID NO: 17451 - DNA, 306 bp, Artificial Sequence
  Description of Artificial Sequence: Synthetic coding sequence
atgtcagatcaggaagctaaaccctcaaccgaagatcttggcgataagaaggaaggcgaatatattaaactgaaggtgatcggacaggatagctcagagatccacttcaaagtcaagatgactacgcacttgaagaagctgaaggagtcttattgtcaaaggcagggagtgcctatgaactcactccggttcctgtttgagggccagcgcattgccgacaaccataccccaaaggagctgggcatggaagaggaagatgtgatcgaagtttatcaggaacagaccggcggccactctaccgtgtag

SEQ ID NO: 17452 - DNA, 306 bp, Artificial Sequence
  Description of Artificial Sequence: Synthetic coding sequence
atgtctgatcaagaggcaaagccctcaactgaagacttgggcgataaaaaggaaggcgaatatatcaagctaaaggtgattggccaagattcaagcgaaatccacttcaaggtgaagatgaccacccaccttaaaaaactcaaggaaagctactgccagcgacagggagtacccatgaattctctgaggttcctcttcgagggccagcgaatcgcggataaccatacgccaaaagagcttggcatggaggaagaagatgtgatcgaggtataccaggaacaaacaggcgggcatagtacagtgtag

SEQ ID NO: 17453 - DNA, 189 bp, Artificial Sequence
  Description of Artificial Sequence: Synthetic coding sequence
atgaccactcatctcaagaagctgaaagagagttactgtcagagacagggcgtgccaatgaactccttgagatttctgttcgaggggcagcgcatcgcggataaccacacacccaaggaactgggtatggaggaagaggacgtgatagaggtgtatcaggagcagacaggtggccactctacagtctag

SEQ ID NO: 17454 - DNA, 189 bp, Artificial Sequence
  Description of Artificial Sequence: Synthetic coding sequence
atgaccacacatttaaaaaaacttaaagagagttactgccagaggcagggagtgccaatgaattcactgcgctttctgttcgagggtcagcggatcgccgacaaccatactcccaaggagctgggaatggaagaagaggatgtgatcgaagtctaccaggagcaaactggaggccattccacagtttag

SEQ ID NO: 17455 - DNA, 795 bp, Artificial Sequence
  Description of Artificial Sequence: Synthetic coding sequence
atgcctcgttccttcctggtgcgaaagcccagcgatcccaatcggaaaccgaattatagcgagctccaggactctaaccccgaatttacattccagcaaccctatgaccaggcccatctgctggccgccatacccccccccgagatcctgaatcccaccgcttccttaccaatgttaatatgggattccgttttagcccctcaggcccagcctatcgcttgggcaagcctaagacttcaggaatcacctcgagtggccgaattgacgtcgctgtctgacgaggattccggcaagggctcacaaccaccaagccccccctctcccgcaccatcaagcttcagctccacttccgtatctagcctggaggctgaggcgtacgccgcctttccaggactagggcaagttccaaagcagctcgcccagctgtctgaagccaaagatctgcaagcccgcaaagccttcaactgtaaatattgcaacaaagagtacctgagcctgggggcccttaagatgcatatacggagccatacccttccatgtgtctgcggaacctgcggcaaagcgtttagtcgcccctggctgctgcagggccacgtccgcacacacacgggagaaaaacccttcagctgtccgcattgtagtagggctttcgcggatagatctaacttacgtgcccacctgcagacccacagtgatgtgaaaaagtaccagtgtcaggcgtgtgctcggacattcagccggatgtcccttttgcataaacaccaggagtcaggatgcagcggatgcccaaggtag

SEQ ID NO: 17456 - DNA, 807 bp, Artificial Sequence
  Description of Artificial Sequence: Synthetic coding sequence
atgccgcgctcctttctcgtgaaaaagcacttcaatgcctcaaaaaagcccaactattctgagctggacacccacaccgtcataataagtccgtacctgtatgaatcctatagcatgccggtcattccccagccagaaattctcagctccggtgcttacagcccaattacagtgtggaccaccgctgccccctttcacgcgcagctgccgaacgggctgagtccactcagcggttatagtagctctttaggaagggtcagccccccacctcctagcgacacctccagcaaagatcatagcgggagcgagtcaccgataagcgacgaagaagagaggttacaatcaaagctctctgacccgcatgccatcgaagccgaaaaattccagtgcaacctgtgcaataaaacatactccacattctcaggcctggccaagcacaaacaattacactgtgacgctcagtcccgaaaatcgttcagctgcaagtattgtgataaagagtacgtgagtctgggagcgctgaagatgcatattcgcacccacacactcccttgcgtttgtaaaatttgcgggaaggcctttagcaggccctggctgctgcagggacatatccgtacccacacaggtgaaaagccattttcctgcccacactgcaacagagcctttgctgatcgttctaaccttagggcccacttgcagacgcatagtgatgtgaagaaataccaatgcaaaaactgcagcaaaacattcagccgcatgagcctacttcataaacacgaagagtcgggctgttgtgtggctcattag

SEQ ID NO: 17457 - DNA, 807 bp, Artificial Sequence
  Description of Artificial Sequence: Synthetic coding sequence
atgccaagatcctttcttgtcaagaagcactttaatgcgtccaaaaagccgaactatagtgaactagacacccacactgttataatttctccttacttgtacgagtcgtactctatgcctgtcattccgcagcccgagatcctgtcctccggagcctactctcctataacggtttggacaactgcagcgccttttcacgcccagctccccaacggattatcacctttaagcgggtatagctcgtccttaggcagggtgtcccccccacctccttccgacaccagctccaaagaccactctggctccgaatcccctatctccgatgaggaggaaagactccagtccaaactgagcgatcctcacgccatcgaagccgagaaatttcagtgtaatctgtgcaacaagacctacagtacttttagcgggttggccaaacacaaacagcttcactgtgacgcgcagtcaagaaagtcatttagctgtaagtactgcgacaaggagtacgtgtccctgggcgccctgaagatgcatataagaactcacactctcccgtgtgtttgcaagatctgcggcaaggcttttagtaggccatggttgctgcaggggcacatccgtacgcacacgggcgaaaaacctttctcatgcccccactgcaaccgggcttttgcggatcgaagcaacctcagggcccatctgcaaacccactcggacgtcaagaaataccagtgcaagaactgctccaagacgttctctcggatgtccctcttgcacaaacatgaggagtctggctgctgtgttgcccactag

SEQ ID NO: 17458 - DNA, 879 bp, Artificial Sequence
  Description of Artificial Sequence: Synthetic coding sequence
atgcctcgaagcttcctggtaaagactcactcctcgcaccgggtaccgaactacaggcgtctcgaaacccagcgtgagatcaacggagcttgcagtgcctgtgggggattggtcgtccctcttttaccgcgcgacaaagaggccccgagtgtacctggcgacctgccccagccttgggatcggagcagtgcagtggcatgcatcagtttgcctctgctccccagaattgaagaggctttgggggcgagcggactagatgcactggaggtctccgaagtagaccctagagcctcccgggcggccatcgtcccccttaaggactccctcaaccatctcaacttaccacctctactggtcctgccaacacgctggtcccctaccctggggcctgatcgtcacggcgcccccgaaaaactgctgggtgcagagagaatgccccgagctcctggcggatttgagtgcttccattgccacaagccttatcataccttggctggtttagcacgtcaccggcaactccactgccatctccaggtgggacgggtgtttacatgcaagtactgcgacaaagagtatacctcactaggggccctgaagatgcatatccggacccacactcttccatgcacctgcaagatatgcgggaaagctttctctagaccttggttgctgcaggggcatgttcggacccatacgggagaaaagccatacgcatgctctcactgttccagagcctttgcggacaggagcaatctccgagctcatttgcaaacacacagcgacgccaagaagtaccgctgcagacgatgcaccaagactttcagtcggatgtccctcttagctagacacgaggagtctggatgttgccccgggccttag

SEQ ID NO: 17459 - DNA, 1398 bp, Artificial Sequence
  Description of Artificial Sequence: Synthetic coding sequence
atggggggagcagtggtggacgaagggcctacaggagtgaaggctcccgacgggggctggggatgggccgtactgtttgggtgtttcgtaattactggattctcttatgcctttcccaaggccgtgtctgtgttcttcaaagagttaattcaagagtttggcatcgggtattcagacactgcctggatcagcagtattctactggccatgctatacggcaccgggcccctatgcagcgtgtgcgtgaacaggtttggatgccgccccgtgatgctggtcgggggcttgtttgcctcacttgggatggtggccgcttccttttgtaggagtatcatccaggtgtatctgaccactggtgtgatcactgggctgggtctggcccttaattttcagccctcgttgatcatgctgaatagatatttcagcaagagacgacccatggctaatggcttagccgccgcagggtcacccgtgttcctatgcgcccttagccccttggggcagctcctccaggatcggtacggatggagaggtggctttctcatcctgggaggcctgcttctgaactgctgcgtatgcgcagccttgatgaggcctctggtggtaactgcccagcccggtagcggacccccacgtccctcccggaggctgttggaccttagcgtattccgcgaccggggcttcgtgctctacgccgtggccgcctcagttatggtcctgggacttttcgtacctcccgttttcgtcgtgtcctatgcgaaagatttgggcgtgcccgataccaaggcagcattcctgctgaccattttgggttttatcgacattttcgcccgccccgcggccggattcgtggctggactggggaaagtgaggccgtattcagtctacctcttctctttcagcatgtttttcaacggcctggctgacttagcagggagcaccgcaggtgactacggagggctggtagttttttgtatcttctttggaatctcctatgggatggtcggcgccctgcagttcgaggtcctgatggccatcgtggggacgcacaaattttcttcagcgatcgggctcgtgctgttaatggaggcagttgcggtgctggtcgggccacccagcggtggtaagctgctggacgccactcatgtgtatatgtacgtgtttattctagcaggcgcagaagtgttaacgagcagcctgatcctgttgctaggcaattttttctgtataagaaagaaaccgaaagagccacagccagaagtcgccgctgcagaagaggaaaaactccataaaccacctgctgatagtggagtggatttgcgggaggtcgagcatttcctgaaagcagaacccgagaaaaacggagaggttgtacacacacccgagactagcgtgtag

SEQ ID NO: 17460 - DNA, 1398 bp, Artificial Sequence
  Description of Artificial Sequence: Synthetic coding sequence
atgggcggggccgtggtcgacgagggcccaaccggcgtgaaggcaccagacggaggatggggctgggccgttctttttggctgcttcgtgattactggattctcttatgcatttcccaaagccgttagcgtgttctttaaagaactgatccaggaattcgggatcggctatagtgatacagcttggatatcttccatattgctggctatgttatacgggacgggccctctgtgctcagtctgtgtcaacaggtttggctgccggccggtgatgctagtcggtggcctgttcgcttcactgggaatggtcgctgcttcgttctgccggagcatcatccaggtttacttgacgacgggggtcattaccggactgggcctagcactgaactttcagccaagcttaataatgttgaatcgctacttctccaaacgtcgccccatggcaaacggattagccgcagcaggcagtcccgtcttcctgtgtgcattgtcgccgttaggtcagctccttcaggaccgctatggctggcgtgggggttttctcatacttggcggactgctgcttaattgttgtgtctgcgctgcactgatgagacccctggttgttacggctcagcccggatcagggcctccgcgtccttctcgacgcctcttggacctgtctgtctttagggatcgcggctttgttctctacgcagtggctgccagcgtcatggtgttgggcttattcgtgcccccagtgtttgtcgtctcatacgctaaggacttgggcgtgccagacactaaggcagctttccttctgactatcctcggttttatcgatatctttgctcggcctgcagctggcttcgttgcaggactgggtaaagtgcgcccctattccgtgtacctcttttccttttcaatgtttttcaacggactcgccgacctggctggaagcactgcaggtgactatggaggactggtggtgttctgtatcttctttggtatctcctacggaatggttggcgcactgcagttcgaggtccttatggctattgtgggaactcataaattctcgtccgctatcgggcttgttctgttgatggaagcggtcgctgtcctcgtcggccctccctccggagggaagttgttggatgcgacacacgtgtacatgtatgtattcattctggcaggggccgaggtgttaactagcagtcttattcttttgctcggaaacttcttttgcattcggaagaaaccgaaggaaccacagccggaggtggccgccgctgaagaggagaagttgcataagccacctgccgattctggtgtggaccttcgggaggtggaacactttctgaaggccgaacctgagaagaatggggaagttgtgcatacaccagagacatctgtgtag

SEQ ID NO: 17461 - DNA, 1398 bp, Artificial Sequence
  Description of Artificial Sequence: Synthetic coding sequence
atggggggagcagtggttgatgagggtcctaccggagtgaaagctccggatggcggctggggttgggccgtgctgtttgggtgtttcgtgattaccgggttcagctatgccttccctaaggccgtttctgtgttcttcaaagagctgattcaagagttcgggattggttacagcgatactgcctggatctcctccatcttgctagcaatgctgtacggcactggacctttatgtagcgtttgtgtgaatagatttggatgccgccccgtcatgcttgtcggcgggcttttcgcctctctgggtatggtggctgcctccttctgccgatctattattcaggtgtatctgactacaggcgtaataactggactcggacttgcccttaatttccagccatcactgattatgctcaaccgctacttctctaagcgtcgtcctatggccaatgggctcgcggcggccgggagtcctgttttcctgtgtgcgcttagtccgctaggacaattgctgcaggatagatacggctggcgcggcggtttcctcatccttgggggtctcctgctgaattgttgcgtttgcgcagctctgatgagacccctagtggtcacggcccaaccaggctctggcccaccaagaccctcacggcggctcctggacttgtccgtctttcgagataggggatttgttctatatgccgttgcagcctctgtcatggtgctggggttgtttgtacctcccgtatttgtagtatcctacgctaaagacttaggagtccctgatacgaaagctgcttttctgctgaccatcctagggtttattgacattttcgcaagaccagccgccggttttgtggccggtctgggcaaagtgaggccttattcagtatacctgttttcctttagtatgtttttcaacggactcgccgacctggctggctccactgccggagattatgggggattggtagttttttgtatattctttggtatctcatacggcatggtaggagctttgcagttcgaggttctgatggcaatcgtcggcacccataaattcagctccgccattgggcttgtgctgctgatggaggctgtcgccgttctagtaggccccccctctggcggaaagctactggacgccacccacgtgtacatgtacgtgtttattttagccggggccgaagtgttaacatcctcattgattctcctcctgggcaattttttttgcattagaaagaagcccaaagaaccacagcccgaggttgccgccgcagaagaggagaaactccacaagccccctgcagattcgggcgtcgacctgcgagaggttgaacattttctcaaggctgaacctgagaagaacggagaagtggtccatacccctgaaactagcgtgtag

SEQ ID NO: 17462 - DNA, 1398 bp, Artificial Sequence
  Description of Artificial Sequence: Synthetic coding sequence
atggggggcgcagtcgtggatgaaggacccactggagtgaaagccccggacggtggctggggctgggcagtgctgtttgggtgcttcgtgattacaggcttttcatacgcatttccaaaggcagtgagcgtgttctttaaagaactaatccaggaattcggcattgggtactcagacacagcatggatctcctccatacttctcgcaatgttgtacggcactggcccactctgctcggtctgtgtgaataggtttggatgcagacccgtgatgctcgtggggggcctgtttgctagcctaggcatggtggctgcctccttttgccgatcgatcattcaggtctacctgacaacaggtgtgatcactggtctgggcttggccctgaactttcagcccagtctcatcatgcttaacagatattttagcaagcgtcgaccaatggccaacgggctggctgcagcggggtctccggtgtttctgtgtgcactctcccctttgggccagcttctgcaggatcgttacgggtggcgtggcgggttcctgatcttagggggtctactcctgaactgttgtgtgtgtgccgcactgatgcgccctttagtcgtgaccgcgcagccaggttcaggacctccgcgtccttcacgacgtttgcttgacctgtctgtgttcagggaccgtgggtttgtcttgtatgccgtggctgctagtgttatggtgctgggcctattcgtaccaccagtgttcgtggtcagctacgcaaaggaccttggggtgccagacaccaaggctgcttttctactgacaatcctgggcttcatagacatcttcgcccgccctgccgctggcttcgtcgcaggactgggaaaagtgcgcccctatagcgtttatctattttccttcagtatgttctttaacggtctggctgacttggccgggtcaacagcaggcgactacggtggcttggttgtcttctgtatttttttcgggatttcctacggcatggttggagcactccagtttgaagttctcatggccatagtggggacccataaattttctagcgccatagggctcgtcctccttatggaagcagtggctgtcctggtgggccccccctccggagggaaacttctcgacgcaacccatgtctacatgtacgtgttcattctggccggagcagaggtcctaacaagcagtttgatccttcttctaggcaactttttttgcattcgcaagaagcctaaggagccccaaccagaggtcgccgccgccgaagaagagaaactgcataagccacctgctgactcaggggttgatttaagggaggttgaacattttctgaaagccgagccagaaaagaacggggaagtggtgcatacaccggagacctctgtttag

SEQ ID NO: 17463 - DNA, 1470 bp, Artificial Sequence
  Description of Artificial Sequence: Synthetic coding sequence
atggtgccttcttcgccagcggtggagaagcaggtgcctgtggaaccaggtccagatcctgagttgcgatcctggaggcatctagtgtgttacctgtgtttttacggctttatggctcagattcgccctggggagagcttcataaccccataccttttgggcccggataagaactttactcgcgaacaggtgaccaatgagatcacccccgtcctgtcatattcctacctggccgtccttgtccctgtttttcttcttacagactacctgcgttacaccccagtgttgctactccagggcctgtccttcgtgtcggtgtggctccttctgctcttaggacactccgtagcacacatgcagttgatggagctgttctacagcgttacaatggccgcgagaattgcttactctagctacatcttctctttagtgaggcctgctcgctaccagcgggtagccggctactctagggccgccgttctcctcggggttttcacctcttctgtcctgggacagctcctggtgactgtcgggcgcgtgtccttcagtactctgaactacataagcctcgcctttctaacattctctgtggtactggccctttttcttaagcggcccaaacggtcactcttcttcaaccgagacgatcgggggcggtgcgagacatccgccagcgaacttgaaaggatgaatcccggacctgggggcaagctaggccatgcactgagagtcgcatgtggcgactccgtcctcgccagaatgttgcgcgagctgggcgactccctgcggcgcccccaactgagactgtggagcctgtggtgggtgttcaatagcgccggatattatcttgtggtgtattacgtacacatcctgtggaatgaagtggatccaaccaccaattcagccagggtatacaatggcgccgcagatgctgccagcacgctgctcggtgctattacctccttcgctgccggattcgtcaagattaggtgggctcgttggtctaaactgctgatcgcgggggttactgccacacaagcaggactagtatttctgctggcccacacaaggcacccgagcagcatatggctgtgctatgctgccttcgtgctattcaggggctcatatcaatttctcgtgcccattgcgacatttcagatagccagcagcctgtccaaggagctttgtgcgctggtatttggtgttaataccttcttcgccacaattgtgaaaactattattaccttcatcgtctcagatgtccgcggcctgggactccccgtgaggaaacagaacgaggagctgcatgtcgcctctctctcactgtggaaaagccacctgcgactcgccgcggacacgctgtctagtgaggggtcatcaggatccggccccagaagctggtttctgtcccccaccctccgagcagccctccacggacccgtgtgcccctcagaggtatgtccttcctag

SEQ ID NO: 17464 - DNA, 1776 bp, Artificial Sequence
  Description of Artificial Sequence: Synthetic coding sequence
atggttccctcaagcccagcagtcgagaaacaagtgccagtggagcctggccccgaccccgaactccgtagctggagacatttggtgtgttacctctgcttctacggcttcatggcacaaataaggcccggcgagtctttcattacgccatatcttttgggcccagacaaaaattttacacgagaacaagtcaccaatgaaatcacccctgtcctcagctacagttacttggcagtgctggttccggtgttcctgctgacagactacctccgatatacaccagtgctccttctccagggcttgagcttcgtaagcgtctggttgttgcttttattgggccatagtgtggcccatatgcagctaatggagctgttttacagcgtgactatggccgctcgcatagcctatagtagctacatattctcactggttcggcccgctagatatcagagagtagcaggctactcccgggctgccgtgctcttgggggtgttcacctcatccgtactggggcagctgcttgttacagtaggccgcgtgtccttcagcaccctgaattatatctctctggcctttcttactttctcagtcgtcttggctctgttcctcaagaggcccaaaagaagcctgttcttcaatagagatgatcgggggcggtgcgaaactagcgcctctgaattagagcgaatgaaccccggacccggggggaagctgggacatgcccttagagtcgcatgtggcgacagtgtgcttgctagaatgctcagggagttaggagatagcctcagacggccccaattgcgactctggtcgctgtggtgggtgtttaatagcgccggctactatttagtggtctactatgtgcacatcctgtggaatgaagtggaccccacaaccaactctgcccgcgtgtacaacggcgccgctgatgccgcaagtaccctactcggtgccattacttcattcgccgccggattcgtcaagatccggtgggcacggtggtccaaactcctcattgcgggcgtgaccgccacacaagccggactggtattcctgctggcacacaccaggcatccctccagcatatggctgtgctacgcagcatttgtcctgtttcgcggaagctaccagttcctcgtgccaattgcaacctttcaaattgcgagcagtctatccaaggagctgtgtgctcttgtcttcggagtgaatacattcttcgccacaatcgtcaaaactattataaccttcatcgtgtccgacgtgagaggccttggtctcccagtccggaaacagttccagctttacagcgtctattttctgatccttagtatcatatattttctaggagctatgctggatggcctgagacactgtcagcgcggtcatcatccaaggcagccacctgcccaggggcttcggtccgcggccgaggaaaaagctgcccaggccctatctgtccaggataagggtctcggcgggcttcagcctgcccaaagtcctcctctaagtccagaggatagcctcggtgccgtcggccctgcctccctggagcagcggcagagcgacccctatctagctcaggctcccgcaccgcaggcggccgagttcctgtcgcctgtcacaacgccgagcccttgtacattatgctccgctcaggcatctgggcctgaagcggcggatgaaacatgccctcaactcgccgtgcatccaccgggggtctctaagctgggcctgcagtgtctgccatctgatggcgtccagaatgtgaaccagtag

SEQ ID NO: 17465 - DNA, 846 bp, Artificial Sequence
  Description of Artificial Sequence: Synthetic coding sequence
atgctgagagagctgggtgactccctgagacgaccccagctgcggctctggagtctgtggtgggttttcaactctgcaggctactatctcgtggtgtattacgtgcacatcctgtggaatgaggtcgaccccacaaccaacagcgcaagggtctataatggtgctgccgatgcagcatctacccttttgggtgccataacatcttttgcggctggctttgtaaagatccggtgggcgagatggagtaagctgctcatcgctggggtcaccgctacccaggccggccttgttttcctcttagcacatacccgacacccctctagcatctggctgtgttacgccgccttcgtgttatttcgcgggtcttatcagttcctcgttcccattgcgacatttcagatcgctagtagcctttcaaaggagctatgtgcgctcgtgttcggagtaaacacgttctttgccacaatagtgaagaccatcataactttcatcgtgtcagatgtgcggggtctaggactgcccgttagaaagcaggctctccgaatgtcccggccccgcctgggactgtgtctgccaggccctttccctcctcagagcgctgcccccgccagagctggaatggctgcctcatctgccgaggaccctggctcggaacggggaccatggagaagagctggcaccgttgcggctcggggagatccgggaggagagaggggcccgtggcggcgagaagggactctggcggcgcgcggggaccctggaggcgaacggggaccatggtggcgggagggaaccttagcagccaaacctcggatgcagtgggtaacacgagctacggcaccatag

SEQ ID NO: 17466 - DNA, 810 bp, Artificial Sequence
  Description of Artificial Sequence: Synthetic coding sequence
tagcttcgcctgtggtcactgtggtgggtgttcaattccgctggttactatctcgtagtttactacgttcatatcctgtggaacgaggtggaccccactacaaatagcgctcgagtgtataacggggctgcggatgctgccagcacacttttgggcgccattacttcattcgctgctggctttgtgaagatccgttgggctagatggtccaagctgctgatcgccggcgtgacagctacccaggcaggcctggtcttcctgctagctcacactaggcaccccagctctatctggctgtgttacgctgccttcgtgttattccgaggttcctatcagttcctcgtgccaatagctacattccaaattgcaagttccctctcaaaagagctttgcgccctggtgttcggcgtgaacaccttctttgctaccatcgtgaaaacaattataacattcatcgtatcagatgtgcgtggactgggactacctgtcagaaagcaggcccttagaatgagccgtccacgactgggtctgtgtctccccggtcctttcccacctcagtctgcggctcctgctagggcgggcatggcagcatctagtgcagaggatcccggatcggagagagggccatggcgccgtgcaggaacagtcgctgccagaggcgaccctgggggagaacgggggccctggcgccgcgaaggaaccttagcagccaggggagatccaggcggggaaagagggccatggtggcgagagggcacattagccgccaagcctcggatgcagtgggtgactcgcgccacggcgccgtag

SEQ ID NO: 17467 - DNA, 549 bp, Artificial Sequence
  Description of Artificial Sequence: Synthetic coding sequence
atggtgcccagcagccccgctgttgagaagcaggtcccggtggagcccggtcctgaccccgaattaagatcctggcgccacttagtgtgctacctctgcttctatgggttcatggcccagatccggccaggggaatcctttatcacaccctacctcttgggcccggacaaaaatttcaccagggagcaggtgacgaatgagataacccccgtgctaagttacagttacctggctgtgctggtgcctgttttcctcctcacggactacctgaggtacacaccagtgcttttgttgcaaggcctttcttttgtctcggtatggttgcttttactcttaggacatagcgttgctcacatgcagctgatggaactgttttactcagtgaccatggctgcgcgtattgcttattcttcctacattttttccctggtgcggcccgccagataccagagggtggctggctatagtcgtgccgctgtcctgctaggggtctttacctcatcagtcctcggccaactcttggtgaccgtgggcagggtgagcttctag

SEQ ID NO: 17468 - DNA, 465 bp, Artificial Sequence
  Description of Artificial Sequence: Synthetic coding sequence
atggttccaagcagccctgctgtcgagaaacaagtccctgttgagcctggcccggacccagagctgcgctcctggaggcacctggtctgctacctgtgcttttacggctttatggcacagatcagacccggagagagtttcatcactccttacctgctgggacccgataagaatttcacacgggagcaagtgactaatgagattacccctgttctgagctacagttatctcgccgtgctggtgcccgtatttttgttgaccgattacctgagatacactcctgtgctgctgttgcaagggctcagctttgtttctgtgtggttgctgctgttgctgggacactccgttgcgcacatgcagttaatggagttgttctattctgtgactatggccgcaagaattgcatacagtagttacattttcagccttgtgcgtcccgctcggtaccaacgtgtagctggctag

SEQ ID NO: 17469 - DNA, 1656 bp, Artificial Sequence
  Description of Artificial Sequence: Synthetic coding sequence
atgcgcccacagcctgccgaacctgcccctggtggccgaggcaacgaggcttgttcaattcactcggaggttactaatgagatcacacccgtactgagttactcttacctagcggtcctggttcccgtctttcttttaaccgactatctcaggtacacacctgtgcttttattgcagggcctctcctttgtctcggtctggctcctactgttgttggggcattcggtagctcatatgcagcttatggagctgttctactctgtaactatggctgccaggatcgcttacagctcttacattttctccttagtgcgccccgcacggtatcagcgcgtggcgggctactcgagggcagcagtattgctcggagtatttacttcctccgtcttaggacagctgctcgtcacagttggacgtgtctcttttagcacgctaaattacattagtctagctttcctgacgttctcggtcgtcctcgcactgtttttaaagcgcccaaagagatcgttgttcttcaaccgtgatgatcgcggccggtgcgaaacttctgccagcgaattagagagaatgaaccccgggccagggggtaaactgggtcatgctctgagagtggcctgcggcgatagcgtcctggcgcgcatgctgagggagcttggcgacagcctgaggagacctcagcttaggctgtggtccctgtggtgggtttttaactctgctggctactatctcgttgtctactacgtccacattctgtggaacgaggtcgacccgaccacaaactctgcccgcgtgtataacggtgccgctgacgccgccagtacgctgctcggggcaatcacatcatttgccgctggctttgtgaagatccgttgggctcgatggagtaaactgctgattgccggagtgaccgcaacccaggccggtttagtctttttgttagcgcacaccagacatcccagtagtatctggctgtgctatgccgcctttgtgttgtttagaggttcgtatcaatttctggttcccattgctactttccaaatcgcttcctccctttcaaaggagctgtgcgcactggtgttcggggttaacacttttttcgcgacaatagtgaagacgatcattacatttattgtttccgacgtgagaggcctcggactgccagtacgtaagcagtttcagctgtattccgtttattttctgatactttcaatcatttatttcctgggagcaatgctggacggcctccgacactgccagcggggccatcacccaagacagcctcccgcccaggggctcaggtcggctgcggaggagaaggcggctcaagcccttagcgtgcaggataaagggttaggtgggctgcagcctgcacagtcacctccgctctcccctgaggatagccttggagcagtaggtccagcttccctcgagcagaggcagtccgatccctacctcgcacaagcacctgcgccccaggctgcagagttcctcagccccgtgacaacaccttctccatgcacgctgtgttctgcccaggcatcaggccctgaagcagctgacgagacttgtccccagctggccgtgcatccacccggtgtcagcaaattaggactgcaatgcctgccatcagatggggtgcagaatgtgaaccagtag

SEQ ID NO: 17470 - DNA, 186 bp, Artificial Sequence
  Description of Artificial Sequence: Synthetic coding sequence
atggttccaagctcgcctgccgttgagaaacaggtgcccgttgagccaggccccgaccccgaactcaggagctggagacatctcgtttgctatctctgtttctatggattcatggcccagatacgccccggcgagagtttcataactccatacctgttaggcccagacaagaactttaccaggtag

SEQ ID NO: 17471 - DNA, 705 bp, Artificial Sequence
  Description of Artificial Sequence: Synthetic coding sequence
atggagccctctagcaagaagttaaccgggaggctcatgctcgcagtgggaggggcagtgctcggaagtctgcagtttgggtacaacactggtgtcatcaacgctcctcagaaggtgatcgaagaattctacaatcagacgtgggtgcatcgctacggagagagcatcctccccacaacgctcacaacactctggagtctgtccgttgccatctttagcgttggaggaatgatagggtcattctccgtgggcctcttcgtcaaccggttcggacgaagaaacagcatgctcatgatgaacctcctcgcctttgtgagtgccgtgctcatgggatttagcaaattggggaagtcatttgaaatgctgattttgggaagatttatcatcggcgtatattgtggcctgactacaggcttcgtcccaatgtacgtcggcgaggtgtccccaaccgccctccggggggccctgggcacattacaccaattgggcattgtggtcgggatcctgatcgcacaagtctcctggggccgcatttacctgcctggcacggctcctgcacactcattctcaggctctcgaatatgtgcacagcagggcagggtgtcattacctccatccccccattccttagcagaggacaactatgggacacaggtacagcggacccaacaccatggcttaccggttgacagcaaaatgacatag

SEQ ID NO: 17472 - DNA, 1377 bp, Artificial Sequence
  Description of Artificial Sequence: Synthetic coding sequence
atggagcccagcagcaaaaagctgacaggccgcctcatgcttgccgtcggcggggccgtcttgggcagcctgcagttcggctacaatactggcgttataaacgcaccacagaaagtgatagaggagttctacaatcagacctgggtccatcggtacggagaatcgatattgccaacaactctgaccactctgtggtccctgtccgtggctatattttcagtgggtggcatgatcgggagcttttcagtcggcctctttgtcaatagattcggacggaggaattcaatgctgatgatgaatttactcgcattcgtttcagccgtcctgatgggcttttcaaagttaggaaaatccttcgaaatgttaatcttagggagattcataatcggagtttactgcgggttaactactggattcgtccccatgtacgttggagaggttagtccaacagcccttagaggcgcgcttggaacacttcaccaactgggaatcgttgtaggtatcctgatagcccaagtttttggcctggatagcatcatggggaacaaggatctctggcccctgctgctgagcatcatattcatcccagccctcctgcagtgcatcgttctccccttttgcccagagagtccaaggttcctgttgataaacaggaatgaagaaaaccgtgcgaaatccgtcctgaaaaagctcaggggaactgcggatgtcacccacgatctccaggagatgaaggaggagagccggcagatgatgagggagaagaaagtcactattctggaattgttccggtcacctgcttatcggcagcccatcctcattgcagtggttctacagctaagtcagcagttatctgggatcaatgccgttttctattactctacaagcatcttcgaaaaagctggggttcagcagccagtctacgcaactatcggtagcggaatcgtgaacactgcattcaccgtggtgtcattgttcgttgtagagagggccgggagacggacattgcatctcattggactggcaggaatggctggctgtgctatcctgatgacaatagctctcgccctgctggagcagctcccctggatgtcctacctctctattgtggcaatctttggcttcgttgctttcttcgaggtggggcccggtccgataccatggttcatagttgccgagctcttctcacaagggccccgtccagccgccattgccgtagcgggtttctctaattggacatccaatttcatagtaggcatgtgcttccagtacgtggagcagctgtgcggaccttacgtttttattatttttacagtgttgttggtgctattcttcatattcactttaaacggctctatgccagaggggggcgactag

SEQ ID NO: 17473 - DNA, 1305 bp, Artificial Sequence
  Description of Artificial Sequence: Synthetic coding sequence
atggaacctagttctaagaagctgacaggacgccttatgctggctgttggaggggccgtgctagggagcctacagtttgggtacaacaccggggtgatcaatgccccgcaaaaagttattgaggaattttacaatcagacgtgggtgcaccgctatggcgaaagcatactgcctacgactttgaccactctgtggtctctatctgtggctatttttagtgtaggcggcatgatcggatcattctccgtggggctcttcgtgaatagattcggcagaaggaacagcatgctgatgatgaatctgctcgcattcgtacctatgtacgtgggcgaggtttctcccaccgccctgagaggggctctgggtacacttcaccaactgggtatcgtggttggaatcataatcttcatccccgctttactccagtgcatcgtgcttcccttctgtcctgaatctccacgattcctgctgatcaataggaatgaggaaaatagagccaagagcgtgcttaagaagctacggggcacggccgatgtcacccatgacctgcaggagatgaaggaggagtctcgccagatgatgagagagaagaaggtgaccattctagaattattcaggtctcccgcttaccgtcaacctatcctgattgccgtggtgcttcaactgagtcagcagctaagcgggatcaatgccgttttttattacagtacctctatctttgagaaagctggcgtgcagcagccagtatatgccactatcgggagtgggattgtgaataccgcttttacagttgtcagcctgttcgtggttgagagggctggcagaagaaccctgcacctaatcgggctggccggcatggcagggtgtgccattctaatgaccatcgccctggcacttttggagcaattaccttggatgagctacctgtccattgtggcgatctttggatttgttgctttctttgaagttgggcctgggccgattccttggtttatcgtggcggagctcttcagtcaaggacccagaccggctgcaatcgccgtcgccggtttttctaactggaccagtaatttcattgtggggatgtgtttccagtatgtcgagcaattgtgcggtccttatgtctttattatattcactgtcttacttgtgcttttttttatttttacatattttaaagtacctgaaactaagggaaggacttttgatgagattgccagcggtttccgacagggcggtgcttctcaaagtgacaagaccccggaagagctcttccatccactaggcgctgatagtcaggtgtag

SEQ ID NO: 17474 - DNA, 528 bp, Artificial Sequence
  Description of Artificial Sequence: Synthetic coding sequence
atggagcccagtagtaaaaaactgacagggcgtctgatgctggcagtgggaggggcggttttggggtcgctgcaattcggatacaatactggcgtaattaatgcaccgcagaaggtgatcgaagaattttacaatcagacttgggtacaccggtatggtgagagcatacttccgacaacactgactacgctgtggagcttgtccgtggccatcttctcagtgggcggaatgatcggcagtttcagtgttggtctgtttgtcaatagattcgggaggcgaaatagcatgcttatgatgaatctattggcttttgtgtccgccgtgctcatgggtttcagcaagttaggaaatcctaaattagagaccaccgacacaccactccctaaaaagtttccttttagaccccaggcccggaaggttactgcggtgcagtgtccattctgcctctctatctgtcccctccacagccttcttattttgggccctacatccacagcaactgaggccggcaagggacacaacgtgtag

SEQ ID NO: 17475 - DNA, 1479 bp, Artificial Sequence
  Description of Artificial Sequence: Synthetic coding sequence
atggagcccagtagtaagaagcttacaggccggctcatgctggctgtggggggggctgttctgggctccctccaattcggctataataccggcgttataaacgcaccccaaaaagtcatcgaggagttctataatcagacctgggttcacagatacggggaatcgatcctgcctacgacgctcacaacactctggtcactcagcgttgcaatcttctctgtgggtggcatgattgggagcttttccgtcggcttattcgttaatagatttggacgtcgaaactccatgttaatgatgaatctgctggcctttgtatcggccgtccttatgggcttcagcaaactgggtaagagcttcgagatgttaatattggggagattcattattggtgtatactgcggtctgaccaccggattcgtgcccatgtacgtgggagaagtgtcacctaccgcactccgcggcgccttaggtacactgcatcaactgggtatcgtagtaggtatcctgatagcccaagtgttcggcctagactcaattatgggcaataaagacttgtggcctcttctgcttagcatcatctttattcctgctctgctccagtgcatcgtgctgcccttttgtccagagagtcctcgctttctgctgatcaaccgcaatgaggagaaccgagcaaagtccgttctcaagaagctacggggcaccgccgatgtgactcatgacctgcaggaaatgaaagaagaaagccggcagatgatgagagaaaagaaggttacaatcctggagctgttcagaagcccagcgtatcgccaacccattctaatcgccgtagtcctgcagctctctcagcagttatccggcatcaacgcagttttctactactctaccagtatcttcgagaaggcaggagttcagcagcctgtttacgctacaatcggatccggcattgtgaacacagcttttactgtcgtctctctcttcgtcgtggaacgagccggccggaggacgcttcatctcattggcctggccggcatggccggctgcgcaattcttatgaccatagccctggcccttttggaacagctcccatggatgagctatttgtcaattgtagccatttttggattcgtggccttcttcgaggtcggtcctggtccaataccctggttcatcgtggccgaactgttttcccagggcccgcgtccagcggctatcgccgttgccgggtttagcaattggacatctaacttcattgtggggatgtgtttccaatatgtggaacagctttgtgggccatatgtatttattattttcaccgtcttattggtgttgttcttcatctttacctattttaaagtgcctgagacgaaagggagaacatttgacgagatcgcaagcgggttcaggcaggggggcgcctcccaatcggacaaaactcccgaagaactctttcaccccctgggcgctgacagccaagtgtag

SEQ ID NO: 17476 - DNA, 753 bp, Artificial Sequence
  Description of Artificial Sequence: Synthetic coding sequence
atgctgatgatgaatctgttagcatttgtgagcgccgtcctgatggggttctccaagctgggcaaaagtttcgagatgcttattttagggagatttattatcggtgtctactgtggcctgacaacaggattcgtgcccatgtatgtgggcgaggttagcccaacagcgctgcggggggctctcgggacacttcatcaattgggcattgttgtgggcatcctgatagcccaagtgttcggtttggactcgatcatgggaaacaaggatctgtggcctcttctgttatctattattttcatcccggccttgctacagtgcatagtgctgccattttgtccagaaagccctaggttcctgctgatcaacaggaacgaggaaaaccgtgctaaaagtgtgctcaagaagttacgtggaaccgccgacgtgactcatgacctgcaagaaatgaaggaagagtcacggcagatgatgagggaaaagaaagtgaccatactggagctattcagatcacctgcttataggcaaccgatcctgatcgctgtcgtgttacaattgtctcagcagctgagtggcatcaatgctgtattttactattccacatccatatttgagaaggccggtgtccagcaaccagtctatgcgacgatcggcagtggcatcgtgaacacagccttcactgtggtgtctgtgagcctgtgtctgctcgcaccgcccgccaaaccccaggggggggggtccgccatctttccctag

SEQ ID NO: 17477 - DNA, 1671 bp, Artificial Sequence
  Description of Artificial Sequence: Synthetic coding sequence
atgccgagtttcgatgaggcactgcaaagggtgggtgaatttgggcgattccaacggcgggtgttcctcttgctgtgtctcaccggggtgaccttcgccttcctcttcgtgggcgtagtttttctcgggacacagcccgaccattactggtgcaggggccccagcgccgctgcacttgccgaaagatgtggttggagtccagaggaggagtggaatcggaccgcccccgcttcaaggggacctgagccgcccgagcggcgcggcaggtgccagaggtatctgctggaagccgcaaatgactccgccagcgcaactagtgccctttcatgtgcggatcccctggccgcgttccccaaccgttcagcacctctagtcccttgccgcggcggctggcggtacgcccaggcccactcaactatcgtttccgagttcgatctcgtgtgcgtgaacgcctggatgcttgacttgacccaggccatcctcaacttgggcttcttgactggagcctttacccttggctatgctgccgacaggtacggacgtatcgtcatctatctcctgagctgtctgggcgtcggtgtgactggagtggtagtggcctttgcccctaactttcctgtgtttgtgatcttccgttttctccaaggggtttttggaaaagggacatggatgacttgctacgtcatcgttacggaaatagttggcagcaaacagcgtagaattgttggtatagtaatccagatgttttttactctgggcatcatcattctccctggaatcgcctattttatccccaactggcaaggaatccagctggcaattacgttgccatcgttcctgttcctgctctactactgggtcgtgcctgaatcgcccaggtggctgattactagaaagaagggggacaaagccttacagatccttcgccgaatagcaaaatgtaatgggaagtacctgagtagcaattacagcgaaataactgtcacagatgaggaagtcagtaatccttcatttctcgacttagttagaacacctcagatgcggaagtgtacactgattcttatgttcgcctggtttacaagtgcagtcgtttatcaaggcctggtgatgagactgggcattatcgggggcaatttgtacattgacttctttatatcaggcgtagtagaattaccaggggcactgctgattctgctaactatcgagcgtctcggaagacgcctgcccttcgccgcttctaatatcgtagccggtgtggcctgtttagtgactgcctttctgcctgaagggatcgcctggctgcgcaccactgtagccactctcggccgattaggcataaccatggccttcgagatcgtgtatttggtcaattccgagctgtacccaaccaccctgcgcaattttggggtctctctgtgtagtggcttgtgcgatttcggaggcataatcgctcctttcctcctgtttagactggccgcagtgtggctggaactaccactgatcatctttggcattctagcgagcatctgcggcgggctagtcatgctgttacctgaaacaaaagggatcgcactccctgaaaccgttgacgacgtcgaaaaactcggaagtccgcatagctgtaaatgcggaaggaacaaaaaaacaccggtgtctcggtctcacctctag

SEQ ID NO: 17478 - DNA, 1674 bp, Artificial Sequence
  Description of Artificial Sequence: Synthetic coding sequence
atgcccagtttcgacgaagccttgcagcgcgtgggggagtttgggcggtttcaacggcgcgtgttcctcctcctgtgtctaaccggagtgaccttcgcatttctttttgtcggggtggtttttttggggacacagcccgaccactactggtgtcgcggaccctccgctgcggcactcgcagagcgatgtggctggagtcccgaagaagagtggaataggacggctccagcttccagggggcccgagccacccgagcggcggggccgctgtcaaagatacctgctcgaggccgccaatgactctgcgagcgcaacctccgctctgtcttgcgcagacccactcgcagcatttcccaacaggagcgcacctcttgtgccatgcaggggaggttggcgctatgcacaagctcatagcaccattgtcagcgagttcgatctggtatgtgttaacgcctggatgttggacctcacccaggctattttgaatcttggtttcctgacgggtgccttcaccctcggatacgctgcagatagatatggccggatcgtaatctatctactaagttgtttaggagtcggagtcactggggttgttgtcgcttttgctcccaactttccagtgtttgtgatatttcgattcctgcagggcgtcttcggcaaaggaacatggatgacctgctacgtgatcgtcacggagatcgttggaagtaagcaacgcaggatagtcggtatcgtcattcagatgttctttacgcttggcataatcatcctgcccggtatcgcctatttcatccctaattggcaggggatacagctcgcaatcacactgccctcattcctgtttttgctttattactgggtggtgccagaatcacctcgctggctgatcacacggaagaaaggcgataaagctctccagattttgaggcgcatagctaagtgcaatgggaaatacctcagctcaaattacagcgagataactgtaacagatgaggaagttagcaatccctccttcttggacctggtgaggaccccgcagatgagaaaatgtacgctgattctgatgttcgcatggtttacgagtgcggtggtttatcagggcctggttatgcggctcggcatcattggcggcaatttgtatatcgacttctttatatcaggcgttgtcgaactacccggggctctgctaatcctgctgacgatcgaacggttgggtcgtcggctgcccttcgcagcaagcaatattgtggctggggttgcctgtctggtgacggccttcttaccggaggccgggattgcctggttgcgaactaccgttgctacattaggcaggctgggcattaccatggcgttcgaaatagtttacttagtcaacagcgaactgtaccccaccacactgcgcaactttggcgtctctctgtgctctggactgtgcgatttcgggggtattatcgccccgttccttcttttccgactcgccgctgtgtggttagagctgccgctcatcatttttggtatactggcgtccatctgcggtggcctcgtaatgctgctgcccgaaaccaagggcatagcccttcccgagacagttgacgacgttgagaagttgggatcacctcactcgtgtaagtgcggaaggaacaagaaaactcccgtttccaggtcacacctgtag

SEQ ID NO: 17479 - DNA, 1017 bp, Artificial Sequence
  Description of Artificial Sequence: Synthetic coding sequence
atggaactccgtagcggatccgtgggtagccaggccgtggcccggagaatggacggagactccagagatggtggagggggcaaagacgccacaggatccgaggactacgagaatcttcccacatctgcgagcgtcagcacccatatgaccgccggggccatggcaggtattctggagcattccgtcatgtatccagtagatagtgtcaagactcggatgcagtcactctccccagatcccaaagctcaatatactagtatatatggcgcattaaagaaaattatgaggactgagggtttttggcggcccttgcggggggtcaacgtcatgattatgggcgccggtcccgcccacgcaatgtattttgcctgctacgagaatatgaagagaacgctcaacgacgtattccatcatcagggtaactcccacctggctaatggcatcgccggcagcatggccactctccttcatgacgcagtgatgaaccctgccgaagtcgtgaaacagagactccagatgtataactctcagcaccggagtgctatctcctgcattcgcactgtgtggcggactgaggggctgggagcattctaccggagttacaccactcaactgaccatgaacatccctttccagtcaatccactttataacctacgagtttttgcaggagcaggtcaatccccaccgcacatacaacccacagagtcatattatatccggaggtctggcaggagcactggcagccgcggcgacaaccccgctcgacgtctgtaagaccctcctgaacacccaggagaacgtcgctctttctctggctaacataagcggcagactaagcggaatggctaacgctttccggaccgtataccagcttaatgggttggcaggctacttcaaaggcattcaggcacgtgtgatttatcaaatgccttccaccgcaatatcctggagtgtctacgagttcttcaaatattttctaaccaaacggcagctcgagaacagggcaccgtactag

SEQ ID NO: 17480 - DNA, 2268 bp, Artificial Sequence
  Description of Artificial Sequence: Synthetic coding sequence
atggcaaggaagctgtcagtgatccttatccttacctttgctctttctgtgacaaatcccctgcatgaacttaaagcagccgcgttcccccaaaccactgagaaaatatcccctaactgggagagcggaattaacgtcgatctggctatttccactcgacagtaccatctgcaacagcttttctatcgatacggcgaaaataactccctatccgtggagggtttcaggaaattgctccagaacatcggaatcgataaaatcaagcgaatccacatccaccacgatcatgaccatcacagtgatcacgaacatcatagtgaccacgagcggcattctgaccatgaacaccacagcgaacacgagcatcacagtgaccatgatcaccactcccaccacaaccatgccgcctccggaaaaaacaaaagaaaagccctttgccccgatcatgattcagattcctcgggaaaagatccgcgcaattcgcaagggaagggggcccacagacctgagcacgccagcgggcggcgcaatgtaaaggactcagtgtctgccagcgaagttacatctacggtttataacactgtgagcgaaggtacacactttctggagactatcgaaaccccgcgtcctggaaagctattccccaaggacgtctctagtagtacccctcccagcgttacctccaagtccagggtgtctagactggccggaagaaaaactaatgaatccgtcagcgaacctagaaagggttttatgtacagcaggaacacaaatgaaaaccctcaggagtgttttaacgccagcaagctgctgactagccacggcatggggattcaggtcccactgaacgccaccgaatttaactacctctgtccagccattatcaatcagattgatgccaggtcatgtctcattcacacaagcgagaaaaaggcagagatccccccaaaaacctatagtctccagattgcttgggtgggtggattcatcgccatcagcattatcagttttttgagccttcttggagtcattctagtcccacttatgaatagagtctttttcaaatttctcctgagcttcttggtcgctttggctgtgggaacattgagcggtgatgcatttttgcacttactgccccattctcacgcgagccaccaccatagtcatagtcacgaggagcccgcaatggaaatgaaacgaggacccctgttttcccatctttcgtcacagaatatagaggaatctgcttacttcgactccacatggaagggcctgaccgccctgggcggcctctatttcatgttcctggtcgaacatgtgcttacactaatcaaacagtttaaagataagaagaaaaaaaaccagaaaaagccagagaatgacgatgatgtcgagatcaagaaacaactctctaagtatgagtctcagctgagcacgaacgaagaaaaggttgacaccgacgaccggactgagggttatttgcgtgctgattcccaggagccgtcccacttcgatagtcagcagcccgcagtcctggaggaagaggaggtgatgatagcacacgctcatccccaggaggtgtataatgaatatgtgcctcgaggttgcaagaacaagtgccattctcatttccacgatacacttggccagtctgacgatttgattcaccatcaccacgactaccaccacatcctacaccaccaccatcaccagaatcaccatcctcacagccatagtcagagatatagccgggaggagctgaaagacgcaggcgtggcaaccctggcttggatggtcattatgggagatggccttcacaatttttcagatggactggctattggggctgcgttcacagaagggttgagctccggactctccacaagtgttgcagtcttttgtcacgagcttcctcatgagctcggcgacttcgccgtgcttctgaaagctggaatgactgtgaaacaagcagtgctgtacaatgctttgagtgctatgctcgcgtatttgggtatggcaactggcattttcattgggcactatgcagagaatgtgagcatgtggattttcgccctcactgccgggctgtttatgtacgtcgcacttgtcgatatggttcccgaaatgttgcacaacgacgctagtgaccacgggtgtagccgctggggatatttttttctccagaacgccggcatgctgctcggatttggaataatgctgcttattagtatatttgagcacaaaatagtctttagaattaatttctag

SEQ ID NO: 17481 - DNA, 1302 bp, Artificial Sequence
  Description of Artificial Sequence: Synthetic coding sequence
atgggcattcaggtgcccctgaatgccactgagtttaattatctgtgtccggctattatcaaccagatcgacgccagaagctgtctgattcacacctctgagaaaaaagccgaaatcccaccaaagacttactccctgcagatagcctgggtgggaggctttattgcaatcagcattatatcttttttgagtctgctgggggttattctcgtgccactcatgaaccgcgttttcttcaagtttcttcttagctttctagtagccctggccgtcggtacgctctccggcgatgccttcctccatcttctcccacattcccatgcctctcaccatcactcccacagtcatgaagagcccgccatggaaatgaaacggggccctctgtttagtcatctcagctctcaaaatattgaggaatctgcgtacttcgactctacatggaagggcttaacagccctcgggggcctgtattttatgttcctggtcgagcatgtccttactctcataaaacagtttaaggataaaaaaaaaaagaaccagaagaaacccgagaatgatgacgacgtggaaatcaagaagcagctcagcaagtacgagtcccagttatccacaaatgaagagaaagtggatactgatgataggaccgaggggtatctcagagccgactctcaggaaccatcccacttcgacagtcaacagccagctgtcctggaagaagaggaagtcatgatagcccacgctcacccacaggaggtatataacgagtacgtgcctcgagggtgcaagaacaagtgccacagtcatttccatgacacattgggccagagtgacgacctcatacatcaccatcatgattatcatcacatcctccaccatcaccaccaccagaaccatcacccccactcgcattcccagagatactccagagaggagctgaaggatgcaggtgttgcaacccttgcttggatggtcataatgggtgacggactacacaacttttcagatgggttggctattggtgctgctttcactgagggactgtcttcaggactcagtactagtgtcgctgtgttctgtcacgagttgcctcacgagctgggggacttcgccgttcttttaaaagccggcatgaccgttaaacaagctgtcctgtacaacgcactgagcgccatgcttgcttacctgggcatggccaccgggatcttcataggacactatgccgaaaacgtgtccatgtggatcttcgccttaactgctggtctgtttatgtatgtggctctggtagatatggtctctttctag

SEQ ID NO: 17482 - DNA, 1233 bp, Artificial Sequence
  Description of Artificial Sequence: Synthetic coding sequence
atgggcatccaggtccccctgaacgctaccgagttcaattacctctgccccgctatcatcaatcaaatagacgctagatcatgtcttatccatacgagtgagaagaaggcggaaattccgccaaaaacgtactcgctccagatagcctgggtcggagggtttattgccatttctattatctcgttcctaagtctcttgggcgtaattctcgttccattgatgaatagggtcttttttaagtttctgctatctttcctggtggccctcgccgtgggtaccctaagtggcgatgcattccttcacctgctgccccatagtcacgccagccaccatcattcccatagccatgaagagcctgcaatggaaatgaaacgcggaccccttttcagtcacctgtcctctcagaacatagaagagtcagcctacttcgatagcacgtggaagggcctgactgcacttgggggactgtatttcatgttcttggtggagcacgtgctcacattaatcaaacagttcaaggataagaagaagaagaaccagaaaaaacccgagaatgatgacgatgttgagattaaaaagcagctgtcaaagtatgaatctcagctgagtacaaacgaagaaaaagtggacaccgatgataggaccgaaggttacctgagggctgactctcaggaaccgtcacacttcgacagtcagcagccagcagtgctcgaagaggaggaggtcatgatcgctcacgcccacccgcaagaggtctataatgaatacgtgccgcgcggatgtaagaacaagtgccactcacactttcacgatacattaggccagagtgatgatctgatccaccaccaccatgactatcaccatattctccaccaccaccaccaccagaatcatcacccacattctcactctcagaggtattcgcgcgaggagttgaaggacgccggagtggctacattggcttggatggtgattatgggcgacggcttgcacaatttctccgatggcctggctatcggagccgcgtttacagagggcctctctagcggcctgtctacctctgtagccctcgttgacatggtcccagagatgttacataatgacgccagcgaccacggttgttcacgttgggggtatttcttcctgcagaacgcaggcatgctgctgggctttggcattatgctactaatttctatattcgagcataaaatcgtcttcagaatcaacttttag

SEQ ID NO: 17483 - DNA, 1833 bp, Artificial Sequence
  Description of Artificial Sequence: Synthetic coding sequence
atggacacacctaggggaatcggtacctttgtggtgtgggattacgtcgtctttgcgggcatgctcgttataagcgccgctatcggcatttactacgcgttcgccgggggcggccaacagacatctaaggatttcctcatgggaggacgacggatgactgccgtgcccgtggccctatccctgactgcctcattcatgtcggcggtgaccgtgctgggtactccctctgaagtttaccgatttggcgcaattttctccatttttgccttcacatatttcttcgtggtggtgatctccgccgaagtcttcctgcccgtgttttacaagctcggcataacaagcacctacgagtatcttgagctgcgtttcaacaaatgtgtaagattatgcggcacagttttattcattgtacagactatactgtacaccggcatcgtgatttacgcacctgcattagcattgaaccaggttaccggtttcgatctatggggagctgtggtcgccactggagtggtctgcaccttctattgcactctaggcggcctgaaggccgtaatctggactgatgtgttccaagtgggaatcatggtggcgggattcgccagtgtcataatccaggccgtggtgatgcagggagggatctcaaccatactgaacgacgcttatgacggcggtagactgaacttttggaatttcaatcccaaccccctgcagcgacacaccttttggaccatcatcatcggcggaacctttacctggacttcgatttacggggtgaaccagagccaggtacagagatacatttcttgcaagtccagattccaggcaaaactgtctctttatatcaacctggtgggtttatgggccatcctcacctgctctgtcttctgcggattggcgttgtactctaggtatcatgactgcgacccatggaccgcgaaaaaagtatccgcacccgaccaactcatgccctacctggtgctagacatactgcaggactaccctggcttacctggcctgttcgtagcgtgtgcttactccggaactttgagcactgtgtcgagctccataaacgcactggctgctgttactgtggaagatctgattaagccctactttcggtcactaagcgagcgcagcctgagctggatctcccaagggatgtctgtagtgtatggtgctctatgcatcggcatggctgcactcgcaagcttgatgggcgctctcctgcaggctgcacttagtgtgttcggcatggttgggggcccacttatgggcttgttcgctctgggaattctggttcccttcgccaattccatcggagctctggtggggctgatggccggcttcgcgatcagtctctgggtgggaatcggagctcaaatatatccccccctcccagagaggaccttgccattacacttggacatacaaggctgtaactctacatacaacgagactaatctaatgactacaacagaaatgcccttcactactagcgtgtttcagatctacaacgtgcaaaggacgcctctaatggacaactggtatagcctgagttatctgtatttctccaccgtgggaacccttgtaacattactggtcggaatacttgtcagcctttcaacgggaggtaggaagcagaatctagacccaagatatatcctgactaaagaggatttcttatctaacttcgatatatttaagaagaagaagcatgtgcttagctacaagagccaccccgtcgaggacgggggaaccgacaatccagcatttaaccacattgagctgaattccgaccagagcgggaaatccaacggcaccaggctgtag

SEQ ID NO: 17484 - DNA, 1071 bp, Artificial Sequence
  Description of Artificial Sequence: Synthetic coding sequence
atggatatggcggacgaacccctaaacgggagtcacacttggcttagcatacccttcgatttgaatggttcagtggtgagcaccaacactagtaatcagaccgaaccatactacgatctgacatccaacgccgtccttacatttatctactttgtagtatgtattattggcctgtgcgggaataccctcgtgatttatgtgatcttgcgatatgctaagatgaagaccattacaaacatatatattcttaacctagctatagccgacgagcttttcatgctcggcctgccctttctagctatgcaggtggccttggttcactggcctttcggaaaggcaatctgtcgggtggtcatgactgttgatggaatcaatcagttcacatccattttttgtcttactgtaatgtctatcgaccgatacctggccgtggtccatccaattaaatccgcaaagtggcgacgcccccgcactgctaaaatgatcactatggccgtatggggcgtctcacttctagtcatcctccccattatgatttatgcgggcctaagatcaaaccaatgggggcggagctcttgcaccattaactggcccggagagtcgggggcctggtataccggatttatcatctatacgttcattctgggcttccttgtgcctttaacgatcatctgcctgtgttatttatttataataatcaaagtaaaatcaagtggaatacgagtcggtagttccaagcgcaaaaaatctgagaaaaaagtcactaggatggtaagcatagtcgtggctgtgttcattttctgctggttacccttttatatcttcaacgtcagctcagtgtctatggcaatctcaccgacccccgcgctgaaaggcatgtttgatttcgtcgtggtgctgacttatgcaaactcttgcgccaatccgattttatatgcattcctgtccgacaactttaagaaatccttccagaatgttctgtgtctggtgaaggtggataacagcaagtcaggagaggaaggctcttgtctcgacatgatctttagaaataataaaaatcgtaaaaagtag

SEQ ID NO: 17485 - DNA, 1110 bp, Artificial Sequence
  Description of Artificial Sequence: Synthetic coding sequence
atggacatggcagacgaacctctcaatggtagtcacacctggctttccatcccctttgatctgaacggctccgtggtgagcacaaacacctccaaccaaacagagccttattatgacctgacttccaacgcggtgttgaccttcatctactttgtggtgtgcatcatcggcctctgtgggaataccctggtcatttacgttattctcaggtacgctaaaatgaagacaatcactaacatctacatcctcaacctcgctattgcagacgaactgtttatgctgggattgcctttcttggcaatgcaggtcgcactcgtacactggccctttggaaaggccatttgtagggtggtcatgacagtggacgggattaaccagtttacctccatcttttgtctcactgtgatgtccattgataggtatctggccgtagttcacccgatcaagtcagccaaatggaggcgcccgcgtactgcaaaaatgatcacaatggcggtatggggagtttcccttttagtgatcctgcctataatgatctacgctggactgcgatccaatcaatggggacggagcagttgtaccataaactggcccggcgagagcggtgcctggtacaccgggtttattatttacacgttcatcctcggcttcctcgttcccctcacaattatctgcttgtgttatctgttcatcattataaaggttaagagtagtgggatacgcgtggggtctagtaaacggaagaagtcagagaagaaagtcacgaggatggtctccatcgtggtggcagtctttatcttttgctggctgcccttctatatcttcaacgtgtcaagcgtgagcatggccataagccctacgcccgctctgaaaggaatgttcgattttgtggtcgtactgacctatgctaatagctgtgccaatccgattttatacgcttttctgtcggacaactttaagaagtctttccagaacgtcctctgtctggtcaaagtttccgggacggacgacggagagaggtcagattcaaagcaggataagtcacgtctgaatgagaccactgaaacacagagaaccctcctcaatggagatcttcagacctccatctag

SEQ ID NO: 17486 - DNA, 3315 bp, Artificial Sequence
  Description of Artificial Sequence: Synthetic coding sequence
atgcaggctcaacagctaccctatgagttcttctctgaggagaatgccccaaagtggagggggctactagtccctgcactaaagaaagtgcagggccaggtacatccgacactggaatcaaacgacgatgccctgcagtacgtcgaggaactgattttgcagcttctgaacatgctctgccaagcccagccccgtagtgcctcagacgttgaagaaagagtgcaaaaaagctttccccacccaatcgacaaatgggctatcgccgatgcccagtccgcaattgagaaaaggaagcggagaaacccattatccctcccggtcgaaaaaattcaccccttgttaaaagaagttttgggctataaaatcgatcaccaggtgagcgtatatatcgtggcggtgctcgagtatatctccgccgatatcctaaagctggtgggcaactatgtgaggaacattcgccactacgagatcaccaaacaggacataaaggtggctatgtgcgcagataaagtattaatggatatgtttcatcaggatgtggaggacattaacattttgtcgctgaccgacgaagaaccctctacctctggcgagcaaacatattatgatctggttaaagcttttatggcagaaattagacaatacatacgcgaacttaatttgattatcaaggtgttcagagagcctttcgtgagtaatagtaagctgttctcagccaatgacgtcgaaaacatcttctctagaatcgttgacattcacgaactttccgtaaagctgctgggccacatagaagataccgtggagatgactgatgaggggtctccccaccccctcgtagggtcctgcttcgaagacctcgctgaggaacttgcattcgatccatatgaaagctacgcccgagacattttgcggcctggcttccacgaccgcttcctgtcacagcttagcaagccgggcgcagccctctatctgcagtccatcggtgagggcttcaaggaggctgtacaatacgttctgcccaggctcttgctggctccggtctaccattgtctacactattttgaactactaaaacagctggaagaaaaaagcgaagaccaggaggataaagaatgcttgaagcaggcgattacagctcttctgaatgtgcagtccggaatggagaagatctgtagcaagtctcttgccaagcggaggttatctgaatcagcgtgcagattctattcccagcagatgaaggggaagcagttggcaattaagaagatgaacgagattcagaagaacatagacggctgggagggcaaggatatcgggcagtgttgcaatgagttcattatggaaggcaccttaactagagtgggcgccaaacatgaacggcacatttttcttttcgacgggcttatgatatgttgcaagagcaatcacggccagccgcgcctgcctggcgcttctaatgctgagtatcggctcaaagagaagtttttcatgcgcaaagtgcagatcaacgacaaagacgacaccaatgagtacaagcacgcatttgagatcatcctcaaagacgaaaacagcgttatcttttctgcaaaatcagccgaggaaaaaaataattggatggcggctttgatttctctgcaatacaggagcaccctggagcgaatgctcgacgtgacaatgctccaagaggagaaggaagagcagatgcgattgcccagtgccgatgtctacaggttcgccgagccggactctgaggaaaatattatttttgaagagaacatgcagccaaaggctggtattccaatcatcaaggcagggactgtcatcaaattaatagagcggctcacctatcacatgtatgccgatcctaatttcgttagaacattcctgaccacgtaccgaagcttctgtaagcctcaggaattactctcactgatcatcgaacgcttcgagattcctgaacccgagccaactgaggcggatcgaatagccatcgagaatggcgatcagcctctgtcagccgaattgaagaggtttcgcaaggaatatattcagcccgtacaactaagagtgctcaacgtgtgtcgccactgggtcgagcaccacttctacgatttcgaacgtgacgcatatctgctgcagcgaatggaggagttcatcggtaccgtccgcgggaaggcgatgaaaaagtgggtcgagtccatcaccaagatcatccagcgaaaaaagatagcgagagataacggacctggccacaacattacctttcagtccagtccccctactgtggaatggcatatctcccgaccagggcacatcgaaacctttgacttgctgacactgcatcctattgagattgccagacagctgacgttgctggaatctgacctctatagagctgtccagccgtcagaattggttggcagcgtgtggaccaaagaggacaaggaaatcaattccccaaatctcctaaaaatgattcggcacactaccaatcttactctgtggttcgagaaatgcatcgttgaaaccgagaatctggaggaaagagtggccgtcgtgtcgcgcatcatcgagatactgcaggtgttccaagagctgaataactttaatggagtcctagaggtagtctctgcaatgaactcctcaccagtgtaccgtctggatcatacatttgaacaaatcccttcgcgccagaaaaaaattttggaggaagctcacgagttgtctgaagatcactataaaaaatacctggcgaaattgaggtcaattaaccccccgtgcgtgccattctttggaatttacctgactaacatcctcaaaaccgaggagggcaacccagaggtcctcaaaagacacggtaaagagttgatcaatttcagcaaacgaagaaaggtggcagagataactggagagatccagcagtaccagaaccagccctactgtctgcgcgtggaaagcgacataaaaaggttttttgagaacttaaatcctatgggcaactccatggagaaggaattcacagactaccttttcaataaatccttagagatcgaaccgagaaatcccaaaccattgccacggttcccgaagaaatattcatacccacttaagtcacccggggttcggcctagcaatcctagacctgggaccatgcggcacccaacccctctgcagcaagaacccaggaagatatcttatagtcgcattccggagagtgagacggaaagcacggcctcagccccgaactcccctaacactgttaatacatctgcttgtttttggtgcttccagtaccacaggtgcctgcaatgtatctag

SEQ ID NO: 17487 - DNA, 3957 bp, Artificial Sequence
  Description of Artificial Sequence: Synthetic coding sequence
atgcaggcccaacagctgccgtacgaattttttagcgaggagaacgcccctaaatggcgcggactcttggtccctgcgcttaagaaagttcagggacaggtccatcccaccctagagtcaaacgacgacgcactgcaatatgtcgaggagttaatactgcagttgttgaatatgttgtgccaggcccagccccgatcagcaagtgacgttgaggagcgagtgcaaaagtcattccctcacccgatcgataagtgggctatcgctgatgcgcagagtgcaatcgaaaaaagaaagagaagaaaccccctgtccctcccagtcgagaagatccatccactcctgaaggaagtcttgggatacaagatagaccaccaagtgtctgtatacatcgtggctgttctggaatacatctccgcggatatcttaaagttggtggggaattacgtacgcaatatccggcactacgaaatcacaaagcaggacatcaaggtggctatgtgtgccgacaaggtgctgatggatatgtttcaccaggacgtggaagacatcaatattctgtccctgaccgatgaggagccgagcacaagcggggaacaaacctactacgacctcgttaaggccttcatggcggagatacgccagtatatacgcgagcttaacctgattatcaaggttttccgtgagcccttcgtctccaattcaaagttgttttccgcaaacgatgttgagaacattttttcacgcatagtggacatccacgaactgtccgtgaaacttttagggcacatcgaagacaccgtggagatgactgatgagggatcccctcatcctttagtgggatcatgcttcgaggatctcgccgaagagctagcttttgacccttatgagtcctatgctagggacatcctgcggcctgggtttcacgaccgttttttatctcagttgtctaaacctggcgccgcactgtatctgcagagtattggggaaggattcaaggaagccgtgcagtatgtgctcccaaggcttttgctagccccagtctaccactgcctgcattattttgaactcctgaagcaattggaagaaaagtccgaagatcaggaggataaagaatgcctgaagcaggcgatcaccgctttgctgaacgtgcagtccggtatggagaagatttgctccaaaagcctcgctaagaggcgcctttcagagagcgcctgcaggttttactcccaacagatgaagggaaaacagctggccataaaaaaaatgaacgagatccagaagaatatagatggctgggagggcaaggatatcggtcaatgctgtaatgaattcatcatggagggcacgctaacccgggtcggagcgaaacatgaacgccatattttcctgttcgatggcctgatgatttgttgtaaatcaaatcacggccagccccgactgcctggggcatccaacgcagagtaccgacttaaagagaagttttttatgcgcaaggtgcaaatcaatgataaagatgacacaaacgagtacaaacatgcctttgagatcattctcaaggacgagaattccgtgatcttcagtgcaaagagcgcggaggagaaaaataattggatggccgctttgatcagcttgcagtaccgtagcactctggagcggatgcttgatgtgactatgctgcaagaagagaaggaagagcaaatgcgccttcctagtgcagacgtctaccgctttgcagaacccgactctgaagaaaatatcatttttgaagagaacatgcaacccaaggccggcatcccaatcattaaggcgggcaccgtcatcaaactgattgagaggctgacatatcacatgtatgctgatccaaacttcgtgagaacctttctaactacctaccgctcgttctgcaaaccgcaagagttgctttcacttattatcgagaggtttgagattcccgagcctgagccaactgaggccgatagaatcgctatcgagaacggcgaccaacctctttccgccgagctgaagcgctttaggaaagaatacatccagccagtccagctgcgagtgctcaatgtgtgtcggcactgggttgaacaccacttctacgactttgaaagagatgcctatcttctgcaaagaatggaggagttcatcggtaccgtgcgtgggaaggccatgaaaaagtgggtggagtccattacaaagatcatccaaaggaagaaaatcgctagagacaacggacccggacacaacatcacattccagtccagccctccaaccgtggagtggcatattagccgtcctggtcacatcgagacttttgacctgttaaccctgcatccgatcgagattgcaaggcagctgaccctgctggagtcggatctataccgcgctgtgcagccatctgaacttgtcggctccgtgtggactaaagaggacaaggagatcaatagtccgaacttgctcaagatgattcggcacactactaatttgacactgtggttcgagaaatgcatcgttgaaaccgagaacctggaagagcgagtggcagttgtctcgagaatcattgaaatccttcaagttttccaggaactgaacaatttcaacggggtgctcgaggtggtgagcgctatgaacagctctcccgtgtataggctcgaccatacgttcgaacaaattccaagcaggcagaagaaaatcctcgaggaagcccacgaactgtccgaagatcattataaaaagtacttagctaaactccgaagcattaaccccccttgcgtgccattcttcggtatctaccttaccaacattctcaaaacggaggaggggaaccccgaggtgcttaaaaggcatggtaaagaactcataaatttcagtaagcgcagaaaagttgctgagattacgggtgagattcagcaataccagaatcagccctactgcctacgggtggagtctgacattaagcgcttcttcgaaaacctgaacccaatgggcaatagtatggagaaggaattcaccgactatttgtttaataagagcctggagattgaacccaggaacccgaaacctcttcccaggttccctaagaagtattcgtatcctctgaagtcccctggcgtaaggccctccaacccacggccaggaacaatgagacaccctacacctctccagcaggagccacgtaaaatttcttacagccgaatccctgaaagcgagacagagtcaacggctagcgcccccaattccccgcgaacaccgttgaccccgccaccggcaagtggcgcaagttctaccactgacgtgtgttccgtgtttgatagcgaccatagttctccgttccacagccgttccgcctctgtctcatccatctcactcactaaagggactgacgaagtgcctgtgcctccccccgtgccacctagacggcggcctgaaagcgctccagccgagtcaagccccagcaaaattatgagcaagcatctggactcaccacccgctatccctcctcgacagcccacttcaaaggcttactcaccacgctatagcatatcagatagaaccagcatctcggatccacctgagtcccccccactgctgccgccccgggagcccgtcagaacaccggacgtcttctcaagcagtcccctgcacctgcagcctccgcctttgggcaaaaagagtgatcacggcaacgcattctttccaaactctccatcacctttcacaccgccgccccctcagacaccgtccccccatgggacaagacggcatctgcctagccctcccctgacccaggaagtcgatttgcacagcattgctggccctcctgtaccaccccgtcaaagcacttctcaacacataccaaagttaccccccaagacgtataaaagggagcacacccatccttccatgcacagggacggtcctccactactggaaaacgctcattctagctag

SEQ ID NO: 17488 - DNA, 4002 bp, Artificial Sequence
  Description of Artificial Sequence: Synthetic coding sequence
atgcaggcccagcagctgccttatgagttcttcagcgaggaaaacgccccaaagtggcggggtctcctggtgcctgcgctgaaaaaagttcagggacaggttcaccccactcttgagtccaatgatgatgccctccaatacgtggaagaattaattctgcagctcctaaatatgctgtgtcaagcccagccacgtagtgcctccgatgtggaggaacgcgtgcagaagagctttcctcacccaattgacaagtgggccatcgctgacgcacaaagtgccatcgagaaaaggaagagacgaaacccactaagcctccccgtggaaaaaatccaccccctcctcaaagaagtgttggggtataaaattgatcaccaagtatccgtgtacattgtggccgtcctcgaatatattagcgcagatatcctcaaactggtgggcaactacgtgagaaacatcaggcattacgagatcacgaaacaggacatcaaagtagcgatgtgtgcagataaggtgctcatggacatgttccaccaggacgtggaggatataaacattctctcgctgactgatgaggaacccagcaccagcggcgaacagacctactacgatctcgttaaggcatttatggcggaaattcgacagtatatccgagagctgaatcttattatcaaggtttttagagaaccattcgtgtctaatagtaaactttttagcgcaaacgacgtggagaatatattctcccgtatcgttgatatccacgagctctccgtgaagttgctcggacatattgaggacacagtagaaatgaccgatgagggcagcccacacccacttgttgggtcatgcttcgaggatctggcagaggaactcgctttcgatccctatgagagctacgcgagggacatcctgagacctggctttcatgacagatttctgagccagttatccaaaccaggggcagccctgtacctgcagagcattggcgagggcttcaaggaggctgtccagtatgtcctgccacgcctcctcctagcaccggtgtatcactgtcttcactacttcgagctcctcaaacaactcgaagagaagagcgaagatcaggaagacaaagagtgtttgaaacaagctattacagcactgctcaatgtccagtcaggcatggagaagatctgttccaagagcttagccaaaagacgcctttccgagagtgcctgtcggttctactctcagcagatgaaggggaaacagctggctatcaaaaagatgaacgagatccagaagaacatcgacggctgggagggcaaggatatcgggcagtgttgcaatgagttcatcatggaaggaaccctgacccgtgtcggtgcaaaacacgaacgtcatatctttctgttcgacggactaatgatttgctgcaagagcaaccacgggcagccacggctgcccggagcaagcaatgccgagtacagactgaaggaaaagttctttatgagaaaggtacagatcaacgataaagacgacaccaacgagtataaacatgcttttgagatcatcctgaaagatgaaaactcagtaatcttctccgccaagagtgcagaggaaaagaacaattggatggctgctctgatctccctgcagtacagatccacactggagaggatgttggacgtgaccatgttacaggaggagaaagaagaacagatgcgcctacctagcgcagatgtataccgatttgcagagccagatagcgaggagaacattatttttgaggagaatatgcagccgaaagcaggcatccccattatcaaggcagggacggtgataaagcttatcgaacgcctgacataccacatgtatgcggatccgaattttgttaggacctttctcaccacttataggtcgttctgcaaaccacaggaattgctgtcactaatcatcgaacgtttcgaaattcctgagccggagcctaccgaggctgataggatcgcaattgaaaacggcgaccagcccctctctgccgaactgaaacggtttcgcaaagaatacattcaacccgtccagctgcgagtgttgaacgtgtgtcgccattgggtcgaacaccatttttatgacttcgagcgagacgcctatctcctgcagcgtatggaagaatttattgggacagtacgcggaaaagctatgaaaaagtgggtcgagtccataacaaagatcattcagcgtaagaagatagctcgcgataatggacctgggcacaatatcacttttcagtcttcgcctcctacagtcgagtggcacatctcgagaccaggtcacatagaaacgttcgatctcctaaccttgcacccaatcgagatagcaagacagctgactctgctggaatccgatctgtatcgcgccgtgcagcccagcgagttagttggcagcgtgtggacaaaagaggacaaggagataaactctccaaacttgctgaagatgatccggcatacgaccaacctgacattgtggtttgagaaatgcatcgtggaaaccgagaacttagaagaacgggtcgccgtggtgtcaagaattatcgagattctacaggtcttccaagaactgaacaactttaatggggtgctcgaggttgtgagcgcaatgaattcttccccagtatacaggttggaccatacctttgagcagattccatctcgacaaaagaaaatactggaggaagcccacgaactaagtgaagatcattataagaagtatctggcgaaactgaggtccattaacccaccatgtgttccattttttggaatctatttaactaatatcttgaagacagaagagggcaaccccgaggtgctgaaaagacatggaaaagaactcattaacttctccaagcggcgtaaagttgccgagataacaggcgagattcagcagtaccagaaccagccatattgtcttcgagtggaatcagatattaaacgtttttttgagaacctcaatcctatggggaattcaatggagaaagagttcactgattacctgtttaataagagtctcgaaatcgaacctagaaacccaaagcccctgccacggttcccaaaaaagtactcatatccattaaaatcgcccggtgtgcgcccttccaatccgagacctggaaccatgagacacccaaccccgctgcagcaggagccacgcaagatttcttacagccgaattcccgagagtgagacagagtctaccgcatctgcccctaactcgcctaggacacctctgacaccacctcccgccagcggcgccagctccaccacagacgtctgctctgtttttgactccgatcacagttccccctttcacagctccaacgacacggttttcattcaggtgactctgcctcacggtccaagatcagcatccgttagcagcatttcattgactaagggtactgacgaagtcccagtgccaccacccgtcccacctaggaggagaccggagtccgctcccgcggaaagctctccttcgaaaatcatgtctaaacacctcgacagtccacctgccattccccctcgacagcccactagtaaggcctacagtcccaggtactccatatcagacaggacttctatctctgatcccccagaatcaccccccctgctgccgcctagagagcccgtacgcacccccgacgtgttctcctcgtcgccgctccacctgcaacctccaccccttggcaaaaagtccgaccatggcaacgcattctttccgaacagcccctcccccttcacccccccccccccgcagacgccttctccacacggtaccagaagacacctgccaagcccccctctcactcaagaagtagacctgcattccattgcaggccctcccgtgcctcctcggcagtctacatcccaacatatacccaaactgccaccgaagacctacaagagggagcacacacatccaagcatgcaccgtgacgggccacctctgctcgagaatgcccactcgagctag

SEQ ID NO: 17489 - DNA, 4002 bp, Artificial Sequence
  Description of Artificial Sequence: Synthetic coding sequence
atgcaagcccagcaattgccatatgagtttttcagtgaggagaacgccccgaagtggagaggcctgctggtgcccgctctgaaaaaggttcaaggccaggtgcatcccacactggagtccaacgacgacgccctgcagtatgtggaggagctgatccttcagctgcttaatatgctgtgtcaggctcagcccaggagcgctagcgatgtggaagaacgcgttcagaagtcctttccacaccctatcgataagtgggctatcgcagacgcacagagcgctatcgaaaagaggaagagacggaacccgctgagcctccctgtggagaagatccaccctttgttgaaagaagtcctgggctacaagattgatcaccaggtatccgtttacatagtggcggtgcttgaatatatctcagccgacatactgaagcttgtgggcaattacgtccggaacattcggcattatgagattacaaaacaagatattaaggtggcaatgtgcgctgacaaagtattaatggacatgtttcaccaagatgtggaggatatcaatatcctcagtctaaccgacgaagagccatctacctcgggcgagcagacctattacgatttagtgaaggcattcatggccgagattaggcaatacattcgcgagctgaatctaatcattaaggtgtttcgagagccttttgtcagtaatagcaagctgttttccgcaaacgacgtggagaatatatttagcagaatcgtggacatccacgaactgtctgtgaagctcctcgggcatatcgaggatacagttgagatgaccgatgaaggaagtccacaccctctcgtgggctcttgttttgaggaccttgccgaggaacttgccttcgacccttatgagtcctatgcaagggacattttgcgacccggcttccacgaccgattcctgtcccaactgagcaaacctggagccgcactgtacctgcagtctattggcgagggctttaaggaggccgtgcaatacgtacttccccggcttctgttggcgcccgtttaccattgtcttcattatttcgagctcctcaaacaattagaagagaaatctgaagatcaagaggacaaagaatgcttgaaacaggcaataaccgccctgctgaatgtgcagtctggcatggagaagatatgtagtaagtccctggctaaacggcgactttcagaatcagcctgtcgtttttattctcaacagatgaaagggaaacaattggccatcaaaaagatgaacgagatccaaaagaacattgacggctgggagggcaaggatattggccagtgttgtaatgaatttattatggaggggacattaacgcgggtgggagcaaagcatgaacgtcacatcttccttttcgatggcctgatgatttgctgtaaatcgaaccatggacagccccggctgcccggcgccagtaatgccgagtaccgcctcaaagagaagttttttatgcggaaagttcagatcaacgataaagacgacacgaatgaatataagcacgctttcgagattatccttaaggacgaaaactcggtgatcttttctgcaaaaagtgcagaggaaaagaacaattggatggctgccctcattagtctgcagtacaggtcaactttagaaagaatgctcgatgtaaccatgcttcaagaggagaaagaggagcagatgaggctgccatccgcggacgtttacaggttcgccgagccggatagcgaagaaaacatcatttttgaggaaaatatgcagcccaaagcaggaatccctatcataaaagccggcaccgtcataaagttgatcgagcgcctgacataccacatgtatgcagatcccaactttgtaaggacctttctgaccacctatcggtccttctgtaaacctcaggaactattgtctctgatcatcgagaggtttgagatacctgagcctgagccaacggaagctgacaggattgccattgagaacggcgatcagccactcagtgcagagctgaagcgattccggaaagagtacatacaacctgtgcaactccgggtcttgaacgtgtgcagacactgggttgaacaccatttctatgactttgagcgggatgcatatctcttacaaagaatggaggagtttatcggaacagttcggggaaaggcgatgaagaaatgggtcgaatccatcaccaagataattcagaggaaaaagattgcgcgagacaatggtcccgggcacaacatcaccttccaaagttcccctcccaccgtagagtggcatatatcccggccgggccacattgaaacatttgacctgctcactctgcatcctatcgagattgcgagacagctaaccctcttagagtcagacttgtaccgcgctgttcaaccctcggaactggtgggatcagtctggactaaggaggataaagagatcaactcacctaatctgctgaagatgatcagacacacgaccaatttgaccctttggttcgaaaaatgtatagtcgaaaccgagaacctggaagagagagtagcagtggtcagcagaatcatcgaaatcctacaggtctttcaggagctcaataatttcaacggcgttctggaggtcgtgtcagccatgaattcatcccctgtctatcggctggaccacacctttgagcagattccttccagacaaaaaaaaatcttagaggaagcccacgaattgagcgaggatcattacaagaaatacctggcaaaactgcggtcaatcaacccaccctgcgtgcctttctttgggatctacctgaccaatattctgaagaccgaggagggcaatcctgaagtgctgaagcgtcacggtaaggaactcataaactttagcaaacgtcgaaaggtggcagaaattacaggcgagatacagcaatatcaaaaccaaccatactgtcttcgagtggagagcgacataaagagattcttcgaaaatttgaaccccatggggaacagcatggaaaaggaatttacagactacttgttcaacaaatcgttggaaatcgagccacgaaaccccaaaccattgccgcggttccccaaaaaatattcttacccactcaaaagtccaggagtgcggccttcaaaccctaggccaggtacaatgagacaccctacgccacttcagcaggagccccgcaaaatttcctatagccgcattcctgagagcgaaacagagagtaccgcctctgctccaaactcacctagaacacccctgacaccgcctccagcgtcgggtgcaagttcaaccaccgatgtgtgcagcgtattcgactcggatcacagttccccatttcacagctccaacgatacagtctttatacaggtcacgctgccacacgggccccgaagcgcctccgtttcttcgatttccctcaccaagggcacagacgaagtccccgtgcctccaccagttccccctcgaaggagaccagaatcagcgccggccgagtcttccccttcaaagatcatgtctaagcatttggattccccccctgctatacccccacggcagccgacgagcaaggcttacagtccacgttattctatctccgatcgaacaagcatttcagatcccccggaatctccacctctcttgcctccccgggagccggtgagaactcccgacgttttcagctcctccccattgcacctccagccccctcccctgggaaagaaaagcgaccacggcaatgcgtttttccccaatagcccgtcaccctttacgccgcctcctcctcagactccctctccgcacggaactcggaggcacctgcctagtccacctctcacgcaggaagtagacttgcattctatagcgggtccacctgtgccacctagacaatcaaccagccagcatatcccaaagttacccccaaagacttacaagcgcgagcacactcatccctctatgcatcgagacgggcctcccctgctcgaaaacgcacacagtagctag

SEQ ID NO: 17490 - DNA, 945 bp, Artificial Sequence
  Description of Artificial Sequence: Synthetic coding sequence
atgttgtgccaagctcagcctcgcagcgctagcgacgtagaggaaagagtgcaaaagagcttccctcaccctatcgacaaatgggccatagcagacgcacagagtgcaattgaaaagaggaaacgccgcaaccccttgtctttgccagtcgaaaagatccaccctctgctgaaggaagttctggggtacaagattgatcaccaggtgtcggtctacatcgtggcggtgctcgagtacatcagcgcagatatcctcaaactggtaggcaattatgtgcgcaacatcagacattatgagatcacaaaacaggacatcaaggtcgccatgtgtgccgacaaggtgctgatggatatgtttcaccaggacgtggaggatatcaatatcctttccctgaccgacgaggagcctagcacatcaggcgaacaaacttactatgaccttgttaaagcctttatggcagagattcgacaatacattcgcgaactgaatctgatcattaaggtctttcgtgaaccttttgtatcaaattcgaagcttttctcagctaacgacgtcgagaacattttttctagaatcgttgatatccacgaactatccgtcaagctactgggccatatcgaggatacagtcgagatgaccgacgaaggcagcccccatcccctcgtcggcagctgttttgaggacctcgctgaagagctggccttcgatccttacgagagctatgcgcgcgatatactgcggccgggatttcacgacaggttcctgtcccaactgtcaaaaccaggagccgccctgtatctgcagagcatcggagaaggcttcaaagaagctgtgcagtacgtccttccccgtcttttgttagccccagtttaccactgtctgcactacttcgagcttctgaagtttccctttggcgatctgtcccgtttgcgagatagcgtgtag

SEQ ID NO: 17491 - DNA, 3153 bp, Artificial Sequence
  Description of Artificial Sequence: Synthetic coding sequence
atgaccgacgaggggagtcctcatccattggtgggatcttgtttcgaggatctggctgaggaattggccttcgatccctatgagtcttacgccagggatattttacggccaggtttccacgataggttcctgagtcagctgtccaagccaggagccgcgctgtatctacagtcaataggagaggggttcaaggaggccgtccagtacgtcctcccacgtttactgcttgcccccgtgtaccactgccttcattacttcgaactgttaaaacagctggaagagaaatcggaggatcaggaagataaagagtgcttaaaacaggccatcacagcccttctaaatgtccagagtggcatggagaaaatctgctccaagtccctggcaaaaagaaggctatccgaaagcgcatgcaggttttattcccaacagatgaagggcaagcagctggccatcaagaagatgaacgaaatacagaaaaacatcgatgggtgggaggggaaggatattggccaatgctgcaacgagtttatcatggaaggcacccttacgagagtgggtgccaaacatgagcgccacattttcttgtttgatggattaatgatctgctgtaaaagcaaccacggacagccaagattaccaggggccagcaatgcagagtaccggctgaaagaaaaattcttcatgagaaaagtgcagatcaacgacaaagacgatacgaacgagtacaaacacgccttcgagatcatcctcaaagacgagaactccgtgattttctctgcaaagtctgcggaggagaagaacaactggatggccgctcttatctcactgcaataccgtagcactcttgagaggatgctggacgtgactatgctccaggaggagaaggaggaacaaatgcgcttgcccagtgcagacgtgtaccgctttgcagagcccgattccgaagaaaacatcattttcgaggaaaacatgcaacctaaggcaggtataccgattattaaagcggggaccgtaatcaagcttattgaacgtctgacataccacatgtatgctgaccccaatttcgtgaggacgttcctaacaacataccgctctttttgtaagccccaggaacttctgtctctgatcattgagaggtttgagatacctgagccagagcccactgaagcagacaggattgctatcgagaatggcgaccaaccattaagcgcagaactcaagcgattccgcaaggagtatatacaacccgttcagctgcgagtccttaacgtgtgtcgacactgggttgaacaccatttttacgacttcgaacgtgacgcctacctgctacagcgcatggaagagtttatcggaaccgtgagaggcaaagctatgaaaaaatgggttgagagcatcacgaagatcattcagagaaagaaaatcgcacgggataatggacccggccacaacattaccttccagtccagcccaccaaccgtagagtggcatatctcacgccctggtcatatcgagactttcgatctcctgacattacacccaatcgagattgcgcgccagttgaccctgctggaaagtgacctttaccgggccgtgcagccctcggagctggtagggtccgtctggaccaaagaggataaagaaattaattcacctaatctgctgaagatgatccggcatacgactaatctcaccctgtggttcgagaaatgtattgtggagaccgaaaatcttgaggaacgggtggccgtggtgagtcgaatcatcgaaattcttcaggtttttcaggaactgaacaatttcaacggtgtgctggaagtggtttccgctatgaatagctccccagtgtaccggctggaccatacctttgaacagatcccaagtaggcagaagaaaattctcgaggaagctcacgagctgagcgaggatcactataaaaaataccttgctaagctgcggtcaattaaccccccctgtgtgccattctttggcatataccttaccaacatcctaaagactgaggaaggaaatccagaggttcttaaaagacacggcaaggagctgattaattttagcaaacgacgtaaggtggccgaaatcacgggcgagatccagcagtatcagaaccagccctactgcctgagggttgagtcagacattaagagattcttcgagaaccttaatcctatgggtaactctatggaaaaagagttcactgattatttgtttaataagagtctagagattgagccaagaaaccctaagcctttgccgcgctttcctaaaaaatattcctatccactgaagtccccaggggtgaggccctcgaatcctagacctgggacgatgcgtcatcctacgccgcttcaacaagagccccgcaagatctcctacagccggattcccgaaagtgaaacggagagtaccgcctcggcccctaattctccacggacccccctaacccctcctccggcgagcggcgctagttccacaaccgatgtctgctccgtatttgactctgatcactcatccccctttcactccagaagtgcctccgtctcttctatcagcctgactaaaggtactgacgaggttcccgtgccccccccagttcccccaagacggagacccgagagcgcaccagccgaaagcagccctagtaagatcatgtctaagcacctggattctcctcctgctatccctccacgacagcccacttcgaaggcctatagccctaggtactccatttcagatcgaacctctatctcggacccacctgaaagtcccccccttcttccccctcgcgagcctgtccggactcctgacgtgttcagtagcagtcctctgcacctacaaccacccccactcggcaagaaatctgatcatggaaatgcattcttccccaatagtccatcaccgtttaccccacctcccccccagacaccctccccccacggcacaagaaggcatttacccagccctccacttacacaggaggtggatctgcacagtattgcgggacccccggtacctccgaggcagtcaacatctcagcatattcccaaacttcccccaaaaacctacaaacgcgagcatacacacccctcgatgcatagagacgggcctccactactcgaaaatgcgcatagtagctag

SEQ ID NO: 17492 - DNA, 2358 bp, Artificial Sequence
  Description of Artificial Sequence: Synthetic coding sequence
atgagcgatcaagaccactccatggatgagatgaccgctgttgttaaaatcgagaaaggggtgggtggcaataacgggggaaatggcaacgggggcggcgccttctctcaggctcgctcctcaagcaccggtagcagcagttctaccggggggggcggtcaggagtcccagccatccccactggccctcctcgctgccacatgcagcagaatcgaaagtccaaacgagaatagtaataatagccaaggtccctcccaaagtgggggcactggagagctcgatctgactgccactcagctgtcacagggagcaaatggctggcagattattagctcctccagcggggccacacctacctcgaaggagcagtctggttcgtcgaccaatggatccaacggatccgaatcatcaaaaaacaggacagtctccggcggtcagtatgtggtggctgccgcccccaacctccagaaccagcaagtgctgacaggactgcctggcgtcatgccaaacatccagtaccaggtaattccacagtttcagacggtggacggccaacagcttcaattcgcagccacaggcgctcaggtgcagcaggatgggagcggacagattcagatcattcctggagccaaccagcagatcatcacaaaccgcgggagtggcggcaacattattgcagctatgcctaatctacttcagcaggcagtgcctctgcaagggctggctaataacgttctgagcggccaaacgcaatacgtcacgaatgtacccgtagcactgaatggaaacattacgctcctgcccgtcaactccgtgtccgcagccacactaacaccgtcttcccaggctgtaacaatcagctcttccggttcccaggagagcggctctcagcctgtcacctctggcactactatcagttcagccagcctggtcagctcccaagcatcctcatcatcttttttcacaaatgctaattcttactcaactactaccactactagtaatatggggattatgaatttcactaccagcggctcatctgggacaaactcccaaggtcagactccccagagagtgtcagggctgcagggcagcgacgccttaaatatccagcagaatcagacttctgggggtagtctccaagcaggccagcagaaagagggggagcagaatcaacagacgcagcagcaacagatcttgatacaaccacagcttgtgcaagggggacaagccctgcaggcattacaggcagccccattgtcagggcagacctttaccactcaagcaatctctcaggaaactctgcagaaccttcagctgcaggcagtgcctaacagcgggccaattattatccgtacacctactgtagggcctaatggccaggttagttggcagactctccagttgcagaatctgcaggtccaaaatccacaggcacagacaattactttggcacccatgcagggagtgagcctgggtcagacatcttccagcaacaccactctcactcctatagcaagtgccgcctctatccctgcggggaccgttactgtcaatgccgcccagctgtctagcatgcccggcttacaaacaattaatctgtcggccctcggcacatctgggatacaggtccacccaattcagggactgccattggccattgctaacgcgcccggagaccatggcgcccagttgggcctgcacggcgccggcggtgacgggatccatgacgatacagccggtggtgaagaaggagagaatagtcctgatgcacagccccaggctgggcgacggaccagacgtgaggcatgtacttgtccctattgtaaggattcggaagggcggggaagtggcgacccgggaaaaaagaagcagcatatctgtcatatccagggctgtggaaaggtgtacggtaaaacctctcacctgcgggcccatctgagatggcataccggggagagacccttcatgtgtacttggagctactgcgggaaaaggttcactaggtctgatgagctacagcggcataagaggactcatacaggcgaaaagaaatttgcatgccccgagtgcccaaaacgcttcatgcgcagtgatcatctgtctaagcatataaagacacaccagaataaaaaaggaggccccggggtagctcttagtgtaggaacacttccattggactctggggctggctctgagggctcaggcactgcaactcccagtgccctcatcaccaccaatatggtggccatggaggccatttgtccggaagggatagcacggctggctaattctgggatcaacgttatgcaggtggccgaccttcagagcatcaatatcagcggcaatggtttttag

SEQ ID NO: 17493 - DNA, 2337 bp, Artificial Sequence
  Description of Artificial Sequence: Synthetic coding sequence
atggacgaaatgaccgcagtggtgaagatagagaagggggtcgggggaaacaatggggggaacggtaacggtggcggagctttttctcaggcccggtcctccagtacgggaagcagttctagcacgggcggtgggggacaagagtctcagccaagtcctttggccctcctcgccgccacttgctccagaatcgagagtccgaatgagaactccaacaactcacagggcccatcacaatccggtggcacgggagagctagacctgacagccactcagctcagccagggagccaacggatggcagatcatttcttcatcaagcggtgccactcctacaagcaaagaacaatccggctcaagcactaatgggagtaatggcagcgagtcatcgaaaaataggacggtgtcagggggccaatacgtagtagctgcggcccctaacctgcagaatcagcaggtcctcacggggctgccaggtgttatgcccaacatacagtaccaggtgatcccccagttccaaacagtcgatgggcagcagttacagttcgccgctacgggggctcaggtgcaacaggatggttcaggccaaattcaaataatccccggcgccaatcagcagatcatcacaaacaggggctccggcggaaacatcatcgctgctatgcccaacttgctgcagcaggcagtgcccctgcagggactggcaaataacgtgctcagcgggcagacccaatatgttacaaacgtgcctgttgctctgaatggaaacatcactctgctcccggttaacagcgtgtcagcggccacactgacaccctcatcccaggccgtaaccatctcctcctcggggtcacaggagagtggctctcaacccgtgacttccgggaccacaattagcagcgctagtctcgtgtcttctcaggcttccagttcttctttctttaccaacgccaattcatactcaacaactactactacttcaaacatgggcatcatgaactttacaacatcaggcagcagcggtacgaatagccagggacagacgccacagagggtgagcggactgcaaggtagcgatgcactcaatatccagcagaaccaaactagcggtggaagcctccaggcaggccagcaaaaggaaggtgaacagaaccagcagacgcagcagcagcagattctgatccagccccagctggtgcagggtgggcaagctttgcaggctcttcaagcggcacctctgtcaggtcagacgttcacaactcaggccatctcacaggagacactgcagaatttgcagctacaagctgtaccaaattccggccctataatcattaggacccctactgtgggccctaatggacaggtaagttggcaaacgctccagctgcagaacctccaagtccagaatccacaggctcaaacgatcactcttgcccccatgcagggagttagcctgggacagacgagctcaagcaatactactctgacccctatcgctagcgccgcaagcattccagctgggactgtgactgtgaatgcagctcagcttagctcaatgccagggctacaaacaatcaatctgagcgccctgggcacttccggaattcaggtacaccctatccaaggcctgccattggctatcgctaacgctcctggagatcatggggcccaattaggattgcacggcgctggaggggatgggatacatgatgatactgcagggggcgaagaaggcgagaactcaccagatgctcaaccgcaggccggcaggcggacacggcgggaagcctgcacctgtccctattgcaaggacagtgagggccgaggcagcggcgatccaggcaagaagaagcaacacatctgccacatccaaggatgcggaaaagtctacgggaagacatcacatctgcgcgctcatttgaggtggcataccggggaacgacctttcatgtgcacgtggtcgtattgtggtaagaggtttacacggtccgatgaactccagagacacaaacggacccataccggagagaaaaaattcgcctgtccggaatgccccaagcgctttatgaggtctgaccatctgtccaagcatatcaagacccaccagaataagaaagggggacccggggtggctctgtcagttgggaccctccccctagattccggcgccggtagcgagggaagtggcacagcgacaccaagcgccctgataacgacaaacatggttgctatggaagctatttgtcctgagggtatcgcccggctggcgaatagcggcattaacgttatgcaggtggctgatctgcaatcaatcaatatcagcggcaatggcttttag

SEQ ID NO: 17494 - DNA, 1413 bp, Artificial Sequence
  Description of Artificial Sequence: Synthetic coding sequence
atgtccgcacaagtgctaggatttctcaggtcgtggacccccctacccctggcagccccaaggggccccgccgcagcaggaaatgacgccggcgcccccgccgccaccgcccctggcggcgagggcgaacctcactctaggccgtgtgatgcaagactgggaagcaccgataaagagctcaaggctggcgcagctgctaccggctccgcccctactgctcctggcaccccatggcagcgcgagcccagagtggaggtgatggatcccgccggcggacccagaggcgtgctcccacggccttgtcgagttctggtgttgctcaatccacgcgggggaaaggggaaggccttacaactttttcgatctcatgtgcaaccactgctggcagaggccgaaatttcattcacacttatgttgactgagaggcggaaccatgcaagggaactggtgaggagcgaggaactggggaggtgggatgccctcgttgtgatgtctggcgatgggctcatgcatgaggtggtcaacggactcatggaaagacccgactgggagaccgcgatccagaaacctctatgtagtctccctgctggctcaggcaacgctctagctgcgtccctgaaccactacgctggatacgaacaggtcactaacgaagatctgttgaccaactgtacactcttgctctgccgtagactgctgtcccccatgaacctgctaagcctgcatacagcctctggcctacgcttattttccgtcctgtcgctggcatggggctttattgcggatgtggacttggaatcagagaaatacaggcggcttggcgagatgaggtttacattgggaaccttcctgagattggccgctctccggacctaccggggccgcctggcctacttgcccgtaggtcgggtgggaagcaagacacccgccagtccagtcgtggtgcagcagggcccagttgacgcccacctcgtaccactcgaggagccagtgccatcccactggaccgtggttccagatgaggatttcgtactggtactcgcccttctgcactcccatctgggtagtgagatgtttgcagcccccatgggccggtgtgcggccggagtgatgcatctcttctacgtccgggccggcgtatctagggctatgcttctgcgactcttcttggcaatggagaaagggcggcatatggagtacgagtgcccgtatctggtgtacgtacccgtcgtggccttcagactcgagccaaaggatggaaagggagtgtttgcggtcgacggcgagctgatggtgtctgaagcagtccaggggcaggtccatcctaattacttttggatggtgagcgggtgcgtcgagccacccccctcatggaagccccagcaaatgccgcctccagaagagccattatag

SEQ ID NO: 17495 - DNA, 1155 bp, Artificial Sequence
  Description of Artificial Sequence: Synthetic coding sequence
atggaccccgccgggggccctcgtggagttttgccccgcccttgcagagtcctggtattgctgaacccaagaggcgggaaaggaaaggccctacaactgtttcggagccacgtgcaacccttgcttgctgaagccgagattagtttcacactgatgctgacagagcgccgaaatcatgccagagagctagtgagatctgaagaactaggcaggtgggacgccctggtcgtgatgagcggagacggcctcatgcatgaggtggttaacggcttgatggaacggccagactgggaaacagccattcagaagcctttgtgctctctgcctgccggatctggcaatgcgctggccgcttccctgaatcactacgccggctatgagcaggtgacaaatgaagacttgctgacaaattgcacactgctgttgtgtcggcgtcttctgtctccgatgaacctgttgtccctgcacaccgcatctggcctgaggctgtttagcgtattaagtctggcctggggatttattgcagacgtggatctcgaaagcgaaaagtacaggcggctcggcgaaatgcgctttactctcggcacctttttgcgattagctgctcttagaacctataggggcaggttggcatatcttccagtgggccgagtgggctctaaaacccctgccagccctgtagtcgtacagcaggggcctgtagatgcccacttggtcccattggaggaaccagtccccagccattggacagtcgtgcctgacgaagacttcgtgctcgtattagcattgttgcactctcacttaggatcagagatgtttgctgcacctatggggcgctgtgctgccggcgttatgcacctgttttacgtgcgagccggtgtgagcagggccatgttactccggttattcctggcaatggaaaaaggacgccatatggaatatgaatgcccctatctcgtgtacgtgcctgtggtcgcctttagacttgagcctaaagatggaaagggcgtgttcgctgtagatggggagcttatggtttcggaggccgttcagggacaagtgcaccctaactacttttggatggtctcggggtgcgtggaaccgccgcccagctggaaaccccagcagatgccaccacccgaggagcccttatag

SEQ ID NO: 17496 - DNA, 1152 bp, Artificial Sequence
  Description of Artificial Sequence: Synthetic coding sequence
gaaccgacgggaggccccaggggggtgttgcctagaccttgtagagtgcttgttttgctgaaccctcgcggcggcaaggggaaggccttacagctgttccggtcgcacgtacagccgctccttgcagaagccgagatttcctttactctcatgctgacggagaggaggaatcacgccagggaactcgtgcgcagtgaagaattaggccgatgggatgcactggtcgtgatgagcggcgacggactgatgcacgaggtggtaaatggactgatggagcgcccagactgggaaactgccatacaaaagccactctgttctctgcccgcgggttccggtaatgcactcgccgcctctctgaatcactacgcaggctacgaacaggtcacgaatgaggacctcctgactaactgtaccctgctgctctgccgtaggctgctgagccccatgaatttgctttccttgcacactgcatcgggactgcggctctttagcgtgctgtccctggcctgggggttcatcgctgatgtcgatctggaatcagaaaagtatcggcggctcggggagatgcgatttacacttgggacctttcttcggcttgctgccctccgcacataccgtggcaggcttgcgtatcttcccgtgggccgcgtgggatccaaaacccccgcctcccccgttgtcgttcagcagggcccagtggacgctcatctcgtgcccctggaagaacccgtacccagccactggaccgtggtcccggacgaggattttgtcttagtcctggccctgctccactctcacctcggttccgaaatgtttgcagcccccatgggaagatgtgcggccggagtcatgcacctgttctatgtgcgggctggcgtctctagggcaatgctgctgagactctttcttgccatggagaagggcaggcacatggaatatgagtgcccttacttggtttatgttccagttgtagccttcaggttggaacccaaggatgggaaaggggtatttgccgtcgacggagaactcatggtgagcgaggcagtgcagggccaggtccacccgaactatttttggatggtaagcggctgcgttgaaccccctccctcgtggaagcctcaacagatgccaccccctgaggagcctctatag

SEQ ID NO: 17497 - DNA, 1155 bp, Artificial Sequence
  Description of Artificial Sequence: Synthetic coding sequence
atggacccagccggaggacccagaggcgtgctgcctagaccgtgcagagtactagttctcctcaaccctcggggagggaaggggaaagcgctgcagctgtttcgctcccatgtacagcccctgctggcggaagccgaaatctccttcacactgatgttgactgaacggaggaaccatgcccgcgaattggtaaggtctgaagagctcggacggtgggacgcactcgtcgtgatgagtggggatggcctgatgcatgaggtggtaaatggactgatggagcgacccgattgggagaccgcgatccagaaacccctgtgttctttacctgccgggagcggtaatgctcttgcagccagcctgaaccactacgccggatacgaacaggtgactaacgaggacctgctgaccaactgcacgctgctcctctgcagacgcttactctcacctatgaatctgctgtccttgcacaccgcaagcggcctaaggctattctcagtgctctctttagcctggggttttatcgccgacgttgacctggagagtgagaaataccgtcgtttgggcgagatgcggttcacattaggtacgttcctgagactcgccgccctccggacatataggggcaggttagcctatctgccagtgggccgcgtgggaagtaagacccctgcaagtcccgtggtcgtgcaacaagggcccgttgatgcacacctggttcctctggaagaaccagttccttctcattggaccgtggtgcctgatgaagatttcgtgctagtgctcgctcttctccactcacacctaggaagtgagatgtttgctgcccctatgggacggtgtgccgctggcgtcatgcatctgttctacgtccgcgcaggcgtgagccgggcaatgctgttgaggctctttctggcaatggaaaagggaaggcacatggaatatgagtgtccatacctcgtatatgtgcctgttgtagctttccggctggaacctaaagatggtaagggagtgtttgcagtggacggcgaactgatggtctctgaggccgttcaaggacaggtacatcccaattacttctggatggtgagtggatgtgtggagccccccccatcttggaagccccaacagatgccccctcccgaggagccactgtag

SEQ ID NO: 17498 - DNA, 1197 bp, Artificial Sequence
  Description of Artificial Sequence: Synthetic coding sequence
atggacccagtggtcggctgcgggcgtggactgttcgggtttgtcttctctgccgggggaccaagaggagtgctaccccgcccctgtcgtgttcttgtgctgttgaacccacgcgggggtaaggggaaggccctgcagctgttccgctcccatgtgcaacccttgctcgcagaagccgagattagttttaccttaatgctcaccgaacggcggaaccacgctagggagttggttcggtcagaagagttaggcagatgggacgccctcgtggtgatgtccggggatggtctgatgcacgaagtggtgaatggcctcatggagcggccagactgggagaccgccatccagaaaccactttgtagcctgccagccggaagcgggaatgctctggccgcatcactcaatcactatgctggatatgagcaggtgaccaatgaggatcttcttaccaactgcactcttctcctctgcaggaggctgctcagccctatgaaccttctttcgctgcacaccgctagtggcctccgtctttttagtgtattgtccctggcttggggttttatagccgatgtggatctggaatccgagaagtaccgaagacttggagaaatgcggtttaccctaggcactttcttacgactggcagcgctgcgaacctacaggggacggctggcctaccttccggtaggaagagtgggctccaaaacgccagcgtctcctgttgttgttcagcaaggtccagttgacgcccacctcgttcccctcgaagaacccgtcccctcccattggactgtggtgcctgatgaagactttgtgttggtgctagccctcctgcattctcacctggggagtgaaatgtttgcagctcccatgggccggtgtgcagccggagtgatgcacctgttctacgtgagggccggcgtatctagagccatgctcttgcgcctgttcttggccatggagaagggcaggcacatggagtacgaatgcccctacctcgtgtacgtacctgtggttgcctttcggttggagcccaaagacggaaagggtgtgttcgctgttgacggagagttaatggtgagcgaagccgtgcaaggccaagtccatcccaactatttttggatggtttctgggtgtgtggagccgccgccaagctggaagccacagcaaatgcctcctccagaagagccgctctag

SEQ ID NO: 17499 - DNA, 1155 bp, Artificial Sequence
  Description of Artificial Sequence: Synthetic coding sequence
atggatccagcaggcggtcctagaggcgtgctcccccgcccatgcagagtgcttgtcttattaaaccccagaggcggcaaaggaaaagccttgcagttgttccgtagccacgtgcagccgcttctagcagaggccgagatatcttttacactaatgctgacagagcgtcgtaatcacgcccgggaactggtgcggagtgaggagcttgggcgctgggatgccctggtcgtgatgtctggtgacggtttaatgcatgaggtggtgaacgggctgatggaacgccctgattgggaaactgccatacaaaagcctctctgctccttacccgcagggtccgggaatgccctcgccgcctctctgaaccactacgccggatacgagcaggtgactaatgaagacctgctcacaaactgtacactgctgttgtgtcgacggctactttctcccatgaacctgcttagcctgcacactgcctctggcttgcgcctgttctccgtcctatctctggcctggggatttatcgccgacgttgatctggaatcggagaaatacagacggctcggagagatgcgctttacactcgggacattcttaagactcgcagccctcagaacatatagaggaaggctcgcctaccttccagtcggacgtgtgggttcgaaaactcctgcgagtccagtagtcgtccagcagggacccgttgacgcccatctagtacccctcgaggagcccgttccatcccactggactgtagttcccgacgaagattttgtcttggtgctggcgctactgcactctcatctgggatccgagatgttcgccgcccccatgggtcgctgtgccgccggagtcatgcacctcttctacgtcagagccggtgtaagtagggcaatgttgctgcgactctttctcgctatggagaagggtcgacatatggagtacgagtgtccttatctcgtatatgtccccgtcgtggcttttcgactcgaacccaaagacggaaagggggtatttgcagttgatggtgaactcatggtttctgaggcggtacaaggtcaggtccatccgaactatttctggatggtctctggctgcgtcgaacctcctccctcctggaagccacagcagatgccacccccggaggaaccactgtag

SEQ ID NO: 17500 - DNA, 1965 bp, Artificial Sequence
  Description of Artificial Sequence: Synthetic coding sequence
atgaatggccacttagaagcagaggaacagcaggaccagcgacctgaccaggaactcaccggcagctggggccacggacctcgcagcactctggtgcgggctaaggcgatggcgcctcctcctccgccgttagccgcaagtacccctctgctccacggagaatttggttcatacccagccaggggacctagatttgctctgactcttacttctcaggcgttgcacatccaacgactgagacccaagcccgaagcccgccctagaggtggcttggtgcccttggcagaagtttccggctgctgtacattaagatcccgaagtcctagcgacagcgccgcctacttctgcatatacacctatccgcggggtagacgcggcgcacgtagaagggccaccaggacgttccgcgctgatggtgccgctacttacgaggagaatagagctgaggctcagagatgggctacagccctgacctgcctgcttagaggcctgccacttcccggcgatggggagattacacctgatctgctgccccgcccaccccggctgctgcttctggtcaacccgttcgggggccggggcctagcttggcagtggtgtaaaaaccacgtgttgcccatgatttctgaggctgggctgtcgttcaatctgatacaaacagaacggcagaaccacgctcgggaactggtgcagggtctgtcgctgtctgaatgggacggaattgttactgtctctggcgacggattgcttcacgaggttctgaacggactcttggacaggcctgactgggaagaagctgttaaaatgcctgtcggcattctaccttgcggctctggcaatgccctggccggtgctgttaatcagcacgggggatttgagccggccctaggtctcgatcttctactgaattgtagcctattgctctgccgcggcggaggccacccactcgacctgctgagcgtaacgctggccagtggctccagatgcttctctttcttgtcagtggcttggggatttgtatctgatgttgatattcaatccgaacgctttcgtgcgcttggatccgcacgctttacactgggaacagtgctgggccttgctaccctacacacctacaggggcaggctgtcctacctgcccgctaccgtggagccagctagcccgacccccgcgcattcactgccgcgagcgaagtctgagctgacccttactccggacccagccccacctatggcacactcacccctacatcgttctgtaagtgacttgccacttcccctgccacagccggcgctggcctcccctggcagtccagagcctctccccattctgtcgctgaacggcggagggccagaactggctggtgattggggcggggccggcgatgccccattaagccccgacccgctattaagctcccctccagggtcccccaaagcggcactgcatagtcccgtgtccgagggcgctccagtgattcccccttcatcaggtcttccactgcccacgcccgatgcccgagttggcgcgtccacatgcgggccccccgaccaccttctgcctccccttggaactcctcttcctccagattgggtgactctggaaggagactttgtgctcatgcttgctatctctccaagtcatctcggagccgacttggtagcagcaccccacgctaggtttgacgacggcttggtccatctgtgttgggtccgcagcggaatcagcagggctgccctcctgcgcttgtttttggccatggagcgaggcagtcacttcagtctcggttgcccccagctggggtacgccgccgcccgggcgttccgcttagagccactcacacctcgaggtgttcttaccgtggatggagaacaagtagaatacgggcccctgcaagcacagatgcaccctggcatcggtactctactgaccggaccaccaggctgtccgggaagagaaccttag

SEQ ID NO: 17501 - DNA, 1851 bp, Artificial Sequence
  Description of Artificial Sequence: Synthetic coding sequence
atggctccaccaccgcctcctctcgccgccagtacgcccctgctccacggggaattcggtagttaccctgcacgcggtccccgctttgcacttaccctgacttcacaggccttgcacatccaacggcttaggcccaagccggaggccaggccacgtggcggcctggtgccacttgcagaggtgagtgggtgctgcactttgaggagtcgctcaccttcagactcagctgcctacttctgtatttacacgtacccgcgcggaaggaggggagcccgccgcagggccacacgaacattcagggctgatggggccgctacttacgaggagaacagggctgaagcccagcgctgggctaccgctttgacatgtctgctgagagggctgcccctacccggcgatggtgagattacacctgacctcctgccacgccccccccgccttttgctgctggtcaaccccttcggggggcggggcctggcttggcagtggtgcaagaaccacgtgttgcctatgatcagcgaggccggtctgtctttcaacttgatccagacagagagacagaatcatgctagggaacttgtgcaggggctgtcactctctgaatgggacggcatagtcacggtttcaggagacgggttgttgcatgaggtgctcaatggtctgctggatcggcctgattgggaagaggccgttaagatgcccgtcggaattctcccatgcggcagcgggaacgcactggcaggagccgtgaaccagcacggaggtccctcttggggcgatagagacccatacatctcccatagcgccaagccaaccgtgtcgcaggtgaaccagcctgcctgtggaatgttgactcccagctcgtggacattcctgccggcatgctttccagccgtcagcagagctcctagaacactccccggtatgggcggaactcaggcactggggagcgcccggtttactcttggaaccgtgctcgggttggctaccctgcacacataccgtggtaggttaagttacctgccagcaacagtggagcctgcctctcccacacccgcacacagccttcccagggccaagtctgagcttactctgacaccagatccagcacctcctatggcccattcccccctgcaccgttccgtgtccgacctgccacttccactcccccaacccgccttggcctccccaggttctcccgaacctcttcccatcctgtctcttaacgggggtggcccagagctcgcaggtgactgggggggcgccggggatgcccctctttcacccgatccccttctgtcctcaccgcccgggtctcctaaagccgctctacactccccagtgtctgagggagcacccgtcattcctccgagctcgggcctgcctctaccaacgccagacgctcgagtgggggcatcaacatgcggtccccctgaccatttgcttccccccctggggacgcccctgccccctgactgggtcactcttgagggcgatttcgttctaatgctggctatatctccaagccacctcggtgcagacctggtcgctgcccctcacgcccggttcgacgacgggctggtgcacttgtgctgggtaaggagcggcatcagtcgcgcagcgctgttgagactgtttctggcaatggagagggggtcccattttagcctgggttgccctcagctcggctatgctgccgccagggcctttagactggagccattaactcctagaggggtgctgacggttgatggtgagcaagtggagtacggccccctgcaggcgcagatgcaccctgggattggaaccttattgaccggccccccaggatgtcctggacgggagccctag

SEQ ID NO: 17502 - DNA, 1884 bp, Artificial Sequence
  Description of Artificial Sequence: Synthetic coding sequence
atgaatggccatctcgaagcagaggagcaacaggatcaacgccccgaccaggagctgacagggtcttggggtcacgggcccagaagtactttggtcagggccaaagccatggctcctcctcccccgccactggctgccagcacgccccttctgcacggagagtttggcagttaccccgccaggggcccccgatttgcactgaccctcacttcacaggcccttcacattcagcgcctcaggcctaaacacagtgccgcctacttctgcatctacacttatccccgcggtcgacgaggggccaggagaagggccacacgcaccttccgtgccgatggggccgcgacctacgaggaaaaccgggcagaggcccagcggtgggctaccgcccttacatgcctgctcagaggcttgccgttgcctggcgatggtgaaattacgccagacctactccctcgcccacctcggctcctccttttggttaacccctttgggggaagggggcttgcttggcaatggtgcaagaaccatgttctgccgatgattagcgaagcgggcctgtctttcaacttgattcaaacagagaggcagaatcacgcacgtgaactggtgcagggactttcgttgagtgagtgggatggtatcgtgaccgtgtctggcgatggcctcttgcacgaggtactgaacggactgctcgacagaccagactgggaagaggcagtgaaaatgcccgttggcattttaccatgcgggtcaggcaatgcactggccggggccgtgaaccagcacggcggctttgagccagctcttggcctcgacctgctgctgaattgttctctcttgctttgtaggggcggggggcacccactagacctgctgtccgttaccttggcctcaggcagccgctgcttttctttccttagcgtggcttggggattcgtgagcgacgttgacattcagagcgagagattccgagcattgggctccgcgaggtttacactagggacagtcctcgggcttgccacgctccacacatacagagggaggcttagttatctgccagctactgtggagccagcctcaccaaccccggctcactctcttccgcgcgctaaaagtgaactcaccttgacccccgatccagcaccgccaatggcacacagcccgttgcatagaagcgtgagtgacctgccactccccctaccccagccagcattagcttcaccgggtagtccagaacccctgcctatactttcactgaatggcgggggacctgagcttgctggtgattggggaggtgcaggtgacgcgccgctctctcccgatccactgctctcatcaccgcctggttccccgaaggcagcgctccactctcctgtcagtgagggggcgcccgttattcccccatcaagcgggcttccgcttccaacacctgatgccagggtgggtgccagcacttgtgggccccctgaccaccttctgcccccgcttggaacgccccttcctcctgattgggtgaccttagagggcgactttgtgctgatgttggccatctcccctagtcacttgggtgctgatctcgtggctgccccgcacgcgcgcttcgacgacggactggtacatttgtgctgggtgcgaagtgggatatcccgagccgcactgttaaggctttttctggccatggagcgcggatctcacttttctctgggatgtccacagctgggctacgccgcagcgcgggcttttaggctagaacctttgacacccaggggggtgttgaccgtggatggagaacaggtggaatatggacccctccaggcacagatgcaccccgggataggcaccctgctgacgggtccgcctggatgccctggacgtgagccgtag

SEQ ID NO: 17503 - DNA, 150 bp, Artificial Sequence
  Description of Artificial Sequence: Synthetic coding sequence
atgaacggccatctcgaggccgaggagcaacaggatcagaggtcacccctgacctgctacctgggccgccccggctgcttttattggagtattcctctaggagtcggagcatggccaggttccggagtgagaacaacctgcttcccctag

SEQ ID NO: 17504 - DNA, 2286 bp, Artificial Sequence
  Description of Artificial Sequence: Synthetic coding sequence
atgatcgggtgtctccatgccagggtgtctggcccattatgggacgccggcctttgccctgcatcttcaagatctgcccatacgtgtctctcactgtccgtgtctgatgccccagtatcccccgcaacggccccccattgtctcctgttgtctacagcccccgcccctccatgtccctgccacggcgtgctgaatagccatccattctcgccgccttttcctcagcggccagaccaggagctcaccggttcttggggccacggaccacggtcaacattggtcagagcgaaggctatggccccccctccaccccccctggccgcaagcacacccttgcttcatggcgagttcggatcataccccgctcgtgggccacggtttgcattgacccttacttcccaagcactgcacatccaacgcctgcgaccaaagccggaagctcggccacgtggcggtctcgtgcccctggctgaggtgtccggctgctgtactctgcgttcccgcagcccctccgattctgccgcgtatttttgtatctacacatacccgaggggcagacgcggggctagacgcagagccacccgcacctttagggccgacggggccgctacttacgaggagaaccgcgccgaagctcagagatgggccacagctttgacgtgccttctgaggggtctgccactccccggagacggcgagattacgccagatctgcttccgcgcccaccacgtctcctgctcctcgtcaatccattcggaggcagagggctcgcttggcagtggtgtaagaatcacgtgctccctatgatctccgaagctggattgtcatttaatctgatccagactgagagacagaaccatgcaagggagcttgtgcaagggttatctctttctgagtgggacgggatcgtcaccgtgagtggtgacggactgctgcatgaagtactgaatggactcttggaccgcccggattgggaggaggctgtcaaaatgcccgtgggtatcctgccctgtgggagcgggaatgcgttggctggagctgtgaatcagcatgggggattcgagccggctctaggccttgatctacttctcaattgttccctcttactgtgcagaggggggggccatcctctcgacttgttatcagttaccctcgcctcgggttccaggtgcttcagctttctgtcagtcgcctggggctttgtgtccgacgtggatattcagtccgagcggttccgcgctctcggctccgcaaggtttacccttggtactgtcctgggcctggccacattgcacacttaccgagggcggctctcctatctgcctgcaaccgttgaaccagcgagcccgacgcccgctcatagcttgcctagagctaagagcgagttaacactaacccccgaccccgcacctccgatggcccacagtccgcttcacagaagcgtgtccgacctgccactgccactgcctcagcccgcactagcctcaccagggtcaccggagcctctccctatcctgtccttgaatggaggaggtccagagctcgccggagattgggggggcgctggtgatgccccattgagccccgatccccttctcagcagccccccgggcagccctaaggcggctctgcattcccctgtctcagagggagccccagtaattcccccttcatcaggactgccactgcctacccccgatgccagagtcggtgcatccacctgcggccctccagatcacctgctgccgcccctgggaacgcccctccctccggactgggtgaccctggagggcgattttgtcctgatgctggcgatatcaccatcccatcttggcgccgatctggtggctgccccccacgccagattcgacgatggtctggtgcacctctgttgggtaagatcagggatctctcgagccgccttgctgcgactgtttctggccatggaacgcggatcacatttttcactcggttgtcctcaacttggatatgccgccgcacgagccttccgtttggagccgctgaccccaaggggggtattgactgtggacggagaacaggtcgaatacggccctctccaggctcagatgcacccaggaatagcgagaggccgaacacagacacccgccctccccgccgcgccggcgctatatgggaggcagccaggcgctgcccatggtctccaacctgtgtgtcagggtgcagcgctcttcttccacaactcgtggctgtgggggtcacaagatctcttccgaatcgtgctgactgaagctgtgggcggctag

SEQ ID NO: 17505 - DNA, 1965 bp, Artificial Sequence
  Description of Artificial Sequence: Synthetic coding sequence
atgaacgggcatctggaagccgaagaacagcaggaccagaggccggatcaagagttaaccggatcatggggccacggaccacggagcaccctggttagagcaaaagccatggctccccctcccccacccctggctgccagtacacctctgttgcacggtgaatttggctcataccctgcacgcgggccaaggtttgctctaacattgacctcccaagcccttcatattcagcgtcttagaccaaagccagaagcccgcccaagggggggcttggtccccctagctgaagtgagcgggtgttgcacattgagatcccggtccccgagcgactcagctgcttacttctgcatatatacatacccccggggtaggcggggagccaggaggcgagcaacacggactttccgggctgatggagccgctacatatgaggaaaaccgagctgaggctcaacggtgggcgactgcccttacctgtttgctccgcgggctgccactccctggtgacggggagattacacccgacttgctgccccgtcctcctcgccttctgctccttgttaaccccttcggaggccgcggccttgcttggcagtggtgtaagaaccacgtcctccccatgatcagcgaagcaggcctgagtttcaatctgattcagactgaaagacaaaaccatgcccgggaattagtccagggcctatccctttccgagtgggacgggatcgtcaccgtgtctggcgatggactcttgcacgaggtactgaatggcctgctggatcggccagattgggaagaagctgtgaagatgccagtggggatcctgccctgtggctctggaaatgccctggccggagcagttaatcagcacggaggatttgaaccagcattgggattggacctactcctcaactgtagtctgttgctgtgcagggggggagggcaccccttagacctgttatctgttaccctggcctctggttccagatgtttcagttttttgagtgtcgcctggggattcgtttcagacgtggacattcagtccgaacggtttcgggccttggggtccgctcgtttcacacttggcacagtcctcgggctggcaactcttcatacataccgtggccgactgagttacctgcccgccaccgtggaaccagcatcccctactcccgctcacagcttaccccgcgcaaaatcggagctaactcttactcccgaccccgcccctcccatggcccattcccccctccacaggtccgtttccgatctgcccttacccctaccccagcctgcattagcttctcctggttcaccggaaccccttcctattctgagtctgaatgggggcggtcctgaactggctggggactgggggggggctggagatgcacccctcagtccagaccccctactgagctcacccccaggcagtccaaaggcggctttgcactcacccgtgtccgaaggggcgcccgtaatccctccgagtagtggtttgccgctgcccactccagatgctcgcgtgggcgcgtccacttgcggtccacctgaccatctgcttcctcccctgggtacgccgctgccaccagactgggtgactctcgaaggcgattttgttcttatgctggccatttccccaagccatctcggcgcggatctggtggctgcgcctcacgcgcgttttgacgacggactcgtgcacctgtgttgggttagatctgggattagccgggctgcactgctgcgattattcctggctatggagcggggtagccacttcagccttggctgcccacagctgggctatgctgccgcaagggcttttaggctggagcctttgacacccagaggagtactgaccgtggacggtgagcaggtcgaatacggacccttgcaggctcaaatgcacccaggaattgggaccttgctaacggggcctcccggctgtcccggcagggaaccatag

SEQ ID NO: 17506 - DNA, 1857 bp, Artificial Sequence
  Description of Artificial Sequence: Synthetic coding sequence
atggccccccctcctccacccctggccgcatccacccccctactgcacggggaattcgggtcataccctgccagaggcccgcggtttgctcttacactgaccagccaggctctgcacattcaaagacttcgaccaaagccagaggctcggcccagagggggcctggtacccctggcagaggtgtccggatgctgcacactgcgctcccggagtccctctgacagcgctgcctatttctgtatctacacctatcccaggggcaggagaggagccagacgccgagcaacaaggaccttccgtgctgacggggcagctacctatgaagaaaaccgggcagaggctcagcgatgggccacagccttgacttgcctgttgagagggctacccttgccgggggatggcgaaatcacacctgacctgctgccgcgcccgccgaggctgcttttgttagtgaatcctttcggggggcgaggtctagcatggcagtggtgtaaaaatcacgttctgcctatgatctctgaagcaggactcagcttcaatttgattcagactgaaagacaaaatcacgctagggaactcgtgcaaggactgagcttaagtgagtgggacggcatagtgacggttagtggagacggcctgctccatgaggtgctgaacggtctgctagatcgcccagattgggaagaagccgtgaagatgcctgttggtatcctgccttgcggctctgggaacgcccttgctggcgccgtgaatcagcacggggggtttgaaccagcgctgggtcttgacctcctgttgaactgctcccttcttctctgtcgcggcggaggacacccgttggatctactgtcagtgacgttagcatcagggtcgcgctgcttttcattcttgagcgtggcatggggctttgtatctgatgtggatatccagagcgagcgctttcgtgcgcttggatctgctagattcactctcggcaccgtattaggcctcgctaccctgcatacttatcggggcagattgtcctacctgccagcaactgtcgagccggcaagtcccacaccggcccatagtctgcccagagccaagtcagaactgactcttacccctgaccccgctccccctatggcccactctcctctgcatcggtctgtgtccgatctccctcttcccctcccccagcccgccctggcatcccctgggtcgcccgagccccttccaatcttgagcctcaatggcggtggcccagaattggcgggcgattggggcggtgccggtgacgcccctctgagcccagatcctcttctgtcaagtccccccggaagtcccaaagccgctctgcacagtcccgtgtctgagggagccccagtgatcccgccatctagtggcctgcctctccccacccctgacgccagggtcggtgcgtctacttgcggtccacctgatcacttgcttccaccactcggaaccccactcccgcctgactgggtcactcttgagggagacttcgttttaatgctcgccattagcccatcccatctgggcgctgatctagtcgctgccccacacgcgcggttcgacgacggcctagtccatttgtgttgggtcagatccggcatttctagagcggctctgcttcgcctgttcttggctatggagcgaggatcccatttcagcttagggtgcccacagctggggtacgccgcagcaagagccttccggctcgaaccacttacgccccgaggcgttcttaccgtggacggggagcaggtggagtacggacccctgcaggcacagatgcacccgggaatcggcactttgcttaccggaccaccaggttgcccaggaagggagccatag

SEQ ID NO: 17507 - DNA, 1149 bp, Artificial Sequence
  Description of Artificial Sequence: Synthetic coding sequence
atgggacccacgtccgtcccccttgtgaaggcgcaccgaagtagtgtttcagattatgtgaactatgatataattgtgagacattacaattacacagggaagctgaatattagcgcagacaaagaaaacagtataaagctaacttcagtagtctttatcctgatctgctgttttatcatactcgagaatatcttcgtcctgctgactatctggaaaactaagaagttccataggcccatgtactactttatagggaatctggcccttagtgatctactcgccggcgttgcctacacggcgaatctgttgctctccggggccacgacatacaagctcacacccgcccagtggttcttaagagaaggcagtatgtttgtggcattgtctgcctccgtattttctctgttagccatcgccattgaaagatacatcaccatgctgaaaatgaagcttcacaacggttccaacaactttcgcttgtttctgctcatttctgcgtgctgggtcatcagtcttattttggggggcttgcctattatgggctggaattgtatcagcgctttaagctcttgctccacagtgcttccgttgtatcacaaacactatatcctcttttgcacaaccgtgttcacccttttgctcctgagcatagtgattttatactgtaggatctacagtctggtccggactaggagcagacggcttactttccgaaagaatatttcaaaagcctcccgcagtagcgagaaaagtctggcgctattgaagaccgttatcatagtgctcagcgtcttcatcgcgtgctgggcaccactgttcatcctgttgctgttggacgttggatgtaaagtgaaaacctgcgatatcttgtttagggctgagtactttctcgtcctggcagtattaaatagcggcaccaatccaattatttacaccctcaccaacaaggaaatgcgacgggccttcatccgcattatgtcgtgttgcaaatgtccttcaggggactcagctggcaaattcaagcgaccgatcattgcaggaatggaattcagccggagcaagtccgacaacagttctcacccgcaaaaggacgaaggcgataatcccgaaacaatcatgagcagtggcaacgtaaactcctcttcctag

SEQ ID NO: 17508 - DNA, 1353 bp, Artificial Sequence
  Description of Artificial Sequence: Synthetic coding sequence
atgggcccaacatcagttccccttgttaaggcgcacaggtcctctgtgagcgactatgtgaattacgatatcatagttcggcattacaattataccggcaagctgaatatttcagccgacaaggagaattcaatcaagctgacatccgttgtgtttatacttatatgttgtttcattatcctggaaaacatttttgtcctgctcaccatatggaagacaaaaaaattccaccgacccatgtactacttcattgggaatctagctctgtccgatctgctagccggcgtagcctacacggccaacctgctgctgagcggtgccaccacctataaattgacgcccgcgcagtggttcctccgggaaggcagcatgttcgtggccttaagcgctagcgtgtttagcctgcttgccatcgccatcgagagatacattacaatgctgaaaatgaagctgcacaatggcagcaataatttcagactgttcttgttaatcagcgcgtgttgggtgatctccctgattctaggcgggctgcctatcatgggttggaactgcatatccgccttgtcatcctgcagcaccgtgctccctttatatcataaacattacattctattctgcactaccgttttcaccctcttgctgctgagcattgtaatcctgtattgccgcatatactccctggtgcgaactcgctcgaggaggctcacattccgcaagaacatcagtaaagcatccagatcatctgagaaatccctcgccctgcttaagaccgtgatcattgtgctgtccgtctttatcgcatgctgggctcccctgttcattctgctgttgctcgacgtaggatgtaaggtcaagacctgcgacatactgttcagggccgagtactttttggtgctcgccgtactcaactcaggcaccaaccctataatctatacattgactaacaaagaaacactgctagccaactcatctgatccgtcgtcccccgcatggaacagcgcagccgcaaatcgaaccattcctccgacacctcggaagaccaaaggaacaacccaaaggccattatgtctgctcgagacatctaccctgttgccacgtacggggagctgccctcctactgggagtgccctgtatctcgtggccgggcatccctccgtgtggaagaaaataagtggcttgcgattgctaccaggtagatcctgctgcaagcctgaagggggtcggggtcgtattaggacggcatggtggtgtcgggttctagtgggaagagtgagttcttgcgaacagtgcaccggtaaaggaggtgatcaggtgcccgcctggaatatatttagtactcccctggagctttag

SEQ ID NO: 17509 - DNA, 726 bp, Artificial Sequence
  Description of Artificial Sequence: Synthetic coding sequence
atggcaaccctgaaagaccaattgatttataacctcctcaaggaggaacaaacgccccagaataagatcactgttgttggcgtaggggctgtcggcatggcctgcgctattagtatcctcatgaaggacctggcagacgaactggccctcgttgacgttatcgaagataagctgaagggggagatgatggatctgcaacacggctctctgttcttgagaacacctaagattgtaagtggcaaagactacaacgtgaccgctaacagtaagctggttatcattactgcaggcgcacggcaacaagaaggcgaatctagactgaacctagttcaacgaaatgtgaacatcttcaagttcatcatccctaacgtggtaaagtacagtcccaactgtaaactgctaatagtgtccaatcctgttgacattctgacatatgtggcatggaaaatcagtggtttccccaagaatcgggtcatcggtagtggttgcaacctcgactcagcacgcttcagataccttatgggtgaaagacttggggtgcacccactgtcctgccacggatgggtgctgggagagcacggggatagctccgtccccgtatggagcggaatgaatgtggccggcgtctcgctcaagacccttcacccagatctgggtacagataaggataaggagcagtggaaagaagtgcacaaacaggttgtcgagcgcgtgtttacagaatag

SEQ ID NO: 17510 - DNA, 813 bp, Artificial Sequence
  Description of Artificial Sequence: Synthetic coding sequence
atgcttcaggcatgcaaaatggaaggctttcccctggtgcccccccctagcgaggatctggttccttatgacaccgatttataccagagacaaacccacgagtactacccctacctgagttctgatggagaatctcacagcgaccactactgggactttcatccgcaccacgttcactctgaattcgagtcctttgcggaaaacaacttcaccgagctccagtccgttcagcctccccagctgcaacaattataccggcacatggagcttgagcaaatgcacgtcctcgatacaccaatggtacctccacatcctagcttaggccatcaggttagctacctccctcggatgtgtctgcagtatccgagcctgtctcctgcacagccttccagcgatgaggaggagggagagcgacagagtcctcctcttgaggtcagcgatggggaggccgacggtctggaaccgggccccggcttgctgccaggggagaccggcagtaaaaagaagatccgcttatatcagttcctgctagatctgctgcgctccggggatatgaaagactccatttggtgggtagacaaagataaaggaacgttccagttctccagcaaacacaaagaggccctagcacatcgctgggggattcagaagggtaacaggaaaaagatgacataccaaaagatggctcgggccctccgcaactacggtaagacaggtgaggttaagaaagtcaagaaaaagctcacataccagttctcgggggaagttctgggtcgcgggggcctcgcggagaggcggcaccctcctcattag

SEQ ID NO: 17511 - DNA, 2403 bp, Artificial Sequence
  Description of Artificial Sequence: Synthetic coding sequence
atgggctccagcaagaagcatcgcggcgaaaaagaagcagctgggaccaccgctgctgcagggaccggtggggctaccgaacagcctccccgccacagagagcataaaaagcacaaacacaggtccggcgggagcggaggtagcggtggtgagcgcagaaaaagatcacgcgaacggggtggtgagcgcgggagcggccggcggggggcagaggcggaggcacggtcatcaacacacggcagagagcgctcccaagctgaaccttccgagagaagggtaaaacgagaaaagagagatgacggatacgaagctgctgccagtagtaagacctcttcaggagacgcctcttccctgagtatcgaggagaccaacaagcttagggcaaagcttggtctcaagcccctagaggtaaacgctataaagaaggaagcaggaaccaaggaggagcccgttacagccgatgttattaatccgatggccctgcgccagagagaagaactgagggaaaaactggccgcagccaaggaaaaaaggctgttgaaccagaagctgggcaaaataaagaccctgggcgaagacgatccatggttggatgacaccgccgcttggatcgaaagaagtcgccagctgcagaaggagaaggatcttgctgagaaaagggcaaagcttctcgaggagatggaccaggagttcggagtgagcacactcgtagaggaggagtttgggcaaagacgccaggatctttactcggctagagacctacagggactgaccgtagaacatgccattgattcatttagagagggtgagacaatgattcttactttaaaggataaaggggtgctgcaggaggaagaagacgtcttggtgaatgtcaacctggtggataaggagagagcggaaaagaatgtggaattgcgaaaaaagaagcctgactacttgccgtatgcagaggatgaatcagtagatgacttagctcaacaaaagcctcgcagcatcctcagcaagtacgatgaggaactggagggagaacgacctcactcctttcgccttgaacaagggggaactgctgatggcctgcgggaacgtgaattagaggagataagagccaaactccgcttgcaggcacagagtctgtccactgtgggccctaggttagcttctgagtatctgactcctgaggagatggtgacttttaagaaaactaagcggcgagtgaagaagatcaggaaaaaggaaaaagaggtggtggtgagggctgatgatcttcttcccttgggcgatcagacacaggatggcgactttgggagtcgactgagaggccgaggcaggagacgggtcagtgaggtggaagaggaaaaagaaccagtcccccagcctctgcctagtgacgatactagagttgaaaacatggacatcagtgatgaagaggaaggaggcgctcccccacctggttccccccaagtccttgaggaggacgaggccgaattggagctgcagaagcagctggagaaaggacgccgtctgaggcagctgcagcaactgcaacagctaagggacagcggcgaaaaagtagtggagatcgtgaagaagcttgaatctcggcagcggggctgggaagaggacgaggatcccgaacgcaagggggcgattgtgttcaacgccacctcagaattttgccgtacgctcggggagattcccacctacggtctggctgggaaccgggaagagcaagaggagctgatggactttgaacgagatgaggagagatcagccaacggcggttctgagtctgacggggaggagaacatcgggtggtcaactgtcaacctcgacgaagagaagcagcaacaggacttctccgcttccagtaccactatcttggatgaggaaccaatcgtgaacagaggcctggccgcggctttgcttctctgtcaaaacaaaggacttctggagaccacagtacagaaagttgctcgggtgaaggctcctaacaagtccctgcctagcgcagtgtactgtatcgaggataagatggctatcgacgataaatatagccgacgcgaggaatatcgaggattcacccaggatttcaaggagaaggacggttataagcccgacgtgaaaatagaatacgttgacgagacaggccggaaactgacacctaaagaagcctttagacagctgagccaccgtttccatggaaaagggtcaggaaaaatgaagacggaacggcgtatgaaaaagctggatgaggaggctctcctcaaaaagatgtcctcatctgatacacctctgggcacggtagccctcctgcaagaaaaacaaaaagctcagaagacaccatacatcgtcctgtccggatctggtaaatcaatgaacgcaaatacaataactaaatag

SEQ ID NO: 17512 - DNA, 1929 bp, Artificial Sequence
  Description of Artificial Sequence: Synthetic coding sequence
atggccttacgccagcgcgaggaattgcgcgaaaagttggccgctgctaaggaaaagaggcttttgaaccagaaacttggtaagatcaagacactaggtgaggacgacccctggcttgacgacaccgcggcctggatagaacgatctaggcagctgcagaaagagaaggacctggcggagaagagggcaaagttacttgaagagatggaccaggagtttggtgtatccaccttggttgaagaagagttcggtcagagaagacaggatctatactccgctcgcgaccttcagggactgactgtcgagcacgccattgatagttttcgggagggtgaaactatgatcctgactctaaaagataaaggtgtgcttcaggaggaggaagatgtcctggttaacgttaacctcgtcgacaaggaacgtgccgaaaagaacgtggagttacggaaaaagaagcctgactacttgccatacgcggaggatgagagcgtggacgacctggctcaacagaagcccaggagcatcctcagcaaatacgatgaagaactggagggagagcggccacattcttttagactggagcagggcggaacagccgatggtctaagagaaagggaattggaagaaatcagggccaagctgcgtctgcaggcacagagcctgtcaactgtaggcccaagactagccagtgagtacctaacaccagaggagatggtcacttttaagaagacaaagaggcgagtcaagaaaatccgcaagaaagagaaagaggtggtggtgagagccgacgatctcctgcccctgggcgatcagacacaggacggggacttcggttccagactccgcgggcgcggacgtaggcgcgtttcggaagtggaggaggaaaaagagccagtgcctcagccactgccaagcgatgacactagggttgagaatatggacatttctgacgaggaagagggaggcgctccccctccaggcagccctcaggtccttgaagaggacgaggcggagcttgaactgcagaaacagctcgagaaaggacgccggctgcgccaattgcagcagctccagcaactgcgcgactccggagagaaggtggtcgaaatcgtgaaaaagctcgaatcaaggcagagggggtgggaggaagacgaggatccggaaagaaaaggagccatcgtgtttaacgcaacgtccgagttttgtaggaccctgggggagataccgacctacggattggccgggaaccgcgaggagcaagaagagctgatggacttcgagagggacgaggaaagatccgccaacggcggctcggagagtgacggagaggagaacatagggtggagcacagtcaaccttgacgaggagaagcagcagcaggatttcagcgccagctcaacgacaatcctggacgaagagccaatcgttaacagaggactggctgccgctctcttactgtgccagaacaaagggctcctcgagaccactgtgcagaaagttgcaagggtcaaggcaccaaataagtctctgccttcagctgtgtactgtattgaggacaaaatggccatcgatgacaagtactcaagaagggaagagtacagaggattcacacaggatttcaaggaaaaggatggttataaaccagatgtcaagatcgagtacgtagacgagacaggaagaaaattgaccccaaaagaggcttttagacaattatcccataggttccatggtaagggctccggaaagatgaagactgaacgccggatgaaaaaactagacgaggaggccctgctgaagaagatgagcagttcagatacacctctggggaccgtggccttgttgcaggaaaagcaaaaagcccaaaaaaccccatatattgtgttgagtggctcagggaagagcatgaacgcaaatactatcacgaaatag

SEQ ID NO: 17513 - DNA, 4392 bp, Artificial Sequence
  Description of Artificial Sequence: Synthetic coding sequence
atgaagaagaaaacggtgtgcacattgaatatgggggacaagaaatatgaggacatggagggggaggagaacggagacaatacaatttccactggccttctctactctgaagctgacagatgccctatctgccttaattgccttctcgagaaagaagtcggctttcccgaaagttgtaaccacgtgttttgtatgacttgcatcctgaagtgggccgaaaccttggcctcatgccctattgatcgtaagccattccaggccgtttttaagttcagtgcactggagggttatgtgaaagtacaagtgaaaaagcagctgagagaaacgaaagacaaaaagaacgagaattccttcgagaaacaggtgagctgccacgagaattcaaagtcctgcattaggagaaaagcaatcgtccgagaagatctcttatctgccaaggtatgtgatttgaagtggatccatagaaactccctgtatagcgagacgggagggaagaaaaacgctgccataaagataaacaagccacagcgtagcaactggtccactaaccagtgtttccggaatttcttcagcaacatgttctcctccgtaagccacagtggtgaatccagttttacctatcgagcctactgcactgagttcattgaagcctcagagattagtgccttaatccgacagaaacggcatgaactggaactgtcttggttccctgacaccttgcctggaattggccgaattggattcattccttggaacgtggaaaccgaggtgctccccttgataagtagcgtgttgccaaggactatctttcccacatccacaatctcttttgaacatttcggcacatcgtgcaaaggctatgcactcgctcatactcaggaaggtgaagaaaagaaacaaacatctggcacgagcaataccagaggcagccgacggaagcccgcaatgactacccctacccgtcgctcaacgaggaacacaagagcagaaaccgcctcacagtcccagagatcccctatttcagataacagcggttgtgatgcacccggcaattctaacccgtctttaagtgttccttcctccgctgagtcagagaagcaaacacgccaagcccctaagcgaaaatccgttcgcagaggcaggaagccccccctgctgaagaaaaagctcaggtcatcagtagccgctcccgagaagtcttcctcaaatgactcagtcgatgaagagactgccgagtctgacacctcccctgtactagaaaaagaacatcaaccagatgtggattccagcaatatttgcaccgtgcagacccacgtggagaaccagtcagcaaattgcctgaagtcttgcaatgagcagattgaggaatctgaaaagcatactgccaattacgacacggaggagcgggttggaagctctagctctgaatcttgtgcacaggacctgccagtgttagtgggggaggaaggggaggtgaagaaactggagaatacgggcattgaggccaacgtcctatgtctggagtcagagattagcgaaaatattctggagaagggaggcgatcccctggagaagcaggaccagatctccggtctgagccagagcgaagtcaaaaccgacgtgtgcacagttcatctacctaatgatttcccgacatgtcttactagtgaaagtaaagtttaccagcctgtgtcctgccccttgtctgacttatctgagaacgttgagtcagtggtgaatgaggaaaaaattaccgagagcagtctggtggaaattactgagcacaaagactttaccctgaaaactgaggagctgattgagtcccccaagctcgaaagctcagagggtgagattattcagactgtggaccggcagagcgtaaagagccccgaggtgcagctgctggggcacgtggagaccgaagacgtagagattatagctacctgcgacacgtttggaaacgaagatttcaacaatatacaggactctgagaataatctgttaaaaaacaacttactcaatacgaaactagagaagtctttggaagagaagaatgagagtttaaccgaacatcccaggtcaaccgagctcccgaagacccacatcgagcagatccaaaaacacttttccgaggacaacaacgagatgatccccatggaatgtgattctttctgctccgaccagaatgaaagtgaagtcgaacccagtgtgaatgccgatctgaaacagatgaatgaaaatagcgttacccactgttccgagaataacatgccgtcctctgacctggccgacgaaaaggtcgagacagtgagccagccgtccgaaagcccaaaggacactatagataagaccaagaagccccggacacgacgtagtcgtttccacagtccttcaaccacctggtcacccaataaggatacccctcaagagaagaagcgccctcaatctcctagtcctcgtcgtgagactggcaaggaaagcaggaaaagccaatcgcctagccccaaaaacgaaagcgcaaggggcagaaagaagtctcggagtcagtcccccaaaaaggatatagccagggagcggcggcaatcccagagccggtctccaaagagagacacaaccagggagagcagacggagtgaatcactgtcccctcgacgcgaaacttcccgggagaacaaaagatcccagccacgggtcaaggacagtagtcctggggaaaaatcacgctctcagtctcgggaacgcgagagcgatcgcgacgggcagcgacgcgaacgggagcggcgcacccgcaagtggagccgctcccggagccattcaagatctccgagtagatgcaggactaaatcaaagtcttcatcatttggaaggattgatagagatagctattccccacgctggaaaggtagatgggcaaacgacggctggcgctgcccaagaggaaatgatcggtaccggaagaacgacccagagaagcaaaatgaaaacacccgcaaggagaagaatgacattcatctcgacgcagacgatcctaacagcgcagataagcatagaaacgactgtcctaattggattacagagaagatcaacagcggtccagatccacgcacgcgcaaccccgaaaagctgaaagagtcgcactgggaggaaaaccgtaatgagaacagcgggaattcgtggaataaaaacttcggatcaggttgggtgagcaaccgcggtaggggccgaggcaaccgcgggagagggacctaccgatcctcttttgcctacaaggaccagaatgaaaatcgctggcagaatagaaagcctctgagcggaaacagtaacagcagcgggtccgaaagctttaagtttgttgagcaacagagctacaagagaaagtcagaacaggagttttcttttgatacacccgccgatcgttctggctggacgagcgccagttcatgggcagtgagaaagactcttcctgccgatgtgcagaattactattcacggaggggcagaaattcaagcgggccccagtccggctggatgaagcaggaagaagaaacttcgggccaggattcaagcctgaaagaccagaccaaccaacaggttgatgggtctcagcttcctatcaacatgatgcagccacagatgaatgtcatgcaacaacaaatgaatgctcaacaccaacccatgaacatcttcccctatccagtgggtgttcatgctcctctgatgaatatacaaagaaatccgttcaatatacacccacagctgccattgcaccttcacaccggcgtgcctctcatgcaagtggccacaccaacatcggtgtcgcagggcctgcccccccccccaccaccccctccccctagccagcaggtaaattacattgcgtcccaacctgacggtaagcaacttcagggcattccttccagctctcacgtttcgaataacatgtcgacgcccgttctgccggcaccaaccgctgccccagggaacaccgggatggtgcagggcccctcctctgggaacacatcaagtagctcacatagcaaagccagtaatgctgctgtcaaactggccgaaagcaaggtgtccgtcgcagtcgaagctagtgccgactcaagtaagaccgacaaaaaacttcagatccaggaaaaggccgcccaggaggtcaagctcgctattaagcccttctaccagaacaaagacattacaaaggaggaatacaaagaaatagtaagaaaggcagtcgataaggtctgtcacagcaagagcggcgaggtgaacagtacgaaagtcgcaaacctggtgaaagcgtatgttgataagtataagtattccagaaagggatcccaaaagaagacactggaggagccggtgagtaccgagaagaatattggctag

SEQ ID NO: 17514 - DNA, 4392 bp, Artificial Sequence
  Description of Artificial Sequence: Synthetic coding sequence
atgaagaagaagacagtgtgcacgctaaacatgggcgacaaaaaatacgaagatatggaaggggaggaaaacggggacaatacaatttcaactgggttactgtactcagaggcagacagatgccccatttgcctcaattgccttctggaaaaagaggtgggattcccagaatcttgtaatcacgttttctgcatgacctgcattctaaaatgggctgagacgctcgcatcttgtcctattgatagaaagcctttccaggcagtgtttaagttttcagcactggaagggtacgtcaaggtgcaggtgaagaaacagctgcgggaaacaaaggataagaagaacgagaattcctttgagaaacaggtttcatgccacgaaaattctaagtcatgcattagaagaaaggctattgtgagagaagacctcctgagcgccaaagtgtgcgatctcaaatggattcacaggaatagcctgtacagcgagacagggggtaagaaaaacgctgctataaaaattaataagccacaacggtcaaactggtccaccaatcagtgctttcgcaactttttttccaacatgttctcctcggtaagtcatagtggggaatcctcttttacatacagggcatactgcacagagttcatagaagccagcgagatcagtgccttaattcgccagaaaagacatgaactggagctgtcttggttccctgatacactgcccggtattggcaggattggttttatcccttggaatgtggagacagaggttcttcctctgatctcttctgtgctgccccgcacgatttttccaacatccacgataagttttgaacactttgggacgtcatgtaagggctacgctctggctcatacacaggagggcgaggagaaaaagcagacctctggcacaagcaacactaggggctcgcggcgcaagcccgcaatgaccacgcccacccgacggtccacccggaacactcgcgccgaaacagcttcacagagtcagcggtcacctatctcagataactctggatgcgacgcccccggcaactcaaatccatccttatcagtgcccagctcagcggaatctgagaagcagactagacaggcaccaaagcgcaaatctgtgcgtcgcgggaggaagccaccactgctgaaaaaaaagctgaggagttcagtggctgcgcccgagaagagttctagtaacgactccgttgacgaagaaaccgccgagagcgacacgtctccagtgttagagaaggaacaccagccagatgtggatagtagcaatatctgtaccgtgcagacacacgttgagaatcagtcagcaaattgcctgaaatcctgcaacgagcaaattgaagagtccgagaaacacacggccaactacgacaccgaagagcgagtgggttcttcatctagtgaaagctgtgcccaggacctgcctgtgcttgtgggggaagagggagaggtgaagaagttggaaaataccggaatcgaagccaacgtcctctgcctggagagcgagatctccgaaaacatccttgaaaagggaggggacccgctagagaaacaggaccaaatttctgggctctcccaatcagaggttaaaactgatgtttgtacagttcatctgccgaatgattttccaacttgcctaacttcagagagcaaagtctatcagcctgtctcatgccctttaagtgaccttagcgaaaacgtagagagtgtggtcaacgaggagaaaatcacagaaagctcactggttgagattacagaacataaagattttacactcaagacggaggagttgatcgagagcccgaagctggaaagctccgagggcgagataattcagacagtggaccgtcaaagcgtgaaatcacctgaagtgcaattgcttggtcacgtggaaacagaagatgttgagattattgctacgtgtgatacattcggaaacgaggattttaataatatccaggatagcgagaacaatcttctgaagaataatttgttaaacaccaaactggaaaagtcactcgaggagaagaacgagtccttaaccgagcacccccgatctactgaactgcccaagacccacattgagcagattcagaaacatttcagcgaagataacaatgaaatgatccccatggaatgtgactcattctgcagtgatcaaaatgaatcagaagtcgaaccttccgtaaacgccgatcttaaacagatgaatgagaacagcgtgacccattgttccgagaataatatgccctcctcagatctggcagatgaaaaagttgagacagtttctcagccgtccgagtctcccaaggatacaatagataagactaagaagcctaggacccgtcggtccagattccatagtccaagcactacatggtcccccaacaaggacacaccccaggaaaaaaaacgtccacagtctccatcacctcggagagagaccggcaaagaatcaaggaaatcccagtccccctctccgaaaaacgagtccgccaggggtagaaaaaagtctcggagtcaatctccaaagaaggacatcgcgagggaaaggaggcagtcacagtcacgctccccgaaacgcgacaccactcgggagtcccgcagatccgaaagtctgagccctagacgggagacatccagagaaaacaaaagatcccagccaagagtaaaggatagctctcccggagagaaaagcagatcccaatcaagagaacgagagtcagaccgcgatggccaaagacgcgagcgcgagcggaggacaagaaagtggagtaggtccagatcgcattcaaggagtccatcaaggtgccgcacaaagtccaagtcaagctccttcgggaggattgaccgagattcctattccccccgttggaagggtagatgggcgaatgatggctggcgctgtccccgcgggaatgacaggtaccgcaagaacgacccggagaagcagaacgaaaatacaagaaaagaaaaaaacgatattcatctcgacgccgacgatcctaacagcgccgacaagcatcgtaatgattgtcccaactggattacggaaaaaataaattcaggtcctgaccctcgaaccaggaatcccgaaaagctcaaggaatcacattgggaggagaatcggaacgaaaacagcggcaatagttggaacaagaactttgggagcgggtgggtgtccaaccgcggacgagggcgtgggaacagggggagaggcacttatcggagttctttcgcctacaaggaccagaacgaaaatagatggcagaaccgaaagcccctgagtggcaattccaattctagcggctctgagtcattcaagtttgttgagcaacagtcctacaaaagaaagtccgagcaggaattctccttcgacactcccgccgataggagcggttggacctcggcaagctcctgggcggttcggaaaacgttgcccgccgatgtgcagaactattattccagacggggacgtaactcctccggccctcagtccgggtggatgaaacaggaggaagaaaccagcgggcaagactcgagccttaaagaccaaactaatcagcaggtcgacggatcacagctccctattaacatgatgcagcctcagatgaatgtaatgcagcagcagatgaacgcacagcaccagcccatgaacatctttccatatcccgtgggcgtgcatgctccactcatgaacatccagaggaacccgttcaatatccatccacagcttccccttcatctgcacacgggagtgccactgatgcaagttgccacccctacttctgtgtcccagggtctccccccacccccccccccacctccgccctctcagcaggtcaattacatcgcttcacagcccgacggcaaacagttacagggcattccaagtagctcacacgtctccaacaacatgtccacaccggttcttccggcccctaccgctgcccccggaaatactgggatggtgcaggggccctcatccggtaatacatcttcctcctcccactctaaggccagtaatgccgctgtcaaactggccgagagcaaagtgtcagtggccgtggaggcctctgccgacagtagcaagactgacaagaagctccagatccaggaaaaagccgctcaggaggtgaagctagccattaagcccttctatcaaaataaagatattactaaggaagaatataaggagattgttagaaaggcagtggataaagtgtgtcacagcaaaagcggagaagtcaacagcaccaaagtcgctaacctagttaaggcttacgtcgataagtacaaatactctcgtaagggatcccagaagaagactctggaggagcccgtttccaccgaaaaaaacattgggtag

SEQ ID NO: 17515 - DNA, 3447 bp, Artificial Sequence
  Description of Artificial Sequence: Synthetic coding sequence
atgaccacaccaaccaggaggtccacaaggaataccagagcagaaacagcgtcacaaagccagcggagcccgatatccgacaactcaggctgcgacgccccaggcaactctaatccaagcttgtctgtgccgtcaagcgcggagagtgaaaagcagacaagacaagctccaaaaaggaagagcgtgaggaggggccggaaaccaccactgcttaaaaagaagctgaggtccagcgttgcagcaccggagaaatcatcctcaaacgactccgttgacgaggaaacggccgaaagcgacactagccctgtgctagagaaggagcaccagccagatgtcgactcatccaatatttgtaccgtgcagacccacgtggaaaaccagtcggctaactgtctgaagagctgcaatgagcagatagaggagagcgaaaaacacaccgcgaactacgacactgaagagcgggtagggagtagctcgtcagaatcctgcgcccaagaccttccagttctagttggggaggagggagaagttaaaaaactagagaacacaggaattgaagccaacgttctgtgtctagagagcgaaatatctgaaaacatcctggagaaaggcggggaccccttggagaagcaggatcagatcagcggtctctcacagtcggaggtgaaaaccgatgtatgtacagtgcacttacctaatgatttcccaacgtgtttgactagcgagtccaaagtgtatcagcctgtgtcgtgcccccttagcgatttgagcgagaatgtggagagcgtagtgaacgaggaaaaaattactgaaagcagtctcgtggagatcactgaacataaagacttcaccttgaaaactgaggagctgatcgaatcaccaaaacttgagtctagcgaaggtgaaattatccagacagtggaccggcagtccgtgaagtcacccgaggtacagctactcggtcacgttgagactgaggatgtcgaaataatcgccacttgcgatacatttggtaatgaggattttaataatattcaggactccgagaacaacctgcttaagaacaaccttctgaatactaaactagagaaatccctggaagagaaaaacgaaagtctcacggagcacccacggagtacagagctccctaaaacccacatcgaacagatccagaagcatttcagcgaggataacaacgagatgatacccatggagtgcgattcattctgctctgaccaaaacgaatccgaggtagagccttcagtcaatgcagatcttaagcagatgaatgagaattcagtaacccattgtagcgaaaacaacatgccttcaagcgatttggccgatgagaaagtggaaaccgtctcacagccgagtgaatcgccaaaggacaccatcgacaagaccaaaaaaccaagaaccagacggtctaggttccactcccctagcactacatggagccccaacaaagacacaccacaggaaaaaaaaaggccacaaagcccgagtcctagaagagagaccggtaaagagtcgcgtaaaagccaaagcccttcaccaaaaaacgagagtgccagggggcgtaagaagagtcgcagtcagtcgccaaagaaagacattgcccgggaaaggcggcagtcgcagtccaggagcccaaaaagggatacgactagggaaagtcgccgctctgaatccctgagcccaaggcgcgagacaagccgggagaacaagcggagccagccaagagtgaaagacagcagccccggggaaaagtccaggagccaatcgagagagcgtgaatccgacagggacggccagagacgcgaaagggagcgccgcacacgcaagtggagcaggagtcggagtcactctcgtagtccatcccgatgtcgtacaaagagcaaaagcagtagcttcggccgtatagaccgggactcatacagtcctcgctggaagggccggtgggctaacgacgggtggcgttgtcccagagggaacgacagatatagaaaaaacgatcccgaaaagcaaaatgagaacacaagaaaggaaaagaacgacattcacctcgatgccgatgaccccaactccgccgataaacaccgcaatgactgccctaactggatcactgagaaaataaactccggccctgaccctagaacaagaaaccctgaaaagttgaaagagtcacactgggaggagaatagaaacgagaattcaggcaattcctggaataagaactttgggtctggatgggtaagcaaccggggacgtgggagagggaaccgtggcagagggacatatcgctcgtcctttgcgtataaggatcagaacgaaaataggtggcagaatcggaagcccctaagtggcaactcaaatagttccggcagtgaaagcttcaaatttgtggagcagcaatcctataagcgcaaaagtgagcaggaattctcattcgacacgcccgctgataggagcggctggacctctgcaagctcttgggcagttcggaaaacgttgcccgccgatgtgcagaattattactccagacgtggaaggaatagtagcggtcctcagtcaggatggatgaagcaggaagaggaaacatccgggcaagacagttcacttaaagaccagactaatcagcaggtggacgggtcccagctgccaatcaacatgatgcagccccagatgaacgtcatgcagcagcagatgaatgcacaacatcagcctatgaacatattcccgtatccagtgggcgtgcacgcccccctcatgaacatccaaaggaatccttttaacatacaccctcagctccccctgcacctgcataccggagtgccactgatgcaggtggcaacccccacgtcagtgagccagggcctgcccccgccaccgccaccccccccgccatcccagcaggtgaattacattgcctctcaaccagacggtaagcaattgcagggcattccttcttccagccacgtcagtaataacatgagtactcccgtattgccggcccccaccgcagcgcctggcaacaccggcatggttcaggggccaagcagcggtaacacatcatccagttcacactctaaagcgtcaaacgccgcagtcaagctggccgaatccaaggttagcgttgccgtcgaagcctcggcagacagctccaaaaccgacaaaaaattacaaatccaggagaaagccgctcaagaggtgaagctggcaatcaaaccattctatcagaataaggacataactaaagaggaatacaaggagatcgtgaggaaggcagtggacaaggtctgccacagcaagtcaggcgaggttaattccacgaaagttgccaatttggtcaaggcttatgtggataaatataagtacagtcgaaagggctctcagaagaagacgttagaagaacctgtgtcaacagaaaagaacatcgggtag

SEQ ID NO: 17516 - DNA, 1401 bp, Artificial Sequence
  Description of Artificial Sequence: Synthetic coding sequence
atggcggaggaacaggacttgtcagaggttgaacttagtcctgtgggcagcgaagagccacggtgcctttcacccggctctgctccgagcctcgggcccgacgggggagggggtggaagcggccttcgggcctccccagggcctggtgagctgggcaaagtcaagaaagaacagcaggacggtgaagccgatgacgataaatttcccgtgtgcattcgggaggcagtctctcaggtcctgtccggttacgactggactctggtaccgatgcccgtccgagtgaacggagcctctaagagcaagcctcacgtaaagagacctatgaatgctttcatggtctgggcgcaggctgctagacggaagcttgcagaccagtacccccacctgcataacgccgaactatctaaaacccttggaaagctgtggcgattgcttaatgaatctgataaaaggccattcatagaagaggccgaacggctgcgaatgcagcataagaaagatcaccccgactataaataccagcctcggcgacgcaagaacggcaaggccgcacagggcgaggccgagtgccccggaggggaggccgagcaaggcgggactgcagcaattcaagcacattacaaatccgcacacctcgatcacagacatcctggtgaagggtccccaatgtcggacgggaaccccgagcacccgtcagggcagtcccacgggcctccaacaccccctacgactcccaagactgaactccaaagtggtaaggcagaccctaagcgcgatggccgctccatgggcgaagggggaaagcctcacatcgattttggaaacgtcgacattggagaaattagccatgaagttatgtctaatatggaaactttcgatgtggcggagttggatcaataccttccgcccaacggtcatccaggtcacgtgtctagctattctgccgccgggtatggactaggatcggctctcgccgtcgcctctggtcactctgcctggatctctaagcctccaggagtggctttgcctaccgtgtccccgccaggtgtggatgcgaaagcacaggttaaaaccgagactgcgggaccccaagggcctcctcattatacagaccaaccaagcaccagtcagatcgcttacacatccctgagcctcccccactatggctcagcatttccgagcatcagtcggcctcagttcgactactcggaccaccagccatccggaccatactacgggcattctggacaggcctcagggctgtactcagctttctcctacatggggcctagccagagacccctgtacacagcaatatctgaccccagcccaagcggaccccagtcccacagtcccactcattgggaacaaccggtgtacaccactctgtctaggccatag

SEQ ID NO: 17517 - DNA, 1401 bp, Artificial Sequence
  Description of Artificial Sequence: Synthetic coding sequence
atggccgaagagcaagatctgtccgaggtagagctctctcccgtgggttccgaggagcctcggtgcctgtcacctggatctgcaccctcacttggcccagatgggggcggagggggctctggcttgagagccagtcccgggccgggagaactcggcaaggtgaaaaaggagcaacaagacggagaggctgatgacgacaaattccctgtgtgcatccgtgaggccgtatctcaggtgctgtcaggttacgactggacattagtcccaatgcctgtacgagtgaatggtgcatccaaaagtaagccccatgtcaaaagaccaatgaatgcatttatggtgtgggcacaagcagcccgaagaaaactagccgaccaatatccccatctacataatgccgaactgagcaaaactctgggtaagttgtggaggcttcttaacgagtcagacaagcgaccgtttatagaagaagctgaacgactccggatgcagcacaaaaaggaccacccagattacaagtatcagcctagaagacggaaaaatgggaaagcggcacagggagaagctgaatgccccggaggggaagccgagcagggagggactgctgctatccaggcacactataagagcgctcacctcgaccacagacaccccggggaggggagcccaatgtctgatggaaaccccgagcacccctcgggacagagccacggtccacctaccccccctactactccaaaaactgaactgcaaagtggtaaggctgacccaaagcgcgacgggcgttccatgggtgaaggaggaaaaccacacatcgatttcggaaacgtcgacattggagagataagccatgaagtcatgagtaatatggagaccttcgatgtggccgagctcgaccagtacctaccacctaatggtcatcccggccacgtctccagctactcagcggctggatacggcctcggaagtgccctggccgtcgcaagcgggcacagtgcctggatttcaaagccaccaggcgtcgctctacccacagtctcccccccaggggtagatgcaaaggctcaagtaaaaacggagactgccggtccacagggaccaccccattataccgaccagcctagcacatctcagattgcatataccagcctgagtctaccccactatggctccgcatttcctagcattagtaggccacaatttgattacagcgaccaccaaccgtccggcccgtactatggccacagcggacaggcatcggggctctatagcgccttttcatatatgggaccctctcaacggcctctatacaccgcaatctctgacccaagccctagcggaccgcaaagtcactctcccactcattgggaacagcctgtctataccacgctgtcacgcccttag

SEQ ID NO: 17518 - DNA, 861 bp, Artificial Sequence
  Description of Artificial Sequence: Synthetic coding sequence
atggccgaagagcaggacttgtctgaggtcgagctcagcccagtgggatcggaagaacctaggtgcctttcaccaggatctgcacctagcctggggcccgacggcggcggcgggggaagcggactgagagccagtcccggcccgggtgaactcgggaaagtgaaaaaggagcagcaggatggagaagccgacgatgataaatttcctgtgtgtatcagagaggccgtatcacaggtgctctcagggtacgattggacactcgtacccatgcccgtgcgcgtgaacggggcaagtaagtccaagccccacgtgaagcgacctatgaatgcatttatggtttgggcgcaagctgcccgtcgcaagctcgctgaccagtacccccatctacataatgcagagctatcaaagaccctaggcaagctctggcggctgctgaacgaatccgacaaacgccccttcatagaagaggcggagcggctacggatgcaacataagaaagaccacccagactataagtatcaaccgcgccgccggaaaaatggtaaggcagcacaaggcgaagccgaatgtccaggcggggaggctgagcaagggggtactgcagccatccaggcacactataaatctgcccacctcgatcatagacaccccggggagggaagccccatgtcagacggtaacccagagcacccgtcaggccagtcgcacggaccgccgaccccccctactactccaaaaactgaactacagagcgggaaagctgaccccaagcgtgacggtagaccttcaccttccggcccccagtcgcactcgcccactcactgggagcagcctgtctataccaccctcagtcggccctag

SEQ ID NO: 17519 - DNA, 642 bp, Artificial Sequence
  Description of Artificial Sequence: Synthetic coding sequence
atggccgaagaacaggatctaagcgaagttgagttaagccccgttggatctgaggaaccgcgttgtctctcgcccggatccgcgccatcactcggtccagatggtggcggcggggggtccggtttgcgtgcctctccaggccctggagagctgggtaaggtgaaaaaagagcaacaagatggcgaagcagacgacgacaagttccctgtttgcataagagaagctgtctcgcaggtgctctctggatatgattggaccctggtcccgatgcccgtccgagtcaatggggcctcaaagtctaagccacatgtcaaaagacccatgaacgcattcatggtgtgggcccaagcggcacgtaggaagctcgccgatcagtacccacaccttcataacgcagagctcagtaagactctgggaaagctttggcggttacttaatgaatccgataagagaccttttatcgaggaggccgagcggctccgcatgcagcataagaaggaccatccggactacaagtatcaaccccgaaggcgaaagaacggtaaagcagctcagggggaggctgaatgtccaggaggtgaggccgagcaaggaggaaccgccgcaattcaagctcattacaaatcggcgcatcttgactag

SEQ ID NO: 17520 - DNA, 1425 bp, Artificial Sequence
  Description of Artificial Sequence: Synthetic coding sequence
atggtgcagcagacaaataatgccgagaataccgaggccctcctggccggagagagctctgacagcggggctgggctcgagcttggcatagcctccagtcccacgccgggcagtaccgcctcgacggggggtaaggcggacgatcctagctggtgcaaaaccccatctggacatataaaaaggcctatgaatgctttcatggtttggtcacaaattgagagacgcaaaattatggagcagagccctgacatgcacaatgccgagatttccaagagactgggtaaacgctggaagctcctaaaagacagtgataaaattccattcatcagagaagcggagagactgcgactcaaacacatggcggattaccccgactacaaatacagaccacgcaagaaagtaaagagcggcaacgctaactcttctagttctgccgcagctagcagtaagcctggagagaaaggagacaaggtcggaggctccggtggtgggggacacggcggaggaggaggcggaggcagctcaaacgccggggggggaggaggtggcgccagtggcgggggggctaacagcaaacctgcacagaagaagtcatgtggctctaaagtggctggcggggccgggggtggtgtgtccaagccccatgccaagctgatcctcgctggaggcgggggcggcggaaaagccgccgcagccgcggcagcgtcttttgccgccgagcaagcaggagccgcagcccttctcccattaggtgccgcagcggaccatcattcactttataaggcaaggacaccttcggccagcgctagcgcttcctctgctgctagcgcctctgccgccctagctgcccccggaaagcacctggcagaaaaaaaggtaaagcgcgtgtatctatttggcggcctgggcacctccagtagcccagttggtggggtgggggccggggcagacccttccgacccattgggcctgtacgaggaggaaggcgccggatgttctcccgacgccccctccttatctggtaggtcatccgctgccagctctcctgctgcgggcagatcacccgccgaccaccgaggatacgcaagcctgcgcgctgcctctcccgcccctagttcagctccatcacacgccagtagctctgcatcctcccattctagctcaagctcctcgtctggtagtagctcaagcgatgacgaatttgaagacgatttactggacctcaacccctcttcaaactttgagtcaatgagccttgggtccttcagttcttctagcgccctggacagggatctcgattttaactttgaacccgggtcggggtcccacttcgagttcccagactattgtaccccggaagtcagcgaaatgatctcaggagattggctggagagctctatcagcaatcttgtgttcacttattag

SEQ ID NO: 17521 - DNA, 1425 bp, Artificial Sequence
  Description of Artificial Sequence: Synthetic coding sequence
atggttcagcagacgaataacgcagagaataccgaggcgttattagcaggcgaaagctccgatagcggagctggcctggagctcgggatcgcgagctcccctacgcccgggtcgactgcgagcacgggcggcaaagcggacgatcctagttggtgtaaaactccttcaggccacatcaagaggccaatgaacgcgttcatggtgtggtctcagatagaacgccgtaagatcatggagcaatctccagatatgcacaacgccgagatctctaagagattgggcaaaaggtggaaactgctcaaggatagcgacaagatccccttcatccgtgaggccgagaggcttaggctgaagcatatggctgactaccccgactacaagtataggcctcgcaaaaaagtgaaatctggaaacgctaacagctcctctagtgccgctgcttcaagtaaaccgggggaaaagggagacaaagtgggcggatcgggaggcggcggtcacgggggtggcgggggcggtggatcctcaaatgccggcggggggggcggtggagcgtccgggggtggggcaaactcaaagcctgcgcagaagaaatcttgcgggtctaaagtggccgggggagccggaggaggggtgtccaaaccacacgccaagctaattttggccggaggcggtgggggcggcaaagccgccgccgccgccgcagcttcctttgccgcggagcaggctggagcagcggctcttctgcctctgggcgccgccgcagaccaccattctctgtacaaggcgcgaaccccgtctgcatctgccagcgcttcttcagccgcctcggcgtccgccgctctggcagcccccggtaaacatttggccgaaaagaaggtcaagcgtgtctatctgttcgggggcctgggtacctcgtcctcacctgtggggggcgtgggcgctggcgcagacccaagcgatcccctcggtctctatgaggaggaaggagctggctgctcccccgatgctcctagtctgtctggccgctccagtgcagcatcttcaccagccgctggtagatcccctgcggatcatagaggatacgcttctttgcgggcggcaagccctgcaccgtcttcagccccctctcacgcctcttcctctgcatcctcgcattcatctagttcttcttccagtgggtcctctagcagtgacgacgaatttgaggacgacttgttggaccttaacccttcatcaaatttcgagagcatgtccctagggagtttttcctcatccagcgcactggatcgagacctcgactttaactttgaaccaggctcgggcagtcactttgaattcccggactactgcacacccgaggttagcgaaatgatttctggtgactggttggagtccagtatctctaatttggttttcacttattag

SEQ ID NO: 17522 - DNA, 3318 bp, Artificial Sequence
  Description of Artificial Sequence: Synthetic coding sequence
atgcttgaacctagttccgtgttacacgccaatgtcaaccaagcccctctctggtgtctggtgctcaggtggtgccgtgagtgtaaggataccgtgtgcggcgggaagcagaagtctcgggtgaaccacacatttcagcgccgcgagattgaagcaaaagaagcctgcgattggctcagggctgctggttttcctcaatacgctcagctctatgaagacagccagtttcccatcaacatcgtagccgtgaaaaacgatcatgactttctggagaaagacctggtggaaccactgtgtcggcggctaaatactctaaataagtgtgcttccatgaaactggacgttaacttccagcgcaagaagggcgacgattccgacgaagaggatctgtgtatttccaataaatggacattccagcgaacctctagacgctggagccgtgtggacgacttatatactctgctgcctcggggcgatcggaacggaagccccggcggcacagggatgcgcaataccacctctagtgagagcgtgttaacggacttgagcgaaccagaagtctgctcgatccacagcgagagctctggtggaagtgattctcgctcacagcctggtcagtgctgcacagataaccctgtgatgttggatgcacctctggtctccagctcactgccacaacctccaagagacgtgctaaaccacccatttcacccgaagaatgaaaaaccgacacgtgcccgcgctaaaagctttctcaagagaatggaaacactgagagggaaaggtgcccacgggagacataagggaagcggacggacagggggactcgtgatctccggccccatgctgcagcaggagccggaatctttcaaagcaatgcagtgcattcagatccctaacggagaccttcagaattctccgcccccagcctgtcgcaaaggcttaccctgcagcggtaagtctagcggcgaaagttcgccctcagagcatagcagtagtggtgtgtcgacgccctgtctgaaggagcgtaaatgccatgaagccaacaaacgaggtgggatgtacctcgaggacttggacgtgctggctggaaccgccctccctgacgccggagaccagagtcgcatgcatgaatttcacagccaggaaaacctggtggtacacatccccaaggatcacaagcctggcaccttccctaaagccttgtctatcgaaagcctaagcccaaccgattcaagcaatggtgtcaactggcgcaccggctctattagtctgggacgggaacaggtccctggagcacgagagccccggctcatggcgagctgtcaccgggcttctcgagtgagcatttatgacaacgtccccggcagtcacctctacgcctctactggtgaccttctggacctggaaaaggacgacctgttcccacacctggacgatattcttcagcacgtcaacgggctccaggaagtggtggacgattggtccaaggatgtactgcccgaattgcaaacccacgatacactggtcggagagccaggtctgtctacatttccctcacccaatcagataacacttgatttcgagggaaactccgtctctgaagggcgaaccacacccagtgatgtggagcgcgacgtaacttctctgaacgagtcagaacccccgggcgtgcgtgaccggcgggatagcggcgtgggagccagcttaacgagaccaaaccggagactcaggtggaatagctttcagctgtcacaccagcctcgccccgcaccagcttccccccacattagctcccagacggcttctcagctatctctgctgcagcggttttccttgctccgattaaccgcaattatggagaagcactccatgtccaataagcatggttggacctggtcagtcccaaaattcatgaagcgtatgaaggtacccgactataaagacaaagctgtttttggagtcccactgattgtgcacgtccaacgcacaggacaacccctgccgcaaagcatacagcaggccctgagatatctgaggagtaattgtctagaccaggttggactgtttcggaaatctggagtaaagtctaggattcacgctcttcgacaaatgaatgagaactttcccgaaaatgtgaattacgaagatcagtctgcgtacgatgtcgccgacatggttaagcagtttttccgcgacctgccggagcctttgtttaccaataaactgagcgagactttcctacacatataccagtacgtctctaaggagcagcgtctccaggcagtgcaagcagccatactgctactagctgatgagaatagggaggtacttcagacactcctatgctttttaaatgatgtagtcaacctggtggaagagaatcagatgacaccaatgaatctggcggtttgtcttgctcctagcttgtttcacctgaacctgcttaagaaagagagtagtccacgggtgattcagaagaagtacgccaccggcaaacccgaccaaaaagacctgaatgaaaatcttgcagcagcccagggattggcgcatatgatcatggagtgtgacaggttattcgaggtaccccatgaactcgtggcccagagcaggaacagctacgtggaagccgaaatccacgttccaacgctggaggagcttggtacacagctcgaagaaagcggagcgacttttcatacatatttgaatcaccttattcaaggcctgcagaaggaagcgaaagagaagtttaaagggtgggtaacatgttcctcaaccgacaacactgatctagctttcaaaaaagtcggagacggtaaccccctaaaattgtggaaagctagtgtggaagtagaggcgcccccgagcgttgtacttaacagagtgctgcgggagcgtcatctatgggacgaggattttgtgcaatggaaggtcgtggaaactctggatcgacagactgaaatctaccagtacgtgcttaacagcatggccccgcacccaagtagggatttcgtggtgctgagaacctggaaaactgatctcccaaagggaatgtgcaccttggtgtccttgagcgtggagcatgaagaagcccaattattgggtggcgttcgcgctgtcgtgatggactctcagtaccttatcgaaccttgtgggtccggaaagagtcggctcactcacatatgtcgcattgacctgaagggccactctcccgagtggtatagcaagggatttggccatctgtgcgcagccgaagttgctcgtatcagaaactccttccagccgcttatcgctgaaggacccgagactaaaatatag

SEQ ID NO: 17523 - DNA, 3342 bp, Artificial Sequence
  Description of Artificial Sequence: Synthetic coding sequence
atgttcagtcaagtgccacgaactccggcttcgggttgctattacctgaattcaatgacacccgaggggcaggagatgtaccttcgtttcgatcagactactcgccgttctccataccgcatgtcccgtatcctggcccgtcatcagttggtcaccaagatacaacaggaaatcgaggcgaaagaggcctgtgactggttaagggctgctggcttccctcagtatgcacagctctatgaagactcccagttccccataaatatcgttgcagtgaaaaatgatcatgactttttggaaaaggacctggttgagcccttgtgtcggagactcaacactctgaataaatgcgcctccatgaaactagacgtcaactttcagagaaaaaagggcgacgacagcgatgaggaggatctttgcatcagcaacaaatggacctttcagaggaccagtcgaagatggagtcgtgtggacgatctctacacactcctcccgagaggcgatagaaacgggagcccaggtggcacagggatgcgcaacacaacttcttctgagagtgttctgaccgacctcagcgaaccagaagtctgtagtattcactccgagagttctggcgggtcagactctaggtcacagccagggcaatgttgtacagacaacccggtgatgctcgatgcacccctcgttagtagctctttgcctcagccaccgagggatgtgcttaaccacccattccatccgaagaacgagaagcctacaagagcgagagcgaagtcttttttgaaaagaatggaaaccttacgtggcaagggggcacacgggcgtcacaaagggagcggacgcacaggtggcctggtgatcagtgggcccatgctccagcaggagcctgaatcctttaaggccatgcagtgcatccagattcctaatggggacctgcagaactcccctcctcccgcctgccggaagggactgccctgttctggcaagtcttccggtgaatctagtccctctgaacacagttctagtggcgtatccactccatgtctgaaagaaagaaaatgtcacgaagcaaacaaacgcggcggcatgtatctggaagatctggacgtgctcgccggcacagctctgcccgatgcaggggatcagtcccggatgcatgagttccacagccaggaaaacctggtagtacacatcccaaaggatcataagcctgggactttccccaaggcactatccattgaatccctgagccctacagacagctccaacggtgttaattggcggactggcagcatctctctggggagggaacaagttcctggcgcacgggagccgcgcctaatggcatcatgtcaccgagcgtccagggtcagtatctatgacaacgtgcccgggtcccacttgtatgcctcaacgggcgacctcctcgacttagaaaaggatgatctgtttccacatctggacgacatcctgcagcacgtgaacgggttgcaggaggtagtagacgactggtccaaagacgtactaccggagctacagactcacgacacgttggtaggagaacctggattatccacatttccctctccaaatcagatcacgctagatttcgaggggaattccgtttcagagggtaggacaaccccctccgacgtagagcgggacgtaacctccctgaatgagagtgaaccacccggcgtgcgggacagacgggacagcggcgtgggagcctccttaacaagacccaacagacgcctgcgttggaacagcttccagctttctcaccagccaaggccggcacctgcttccccccacatttcttctcagactgctagtcaactgagtctactgcagcggttctccctcctgcgcctgacagccattatggagaaacactcaatgtcaaataagcacggttggacctggagcgttcccaagtttatgaagcggatgaaagtgcccgactataaggataaggcagtgtttggcgttcctctcattgtgcatgtccaaaggaccggccagcccctcccccaatccattcagcaagccttgcggtatttgcgcagcaattgcctggatcaagttgggctcttccggaaatctggcgtgaagtcccgcatccacgcgctccggcagatgaacgaaaattttccagagaacgtcaactatgaggatcagtctgcatatgatgtggctgatatggtcaagcagtttttcagagatctgcccgaacctttgtttaccaataagctgtcagaaaccttcctgcacatttatcaatacgtgtctaaggaacagagactgcaggcagttcaggctgccatacttctcctggctgacgaaaatcgggaagtgctacagacattgctctgctttctgaacgacgttgtcaacctcgtggaggagaatcagatgaccccaatgaatctcgccgtgtgcttggcccctagtcttttccacctgaacctcttgaaaaaggagagtagcccgcgtgtaatccagaaaaagtacgccacgggcaagccagaccaaaaggatctcaacgagaacctggcagctgcacaagggctagcccatatgatcatggagtgcgacagattgttcgaggtgccccatgagcttgtggcgcaatcaagaaacagctacgtagaggccgaaatccatgtcccaaccttggaagagctgggaacccagctggaagaatcaggcgcgacctttcacacataccttaaccatttaattcaaggattgcagaaagaggcgaaggagaagttcaaaggctgggtaacatgttccagtaccgataacaccgatcttgcattcaagaaagtcggtgatgggaaccccctgaaactgtggaaagccagcgtggaggtagaggcacctcctagtgtggtgctcaatcgggtgttaagagaaaggcatttatgggacgaggactttgtccagtggaaagtggtcgagaccctggatcggcagaccgagatctaccaatatgtgctgaacagtatggctccccacccctccagggattttgtggtcctgcgcacttggaagacagacctaccaaaaggtatgtgtaccctggtgtccctttcagttgagcatgaggaagcccaactgctgggtggggtgagagccgtcgtgatggattcacagtatttaattgagccctgtgggtcaggcaagagtcgactgactcacatctgtagaatcgatctgaaaggccattcccctgagtggtacagcaaagggtttgggcacctctgcgccgctgaggtagcccgcattcgcaatagcttccaacccctgattgctgaaggtccagagacaaaaatctag

SEQ ID NO: 17524 - DNA, 2064 bp, Artificial Sequence
  Description of Artificial Sequence: Synthetic coding sequence
atgctggagccttcaagcgttcttcatgccaatgttaaccaggcccctctctggtgtctcgtgctccgatggtgccgcgaatgcaaggacactgtgtgcggaggcaaacagaagtcccgtgtcaatcatacctttcaacggagagagatcgaggccaaggaggcctgtgactggttgagagccgccggcttcccccaatacgctcagctctatgaggactcccagttcccgattaatattgtggctgtgaagaacgaccacgattttctagagaaggacctggtggagccgctctgccgacgtctgaatactctaaacaagtgtgcctccatgaagttagatgtgaactttcaacgcaagaagggagacgactccgacgaagaggacctatgtatcagtaacaagtggacatttcaaaggacgtcaagacggtggtctagggtggacgacctgtatactttattgccaagaggggatcggaatggctcgccggggggcacaggcatgcgaaacacaaccagcagcgagagtgtactgactgatctgtctgaacctgaagtgtgttccattcatagcgagtccagtgggggttcggattctcggagccagccaggccagtgctgcactgataatcctgtaatgttagatgcaccgctggtgtcctccagcttgcctcaaccgcctagggacgtcctgaatcatccattccaccctaagaacgagaaacctacgagggctcgggctaaaagcttcctcaaacgcatggagacactgagagggaaaggggcccacggcaggcacaaaggcagcgggagaactggagggttggtcatttcgggaccaatgttgcagcaggagccagagtcattcaaggctatgcagtgtatacaaatcccgaacggcgacctccaaaacagtccaccgcccgcatgccgaaaagggttaccctgcagcggcaagtcctcgggagagtctagtccgtccgaacactccagctccggcgtttccactccttgcctgaaggagcgaaagtgtcacgaagccaacaaaagaggcggcatgtacctcgaggacctggacgtgctggcaggcacagctttgccagacgcaggagaccaaagtcgaatgcatgagttccattcgcaggaaaacttggtggtccacatccctaaggatcacaaacctggcacattccccaaggccttgtctatcgaaagcctctcccctacggactcgtcaaacggggtgaactggaggacagggagtatctctcttggccgagagcaggtacccggggcgagagagccgcggctcatggccagctgccatcgcgccagcagggtttctatctacgacaacgtgcccggaagtcatctatatgcctcaaccggtgatctactggatttggagaaagacgatttattccctcacctggacgatatcttgcagcacgtgaacggtctgcaggaggtggtggatgactggtctaaggatgttctgcccgagctgcaaactcatgatacgctggtgggcgagcccggattgtctacatttccctcgccaaaccagatcacgctcgattttgagggaaacagtgttagcgaaggtcggacaacacccagtgacgtggaaagggatgtaacttcccttaacgaatccgagcccccgggcgtgcgggataggagagactcgggcgttggggcaagcctcacaagaccgaaccggagactgcggtggaactcgttccagctgagccaccaaccgcgtcctgctcctgcctcacctcacatctcatcccagaccgcctcccagctctccctgctccagcgtttctccctgctgagactgacagcgattatggaaaagcacagtatgagcaataagcatgggtggacctggtctgtcccgaaattcatgaaacgaatgaaggtcccagactacaaggataaagctgtttttggtgtgcccttgatagttcacgtccaacgcaccggtcagccactgccccagtccatccaacaggcactgagatatctccgcagcaattgcctggatcaggaatag

SEQ ID NO: 17525 - DNA, 2988 bp, Artificial Sequence
  Description of Artificial Sequence: Synthetic coding sequence
atgaaactggacgtaaactttcagagaaaaaagggcgacgactctgacgaagaggatctttgcatctccaacaagtggacgtttcagagaacatcccgcaggtggtcacgtgtggatgatctctatacgctgctgccccgtggcgaccggaacggaagccctggaggcactggtatgcgcaatacaacaagcagcgaatcagtgctgactgacctctcggagcccgaggtctgttccatacacagtgagtcgtccgggggatctgattcaagaagtcagccagggcagtgctgtactgacaatccagtcatgctcgatgcgcctctcgtcagcagttccctaccccagccccccagagacgtgctgaatcacccctttcatcccaaaaacgagaagccgacccgtgcgcgggctaagtcttttctcaaacgtatggagaccctacgcgggaaaggagctcacgggcgacataaagggagcgggcggaccggcgggctggtgatttccggtccgatgcttcagcaggaaccagagagttttaaggctatgcagtgtattcagatccctaacggggacctacagaactcgcccccacccgcatgccgcaaaggactgccttgcagtggcaagagctctggggagagttctcctagtgagcatagttctagcggtgtctccacgccctgtctgaaggagaggaagtgtcatgaggccaacaaaagggggggaatgtatctggaggatctggatgtgcttgctggcactgccctgccagacgccggtgatcaatcccggatgcatgaatttcattcacaggagaatctcgtggtgcatattcccaaggatcacaaacctggcaccttcccaaaggcattgtccatcgaaagcctgtctccaaccgatagctcaaatggcgtgaactggcgtaccggatccatatctctgggaagagagcaggtacctggcgcgcgcgagccccggttgatggcttcatgtcaccgggcttcacgtgtgagtatatatgacaacgtcccaggctctcacctctatgcgtccactggtgatctactcgacctggagaaggatgatttgtttcctcacctggacgacatacttcagcacgtgaacggcctccaggaagtggtcgatgactggtctaaggatgtgcttccagagctgcagacccacgatacactggttggggagccgggcctgtccacatttccatcacctaatcaaataacattagacttcgagggtaacagcgtgtctgagggacggaccaccccttcagatgtcgaaagagacgtgacctcactcaacgaatcagaacctcctggggtgagggatcgccgtgactccggcgtcggcgcctctctgactaggcctaaccggcggcttcggtggaactcctttcagctttctcaccagccccgaccagcacccgcctcgccccacatctcctctcagacagcttctcagctgtcactgctgcaacgctttagtctcctccggctgactgccattatggagaaacatagtatgtcaaataaacacgggtggacctggtcagtacctaagtttatgaaaagaatgaaggttccagattataaggacaaggcggttttcggagtgcccttgatagtgcacgtgcagcgcacaggtcagccattaccacagagcatacagcaggcattgcggtatttgaggtctaactgcttggaccaggtgggccttttccgcaaatctggagtcaaaagcaggatccacgctctaagacagatgaatgagaatttccctgagaacgtgaactatgaagatcagtccgcctatgatgtggcagacatggttaaacagttctttagagacctgcctgagcctcttttcacaaataaactgtctgagaccttcttgcatatctaccagtacgtctcaaaggagcagagactgcaggccgtacaggctgccattctcctgctggctgatgaaaatagggaagtgctgcagaccctgttatgctttctaaacgatgtggtcaatttggtggaggaaaaccagatgacgccgatgaatcttgccgtgtgcctggcaccctctttgtttcacctgaatcttctgaagaaagagtcctctccccgggttatccagaagaagtacgccacaggaaagcccgatcagaaggacctgaatgaaaatctggctgctgctcaagggctcgcccacatgattatggagtgtgaccgcttgttcgaggtacctcatgagctcgtggcacaaagcaggaactcttacgtggaggcagagatacacgtgccaaccctagaagagcttggcactcagctggaggaatcaggcgccacctttcatacatacctcaatcatctgattcaaggcctgcagaaggaggcgaaggagaagttcaaaggctgggttacatgcagctcaaccgacaatactgacctggcatttaagaaggtgggggacggtaaccccctgaaactgtggaaagccagcgttgaggtggaggcccctccgagtgtcgtccttaatagagtcctgagggaacgccatctctgggacgaagacttcgtgcagtggaaggtggtggaaaccttggaccgccagacagaaatctaccagtatgtactgaactccatggccccacatcctagccgggactttgtagtgcttagaacgtggaaaacagaccttccaaaggggatgtgcacacttgtgagccttagcgtcgagcatgaggaagctcaactgttgggtggcgtgcgggccgtggttatggacagccaatacttgatcgaaccatgtggttcaggcaagagtcgtctgacccatatctgtcgcattgaccttaagggacacagcccggagtggtatagtaaaggcttcggacatctgtgcgccgctgaggtggcaagaattcgtaacagttttcaacccctcatcgctgaaggaccagagacaaagatctag

SEQ ID NO: 17526 - DNA, 450 bp, Artificial Sequence
  Description of Artificial Sequence: Synthetic coding sequence
atggcgtccagcgacatccaagtgaaggagctggaaaagcgcgccagcggccaggccttcgagttgatcctcagtcctaggtcgaaagaatcggtacctgagttccccctgagcccgccgaagaaaaaagacctgtctctggaagaaattcagaagaagctcgaagccgccgaggaacgccgcaagagtcatgaagccgaagtgctgaagcagctggcggaaaaaagggagcacgagaaggaggtgctccaaaaggcgatcgaagagaacaataacttcagcaagatggccgaggagaagctgacccacaaaatggaggcgaacaaagagaaccgggaagctcaaatggcggcaaagttagaacgcctcagagaaaaagacaagcacatcgaggaggttcgcaaaaacaaggagtccaaggatcctgctgatgagacagaggccgactag

SEQ ID NO: 17527 - DNA, 450 bp, Artificial Sequence
  Description of Artificial Sequence: Synthetic coding sequence
atggcttcttcggacatccaggtgaaagagctggagaaacgggcgtccggccaggccttcgaactgattctgtctccgagatcgaaagagtcggtgcccgaatttccactttcaccgccaaagaagaaggacttgtctttagaagagatccagaaaaagctggaagcggcggaagagcgacggaaatctcacgaggctgaagtcttaaaacagctggccgaaaaaagggagcacgagaaggaagtgctccagaaagccattgaagagaacaataacttttctaagatggctgaagagaaattaacacataaaatggaagcgaataaggagaatagagaggcacagatggccgccaaattggaacgcctaagggaaaaggacaaacatattgaagaggttaggaagaataaggaatccaaggaccccgccgacgagaccgaggcagactag

SEQ ID NO: 17528 - DNA, 450 bp, Artificial Sequence
  Description of Artificial Sequence: Synthetic coding sequence
atggcaagcagtgacatccaggtgaaggagttggagaaaagggccagcggccaggcattcgaactgattctgtctccgcgtagcaaggaatctgtgcctgaatttcctctgagcccccctaagaagaaggacttgagcctagaagagatccaaaaaaagctggaggccgcggaggagcgtcgcaaatcacacgaggcagaggtgttgaaacagcttgccgaaaagcgagagcacgagaaggaggttctccagaaagccatcgaggagaataacaatttctctaaaatggccgaagaaaagcttacacacaagatggaggccaataaagagaaccgtgaggcgcagatggcagcaaagcttgaacggctgcgagagaaggataagcacatcgaagaagtgcgcaagaataaagaaagtaaggatcctgcagatgaaaccgaggctgattag

SEQ ID NO: 17529 - DNA, 525 bp, Artificial Sequence
  Description of Artificial Sequence: Synthetic coding sequence
atggcctctagcgatattcaggtgaaggaactggagaagcgggcatctggtcaggcgttcgagctgatcctgtccccccgcagcaaagaaagtgtgcccgagttcccactgagccctcccaagaagaaggacctgtctctggaggagatacagaagaaactggaggccgcggaagagcggcgcaagtctcacgaagctgaagtgttgaagcagctggccgaaaagagagagcacgagaaagaagtcttgcagaaggctatcgaggaaaacaacaatttctcgaaaatggccgaagaaaaattgacccacaagatggaagcaaacaaagaaaaccgcgaagcccagatggctgccaaactcgagcgcctgcgagagaagatgtacttttggacacatgggcccggggcacacccagctcagatttccgccgagcagtcttgtctccacagcgtccctgctctgtgtcccgcccttggccttcagtccgctctgatcacatggtccgacctatcccaccatcattag

SEQ ID NO: 17530 - DNA, 261 bp, Artificial Sequence
  Description of Artificial Sequence: Synthetic coding sequence
atggcatcatcagatattcaggtaaaagagttagaaaagagagccagtggacaggcttttgagctgatcctcagcccccggtccaaagaatccgtccctgagttccctctgtctccgccaaagaagaaggatttgtcactcgaagagatccaaaaaaagctggaggcagctgaggaacggaggaagagccatgaggcagaagtccttaaacaattggccgaaaaacgagagcacgagaaagaggttctccagaaggcttag

SEQ ID NO: 17531 - DNA, 450 bp, Artificial Sequence
  Description of Artificial Sequence: Synthetic coding sequence
atggcgtcctcagatatacaggttaaggagttggagaagagagcttccggtcaggctttcgaacttatactgtctcccagatctaaagaatccgtgccagagttcccgttgtctccccccaagaaaaaggacctgagcctggaagaaattcagaaaaagttggaggctgccgaggaacggcggaagtcccatgaggccgaggtgcttaaacagctcgcggagaaaagggagcacgagaaggaagttctccagaaagccatagaagaaaataacaatttctccaaaatggccgaggagaagcttacacataagatggaagctaacaaggagaacagagaggcacagatggccgccaaacttgagagacttcgggaaaaggacaagcacatcgaagaagtcaggaaaaataaggagagcaaggatccagccgatgagacagaagcagactag

SEQ ID NO: 17532 - DNA, 3615 bp, Artificial Sequence
  Description of Artificial Sequence: Synthetic coding sequence
atgtcatttttcaacttccggaagatatttaaattggggtcagaaaaaaagaaaaagcaatacgaacatgtgaaacgggacctgaaccctgaagatttttgggagatcattggagaactaggggacggggcttttggcaaggtgtacaaggcacagaacaaggagacctccgtcctggccgccgctaaagtgattgacaccaagtccgaggaagagctcgaggattatatggtggaaattgatatcctggcgagctgtgatcacccaaatatcgtcaaactcctggacgccttctactacgaaaataacctgtggattttgatcgagttctgtgccggcggggccgttgacgccgtgatgctggaactggaacgccctctcacagagagccaaatccaggtcgtatgcaaacaaacccttgacgcacttaattatctgcacgacaacaaaattattcacagagacctcaaggccgggaacatcttgtttactctagacggcgatatcaaattggctgactttggcgtctctgccaaaaacactaggaccattcagagaagggacagttttatcgggaccccctattggatggcccctgaagttgtgatgtgcgagacttcgaaagatcggccgtacgactacaaggctgacgtgtggtcccttggcattactttgatcgagatggcagaaatcgagcccccacatcacgagctgaatcccatgagggtactcttaaaaatagcaaagtccgagccccctacacttgctcagccctcgcgatggagttctaatttcaaagacttcctgaagaagtgcctggaaaagaatgtggatgcgcgctggacaacttcccagctgctccaacaccctttcgttaccgttgatagcaacaagcctattcgagagctcattgccgaggctaaggcagaagttaccgaggaggttgaagacggcaaggaggaggatgaggaagaggagacagagaattctctccccatccccgcaagcaaaagagcctcgtctgatctgtccatcgcaagctcagaggaggacaaattatctcaaaacgcctgtattctcgaatccgtatcggaaaaaacagaaaggtcaaattccgaggacaaacttaactccaaaattcttaatgaaaagcccaccactgacgagcccgagaaagccgtcgaagacattaatgaacacattacagatgcccagcttgaggctatgaccgaactgcatgataggacagcagttattaaagagaacgaacgggaaaaacggcccaaattggagaacctaccagacacagaggatcaagaaaccgtggatatcaactctgtgtccgaaggcaaagaaaataatatcatgattaccctggagaccaacattgaacataatctgaagtcggaggaagagaaggatcaggagaagcagcagatgttcgagaacaagcttatcaaatctgaggagataaaggatactattcttcagactgtagacctggtaagtcaggaaactggagagaaggaagcaaacatccaagccgtagactctgaggtcggccttactaaagaggacacacaggagaagctgggggaagatgacaagactcagaaggacgtgatctctaacacatccgacgtgataggaacatgcgaggcagccgatgtagctcagaaggtagacgaagacagcgcagaagacacgcagagcaatgatggcaaagaggtggtcgaagttggacagaagttaattaacaagcccatggtgggtcctgaggccggcggcacaaaggaggtccctatcaaggagattgttgagatgaacgaaattgaggaaggcaagaacaaggagcaagccataaacagttcagagaacatcatggacattaacgaggaacccggcactaccgagggcgaggagatcactgagagttcgtctactgaggaaatggaggtgaggagcgtcgtggctgacaccgatcagaaagctctcgggtctgaagtacaggatgcaagcaaagtgacgacacagattgacaaagagaagaaagaaattccggtgtctatcaaaaaagaacctgaagtgacagtcgtgtctcagcccaccgaacctcagcccgtgctcatcccttcgatcaatataaattccgattcaggcgaaaacaaagaggaaattggtagtttatcaaagacggaaacgatcctccctcctgagtcagagaatccgaaggagaatgacaatgactccggaaccgggagcaccgcagacacctcctcaatcgatcttaacctgagcatcagttcgtttctctccaaaactaaagactcaggatccatctccctgcaggagacccggcgacagaaaaagacactgaaaaaaactcgaaaattcattgtggatggcgtggaagtgagcgtcacaacatctaaaattgtgactgactccgactcaaagacggaggaacttagatttctcaggagacaagaactgagggagcttagatttcttcagaaagaagagcagcgcgcccagcagcagctgaattccaagcttcagcagcagagggagcagatctttagacgcttcgaacaagaaatgatgtcgaaaaagaggcagtatgatcaggagatcgaaaacttggagaagcagcaaaagcaaacgatagaaagactggagcaggagcacacgaataggttaagggacgaagctaagcgcataaaaggcgagcaggaaaaggagttatccaaattccagaatatgctgaagaacagaaaaaaggaggagcaggagttcgtgcagaagcagcagcaggagctggacggaagtctaaagaaaattattcagcagcagaaagcagaactagcaaatattgaaagagagtgtcttaacaataagcagcagcttatgcgcgctagagaagctgcaatctgggagctggaggagcgacacctccaagagaaacaccagctcttaaagcagcaactaaaggaccagtatttcatgcaacgccatcagctgttgaaaaggcacgagaaggagacggagcaaatgcagaggtataatcagcgtctgattgaggaattgaagaaccgtcagacgcaggaacgggcacgtcttccaaagatccagcggagcgaggcgaaaacacggatggctatgtttaaaaaaagcctaaggattaacagcaccgccacccctgaccaggatagagacaagataaagcagtttgcagcacaagaggaaaaacgccaaaaaaacgagagaatggcccagcaccagaaacacgagaatcagatgagggacctccaactgcaatgcgaagcaaatgtgcgcgagctccatcaattgcagaacgagaagtgccacctcctcgtggagcacgagactcagaaactgaaggagcttgatgaagagcacagtcaagagttgaaagagtggcgcgaaaaactgcggcccaggaagaaaaccctggaggaggaattcgcccgaaaacttcaggagcaggaggttttctttaaaatgactggagagtctgagtgccttaatccgtccactcagagcagaatttccaaattttacccaatccccagcctgcattccacgggctcctag

SEQ ID NO: 17533 - DNA, 3708 bp, Artificial Sequence
  Description of Artificial Sequence: Synthetic coding sequence
atgtctttctttaatttcagaaaaatcttcaagctgggctccgagaagaagaagaagcaatatgaacatgtcaagagagatcttaaccctgaggacttttgggagataatcggcgaactgggcgatggggcctttggcaaagtttataaggcgcagaataaggagacatccgtgcttgctgccgccaaggtaatagacactaagtccgaggaggagttggaggactatatggttgagatcgatatccttgcctcttgtgatcatccaaatatagtgaagctgctggacgcattctattatgaaaataatctttggatcctgattgagttttgcgctggcggagctgtcgacgcggtcatgctcgaacttgagcgcccgctgacagaatcacaaattcaggtggtctgcaaacagacgctcgacgcgctgaattacctgcatgacaataaaattattcaccgcgacctgaaagccgggaacatactgtttaccctcgacggcgacatcaagctcgccgacttcggcgtgtctgctaagaatactagaaccattcagcgtagggattctttcattgggaccccctactggatggcccccgaggtcgtcatgtgtgagacttccaaggatcggccttatgattacaaagcggatgtttggtcgctggggattaccctgattgagatggccgagatcgagcctccccaccacgagttgaatcccatgcgcgtcctgctcaaaatcgcaaagagtgagcctccaacactcgcccaacccagccggtggtcgagtaacttcaaggactttcttaagaagtgtttggagaaaaatgtggatgcccgctggacaacaagtcaattgttacagcatccctttgttactgtggattctaacaagcctataagagaactcattgcagaggccaaagctgaggtgaccgaggaagtggaggacggtaaggaggaagacgaggaggaagaaacagaaaactctctgcccattcctgcctctaagagagcatccagtgatttatctatcgccagttctgaggaagacaaactgtcccaaaacgcctgcatcttggagagtgtctccgagaagactgagcgctctaactccgaggacaagttgaattctaaaatcctcaatgaaaaaccaactactgatgagcccgagaaggcagtcgaagacatcaatgagcatataacggatgcccagttggaggccatgactgaactgcatgatcggaccgccgtaataaaagagaatgaaagagagaagcgcccaaaattggagaacctccccgacactgaagaccaggaaacagtggacatcaatagcgtgtctgagggaaaggagaataacattatgataaccctggaaactaatatcgaacacaatctgaagagtgaagaagaaaaagaccaggagaaacagcagatgtttgagaacaagctgataaaatccgaagagatcaaggataccatcctgcagaccgtggatctggtctctcaggagaccggagaaaaggaggcaaacattcaggccgtggactccgaggtagggttgacgaaggaagacactcaggagaagctgggcgaagacgataagacccaaaaagatgtgatttccaatacaagtgacgtgatagggacatgtgaggcggcggacgtcgcccaaaaagtggacgaggattctgccgaggacacccagtccaatgacggcaaggaggtggtggaagtcgggcagaagctgataaataaacccatggtcgggccagaggctggaggcacaaaggaagtgccgatcaaagagatcgtagagatgaacgagatagaggaaggcaaaaacaaagagcaggccattaacagcagcgagaacatcatggacatcaacgaggaaccggggacaacagaaggtgaagagatcactgagagctcgtctacagaggagatggaagtccgaagcgtcgtagcggacacagatcagaaggcactcgggtcagaggtgcaggatgcatccaaggtgactactcagatagataaagaaaagaaggagattccagtgagcataaagaaggaaccggaagttacagtggtgtcacagcccaccgagccccagccggtgctaattccatcgatcaatattaactctgacagcggggaaaataaagaggagatcgggtccttgagcaagaccgagactattctaccacccgagtccgagaatcccaaagaaaatgataacgactctggtactggctcaaccgctgacacctcatctatcgatctaaacttaagtatctcatccttcctaagcaaaacaaaagattcaggtagcattagtctccaggagacgcgtaggcagaagaagaccctaaaaaagacccgaaagttcattgtcgacggcgtcgaagtttcggtaacaaccagtaaaatcgtaaccgactctgattccaaaacagaagagctaaggtttcttagacggcaagaacttagggagctgcggttccttcagaaggaggagcaacgcgcccagcagcagcttaattctaagttacagcagcagcgggaacagatcttccggcgttttgaacaggagatgatgtcaaagaagagacagtacgaccaggagatcgaaaatctggaaaagcagcagaagcaaaccatcgagcggctggagcaggagcacaccaatagattgcgcgacgaggccaaaaggatcaagggagagcaggagaaagaactgagtaaatttcaaaatatgctcaaaaaccgcaaaaaggaggtaattaatgaggtggagaaggcgcccaaggagcttaggaaagagttaatgaaacggcgaaaagaagaactggcccagagccagcacgctcaagagcaggagtttgttcagaagcagcagcaggaacttgatggaagcctgaagaaaatcatacaacaacagaaggccgagttagctaatatagagagagaatgtcttaataacaaacagcaactcatgagggcacgggaagctgctatctgggagctcgaagagaggcatttgcaggaaaaacatcagcttctgaagcagcaactgaaggaccagtacttcatgcaaaggcaccaattgctgaagcgccatgaaaaagagacagaacagatgcagaggtacaatcaacgactcatcgaagagttgaagaatcgccagacgcaagaacgggctcggttgcccaaaatccagcgatctgaggctaaaactcgcatggccatgttcaagaaaagcctcaggataaactccaccgcaaccccggaccaggacagagacaagatcaagcagttcgcggcccaggaagaaaagcggcagaaaaatgaacggatggcacagcaccagaagcacgagaaccaaatgcgggatctgcaattacagtgcgaggctaacgtgcgggagcttcaccaattacaaaatgaaaaatgccatctgctcgtcgagcatgagacccagaagcttaaggaattggatgaggagcactcgcaggaacttaaggaatggagagagaaactccgtccccggaagaagacgctcgaggaagagttcgccaggaaactgcaggagcaagaggttttctttaaaatgacaggagagtccgagtgcctgaacccctccacgcaatcccgaatctcgaagttttatccaatcccctcactccactccaccggatcctag

SEQ ID NO: 17534 - DNA, 3444 bp, Artificial Sequence
  Description of Artificial Sequence: Synthetic coding sequence
atggacgaacccccgttttccgaggctgctctagaacaggcactgggcgaaccatgcgacctggatgccgcgctcctcacagacattgaggacatgctgcaactgatcaataatcaggactcagacttcccgggcctgtttgatccgccatatgcggggagcggagcaggcggaaccgatccggcctctcctgatacttcgtcccccggatccctgtccccccccccagcaaccctgagctcctccctggaagccttcctttcaggacctcaggccgccccaagccccctgagcccccctcagccggcacctaccccactgaagatgtacccctccatgcctgccttctcccccgggccgggaatcaaagaagaatcagtaccattgtctatattacagacacccactcctcagcctttgccaggcgctttactccctcagtccttccctgccccagccccaccgcagttttctagcactcccgtgcttgggtacccctctccacccgggggcttttctaccgggtcccctcccggaaatacacagcagccgctcccaggcctccctctcgccagtccccctggagtcccccctgtgagcctgcacacgcaggtgcagagcgtcgtcccccagcagcttctcaccgtgacagccgctcctaccgccgccccggtgacaacgaccgtgaccagtcagattcagcaggtaccagttctgttgcagccccactttataaaggccgactcccttcttctcaccgccatgaagaccgatggcgccacagttaaagcagcaggcctcagtccactggtatcagggactactgtacaaacagggcccttgccaactctcgtaagcggcgggaccattttggcgacagttcctctcgtggttgacgccgagaaactgcccatcaatcggttagcagccggttcaaaggcccctgcatcagcacagagtcgcggagaaaagaggaccgcacacaatgctattgagaaaagatataggagctcaatcaacgataaaattattgaactgaaggatttagtggtgggcaccgaggcaaagctgaataagtccgccgtgttgaggaaggccattgattacatcagatttttacagcattcaaaccagaaactgaagcaggaaaacctttctttgaggacagccgtgcataagagcaagagcctgaaagacctagtcagtgcctgcggtagcggcggaaacacagacgtcctgatggaaggagttaagacggaggtagaagacacgctgacacctccaccctcagatgcggggtcgcctttccagtcctccccactatccctggggtcaagaggctccggcagtggaggctctgggagcgatagcgaaccagattcccccgtgttcgaggattccaaagctaagcctgagcagcggccttcactccactcccggggaatgctggaccgcagcaggctagctctctgtacacttgtttttctgtgtttatcttgcaatccattggcgtcccttctcggagcacgtggtcttccctcgcctagcgacactacatccgtttatcactcccccggacgaaatgtgcttggtacagaatcccgcgatggtcccgggtgggcccagtggctcttgcctcccgtcgtttggctgcttaacgggcttctggttctcgtgagcctcgtgctgttgttcgtatatggtgaaccagtcacacggccgcacagcggccctgccgtttacttctggcgccatcgcaagcaggccgatttggacctggcaaggggggatttcgcacaggccgcacagcagctctggctcgctttaagagctttgggacgccctctgccgaccagtcatctggacctggcttgtagtctgttatggaacctgataaggcacttgctccagaggctgtgggttggacgctggctggccgggagagctggtggcctgcagcaggactgcgccctgagagtggatgccagcgcctctgcccgcgacgctgctttggtgtaccacaagttgcaccagctccacactatggggaagcacactggcgggcacctgactgctacgaatctagcactctccgccctgaatctcgctgaatgtgcgggagatgctgtttccgtcgccactctggcggagatctatgtcgccgccgccctccgagtgaaaacttccctgcccagggcacttcactttctcacacgcttttttctctccagtgcgagacaggcttgtctagctcagtcaggaagtgtcccaccagcaatgcagtggctgtgtcatcccgtgggtcaccgattctttgtggatggggattggtctgtcctaagcacaccgtgggaatccctgtattccttggctggaaaccctgtggaccctttggcccaggtgacccagctcttcagggaacacctgcttgagagagcattgaactgcgtgacacagcctaatccctccccaggatctgccgatggagacaaagaattcagcgatgcactgggttatcttcagctgctgaattcttgcagcgacgcggctggggcaccagcatacagtttcagcatttccagctcaatggcaaccactaccggggtggatcctgtcgccaagtggtgggcttctttgacagcggttgtgattcattggctgcggagagatgaagaggcagcagaaagactctgtccccttgtggagcacctacccagagtcctgcaagagtcagagcggcccctccctcgggccgcgctgcacagcttcaaagccgcccgcgccttactgggatgtgccaaggcagagtcggggcctgcctcactgaccatatgcgagaaagctagtggatatctccaggattcactggccactactcccgcgtcatccagtatcgacaaagccgttcagctgtttctttgcgatctgctcctggttgtccgcactagcctgtggaggcagcagcagccccctgcgcctgcccccgcagctcagggcacctctagtcgaccacaggcctctgccctcgaactcagaggattccagcgggacttgagcagcctccggcgattagcacagtcatttaggcctgccatgcggcgggtcttcctccacgaagccaccgccaggcttatggctggcgcttctcccacaaggacacaccagttgttagaccgaagtcttcgtcggagagcaggtccaggcggtaaaggaggggccgttgcagagctagaaccacggcccacacgtcgcgagcacgctgaggctctactgttggcttcatgctatctgccccctgggttcctaagcgcccctggacagagagttgggatgctcgcagaggccgcgagaaccctggaaaagcttggtgatcggagactgcttcacgattgtcagcaaatgctcatgagactgggcggagggaccacagtaacttcatcctag

SEQ ID NO: 17535 - DNA, 3216 bp, Artificial Sequence
  Description of Artificial Sequence: Synthetic coding sequence
atggacgagccccccttttcagaagccgccttggaacaggccctgggagaaccgtgtgacctggacgccgccctgctgactgacattgaggacatgctccagctgataaacaatcaagattccgactttccgggtctctttgaccctccatatgcggggagcggagcaggcggcaccgatcctgcttcgccggatacgagctctcctggatccttgagtccacctcccgccacactgtcatcctccctcgaggcctttctaagtggaccccaggctgcccccagtcctctctcccccccccagcccgccccaacgccattaaaaatgtacccctctatgccagcttttagcccaggacccgggattaaagaggagtccgtaccactcagcatcctccagacacctacaccacagccattgcctggcgcactcctcccgcagtcgtttccggcccctgcccccccacaattttcttcaacaccagtcctgggctatccctcgccaccaggaggattctctacaggatccccacctggtaacacacagcagcccctaccagggctgcctcttgcttcgccgccgggggtgccacccgtatccttacacacccaggtccagagcgttgtccctcagcagctgctgactgtcacagccgctcctacagccgctcccgtgactacaacagtgactagtcagatccagcaggttcctgtactgctgcagcctcacttcattaaggctgactcgctgctgttgacagcgatgaagacagatggagcaaccgtgaaagctgctggcctgagcccacttgtttcagggacaactgtgcaaaccgggcccctccccacactggtcagtgggggcacaatactggccaccgtgcccttagtggtggacgccgagaaattgcccattaacagactggctgccgggagtaaggcccctgcatcagcgcaaagccggggcgagaagcggactgctcataacgccattgaaaaaagatatagaagctctatcaatgataaaattatcgagctgaaagacctggtggtcggaaccgaggccaagctgaataaaagcgccgtgctgaggaaggctattgattacattcgcttcttacagcattctaatcaaaaactaaaacaggagaacctttccttacgtacagccgtccacaagtcaaagtccctgaaagacctggtgtccgcctgcggcagtggaggaaatacagacgtacttatggagggagtgaaaacagaggtggaagataccctaactccgcccccctcggatgccggttcaccctttcagtcgagccccctaagccttggaagccggggtagtggttccggaggaagcggatccgatagtgaaccggattctcctgtgtttgaggattcgaaggcaaaacctgagcagcggccgtcgctgcattcacgaggcatgctcgacagatctagactggcactgtgtaccctggtcttcctatgcctaagctgtaacccattggctagcctgcttggtgctcgagggctgccaagtccctcagacaccaccagcgtgtatcattccccaggtcggaatgtactggggaccgagtccagagacggccctggctgggctcagtggctactgccacccgtcgtgtggctcctgaatggattgcttgtgctcgtttccctagtcctgctttttgtctatggtgaaccggtaacccgacctcactccggaccagccgtgtacttctggagacataggaagcaggccgacttagatctcgcccgcggtgattttgctcaagcggcccagcagttgtggctggctctacgggccctcgggcgaccccttcccactagccacctggatctggcgtgttccttactgtggaatctgattcgccacctccttcagaggttgtgggttggaagatggctcgctggcagagccggcggcctccaacaggattgtgctctgcgggtggatgctagcgcatctgccagggatgcagctctggtgtaccataagttacaccagctgcataccatgggcaaacacaccggtgggcacctcacagcaactaaccttgcgttgtccgctctcaatcttgctgaatgcgcgggagatgcggtctccgtagctactctggcagagatctacgttgcggctgcactcagggtgaagaccagtctgccccgggcactgcatttcctcacccggttcttcctctcctcagctaggcaggcatgtctggcccagtctggaagcgttccacccgctatgcagtggctctgtcatccagtaggccacaggttctttgtcgacggtgactggtcagtgctctcaacaccatgggagtcgctgtattctctcgcaggtaaccccgtggacccgctggcacaagtgacccagctattcagagagcatcttctcgagagagccttaaactgcgtgactcagcccaacccaagccccggctcagcagatggtgacaaggagttcagcgacgcacttggatatctgcagcttctcaacagttgttccgatgctgccggagcccctgcctactccttctctatttccagctccatggccaccaccaccggtgttgacccagtagctaaatggtgggcgagcctgacagccgttgtgattcattggcttcgcagagatgaagaggctgctgaaaggctgtgtcccctcgttgagcatttacctcgggttcttcaagagagtgagagaccactgccccgcgcagctctgcacagctttaaagcagctcgagccctcctgggctgtgcgaaggcagaaagcgggcccgcttcactgaccatatgcgaaaaggcaagtggttatctgcaggattcgctggctaccacacccgcttctagcagtattgacaaggccgttcaactgttcctatgtgacctcctcctggtcgtgcgtacgagtttatggagacaacagcagcctcccgccccagcgcccgcagctcagggaacaagtagcagaccacaggcgtctgctctagaactgaggggctttcaacgcgatctgagctccctgcgtcgcctcgcccagagcttcaggcccgccatgagacggctcatggacgttctgacaagtgagtcagcgtgggccctgccacaacacctcgggaaggggtttccatccccctctggccacaaggtgccgggctggcatggccgaatggattag

SEQ ID NO: 17536 - DNA, 3534 bp, Artificial Sequence
  Description of Artificial Sequence: Synthetic coding sequence
atggacgaaccccccttctctgaggcagctctcgaacaggcactgggtgaaccatgtgacctggatgcggcccttctcactgacatcgagggcgaagtgggagctggcagaggccgtgccaatggactggacgcaccgcgggccggcgccgataggggtgcaatggattgcactttcgaggacatgctgcaactgattaataaccaggattccgattttcccggcctctttgaccccccctacgcgggttctggtgctgggggcacagacccggcttcacccgacacctccagcccaggatctctgtctccaccccccgccacgctctcctcctctctagaagcctttctaagcggacctcaggcggcgccaagcccactctctcctcctcagcccgcccctacacctctgaaaatgtaccccagcatgcccgccttctcccctggcccaggcattaaggaggagtccgtgccacttagtattcttcagacgcccaccccccagccattgccaggagctctgctccctcagagctttcctgcgcccgcgccaccccagttttcgtcaaccccggtgcttggctacccttccccacctggtggttttagtacgggtagccctccagggaacacacagcagccactgcccggtttgcccctcgcctcacctccgggcgtcccccctgtcagcctgcacacccaggttcaatctgtggtgccgcagcagcttctcaccgttaccgctgcaccgacggctgctccggtgacaaccacagtcacgtcccagatccaacaagtgcctgtcttattgcaaccccatttcatcaaggctgattccctcctgctgactgcgatgaagactgatggtgccacagtgaaggctgctggactgtcacccctagtatccggtacaacggtgcagacaggcccactgccaacattggtgtccggaggcacaatcttggccaccgttcccctggtcgtcgacgccgagaagttacccataaatcgtttagcggctggatctaaggccccagcgtccgcccaaagtagaggtgagaaaaggacagcccacaatgcaatagaaaaacgctacaggagctcaattaacgacaagatcatcgaactcaaggacctcgtcgtggggaccgaggccaagctgaacaagtccgccgtactaagaaaggccatcgactacatccgcttcttacagcatagcaaccaaaaattaaaacaggaaaacctttcattacgtacggccgtgcacaagtctaagtctctgaaggatctcgtgagcgcctgcgggtcgggaggcaacaccgacgtgctgatggagggcgtgaagactgaggttgaggacacactcacacctcccccttcggatgcgggcagcccatttcagagctcccctctctccctaggaagtcgtgggtctgggagtggggggtctggctctgactctgagccagattcaccagtgtttgaggattccaaagccaaacccgagcagaggccctccctgcactctagaggtatgttagaccggtctcggttggcactctgcacactagtgtttctgtgtttaagctgtaatcccttagccagcctactcggcgcacgcggactgccaagtccatccgacactaccagcgtgtatcactctcccggccgcaacgtacttggaactgagtcaagagacggtccagggtgggctcagtggcttttgccaccagtggtgtggctccttaatggccttctagtgctagtatcactcgttctgcttttcgtctatggcgagcccgtcacacgccctcatagcggccctgctgtatatttttggcgccacagaaagcaggcggatctagacctggcccgcggtgactttgcacaggctgctcaacaattgtggcttgctctgcgggccttggggagacctctaccaacgagccacctcgatttggcatgctctctgctgtggaatttgattcgtcatttgctccagcggttatgggtcgggaggtggctggccggccgcgctggagggctgcaacaggattgcgcactaagggtcgacgcatccgccagcgcacgcgacgctgcattagtgtaccataaactgcaccagctgcacaccatggggaaacataccgggggtcatctgactgctactaacttagctctttcagccctgaacctggccgagtgcgccggagacgccgtctccgtggccaccctggcggagatctacgtcgccgccgctctgagggttaagacttcactccctcgtgctctgcactttctgactcggtttttcctgtcttcggcacggcaggcttgcctcgctcagtcgggttctgttcctccagcaatgcaatggttgtgccacccagtggggcatcgcttcttcgtcgatggagattggtcagtactgagcaccccatgggaaagtctgtattctctggcgggcaacccagttgatccactggcccaggtcacccagttattccgggagcatctcctggagcgcgcactgaactgtgtcactcagcctaacccaagccctggttccgccgatggcgataaagaattttctgatgccttgggctacctccagctgcttaatagttgctcagacgctgctggagccccagcgtactctttttcaatttcctcttccatggcaacaacaactggtgttgacccagtggccaagtggtgggcatcgctaacggccgtggtcatacattggcttaggagagacgaagaggccgccgaaaggttgtgccccctcgtggagcacttgcctcgggtgctgcaggaaagtgaaagaccgctgcccagagctgcacttcactcattcaaggccgcaagggccctcctgggatgcgccaaggcggagtcaggtcctgcctcattaactatctgcgaaaaagcctctggttatctgcaggactcactggccacgactcctgcctctagctcaatcgacaaagcagtgcagctgtttctatgcgacctgcttttagtggtaagaacctctctgtggcgccagcagcagccgccagcacccgcccccgccgcccaggggacctctagccgcccccaggcctcagccttagagttgcgcggtttccaaagggatctgtcttccctgcgaagactagcacagtcgttccgtcctgcaatgagacgggtatttctgcatgaagcaacggctcggctgatggccggggcctctccgactcgtactcatcagctgctggatcgatccttacgtcgaagagccggtcctggaggcaaagggggtgccgtggccgagctggagccaaggcccaccaggagggaacacgccgaggccctcctgctggccagctgctacctcccgcccggattcctttctgctcccggtcagcgtgtgggtatgcttgcagaggcagccagaactcttgaaaaactcggcgaccggcgtctcctccatgattgccaacagatgcttatgcggttaggtggagggaccaccgtcacatctagctag

SEQ ID NO: 17537 - DNA, 3468 bp, Artificial Sequence
  Description of Artificial Sequence: Synthetic coding sequence
tgaaagatacgaagggcactcacaggggaagtgggagcaggccgtggacgggccaatggtctagatgctccaagggcgggtgccgataggggcgctatggactgcacgtttgaggatatgctgcagctcatcaataaccaggacagcgactttcctggacttttcgatcccccctacgcaggctccggggccggggggacggatccggctagtcctgacacttcgtcccctggttcattaagccctccacccgcaacactaagttcatcactggaggcctttctgtctggaccccaggccgccccctccccactgtctcctccacagccagctccaacccccctgaaaatgtacccatctatgccggcgttttcaccaggtccggggatcaaagaggagagcgtgccactttcaatcctgcagactcctaccccccagcctttgcctggcgctctcctgccccagagcttccccgctcctgcgccaccccaattcagttcaactcccgttttaggatatcccagtccccccggaggcttctctacagggtccccccctggtaacactcagcagccactgccaggcctgccccttgcatccccacccggggttcctcccgtttcactccatacccaggtccagagcgtcgtgcctcagcagctgctgaccgtgacagccgcaccgacagccgcacccgtgaccactactgtgacaagtcaaattcagcaggtcccagtgctgctgcagccgcacttcattaaggcagactctctgttactcactgccatgaagaccgacggcgcaacggtcaaagctgctggtctgtcaccccttgtctcaggcacaacggttcaaaccggccctctgcccaccctggtatcaggcgggacaatcctagcgacagtgccgcttgtggtcgatgcagaaaaattacccatcaaccgactggcggccggctccaaagcccccgctagtgcacagagtagaggggaaaagcggactgcgcacaacgcaatcgagaaaagataccggagtagcattaacgacaaaatcattgagctgaaggacctcgtggtgggcactgaggctaaactgaataaatctgctgtgctgaggaaggccatcgactacattcgcttcctgcagcatagcaaccagaagctcaagcaggagaatctatccttgcggacggcagtccacaaatccaaatccctgaaagacctggtgagcgcttgtggatccggaggcaacactgacgttctaatggagggagtcaaaacagaagtggaagatactcttaccccccctcccagcgacgcgggctctcccttccagagttcaccgttgagtctgggctcccggggctcagggtctggcgggtctggaagtgatagcgaacctgactcccccgttttcgaggactccaaggctaaacccgaacagcgcccatccctgcacagcaggggaatgcttgatagaagccgcctggccctgtgtactctcgtcttcctgtgtctctcgtgtaatcctctggcaagcctgctgggagcacgaggcctgccttcaccgtccgacacaacgagtgtttaccactcgcctggccgaaacgtgctggggacggagtcaagggacggtcccggatgggcacaatggttgctgcctcctgtcgtatggctgctcaatggcttgctggtgctcgtgagcctggtgctgctttttgtgtacggagagcccgtgacacggccacattctgggccagcagtgtatttttggaggcacaggaagcaggccgacctcgaccttgcacgcggagattttgcccaagccgcgcaacagctctggttggctttgagggctcttggaagacctctgccaacttcgcacctggatctagcctgctccctcctgtggaatctgatcaggcacttgttgcagcggctttgggtcggaaggtggctcgctggcagagccggcggactgcaacaggattgtgcgttgagagtcgatgcgtcagcttctgctagagatgccgcactggtgtatcacaagctacatcagttgcacacaatggggaagcacacaggggggcacctgactgccacaaacttggccttatcagcactcaatttagccgagtgcgctggggacgcagtctcagtagccacactggccgagatttacgtcgctgcagcgctgagggtgaaaacaagcctgcccagagcattacactttctgacacgattcttcctgtcctccgcacgtcaggcctgcctcgctcaatcaggcagcgttcctcccgccatgcaatggctctgccaccctgtcggacacaggttttttgtggacggagactggtcagttttatcgacaccctgggaatcactgtactccctggctggtaatccagtggaccctctcgctcaggtgactcagctcttccgggagcacttgcttgagagagcactcaattgcgttactcagcccaacccatcaccaggatcggctgacggcgataaagagttctccgatgccctgggatacctgcaactgttgaactcctgctctgatgccgctggcgcgcctgcctacagcttctccatcagttcatctatggccaccactacgggcgtcgatccagttgcaaagtggtgggctagcttaactgcagtcgtgatccactggttgcggcgagatgaggaggccgcggagagattatgtcccctggtcgagcatctgcctcgtgttctgcaggagtccgaaagacctttgcccagagccgccctgcactcctttaaggctgcccgggccctgctcggttgcgccaaagctgagtcaggcccggctagtctgacaatatgcgaaaaggcgagcggttacctccaggattcactggcgacaacaccagctagctcttctatcgataaggctgtgcagctgtttctgtgcgacttgttgctggtcgtcaggacgagcctttggaggcagcagcagcccccggcgcccgctcctgccgcacagggaacttcctcacggcctcaggccagcgctttggaactgcggggattccagcgggacctgtcatcactgcgcagactcgctcagagtttccggcccgcgatgagaagggtgttcctacatgaagccaccgcccgcttgatggccggggcatctccaacacgaacacatcagttacttgataggagcctgcgccgcagggccggccccggagggaagggtggcgcagtcgccgaactcgagccccgccccactcgccgcgagcatgccgaggctctgctgctggcatcttgctatcttccccctggatttctatctgctcctggccagcgtgtgggaatgctagccgaggctgcacgcacactcgaaaagctgggcgaccgtcgcctgctccacgattgtcagcagatgttgatgcgtctcgggggagggaccacagtgacctccagctag

SEQ ID NO: 17538 - DNA, 2301 bp, Artificial Sequence
  Description of Artificial Sequence: Synthetic coding sequence
atgttggcccatctgtcgcgtgctgccccctgcccgttggcggccggagctgtcgcggccgtggccgtggccgtgactaggtcactcacagcccagtccctacgaacggcacgactcggccctgcaacagtccccccctctcctctgccagcaatctcctctgaacctcatgatagagctggcaagacactgaccgatcccacaagtcatttcatagacaggatcaccgaagcatggtcacatgttgggtcgcattcaaaagcaaagcctgaacaaaggccaagtctgcattcaaggggaatgctggatcggagtcggcttgcattatgcaccctggtttttctgtgcctgtcctgcaatcctcttgccagtctgttaggagcccgcggacttccttccccttctgacaccacatctgtgtatcactctcccggtcggaatgtcctgggaaccgaaagtagagatggccctggttgggcccagtggctgcttcccccagtggtctggcttttgaatggcctcctcgtgttggtttctttggtcttactttttgtttacggggagcctgtgacacgcccgcacagtggccccgcagtttatttctggcgccatagaaagcaggcagacctcgacttagccaggggcgattttgcccaggctgcgcaacagctttggctggctctgagagcactggggagacctctgccaactagtcacctggatctggcttgctccctcctttggaacctcatccggcaccttttgcagcgcctgtgggtcggtcgatggctggctggccgcgctggtggactgcagcaagattgcgcgctccgggtcgatgcctcagctagcgcccgcgacgctgctctcgtctaccataagctccatcagctgcacacaatggggaagcacaccgggggccacctgacagctacaaacttggcacttagcgctttaaatctggctgaatgcgccggagacgctgtaagcgtagcgaccctggctgaaatctatgtggcagctgcgttacgagtgaagacatcactgccccgtgcacttcatttccttactagattttttctctcctccgctcgtcaagcttgtttagcccaatccgggagcgtgcccccagcaatgcagtggctctgccaccctgtgggccatcgattcttcgtggacggggactggtctgttctaagcacaccatgggaatcactgtatagcttggctggtaaccccgtggatcccctggctcaagtgacccagctcttccgggagcatttattggaaagagctctcaactgcgttacccagcccaatccgtcccctggctccgcagacggggacaaagaatttagtgatgccctggggtacctgcaactactcaacagctgctctgatgctgccggagctcccgcctatagcttctccatttctagctccatggccacaactacgggtgtggatccggttgctaaatggtgggcttcactgacggccgtggtgatccactggcttcgccgcgacgaggaagccgcagagcgtctgtgtcccctggttgaacacctgccgagggtcctccaggagtctgagcggccccttcccagggcagcactccacagtttcaaggctgccagggccctactggggtgtgcaaaggcagaatctgggccagcgagcctgaccatctgtgaaaaagcgtctggctatctccaagacagtcttgctaccaccccggcctcatcttctattgacaaagccgtccagttattcctgtgtgacctgctgctggttgtgagaacaagcttgtggcggcaacaacagccgcctgccccggctccggccgcacagggcacatcgagcaggccacaggcctcggctcttgagttaagaggttttcagagggacctttcaagtcttagaaggctcgctcagagtttccgaccggctatgaggagagtctttttgcatgaggctacagccagacttatggctggcgccagccctactcgcacacatcagctgctggatcgatctctccggcgaagagccgggccaggcggcaagggaggagccgtcgccgagctagagccccgacccacacgacgggagcatgccgaggcactgctattggctagttgctacttgcctcccggatttctttcagcccccggtcaacgtgttggtatgctcgccgaagccgcccgaaccctagagaagttgggggatcgacggctcctgcacgactgtcagcagatgctgatgagactgggagggggaactaccgtgacttcatcctag

SEQ ID NO: 17539 - DNA, 2682 bp, Artificial Sequence
  Description of Artificial Sequence: Synthetic coding sequence
atgaaaacagatggagccacagtcaaggccgcgggcttatcacctctagtttccgggaccacagttcagactggacccctccctactttggtgagcggagggactatcctggctacagtccccttagtggtggacgcggagaagttaccaatcaataggctcgcagcaggaagtaaagctcctgcctccgctcagagccgaggcgaaaaaaggacagcacacaacgcaatcgagaagcggtatcggtcttctatcaatgacaagatcatcgagcttaaagatttggtggtgggtacagaagccaaactcaataaatcggcggtgctccgaaaagctatagattacattcggttcctccagcacagcaatcagaaactcaagcaagaaaatctgtccctgagaacagctgttcataagagcaaatccttaaaggatctggtgtcggcgtgtggttctgggggtaataccgatgtgttaatggagggagtgaagacagaggtcgaggacacacttaccccgccaccatctgacgccggatctcccttccaatcctctcccttgtcacttggctcccgggggagcggtagtggagggagcggctctgactcagagcccgactcccccgtttttgaagacagtaaggctaaacctgagcagagacctagtcttcattcgcgtggtatgttggaccgcagccgcttagcgctctgtactttagtttttctctgcctttcttgcaatccgctggcctctctcctgggtgccaggggcctgcccagcccatccgatacgacttccgtctaccactctccaggaagaaatgtgttaggcactgagagtagagacggcccagggtgggctcagtggctgcttcccccagttgtctggctgctaaatggcttgcttgtcctcgtctccctggtgctcctctttgtctacggcgaacctgtcactcgtcctcattccgggccggctgtttacttctggcggcaccgtaagcaagctgaccttgacctagctcggggtgacttcgcccaggctgcccagcagttgtggctggcccttcgcgccctaggacgacctctcccgacatcccacttggacttagcgtgttcactgctgtggaatcttatccgtcatctgcttcagcgcttatgggtgggccgctggctggctggccgagcgggcggcctgcaacaggattgcgcccttagagttgacgcctcggccagtgcccgagatgccgccctggtctaccacaagctgcatcaattgcacacaatgggtaagcacacaggtggacatctgacggccacgaatctggctctctctgcactgaacctcgccgagtgcgcaggagatgccgtttctgtggccacactcgccgagatctatgttgcagccgccctgagagtaaagaccagcctgccacgcgccctgcactttctgacccggttctttctgagtagtgctagacaggcatgtctggctcagagcggatcagtaccaccggcaatgcagtggttatgtcaccccgtggggcatcgctttttcgtcgacggcgattggagcgtgctcagcacgccctgggaaagcttatatagcctggcgggaaaccccgtggatcctctggcacaggtgacccagctctttagagagcacctgctggaaagagcgttaaattgtgtgactcagcctaacccatcccctggatcagctgacggcgataaggagtttagcgatgcactcggatacctgcagcttctgaattcatgctccgatgctgccggggcccccgcctacagcttctctatctcttcctctatggctacaactaccggcgtggaccccgtcgctaaatggtgggcctcacttacagccgtcgttatacattggctcagacgggatgaggaagccgctgagaggttatgtccactggtggagcatctgccccgagtgctccaggagtcagagagaccactgccaagagccgctctgcactctttcaaggcggcaagggccctcctgggatgtgctaaagctgaatccggtccagcgagtctgaccatttgtgaaaaggcttctggttatctacaggactcactagctaccacacctgcttcttcatctattgacaaggcagtgcaattgtttctatgtgacttgctgctggtggtcagaacaagtctttggcgccagcaacagccccctgcccccgctccagctgcccaggggacaagtagccggccacaagctagtgcactggagctgagaggctttcagagggacctgtcttccctgcggaggctcgcacagtcctttcgacccgccatgcgtagagtgttcctccacgaggctactgcccgcctcatggccggcgcaagcccaacacgcacccaccagctgctagacagaagtttacggcgccgcgccgggcccggaggcaagggaggggcggtggcagaacttgagcccaggcctacccgccgggagcatgctgaagccctcctgctagccagttgctatcttcctcctgggttcctgtcagcccccggccagcgcgtgggaatgttggctgaggcagcgcgtactcttgagaagctgggggaccgcagactgctgcacgactgtcagcagatgcttatgcgtctgggaggaggtaccacggtgacttcctcttag

SEQ ID NO: 17540 - DNA, 2955 bp, Artificial Sequence
  Description of Artificial Sequence: Synthetic coding sequence
atggattgtacgtttgaagacatgctgcagctgataaataaccaagatagcgattttcccggtttattcgatcccccctacgctggaagtggagcaggtgggacagacccggctagcccagatacttcttctcccgggtctctgtcgcccccgccggccactctgagctcaagcctcgaggctttcttgtctggcccacaggccgcaccctcccccttatcccctccacagcccgcccccactcccttgaaaatgtacccatccatgccagcgttctctcctggtcccggaattaaagaagaaagtgttcctcttagtattctgcagacaccaaccccccagcctctgccagtgcctactctggtgtctggcgggactattctggctactgttcccctggtcgtggacgcagaaaaactgcctattaataggctggctgccgggtccaaagcacccgcctcagctcagtctagaggtgaaaaacgaaccgctcacaacgccatagaaaagcgctatcgcagcagcatcaatgacaagattatcgaattgaaagatctggtggtgggcactgaagccaaattgaacaagtcagctgttctacgcaaggccatcgactatatcaggttcctgcaacactccaaccagaaactgaagcaagaaaatctttctctgcgcacagctgtccataaaagcaaatctctgaaagatttagttagcgcctgtggcagtgggggcaacaccgacgtactgatggagggggtcaaaactgaggtcgaggacaccttaacccctcccccgagcgacgctggttcaccgtttcagtcctctccgctctctcttgggtccaggggaagcggatctggagggagcggatcagattcagagcctgatagtcccgtgtttgaagacagcaaagccaagcccgaacagaggccgtcgctacactcaagggggatgctggacagatctaggctcgcgttatgcacactggtgttcctctgcttgtcgtgtaatccccttgcctcgctcttgggagcaaggggtctcccttcgccctccgatacaacaagcgtttaccactctccagggcggaacgtgcttggcactgaatctagggacgggccaggttgggcccagtggttactccctccagtggtatggttattgaatggcctgctcgtcctggtgagccttgttctgctgttcgtgtacggcgagcctgtcacccgccctcacagtgggccggcagtgtacttctggagacacagaaaacaggcagacttggatctggcacgaggtgatttcgcacaggccgctcaacagctgtggttggcactgcgcgcactcggaagacccctgcccacaagccatttggacctggcctgttccctgctctggaatctgatccgacatcttctgcagaggctatgggtcggacgttggctagctggcagagcaggagggttgcagcaagattgcgcgttgagggtggatgcctctgcaagtgcacgggacgccgccctagtgtatcataaattgcatcaactgcacacgatgggcaaacacacgggagggcatctaacagcaactaacctggctttatccgcgttgaacctcgctgagtgtgccggagatgccgtgagtgtggctaccctcgcggagatttacgtggccgcagccctgcgagtgaagacttccctacctcgggcgctgcatttcctgactcgcttcttcctcagttcagcccggcaggcctgcctggctcagtctgggagcgttcccccagcaatgcagtggctgtgccacccggtgggacacagattcttcgtcgacggggactggtctgtactgtctaccccatgggagagcctctacagtttagctggaaatcctgtggatccactggcacaagtcacccaactctttagggagcatttactcgaacgggccctgaattgtgtgacacagcccaacccatcgcctggctctgcggacggagacaaggaattttctgacgcgctcggatatctacagttattgaacagttgttctgatgccgcaggcgccccagcctatagttttagcatctcctccagcatggcaaccacgactggtgtggatccggttgccaagtggtgggcctctctaaccgccgttgtgatccattggttaaggcgggatgaggaggcagccgaaagactttgcccattggtcgagcatctcccccgtgtcttacaggagtccgagaggccactgccgagagctgccctgcacagcttcaaggccgctagggctttgcttggctgcgccaaggccgaaagcgggcctgcatctctgaccatttgtgagaaagcatcagggtacctccaggactcgcttgcaaccaccccagcttcctcatcaattgacaaggccgtgcagctcttcttatgcgacctgctgctggtggtgcggacgagcctgtggcgtcaacagcagccacctgcccccgcccccgcagcccagggcacatctagccggccccaggcaagcgctttggagctgcggggcttccagcgggatcttagcagcctccggcggcttgcccagagcttcagaccagccatgcgaagagtgtttctgcatgaagccaccgctaggctgatggccggggcgtctcctactcgaactcaccagctgctggatcgatctctgcggcgtagggcaggacctgggggcaaaggtggcgcagtggccgaactggagcctcggccaacacgccgcgagcacgccgaggctctgttgctcgcctcctgttatctgccgcccggtttcctgagtgcccccggccagagagtgggcatgttggccgaggcagccaggaccctcgagaaactgggcgaccggaggctactgcatgactgccaacaaatgctgatgaggttgggagggggaaccactgtcacttcctcctag

SEQ ID NO: 17541 - DNA, 3222 bp, Artificial Sequence
  Description of Artificial Sequence: Synthetic coding sequence
atggactgcactttcgaagatatgcttcagcttattaacaaccaggatagcgacttcccaggcctttttgatccgccacagcctgctccaacacccttgaagatgtacccctcgatgccagccttctctcctgggcctggcatcaaggaagagtccgtgcccctgagcatactccagactcctacaccccagcccctgcccggggccctcctgccccaaagcttccctgcaccagcaccacctcaatttagtagtacccccgtgctggggtatccatcaccgcctggaggtttcagcacaggttccccccccggtaacactcagcaacctctacccgggctgccacttgcttcccctcccggggttcctcctgtgtcacttcatactcaggtgcagtcagtggtgccgcaacagttgctgacagtcaccgcagcgccgacggctgctcccgtgacgaccaccgtgaccagtcaaatccagcaggttcccgttctcctgcagccccacttcattaaagccgattccctcctactgactgctatgaaaacagacggggccaccgtaaaagctgccgggttgagtccactggtcagcgggactaccgtgcagactgggcccctgccgacacttgtctcggggggaactatcttggctacagtccctttggtggttgatgctgaaaagctgccaattaatagactcgccgccggatctaaggccccagccagcgcacaaagccgcggagaaaaacggacggctcacaacgccatcgagaaacggtacaggtcttccatcaacgataagatcattgagctaaaggatcttgtggttggcactgaagccaaacttaataagagtgctgtgcttcgtaaggctattgactatatccggtttctgcaacactcaaatcagaagctgaagcaggaaaacctgagtctaaggaccgcggtgcataagtccaaatccctgaaagatctggtgtcggcgtgcggttctggaggcaataccgacgtgctcatggagggggtgaagacagaggtcgaagatacgctgacacctccaccaagcgacgcaggatcgccctttcagtctagcccgctttctctgggctccaggggctctggcagcgggggttccggaagcgactccgagccagatagtccagtctttgaggattccaaggcaaaacccgagcagcgcccgtctctacattcacggggtatgctcgaccgttcacgacttgccttatgcaccctagtgttcctgtgcctgagttgtaatcctctagcgtcactcctcggggcacgtggcctgccatctccaagtgacaccacctctgtctatcattcgcctgggcgcaatgttctcggcacagagagccgggatgggcccggatgggcacagtggctgttacccccggttgtttggttgctaaacggattattagtcctggtgtctctggtcctcctatttgtgtatggagaacccgttacaaggccccattccgggcccgctgtctacttttggcggcataggaagcaagccgacctcgacctggcccggggtgattttgcacaggctgcgcaacagctgtggctggcactgcgggcgctaggccgccctcttccaacaagccatttggacctggcatgctccctcctgtggaacctgatcagacacttattacagaggctctgggtgggaaggtggctggctgggagggccggaggtctgcagcaagactgcgccctgcgggtggacgcgtccgcatccgctcgggacgctgcattggtctaccataagctgcaccagcttcacactatgggaaagcacaccggcggccacctgacagctactaacctagccctgtcagccctgaacctggccgagtgtgcaggagatgccgttagtgtggcaacgctcgcagaaatatacgtggcagcagccctgcgtgtgaaaacttcccttccaagggcgctgcacttcctgactagatttttcctttcatccgcgaggcaggcctgtcttgcacagagcggctccgttcctcctgcaatgcagtggttgtgtcatccagtgggccataggtttttcgtggatggggactggagcgtgctgagcacaccctgggagagcctgtattctctggccggcaatccagtcgacccactggctcaagtgacgcagctatttcgggagcaccttctggagcgggcactgaattgtgtcacgcaaccgaatccaagtccaggatccgcggatggcgataaagagttttcggatgccttaggctacctacagctcctaaacagctgctctgatgcagccggtgctcctgcttacagcttctccatctcttcttccatggcaacgaccaccggagtggatccggtcgctaaatggtgggcctcactgaccgccgtagtgatccattggcttagaagggatgaggaggccgctgaacgtctgtgcccccttgtggagcacctgccccgcgtgctgcaggagagcgagagacctcttccaagagccgcattgcattctttcaaggccgctagagccctgcttggatgcgccaaagccgaatctgggcccgctagcctgacaatctgcgagaaggcatccgggtacctgcaagactccctagcaaccaccccggccagttcatccattgacaaggctgtccagctcttcctctgtgacctcctgctggttgtgagaacatccctatggaggcaacagcaaccacctgccccagcccccgctgcacaggggacctcatcccggccacaggcgtcagcgcttgagctgcgcggttttcagagggacctgtcctctctgcgccggcttgcacagtcctttagacctgcgatgagaagggtgttcctgcacgaagccacagcaagactgatggccggtgcctccccaacacggacccaccagttgttagatcgcagtctgcggagaagggccggacccggaggaaaaggcggcgcagtggctgagcttgagccgagacctacacggcgcgaacatgctgaggctttgcttctcgctagctgttatctaccccctggcttcctgtcagcccccgggcagagagtgggcatgctggccgaagcggccagaaccctggaaaaactcggcgaccgcaggctcctccacgactgtcagcagatgctgatgcggttaggcggggggaccacagttaccagctcctag

SEQ ID NO: 17542 - DNA, 1413 bp, Artificial Sequence
  Description of Artificial Sequence: Synthetic coding sequence
atggatgagccccctttctctgaggccgccctggagcaagccctgggagaaccatgtgacctagatgcagccctcctgactgatatcgaggacatgctccaattaatcaataatcaggacagcgactttccaggtcttttcgatccgccttacgccggctcaggcgcaggaggtaccgaccccgcctcgcccgacactagctcacccggatcactgagtccacctccagccactctgagctcctcgctggaagcttttttatccggcccccaagctgctccatccccattgagccccccacagccagccccaacccctttgaaaatgtatcctagcatgccagctttttcaccaggcccagggatcaaggaggagtctgtcccgttgtccatccttcaaaccccgacaccacagccactccctggtgctctgctgccgcagtctttccccgcaccggcccccccccagttctcttcaactccagtgttgggatacccatccccacctggagggttctctaccggtagccctccaggaaacacacagcagcctcttccggggctcccccttgcgtccccacccggcgtgccaccagtgtctctccatacccaggtacagtctgtggtgccgcagcaactgctaacggtcactgccgctcccaccgctgctccagtgaccacaaccgtcacaagccagatccagcaggtgccagtgctcctgcaacctcatttcattaaggcagactccttgcttctgacagcgatgaaaaccgacggcgcaactgttaaggcagctggactgagccctttagtttctgggacaactgtgcagactggccccctgcctactttggtctccggtggcacgattttggctacggtacccctcgtggtcgatgcagaaaagctgccaattaatcggttggccgccggatcaaaagcgcctgcctcagcacaaagcagaggcgaaaagagaaccgcccacaacgcaattgagaagcggtaccggagtagcattaacgataaaattattgaactgaaggacctcgtggtgggcaccgaggcaaagcttaataaaagcgcagtcctgcggaaggccattgactatatcaggttcctgcagcattcaaatcaaaagcttaaacaagagaaccttagcctccgaaccgctgtgcataagtcgaagagtctgaaagacctggtctccgcctgcggcagcgggggcaacacagatgtactaatggaaggtgtcaagaccgaggtcgaggacacgctaacaccccccccttccgacgctggtagcccattccagtcatcaccgctgtcgctgggaagtagggggtctggatccggaggcagtggatcagattctgaaccagacagccccgtgttcgaagacagtaaaacggagtag

SEQ ID NO: 17543 - DNA, 645 bp, Artificial Sequence
  Description of Artificial Sequence: Synthetic coding sequence
ctcatgcccgcctgccttccaggcaagcatactggaggacatcttaccgcgacgaatctcgccttatccgcactcaatcttgctgaatgcgctggagatgctgtatccgttgctacccttgccgagatttacgtagctgcagcgctgcgtgtgaagaccagcctaccgcgtgcccttcattttctgacccgtttcttcctgtcatctgctcgtcaagcctgtctcgcccagagtggttccgtgcctcccgccatgcagtggctgtgccatccagtaggacaccggttcttcgtggacggggattggtccgtgctgtctactccctgggaaagtctctactccctagcgggaaatcctgttgacccactggcacaggttacgcagctcttccgcgaacacctgctggagagagctttaaattgcgtgacccaacctaaccccagtcctggatcagctgatggggacaaggagtttagcgacgccctggggtatctgcagttgctcaacagctgttccgacgccgcaggggctcctgcgtactccttttcgataagctcgtccatggcaactaccacgggcgatccctgtcccggtcagctgtgtactccttccagactccctggcccttgctgggctgttccttag

SEQ ID NO: 17544 - DNA, 747 bp, Artificial Sequence
  Description of Artificial Sequence: Synthetic coding sequence
atggaaagggcttccctgattcagaaggccaagcttgcggagcaggctgaaaggtatgaagatatggcagcctttatgaagggggctgtcgagaagggcgaggagctttcatgcgaggagagaaatctcctctcagttgcttataaaaacgtagtggggggtcagcgagctgcctggcgagtgctgtccagcattgagcagaaaagcaacgaggaagggagtgaagaaaaagggccagaggtaagagaatacagggagaaggtggagacagagctccagggggtgtgtgacaccgtcctcggactcttagactcccacctaatcaaggaggctggggacgcagagtcaagagtgttctatctcaagatgaagggagattactaccgatacctagctgaagttgcaacgggcgacgacaaaaaaaggatcatcgattcagctagatccgcttaccaagaagctatggatatcagtaagaaagagatgccacccaccaacccaatcaggctgggtttggccttaaacttctccgtgtttcattatgagatcgcaaactctcccgaggaagctatatccctagctaaaacaacatttgatgaagcgatggctgatctgcacacgctatcagaggattcctacaaggactctaccctcattatgcagctcctgcgcgacaacttaacactgtggacggctgacaacgccggcgaggaagggggcgaagccccccaggagcctcagagctag

SEQ ID NO: 17545 - DNA, 651 bp, Artificial Sequence
  Description of Artificial Sequence: Synthetic coding sequence
atggaacgggccagtctgattcagaaggctaagctggcggagcaggcagagaggtatgaggacatggccgcttttatgaagggcgccgttgagaagggagaagaactgtcttgtgaggagcgaaacttgctttctgtggcttataagaacgtggtcggcggacaacgcgccgcttggagagtgcttagctctatcgagcaaaaatcgaatgaagagggctctgaggagaaaggacccgaagttcgcgagtaccgcgtcttttatctcaaaatgaaaggtgattattaccggtatttggccgaggtggcaactggggatgacaaaaagcgcattatcgatagtgcccgctccgcctatcaggaggcaatggatatcagcaaaaaggagatgccaccaaccaatccgattagactgggtttggcattgaacttttccgtcttccactacgaaattgctaatagcccagaggaggcgatctctttagccaaaacaactttcgatgaagcgatggccgaccttcacaccctgagcgaggatagctataaagacagcactctcatcatgcagctgctgcgagataacctgaccctgtggacagccgacaatgctggggaggaaggcggcgaggccccccaggagccccaatcctag

SEQ ID NO: 17546 - DNA, 3702 bp, Artificial Sequence
  Description of Artificial Sequence: Synthetic coding sequence
atgggatttctcaaactgattgaaattgagaacttcaagagctacaaggggcgtcagatcatcggacccttccagcgctttactgccattatcggaccaaacggatcaggaaaaagcaacctgatggatgctattagctttgtgctcggtgagaagacttctaaccttcgggtaaagacactaagagatcttatacacggtgcccctgtggggaaacctgccgccaaccgggcatttgtgagtatggtctacagcgaagaaggcgccgaggacaggacattcgcacgcgtaatcgtggggggctcctcagagtacaagatcaataacaaagtcgtgcaactgcacgaatattcagaagagctcgaaaagctgggcatactgataaaggcacggaattttcttgtgttccagggcgccgttgaaagcattgccatgaaaaatccaaaggagaggactgcactttttgaagaaatatcacgatccggggaattggcacaagagtatgataagcgcaagaaggaaatggtgaaagctgaggaggatacccaattcaattaccacagaaagaaaaatatcgctgccgagaggaaagaggccaaacaggaaaaggaggaggccgatcgttatcagcgcctaaaggacgaagtcgtccgagcgcaggtccaactgcagctcttcaagctctatcacaacgaagtagaaattgaaaagctgaacaaggagctggcatctaagaacaaagaaatcgaaaaggataaaaagcggatggataaggtggaggatgaactcaaggagaagaagaaggaactaggcaaaatgatgagagaacagcagcagatcgaaaaagaaattaaggagaaggatagcgaactcaatcagaaacgaccacagtacataaaggccaaagagaacacgtctcataaaattaaaaagctcgaggctgccaagaagtcactccagaacgctcagaaacattacaagaagcggaagggggacatggacgagctagaaaaggaaatgctaagtgtggagaaggcacgacaagagttcgaggaacgaatggaggaagagtctcagtctcaggggcgtgatctgacgttggaggaaaaccaggttaaaaagtatcaccggttgaaggaggaagctagtaagcgcgctgccacactcgctcaggaactggagaagttcaaccgcgaccagaaggccgatcaggatcgcttggatctggaagagcgcaagaaggtcgagacagaagccaagatcaaacagaaattgcgggaaattgaggagaaccagaaacgcatcgagaaacttgaagagtacatcactacatccaagcagagtttggaggaacaaaagaagttagaaggggaattgacagaggaagtagagatggctaagagacgcattgatgagatcaataaagaacttaatcaggtcatggaacagcttggcgacgctcgtattgatcgccaggagtcctctcggcagcagcggaaggccgaaattatggagtctattaaacgactctatcctgggtcagtgtacgggaggttaattgacctctgtcagcctacacagaagaaataccaaatcgcagtcacgaaagttctgggtaagaacatggatgccatcatagtggattccgaaaaaacaggaagagattgtatccaatacatcaaagaacagcgcggagagcccgagacctttttgcctcttgattacttagaagtgaagcccaccgatgagaaactccgggaattaaagggggccaaactagtgattgacgtgattcggtacgaacctccacacattaaaaaggccttgcaatacgcctgcggaaacgcactcgtttgtgataacgtggaggacgcgaggaggatcgccttcggggggcaccagcggcacaagactgtagctttggacggtaccctattccagaagtcaggggtcatcagcggcggcgcctctgacctgaaagctaaggctcggcggtgggatgaaaaggcggtggacaaactgaaagaaaaaaaggaacgtctaactgaggagctcaaagaacagatgaaagccaagcggaaagaagccgaattgcggcaagtgcagtctcaggcacatggactgcagatgcggcttaagtatagccaatcagatctggaacaaactaagacgagacacctcgctttgaaccttcaggagaaatctaagctagaaagcgagctggccaattttggcccacgtatcaacgacatcaagaggattatccaatcccgcgagcgggaaatgaaagatttgaaagagaaaatgaatcaggtggaggacgaagtattcgaggagttctgtagagaaattggtgtcaggaatatccgtgaattcgaagaagagaaggtgaagcgtcagaatgagatcgccaaaaagcgcttagagtttgaaaatcagaagactcgcctggggatccagctcgatttcgagaagaaccagctgaaagaagaccaggataaagtccacatgtgggagcagacggtcaagaaggatgagaatgagattgaaaagctaaaaaaggaagagcagcggcacatgaaaattatagatgaaaccatggcccagttacaggacttgaaaaatcagcacctggcaaaaaagagtgaagtgaacgacaagaatcacgaaatggaggagataaggaagaagctgggaggagctaataaagagatgactcacctgcaaaaggaggtcacagcaattgagaccaagctcgagcagaaacggtctgaccgacataatctgctccaggcttgtaagatgcaagatataaaacttcctctgagcaaaggtacgatggatgacatcagtcaggaagaggggtcgagccagggcgaggacagcgtgagtggatcacagagaatttcgtcgatctatgccagagaagctctgattgagatcgattatggagacttgtgtgaggatctgaaggacgcccaggcagaggaagagattaaacaagagatgaataccctccagcagaagcttaatgaacaacagtccgtgcttcagaggattgctgcacccaacatgaaggccatggaaaagctggagtctgtgagagacaagttccaggagacatcagacgaattcgaagccgctcggaaaagagccaagaaagctaagcaggcctttgaacagattaaaaaggaacggtttgaccgcttcaacgcttgcttcgagtccgtagctacgaatattgacgagatctataaggccctgagtcggaatagctctgcacaggcctttctgggtcccgagaatccggaagagccatatctcgacgggatcaattataactgcgttgcgccgggtaagcgcttcagacccatggataatctatctggcggcgagaagaccgtcgctgcactcgccttgctgtttgccatacattcttacaagcccgcgccattttttgtgctcgacgaaattgacgcagcactcgataataccaatatcggtaaagtcgctaattacataaaggaacagtctacttgcaatttccaggccatcgttatcagtctgaaagaagagttctatactaaagcggagtctctgatcggggtgtaccctgagcagggcgactgtgttatttccaaggtgctgacatttgacttgacgaagtacccggacgctaaccccaatcccaatgaacaatag

SEQ ID NO: 17547 - DNA, 612 bp, Artificial Sequence
  Description of Artificial Sequence: Synthetic coding sequence
atgggattcttaaaacttatcgaaattgaaaactttaagagttataaaggccgccagatcatcggacccttccagaggttcaccgcaattatcggtccgaatggctctggaaaaagcaatcttatggatgccatatcctttgtcttaggagagaagacctccaacctaagggtaaaaacactgcgcgatttgatacacggtgctccagtcggcaaacccgccgcgaaccgtgctttcgtgtcaatggtctacagcgaagagggtgcagaggaccgaacctttgctagagtgatagttggagggagttcagaatataaaatcaacaataaggtggtgcagctccacgagtactccgaagagttagaaaaattgggaattcttataaaagcgaggaatttcctcgtcttccaaggctgctgcggcatttattgccatgagacgccaaaacgtgggcaactttacttaaagatctcgagatcgggcgagctggcccaggagtacgacaaacggaaaaaagagatggtcaaggctgaggaggatacgcaatttaactatcacagaaagaaaaacattgccgcagagcggaaagaggccaaacaggagaaggagtag

SEQ ID NO: 17548 - DNA, 1551 bp, Artificial Sequence
  Description of Artificial Sequence: Synthetic coding sequence
atgggctttctcaagttaatcgagatcgaaaactttaaaagttataagggaaggcagatcattggaccattccaaaggttcactgcaatcatcggcccgaacggatccggtaagtctaacctgatggatgctatctcatttgtattgggagagaagacaagcaatctcagagtgaaaacactgcgcgacttaattcatggagctcccgtgggtaagcctgcagctaatagagccttcgttagtatggtttactccgaggaaggtgctgaggacagaacctttgcaagagtcatcgtgggaggatcaagcgaatacaaaatcaataataaggtcgttcagctgcacgaatacagtgaagaactagagaaattgggcattcttatcaaagcaagaaatttcctggttttccaggtgaagaagtaccacaggctaaaggaagaagcctcaaaacgcgcagccacactggctcaggagcttgaaaagtttaacagggatcagaaagctgaccaggatcgtctggatctggaagaacgaaaaaaagtcgaaacggaggcaaagatcaaacagaaactccgggaaatcgaggagaaccagaagagaatcgaaaaattggaggagtacatcacaacgtctaagcagtctctcgaagagcagaagaaactcgaaggcgagttgacagaagaggtggagatggctaagcgaagaatcgacgagatcaacaaggaattaaatcaggtgatggagcagcttggagacgcaaggatcgatagacaagaatcaagtcgccaacaacgtaaagctgagattatggaatcaatcaagaggctgtatccagggtcagtatacggcaggctgattgacctgtgtcagcctacccaaaagaagtaccagatcgcagttaccaaagtactggggaagaatatggatgcaataatcgtggacagtgaaaagacgggtcgagattgtattcaatatattaaagagcaacgaggagagcctgaaacttttttacctttggattaccttgaggtgaagccgaccgacgagaagttgagggaactcaagggcgcaaagttagtcattgacgtgattcggtacgagcctcctcatattaaaaaagctttacagtatgcgtgtggaaacgccctggtctgcgataatgtggaggacgcccggcgaattgcatttggtggacatcagcgccataagaccgtcgcactggacggaacactttttcaaaagtccggggttatttcagggggcgccagcgatctcaaagccaaagccaggcgatgggacgagaaggccgtagataaactcaaggaaaaaaaagaaaggttaactgaagaactaaaagaacagatgaaagccaaaaggaaagaggccgagctccgccaggtccaatctcaggctcatggattgcagatgcgacttaagtacagtcagtcagatctggagcagaccaaaacgcgccatctcgcactcaacttgcaggtgggcccaggactgcagccatgttcccccaaagccatacacaccttcctggcgtag

SEQ ID NO: 17549 - DNA, 870 bp, Artificial Sequence
  Description of Artificial Sequence: Synthetic coding sequence
tagtggtacacccccacgcccttttacagtagcctggaggctgcactgttgaacttcagaccaagcgcacccgtctttcggatgctcgaagtaagcattcctactccccatcgctacgtcagaggaaaaagtaatttgatggatgctatcagttttgtgctcggcgagaagacatctaatcttagggtgaaaacactgcgtgatctgatccacggggccccagtcggcaaacccgccgctaatagggcttttgtctccatggtatactccgaggagggcgctgaggatcggaccttcgccagggtcattgtggggggaagctctgagtacaagataaataacaaggtagtgcagctgcatgaatacagcgaggagctcgagaaactgggaattctgattaaggcgcgcaacttcctggtgttccagggcgctgtggaaagtatcgccatgaagaaccctaaggagaggaccgccctgttcgaggagatatcacggtccggtgagctcgctcaagaatatgataaaagaaagaaagaaatggttaaagctgaggaagacacccagttcaattaccatagaaaaaaaaatatcgcagccgaaagaaaggaggccaaacaggaaaaggaagaagctgatcgctatcaacgattgaaggacgaagttgtccgggcccaggttcagttacagctttttaaactgtaccacaatgaagtcgaaattgagaagttaaataaggagttagcgagcaaaaataaggagattgaaaaagataagaagcggatggacaaggtggaggatgaacttaaggagaagaaaaaggaactgggaaagatgatgcgtgaacagcagcaaatagagaaggaaatctag

SEQ ID NO: 17550 - DNA, 1995 bp, Artificial Sequence
  Description of Artificial Sequence: Synthetic coding sequence
atgagcggggtgcgcggcctgagtcgtttactgtcggcccgacggctggccctggcaaaagcgtggccaacagtgttgcagactggcacccgaggtttccatttcacagtggatggcaacaaacgtgctagcgccaaagtgtccgattctataagcgctcaataccctgtggtcgaccacgaatttgacgcagtcgtagtcggggccggcggagccgggctgagggccgcatttgggctgtccgaggctgggtttaacactgcctgcgtgacgaagctcttcccaaccaggtctcacacggttgcagcccaaggaggaatcaacgctgccctgggcaacatggaggaggacaattggcggtggcacttctacgacacggtgaaagggtcagattggttaggagaccaggacgctatccactatatgaccgagcaggcaccagctgccgtagtagaactggagaattatggaatgcccttctctaggactgaggacggtaaaatctaccagcgagcttttggggggcaaagtctgaagtttggtaagggaggccaggcccaccgttgctgctgtgtggccgaccggaccggacactccttgctgcacaccttatatgggagatctcttcgctacgacacaagctacttcgtcgagtatttcgccctggacctgcttatggagaatggagagtgccgcggagtgattgcactgtgtattgaggatggctctatccacaggattagagcgaagaacacggtggtagccactggggggtacggccggacatactttagctgcacatccgcccacactagcaccggggacggtaccgcgatgatcacccgggccgggctcccgtgccaggatctggagtttgttcagtttcacccaaccggaatttatggcgcgggctgcctcatcactgagggctgtcggggggaagggggtatcctgattaactcccagggcgaacggttcatggaacgttacgccccagtggctaaagatctggcatcacgcgatgttgttagtcgcagcatgacactggaaatcagggaagggcgaggttgcggtcccgaaaaggatcatgtgtaccttcagctgcaccatcttccacctgaacagctggccaccagattgcccgggatttccgaaaccgccatgatttttgccggagtcgatgtgaccaaggagcctatccctgtgctgcccaccgtgcattataacatgggaggcatacccactaactacaaggggcaggtactacgacacgtgaacgggcaggatcaaatcgtgccggggctatacgcctgtggggaggcggcttgcgcctcagtgcacggtgctaaccgactgggagctaactcactgctcgacttggtcgttttcggtagagcttgcgcacttagcattgaggagtcatgccgcccaggcgataaggtgcctcctatcaagccaaacgcaggcgaggaatcagtcatgaatctagataagctgcgtttcgccgacggctccatccgcacttcagagctgagactgtccatgcagaagtcgatgcaaaaccacgccgctgtcttcagagttggctcagttctgcaggagggctgtggcaaaatttccaaactgtacggggacctcaaacatttgaagacctttgatagggggatggtttggaataccgacttggtcgaaacgcttgagctgcagaacttgatgctgtgcgctttgcagacaatttatggagcagaggctagaaaagaatcgcggggcgcacacgcccgagaggactacaaagtgcgcattgacgagtatgactacagcaagccaatccagggccagcaaaagaagccgttcgaggagcattggcggaaacacacgctttcatatgtcgatgtgggcaccgggaaggtcactctggaatatcgacctgtgatagataaaacattgaatgaggctgactgtgccacagttcctccagccatccgaagctactag

SEQ ID NO: 17551 - DNA, 1560 bp, Artificial Sequence
  Description of Artificial Sequence: Synthetic coding sequence
atgtccggcgtaagaggcctgagccgcctgttgagcgcacgaaggctcgcgctggcgaaagcatggccgacggtgctacaaactggtacaagagggtttcactttacagtagacggaaacaaaagggcatctgccaaggtctccgacagtatctctgcccagtaccccgttgtcgatcatgagtttgacgccgtggttgttggcgccggaggtgctggcctgcgcgccgcctttgggctgagcgaagccgggttcaataccgcctgtgtgacgaagctttttcccaccagatctcacacggtggctgcccagggagggattaatgccgccctgggcaatatggaggaggacaactggcgctggcacttttatgatacgtcaaccggcgacggtacagctatgattactagggccggcctaccctgtcaggatctcgaattcgtgcagttccaccctaccggcatctatggggcgggctgtctgattacagagggatgtcggggagaaggcggaattctcatcaattcacagggggaacgattcatggaacgttacgcaccggtcgccaaggacctcgcatctagggatgtggtgtcccgcagcatgacactggagattagagaagggagaggatgcggcccagaaaaggaccacgtgtatctgcagctccaccatctccctcccgaacagctggccacacggctacctggcatctctgagaccgccatgatatttgctggcgtcgacgttaccaaagagcccatccccgtcctccctacggtgcactataatatgggggggatccccacaaattataagggccaggtactgcggcatgtgaatggtcaggatcagattgtccccgggctctatgcctgcggcgaggctgcctgcgctagcgtgcacggtgctaacaggcttggagcaaattcattgttggatctggtcgttttcgggagagcgtgtgcattatccattgaagaatcctgtcggcctggagacaaggtgccacctataaaacccaatgcaggagaggagtctgtgatgaatctggacaagctcaggtttgccgatgggagcatcaggacctcagaactccggctgtctatgcagaaatccatgcagaaccacgccgcggtcttccgcgtcggcagcgtcctgcaggagggctgcggtaagatttctaaactctatggagatttgaagcacctgaaaacgtttgacagaggtatggtttggaacacggacttggttgaaacactcgaactacagaacctcatgctttgtgctctccagaccatatatggggcagaggctcggaaggagtccagaggtgcccacgctcgcgaagattataaagtgcggatcgacgaatacgactatagtaaacctatacaaggccagcagaagaaacccttcgaagaacactggcgcaagcacaccctgtcttacgtggacgttggaacggggaaagttacactagaatatagacccgtaatagataaaactctgaacgaggctgactgcgcaactgtgccgcctgctatccgttcctactag

SEQ ID NO: 17552 - DNA, 6645 bp, Artificial Sequence
  Description of Artificial Sequence: Synthetic coding sequence
atgaaacgcaaggaacgaatcgctcgcagattggaaggcattgagaacgatactcagcctatactactgcagagttgcaccgggctggtcacacatagactcctggaagaggacactccgcgctatatgcgagccagcgacccagcttcacctcatattggcaggtccaacgaggaagaagagactagcgactcttccttggagaaacaaacacggagcaagtattgcactgagacttcgggcgtgcatggggattccccctacggcagtgggacgatggacacccactcccttgagtcgaaagctgagaggatcgcacgttataaggctgaacggcgaagacagctcgctgagaagtacggacttacactggaccccgaagcagattccgagtacctgagcaggtacactaagagcaggaaggagcctgacgccgttgaaaagcgcggagggaagagtgataagcaggaagaatcgagcagggatgcaagctcattgtacccgggcactgagactatggggcttcggacctgcgcgggggaatccaaggactatgcattacacgtaggcgacgggagcagcgatcctgaagtcctgctgaacatagagaatcagagacgaggccaggagctgagtgctacccgccaggcccatgatctgtcacccgctgccgaatcttcatcgaccttcagctttagtggcagggattctagcttcacagaggttccccggtcgcccaaacatgcacatagttcctccttgcagcaggcagctagcagatcgcctagcttcggcgatccgcagctctcaccggaggccaggccctctactggcaagcctaaacatgagtggttcttacagaaggattcagaaggggatactccctccctcattaattggcccagcagggtgaaggtccgtgaaaaacttgtaaaagaagaatccgcgagaaactcgcctgaactcgcctccgagtctgtaacacaacgccgacatcaaccagcacccgtccattacgtctcttttcagagtgaacacagcgctttcgacagagtcccttccaaagctgccggatccacacgccaaccaattcgcggatacgtgcaaccagccgacacaggccacacggcaaaattggtgactcccgagactccagagaacgcttcagagtgttcttgggttgcaagcgccacacagaacgtcccaaagccaccaagcttaaccgtgctggagggcgatggaagggatagccctgtgctgcacgtatgtgagtcaaaggccgaggaggaggagggggaaggagagggcgaggaaaaagaggaggatgtgtgttttactgaggccctcgagcagagcaaaaagacgttactagccttggagggagacggactcgttcgatctcccgaagatccttctaggaacgaggacttcggaaagcctgccgtgtccaccgtgactctcgagcaccaaaaagaacttgaaaatgtggcccaaccccctcaggcacctcaccagcccacagagagaactggcaggagcgagatggtgctgtacatccaaagcgaacccgtcagtcaggatgccaagccgacggggcacaacagggaagccagtaagaaaagaaaagtccgcaccaggtccctaagcgacttcactggcccccctcagcttcaggccctgaaatacaaggatccagctagccgccgtgagctggagctcccatcctctaaaaccgaggggccctacggtgagataagtatgctcgacacaaaggtgtcagtggcacaattaaggagcgcatttctggccagcgccaatgcctgtcggcgacctgagctgaaatcccgggtggaaaggtctgccgaaggacccggtttgcctacaggcgtcgagcgcgagcgcgggtcccgcaaaccccggcggtatttttctcccggcgaaagccggaaaacttccgaacgattccggacccagcccatcacatccgccgagcggaaagagagcgatagatgtacatcccactccgaaacccctacagttgacgacgaggagaaggtagacgagagagcgaaactcagtgtcgcggccaaacggcttctgttccgagagatggaaaagtcgttcgacgagcagaacgtccccaaacggagaagccgcaatacggccgttgaacagagactccgacgacttcaagatcgctctctgactcagcccatcacgacagaagaagtggtgattgcggccaccgagccgatccccgcaagctgctccggcggtacccatcccgttatggcccgcctcccctcgccaacagtggccagatcagcagtgcagcccgcaagactccaggcaagcgcgcaccagaaagccctggctaaggaccagaccaatgaaggcaaggaactcgctgagcaaggggagccagactccagcacactcagcctcgctgaaaagctggcattgttcaacaagctgagccagcccgtgagtaaggcaatctccacaaggaatcggatcgacacacgacaacgaaggatgaatgctcggtaccaaacgcagccggtcactctgggcgaggtcgagcaggtgcagagcgggaagttgattcccttcagccctgctgtgaacactagcgtgtctaccgtggcaagtacggtcgcccctatgtacgcgggcgacctgaggacaaagccacctctggaccacaatgcctctgccacagattataagttttccagttcaatagaaaactccgattcacctgtgcggtcaatcctcaaaagtcaggcctggcagccgctcgtggagggatcagagaacaagggcatgcttagagaatacggcgaaaccgaaagcaagagagccttaaccgggcgggattccggcatggagaaatacggttcatttgaggaggctgaggccagctaccctattctgaatcgagccagagagggtgattcccataaagagtcgaagtacgccgtgcccaggagaggtagcctggagcgcgctaaccccccaattacacaccttggcgacgaaccaaaggaattctccatggcaaagatgaacgctcaggggaaccttgatctacgggaccgcctaccctttgaagagaaggtagaagtcgaaaatgtcatgaagcggaagttcagtctccgggccgccgagttcggagagcctactagtgaacagactggaactgcagctgggaaaaccatcgcacagactacagcacccgtctcctggaagcctcaggatagtagtgaacaaccccaggagaaattatgtaaaaacccttgcgcgatgttcgccgctggcgaaatcaaaacacccaccggcgaaggactccttgattccccaagcaagaccatgtctatcaaggaacggctagcccttctcaaaaaatccggcgaagaggattggcgcaaccgcctctctaggcggcaggaggggggcaaggcccctgcctcctcactccatacgcaagaggccggaaggagcctgattaaaaaacgtgtcaccgagtctagggaatcccaaatgactatcgaagagcgcaagcaactgataacagtgcgagaggaagcatggaaaacacgaggccgcggggctgctaatgactctacacagtttaccgtggcgggcagaatggtgaagaaggggctggcatctccaacagcaatcacccctgtggcctcccctatctgcgggaaaacccgtggaactacccccgtatcaaagcctttggaagatatagaagcccgtcccgacatgcagctggagagcgacttaaagcttgaccgcctggagacatttctgagacgattaaacaataaagttggcggcatgcatgaaaccgtgctgaccgtgacaggaaagtcagtgaaagaggtaatgaagccagatgacgatgagactttcgccaagttctaccgctccgtagattataacatgcccaggagcccggtggagatggacgaggacttcgacgtcatttttgatccgtatgcccccaagttgacaagcagcgtggctgaacacaagcgggccgtacgtccgaaacgacgggttcaggccagtaagaatcctctgaagatgttggccgcccgcgaggatcttctccaggaatatacagagcagcgccttaacgtggccttcatggagagcaagcgtatgaaagtcgaaaaaatgtcatccaactctaatttcagcgaagtcacactggctggactggctagcaaggagaacttcagtaacgttagccttcgcagcgtaaacctgacggagcaaaattcgaacaactcggccgtaccctacaaacgcctgatgcttttgcagataaaaggtagacgccatgtgcaaacaaggctcgtggaaccccgggcttctgccctcaattctggggactgctttttgctactgtcgccacattgctgttttctctgggtgggcgaattcgccaatgtaatcgaaaaggccaaagcaagtgagctggcgaccctgatacagactaagcgagagctcgggtgcagagctacatacattcagacgatcgaagaaggaatcaacacacacacacacgccgctaaggatttttggaaacttcttggtgggcagacttcctatcagtcagccggcgatcctaaggaagacgagttgtacgaagctgccatcatagagaccaattgtatttatcggctgatggacgataagctggtgcccgatgacgattactggggcaagattcctaagtgttctctcctgcagcctaaggaggtgctcgtttttgacttcggaagtgaagtgtacgtctggcacggtaaagaagtaaccctggcgcaacggaaaattgccttccagttagccaaacatctgtggaacggaaccttcgattacgaaaattgcgacatcaatcctttggacccaggcgagtgtaaccccctgattccacgcaaaggtcagggaaggccagattgggcgattttcggccgactgacagagcataacgagactattctattcaaggaaaagttcctggattggaccgaattaaagaggagcaatgaaaagaatccaggcgaacttgcccagcataaagaagatcctagaaccgacgttaaggcctatgatgttacccggatggtgagcatgccccagactactgcagggaccatccttgatggggttaatgttgggagaggatacgggttggtcgagggccacgataggaggcagttcgagataacatctgttagtgtcgacgtttggcatatcttggagttcgactattccaggctgcccaagcagtcaatcggacaatttcatgaaggcgatgcctacgtcgtcaaatggaagtttatggtgagtacggcagtgggctctcggcagaagggggagcacagtgtgcgggctgcgggtaaggaaaagtgtgtttatttcttttggcaggggagacactctacggtgtccgagaaaggcaccagcgcccttatgacagttgaacttgatgaggagaggggggcacaggttcaggttctgcagggaaaagagcctccgtgtttcctgcagtgtttccaaggtggcatggtggtgcacagcgggcggagggaagaggaagaggaaaatgtgcaatcagagtggagactctattgtgttagaggggaggtgcctgtcgagggtaacctgttagaagtcgcatgccattgcagctcactccgcagccggacctccatggttgtgctaaacgttaacaaggctcttatctacctttggcacggatgtaaagctcaggctcatactaaggaagtgggcagaaccgccgcaaataagataaaagagcagtgccccctcgaggccgggctgcactcctcatcgaaagtgacgatccacgagtgtgatgaaggatctgagccattaggattctgggatgcactcggcaggcgggatagaaaagcctacgattgcatgctccaggacccgggcagctttaatttcgctcctcggttattcattttgtctagcagctcaggggactttgcagccaccgaatttgtataccccgcccgtgcccctagcgtggtgagcagtatgcccttcttacaggaggatctgtatagtgccccacagcccgcgctgtttttagtggataatcatcacgaagtatatttatggcagggttggtggcctatagagaataagatcaccggttctgccagaattcggtgggcttccgatcgtaaatccgcaatggaaactgtcctccagtactgtaaggggaagaatctcaagaaaccagctcccaagagctacctgatccatgctggcctcgaacctctgactttcacaaatatgtttccctcgtgggaacatcgggaggatatcgccgaaatcaccgaaatggacacagaagtgtcgaaccaaataaccttggtggaggacgtgctcgccaaactctgcaagacgatctaccctttagctgatctactggctcggcctctgcccgagggagtggatccgctgaagcttgagatctacttaaccgatgaggattttgagtttgctctggacatgacaagggatgagtacaacgcacttccggcatggaagcaggtgaacctcaaaaaggcaaagggactcttctag

SEQ ID NO: 17553 - DNA, 6645 bp, Artificial Sequence
  Description of Artificial Sequence: Synthetic coding sequence
atgaagcgcaaggagcggatcgcaaggcggctggaggggatcgagaacgacacgcagcctatccttctgcagagctgcaccgggttagtaacacaccggctgctggaggaggacacgccaagatacatgagagctagcgatcctgcgagcccccacattggccggagcaatgaggaggaggaaacctcggattccagtttggaaaagcagacccgatccaaatactgtactgaaacatcaggcgtgcatggcgacagcccatacggttctggtactatggatactcatagcttagagtccaaagcggagagaattgccaggtacaaagctgaaagacggcggcagctagcagagaaatacggtctcaccctcgaccccgaggccgactcggagtatcttagtcgctacacaaagtcccgtaaagaaccagatgccgtggaaaaacgggggggcaaatcagacaagcaggaagaatcatcccgcgacgcctcttcattgtatcctgggacagaaacaatgggcctgcggacgtgtgctggggagagcaaagactatgcactccacgtcggagatggatcttcagatccggaggtcctgctaaacatcgagaaccagaggcgaggccaagaactatcagccacaagacaggcccacgacttaagccctgcggctgaatcaagcagcacgttctcgttttctgggagagacagctctttcaccgaggttccacggtcaccaaaacacgcacatagttcctctcttcagcaggcggcatccagatccccatcgttcggggacccccagctgagccctgaggctcggccatccacaggaaagccaaagcacgaatggtttctccaaaaggattcagaaggagataccccgtctctcattaattggcctagccgcgttaaggtgcgggagaagctggtcaaagaggaatccgcccgcaactcccctgaattggcatcagagtcggtgacccagcgccgtcaccagccggctccagtccactacgtgtccttccagtccgagcacagcgcctttgatcgggtacctagcaaggctgccggctctactcggcagcctatccgcggatatgtacaaccagccgacactggacacaccgcaaaactggttacccctgagacccctgagaatgccagcgaatgctcctgggtggctagcgcaactcagaacgttcctaaacctccaagtctgactgttctggaaggagatggtcgggactctcccgtattacatgtatgcgagtccaaggcggaagaggaagagggtgaaggtgagggcgaggagaaggaagaggatgtctgttttactgaggccttggagcaatcaaagaagaccctgttggccctcgagggtgacgggctagtgaggtcccctgaggatccatctcggaacgaggacttcggcaagcccgccgtctccaccgtcacactcgagcatcagaaggagttggagaatgtggcccagcccccacaggccccccaccagcctaccgaacggacaggacgttccgaaatggtcctctacatccagtccgaacccgtctcccaggacgctaaaccaactgggcacaatcgcgaagccagcaaaaaacggaaagtgcgcacacgctccctatcagacttcacaggcccacctcaacttcaggctctgaagtacaaggacccagcatctcggcgcgaactcgagctgccttcaagcaaaaccgaagggccatatggggagataagtatgctggatacaaaggtcagcgtggcgcagctgcgatccgcttttttagcctctgcgaacgcctgtaggagaccagagctgaaatcccgggtggagcggtccgcggagggccctgggctacccaccggtgttgaacgtgagaggggctcaagaaagccaagacggtatttctctccaggagagtcccggaaaaccagcgagcggtttcgcacacaacctattacgtccgccgagcgcaaagaatccgaccggtgcacatcccactctgagacaccaacagtcgacgatgaagaaaaggtggacgagcgggctaaactctctgtggccgcaaaacgcttgctgtttcgagaaatggagaaaagctttgatgaacaaaacgtccccaagcggcgctcaaggaataccgccgtcgaacagcgcctgcggagactgcaggatcgcagcctgacgcagcctatcacaaccgaagaggtggtcattgccgcgactgagcctatacccgcaagctgcagcggcgggacccatcctgttatggctaggctgccctctcctacagttgctcgttccgcagttcagcccgcaagactgcaagcctctgcgcaccaaaaggccctagctaaagaccaaacaaacgagggcaaggagctcgctgaacagggagagcccgactccagcacactttcactggccgagaagcttgccctgtttaacaaattgtctcaacccgtttccaaagccatatccacccggaacagaatcgatacgagacagagaagaatgaatgctcgctatcagacacagcccgttaccttgggggaagttgagcaagtccaaagcggcaaattaatacccttcagcccagctgtcaacacgagtgtctctaccgtggcttccacagtggccccgatgtacgctggtgatcttcggacaaagcctccacttgatcacaatgcaagcgctactgattacaaattctccagcagtatcgagaacagcgattctcctgtgagaagcatcctgaagagccaggcatggcaaccgctcgtggaaggttccgaaaataaggggatgttgcgcgagtacggggagacagagagcaagcgagcactgactgggcgcgatagcggaatggaaaagtatggctcttttgaagaagccgaagctagctacccaattctgaaccgggctcgggaaggtgacagtcacaaggagagtaaatacgctgtacctcgccgaggaagcttggaaagggccaatcctcccatcacacacctgggcgacgagcccaaagagttttccatggcgaagatgaacgcccagggtaacctcgacctgcgggatagattaccatttgaagaaaaggtagaagttgaaaatgtgatgaagcgcaaattttctctgagagccgccgagttcggagaacccacatcggaacagactggcactgccgccggcaagactatcgcacagactaccgcgcctgtttcatggaaaccccaggactctagtgagcagcctcaagaaaaattatgcaaaaatccttgcgcgatgtttgctgctggggaaatcaagacacccaccggcgaaggacttcttgactccccaagtaaaaccatgtccataaaggaaagactcgccctcctgaaaaagtcaggtgaggaagattggcggaatagactcagcagacgtcaggaggggggtaaggcacccgcctctagtctgcatacccaggaagctggccgctcactgatcaaaaaacgcgtgacggaaagtcgggagagtcagatgaccatcgaagagagaaagcagctgatcacagttcgggaagaggcctggaagactcggggacgcggcgcagccaacgattcaacgcaattcacagtggccggcaggatggtcaaaaaaggcctggccagtcctactgctattacccctgtggcctcacctatctgcgggaagactcgtggaacaacccctgtgtcgaagcctctggaagatatcgaggcccgcccagatatgcagctggaaagtgacttgaagctggacagattggagacattcctccgtaggctgaacaataaggtgggtggtatgcatgagacagtactgactgtcacagggaagtccgtcaaggaagtaatgaagcccgacgacgatgaaactttcgccaaattctatcgcagcgtcgattacaatatgccacgcagcccagttgagatggatgaagactttgatgtgatatttgatccctacgcccctaaactgacttcgagtgtggctgagcacaaacgagccgtgagacctaagcggagagtgcaggcatccaagaatcctttaaagatgctggccgcgcgtgaagatctcctgcaggaatataccgaacagcgtttgaacgttgcttttatggaatcaaagcggatgaaggtcgagaaaatgtcaagcaactcaaatttttctgaagtaaccctagcaggcctggcttccaaggaaaatttctccaatgtatctttgcgctcagtgaatctaactgaacagaattctaacaactctgccgttccttataagagactgatgctgctccaaatcaaagggaggcgccatgtccagactagacttgtggagccaagggccagcgccctgaatagcggtgattgcttcctgctcctaagcccacactgttgctttttgtgggtgggtgagtttgcgaacgtgattgagaaggcgaaggccagtgaattggcaacattgattcagaccaaacgtgaacttggttgtagggccacctacattcagactattgaggaaggcatcaacacccacacccatgcagctaaggatttctggaaactgctaggggggcagacgtcctatcagtccgccggcgacccaaaagaggatgagctttacgaggccgctataatcgagaccaattgcatttaccgcctgatggatgataagttagtgcccgatgacgactactggggcaagattccgaaatgttcactgctccagccgaaagaggtgctggtcttcgattttggatcagaggtctacgtgtggcacggcaaggaagtgactctggcgcagaggaagatcgcattccagcttgctaagcatctgtggaacgggactttcgattacgagaattgtgatattaacccgctggaccccggggagtgtaaccctctgatccccaggaaagggcaagggaggccagactgggcaatcttcgggaggctgaccgagcataatgaaactattctgtttaaagaaaaattcttggactggacagagctgaaaaggtcaaatgagaagaatcctggggagctggcacaacacaaggaagatccgcgtactgatgttaaagcatatgatgtgactcgtatggtgagcatgccccaaaccacagctggtacgatcttagatggtgttaatgtggggcggggatacggactggtcgagggccatgataggcgccagtttgagatcacatcagtgtcggtggatgtgtggcacatcctcgagttcgactatagccggctgcccaaacagtctatagggcagttccatgaaggcgatgcatacgtggtcaaatggaaatttatggtaagcacggccgtcggaagcagacagaagggggagcatagtgttcgggccgctggtaaggaaaaatgcgtctatttcttttggcaaggtaggcacagcaccgtgtcggagaagggcacatcggctcttatgacggtcgagctggacgaggaacgcggcgctcaggtgcaggtgctgcaagggaaagagcctccttgctttcttcagtgtttccagggagggatggtggtacatagtgggaggcgtgaggaggaagaggaaaacgtgcaatccgaatggaggctgtactgcgtgaggggagaagtgccagtcgaaggcaacctgttagaagtagcctgccactgttcgagtttacgttctagaacctcgatggttgttcttaatgtgaataaggctctcatttatttgtggcacggatgtaaagcacaagcgcataccaaagaagtcggacggaccgcggccaacaagatcaaagagcagtgcccattggaagcggggttgcactctagctccaaggtgacgattcacgagtgtgacgaggggtcagaacctcttggtttttgggacgcattagggaggcgggataggaaagcctatgactgcatgctccaggacccaggctccttcaattttgcaccgcgcctgtttattctatcctcctcatctggagacttcgcagcaaccgaattcgtttaccccgctcgtgccccttcagtcgtctcttctatgcccttcctgcaggaggatttgtatagtgctcctcaacctgccttgtttttagtcgacaaccaccatgaggtttacctgtggcaaggctggtggcccatcgaaaacaagatcactggatctgctcggattagatgggcttctgacagaaaatccgccatggaaaccgtgctgcagtactgcaagggtaagaacctgaagaagcctgcacctaagagctatctcatccacgccggtctggaacccctcactttcaccaatatgttccctagctgggagcacagggaggacattgcagagattaccgagatggacacggaggtatcaaatcagattacactggtggaggatgtgcttgcaaaattatgcaagacgatctacccgttagctgacctcctggccaggcccctccccgagggcgttgaccccctgaagctggaaatctacctgactgatgaagatttcgagtttgccctggatatgacacgggatgagtataatgcgctgccagcctggaagcaggtcaatctgaaaaaggccaaaggactgttctag

SEQ ID NO: 17554 - DNA, 5367 bp, Artificial Sequence
  Description of Artificial Sequence: Synthetic coding sequence
atgaaacgaaaagaaagaatcgctcggcgactggaaggtattgagaacgacacccaacccattctgctgcaatcatgcacagggctagtcactcataggctcttagaggaggacactccacggtatatgagggcctccgatcctgctagcccgcatataggaagatcaaacgaggaggaagagacctcagatagtagcctggagaaacaaacacgtagcaagtactgtaccgaaactagcggtgtccacggggacagcccctacgggtcagggaccatggacacccactctttggaatccaaagctgagaggatcgcacgatacaaagcagagaggaggcgacagctcgcagaaaagtacgggctgaccttggatccggaagctgattctgagtacttatcccggtataccaagagccggaaggaacccgacgccgtcgagaagcggggtggcaaatctgacaaacaggaggaaagtagcagggacgcttccagcctctacccgggaaccgagacgatggggctgcgtacatgtgcaggagaatcaaaagactacgcgcttcacgtgggggacggatcaagtgacccagaggtcctgctgaatatcgagaatcagcgtcgcggccaagagctctccgccacgagacaggcccacgacctgtcaccagccgcggaatcttcctctacattctctttcagcgggcgggactccagtttcactgaagtgccaaggagtcctaagcacgctcatagtagttctctgcaacaggccgccagtcgctctccgagcttcggagacccccagttgagcccggaagcaaggccaaggtgtaccagccacagtgagaccccaaccgtggatgatgaggagaaagtcgacgagagggcaaaactgtcagtggccgctaagcgactactgtttagggaaatggagaagagcttcgatgagcagaacgtccctaaaaggcgctctcgaaataccgctgtcgaacaaagactgcggcggttacaggatcggagtctgactcagcccatcacaactgaagaggtggttatcgcagctaccctgcaggcatccgctcaccagaaagcacttgctaaggaccagaccaacgagggtaaagaactggctgagcagggcgagccagattccagcaccctaagcctggcagaaaagctggccctgttcaacaaactctctcagcctgtgtcgaaagcgatctccactcgaaatcgcatagatacgagacagagacgcatgaatgctaggtaccaaactcagcccgtcaccttgggcgaggtcgaacaggtgcagtcaggtaaactaatccccttctcacccgccgtgaacacgtccgtttccacagtggcatcaactgtggctcccatgtacgcgggggacttgagaacgaaacctccattagatcacaacgcttcagccacagattacaaattctcctcctccattgagaactctgacagtccagtgaggagtatcctgaagtctcaagcatggcagcccctagtggaaggcagtgagaacaaggggatgctccgggaatacggagagactgagagcaaacgcgccttgaccggacgtgactccggcatggagaagtatgggagcttcgaagaggccgaagcttcataccctattttaaatcgcgcaagggaaggcgattcccacaaggagtcaaagtacgccgtgccacggaggggaagtctagaacgtgctaaccctcccattacccacctgggcgacgagcccaaagagttcagtatggcgaaaatgaatgcacaaggcaacctcgacctgagggaccggctgccatttgaggagaaggtcgaagtggagaacgtgatgaagagaaagttctctctgcgagcggctgaattcggagagcccacctcagaacagactggaacagccgctgggaagactattgcccagactaccgcacccgttagttggaagccccaggactcatctgagcagccgcaagaaaagctgtgtaaaaacccttgcgccatgttcgcagctggagagattaagaccccaactggcgagggcttactcgattctccatctaagaccatgtccattaaagagcggctggccctccttaaaaaaagtggtgaagaagactggagaaatcgcttatcacgcaggcaggagggcggaaaagcaccagcaagcagcctccacacgcaagaggctggacggtccctgatcaagaaacgtgtgacggaatctcgggaatcgcagatgaccattgaggagagaaaacaactgattactgtcagagaggaggcatggaagacacgcgggaggggggccgccaacgatagtacacaattcactgtggccggaaggatggttaaaaagggcctggcaagccctaccgctataacgcctgtggcctcccccatctgcggcaaaactagaggcactacgccagtgagtaagcctctggaagatatagaagcccggccagatatgcaactagagagtgacctcaagttagatcggctagagacatttctgaggcgattaaataataaagtaggtgggatgcacgagactgtgctcactgtcaccggcaagtccgtcaaagaggttatgaaacctgatgacgatgagacctttgcgaagttctacaggagcgtggactacaacatgcctcgatcaccggttgaaatggacgaagatttcgatgttattttcgacccgtacgctccgaaactcactagttccgtggccgaacacaagagagctgtgaggccaaaaagacgggttcaggcttccaaaaacccactgaagatgctcgccgcacgagaggatctgttgcaagagtatactgaacagcgcctgaacgtcgcattcatggaaagtaagcgcatgaaggtcgagaagatgagctcaaactctaacttcagtgaagttacgctggcgggactggcctcaaaagaaaacttttcgaacgtgtctctacggagtgtgaatcttacagagcagaactccaataatagtgctgtgccttacaagcgtctcatgttgttgcaaatcaagggccgccggcacgttcagaccagactggtcgaaccccgtgctagtgctctgaatagtggagattgcttcctgctcctgagtccacactgctgctttttatgggtcggcgagtttgcaaacgtgattgaaaaagctaaagccagcgaactagccacactcatacaaacgaaacgcgagctcggatgcagggccacctacatacaaaccattgaggagggcataaatacacatacacatgcagcgaaagatttctggaagttattgggtggacagacctcttaccagagtgccggcgatcctaaggaagacgaactttacgaagcagctatcatagagaccaactgcatctatcgtcttatggacgacaaactggtccctgacgacgactattgggggaagattcccaagtgcagcttgcttcaaccaaaggaagtgctcgtgttcgactttggatctgaggtctacgtgtggcatgggaaggaggtgacactcgcccagcgtaagatcgccttccagctggccaaacatctgtggaacggcaccttcgactacgagaattgtgatatcaaccccctggaccccggagagtgcaacccactgataccaagaaagggacagggacgtcccgattgggctatctttggacggcttaccgaacataatgagactatcctattcaaagagaaatttcttgactggacggaactaaaacgctctaacgaaaaaaatcctggcgaactagcacagcacaaggaggacccacggaccgacgtgaaggcatacgacgttactcgcatggtatccatgccccagacaacggctggtaccatcctggacggcgttaacgtgggccgtggctacggcttggtggagggccatgaccgtaggcaatttgaaatcacttctgtatctgtcgacgtttggcacattctggagtttgattactcacgcttgccaaagcagagcattggacaattccacgaaggggatgcctacgtggtgaaatggaaattcatggtctctaccgcagtgggatcaaggcaaaagggggaacactctgttagggcagcaggcaaggaaaagtgtgtctacttcttttggcaaggcagacattcgaccgtgagtgaaaaaggcacttctgccttaatgacggtggaactggatgaggagcggggggctcaggtccaggtgttacaggggaaagaacccccatgcttccttcagtgttttcagggtgggatggtggtacacagcggtagacgtgaggaagaagaggagaacgtccagagtgagtggcgactgtattgtgtgaggggagaggtgcccgtcgagggaaacctcctggaagtggcttgccactgctctagcctgagatcacgtacttccatggtcgttcttaacgtgaataaggcgctgatttacctgtggcacggatgcaaagcgcaggcacacacaaaggaggtaggccgcacagcagccaataagatcaaggagcagtgccctcttgaggccggactgcacagtagtagtaaagtgactatccacgagtgtgacgaaggcagcgagcccctcgggttctgggacgccctgggcagacgggacagaaaagcctatgactgtatgctacaggatcccgggagcttcaatttcgccccccggttattcatcctgagctcttccagtggagacttcgcagcaaccgaattcgtatacccagcaagagcaccctctgtcgtatcttctatgccgtttctgcaggaggatttgtacagcgcgcctcaaccagcgcttttcttggtggacaaccaccacgaagtctacttatggcaaggatggtggcctatagaaaacaagatcacgggatccgctcggattagatgggcatcagatcgaaagtctgctatggagacggtgctacaatactgcaaaggcaagaatttgaagaagccggcccctaaaagctacttgatacatgcaggcctggagccccttaccttcaccaatatgtttccatcatgggagcatagagaggacatcgctgaaatcactgaaatggacacagaagtttccaaccagattacactggtggaggacgttttagcaaagctctgcaagaccatataccctctggccgatttgctggctcgcccactgcccgaaggagtggatcctctgaagctggagatctacctgactgatgaagatttcgagtttgcgttggatatgacgagagacgagtacaacgcgttgccagcctggaagcaggtgaacctcaagaaagctaagggtcttttttag

SEQ ID NO: 17555 - DNA, 3387 bp, Artificial Sequence
  Description of Artificial Sequence: Synthetic coding sequence
atgtttgctgccggggaaataaagactcctacaggagaagggctcctggatagtccgtcaaagactatgagcatcaaggagagattggcactgctgaaaaaaagtggggaagaagattggcggaaccggctgagtcggcgacaggagggaggtaaagcgcccgcatccagtctgcacacacaagaagccgggaggtctcttataaagaaggaggagggcggagttgcggatgattcagctatttctaacctcttgtggcgcgtaaccgagtccagagaaagccagatgaccattgaggagcgtaaacagctcattacagtaagggaggaagcttggaaaaccagaggccggggagcagcaaatgactctacccaattcactgtggctggaaggatggtgaaaaagggactcgcttctcctacagccattactcctgtcgcttcacccatttgtggaaagaccagagggacaaccccggtttccaagccgttggaggatattgaagctagacccgatatgcagctggagtctgacctgaagctggatcgactggagactttcctgaggagactcaataacaaagtcgggggtatgcatgaaaccgtgctgactgtgaccggcaaaagtgttaaggaagtgatgaagcctgatgatgatgaaacattcgctaagttctaccgctctgtagactataatatgccgcgctcccccgtcgagatggacgaggattttgatgtgatctttgacccttacgcccccaaactcacttcatctgtagcagagcacaagcgggccgtgcggcccaagagacgtgtccaggcgtccaaaaacccccttaaaatgctggctgcccgcgaggatttactgcaggagtacacagagcagaggctgaacgtagccttcatggagagtaagaggatgaaagtggagaaaatgagttcaaattcgaatttctcggaggtcacactggcaggactggcatcaaaagagaacttttcgaacgtaagcttgcgatcggtcaatcttactgagcaaaattccaacaactcagctgtcccctacaaacgtctgatgcttctccagatcaaggggagacgacacgtacagacaaggctagttgagccacgagcctcagccttgaattctggtgactgtttcctgctgctctctcctcactgttgctttctgtgggttggtgagtttgctaacgtgatcgaaaaggcaaaagcaagcgagttggctacactgatccagaccaagcgcgaattaggatgtcgggctacttacatccagaccatagaagagggaatcaacacccacacgcatgccgcaaaggacttttggaagctgctcggtggacaaacatcctaccaatcagccggagatcctaaggaggatgaactgtacgaggccgctatcatcgaaacaaattgtatatatcgtttaatggatgacaaactggtacccgatgatgattattggggaaagattccaaagtgttcccttctccagcctaaggaagtcctggttttcgattttgggtctgaggtctacgtctggcacggcaaggaggtaactttagcccaaagaaagatcgctttccaattggctaagcacttgtggaacggcacattcgattacgagaattgtgacatcaaccctctagacccgggcgaatgcaatcctttaattccacggaaagggcaagggcgacctgactgggccatctttgggcgcctcacagagcacaatgaaaccatcctctttaaagagaaattcctggactggaccgagctgaagagaagcaatgagaaaaaccccggcgagctagcccagcacaaggaggatccccgcacagatgtgaaagcgtacgatgtgaccagaatggtgtccatgccgcagactacagcagggaccattctcgatggtgtgaatgtgggcagggggtacggtcttgtggagggccacgacagacgccagtttgaaataacgtccgtgagcgttgacgtgtggcacatacttgagtttgactattcccgcctcccaaagcaaagtatcggtcagtttcatgagggagatgcttatgtagtcaagtggaaatttatggtgagtactgccgtaggctctagacaaaaaggtgagcattctgtcagagctgctggcaaggaaaaatgcgtgtacttcttttggcagggcagacattccacagtgagtgaaaaagggacaagtgccctgatgacagtcgagctagatgaggagcgcggcgcacaggtccaggtccttcaggggaaggagccgccttgtttcttgcagtgcttccaaggcggtatggttgtacatagcggccgcagagaagaagaagaagagaacgtccagtctgagtggcgcctatattgcgtgagaggtgaagtgcctgtagagggtaacctgctggaagtggcatgtcattgtagcagtttacggagtagaacctccatggtggtgctgaacgtcaataaagccctaatttatctctggcacgggtgtaaggctcaggcccacactaaggaggtgggtcggaccgcagcaaacaagataaaggagcagtgcccactcgaggccggccttcacagctcaagtaaggttaccatacatgaatgtgatgaaggctctgagccattaggcttctgggatgctctgggacgcagggatcgcaaggcctacgactgcatgctccaggacccaggcagcttcaattttgctccacggctttttatattgagctcttcatctggcgatttcgcagcaactgagtttgtgtaccccgcccgcgcaccttctgttgtctcttctatgcccttcctgcaggaggatctgtattcagccccgcagccggcgctgtttctggtcgacaaccatcacgaggtgtacctgtggcaaggatggtggccaattgaaaacaagattacagggtccgcgcgaattaggtgggccagtgacagaaagtctgccatggaaacagtgctccagtactgtaagggtaaaaatctgaaaaagccggcaccgaagtcctacttgatacatgcgggccttgagccgttgacctttaccaacatgttcccttcatgggagcaccgtgaggacatcgctgaaattacagaaatggacactgaagtgtcaaaccaaatcacactggtggaagacgtgttggcgaagttgtgcaaaacaatctatccactcgcagatttgctcgccaggccacttcctgagggagtcgacccactgaagctggagatttacctcactgacgaggattttgaatttgcattggacatgacaagagatgaatataacgcactcccagcatggaaacaagttaacttaaaaaaagcgaaaggactgttttag

SEQ ID NO: 17556 - DNA, 2301 bp, Artificial Sequence
  Description of Artificial Sequence: Synthetic coding sequence
atgaagcgcaagtttagccttagagccgccgagttcggagaacccacctcggaacaaacagggaccgctgcgggcaaaacgatcgcacagacgactgcccccgtgagctggaaacctcaggacagctcggaacagccacaggagaaactgtgcaagaatccctgcgcgatgtttgcagccggcgagatcaagacgccgacaggagagggtctcctcgattccccgtccaagacaatgtcgattaaagaacggctggcgcttctcaaaaaatccggcgaagaagattggaggaatcgtctctcacgccgacaggagggggggaaggcacccgcatcctctctgcacacgcaggaggccggcagatcactaattaaaaaacgggtcacagagagccgtgaaagtcagatgactatcgaggagaggaaacaattaattacagtgagagaagaagcctggaagactcgggggcggggagcagccaatgacagcacacaatttacggtcgccggcagaatggtgaagaagggactggcttcgcctacagccatcacccccgtggcgtccccaatatgcggcaaaacccggggaaccactccagtgagcaaacctctggaagacatcgaagctcgcccagatatgcaattagagtccgatctgaagctggataggctggagacattcctccgcagacttaacaacaaagtgggcggcatgcatgagacggtgctcacagtcacagggaaatccgttaaagaggtcatgaagcccgacgacgatgagacattcgccaaattctaccgctctgtggactataacatgccacggagcccagtggaaatggacgaagattttgatgtaatctttgacccctacgcacccaaacttacaagcagtgtggcagaacacaagcgggccgtgaggcccaaaaggcgtgtccaggccagcaaaaaccccctcaagatgctggctgcccgcgaggatctgcttcaagaatacacagaacagcgactgaatgtggctttcatggaaagcaagcggatgaaggtagagaaaatgtcgtccaatagcaatttctctgaggtgacgctagccggcttggcatccaaggaaaacttttccaatgtgtcactccgcagtgtgaacctcaccgagcagaacagtaacaacagtgccgtgccttacaagcgtctgatgctgctgcagataaagggaaggagacacgtacaaaccagactcgtggaacctcgcgcatcagcacttaactcaggtgactgctttctgctgttgtcaccgcactgctgtttcttgtgggtgggagagttcgcgaacgtgattgagaaagcaaaggccagtgaactggctacactgatccaaactaagcgggaattggggtgccgagcgacttacatccaaactattgaggagggtattaatacacatacacacgcagccaaagatttctggaaacttctgggcgggcagacttcttaccagagcgcgggcgaccccaaagaagacgagctgtatgaggcagcaatcatagagaccaattgtatttacagactgatggacgacaaactggttcctgacgacgactactggggaaagatccccaaatgctcccttctccaaccaaaagaggtcctggtttttgactttggatcagaggtttacgtttggcatggtaaggaagttacgctagcccagcgaaaaatagcctttcagctggctaagcacctgtggaatggtacgtttgattatgaaaactgcgacattaatccactggaccccggagaatgcaatcctctgattcccagaaagggacagggtaggcctgactgggcaatctttggcagactgactgagcacaacgaaacaatattgtttaaagaaaagttccttgactggaccgagctgaaacgttcaaacgaaaaaaatccgggcgagttggctcagcacaaggaagacccaaggaccgatgttaaggcctatgacgttacgcgaatggtgtcaatgccccaaactacagctggaaccatactggacggcgtgaacgtggggcggggatatggattggtcgaaggtcatgaccgaaggcaattcgagatcacgtccgtaagcgtggatgtgtggcatattctggagttcgactacagtaggctgccaaaacagtccattggtcaattccacgaaggcgacgcctatgtggtgaagtggaaatttatggtttcaacggctgtattaagagcctggaggggcgcccgagggcgagagtttgccggatccggtcttagtttatag

SEQ ID NO: 17557 - DNA, 1758 bp, Artificial Sequence
  Description of Artificial Sequence: Synthetic coding sequence
atgaatagttccgacgtctcttcgcttaaacatcccagctctcttgcatcccccaccgccatcacccccgtagcctcacccatttgcgggaagacacgaggcacaacgccagttagtaaaccccttgaggacatagaggcccgccccgatatgcaactggagagcgatctcaagctggacaggctagaaacattcctgcgacgcttgaacaacaaagtgggcgggatgcatgaaactgtcctgactgtcactggtaagagtgtgaaagaagttatgaaaccagatgacgatgaaacttttgcaaagttttacaggagtgtagactataatatgcctcgaagccctgttgaaatggatgaggacttcgatgtaattttcgacccttacgcccccaagctcacgagcagtgtggctgagcacaaacgtgctgtacggccaaagcgtcgtgtccaggcctctaaaaacccactgaaaatgctggccgccagagaggatctactgcaagagtacaccgagcagcgccttaacgttgcgtttatggaaagcaagcgcatgaaagtggagaaaatgagctcaaacagtaacttctctgaagtcacactggctggtctggccagtaaggaaaactttagcaacgtgtcgctgaggtccgtgaatctgactgagcagaattccaacaactctgccgtcccatacaagcgcctgatgttacttcaaatcaagggccggaggcacgtacaaacgagattggtcgagccaagggcaagtgccctcaacagcggcgattgtttcctactccttagcccacattgttgcttcttatgggtcggagagttcgcaaatgtcatagaaaaagctaaagccagcgaactggccaccctaatccagaccaaaagggagttgggctgccgtgccacgtatatccaaaccatagaagaaggaattaatactcacacccacgcagccaaggacttttggaagctgctgggagggcaaacaagctaccagagcgccggcgaccccaaggaagacgagttatatgaggccgccatcatcgaaacaaactgtatctatcgactgatggacgacaaactcgtgcctgacgatgattattggggcaaaatccccaagtgcagcctgctgcaacctaaggaggtactggtgttcgattttggaagcgaagtctatgtctggcacggaaaagaggtaacactcgctcagcggaaaatcgctttccaacttgcgaaacatttgtggaatggcacattcgattatgagaattgtgacattaatccgctcgatcctggcgaatgtaaccctctcatcccacggaaagggcaaggccggcctgactgggcgatcttcgggcgccttacagagcataacgagactatattgtttaaagagaagtttctggattggaccgagctgaagcgatctaacgagaaaaatcccggggagttggcccaacacaaagaggacccacgcaccgacgtgaaggcatacgatgttacccgcatggtctccatgccccagactaccgccggcaccatattagacggagtcaacgtggggcggggctatggccttgttgaagggcacgataggaggcagtttgaaatcacttccgtctctgttgatgtttggcacattctcgagttcgattattcaagactgcccaagcagtccatcggtcagtttcacgagggtgacgcttatgtggtcaagtggaaatttatggtgtccaccgcagggtag

SEQ ID NO: 17558 - DNA, 636 bp, Artificial Sequence
  Description of Artificial Sequence: Synthetic coding sequence
atggtcgcgcataaccaagtggccgctgacaacgcagtgtcaaccgcggccgagcccagacgtcggcccgaaccctcctcaagtagttccagtagcccagcggctcccgcccgcccccgtccctgcccggccgtgccggccccagcgcccggggatactcactttagaacattcaggagtcatgctgactacagacgcatcactagggccagcgctctgctggatgcatgtggattttactggggtccattgagtgtgcatggcgcccatgaacgccttagggccgagcccgttgggacctttctggtaagagacagtcgacaaaggaattgctttttcgccctcagcgtgaaaatggcctcaggtcctacttccattcgcgtacactttcaggctggcaggttccaccttgatggatcgagagagtcattcgattgtcttttcgagctgcttgagcactatgtggcagctccacggaggatgctgggcgctcctcttagacagcggagagtgcgacctttacaggagctgtgcaggcaaagaatcgtcgccacagtgggcagagagaatctggccagaatcccattgaatcccgtgctgagggattatctgagcagtttcccattccagatttag

SEQ ID NO: 17559 - DNA, 678 bp, Artificial Sequence
  Description of Artificial Sequence: Synthetic coding sequence
atggtcacacactcaaagtttccagccgcagggatgtcacggcctctagacaccagcttacgactgaaaaccttcagctcaaagtcggagtatcagttagtggtaaatgctgtgcgtaaactccaggagtctgggttctactggtcagcagtgacaggtggtgaagcgaacctcttgctatctgcagagcccgcaggaacgttcttgatccgagacagctcggatcaacgtcatttcttcaccctgtcggtgaagactcagtctggcacaaaaaatttaaggattcagtgcgaaggtggtagcttcagcctgcagtccgaccctagatcgacccagcctgtacccagattcgactgtgtcctgaagctcgtccatcactatatgcccccccccggcgcacccagctttccctctccaccaaccgaaccttctagcgaggtccccgagcagcccagcgcccaaccgctgccagggtcaccaccgcgccgtgcatactacatctattccggcggcgagaaaatacctctagtcctgagtcgcccactctcaagtaacgtcgctacgttacagcacctctgtagaaaaaccgtcaatggtcaccttgacagttatgagaaggttactcagttacccggtccaattcgcgaattcctggaccagtacgatgcgcccctgtag

SEQ ID NO: 17560 - DNA, 1302 bp, Artificial Sequence
  Description of Artificial Sequence: Synthetic coding sequence
atggccgaactccggccctctggtgctcccggtccgaccgcgcctcccgcccctggcccaacagcccctccagccttcgcctcacttttcccacctggtttgcacgcgatctatggggagtgccgaaggctttatcctgaccagcccaacccattacaagtcactgccattgtcaaatactggcttgggggtcccgacccacttgattacgtatccatgtatcgcaacgtggggagtccaagtgcgaacattcctgaacattggcattacatctctttcgggctgagcgacctctacggcgataatcgggtgcatgagtttaccggaacagacgggccttctgggttcggatttgaactgacattccgcctaaagagggagaccggagagtcagcgccccctacctggccagccgaattgatgcaaggcctggctagatacgtgttccagagtgaaaacacattttgctcaggcgatcatgttagctggcactcacccctcgacaacagtgaatcacgcatccagcacatgctgcttaccgaggacccgcagatgcagcccgttcagactccattcggtgtggtcacatttttgcagatagttggggtctgtacagaggagttgcacagcgctcagcagtggaatgggcagggaatactagagcttctgcgaacggtaccaatcgctggcggcccctggctgattactgacatgcggcggggagaaactatctttgaaattgacccacatctgcaagagagagtggataaaggtatcgagaccgatggctctaacctaagtggcgtatctgctaagtgcgcttgggacgacctcagcagacctcctgaagacgatgaggactctcgcagtatctgtatcggcacgcagccacggcgtctctccggaaaggatacggaacagattcgggagacgctgaggaggggtttagagatcaacagtaaaccggtgctgccccctatcaaccctcaaagacagaatggactcgcacacgatagggcaccctcgagaaaggactcactggaatccgacagctccactgcgattatccctcacgaacttatacgcaccagacagcttgaatccgtgcatctcaaattcaatcaggagagcggcgccctgattccactttgtctacgtggacgtctgctacacggccgccactttacatacaagtccattactggagatatggcaataactttcgtctccactggcgttgaaggtgcctttgccacagaggagcacccgtacgccgcacacggcccttggctccagttatag

SEQ ID NO: 17561 - DNA, 1455 bp, Artificial Sequence
  Description of Artificial Sequence: Synthetic coding sequence
atggccgagctccgaccctctggagccccaggacccacagcacccccagcccctggacccaccgccccccccgcctttgcgagtctgtttccacccggattgcacgccatttatggtgaatgtagacgtttgtacccagatcagcctaatcccctgcaagtgaccgcaatcgttaaatactggctcggtgggccggacccccttgactacgtctcaatgtatcgcaatgttgggtctccgtccgccaacatccccgagcactggcattatatttccttcgggctttccgatctctatggggacaaccgggtgcatgagtttaccggcacagacggaccgtccggttttggattcgagctcaccttcaggcttaagcgggagaccggagaaagcgccccacctacctggccggcggaactgatgcaaggcctagcaaggtacgtgtttcagtctgagaacacattttgttccggcgaccacgtctcctggcactcacccttagacaactccgagtcacggatccagcatatgcttttaacagaggacccacaaatgcagcccgtgcagactcccttcggcgtcgtgacattcctgcagatagtaggtgtttgcactgaggagcttcattcggctcagcagtggaacggccaggggatcctggagttactccgcactgtgccaatcgccggcgggccgtggctcataactgacatgcgtcgcggtgagactatatttgaaatcgatccgcatctgcaggagcgagtggataagggaattgagacagatggatctaatctgtctggggtcagcgctaagtgcgcttgggatgatctctcaagacccccagaagacgatgaggactctcggtctatttgcatagggactcagcccagaaggctgtcaggcaaagacactgagcagatcagggagaccctgcggaggggcctcgaaattaacagcaagccagtccttcctcccatcaatccacaacgacaaaatggactggcacacgatcgggctcccagtagaaaagacagtctcgaaagcgactcgtccaccgccatcataccccacgagctaatccgcacacgccagctggagagcgtgcacctaaagttcaaccaggagtctggagcattaatacctctgtgtctcagaggtagacttctgcatggacggcatttcacctacaaaagcataacaggcgatatggctatcaccttcgtctctaccggcgtcgagggcgcattcgcaacggaggaacatccgtacgcagcccacggaccttggctgcagattttgttgactgaggagttcgtggagaagatgctggaggatctggaggatctgacaagcccggaagaattcaaacttcctaaggagtatagctggcctgaaaagaaactcaaagtgagcattcttcctgacgtcgtgtttgattccccactgcactag

SEQ ID NO: 17562 - DNA, 240 bp, Artificial Sequence
  Description of Artificial Sequence: Synthetic coding sequence
atggcaaggagccggctgaccgcaacttccgtatcacaagtgcaggagaacgggttcgttaaaaagctcgagcccaaatccgggtggatgacgttcttggaggtgaccggcaagatctgtgagatgctcttttgccctgaagcaattctattgacacgcaaagacactccgtattgtgagactgggttgatttttcttacacttaccaaaacaatcgccaacacatatttctatttttag

SEQ ID NO: 17563 - DNA, 240 bp, Artificial Sequence
  Description of Artificial Sequence: Synthetic coding sequence
atggcgcgatccaggctgacagcgacttccgtcagccaggtgcaggaaaatggctttgtcaaaaagttagaacccaaatctggatggatgacatttcttgaagttacgggaaaaatatgcgagatgctcttttgtcctgaggccattcttctgactagaaaggatacaccctactgcgaaactggcctgatcttcctaaccctgaccaaaaccatcgctaatacgtacttctatttctag

SEQ ID NO: 17564 - DNA, 1245 bp, Artificial Sequence
  Description of Artificial Sequence: Synthetic coding sequence
atgaatttgcagcgatactggggagaaatccccattagctcctcccaaactaatcgctccagctttgatctcctccctagagagtttaggctcgttgaagtgcacgacccccctctccatcagccgagtgcaaacaagcctaaacctccaaccatgctggatatacctagtgagccttgttcgctgacgatacatacgatacaactaatccaacataaccgacggctgaggaaccttattgctactgctcaggcgcagaaccagcagcagaccgagggcgtgaagacagaggagtctgaaccgctccccagctgtcctggatctccaccgctacctgacgatctgctgcctttagactgtaaaaaccccaacgcacccttccaaatccgtcatagtgaccctgagtcagatttttatagaggcaaaggtgaaccagttaccgagctaagttggcattcatgcagacagttgttatatcaggccgtggccaccatcctggctcacgctgggttcgactgtgcgaatgaaagtgtcctggagacattgacagatgtagcgcacgaatactgccttaagttcactaaacttctccgctttgcagtagatcgtgaggccaggcttgggcagaccccttttcctgacgtgatggaacaggtgtttcacgaagtaggaatcggatcagtcctttcactacaaaaattctggcagcatcgtattaaagactatcactcttacatgttgcaaattagcaaacaactttcggaagaatatgagcggattgtgaaccccgaaaaggcaaccgaagatgcaaagcccgtgaaaatcaaggaggagcccgtctcagatattacatttcccgtgtctgaggagctcgaggccgacttggccagtggggatcaatctttacccatgggcgttctcggagcgcaatccgagcgctttcctagcaacctcgaagtcgaagcttcccctcaggccagcagcgccgaagtgaatgccagtccgttgtggaaccttgcccatgtgaagatggagccccaggagagcgaggagggaaatgtaagcgggcatggtgtactagggtctgacgtgtttgaggaacccatgtctggcatgtcagaagcgggtatacctcaaagtcctgatgattccgactcgtcttatggttctcattcaaccgattcattgatgggttcatctccagtgtttaaccagagatgcaagaaacgcatgagaaagatctag

SEQ ID NO: 17565 - DNA, 840 bp, Artificial Sequence
  Description of Artificial Sequence: Synthetic coding sequence
atgaacttgcaatcagggaaaggggagcccgtgactgagctctcatggcactcctgccgccagcttctgtaccaggccgtcgccactattctcgcccatgccggattcgactgcgcaaacgagtctgtgctggagaccttaactgacgtagcacacgaatattgcctgaagtttacgaagctgctgaggtttgcagtggatagggaagccaggcttgggcagaccccgtttccagacgtgatggaacaggtgttccacgaagtgggaattggcagcgtgctcagccttcaaaaattttggcagcatcgtataaaggactatcacagctacatgttacaaattagtaaacagctgtcagaagagtacgagagaatcgtgaaccctgaaaaagccaccgaggacgcaaagccagtcaaaatcaaagaagaacctgtatccgatatcacattccctgtgagtgaggagctggaggcagatcttgccagtggcgatcagtctctgcccatgggagtccttggagctcagagtgaacggttcccttccaaccttgaagtggaagcaagcccccaggcctcctcagccgaggtaaatgcatcccctctctggaacctggcacacgtgaagatggaaccgcaggaatctgaagagggcaacgtgtcaggccatggggtattggggtcagatgtcttcgaggagccgatgagcgggatgtctgaagcaggaattcctcagagcccagatgactctgattcttcatacggttctcattccaccgacagtttaatgggctcaagtcccgtgttcaaccaacgatgcaagaaacggatgcgcaagatctag

SEQ ID NO: 17566 - DNA, 1239 bp, Artificial Sequence
  Description of Artificial Sequence: Synthetic coding sequence
atgctacggtattggggggagatcccaatttcttcctcccaaaccaacagatccagctttgatttgctgccgcgggagtttcgtctggtggaggtgcacgaccctcccttacaccaaccgtcagcaaacaagcctaaaccacctaccatgctggatatccccagcgagccttgtagcttgactatacacactatacagctcatccagcataatagacgtctgcggaacttgattgccaccgcccaagcccaaaatcagcagcaaacagaaggcgttaagaccgaagagtccgaacccctgccttcatgccctggctctcctcccctccctgatgacctgttgcctcttgattgcaagaatccaaatgcaccctttcaaatccggcattcagatcctgaatccgatttctaccgtgggaaaggagagcctgtgacagagcttagctggcacagttgtaggcagttgctctatcaagcagttgcaaccattctggcgcatgccgggttcgattgcgctaacgaatccgtgcttgaaaccctcaccgacgttgcacatgagtattgcctcaaattcaccaaacttttgcgatttgctgtcgaccgagaggctcggctaggccagacaccatttcccgatgtgatggagcaagtcttccacgaagtggggataggtagtgttctgagcttgcagaagttctggcagcatcgcattaaagactatcattcatatatgttacagatttccaagcaactgagcgaagaatacgagcgcatcgttaatccagagaaagccacagaggatgcaaagcctgtcaaaattaaggaagagcctgtgtccgacatcacattccccgtatctgaagagctggaagctgatcttgcctctggcgaccaatctctgccaatgggggtactcggcgctcagagcgagaggttcccctctaatttggaggtcgaggcatctccccaagcaagttccgctgaggtaaacgcatcaccactgtggaacctcgcgcacgtgaaaatggagccccaggagtccgaggagggcaacgtgagcgggcatggagtcttggggagtgatgtattcgaggaacccatgagcggtatgtctgaggccggcataccccagagcccggatgatagtgatagcagctacggcagccatagtactgattctcttatggggagcagtcctgtcttcaatcagagatgtaaaaagcgcatgagaaagatctag

SEQ ID NO: 17567 - DNA, 1239 bp, Artificial Sequence
  Description of Artificial Sequence: Synthetic coding sequence
atgctgagatactggggggaaatccccatcagctcctcccaaacaaatagatcctcttttgacttgttgccgcgagaattcagactcgtagaggttcatgacccacccctgcatcagcctagtgctaataagccgaagccacccaccatgcttgatataccctccgaaccttgctccctgaccattcataccatacaactaatccagcataacagacgactccgtaacctgatcgctaccgcccaagctcagaaccagcagcagactgagggcgtgaagaccgaggagtcagagccgctaccatcttgtcctggctcacccccgttgccggacgacctgctgccattggactgcaagaaccccaacgcacctttccagatccgccattccgatccggaatccgacttttatcgaggcaagggtgagcccgtgaccgagctcagttggcacagctgtcggcagctgctctaccaggccgtggccacaatcctggcccacgcaggcttcgattgtgctaatgagtcggtgctggagaccctgacagacgtagcgcacgagtactgtttaaagtttaccaaactccttaggtttgctgtggacagggaggcccggctcggccagaccccattccctgatgtcatggaacaggtcttccatgaagtcgggattggcagtgtcctgtcgctccagaaattctggcagcaccgcataaaggactatcatagctacatgcttcagatatccaaacagctctctgaagagtatgagcgtattgtgaatcccgaaaaagccaccgaggatgccaaaccagtgaaaattaaggaagaaccggtgtccgatataacctttccggttagtgaggaactggaagccgacctggccagtggagatcaatcactgcctatgggagtcctcggcgcacaatcagagcgttttccatccaacctcgaggttgaggcaagtccccaggcttctagcgctgaggtgaacgcctcgccactgtggaacttagcacatgttaaaatggagccacaagaaagcgaggaggggaatgtaagtggacatggagtgttggggagcgatgtcttcgaggaacctatgagtggcatgagcgaggcagggatcccacagtcgcctgacgactccgactcctcttacggctctcattcaacagatagtcttatgggcagttcccctgtgtttaatcagcgatgtaaaaagcgaatgagaaaaatttag

SEQ ID NO: 17568 - DNA, 1239 bp, Artificial Sequence
  Description of Artificial Sequence: Synthetic coding sequence
atgttaaggtattggggcgaaatcccaatcagctcaagtcagaccaatcggtcctcattcgatctactccccagggagttccgactggtcgaggtccacgacccaccactgcatcagcctagcgccaataagccgaaacctcctactatgctcgatatccctagtgagccttgtagcttgacaattcacacaatccaacttatccagcataaccgcagactgagaaacctgatcgcgaccgcccaggcacagaaccaacagcaaaccgagggcgtgaagacagaagaatctgagcctctaccatcctgcccaggatctcccccattgccggacgatctgttgccattagactgcaagaatccaaacgccccatttcagatacgccatagtgatcccgagtccgacttctaccggggaaagggcgaaccagtgactgagctgtcttggcacagttgcagacagttactctaccaggccgtggccactatcctagcacacgctggattcgattgtgcaaacgaatcggttcttgaaacactgactgacgtcgcccatgaatactgtttaaagtttactaaactcctgaggttcgccgtcgacagagaggcccgtctgggccaaacacctttcccggacgtgatggagcaggtgtttcatgaagtgggaattggctccgtcctttcccttcagaagttctggcaacatcggataaaggactaccactcctatatgctccagattagtaagcagctgtccgaggaatatgagagaatcgttaaccccgaaaaggccactgaggatgctaaacccgtcaaaattaaggaggagcccgtctccgacatcacattcccagttagcgaggagctcgaggcggatctcgcgtccggcgatcagtcgctgcccatgggggtgctaggagcgcagtctgagcggttcccctctaacctggaagtcgaggcatctccgcaggccagcagcgcagaagtgaatgcatcccctctgtggaatctcgcgcatgtcaaaatggagcctcaggagtcagaagagggaaatgtgagcggccatggcgtcctgggctcggacgtttttgaggagcccatgtccggcatgtccgaggccgggattccacagagccccgatgacagtgactcatcatacggcagccacagtaccgactcactaatgggatcgagcccagtcttcaaccagagatgtaaaaagcggatgaggaaaatttag

SEQ ID NO: 17569 - DNA, 1272 bp, Artificial Sequence
  Description of Artificial Sequence: Synthetic coding sequence
atggtgggaatgtccaggttacgcaatgacagactcgctgaccccctgacaggctgctcagtttgttgtaagtccagttggaatcagctccaggacctctgtcgattggccaagcttagctgccccgccctaggaatttcaaagcgaaacctgtatgattttgaagttgagtacctctgcgattacaaaaaaataagggagcaggagtattacctcgtgaaatggcggggataccctgattccgagagtacctgggagcctcgacagaatttgaagtgcgtgcgaatcctgaagcagttccacaaagacttagagcgcgaactcctgagacggcaccaccgaagcaaaacaccgaggcacctagatccatcccttgccaactatctggtccagaaggcaaagcaacggagggccctcagacgctgggagcaggaattgaacgccaaacgctctcatctgggccgtattactgtggagaacgaggtggatctggacggtccaccgcgtgctttcgtgtacattaatgagtacagagtcggcgaaggtattacacttaaccaggtggctgtgggctgtgaatgccaagattgcctttgggcgcccactggcgggtgctgccccggcgccagtctccataagttcgcttacaacgaccagggacaggttaggttgagggccggcctccctatctatgagtgtaacagtcgctgcagatgtgggtacgactgcccgaaccgtgtcgttcagaagggcatacggtatgatctctgtatcttccgcaccgatgatgggcgcggatggggcgttcgcaccctggaaaagattagaaaaaacagcttcgtgatggagtatgttggagaaataattacctccgaggaagcagaacggcgtgggcaaatctatgatagacagggcgcaacctacttgtttgatctcgactacgtcgaggatgtctacactgtagacgcagcatattatgggaatatttctcacttcgtcaaccacagctgtgatccaaatctgcaagtttacaacgtgtttattgacaatctggacgagaggcttcctagaattgcattctttgctactcggactattagggcaggcgaggagctgaccttcgattacaatatgcaggttgatcctgtcgacatggagtctactagaatggacagcaacttcggactggccggactacctggcagtcctaagaaacgcgtgcgtatagaatgcaagtgcggaacagagtcctgtcgcaagtaccttttttag

SEQ ID NO: 17570 - DNA, 1239 bp, Artificial Sequence
  Description of Artificial Sequence: Synthetic coding sequence
atggcagagaacttgaagggttgctccgtatgctgtaagtcctcttggaaccagctccaggacctttgtagattggcgaagctgtcatgccctgccctgggaatatctaagagaaatctttacgatttcgaggttgagtatctgtgtgactacaagaagattagggaacaggagtattatttagttaaatggcggggttatcccgatagcgagtccacttgggaaccgagacagaatcttaagtgcgtgcgcatccttaaacagtttcataaggacctggaacgcgaactactgaggcgccaccacaggtcaaaaactcccagacatctggacccttctctcgccaactacctggttcagaaggctaagcagagacgtgccttgagaagatgggagcaggaattgaatgcgaagcggtcccacctgggccgtataacagtcgagaatgaagtcgacttggatggacccccgagagcatttgtgtatattaatgagtacagggtcggtgaaggtatcactcttaaccaggtcgctgtaggttgtgagtgtcaggactgcctgtgggcacctactggcggatgctgccctggagcgagccttcacaaatttgcatataacgatcagggccaggtcagactgagggccggactcccgatttacgaatgtaattcacgttgccgctgcggttacgactgtcctaaccgtgttgtgcagaaaggaatccggtatgacttgtgcatcttccgcaccgatgatggtagagggtggggagttagaactctggagaagatcagaaaaaattcatttgtgatggagtacgtgggggagattatcaccagcgaagaggccgagaggcggggccagatttacgacagacagggggcgacatacctcttcgatttagattatgtcgaggacgtctatactgtagatgccgcttattacggcaacatatctcattttgttaatcactcatgcgacccaaacctgcaggtgtataacgtctttattgataatctggacgagcggcttcccagaattgctttctttgcaacgcgcaccataagagcaggcgaagaattgaccttcgattacaatatgcaggtcgatcccgtcgatatggaaagtacacgaatggatagcaattttggcctggctggcctccctgggagcccaaagaagcgcgtccgcattgaatgtaaatgtggaacggagtcatgcaggaaatacctcttttag

SEQ ID NO: 17571 - DNA, 648 bp, Artificial Sequence
  Description of Artificial Sequence: Synthetic coding sequence
atggcctggatctcccgacttcgcgaacatctggatggaccacctagagcgttcgtatacatcaatgagtatcgcgttggggaaggcatcactttgaaccaggtggccgtgggctgcgagtgtcaggactgcctgtgggcccccacaggtgggtgctgcccaggggccagtctccacaaatttgcttataacgaccagggtcaagtgcgcctgcgcgcaggcctgccaatctacgaatgtaactccaggtgccgctgtgggtatgactgtcctaatagagttgtgcagaagggcattcggtacgatctatgcatcttcaggaccgacgacggaaggggttggggtgtacgtacacttgaaaagatcagaaagaatagctttgtcatggatcccgccctgctgaccgtgtgtttaaaattgcccgccttccccatggggaaagcttgggaaacagacctctccgtgacaggcacgctgggacgtgggtgtggcaggggagaggaccgcttgcaggagagtcccttcccagttcctgcacccagcgtcggttgcacctataagccaccgccaacctttaggaactcattttctacgtctcggctcagtgttgtcgggattcacggcctgctgcgaaggagtaaggggtag

SEQ ID NO: 17572 - DNA, 1230 bp, Artificial Sequence
  Description of Artificial Sequence: Synthetic coding sequence
atggccgagaaccttaagggatgcagtgtgtgctgtaaaagttcttggaatcagctacaggatttgtgccgtttggctaagctcagctgcccagcactaggtatctctaaaagaaacttatatgatttcgaagtagagtacgtgagattgcaagaggaccctaggactggcatactccccggggaaatggcttggattagtcggttacgcgaacacctgggagcaaccgctgaaagtcaagtgtgtgcatatcctcaagccgtcccgcaaggattgaggaagggagccgcaccggcagcccctccggtcaaggatccacccgctcccgggcccaaacttggacagctgcctggagccgagggtcaagctgaggccggagccccctcccttggagcgggagcccagtgtcaggcgcacctaggacgaatcaccgtggaaaatgaggtcgacctcgacggccccccgcgagccttcgtgtatattaacgaatatcgcgttggcgaggggatcacccttaatcaggtcgccgtcgggtgtgagtgccaggattgcctttgggcacccaccgggggctgttgcccccggcactgtactagcctgcccactatgacccgggccaggtgcggctttgagcccggatgcccatccacaagtgctacccctgccgccgcagctgctatgactgcgcaaatagtatggtatcggagggttagcgatatgacgagtgcctcgagtgcacgtatgatgggcgtcgcaggtgcctccgcaccctggcgccggttcgcgagaactgcttcttcgtggagtacctgggaaaggtccctgccacaacgaagacaatccgggggccaaatatacgatagacagggagcgacctacctgttcgacctggactacgttgaagatgtttatactgtggatgcagcctattatgggaatatctcccacttcgtaaatcatagctgcgatccgaatctgcaggtctataacgtgtttatagacaacctggacgagcgcctaccttctctgtccctgccccaggagcctagtggacaggctcggagcagccctctgataacgacttgtaaatggacgccatggacttggcgtgcgcctgcatggacccccacactcgcatggttgggctctctggctcccctgcgcagcggttccgttctgaatgcatcggtaggactatcccccgctgctaacacatcaagcagtccctag

SEQ ID NO: 17573 - DNA, 555 bp, Artificial Sequence
  Description of Artificial Sequence: Synthetic coding sequence
atggcttggatcagcaggttacgcgaacatctcggggcgactgccgaatcccaggtgtgcgcgtatccacaagccgtgcctcaaggacttcggaaaggagccgcccccgcagcccccccagttaaagatccacccgcaccggggcccaagctgggccaacttcctggggctgagggccaagcggagccagggtgcccttcaacttcagccacccccgccgccgctgccgccatgactgcgcaaattgtgtggtaccgaagggtctcggacatgaccagcgcttcctcagctcggatgatgggagttgccggagcctcggccccctggcggaggttcgcccgaacagcctcatcatggtcaacctgggaaaggagcctccctcaaaggcggcagtccggtggagcacgatccactacagtccgcgctccacccacttcgctgacttggacaacttggaggacgtgcaccccctggatgccccctacaatggccacttcccccaccctgtccacaaccgttgtgacaccaacgtgccgctgtaccacaagttcttag

SEQ ID NO: 17574 - DNA, 285 bp, Artificial Sequence
  Description of Artificial Sequence: Synthetic coding sequence
atgcgagcaggtttctccgattttcagcttatcagggaccaggtcctgttcctccaagatcaggctcaaagactaactgagtggctacagctctctggcttcgaaaatccagtaagcgaatccaccaccctctgtttgagagagcgagaaaagcgcataccaacgtgcgtcgctgtctgtgttccatctcctggaacagtgcacactgccctgctgcatcccacaacattgtctcaaagccgcagttcgagcgaggctaagatgctgataatacacacagcctag

SEQ ID NO: 17575 - DNA, 594 bp, Artificial Sequence
  Description of Artificial Sequence: Synthetic coding sequence
atggacgtgggctccaaggaggtcctcatggaatcgcctcccgactactctgctgcccctagggggaggttcggaattccatgctgccctgtacaccttaagagactactcatcgtcgtagtggtcgtcgtgttgattgtggttgtgatcgtcggggccctcttgatgggcttgcatatgtcacagaagcatacagagatggtccttgagatgagcattggcgcacccgaggcccaacagcggttggcactgtcagagcatttagtgactaccgcaacctttagcatcggtagcacaggactagtcgtatacgattatcaacaattgctgattgcatataagccagcaccaggaacctgttgctacatcatgaagatagcaccagagagtattcctagtctggaagctttgactcggaaggtacacaacttccaaatggaatgttcactgcaggcgaaacctgcagttcccacatctaagctgggccaggccgaaggcagagatgcaggcagcgcaccctctggaggggaccctgctttcctgggaatggccgtgtcgacattgtgcggcgaagtgccgctgtattatatttag

SEQ ID NO: 17576 - DNA, 576 bp, Artificial Sequence
  Description of Artificial Sequence: Synthetic coding sequence
atggatgttggctctaaggaagtgctgatggagtcccccccagactattctgctgcccctagggggcggttcggaattccttgctgtccggtgcacctgaagcgattgctcattgtggttgtggtcgtagtcttgatcgttgtggtgatagtgggcgctctgttgatgggacttcatatgagccagaagcacactgaaatggttttagaaatgtccattggggcccccgaagcacagcagaggctcgcgcttagcgagcaccttgtaacaacagccaccttctcaataggctctactggactggtggtctatgactatcagcagctgctgatagcgtataagccggcaccagggacttgctgttacatcatgaaaatcgctcctgaatctattccatctctggaggctttgacgaggaaggttcacaatttccaagcaaagccagctgtacccacgtccaagctgggccaggctgagggacgcgacgcgggaagtgcaccctccggaggggaccccgcctttctaggtatggccgtcagtacgctctgcggcgaagttcccctttactatatttag

SEQ ID NO: 17577 - DNA, 1158 bp, Artificial Sequence
  Description of Artificial Sequence: Synthetic coding sequence
atgatgatgatggccctgtcaaagacctttggtcaaaagccagtgaagtttcagctggaggacgacggagaattctatatgataggatcagaggtgggcaattacctcagaatgtttcgggggagcttatacaagcggtacccatccctatggaggcgactggctacagtcgaggaacgcaagaaaatcgtggcttcctcccatggcaaaaagactaagccaaacactaaagatcacgggtatacaaccctggccacctcggtcacactattgaaagcatctgaagtggaggaaattctggatggcaatgacgaaaaatacaaggccgtgagtatttcaacagaacctcccacatatctgagagaacagaaggccaaacgtaattcgcagtgggtgcccactttgcccaatagctcccaccacctggatgctgtgccgtgcagcaccactatcaacaggaatcggatgggtagagacaagaaacggacttttccgctttgtttcgacgaccatgacccagcagtcattcatgagaacgcttcacagcccgaggtcctcgtacctatacgactcgacatggagatagatggccagaaactccgtgatgcctttacctggaacatgaatgagaagttgatgacgccggaaatgttttccgagatcctatgcgacgaccttgacctcaatcccctcacctttgtccccgcaattgccagtgccattcgtcaacaaattgaatcatatccgaccgatagcatactcgaggatcaatcagatcagcgcgtgattatcaagcttaacatccatgttgggaacataagtttagttgatcaatttgagtgggatatgtccgagaaagaaaactcccccgaaaagttcgccctaaagttgtgctccgaattaggtcttgggggcgagttcgtgacaactattgcctattccatccggggacagctcagctggcaccaaaagacttacgcttttagtgagaaccctttgccgactgtcgagatcgctatcagaaatacgggtgacgctgatcagtggtgcccacttcttgaaacattgaccgacgcagaaatggagaaaaaaatcagagatcaggatcgaaatacaagacggatgcggcggctcgctaacacagcgcccgcctggtag

SEQ ID NO: 17578 - DNA, 1131 bp, Artificial Sequence
  Description of Artificial Sequence: Synthetic coding sequence
atgatgatgatggctctgagcaaaactttcgggcaaaaacctgtgaaatttcagctggaggatgacggggagttctatatgatcggaagtgaggtgggaaattatctgaggatgttcaggggctcactgtacaaaaggtatccctcactctggcggaggcttgcaacagtggaagaacgcaagaaaattgttgcctcatctcatgaccacggctacaccactctggcaacaagtgtgacattgctcaaggcgagcgaggtcgaagaaatcctcgatggcaatgacgagaagtataaggccgtgtccatttctaccgagccccccacataccttcgagagcagaaggccaagaggaattcacagtgggtcccaacactgcccaactccagtcatcatctggacgccgtgccttgtagcacaacgatcaacaggaacagaatggggagggacaaaaagaggacctttccgctctgttttgatgatcacgatcccgccgtcattcacgaaaatgcctcccaaccagaagtcctggtcccgatcaggctggatatggagatcgacggacagaagctgcgggacgcatttacctggaacatgaatgagaaattgatgactccagagatgttcagtgagatcctttgcgacgacttggatctgaacccactgactttcgttccagccatcgcttcagcaatccgccagcagattgagtcataccccacggattccatactggaggatcaatcagaccagagagtaatcatcaagttaaacattcacgtcggaaatattagtctggtggatcagttcgagtgggatatgtctgagaaggaaaatagccctgagaagttcgccctaaaactttgtagcgagcttggacttgggggagaattcgtcacgacaatcgcctactcgatcaggggccagctgtcatggcaccagaagacatacgctttcagcgagaaccctctccctaccgtggagattgcgatcaggaatacaggtgatgctgaccagtggtgtccactgctggaaaccctcacagatgcggagatggaaaagaagatcagagaccaggatagaaacacaagacggatgagacggctagctaataccgcgcccgcatggtag

SEQ ID NO: 17579 - DNA, 81 bp, Artificial Sequence
  Description of Artificial Sequence: Synthetic coding sequence
tggaggagactggcgaccgtggaggaacgtaaaaaaattgttgcaagcagccatgccctgatgacaatgactcagctgtag

SEQ ID NO: 17580 - DNA, 7626 bp, Artificial Sequence
  Description of Artificial Sequence: Synthetic coding sequence
atggtggctcttagtttaaagatcagcatcgggaacgttgtcaagactatgcagtttgaaccttctaccatggtgtacgatgcctgtcgcatcatccgggaaagaattccagaggcccctgccggcccaccttcggatttcgggttatttctctctgatgatgatccgaaaaagggcatctggctggaggccggcaaagccctcgattactacatgttgaggaatggcgacaccatggagtatcgaaaaaagcagaggccccttaagattcgaatgctagacggcactgtcaaaactatcatggtggacgattcaaagaccgtaacagatatgctcatgaccatctgcgccagaatcgggattaccaatcacgacgagtactctctggtgagggaactgatggaagaaaaaaaagaggaaatcaccggaacccttagaaaagacaagaccttactgagggatgagaaaaaaatggagaagctgaaacagaaactccataccgatgacgagctgaattggctggatcacggcagaacgctgcgggaacagggggtggaagagcacgaaaccctgcttctacggcgtaagtttttttattctgaccaaaacgtggacagccgagatccagtgcagttgaatctgttatatgtgcaggcgcgcgatgatatcttaaatggaagccaccccgtcagctttgataaggcttgcgagtttgccggttttcaatgtcagattcagttcggacctcataacgagcagaagcacaaggcagggtttttggacctgaaggacttcctcccaaaagagtacgtcaagcagaaaggtgagcggaaaatcttccaggctcacaagaactgcgggcagatgtccgaaattgaggccaaagtccgatacgtaaagctggctcgatccctcaagacttatggggtcagcttctttttggtaaaggagaagatgaagggaaaaaataaactcgtgcctagactgcttggcatcaccaaagagtgtgtcatgcgggtggatgagaagacaaaagaagttatccaggagtggaacctcaccaacatcaagagatgggccgcgtcacccaagagcttcaccctcgactttggtgactaccaggacgggtactattccgtccagacgactgaaggggagcagattgctcaacttattgcaggttatatcgatattatcctgaaaaagaaaaagtccaaggaccatttcggtctagagggcgatgaggagtctaccatgctggaagattccgtgtcgccgaaaaagagtacagttctccagcagcagtacaatcgggtaggcaaagttgaacacggtagtgtcgctctgcctgccatcatgcgctctggcgcctccggacctgagaactttcaggtaggaagcatgcctcctgctcagcagcagatcacaagcgggcaaatgcacaggggtcacatgccaccgctcacatcagctcagcaagcccttaccgggactataaattcctctatgcaggccgtgcaggccgcacaggctactcttgatgatttcgacaccctaccgcccctcggccaggatgcggcgagcaaggcctggagaaaaaataaaatggacgagagcaagcacgagatccacagccaggtcgatgctatcacggccggcacggcttccgtagtgaatctgactgccggggaccccgctgaaacagattacacagcagtggggtgcgccgtgaccaccatttctagtaatttaactgaaatgtcgcgcggcgtgaagctgctggcagccctgttagaagacgaggggggctccggtcgcccgttgctccaggccgccaagggtctggccggtgccgtatccgagctgttacgatccgcacagcccgctagcgcggagcccaggcagaacctcctccaggccgccggcaatgtggggcaagcctccggcgaactgttgcagcagatcggcgagagtgacacagatcctcacttccaggacgccctgatgcaactggccaaggccgtggcgagcgctgccgcggcactggtgctcaaggccaaaagcgtggcccagagaacagaggattcaggcctgcagacacaggtgatcgcagctgctactcaatgtgcactctctacatctcagctcgtcgcctgcactaaggtcgtggcaccgacaatctcttcgccagtgtgccaagagcaactggtcgaggctggaagactcgtggcgaaggcagtcgaaggctgcgtttccgcttcacaggcagccactgaggacggtcaacttctaaggggcgtgggcgccgctgctaccgctgtgactcaggcattaaatgagcttctccagcacgtcaaggcacacgccaccggtgccggaccagccggacggtatgatcaggcgactgacaccattctgacagtgacagagaacatcttctcatccatgggggatgctggagaaatggtgcgacaggcaaggatactagctcaggctaccagtgacctggtaaatgcgatcaaagcggatgccgaaggggaaagcgatctggaaaatagcaggaaactgttgtctgctgctaaaatcctggcggacgccaccgcgaaaatggtcgaggccgctaagggcgccgctgcacaccctgattcggaagaacaacaacagcgtttgagggaagccgcggagggtctgcggatggcaactaatgctgcagcacagaacgcgatcaaaaagaaactggtgcaaagactggagcacgccgcaaagcaggcagctgcctccgctactcagaccatcgctgccgcgcagcacgctgcctccactccaaaggcctcagccggcccccagcccctcctagtgcaaagctgcaaggccgtggcagaacagatcccgctgcttgtgcagggcgttcgcggctctcaggctcagccagacagcccctcagcccaattagccctcattgctgcttcacagtcctttctgcagcccggaggcaagatggtggcagcggctaaggcaagtgtcccaacaattcaggaccaggccagtgccatgcagctctctcagtgtgctaagaacctcggaactgctctcgcagagttacgtaccgctgcccagaaagcccaagaagcgtgtggacctctcgagatggactccgcactgagcgtcgtgcagaacctcgagaaggacctgcaggaggtcaaggcggccgctagagacggaaagcttaaacccctcccgggagaaactatggagaagtgtacgcaggatctgggcaactcaacaaaggcggttagcagcgcgatcgcccaactactgggagaagtagctcaggggaatgagaactacgccggaatcgcagctagagacgtggccggaggattgcgctctctggcccaggccgcccgaggcgtggctgccctcaccagcgacccagccgttcaggccatcgtcctcgacaccgcttccgacgtcctggacaaagcttcaagcctgatcgaagaggctaaaaaagcggccggccaccccggcgatcccgagagtcagcagcgactggctcaagtggctaaagccgtcacacaggccttgaacagatgcgtctcttgcctcccaggccaacgggatgtagacaatgcgctgagagcggtcggagacgctagcaagagattactcagcgattcattacctcctagcactggtaccttccaggaggctcaaagcagactgaacgaggccgccgccggcctcaaccaagccgccactgaacttgtccaggcttcaagagggacaccacaagacctcgctcgcgcatccggtcgcttcgggcaggactttagcacatttttggaggctggagtggagatggctggtcaggctccctcccaggaggatagagcccaagtcgtgtccaatcttaaggggatctccatgtccagcagcaagctgctgcttgctgcaaaggcgctatccaccgaccccgcggcaccaaatctcaaatcccagcttgccgctgccgctcgcgcagtgacggatagcattaaccaactcattactatgtgcactcagcaggccccgggccaaaaagaatgtgataatgcactgcgcgagcttgagacagtcagagagctgctggaaaaccccgtacaacccattaatgatatgtcttattttggttgtttggactccgtcatggaaaacagcaaagtgctgggggaggcaatgaccggaatcagccaaaacgcaaaaaacggcaatcttccagaatttggtgacgccatctcaaccgcctcaaaggccctatgcggattcaccgaggcagccgcacaggcagcttacctggttggggtaagtgatcctaactcccaggcagggcagcagggactcgtagagccaacacagttcgctcgcgcaaatcaggcgatccaaatggcatgtcaatctctgggtgagcctgggtgcactcaggcccaggtgctatccgctgccacgattgttgctaagcacacttccgccctttgtaacagctgcagactcgcgtctgcaagaacaacgaacccgaccgccaagcggcagttcgtgcagagcgccaaagaggtggcaaattccactgccaatctcgtcaagacgattaaggccctggacggggcctttactgaagagaatagagcacagtgcagagccgccacagcaccattgttggaggcggttgataacctgtctgctttcgcaagcaatcctgaatttagttccatacctgctcagatttctccagagggcagggcagcaatggagcccatagtcatcagcgccaagacgatgctggaaagtgccggaggtttgattcagacggcaagagcactggctgttaacccacgcgaccccccttcatggtccgtgctagccggtcactccaggaccgtgagcgacagcattaaaaagcttataacctctatgcgggacaaggcacccggccagctggaatgcgagacagccatagccgctttgaacagctgtctcagagaccttgatcaagcgtccctagccgccgtgagccaacagttggcccctcgcgaagggatctctcaggaggccctccatacacagatgctcacagctgttcaagagataagccacctgatcgagcccctggctaacgcagctagagccgaagcctcccaactgggccacaaagtgagccagatggcgcagtatttcgaacccctcacactggctgcggtcggagctgccagcaaaaccttgtcccaccctcaacagatggcccttctggaccagaccaaaacactggcagagagtgccttgcagctgctctataccgccaaggaagcaggcggaaatcccaagcaggcagctcacactcaggaggcccttgaggaagccgtccagatgatgactgaagcagttgaagacctgacaaccacactcaatgaggcggctagtgctgcaggcgtcgtcggcggcatggttgactccattacacaggccataaatcagttggacgagggacccatgggggagcctgaaggcagtttcgtggattaccaaaccactatggtcagaaccgccaaggctatcgcggtgacggtgcaggaaatggtgacaaaatctaatacctctcctgaggagctcggccccctggctaatcagctgacttccgattacggaagactcgcatcagaggccaaacccgctgctgttgcagctgaaaacgaggagattggctcccacatcaagcaccgcgtgcaggagttagggcatgggtgcgctgctcttgtgactaaagcaggcgccctccagtgcagcccgtctgacgcttatacgaagaaggagctgattgagtgtgctcgtcgagtgtccgagaaggtgtctcatgtgctagccgccctccaagcaggaaatcgcggtactcaggcctgcatcacagcggctagtgccgtgagtgggattatcgctgacctggacactaccataatgttcgccaccgctgggaccctcaaccgtgaggggaccgaaacatttgccgaccatcgagagggaattctgaaaactgctaaggtgttggttgaggatacaaaagtgctggttcagaacgcggcaggctcccaggagaaactcgctcaagcagcacagagctctgtcgctacaattacccgattagcagatgtagttaaattgggcgctgcaagtctaggtgccgaggaccccgagacgcaggttgtgctcataaatgcagtaaaagatgtggccaaagccctgggggacctgatatctgcaaccaaggcagcggctggcaaagttggcgacgatccggctgtttggcaactcaaaaacagtgcaaaggtgatggtgacaaacgtaactagtcttctgaagaccgtgaaagcagtcgaggatgaagccactaaaggcacaagagccctggaggctaccacagaacacatcaggcaggagctggccgtcttctgttcccctgagccaccagccaagaccagcacgcccgaggacttcattaggatgaccaaaggcattaccatggccacagccaaggctgtcgctgcgggcaactcctgtcgccaagaggacgtaattgccacggctaacctgtcacgacgggctattgccgatatgctccgagcctgtaaagaagcagcgtaccaccctgaagtcgccccagacgtgaggctgcgcgcacttcactacggtcgagagtgcgccaacggctacctggaactgctcgatcatgtgctccttactctgcagaaacccagcccagaactcaaacaacagctgacaggccacagcaagagggtggcaggttcggtgaccgagctgatccaggctgcggaagccatgaaagggaccgaatgggtggatcctgaggaccccacagtgattgccgaaaatgagctcctgggagccgcagccgccatcgaggctgctgctaagaaactcgagcaactcaaaccacgggccaaacctaaagaagcagatgaaagcttgaacttcgaggagcagattctagaggctgctaagagcattgcagcggccaccagcgccctggtgaaggccgcaagcgcagcccagagggaattggttgcacagggaaaggtgggggccattccggccaatgcacttgacgacggccagtggtcacaggggctaatctctgcagctaggatggtggctgctgcgaccaataatctgtgcgaagccgccaatgcagcagtgcaaggccacgcctctcaggagaagctgatttcttccgccaaacaggtggcagctagtacggcacagttgctggtggcatgcaaggtcaaagccgaccaggacagcgaagcaatgaagcgactgcaggctgcaggcaatgccgtaaaacgggcaagcgacaacctggtgaaggcggcccagaaagctgcagcgttcgaggagcaagaaaatgaaacagtagttgtgaaagagaagatggtgggaggcattgcccagattattgccgcgcaagaagagatgctgcggaaggaacgcgagttggaagaggcacgaaagaaactggcccagataagacagcaacagtacaaatttttgccttccgaattaagggatgagcactag

SEQ ID NO: 17581 - DNA, 7290 bp, Artificial Sequence
  Description of Artificial Sequence: Synthetic coding sequence
atggtcgctctgtccctcaagatcagcatcggaaacgtggtaaagactatgcagttcgaacctagcacaatggtctatgatgcgtgcaggatcatcagagagaggatcccagaggctccagccggtcctccctctgattttggactttttctctcagacgatgacccgaagaagggaatatggctggaagctggcaaggccctagattattatatgttgagaaacggcgatacaatggagtacaggaagaagcagaggccccttaagatacggatgctggacggaacagtgaagactattatggtggacgacagtaagacggtgacagacatgctgatgacaatttgtgcccggattggtattacaaaccacgacgagtactccctcgtccgagagctgatggaagagaagaaagaggagataaccggcaccctgaggaaagacaagaccctgcttcgggatgagaaaaaaatggaaaaacttaaacagaagctccacaccgatgatgagttgaactggctggatcacggcagaacgctacgggaacagggagtggaggagcatgaaaccctcctgctccgcaggaaattcttctattcagaccaaaacgtggactccagggatcctgtgcagttgaatctcctgtacgtgcaggcaagggatgacattcttaatggttcccaccccgtgtcctttgataaggcctgcgaatttgcagggttccagtgtcagattcagtttgggcctcacaacgagcagaaacacaaggccgggttcctcgaccttaaggacttcctgcctaaagaatacgttaaacagaaaggcgagcgaaagattttccaagcacacaagaactgcggtcagatgtcagaaatagaggctaaggtccggtacgtgaaattagctcgctctcttaagacatatggcgtgagcttctttctggtgaaagaaaagatgaaagggaagaacaagctcgtgccaaggctgctgggcatcaccaaagagtgcgtcatgcgggtcgatgagaagaccaaggaggtgattcaggaatggaacctgaccaacattaaaaggtgggcagcaagcccaaaatcctttaccctcgattttggagattaccaagacggatattattctgttcagactacagagggcgaacagatagcccagctgattgctgggtacatagacatcatcttgaaaaagaagaagtccaaggaccattttggcctcgagggggacgaagaaagcacaatgctcgaggacagcgtgtccccgaaaaagagtaccgttctccaacaacagtacaatagagtgggaaaggtagagcacgggtccgtggcactccctgcgatcatgagatctggagccagcggaccagagaacttccaggtgggtagcatgcctcctgcccagcagcaaatcacatctgggcagatgcataggggacacatgccacccctgacatccgctcagcaggctctgaccggaacaatcaactcaagcatgcaagctgtgcaggcagctcaggctacattggacgacttcgacaccctgccacctctcggtcaggacgcagcctccaaggcctggcgaaagaataagatggacgagtcaaaacacgagatccactcacaggtggatgccattaccgcgggaactgccagcgtggtgaatctgaccgccggagatcccgccgaaactgattataccgccgtggggtgtgcagtgaccacgatctccagcaacctcaccgagatgagccgcggtgtgaagttgcttgcggcgctgcttgaggacgaaggaggatctggtcggccattgttgcaggctgcaaagggtcttgcaggggccgtgtcagaacttctgcgctctgcccagcccgcctcagccgagccgcgtcagaacctgctacaagcggcgggcaacgtaggacaagccagcggcgagctgttgcagcagatcggggaaagcgacacggatccacacttccaagatgcactaatgcagttagcaaaggcagtcgcctcggcagcggctgctctggtactaaaggcaaagtcggtggcgcagcgcaccgaggattcgggtttgcagacacaggtcatcgccgctgcaacccagtgcgctctgtctaccagccagctggtggcctgtaccaaagtggtcgcccctacgatctcatccccggtgtgccaagagcagttggtcgaggccggccggctggtcgctaaagcggtggaagggtgcgtcagcgcaagccaggccgctaccgaagatgggcagttgctccgcggggtgggtgcagccgctaccgctgtgacccaggccctgaacgaactgctgcaacacgttaaggcccacgctacaggggcaggtccagctggtcgatacgaccaagctaccgatacaatcctgaccgttacagaaaacattttttcctctatgggcgacgcgggagaaatggtgagacaggccaggatactcgcccaggcaacctctgacttagttaatgccatcaaagctgatgccgagggggaaagtgacctggaaaattctcgaaagctgttaagcgccgccaagattctggccgatgctactgctaaaatggtcgaggctgctaagggtgctgcggcccaccccgacagcgaagagcagcagcagagacttagagaggccgccgaaggcttgcgcatggccactaacgccgcagctcagaacgctataaagaagaagctcgtgcagcggctggagcatgctgctaagcaggccgcagcgagtgcaacccagactattgccgcagcacagcatgctgccagcacaccaaaggcctctgcgggccctcagcccctcctggtgcagtcttgtaaagcggttgcagagcagattcccctgttggtccagggagtccgtgggtcacaggctcaaccagacagcccctctgcacaattagctctgatcgctgcatcccagagttttctccagccagggggcaaaatggttgccgccgcaaaagcttccgtcccaactattcaagaccaggcgtcagcgatgcagctcagtcaatgcgccaagaacctcggtactgccctcgctgaattacggactgctgcccagaaagctcaggaggcatgtggccccttggagatggattctgcactatcggtggtgcagaatttggagaaggacttacaagaggtaaaggcagccgcacgggacgggaaactaaagccactgcccggcgaaaccatggaaaagtgtacccaggatctcggcaacagcacaaaagccgtcagctctgccattgcgcagttactgggagaagttgcacaagggaacgagaattacgcaggcatagccgccagagacgtggctgggggactgcgctccctcgctcaggctgctaggggagtggccgccctgacctctgatcccgctgtacaggccatcgtacttgacacagcctcagatgtgctcgacaaggctagttccctgatcgaagaggccaaaaaagctgcaggccatcccggggaccctgagtctcagcagcgacttgcccaggtcgccaaagcagtgacccaggctctgaaccgctgcgtatcttgtctccccggacagagggatgtggacaatgcattacgtgcagtaggtgatgcctctaaaagactgcttagtgacagccttcctccttccacgggaacatttcaggaggcccagagcagattgaacgaggccgcagccggactcaatcaggccgctacagagctggtgcaggcatcaagagggacgcctcaggaccttgccagagcatccgggagatttgggcaggacttcagtacctttctcgaggctggtgtcgagatggcaggccaggcccccagccaggaagaccgggcacaggtcgtgtctaatctcaaggggatttcaatgagcagcagtaagctgttactggccgccaaggcactgagcactgaccccgctgcacccaacttaaagagtcaactggccgccgcagccagggcggtgaccgacagtataaatcagctcatcacgatgtgtacacagcaggctccaggtcagaaagaatgtgacaatgcgctccgcgagctagaaacggtacgcgaactactagagaatccagtccaacctataaacgatatgtcatactttggatgcctggatagcgtaatggaaaacagcaaggtcctgggggaagcaatgacaggcatatcccagaatgcaaagaacggcaatttaccagagttcggagacgccatttctactgcttcaaaggccctatgtgggtttaccgaggcagcagcccaggctgcctacctggtgggcgtgtccgaccctaattctcaggccggacagcagggcctggtggaaccaactcaatttgcccgcgctaatcaagcaatccaaatggcctgtcagagtctgggggagccgggatgcactcaggcccaggtgctctccgctgcaaccattgtggctaaacacacatccgccctgtgcaactcatgtcgactggcttccgcacgaaccactaatcccactgcaaaaagacagttcgtgcagagtgcgaaggaagtggctaactccaccgccaacctggtaaaaacaataaaagccttggacggggcttttactgaggaaaatagggcacagtgccgggcagccacggcccccctgctggaagcagtagataacctttcagcttttgcctcaaaccccgagttctcctcaatccccgcacagatcagccctgaaggcagagccgccatggagcctatcgttatatccgccaagaccatgcttgaaagcgccggtggcctcatccaaacggcgcgggctctggcagtgaacccaagggacccacctagctggagtgtgctggcaggacactcacgaactgtgtctgatagcataaagaaactgataacatcgatgcgcgacaaagctccaggccagctggagtgcgagacagcaatcgccgctttaaacagctgtcttcgagatctggaccaggccagcctggctgcagtttcccagcagttggcccccctgcaagaaatctcccaccttatcgaaccactggccaacgctgctcgagccgaagcgtcccagctgggccacaaggtttctcagatggctcagtattttgagcctctgacgctggcggccgttggtgcagctagtaagaccttaagccacccccaacaaatggctttgctggaccagacaaagacactggctgaaagtgctcttcagctgctgtacactgccaaggaggccggcggtaaccccaaattggatgaaggcccaatgggcgagcctgaggggagcttcgtggactaccagaccactatggtgagaaccgctaaggccatcgccgttaccgttcaggaaatgataggctcccacatcaagcatagggtccaggagcttggtcatggctgcgccgctctggttacgaaggctggggccctgcagtgttctcccagtgacgcttacacaaaaaaagagctgattgaatgcgctaggcgggtctctgaaaaggtgagccatgtgcttgcagccctgcaggctggcaatcggggcactcaggcctgcattacggccgcatcggccgtgtccggtattatcgctgatctggatacaaccattatgttcgcgactgctgggaccttaaaccgggagggaacagaaaccttcgctgatcatcgggaggggatcctaaagacggcaaaagtgctagtggaggacacgaaggtgctggtgcagaacgcggctggaagccaggaaaagctcgcccaggccgcgcagagcagtgtggctaccataactcgcctagctgatgtcgtcaagctcggggcagcttcactgggagccgaggatccggagacccaggtggtgctgattaatgccgtgaaggacgtggcaaaagccctgggagacctcataagcgctacaaaggctgcagctggcaaagtaggcgatgatcctgcagtctggcagttgaagaactccgcgaaagtgatggtgacaaacgtgacctctctgctaaagaccgtgaaagccgtggaagatgaggctaccaagggcactcgcgcccttgaagccacaaccgagcacatccgccaagaacttgccccccctgcaaagacttcaactccagaagattttattcggatgaccaagggcatcacaatggctactgccaaagctgtggccgccgggaactcctgccggcaggaagatgtcatcgccaccgcaaacctgagccggcgcgcaattgccgacatgctgcgcgcgtgtaaggaagcggcttatcaccctgaggtggctccggacgtgcgcctgagagcacttcactatggtcgagagtgcgctaatgggtacctggagttattagatcatgtgctgttgacgctgcagaagcctagcccggagttgaaacagcagttgaccggacactccaagagagtcgccggaagcgtcactgagctgatccaggctgccgaagcaatgaaagggaccgaatgggtcgatcccgaggacccaacagtgatcgctgaaaatgagctgctgggtgctgcggccgctatcgaagccgccgcaaaaaaactcgagcaattgaagccccgggcaaagccaaaggaagcagacgaaagcctcaacttcgaggagcagatactggaggccgccaagagcatagcggcagcaacctctgctttggtcaaggccgctagcgcggcccagcgggagttggttgcccagggcaaggtaggggctatccctgcgaatgcactggacgatggccagtggagtcagggtctgataagtgcagcacggatggtggcagctgctaccaacaacctctgcgaggccgccaacgccgcggtgcagggacacgcaagccaggaaaagctgatatcttcggcaaagcaggttgctgccagcactgcccagttgctcgttgcctgtaaggtgaaggccgaccaggattctgaagctatgaagcgccttcaggccgctggaaatgccgtgaagcgagcatctgacaacctcgtcaaagcagcccagaaagccgccgcattcgaggagcaggagaacgagacagttgttgtgaaggaaaaaatggtcggaggaatcgcgcaaatcatcgccgcgcaggaggaaatgctgcgaaaggagagagagctggaggaagctaggaagaagctcgcacagattagacagcagcagtacaagttcctcccatccgagttgagagacgaacactag

SEQ ID NO: 17582 - DNA, 3984 bp, Artificial Sequence
  Description of Artificial Sequence: Synthetic coding sequence
atggcggcctctagacggtcccagcatcaccatcaccaccatcagcagcagctccaacctgcccccggcgcttccgccccgccgccccctccaccaccgcccctctctcctggcctcgcccctggcaccacccccgcaagtccaacagcaagcggccttgcacccttcgcaagcccgcgccacggcctggctctaccagaaggcgatggaagccgcgacccacctgataggcccaggtcaccagatccggtggatggtacatcttgttgttctactacttcaacaatttgcacagtggccgccgctccagtggtacctgctgtctctacatcttcggcggccggggtggcgcctaaccccgccgggtccgggtccaataactcccctagcagctcatcatcaccgacatcttcatcttcaagtagccccagttccccgggctctagtctggccgagtctcccgaggccgcgggtgttagctctacggcccctctgggcccgggcgccgcagggcccggcacgggggttcccgcagtctcaggagccctacgggagcttttggaggcttgtaggaatggcgatgtgtcccgggtcaagcggctggttgatgccgccaatgtcaatgcgaaggatatggctgggcgcaaaagttcccccttgcacttcgcggctggttttggaagaaaggacgtggtggaacatctcctacagatgggggccaatgtgcacgccagggacgacggggggctcataccccttcacaatgcgtgcagctttgggcacgctgaggtcgtttccctgcttctgtgccaaggtgctgacccgaatgcccgagacaactggaattatacacccctccacgaagcggccattaaagggaaaatcgacgtgtgcatcgttttgctgcagcatggtgcggacccaaatattcggaatactgatggaaaatccgcactggatcttgcggatccatctgccaaggctgtgctgaccggcgagtataaaaaagatgaacttcttgaggccgcgaggagcgggaatgaggaaaagctgatggcactgcttacccctctcaatgtcaattgccacgcatccgacggccggaagagtacgcctcttcacctagccgctgggtataatcgggtccgtatcgtgcagctgcttctgcagcatggtgcggacgtgcacgccaaggacaaagggggcctcgtaccactgcataacgcttgtagctatggccattatgaggtgaccgagctcctgctgaaacatggtgcctgtgtcaatgcgatggacctctggcagtttaccccccttcacgaggctgcatctaagaatagggtggaggtttgttctcttcttctgagtcacggagcagacccaactctggtgaactgtcacggtaaatctgcagtcgatatggcccccacccctgaactgcgggaaagactaacttatgagtttaagggtcactcccttctccaagcagctcgggaggcggatctcgcgaaagtgaaaaagacactcgcgctagagattatcaatttcaaacaacctcaatcacatgaaacagctctgcattgcgcggtcgccagcctacatccaaaacgcaagcaggtgaccgaactcctgctgcgcaaaggagctaacgtcaatgaaaagaataaggacttcatgacacctcttcatgtggcggctgagagggcacataacgacgttatggaggtgttgcacaaacacggagccaagatgaacgctctagacaccctggggcagaccgctctgcaccgcgccgcactggcgggccaccttcagacatgccggctcctcctgagctacggctcagatccatcaatcatttcattgcaaggctttacagctgctcaaatggggaatgaggcagtacagcagatcctctccgaatcaacacccattagaacttctgacgtggattatagactcctcgaggcaagcaaagcgggtgacctggaaacagtgaaacaattgtgctctagtcagaatgtgaactgtagggatttggagggtcggcacagcacccctttacacttcgccgctggctacaatcgcgtgtctgtggtcgaatatctgctgcaccatggggccgacgtgcatgccaaggacaagggaggcctcgtccccttacacaatgcctgtagttacggccattacgaggttgcagagcttttagtgcgtcacggcgcctctgtcaacgttgcagatctgtggaaatttacccccttacatgaagctgccgcgaaggggaaatacgagatctgtaagctcttactcaagcacggagccgaccctactaaaaagaacagagacggtaataccccgctcgatctcgtcaaagagggtgatactgatatccaggacctgctgcgcggggacgcggcattgttggatgctgccaagaagggatgcctcgcacgcgtacagaaactatgcactcctgaaaatatcaactgcagagatacccagggccgcaattcaacgcccctccacttggccgcaggatacaacaaccttgaggtggcggaatacctccttgaacatggagccgacgtgaacgcacaagataaagggggactcatacctctacataacgcggcaagttatggtcatgtggatattgcggctctgctgataaaatataacacatgtgtgaatgccactgacaaatgggctttcaccccacttcacgaagccgcccagaagggaagaactcagctttgcgcgctgctgttggcccacggtgcagaccctacgatgaagaaccaggagggacaaaccccactcgacttggccacagccgatgacatccgagcacttctgatagacgccatgccgcctgaagcactgcctacctgcttcaaacctcaagcaaccgtggtgtcagcgtccctgatctcaccggctagtactccttcctgtctgagcgctgcttcctccatcgataatcttactggccctctggccgagctcgccgtcgggggagcgagcaacgcaggtgatggagccgcagggacagaaagaaaggaaggagaggtggccggtctcgatatgaacatctctcagtttctcaaatcattagggctggaacacctgcgtgatatatttgaaactgaacagattacactcgacgttctggctgacatgggtcatgaagagctgaaggaaatcgggataaatgcatatggacaccgccacaagctaatcaagggcgtcgaaagactgctcgggggccagcagggaacaaatccatacctgaccttccattgtgtgaaccaagggaccatacttctggatctggcccccgaggacaaggagtatcagtccgttgaggaggagatgcagtccacaattcgagagcatagggacggaggcaacgccgggggtatatttaatcgctacaacgtaatccgcatccaaaaggtagtgaacaagaagcttcgtgagcgtttttgtcatcggcagaaggaggttagtgaggaaaaccataaccaccataatgagcgcatgctattccacggaagtcccttcatcaacgccattatacacaaaggttttgatgagagacacgcttacattgggggcatgttcggggccggtatatattttgcagaaaactcatccaaaagtaaccagtacgtgtatggcatcgggggtggcacagggtgccctactcacaaggaccgcagctgttatatctgccatcggcagatgcttttttgtagggtgacactggggaaaagtttcctgcagtttagcaccatgaaaatggcccatgcccctcctggccaccacagtgtcatcggcaggcctagtgtgaatggtcttgcctatgctgagtatgtgatctacaggggagagcaggcctatcccgaatatctgatcacataccagatcatgaagccggaggcaccatcacaaactgcaacggcagccgagcagaaaacgtag

SEQ ID NO: 17583 - DNA, 3501 bp, Artificial Sequence
  Description of Artificial Sequence: Synthetic coding sequence
atgagtgggcgtaggtgcgctggaggaggcgcagcctgcgctagcgcagccgccgaagcagtggaaccggccgcccgggaattatttgaggcatgcagaaatggtgacgtggagcgggtgaaacgcctggttacaccagagaaagtcaactcgagggacacagcaggtcgaaaatcaacccctctgcacttcgcggctggctttgggagaaaagacgtagtcgaatacctgctccagaacggcgccaacgtacaggccagagacgatggcggcttaataccattacacaacgcttgcagcttcggccacgcggaggtcgtcaaccttttgcttcggcatggcgcggacccaaacgctagagacaactggaactacacacctctccacgaagctgcaatcaagggcaagatagacgtctgcatagtgctgcttcaacacggcgccgaacctacaataagaaacactgacggccgcactgccctagaccttgcagacccctcagccaaggctgttcttaccggggagtataaaaaagatgaactgctggagagtgcccggagcggcaatgaggaaaaaatgatggcactactgactcccctgaacgtcaattgccacgcctctgatgggcgcaagtccacgccactgcacctcgccgccggatataatcgcgtcaagatcgttcagctcctactgcaacacggggctgacgttcatgccaaagataagggcgatcttgtgccacttcacaacgcttgtagttatggacactatgaggttactgaactgctcgttaagcatggcgcatgtgtaaacgctatggatctctggcagttcacgccactccacgaagccgcttccaagaatagggtggaagtgtgctctctcctgttaagttacggcgccgacccgactttgctgaattgtcacaataagtcagccatagacctggccccaactccacagctgaaggaacgtctcgcttatgaattcaaaggtcattctctgcttcaggccgctcgagaagctgacgtcacacgcattaaaaagcacttgtcactcgagatggttaatttcaagcaccctcagacacacgagacggctttgcattgtgccgccgcctccccataccctaagcgtaagcagatatgcgaattacttctgcggaaaggggccaacatcaacgagaagacaaaggagtttctgactcctttgcatgtagcatccgagaaagcccacaacgatgtcgtcgaggtcgtcgttaagcacgaagcaaaagtgaatgctctggacaacctgggtcagacgagcctgcaccgggccgcgtactgcggccatttgcagacctgcagactactcctctcatatggatgcgaccccaacatcatcagcctacaaggcttcacagccctacaaatgggaaatgagaacgtgcagcaactgctgcaagaggggattagtttaggaaattcagaagctgatcgtcagctgctcgaagctgctaaagctggcgacgtcgagacagtgaagaaattatgtacggtgcagtcggtgaattgccgtgacatcgagggccgtcagagtactcctcttcacttcgctgctggatacaatcgggtgtctgtggtggaatacttgctccagcacggggccgatgtccatgccaaggacaaaggcggactggtgccactgcacaacgcttgctcttacggacattatgaggtggcggagttgttggtaaagcacggagccgtggtgaatgtggccgatctgtggaagttcactcccctgcacgaagctgccgcaaaaggcaagtacgagatttgtaaactgcttttgcaacatggcgccgatccaacgaaaaaaaaccgcgacggtaacaccccactcgaccttgtgaaagatggggatactgatatccaggacctgctgcggggggacgccgcattgcttgatgctgccaaaaagggttgcttagctagagtaaagaaattaagtagtccggataatgtgaattgccgggacacacaaggccgacacagtactcccctgcacctagccgctgggtataacaaccttgaagtggctgaatatctcttacagcacggcgccgatgttaacgcccaggacaaaggggggttaattcccttgcataacgcagcaagttacggccatgtggacgtagcagccctgttgatcaagtacaacgcctgtgtgaacgcaacagataagtgggccttcactcctctccatgaggccgcacaaaagggaaggacacaactgtgcgccctgttgcttgcacacggcgctgatccgactttaaaaaaccaggagggccagacccctctagacctagtcagcgctgatgacgtctctgcactcctgaccgccgcaatgcctcctagcgcactcccctcctgctataaacctcaagtcctgaatggagtgagaagcccaggggctaccgccgatgctctaagctccggaccatcgtccccttcctccctgtcagctgcaagttccttagacaacttatctggcagcttttccgagcttagcagtgtggtgtcctcctccgggaccgagggggctagttccttagagaaaaaagaggtgcccggcgtggactttagcattactcaattcgttagaaacttgggcctggagcatctgatggacatcttcgaaagggaacagatcacgttggacgttctcgttgagatgggccataaggaattgaaggagattggcatcaatgcctacggccacagacacaaacttatcaaaggcgtggaacgcctgatttcaggtcaacagggtctcaatccttacctgacccttaatacttctgggtcaggaaccattttgattgacctctcacccgacgacaaggaattccagagcgtggaagaagagatgcaatctaccgtgcgcgaacatagagatggaggacacgccggaggcattttcaacaggtacaatattcttaaaatccagaaggtgtgtaacaaaaagctctgggagcgctacactcacaggaggaaggaggtgtccgaagaaaatcacaatcatgctaatgaacgaatgctcttccacggttccccttttgttaacgccatcatccataagggctttgatgaaaggcacgcctacatcgggggcatgtttggcgcaggtatatatttcgcagagaattcttcaaaatccaaccagtacgtgtacggcattggcggcgggactggctgccccgttcacaaagatagatcatgttacatctgccataggcagcttttgttttgcagggttactctgggaaagtcgttcctgcagttcagcgcgatgaagatggctcacagccctccaggccaccatagtgtgaccggacgtcccagcgtgaacgggctggccctggctgaatatgtgatctatcggggcgaacaagcctaccccgaatacctcattacataccagatcatgaggcctgaaggcatggttgacggctag

SEQ ID NO: 17584 - DNA, 2139 bp, Artificial Sequence
  Description of Artificial Sequence: Synthetic coding sequence
atgcgagaacccgcccttgccgcctctgctatggcataccacccattccacgctccgcggccagccgactttcctatgagcgcctttctggcagcagcccagccatcattcttccccgccctggcactgccacctggggctctggcaaagcctttgcctgatccggggctggccggagctgccgctgctgccgccgccgcagccgctgccgccgaggccgggctccacgtttcagcactgggcccacatcctcccgcagcacacctgaggagtctgaaaagtttggagccggaagacgaagtggaggatgatcccaaagtgacactggaagctaaggagctgtgggatcaatttcacaagctgggaacagaaatggtgattacaaaatctggaagacggatgttccccccattcaaagttagagtttcaggactagacaagaaagcaaagtatatcctgctaatggacatcgttgcagccgatgactgtcgctataaattccataactctcggtggatggtcgccggtaaggccgatcccgaaatgccgaaacgcatgtatattcaccctgatagtccggctacaggagagcagtggatggccaagcccgtggctttccacaaactgaaactcaccaataacatctccgacaaacatggatttaccatccttaattccatgcacaagtatcagcctagattccatattgtgcgggctaacgacatcctgaagttaccctatagcactttccggacatacgtgtttcctgagactgacttcatcgcagttaccgcctaccaaaacgacaagattacccagctgaagatcgacaataatccatttgctaagggcttccgggacactggcaacgggcgccgcgaaaaacgtaaacagcttacactgccttccttaaggctttatgaagaacattgcaagcctgagcgggacggggccgaatcagatgccagcagttgcgatccaccgcccgctcgggagccacccacatccccaggcgccgcgcccagtccactgagattacaccgcgctagagccgaagaaaagtcttgcgcagcggatagtgatcccgagcccgagcgactctcagaagagagggccggagcacccctggggaggtctcctgcccccgactcagcctcgcctacacggctgacagaaccagaaagagcgagagagaggcgttcaccagaaaggggaaaggagccagccgaatccggcggtgacggacccttcgggcttcggagcctggagaaggaacgagcagaagctcgccgaaaagacgaaggtcggaaagaagctgccgaggggaaagagcaaggattggcacctctggtcgtgcagacggacagcgcctcacctttgggagccggtcacttgcccggactcgctttctcaagccacttgcacggccagcaatttttcgggccgttgggggcaggtcagcccctgttcctgcatcccggtcagttcacaatgggaccgggcgccttctcagccatgggaatggggcacctgttagccagcgtggctggcggagggaacggagggggcggaggaccaggaactgccgctggactcgacgctggaggcctggggccagcggccagcgccgcatccacagctgcccccttcccatttcacctcagtcagcacatgctggctagtcaggggatccctatgccaacttttggtggactgtttccctatccttatacatatatggccgcagctgcagctgccgcctccgcactgccagccaccagcgcagcagctgctgcggctgcagcggctggatccctctcccgcagcccgtttttaggctcagctcgcccccgccttcggtttagcccatatcagatcccggtgactattcctcctagcaccagtttgttgaccacaggtctcgccagtgagggtagtaaagctgctggaggcaacagccgggagccctcccctctgccagaactggctctgagaaaagtgggggcaccgtctaggggggctcttagcccatcaggcagtgcaaaggaggccgccaacgagctgcagtccatccagagattagtgagtggcttagagagccaacgagccctgtcgcccggcagagaatcgccaaagtag

SEQ ID NO: 17585 - DNA, 981 bp, Artificial Sequence
  Description of Artificial Sequence: Synthetic coding sequence
atgagcgcttttttagcagccgcccaaccatcattttttccggctcttgctctgccccctggggctctggcaaagccattaccagaccctggtctggccggtgccgcagctgctgcggcagcggccgccgcagccgcggaggctggtctccacgtctccgccctcggaccacacccacccgccgctcacctccggagccttaaatcacttgaacctgaggatgaagtggaggacgaccctaaggttacactagaagccaaagagctctgggaccaatttcacaagttgggcactgagatggtcatcacaaaatctggtcggcgcatgttccccccctttaaggtgagggtgagcggactcgacaaaaaagctaaatatatcctgctgatggacatcgttgcggcagatgattgccgttacaaattccataactcccgctggatggtggcgggtaaggccgatcccgagatgcccaaacggatgtacatacacccagattcgccggctacaggagagcaatggatggccaaacctgtggccttccacaaacttaaactgactaacaacatctccgacaagcacgggtttacaattctgaactccatgcataagtaccagccccgctttcacattgtgcgggccaacgatatcctcaaactgccatactcaaccttcagaacttacgtctttccagagactgacttcattgctgtgacagcctatcagaatgacaagattacccagctgaagattgacaacaatccttttgccaagggctttagggacaccgggaacggaaggcgggagaagagaaagcaactgacactgccttcacttagactgtatgaagaacattgcaagcccgagagggacggcgcagagagcgatgcctcctcttgcgaccctccccccgctagggagccacctacctctccaggtgccgctccaagtccactgcgactccaccgcgccagaggttag

SEQ ID NO: 17586 - DNA, 996 bp, Artificial Sequence
  Description of Artificial Sequence: Synthetic coding sequence
atgactgagagaccccctagcgaggccgcgaggagcgacccgcagttggagggcagagatgctgcagaggctagcatggccccaccgcacctcgtcctactgaacggtgtggccaaggagaccagtcgcgcggccgccgccgagccacccgtgatagaactgggcgcaagaggaggccctggcggcggccctgctgggggtggcggcgcagcacgcgatcttaaaggacgggacgctgctaccgcagaagctaggcatagagttcccactaccgaactctgtcgccccccaggtcctgctcctgcacctgcccctgcttccgttacggccgaactgcctggagatggcagaatggtgcagctgtctccccccgccttggccgccccggccgctcccgggagagcattactctattcactgtcccagcctttggcctccttgggctcgggtttttttggtgagcccgacgccttccccatgttcactacaaacaacagggtgaagcgaaggcctagcccttacgagatggaaattaccgacgggccccacacaaaggttgtgaggcgtatatttaccaacagcagggagagatggcgacagcagaatgtgaacggtgccttcgctgagctgaggaagctcatacctacccatcctcccgataaaaaactcagcaaaaacgaaatactaaggcttgccatgaaatatatcaacttcctagcaaagttactgaacgatcaagaggaggaggggacccagcgcgcaaagaccggcaaagaccccgtcgttggggcaggtggagggggtggaggcggcggaggaggcgctccgcccgacgacctcctgcaggacgtcctaagtcccaactcctcttgtggcagtagcctggacggcgcggcgagccccgatagttacaccgaggaacctgcccctaaacacaccgcccggtccttgcaccctgctatgctgccggccgccgacggcgctggaccacggtag

SEQ ID NO: 17587 - DNA, 1002 bp, Artificial Sequence
  Description of Artificial Sequence: Synthetic coding sequence
atgaccgagcgcccgccttcggaggcggccaggagtgatccacagttggagggccgcgatgctgctgaggcaagcatggcccctccacatctggtgctgcttaatggtgtggccaaggagactagccgggccgccgctgccgagccgccagttatagagttgggcgcacgaggggggcctggaggtgggccagctggcgggggaggtgctgcccgcgacctgaagggccgagacgcagctaccgccgaggcaagacacagagtgcctacgactgagctttgcagaccacccggcccagcacctgcccccgcacccgcttcagtgacggctgagttacctggcgatggacgaatggtgcagctgtcaccacccgcacttgctgcccccgctgcgcccggacgtgcactgctatactccctctctcagccgttagcttccttgggatcccattctggcttttttggcgagcctgacgcgttcccaatgttcactacgaataaccgtgtgaagcggagacccagtccctacgagatggaaatcacggacggcccacacaccaaggtagtgcgccggatcttcaccaactcaagagagaggtggaggcagcagaacgtaaacggggcattcgccgaacttcgcaaactgattcctacccacccgcctgacaagaagctgagcaagaatgagattctgcggctggctatgaaatatattaactttctcgcaaaactcttgaacgaccaggaggaggaagggactcaaagggcaaagacagggaaggaccccgtcgttggcgccggaggaggtggaggcggaggtgggggcggggctcctcctgacgacctgcttcaggacgtccttagtccgaattcatcctgcggctccagcttggacggtgccgcaagccctgacagctacaccgaggaaccagcacctaagcatactgcccgaagcctgcacccggccatgctgccggccgctgatggggccgggcccagatag

SEQ ID NO: 17588 - DNA, 996 bp, Artificial Sequence
  Description of Artificial Sequence: Synthetic coding sequence
atgactgagcggcccccctcagaggcggcacgaagtgatccccagctagagggccgggatgcagcagaggcttcgatggccccgcctcatctagttctgctcaatggggtggctaaagaaacaagtcgagcggccgctgccgaacctccagtgattgaactcggagcgcgcggcggacctggagggggcccagctggaggaggtggcgccgctagggacctgaagggaagagatgccgccactgcggaggccagacaccgcgttccaaccacggagttgtgtcgcccgcccggccccgcccctgcgcccgccccagcgtcagtcacggccgagcttccaggtgacggaaggatggtgcagctgtcccctcctgccttagccgcacccgctgcccccggaagagccttgctgtacagtctcagtcagcccctggcttccctggggtccgggttctttggcgagcccgacgctttccccatgttcacaaccaacaatagggtaaaaagaagaccgtctccatatgagatggaaatcactgacggcccccatacaaaggttgtcaggcgcatattcaccaattcacgcgaaagatggaggcagcaaaacgtgaacggtgcttttgccgagttaaggaagttaattcctacacacccccccgacaaaaagctctctaagaacgaaattctgcgtttggctatgaagtatatcaacttcttagccaaactgctgaatgatcaggaggaggagggtacccagcgcgctaaaactggtaaggaccctgtggtgggcgcaggaggaggcggaggagggggaggcgggggggccccacctgacgaccttttacaggatgttctttcccccaatagttcgtgtggttccagcctggatggagccgcttcaccagactcatacactgaagaacctgctccgaaacataccgcccgctcactgcatccagccatgctcccagcagcagacggagcaggaccccgatag

SEQ ID NO: 17589 - DNA, 993 bp, Artificial Sequence
  Description of Artificial Sequence: Synthetic coding sequence
atggagcacttagggcctcatcacctgcaccccggccatgccgagcccatttcatttgggatcgaccagattcttaactctccagatcagggaggttgcatggggcccgcttcccgcttgcaggatggggaatacggcctcgggtgtctcgtcggaggcgcatatacttacggcgggggcggatcggctgccgcgaccggtgccggcggcgctggagcatatggtactggtgggcctgggggtcctgggggtcccgcaggcggtggcggtgcgtgctccatgggtccccttacggggtcttacaatgtcaatatggcactggctggtggccccggtcccggtgggggcggcggctcaagcggcggcgccggcgcactgagtgccgccggcgtgatccgggtgcctgcccaccggcctctcgccggggccgtggcacacccacagcccctggcaaccggcttgcctactgtccctagtgtgcctgccatgcctggcgtgaataatctcactggcctgactttcccttggatggagagcaatcgtcggtacacgaaggatcggttcacgggtcacccctatcagaacagaacacctccaaagaagaagaaaccacggaccagtttcacaaggttacagatctgtgaactggaaaagcgtttccacaggcagaagtacctggcaagcgccgaaagagctgccctcgccaaggccttaaaaatgaccgatgctcaggtcaaaacctggtttcagaatagacgcactaagtggagacgacaaaccgccgaagaaagggaagccgagaggcaacaagcaaaccgaatattgttacagttgcagcaggaggcgttccagaagtctctggcccagccactcccagccgatccactgtgcgtgcacaattcttctctgtttgccttgcaaaatttgcagccatggagtgatgattccaccaagatcacctctgtgacgagtgtcgcctcggcatgtgagtag

SEQ ID NO: 17590 - DNA, 774 bp, Artificial Sequence
  Description of Artificial Sequence: Synthetic coding sequence
atggagcacctgggcccccaccacctccacccaggacatgcagaacccatttcttttggcatcgatcagatcttgaattctcctgaccagggcggctgcatgggtccagctagtcgtctccaagacggcgagtacggactggggtgcctcgtcgggggagcatacacatacggaggaggcggctccgccgccgcaaccggtgcaggaggtgcgggggcttacggtacaggggggccagggggcccaggagggccagcgggcggtggcggggcctgctctatgggtcctctgaccggcagttacaacgttaacatggcgctagctggcgggccgggccctggcgggggcggaggaagcagtggaggagcgggcgccctctctgccgccggcgtcattcgggttccagcccaccggcccttggcaggggccgtggctcatccacagcctctcgcaaccggactgccgactgtgccttccgtgcctgcgatgccaggggtaaataatttgacgggcttgacttttccttggatggagtctaacagaaggtatacgaaggacaggtttaccggccatccataccaaaacagaaccccccccaaaaagaagaagcccagaacaagttttactcggctccagatctgtgaactggagaaacggttccacagacagaagtacctggcttctgccgaaagagccgctctggccaaggcgctgaagatgaccgatgctcaggtgaaaacctggttccaaaaccggcggacaaagtggaggtag

SEQ ID NO: 17591 - DNA, 345 bp, Artificial Sequence
  Description of Artificial Sequence: Synthetic coding sequence
atggcggaatgtccgacactgggggaggccgtgaccgatcacccggaccggctgtgggcgtgggagaagttcgtgtacctggacgagaagcaacacgcttggctgccactgacaatagaaattaaagacaggcttcagctcagagttctgttgcgtagggaggacgtggtcttggggagacccatgactcccacgcagatagggccatcgttactgccgatcatgtggcaactctatccggacggtaggtacaggtcctcagattcctcattttggcgcttggtataccacattaaaatagatggtgttgaggacatgcttctcgaacttctaccagacgattag

SEQ ID NO: 17592 - DNA, 345 bp, Artificial Sequence
  Description of Artificial Sequence: Synthetic coding sequence
atggcagagtgccctactctgggagaggctgtaactgatcacccggacagactgtgggcatgggagaagtttgtctatttagacgagaaacaacacgcctggctacctctaacaatcgaaatcaaagaccgactgcagttgagggtactgctgaggagagaggacgttgtgctgggacgccctatgactcctacacagatcggcccatccctcctgccgattatgtggcaattataccccgacggacgctacaggtctagcgacagtagcttctggcggctggtgtaccatattaagatcgatggcgttgaagacatgctgctggaattattgccagacgactag

SEQ ID NO: 17593 - DNA, 345 bp, Artificial Sequence
  Description of Artificial Sequence: Synthetic coding sequence
atggccgagtgtccgactctgggcgaagctgtgacagatcatcctgatcggctgtgggcttgggagaaatttgtgtacctcgatgagaagcagcacgcatggttgcctctcacgatcgaaattaaagacaggttgcagctacgggtgttgctgcggcgagaggatgtagtcttaggtcgcccgatgactcctacacagatcggtccctcactgctgccaataatgtggcagttgtatcctgacggcaggtatcgcagcagcgactcctcattctggcggctggtttaccacattaaaattgatggagttgaggacatgcttctggaattactacccgacgattag

SEQ ID NO: 17594 - DNA, 345 bp, Artificial Sequence
  Description of Artificial Sequence: Synthetic coding sequence
atggctgaatgcccaacactgggtgaggcggtcacagaccatcctgatcggctgtgggcctgggagaaatttgtctatcttgatgaaaagcaacatgcgtggctgcctctgaccatcgaaataaaggacagactgcagctgagggtcttgctgcgaagggaagatgtcgtgttgggacggcctatgaccccaacacagatcgggcccagcctgctgcctattatgtggcagctgtatccagacggccggtacaggagtagcgacagtagcttctggcggctggtgtaccacatcaagatagatggagttgaagatatgttactggagttgctgccagacgactag

SEQ ID NO: 17595 - DNA, 1407 bp, Artificial Sequence
  Description of Artificial Sequence: Synthetic coding sequence
atggattctctggcgagtttggtgctatgtggcgtgagtcttctgctgagtgggacggttgagggcgcaatggacctcatcctcataaatagcttgcctttggtctccgatgcagagacatccctgacttgcatcgcgagcgggtggcgtccacatgaaccaataacaattggcagagactttgaggccctgatgaaccagcaccaggaccctctcgaggtgacacaggacgtcactcgcgaatgggctaaaaaggtggtctggaagcgagaaaaagcttccaagataaatggcgcatatttttgcgaggggagagtccgaggagaggcaattaggattagaaccatgaagatgaggcagcaagcttcgttcctgcctgcaaccctgacaatgactgtggataaaggagataacgtgaatatatcattcaagaaggtgctgataaaggaggaagacgccgtgatttacaagaatggctcctttatccatagcgtcccccggcacgaagtgcccgacatcctagaggtgcacctgcctcatgctcagcctcaggacgctggcgtgtactccgctcgatatatcggaggaaacctgtttacgtcagcgttcacacgtcttatagtgcgcaggtgcgaagcacagaaatgggggccagaatgcaatcacctctgcactgcctgcatgaataacggagtctgccacgaggataccggcgagtgtatctgtcccccaggcttcatggggcgcacctgtgagaaagcttgcgagctccatactttcgggcggacttgcaaagagcgttgtagcggccaggagggctgtaaatcctatgtcttctgcctaccggacccctatgggtgttcttgtgctacaggttggaaaggtctgcagtgcaacgagggaattcagagaatgactccgaagattgtagacctgcctgaccatatcgaagttaacagcggtaaatttaaccctatatgcaaggcatctgggtggcccttgcccacgaacgaagagatgacactggttaaaccagacgggaccgtattacatcccaaggattttaaccacacggaccactttagtgtcgcaatttttacgattcacaggatcctgcctcccgatagtggagtctgggtttgctccgtgaatactgtggctggaatggtcgagaagccctttaatattagcgtgaaagtgctgcctaaaccacttaacgctcctaacgtgatcgatacgggccataactttgccgtgattaatatttccagtgagccctactttggggacgggccgataaaatccaaaaaactgctgtacaaacctgttaaccactacgaagcatggcagcatatccaggtgtccatggaaaaacagcgtctgactaaagcaaactccgatatttag

SEQ ID NO: 17596 - DNA, 3375 bp, Artificial Sequence
  Description of Artificial Sequence: Synthetic coding sequence
atggactcactcgcctccctcgtgctgtgcggcgtttctctcctcctgtctggtacggtcgaaggggcaatggaccttattcttatcaactccttgccgctcgtgagtgatgccgaaaccagcctcacctgtatcgcatcagggtggagaccccatgaacctatcactataggcagggattttgaggccttgatgaatcagcaccaggaccctttggaggtgactcaggacgtcactcgagaatgggcgaagaaagtcgtgtggaaacgcgagaaagccagtaaaatcaacggggcatatttctgcgagggtagagtgcgtggcgaggcaatccggatacggacgatgaaaatgcggcaacaagcatcttttctccccgctacgttgacaatgacagttgataagggcgataacgtaaacatttccttcaaaaaggtgttgattaaagaagaggacgcggtgatttataagaatgggtcattcattcactctgtacctagacatgaggtccctgacatcctggaagtgcacttaccccatgcacaacctcaggacgcaggggtgtattccgcaaggtatataggagggaatctgttcacgtctgcgttcaccagacttatcgtgcgcagatgcgaagcccagaaatggggcccggaatgcaaccacctgtgtaccgcttgtatgaacaacggtgtgtgccacgaagatactggcgagtgtatctgcccccccggctttatggggcgtacatgcgagaaggcctgtgaattgcacacctttggtcggacttgtaaggaacgatgctcaggtcaggaggggtgcaaatcgtatgttttttgcttacctgatccatacggttgctcatgcgcgacaggctggaaaggcctgcaatgcaacgaggcctgccatcccggtttttatggccctgattgcaaactgagatgttcttgtaacaatggagagatgtgtgaccgctttcaggggtgcctgtgcagccccggatggcagggattgcagtgtgagcgggaaggcattcagagaatgacaccaaaaattgtggacctgccagatcacatcgaggtaaattctggcaaatttaatcctatatgcaaagctagtggttggccgctacccacaaacgaggagatgacactggtgaaacccgacggaaccgtgctgcatcccaaggactttaaccacaccgaccacttctccgttgctattttcacaatccaccgtattctgcctcctgatagtggagtttgggtatgctccgtcaacacagtcgctggaatggtggagaagccattcaacatcagtgtgaaggtactccctaaacctctgaatgccccaaacgtgattgacacagggcacaacttcgcagtaataaacatatccagcgagccctactttggggacggcccgattaagagcaagaaactactttacaagcctgtgaaccactacgaggcctggcaacacatccaggtgacaaacgagatcgtgaccctgaattacctagagccgagaacggaatatgagctgtgcgtgcagctcgtccgcaggggggagggtggtgagggacacccagggccagtgagaagatttacgactgcctctattggacttccccctccgagaggccttaacttgctcccaaaaagtcagacgaccttaaatctgacatggcagcctattttccccagttctgaagacgatttttatgtggaggtggaacgccgcagcgtgcagaaatccgatcaacaaaacatcaaagtgccaggcaacctgacgtcggtgctgctgaacaatctccacccgcgggagcaatatgttgtcagagcgagagtcaatacaaaggcgcaaggcgaatggtccgaggatcttactgcgtggacgctgtccgatatcttgccgccccaaccagagaatattaagatctccaacataacccattcaagcgctgtcatctcttggacaattttggatgggtatagcatatcttctattacaatacgatacaaagtacagggcaagaatgaagatcagcacgtagatgtgaagatcaaaaacgcgacaattactcagtatcagctcaaaggactggagccggagacagcctaccaggtcgacattttcgcggagaataatatcgggtcctctaacccggcattcagtcacgagctcgtgacgctgcctgaatctcaagcaccagctgacttgggcgggggcaaaatgctgcttatagcgatcttgggtagcgctggtatgacttgtctgaccgtcctcctagcctttctaattatcctacaactaaaaagggctaacgtgcaaagacgtatggcgcaggccttccagaatgttagagaggaaccggccgtgcaatttaactcggggaccctggctctgaatcgaaaggtcaagaataatccagaccctacaatctatccagttctggactggaatgatatcaagtttcaagacgtgatcggagaaggaaacttcggccaggtgctcaaagccagaatcaagaaagacgggctgcggatggatgctgccattaaacgaatgaaagaatacgccagtaaagatgatcatagagacttcgcaggagagctcgaagtcctgtgcaagctagggcatcaccccaacattataaacctgctgggcgcctgcgagcataggggctatctatatctcgccatcgagtatgccccacacggcaaccttctggatttcttgcggaaaagtagggttctggaaactgatcctgcttttgccattgctaatagtactgcatcgaccctgagctctcaacaattattacactttgccgccgacgttgctagaggtatggactacctaagtcaaaagcagttcattcaccgtgacctcgctgcccggaacatacttgtaggagagaactacgtggccaagatagctgactttggcctgtcacgtggacaggaggtgtatgtcaagaagaccatggggcgtctgccagtacgatggatggcaatcgagtctctgaactattctgtctatactacgaacagcgatgtttggtcgtacggggtgttgctatgggagatcgttagtctggggggtactccctactgcggtatgacatgcgcggaactgtacgagaaacttccgcagggctacagattggagaagccccttaactgtgacgacgaggtgtacgatcttatgcgccaatgttggcgcgaaaaaccatacgagcggccctcatttgcccagatactcgtcagtcttaaccgcatgctcgaggaacgaaagacctatgttaatacaaccctgtacgaaaagtttacatatgccggcatcgactgctctgccgaagaagcagcctag

SEQ ID NO: 17597 - DNA, 3246 bp, Artificial Sequence
  Description of Artificial Sequence: Synthetic coding sequence
atggatagccttgcttcactggtcctgtgcggagtctcccttctcttaagtgggactgtggaaggcgcgatggatctgatcctgattaactccttgccactcgtgtccgacgccgaaacgagtcttacctgcatcgctagcgggtggcggcctcacgagcctatcaccataggccgtgacttcgaggctctcatgaatcagcaccaggatcccctggaggtaactcaagacgtcaccagggaatgggcaaagaaggtggtttggaaaagagaaaaggcctccaaaattaacggcgcctatttctgtgaggggcgggtgcgcggggaggctattcgaattagaaccatgaagatgagacaacaggcaagctttctgcctgcaaccctgactatgactgtagacaagggcgacaatgtgaacatatcatttaagaaagttctgattaaagaggaggatgccgttatctataaaaatggctctttcatacattccgtgcctcgacatgaggtccccgatattctggaggttcacttgccgcatgctcagccacaggacgctggagtttatagtgcccggtacattggtggcaacctattcacctcagcatttaccagattaattgttcgacgctgtgaggctcagaagtggggaccggagtgcaatcacctgtgtactgcgtgtatgaataatggagtctgccacgaggatacaggcgagtgtatctgtcccccaggcttcatgggcagaacatgcgagaaggcgtgtgaactgcacacatttggccggacctgcaaggagcggtgttcaggacaggaagggtgtaagtcctacgtgttctgcctgccagacccgtacggatgctcctgcgcaacagggtggaagggcctccagtgtaatgaaggaatccagagaatgactcctaaaatcgttgacctgcctgaccacatcgaggtcaattctggaaagttcaaccctatatgcaaggctagcggctggccattgccaacaaacgaagaaatgacactggtcaaacctgatggcaccgtcctgcaccctaaagacttcaatcacactgatcatttctccgttgccatcttcacaattcacaggatcctcccccccgattccggagtttgggtatgtagcgtgaacaccgtggccggcatggttgaaaaaccgttcaacatatctgtcaaagtgttaccaaaacctctgaacgcaccaaacgtgatagatacagggcataattttgctgtgattaacatctcttccgagccgtatttcggggatggacctattaaaagcaaaaagttgctgtacaagccagttaaccattatgaggcttggcagcatatccaggtgactaatgagattgtaacgctgaactacctggaaccaagaacagaatatgagttatgcgtgcaactggtcaggagaggcgaaggcggcgaggggcaccccgggcctgtgcgaagatttaccacagcatctattggtctcccgccaccacgaggattgaacctgctcccgaagtcgcagaccactctaaacttgacctggcaacccattttcccatcttcagaggatgatttttacgtcgaagtcgaacgaagatctgtgcagaaatccgaccagcagaacattaaagtgcctggaaatttaaccagcgtgttacttaacaacttgcaccctagagagcagtacgtggtgcgggcacgcgtgaacactaaggcccagggagagtggagtgaagacttgacagcatggaccctaagcgacatcctgcctcctcagcccgaaaacattaagatctccaatataacacacagttctgccgtgatttcctggactatactggacggatatagtatatccagcatcacaatccggtacaaggtgcagggaaaaaatgaagaccagcacgtggatgttaaaatcaagaacgcgactatcactcagtatcaactgaagggtctggaacccgagacagcttaccaagtcgacatcttcgccgaaaataatataggctccagcaatccggccttcagccatgagctcgtcaccctccccgagtcccaggcccccgcagatttgggtggagggaaaatgctcttgatagccattctgggatccgcgggcatgacctgtctgactgtccttctggcattcctaatcattctgcagttaaagagagcaaatgttcaacgacggatggcacaggccttccagaatgtgagagaagagcccgccgtgcagttcaattccggcacattggcactcaacaggaaggtaaagaataacccggatccaacgatctatcctgtgctggattggaacgacataaaattccaggacgtcatcggcgaaggcaacttcggccaggtgctcaaggcccgtatcaagaaagatgggcttcgcatggacgctgccatcaaaaggatgaaagagtatgctagcaaggatgaccaccgggacttcgctggggaactggaggtgctgtgcaaactgggtcatcacccaaatatcattaacctgctcggcgcttgcgaacatagaggctatctgtacctggccatagagtatgcccctcatggaaatcttctggactttcttcgaaaatctcgggtacttgagacagatcctgcttttgccatcgccaacagtactgcttcaacattgagcagccagcagctgttgcacttcgctgccgatgtggcgcggggtatggattacttgtctcagaaacaatttatccatcgggacttagcagccaggaatatactggtaggcgaaaactacgtggcgaaaattgctgatttcggcttaagtcgcggccaagaagtgtatgtgaaaaagactatgggtcgactaccggttaggtggatggccatcgagtccttaaattatagtgtctacaccactaattcggacgtttggagctacggagttcttctttgggaaattgtgtcactgggagggacgccatattgcggaatgacctgtgccgaactgtatgagaagctaccccagggatacagactggaaaagccactgaactgtgatgatgaggtgtacgacttaatgcgccaatgctggagggaaaaaccctatgagagaccctcattcgcacagattttagtgtctcttaataggatgctggaagaaagaaaaacttacgttaacactactctgtacgaaaagttcacttacgccggaatcgattgtagtgccgaagaggccgcatag

SEQ ID NO: 17598 - DNA, 3375 bp, Artificial Sequence
  Description of Artificial Sequence: Synthetic coding sequence
atggattcacttgctagcttagtactgtgtggtgtgagtctgctgctttctgggaccgtggagggggctatggacttgatccttattaactcactgcctcttgtgtcagacgcagagacctccttgacttgcattgcttccggctggcgccctcatgagcctataactatcgggcgggacttcgaggcattaatgaaccagcaccaggatcctctggaggttacacaggacgtcacacgcgaatgggccaaaaaggtggtttggaaacgcgaaaaggcaagtaaaatcaatggtgcctatttttgtgaaggacgggttagaggagaggccatcagaattcgcacgatgaaaatgcggcagcaggcctcattcctgccggccacactcacaatgacagtggataaaggggacaacgtaaacatttcattcaaaaaggtgctgattaaggaagaggatgcagtgatctataagaacggctccttcatacacagcgtgcctcggcacgaggtgcctgacatcctggaggtccacttgcctcatgcgcaaccccaggatgcaggcgtatactctgctagatacattggcggcaacctgtttacatctgctttcactaggttgattgtgaggagatgtgaagcccagaagtggggccccgaatgcaatcacctgtgtaccgcttgtatgaacaacggcgtgtgccatgaagacacgggcgaatgcatatgtcctcccggcttcatggggcggacgtgcgaaaaagcatgtgagctgcacaccttcgggcgcacttgcaaggaacggtgcagcgggcaggaagggtgcaagagttacgtgttttgcctgcctgatccgtatggatgttcatgcgctacaggatggaaaggcctgcaatgtaacgaggcctgtcaccctgggttttacggtcccgattgcaaactgagatgctcctgtaacaacggggaaatgtgtgatagattccagggttgtctttgctctcccggatggcaggggctgcagtgtgagcgtgagggcatacagcgaatgacgccaaagatcgtcgatttgcctgaccacattgaagtaaactccggaaaatttaatccaatttgtaaggcctcagggtggcccctgcccaccaacgaagaaatgactctggtcaaaccggatggcactgtgctgcaccctaaggactttaatcacactgaccatttttccgtcgctatatttacgatccaccgaattttacctcccgacagcggcgtgtgggtgtgctctgttaacaccgtcgccggaatggtggaaaagccctttaacatttccgtgaaagtgttacccaagcctctcaacgcacctaacgtgattgacaccggccataactttgccgtgatcaacattagtagcgaaccttacttcggagacggtccaattaagtcgaagaagttgctttacaagcctgttaaccattacgaagcttggcaacacatacaggtgactaatgagatcgtcacccttaactacttagagccgagaactgagtatgagctgtgcgtgcaactggttcgacggggtgaaggtggcgaagggcatccaggccctgtccgaaggtttacaacagcctcaattgggcttcccccccctaggggcctgaacctacttccaaaaagccaaaccactctgaacttgacttggcaacccattttcccaagtagtgaagacgatttctacgtcgaggtcgagagacgcagcgtgcaaaaatccgaccaacagaatattaaggtgcccggcaacctcacttctgtactcttgaacaacctgcaccccagagaacagtacgtggtgcgggccagggttaacactaaggcacagggggaatggtctgaggacttgaccgcctggactctgtccgatattctgcccccgcagcctgagaatattaagatttccaatattacacactcttcagcggtgatcagctggaccatactggacggctatagcatctcgtcaataaccatccggtataaggtccaggggaaaaacgaggaccagcacgtcgacgtcaagatcaagaacgcaactattactcagtaccaactgaaagggttggagcccgagacagcgtatcaggtcgatatcttcgctgagaacaacattggctcctcgaaccccgctttttcccatgaactagtcacacttcctgagtctcaggctccagccgatcttggaggcggcaagatgctgctgatagccattctgggttccgcagggatgacttgtctgactgtccttttagcattcttgataatcctgcagctgaagagagctaatgtgcagagacgaatggcacaggcattccaaaacgtcagagaagaacctgccgttcagttcaattccggtaccttggcgcttaaccggaaggtcaaaaataacccagatcctactatctacccggtgttggattggaatgatatcaagttccaggacgtgattggggagggaaatttcggacaagtactcaaagctcgcattaagaaggacgggttgaggatggacgccgctattaaacgaatgaaagaatatgcatctaaggacgaccatcgagatttcgccggagagttggaagtgttgtgcaagctcggtcatcatcctaacatcatcaacctgctgggggcatgtgaacaccggggttacctgtatttggcgattgagtacgcaccacacggaaatctcttggactttttgagaaagtcacgcgtgctcgagacagatccagcctttgctatcgccaacagtaccgcgagcaccttgtcctcgcaacaactgctgcatttcgcagcggatgtcgctcggggtatggattacctatctcaaaaacaatttattcacagagatctggccgctaggaatatcctcgttggggagaattacgttgcaaagattgcggattttggactcagtcgaggtcaggaggtgtatgtgaaaaagaccatgggacgcctgccggtgcgctggatggcaatagagtctctgaactactcggtttacaccacaaactcagatgtgtggagttatggcgttctgctgtgggaaatcgttagcttgggtggaaccccttattgcgggatgacttgcgccgagctctacgaaaaactgccgcaggggtacaggctcgagaaaccactgaactgcgacgatgaggtgtacgatctgatgcgccaatgctggcgcgaaaagccgtatgagcggccctcttttgctcagatactggtgtctcttaacaggatgttagaggagaggaagacctacgttaacacaaccctatatgaaaaattcacatacgcaggaatcgactgctccgctgaggaagccgcttag

SEQ ID NO: 17599 - DNA, 2931 bp, Artificial Sequence
  Description of Artificial Sequence: Synthetic coding sequence
atggattccttagcctccctggtcctatgcggagtgtccctgttgctttctgcatcttttctaccagccacactgactatgactgttgacaagggtgacaacgtcaatataagcttcaaaaaggtgcttatcaaggaagaggatgcagttatctataaaaacggtagcttcattcacagcgtacctaggcacgaagtgcccgacattttagaggtccatctgccccatgcccagcctcaggacgccggggtttactctgctcgatacattggtggcaatctgtttacaagcgcttttaccagactgatcgtgcggcgctgtgaggctcagaagtgggggccagaatgcaaccatctctgcaccgcatgtatgaataacggcgtatgccacgaggatacgggagagtgtatttgcccgcccggctttatgggccggacctgcgaaaaggcctgcgaactgcacacattcggccggacctgcaaggagaggtgcagcggccaggaagggtgtaaatcctatgtcttttgtttgccagacccttatggatgcagttgcgcaacgggctggaaggggctacagtgcaacgagggcatccagaggatgactcccaagatagttgatctgccagaccacatcgaggtaaattctggcaaattcaatcccatttgtaaggcatccgggtggccactgcccactaacgaggagatgaccttggtgaaacccgatggcacggttttacacccaaaggacttcaatcacaccgaccacttcagcgtagctatttttacgatacatcgcatccttcccccggacagcggcgtctgggtgtgctctgtcaatacagtggccggaatggtggaaaaaccctttaacatttctgtcaaagtcttgcccaaacccctgaacgcaccaaacgtgatcgacacaggtcacaatttcgctgtgattaacatctcaagcgaaccatacttcggcgacggacccattaagtccaaaaagcttctgtataagcctgtgaatcactacgaggcatggcagcacattcaggtgacaaatgagattgtgaccctcaattatctggagccccgcacggagtacgagctttgcgtccaactggtccggcgcggcgaaggaggcgagggacatcctggacccgtgaggcgtttcactaccgccagcatcggacttccacctccgcgcggcctgaatttgctgccaaagtcccaaactacccttaatttaacttggcagcccatttttccaagtagtgaagatgatttctacgtggaagtagaacgtcgcagcgttcaaaagtcagaccagcaaaacatcaaagtgcctggaaatttgactagcgtcctgcttaacaacttgcaccctagagagcagtacgtagtgagagctcgggtgaacaccaaggcacagggtgagtggtcggaggatttaacagcgtggactctcagtgatattctgcctccacaaccagaaaatatcaagatttcaaatatcactcactcgtctgcagtgatctcttggaccatccttgacggctattccataagttcaatcactatccgctacaaagtccaggggaaaaatgaagaccagcatgtagatgtgaagattaagaacgccacaatcacccagtaccagctgaagggcctggagccagagaccgcttatcaggtagacatctttgccgagaacaatatcggtagctcaaatccagccttcagtcatgaattggtgacattaccagagagccaagccccagcggatctgggcggcggtaagatgctgctgatcgcaattttgggaagcgccgggatgacctgcttaaccgtgctcttggcctttctgatcatactgcagctcaaaagagcaaatgtccagcggaggatggcacaggctttccagaatcgggaagagcctgcagttcagtttaactcaggcactcttgcgctgaacaggaaggtcaagaacaatcccgacccaaccatttacccagtcttagattggaatgatattaaattccaggacgtcatcggtgaggggaattttggtcaagtcttgaaagccagaatcaaaaaagacgggctcagaatggatgctgctattaaaaggatgaaggaatacgcttccaaggatgatcaccgtgattttgccggcgagttagaagttctctgcaagctggggcatcaccctaatatcattaacctgttgggcgcctgcgagcatcgagggtacttgtacctggccatagagtacgcaccccacggcaatcttctagatttcttgcggaagtcccgcgtgctagagaccgaccctgcattcgccattgccaacagcaccgcctccactttatcctcccagcagctcctacacttcgccgcagatgtcgcacgaggaatggactacctcagccaaaagcaattcattcaccgggatctggccgcccggaatattctggtgggtgaaaactacgtagccaagattgccgacttcggcttgtcacgggggcaggaggtgtatgtaaaaaagactatgggccggctcccagtccgctggatggcaattgagtccctgaattactctgtatacactactaactcagacgtgtggagctacggggtgttactgtgggagatcgtgagcctcggaggtacgccttattgcggcatgacctgcgcagagctttatgagaagttgccgcaagggtaccggcttgaaaagcctctgaactgcgacgacgaggtgtacgatcttatgcgtcagtgttggcgcgagaaaccctacgagcggcccagtttcgcacaaatcttagtatcactgaataggatgctggaggagcggaaaacctatgtgaacaccaccctgtacgagaaattcacctatgctgggatagattgctctgccgaggaagccgcatag

SEQ ID NO: 17600 - DNA, 7884 bp, Artificial Sequence
  Description of Artificial Sequence: Synthetic coding sequence
atggaaaaactccacggtcacgtcagcgcccatcccgatatactgagcctagaaaatcggtgtcttgcaatgctcccagacctccagccccttgagaaactgcaccagcatgtgtctactcactccgacatcctgagtctcaaaaatcaatgcctggccacactgcctgacctcaaaacaatggagaagccgcacggctatgtctccgcccatcctgacatcttatctctggagaaccagtgtctggcaaccttaagtgatttaaagacgatggaaaaacctcatggtcatgtctctgcccaccccgacatcttgagcctagagaacagatgtctcgcaaccctctcttctctcaagagcacagttagcgccagcccattgtttcagtccctccagatttcgcacatgactcaggccgacctctaccgagtgaacaactctaactgtctgttgtcggaacccccaagctggagggcccagcacttctctaagggcctggacttgtccacatgccctatcgccctgaagtctatcagtgccacggaaaccgcccaagaggccaccctgggccgttggttcgatagcgaggagaagaagggggcggagacacagatgcccagctactcccttagcctgggtgaggaggaggaggtagaggatcttgccgtgaagcttacctccggggactctgagagtcacccagagcccacagatcacgtgttacaggaaaagaaaatggctctgctcagtctcctctgcagcaccctggtgtccgaggtcaacatgaataacactagtgaccccactctggcggctatttttgagatttgcagggaactggcccttttggagcccgaattcatcctaaaagcttccctgtatgcaagacagcagctgaacgttaggaatgtggcaaacaatatcctcgccatagctgcgtttctacctgcttgccgccctcacctgagacggtacttctgcgctatagtgcagctcccctccgactggatccaggtggctgaactttatcagtctcttgccgaaggcgataagaataaacttgtaccattgcccgcttgcctccggacagcaatgactgacaagttcgctcagtttgatgagtatcagttggcgaaatataatccaaggaaacatcgggcgaagcggcaccctcggcgcccccctaggagccccggtatggagccaccatttagccaccggtgcttcccgaggtatattggctttctccgtgaggagcaacgtaagttcgaaaaagcgggcgacaccgtctcagagaagaagaatccaccacggtttacactgaagaagctggttcaacggcttcacattcataaacccgcccagcatgtacaggcactcctcgggtatagatacccgagcaatctccagctgttttcgcgctctaggctcccaggcccttgggatagctcacgagcaggtaagcgcatgaagctctcccgccccgaaacttgggagagggagctctccctgcgtggcaacaaggcaagtgtgtgggaggaactgatagagaatgggaagctaccttttatggccatgcttagaaacctctgtaatttactgcgcgtcggtatttcgagtcggcaccacgagctcatactgcagcgactgcaacatgcaaagtctgtcatccactctagacagttccccttcagatttctaaatgcgcatgacgctatcgatgccttggaagctcaactgcgcaaccaggctctcccctttcccagcaacatcacgctgatgcgacgaattctgacacggaacgagaaaaatagaccacgtaggaggtttttgtgtcacctgagtagacaacagctgaggatggccatgcgcatccccgtgctctacgaacagctcaaacgcgagaaactgcgtgtccataaggctcggcagtggaagtatgatggagagatgctgaatagatatagacaagccttggaaaccgccgtgaacctgtccgtgaagcacagcctgcctctgctgcccgggcgaacggtgctggtatacctaacagacgccaacgccgacagactttgcccgaaatccaatcctcagggaccccctctgaactacgcattactgctaataggtatgatgataacacgtgccgagcaggtggacgtggtcctgtgtgggggagacaccctgaagaccgcagtgctcaaagccgaagaaggtatcctcaagaccgccatcaaactgcaggcccaagtgcaggagtttgacgagaatgatggttggtccctgaatacattcgggaagtaccttttaagcctcgctgggcagagggtcccagtggatagggtgatcctgttggggcaatctatggacgacggaatgatcaacgtcgccaaacagctctactggcaaagggtcaattctaagtgtcttttcgtgggtatcctcctcaggcgtgtgcagtacctttcgacagatttaaaccctaacgatgtcacactaagcggttgtacagatgccatcttaaagttcatcgctgaacacggcgcgtctcacctgttggagcatgttggtcagatggacaagatatttaaaattcctccgcctcctgggaaaactggtgtccagagcctacgtcccttggaggaggacacccctagccctttggcccctgtcagccaacagggctggcgttccatccgtctttttatttctagtacatttcgagatatgcacggtgaaagagatctcttactccgctctgtgctgccagcccttcaggctagggctgcccctcaccgtatcagtctgcatggcatcgacctcaggtggggagtgaccgaggaagagactagaaggaacagacagctcgaggtctgcctcggtgaggtcgaaaacgctcaattatttgtcggtatcctgggctcccggtacggatacatcccacccagctacaacctgcctgaccatccacatttccactgggcacaacagtacccttctggccggagtgtcactgagatggaggtcatgcagtttctgaaccggaatcaacgcctgcagcctagcgctcaggctctgatttatttcagagatagttctttcctgtctagcgtgcccgacgcctggaagagcgatttcgtctccgagagcgaggaagctgccagacgaatctctgaattaaagtcatacctatcccggcagaagggcatcacatgtaggcggtacccttgtgaatggggtggggtggccgctgggcgcccttacgtgggaggtctcgaggagtttgggcagcttgtgctgcaggacgtgtggaatatgattcagaagctgtacctgcagcctggcgccttgctggagcagccggtgtctatccctgatgacgatttggtgcaggccacctttcagcaactgcaaaagccgccctctccggcccggccaaggttgcttcaggacactgtgcaaagattgatgctccctcacgggcgtctgtcactagtaactggacagtctgggcagggcaaaaccgccttcttagcgagcttggtcagcgccctgcaggctccggatggggcgaaagttgcgagcttagtgttcttccactttagtggcgcacggcccgatcagggcctagctctgactcttttgcgccgactttgcacctatcttcggggacagttaaaggaaccaggagcactgccctccacatacagaagcctggtatgggagttgcagcagcgactcctgccaaaatcagcggaatccctacatcccgggcagacccaggtcctgatcattgatggggctgatcggctggtcgatcagaacggacagcttatttccgattggatacctaaaaaactgccgcggtgcgtgcacctcgtcctcagtgtgagtagcgatgcaggactgggggagacgctggagcaatcacaaggagcgcacgtgctggcattgggtccgcttgaggccagcgcccgcgctcgcttggtgcgtgaagagctggcactgtacggcaaacggctagaagagtctccctttaataatcaaatgcgccttttgctggttaagagggagagcgggcggcccctctacctgcgtctagtaactgaccatcttcgattatttaccctgtatgaacaggtatcagagcggctgaggaccctgcccgctaccgtgcctctgctgctgcagcacattctgagcactttggaaaaagagcacggccctgacgtactcccacaagctctaacagccctggaggtaactcgcagtgggctgacagtggatcaacttcatggagtgctgtccgtgtggcgcacactaccgaagggtactaaaagctgggaagaagctgtcgcagccggcaacagcggtgacccataccccatgggtcctttcgcctgcctagtgcagagcctgcgctccctgttaggtgaagggcccctagagagacccggcgctagactttgtctgcctgacggacctctcagaacggctgctaagcggtgctatgggaagaggcccggattggaggacaccgcccatattcttattgctgctcagctgtggaaaacttgcgacgcagacgccagcggtacattccgcagctgtcctcccgaagcgttgggagacctgccctatcatcttcttcagtccgggaacagaggcctcctgtctaagtttctgactaacctgcacgtggtggcagcccacctcgagttgggcctggtgtctcggttactggaagctcatgccctatatgcttcctccgttcctaaggaggaacagaagctgcccgaggcagacgtggctgtgtttcgcactttcctgaggcagcaagcttctatcctgtcccagtatccaagattgctgccccagcaagcagcaaatcagcctttggatagccctctttgccaccaggcctcccttctgagccgccggtggcatctccagcacacactcaggtggttgaacaagcctcggactatgaaaaatcagcagtcctccagcttgtccctggccgtgtcctcatctcccactgccgttgcctttagcaccaatggacagagggccgctgtaggcaccgcgaacgggacagtttacctgctcgatttgaggacatggcaagaagaaaaatctgtggtttccggatgcgatggaatttccgcctgtttgttcctcagtgacgatacactgttcctcacagccttcgatgggctgttagaactatgggatctgcagcacgggtgcagagttctccagacgaaggcccatcagtaccagattacaggttgctgtttgagccctgactgccgcttgctcgccaccgtgtgcctcggaggctgtctgaaattgtgggacactgttagaggccaattggcattccagcatacgtatccaaaatcattgaactgtgttgcctttcacccggaaggccaggtaattgcaactggatcatgggctgggagtattagtttctttcaggtagacggccttaaagtgacgaaggaccttggggctcctggagcatctattagaactttggccttcaacgtgcccgggggtgtggtggcagtcggcaggctggacagtatggtagagttgtgggcttggcgcgagggggcccgcttggctgcttttcctgcccatcacggcttcgttgcagccgccctgttcctgcatgctggatgccagctgctgacagccggggaggacggtaaggtgcaggtatggtctggaagcttgggtcgccccagaggacaccttgggtcactgagcctgtcacctgccttgagcgtggcattaagccccgatggtgatagggtggcggttggctaccgggccgacggaattaggatctacaagatctcctcaggaagtcaaggtgcacagggccaagccctcgacgtggcggtgtccgctctcgcttggctcagcccaaaagttctggtatcaggcgccgaggatggttccctccaggggtgggctctgaaagaatgttccttgcaatctctctggctactgtctagattccagaaaccagtcctaggattagctacgtctcaggagctgcttgctagtgccagcgaggatttcacggtccaattgtggccgcgccagcttctgactcggcctcacaaggccgaggactttccatgtggaacggagctgagggggcacgagggtccagtgtcctgctgctccttcagtacagatggaggcagtctagcaaccggaggaagagataggagcctcctgtgttgggacgtcagaacacctaagacccctgtcttgatacatagcttccccgcttgtcatcgggactgggtcacggggtgcgcatggactaaagacaatctgctcatcagctgctcatctgatggttcagtcggtctgtgggacccggagtctgggcaacggctgggccagttcctgggacaccaatccgccgtatccgccgttgctgctgtagaagaacacgtcgttagtgtcagtcgagacggcacactgaaggtttgggatcaccagggagtggagctcaccagcattccagctcactcagggcccataagccattgtgctgctgcgatggagccgagagccgccggacagccaggttcagaattgctggtggtcactgtcggcctggacggggctacgcggttgtggcaccccctcttggtgtgccaaactcacaccttgctgggtcattctggccctgtgcgggcagctgccgtttctgaaacctcaggcttaatgcttacggcatcagaggatggttctgtgaggctatggcaggtcccaaaggaagctgatgacacctgcatcccccggagctcggctgcagtcaccgccgtggcctgggctccagacggatctatggcagtgtccggaaatcaggcaggggaacttatcctatggcaagaagcgaaagcagtggccaccgctcaagcccctggtcacatcggagcactgatctggagtagcgctcatacttttttcgtgctttccgccgacgaaaaaatctctgagtggcaggtgaagctgagaaagggaagcgcaccaggaaacctgtcgctgcatctcaacaggattcttcaggaggatttgggcgtgctcaccagtttagattgggctccagacggtcattttttgatcctggcaaaagccgatcttaagctgctctgcatgaagcccggggacgcccctagcgagatctggtcctcttacacagagaatccaatgattctatctactcataaggagtacggcatttttgtgctccagccaaaggatcccggtgtcctgtccttcctgcggcagaaagagagcggggaatttgaggagcgcttgaacttcgacatcaatcttgagaacccctccaggacattgattagcataactcaggccaaaccggagtctgagtcctctttcctgtgtgccagcagcgacggaatcctgtggaatctcgccaagtgtagccctgagggagaatggacgacaggaaatatgtggcagaaaaaagctaatacgcctgagacacagacacctgggacggacccttcaacatgccgggaatctgacgcctcaatggatagcgacgctagcatggactctgagcctactcctcatttaaagacccgacagaggagaaagatacattccgggtccgtgacagctctccacgtcttacctgaactcctcgtgacagcttcaaaggatcgggacgtcaaattatgggagcggccgagcatgcagctgttggggctgtttcggtgcgaaggtagcgtctcatgtctggaaccttggctcggagccaattctacactgcaactggcagtcggtgacgtccaaggaaacgtgtacttcctgaactgggagtag

SEQ ID NO: 17601 - DNA, 7860 bp, Artificial Sequence
  Description of Artificial Sequence: Synthetic coding sequence
atggagaagctgcacggccacgtgtctgcgcatcctgatattctcagcctcgagaatcgatgtctggctatgcttccggacttacagcccctggaaaaactgcaccagcatgtgagcacccattccgacatactgtcactaaaaaatcagtgcctcgctacactgccagatttaaagactatggagaagcctcacggatatgtctcagctcacccagatatattaagcctggagaaccagtgtctggctactctatccgatctgaagacaatggaaaagccccatggccacgtttctgcacatcctgatatcttatctctggagaatcgctgcctggctactctctcttccctcaaatcaacagttagcgcgtcccccctcttccagtcccttcagattagccacatgacacaagctgacctttaccgtgtgaacaatagtaactgtttattgtctgagccccccagctggagggcacagcatttttcaaaaggtcttgacttgagcacatgtccaatagctcttaaaagtattagtgcaacagagaccgcccaagaggctacactgggaagatggttcgactctgaagaaaagaaaggggccgagacccagatgccaagctatagcttgtcactgggcgaagaagaggaagtggaagaccttgctgtgaaattaacctctggggatagtgaatcacaccctgaacccacagaccatgtgctgcaggaaaagaaaatggcgttattgtcactgctttgctccactcttgttagtgaggtgaatatgaataataccagcgatccgaccttggcagccatctttgagatatgccgggagctcgctctgctcgaacccgagtttatcctgaaggcctcactgtacgcccggcagcagctaaatgttagaaacgtggccaataatatcctggccatagccgccttcctgccagcctgtcggccgcacctgcggcggtacttttgcgcgatcgtccagcttccctccgactggatccaggtggcggaactgtaccaatctttggccgaaggggacaagaacaagctggtgcccctgcccgcctgtctgcgaaccgcaatgacagacaaatttgcccagtttgacgagtatcagctggccaagtacaaccctcgaaagcacagggcaaagcggcatcccaggcgcccgcctcggagccccgggatggagcccccctttagccaccgatgttttccccgatatattggctttctgcgtgaagagcagaggaaatttgagaaggcaggggacacagtgtcagagaaaaagaacccacctcggttcaccctgaaaaaactggtccagagattgcatatccataagccagcgcagcatgtgcaggccctactgggatatcggtaccccagcaacctgcagctgtttagccgcagcagactgcctggcccttgggactctagcagagccggtaaaagaatgaagctttccagacccgaaacttgggaaagagaactgtctttgcgcggcaacaaagccagcgtgtgggaagagctgatcgagaatggcaaactgcctttcatggcaatgctgagaaacctgtgcaacttactccgagttggcatttcctcacgacaccacgagctgattctccagagactgcagcatgccaaatctgtcatccactcccgacagttcccctttcgcttcctgaatgcacacgatgccatagacgcattggaagcacagttaagaaaccaggcgttgcccttcccgtctaacatcaccttaatgaggcgcattttgaccaggaacgagaagaaccgcccaaggagacgcttcttatgtcacctctctcggcagcagctgcggatggccatgcggatccccgttttgtatgagcagctgaaacgcgaaaaacttcgcgttcataaagctcggcagtggaaatatgatggagaaatgctaaataggtacagacaagccctggagacagctgtcaatctgtcagtgaagcactccctccccttgctgcccggtcggactgtgctggtgtacctaacagacgccaacgcagatcggctgtgccccaagtctaatccacagggaccccccctaaattatgctctccttctaattgggatgatgatcaccagggccgagcaggtagacgtcgtgctgtgtggcggcgatactttgaaaactgccgtgctgaaagctgaggaagggatccttaagacagccattaagcttcaggcacaggtccaggaatttgatgagaacgatgggtggtcgcttaacacatttggcaagtacctgctgagcctcgctggacagcgggtgccagttgatcgggtgatccttttggggcaaagcatggatgacggaatgatcaatgttgctaagcagctatactggcaacgtgtgaattcaaaatgtctgtttgtgggcattttgttgcgcagagtccagtatcttagtacagatctgaacccaaatgatgtgaccctgtctggatgtacagatgctatacttaagtttatcgctgagcatggggcttcccacctgctcgaacacgtcggacagatggataagatcttcaagatcccacccccccctggcaaaactggagtgcagtccttgcggcccctagaggaagacacccccagtccccttgccccagtctcgcagcagggatggagatctatcaggctgttcatatcttcaacatttcgcgacatgcacggggagcgggacttgttgctgcgcagtgtcctgcccgctctgcaggcccgagctgcaccacaccgtataagtctacacgggattgacctgcggtggggcgttacagaggaggaaacacgcagaaaccgccagttagaagtttgtctaggagaggtggagaacgcacagctgtttgttggaatcctcggctctcgatatgggtatatccccccttcttacaatcttcctgatcacccgcactttcactgggcccaacaatacccaagtggccggtcagtgaccgagatggaagtgatgcagttcttgaaccgcaaccaaagactgcagcccagcgctcaggccctgatctacttccgggatagtagcttcctcagctccgtgccagatgcttggaagtctgacttcgtgtctgaaagtgaagaagctgcgcgcaggatcagtgaattaaagtcatatctgtcccggcagaagggaattacctgtcgacgctacccttgtgaatggggtggagtcgcagccggacgcccctacgtgggcgggctagaggagtttggacaactcgtgctgcaggatgtatggaatatgatccaaaaattgtacttacagccaggagccctgctggaacagccggtctctattccggatgacgatctggtgcaggcgactttccagcagctccagaagccccccagccccgcccgccctcggcttctacaggataccgtgcagagacttatgctacctcacggcagactttctttggtcacaggtcaatcaggccagggcaaaactgccttccttgcgtcactggtttctgccttgcaagcaccggacggagccaaagtcgcctccctggtgtttttccatttctcaggagctaggcccgatcagggactggccttgacactgcttcggaggctttgcacttacctgaggggccagctaaaagaaccaggcgcacttccttccacgtaccgaagcctggtatgggagcttcaacagcgcctactccctaaaagcgctgaaagtctgcacccagggcagacgcaggtgttaattatcgacggcgccgatcgcctcgtagatcaaaatggccagctcatctccgactggattccaaagaagctgccccggtgtgtgcacctggtgctgtcagtgtcctcagatgctgggttgggagagaccctggaacaaagccagggcgcgcacgtgctggccttaggacctctagaggcatcggcccgggcccgactggttcgagaagagctagccctctatgggaaaagactcgaagagtccccatttaacaatcagatgcgcctgcttctggtcaagagggaaagcgggaggccgctctatctgcgcctggtgactgatcacctgcgcttatttacactgtatgagcaggtgagtgagagactcagaacactcccagctacagttcctctcctgcttcagcatattctgtccacactggaaaaagagcacgggccagatgtgctgcctcaggctctcacagcgctcgaggttactagaagcggtctcacagtcgaccagttgcacggtgtgctgtcagtatggagaacattgcctaaggggaccaagtcatgggaagaagcagtggcagctggaaattccggcgatccatatccaatggggccctttgcctgtttagtgcagtctttgaggagcctactgggggaggggccccttgaaaggccaggcgccagattatgcctgcccgacggaccactgcgcacagctgcaaagaggtgctatggcaagaggcctggcttagaagacaccgcacatatcttgatagccgcgcagctgtggaagacttgtgacgctgatgcgagtggaacttttaggtcatgcccgcctgaagctctcggcgacttgccataccacctgcttcagagcggaaacagggggttactgtcaaaatttttgactaacttacacgtggtcgccgctcatttggagctaggcttggtctcacggcttttagaggcgcatgccctttacgcctcttccgtcccaaaggaggaacagaagttacctgaggccgacgtggccgttttcaggacatttttacgacagcaggcaagcattctgtctcaatatcccagattgctgcctcaacaagctgcgaatcaacccctggactctcctttgtgtcatcaggcatcactcctgtcacggcggtggcatctgcagcacaccctacgctggctaaataagccacgcactatgaagaaccaacagtccagttcactgagtctggcagtgtcgtcgagccccactgccgttgctttctcgacaaatggccagagggcagcggtgggcacagccaacggaacagtttatctgctggacctaaggacttggcaggaggagaagtcagtagtgagcggttgtgatggcatcagcgcttgcctgttcctgtctgacgacacattattcctgactgcctttgacggcctgttggagctgtgggatttacaacacggctgtcgcgtgctgcagaccaaggcacaccagtatcagatcactggctgttgtctctcccctgactgccgcctgcttgccacagtttgtttgggcggatgtcttaagctctgggacacagttaggggacagctggcattccagcacacctaccctaaatcccttaactgcgtggcctttcaccccgaggggcaggtgatcgctaccggatcgtgggctggaagtatctcattctttcaagtcgatggcttgaaggttacaaaagaccttggagccccaggtgccagcatccggacattggcattcaatgtgcccggaggcgtggtcgccgtgggtcgtcttgattctatggtggagctctgggcatggagagagggagctaggctggcggcatttcccgcccaccacggcttcgtagcggccgctttgttcctacacgccggctgtcagctactgacagccggggaagacggcaaggtgcaggtgtggagcggttcactgggccgcccccgagggcatctgggctcattgagtctctcccccgcgctgagtgtcgctctctcaccagacggagatagggttgcagttggttatcgcgctgacggtatccgcatctacaaaatatcaagcggcagccagggtgcccagggacaggctctcgatgtcgctgtctccgccctcgcctggctgtcccccaaagtcctggtgtcgggcgcagaggacggaagcctacaggggtgggcgctcaaggaatgctcacttcagtcactctggctgctgtcacgttttcagaaaccagtgctgggcctagccacttcccaggaattattagcgtcagcatccgaagactttactgttcagctgtggccacgccagctgctgacccgaccccataaggctgaggatttcccctgcggaactgagttgcgtggtcacgagggcccagtttcgtgttgtagcttttcaactgacggagggagtttagccacaggcggcagagatagaagtctcctttgttgggacgtgcggacgcctaaaacccctgttctcatccatagctttccagcatgccaccgagattgggtcaccggttgtgcctggacaaaggataacctgctgatctcttgctcctctgatggaagcgtaggcttgtgggatccagagagcggtcagagactcggacagttcttgggacaccagtctgctgtgtcagctgtggcagccgtggaagagcatgttgtgtcagtgagccgcgacggtaccctcaaggtatgggaccaccagggggtggaactgacttctataccagcccactccggaccaatctcccactgcgccgccgcgatggagccgcgggccgccgggcagcctggcagcgagctgctggttgtgactgtgggcttggatggagccaccaggctgtggcatcctctactggtgtgccaaacccatactctcctgggtcacagtggaccggtgcgtgccgccgcagtcagcgagaccagcggactcatgctcacggcttccgaagatgggtcggtcagactgtggcaggtgcccaaggaagctgacgacacctgcataccgcgcagttccgcggccgtcaccgccgtggcctgggcccctgacggcagtatggcagtgagcggcaaccaggccggagagctgatcctctggcaggaagcaaaagccgtagcaacggcccaagcccctggccacataggagccctgatctggtcctccgctcatacattctttgtcctttccgccgatgagaaaatttccgagtggcaggtgaaacttcgcaagggaagcgctccggggaatctgtctctgcacctgaatcggatactccaggaggatttaggcgtactgacgtcattggattgggcaccagatggacatttcttgatcctggccaaggccgatcttaagttgctgtgcatgaagccaggggatgcaccgagtgaaatctggagcagctatactgagaaccctatgattttgtcgacccataaggaatatggcatattcgtgttacagccgaaggatccgggcgttctcagctttttacggcagaaagagtccggcgagtttgaggagagacttaatttcgacataaatctagaaaatccttcccgtaccttgatttctattacacaggccaagcctgagtcagctctgatgggctcttacggaacctggccgaatgccgcccagaaagagaatggaccacaggtgacctgcgggagaaagaaaaacacacccgagacacagacaccaggcacagacccctctacttgccgtgagtcagacgcgtcaatggactccgatgcatctatggacagtgagccgaccccccatctcaaaacaagacagcggcgcaaaattcatagtggctctgttaccgccttacacgtgttacctgagcttctcgtgacagcctcaaaagaccgggatgtgaagctgtgggagagaccatccatgcagctcctgggtttattccgttgtgagggctccgtctcttgtttggaaccttggctgggggcaaatagcacactccagcttgccgtgggggacgtgcaggggaatgtgtatttccttaattgggaatag

SEQ ID NO: 17602 - DNA, 2031 bp, Artificial Sequence
  Description of Artificial Sequence: Synthetic coding sequence
atgaagaaccagcagtcttcctctctttccctggcggtctcaagctctccaaccgcggtggcatttagcaccaacggccaaagggccgctgtgggtaccgcaaatggcaccgtgtaccttctagatctcagaacatggcaggaagagaagtcagtcgtttccgggtgtgacggcatcagcgcctgcctatttctcagcgatgataccctctttcttaccgccttcgatggcctcctggagttgtgggatctacaacacggctgtagagtactccaaaccaaagctcaccaataccaaatcacaggctgttgtctgtcacctgattgccgtctcctcgctaccgtgtgcctgggagggtgtctgaaactgtgggacactgtccgaggccaactcgcctttcagcacacctaccccaagagcctgaattgcgtggcattccatccagaaggtcaggttatagcaaccggcagttgggctggatccattagcttcttccaagtggacggactcaaggtgacaaaggatctcggcgcacccggtgcatctatacgtacattagctttcaacgtgccagggggggtagtggcagtcggtaggctggattctatggtggagctttgggcttggcgggaaggggctagactggccgccttccctgcccaccacgggttcgtcgccgccgccttattcctgcatgctggctgtcaattgctcaccgctggagaggacgggaaggtacaggtttggtcaggcagtctgggccgaccaagaggacacctgggtagcttgagcctctcacccgctctctctgtcgcccttagtcccgacggcgacagagtggccgtgggatatcgcgcggatggcataagaatctacaaaatttccagtggtagtcagggggcccaggggcaggcactggacgttgcggtgtctgccctggcctggctgtctcctaaggtactggtgtcgggagctgaggatggatcattacagggctgggcactgaaagagtgctctttgcaatcattatggctactttctaggttccaaaaacccgtccttggtctggccaccagccaggagttgctcgctagcgcctccgaggattttaccgtacagttgtggcctcggcaacttttaacacggccccataaagccgaagattttccctgtggtactgagttgagaggccacgagggaccagtgtcctgttgctctttcagtactgatgggggatctctcgcaacaggaggccgggatcggagtctgctgtgctgggacgtgagaacccccaaaacgccagtgctgattcattcattccccgcatgtcaccgcgattgggtgactggttgcgcatggaccaaagataacttgctgatcagttgttcctcagacggatcggttggactctgggacccagagtccgggcagcgcctcggtcagttcctcggacatcagagcgcagtgtctgcagtcgccgccgtggaagaacacgtcgtgagcgtttcccgggatggaaccctgaaggtgtgggaccatcagggcgttgagttgactagtattcccgcacactctgggcctatcagccactgtgccgctgcaatggagccccgcgcggccggccagccgggaagtgagctgctcgtggtaactgtgggcttagacggggcaacccgcctttggcaccctctgttggtttgtcaaacgcatacactcctagggcactccgggccagtccgcgccgctgccgtgtctgaaacatccggattaatgctgaccgcttctgaagacggtagcgtccggctgtggcaagtccctaaggaagctgacgacacctgtatccccagatctagcgcggcagtcaccgcggtggcatgggctccagacggcagcatggccgtttctggtaaccaagccggcgagctcatactctggcaagaagcaaaagccgtcgctacggcccagagttctcccgagcccaattcgacgggaggcttacgcggagctgacaaatccggtctggggtcgtag

SEQ ID NO: 17603 - DNA, 501 bp, Artificial Sequence
  Description of Artificial Sequence: Synthetic coding sequence
atggagaagttacacggacacgtgagtgctcaccctgatattttgagcctggagaacagatgcctcgcaatgcttcctgacctccagcctctggaaaaattacaccagcacgtgagcacccactcggacatccttagcctcaaaaaccagtgcttggccactctgccagatttgaaaactatggaaaaacctcatggatacgtttctgcccacccggacatccttagcctggaaaatcagtgcctggcaaccctctcggacttgaaaactatggagaagcctcacggacatgtttccgctcaccctgatatcctctccctggagaaccggtgtctggccactctgtcatccctcaagtctaccgtgagcgccagccccctgtttcagagcctgcagattagccacatgacacaggcagacctttaccgggtgaataactccaactgtctgctaagcgaaccgccgtcatggagagctcagcacttcagcaaaggtctctag

SEQ ID NO: 17604 - DNA, 1260 bp, Artificial Sequence
  Description of Artificial Sequence: Synthetic coding sequence
atggctgaggatgtgagttcagctgctccgagcccccgcggttgtgccgatggcagggacgccgaccctaccgaagagcagatggccgaaacagagagaaacgatgaagagcagtttgaatgtcaagaattactggaatgtcaggttcaggtgggagcccctgaggaggaagaagaggaggaggaggatgccgggcttgtagctgaagctgaagccgtggccgccggctggatgttggactttctttgtctgagtttatgtcgcgcgttcagggacggcaggtcagaagactttcgccgaacacgtaacagcgcagaagcaatcatccatgggctgagttctctaaccgcttgccaactccgcacgatttatatttgtcaattcctaaccaggattgcggccggaaagaccctggacgcgcagtttgagaacgatgagcgcattacaccacttgagagcgcgctgatgatttggggcagtattgagaaggagcacgacaaactgcatgaggagatccagaacctgattaagattcaggccatcgctgtgtgtatggagaacggcaattttaaagaggcagaagaagtcttcgagagaatctttggcgaccctaacagtcacatgcccttcaagtctaagctcctcatgatcatcagtcaaaaagacacttttcactcttttttccaacatttctcttacaaccacatgatggagaaaataaagagttacgtgaattacgtgctgtccgagaagtccagcaccttcctgatgaaggccgccgcaaaagtagtggaatcgaaaaggacgcgaacaattacatctcaagataagccaagtggcaatgacgttgaaatggaaaccgaagcgaatctcgatacaaggaagagaagccataagaatctctttctcagcaagctgcagcacggtacacagcagcaggatctgaataaaaaggagaggcgagtgggaaccccacagtcgacgaaaaagaaaaaagagtctcgacgggcaacagagtcccggatcccggtgagcaaatctcaaccggtaactccggaaaagcatcgtgctcggaaacggcaagcgtggctctgggaggaagacaaaaaccttagatccggcgttaggaaatacggggagggaaattggtccaagatcctacttcattataagtttaacaatcggacttctgtgatgctgaaagaccgttggaggaccatgaaaaaattgaaactgatcagctcagattccgaagattag

SEQ ID NO: 17605 - DNA, 1320 bp, Artificial Sequence
  Description of Artificial Sequence: Synthetic coding sequence
atggcagaggatgtgtcgagtgcagccccctcgcctcgcggctgcgccgatggacgtgatgccgaccctacagaagagcagatggcggagactgaaagaaatgacgaagaacagttcgaatgtcaggagcttctcgaatgtcaggtgcaggtaggagccccagaggaggaagaagaggaggaagaggatgccgggcttgtcgcagaagcagaggccgtggctgccggttggatgctggattttctatgcttaagtctgtgccgcgctttccgcgacggaaggtctgaggacttccggcgcacccgcaactcggccgaagccatcatccacggcctttcctctcttacggcatgccagctgagaactatatatatttgccagttcctcacacggatagccgccgggaaaactttagatgctcagtttgaaaacgatgaaaggatcacaccgttagagagtgccctgatgatttggggttctatcgagaaggagcacgataagctacacgaggaaatccaaaacctaatcaaaatccaggcaattgctgtgtgcatggagaacgggaacttcaaggaggccgaggaggtgtttgagaggatatttggcgaccctaattctcacatgccttttaaatcaaagctcctcatgattataagtcagaaagacacatttcattctttcttccagcacttcagttacaaccacatgatggagaagataaaatcttatgtgaactacgtgctgagtgaaaagagttcgacctttctaatgaaggccgcggccaaggtcgttgaatctaagcggactaggacaatcacctcccaggacaagccatccgggaacgacgtggagatggagaccgaggctaacctggatacgagaaagtcagtttctgacaagcagtccgccgttaccgagtcctcagagggaacggtttcccttctgagaagtcacaaaaacttgttcctctcgaagctccagcacgggactcagcagcaagacctgaacaagaaagaaagacgtgtgggaaccccgcagtctactaagaagaagaaagagtcaagacgggcaacggaaagccgaatcccagtttcgaagtcacagcccgtcacaccggagaagcatcgtgcccgcaagcggcaggcttggctctgggaggaggataagaatctcaggagtggtgttcggaagtacggagagggcaactggtccaagattctgctgcactataaatttaataatcggacatccgtgatgctaaaagatcgttggcgaaccatgaagaaactgaaattaattagttcggactctgaagattag

SEQ ID NO: 17606 - DNA, 153 bp, Artificial Sequence
  Description of Artificial Sequence: Synthetic coding sequence
atattttctattatacacggactcagctctctgacagcctgtcagttacgcactatctacatttgccaatttctgacccgaatcgcagccggaaaaacgctggacgcccagttcgagaacgacgagcgcatcacccctcttgagagcgcctag

SEQ ID NO: 17607 - DNA, 1503 bp, Artificial Sequence
  Description of Artificial Sequence: Synthetic coding sequence
atggcaggcggtggaggctcctctgacgggtcgggaagagccgccggcaggcgggcatccaggtcttcaggccgcgctcggaggggtcggcatgagcccggattgggcggccccgcggaaaggggagccggagaggctcggcttgaggaggccgtgaaccgctgggtgctgaaattctactttcacgaggccctgagagccttcaggggatctagatacggggatttcaggcaaattcgtgacataatgcaggcactgctggtcagaccattgggcaaggaacacactgtgagtaggctccttagggtcatgcagtgcctgtcgcgaattgaagaaggggagaatctcgattgtagcttcgatatggaggccgagctgaccccgctggaatcagctatcaatgtgttggagatgatcaaaaccgaatttaccctaacggaagcagtggtggagagttcacggaagctggtgaaagaagccgcagtcattatctgtattaaaaataaagaattcgaaaaggccagtaaaatcctcaagaagcacatgtctaaagacccaaccacacagaagctccggaacgacttactaaatatcatacgcgagaagaatctcgctcacccagtcatacagaacttttcatacgaaacatttcagcagaagatgctgcggttcctagagagccatcttgatgatgctgaaccttatctgcttacaatggctaagaaggctctgaagagcgagtcagccgcctcttcaaccgggaaagaagataaacagccagctcccggccctgtggaaaagccgccaagagaaccggctcgacaactgaggaatccgcccacgaccatcggaatgatgactctcaaggccgcattcaagaccctgtctggggcccaggactccgaagcagccttcgctaagctggaccagaaagacctggtattaccaacccaggccctacccgcctctcccgcattgaaaaataagagaccaagaaaagacgagaacgaatcttccgcccccgccgacggcgaaggagggtccgaattacaaccaaaaaataagagaatgacaataagcagattggtactggaagaagattctcagtcaaccgaaccaagcgctggattgaactcttcccaggaggccgcttcagcaccaccttccaaaccaacggtcttgaaccagcctctgcctggggagaagaaccccaaagtgccaaaaggaaagtggaattccagtaacggcgtcgaggagaaagagacttgggttgaggaggacgaacttttccaggtccaggcggcccctgatgaggattcaactactaacataacaaaaaaacagaagtggaccgtggaggaaagtgagtgggtcaaagctggtgtgcagaaatatggcgagggaaactgggctgccatttcaaagaattatccctttgtcaacaggactgctgtcatgatcaaagataggtggcgcaccatgaaacgcctgggaatgaactag

SEQ ID NO: 17608 - DNA, 1200 bp, Artificial Sequence
  Description of Artificial Sequence: Synthetic coding sequence
atggccgaagcaatggatctgggcaaagatccaaacggcccaactcactctagtactctctttgtcagagatgatggctcatctatgtccttctatgtgcgaccttccccagccaaacgccgcctctccaccctgattctgcacggcggcggaactgtgtgcagggtccaggaacctggggctgttctgctggcacagccgggggaggccctggccgaggcctctggcgactttatatcaacccagtacatccttgattgtgtggaaaggaatgaaaggctggagctggaggcttatagactggggccagccagcgctgccgacaccggatccgaggctaagcctggcgcactcgccgagggagccgccgagccggagccccagaggcacgcgggacgaatcgcgtttactgatgctgatgacgtggctattctaacttatgtcaaggagaatgcccggagtccctcaagcgtaactgggaatgctctatggaaagcaatggagaaatcttctttgacacagcactcatggcaaagcctgaaggataggtacctgaaacatctgcgggggcaagaacataagtatcttctcggggatgcacccgtgtccccgtcgagccaaaaattgaagcgcaaggctgaggaagaccctgaagctgcagattcgggcgagccccaaaacaaaagaacccccgacctgcccgaggaggagtacgtgaaggaggaaattcaggaaaatgaggaagcagtgaaaaagatgttggttgaggcaacgagagagttcgaggaagtagtagtggacgaatcccctccggacttcgagatacacatcaccatgtgcgatgacgacccacccacacctgaggaagacagcgaaactcagccagatgaagaagaagaggaggaggaagagaaggtgagtcagccagaggtgggggccgctatcaagatcatacggcagctgatggagaaattcaatctcgatctctccactgtgacccaagcatttttgaagaattctggggagttagaggcaaccagtgcttttctggcctcgggccagcgggctgatgggtacccaatctggtcacggcaggacgacattgatctacagaaggacgatgaagacacccgggaagctctggtcaaaaaatttggcgcccagaacgttgccaggcggattgagttccgaaaaaaatag

SEQ ID NO: 17609 - DNA, 12735 bp, Artificial Sequence
  Description of Artificial Sequence: Synthetic coding sequence
atgatgcctgcccagtatgcactcacttccagtctggtgctattagttttgctcagtactgctagggccggtccattctccagccggtctaacgtaaccctaccggctcccagaccccccccccagccgggaggacacaccgtgggcgccggcgtggggtcccctagctcacagctatacgaacacacggtagaaggtggtgagaagcaggtcgttttcactcacaggatcaacttgccgccaagcacaggatgtggctgtccccctggaacagagcctcctgtgctggcctctgaggtacaggcactccgggtgcgtctcgaaatcttagaggaacttgtgaaagggctgaaagagcagtgcaccggaggttgctgtccggcatcagcccaggctggtaccggacagaccgacgtgaggacactgtgcagcctccatggggttttcgatctctctaggtgcacctgcagttgcgaaccaggatggggcggtcccacttgcagcgaccctacagatgcggagatacctccctcctcccctcctagcgcaagcgggagttgtcccgacgactgcaacgaccagggacgatgtgtgcgcggaagatgcgtgtgttttcctgggtacactggtccttcttgtgggtggcccagttgccctggcgattgccagggaagaggtagatgcgtgcagggtgtttgcgtttgcagagccggcttcagcggcccagactgcagccagcgaagttgccctaggggctgctcacagaggggccgctgcgagggtgggagatgtgtctgcgacccggggtacacaggcgacgattgcggcatgcggtcttgtccacgagggtgctctcagcgaggacgctgtgagaacggccgctgcgtctgcaacccaggttatacaggggaggactgtggcgtgcgtagttgcccacgtggttgctctcagcgtggcagatgtaaggacgggcgatgtgtatgtgaccctggctatactggagaggattgcgggactcgttcatgcccttgggattgtggcgaaggcgggcgctgcgtggacggtcgatgtgtctgttggcccggatacactggggaggactgctccacaagaacctgtcctcgggattgtcgtggtagaggcaggtgtgaggatggtgaatgtatttgcgataccggatatagcggtgatgactgtggggtccgaagctgccccggcgattgcaaccagcgcgggcgctgcgaggacggaagatgcgtgtgttggcccggctataccggtactgattgtggcagcagggcttgcccccgggattgtagagggcgcgggagatgtgagaacggagtttgcgtctgtaatgccggatactcaggagaggactgcggggttcgatcgtgtcctggcgactgcaggggaaggggcaggtgtgaaagtgggagatgtatgtgttggcccggttacaccggacgtgactgtggcacacgcgcttgtcctggcgattgtagagggcggggtcgctgtgttgacggtcgctgcgtgtgcaatcctggcttcacgggggaggactgcgggtctcgtagatgtcctggggattgtcgcggacacggcctctgcgaggacggggtttgcgtatgcgatgccggctactcaggcgaagactgttcgacgagaagttgcccaggcggctgccgcggcaggggccagtgtctggacgggcgctgcgtttgtgaggacgggtactctggggaagactgcggggtacggcagtgcccgaatgactgtagtcagcacggcgtatgccaggacggcgtgtgcatttgctgggagggatacgtctcagaggactgttcaattagaacgtgcccatccaattgccacggtaggggaagatgcgaggaaggacgctgcctgtgtgaccctggttatactggcccaacgtgcgccacgcgcatgtgcccagcagactgcagggggaggggacgctgtgtccagggggtatgtctttgtcacgtggggtatggtggtgaagactgcggccaagaggagcctcccgcatccgcctgccccggcgggtgcggacctagagagctgtgccgggcaggtcaatgcgtgtgtgttgagggtttccgcggaccggattgtgctatccagacttgtccaggagattgccgggggcgtggcgaatgtcacgacggatcatgcgtgtgcaaggatgggtatgccggggaagattgtggtgaagaagtgccaaccatagaagggatgagaatgcacctgctcgaggaaacaactgtgcgcaccgaatggacgccggccccgggacccgtggatgcgtacgagattcagtttatacccacaactgaaggggcttcacctccatttaccgcacgagtgccaagttcagcttctgcctacgatcagcgggggttggccccaggacaggaataccaagttactgtcagagccctgcgcggcacttcctggggactcccagcctccaagacaattacgaccatgatcgatggccctcaggacttgcgagtcgtagctgtgacacctacgacactggaactgggctggctgagacctcaggctgaggtcgacagattcgttgtgtcctacgtgagcgcaggtaaccaacgggtcaggctggaggttccgccagaagccgatggaaccctgcttaccgatctgatgcctggcgtcgagtatgtggtgacagtgaccgccgagcgtggaagagctgtgagctaccccgcgtcggtgcgggccaacaccgggtcatcgcctctcggcctgcttggcactacggacgagcctcctccctccggacctagtactacccagggtgcccaggcgccactcctgcagcagaggccccaggagcttggcgagctgcgcgttctcggcagggacgagaccggacgcctgcgggtggtgtggaccgcccagcctgacacattcgcttactttcagctacggatgagggtgcccgaggggccaggcgcacatgaggaggtcctgccgggggatgtccggcaggctttagtgcccccacccccaccagggacaccttatgaactgtccctgcacggcgtgccaccagggggtaagccatccgatccgattatctatcaggggatcatggataaggacgaggaaaaacctggcaaatcctccggaccaccccgattaggcgaactgacagtgacagaccgaacatcagattcacttttactcaggtggacagtaccggaaggggagtttgactcgtttgtgattcagtacaaggaccgggatggccagcctcaggtagtacccgttgagggaccacagcgatctgctgtgatcacttcattagacccaggccggaagtataagttcgtgctttacggctttgtagggaaaaagagacatggccctctcgtagccgaagccaaaatcctgccacagagtgatccttctcctggaacgccccctcatctgggtaacctttgggtgactgaccccacccccgattctcttcacctctcctggactgttcccgaaggacaattcgatacattcatggtacagtatagggatagagatgggagaccccaggttgtcccagtggaggggcccgaaagatcattcgtggtcagctccctggaccctgatcacaaatacaggttcaccctgttcggcatcgcaaataagaaacgatacggtcctttgaccgccgacgggacgaccgccccggaaaggaaggaagaacctccaaggcccgagttcctagaacaacctctactcggagagctcacagtaactggtgtgacccccgatagcctcaggctctcctggaccgtcgctcaggggccttttgacagctttatggtacagtacaaggacgcccagggccaaccccaggccgtcccggttgctggagacgagaacgaagtgactgtcccgggcctcgaccccgacagaaagtacaaaatgaacttatatgggctacgtggtcgccagagggtgggccccgagagtgtggtggccaagaccgccccccaggaggatgtggacgaaaccccctctcccacggaactcggaactgaggcacctgagtcgccagaggaacctctgctgggcgagttgacagtcaccggcagctctccagacagtctttctctcttttggaccgtgccccagggaagcttcgacagctttaccgtacagtacaaggatagagacgggaggcccagggccgtgagggtggggggaaaggagtccgaagtgactgttggcggtctggaaccaggccataagtataagatgcacctgtacgggctgcatgagggtcagagggtggggcccgtgagcgccgtgggagtcactgcgccgcagcaagaggaaaccccgcccgccacagagagcccactcgaaccacgcttgggcgagctgacagtaacggacgtcacccctaactcagtcggactctcttggacggttcctgagggacagtttgacagttttatcgtgcaatataaagacaaagacgggcagcctcaggtggtgccagtggccgctgatcagagagaggtaaccgtgtacaacttagagcctgagcggaagtacaaaatgaatatgtatggcctgcatgatggccaacggatgggccccctgtcagttgtgatcgtgactgcccctttgccgcctgcgccagcaaccgaagcatcaaaaccccctctcgaaccccggctgggggagctgacagtcacagacataaccccagacagtgtcggcctctcctggaccgtgcccgaaggagagttcgattcctttgtggtacagtataaggatagggatggccaaccacaggtcgttcccgtggccgctgaccagcgtgaggtgacgatcccggacttggaaccatccaggaagtataagttcctgctttttggaattcaggatggaaaacgccgctcacccgtttctgtggaggctaaaacagttgccaggggcgatgcctcgcctggcgctccaccaaggctgggagagctgtgggtaaccgatcccaccccggatagcttgcggctaagctggacggttcccgaaggtcagttcgactcttttgtggtgcagttcaaggataaggacggtccccaggtggtaccggtggagggccacgagcggtctgtgacagtgacgccactcgatgccggaaggaaatatcgattcctgctgtacgggctgctgggtaagaagaggcatggccctctgactgcggatgggacaacagaggcccgatcagcgatggatgatactggaacaaaacgcccacctaagccccgtctcggggaggagcttcaggtgacaaccgttacccaaaatagtgtgggcctttcatggactgtgcctgagggccaatttgacagctttgtggtacagtataaagatagagacggccagccacaggttgtgccagtggaaggtagcctgagagaggtgagcgttccaggactggaccctgcacaccgttataagttgctgctctacgggctgcatcacggcaagagggtcggcccgatatctgcagtcgccatcaccgcgggccgagaggaaacagagaccgaaacaactgccccgacgccgccagcaccagagccgcatctgggcgagctaacagtcgaggaggccacatcgcacaccctccacctgtcttggatggtcactgaaggggagtttgactccttcgagatccaatacaccgaccgtgatggccagctgcagatggtgaggattgggggagaccgaaatgatatcaccctgtccggactggagtctgaccatcggtatctcgttaccctctatggcttcagcgacggcaagcatgtaggccccgttcatgtcgaggctcttacggttccggaagaggagaaaccatctgagcctccaaccgcaactccagaacctccaataaagcctcgcctgggtgaactaactgtcacggacgctacaccggattccctctcgctttcttggactgttccagagggacagtttgaccatttcttagtccagtaccgtaatggggatggtcagccaaaggcagttagagtcccagggcacgaagagggagtcactatctcgggcctggaaccggatcacaaatacaaaatgaatttgtatgggtttcatggggggcagagaatgggacctgtttcggtggttggggtaaccgcggctgaggaagagacgccctcccccaccgaaccatccatggaggcaccggagccggctgaggagcctcttctcggcgagctcaccgtcactggttcttcaccagattctctgtccctgagttggactgtaccccagggacggtttgacagcttcaccgttcaatataaggaccgggatggacgtcctcaggtcgtccgtgtaggcggcgaggaaagcgaggtcaccgtaggaggtttggaacccgggagaaagtacaaaatgcacctatatgggttacacgagggcagacgggttggccccgtgagcgctgtcggggtgacggcccctgaggaagagtccccagatgctccactggcgaaactcaggttggggcagatgacagtaagggatattacttccgattctttgtccctgagctggacagtgcctgagggccagttcgatcacttcctagttcagtttaagaatggagacggacagccaaaagccgtacgagtccctggccatgaagatggggttacaatttccggtctagaaccagaccacaaatacaagatgaacctttacggctttcatggcggccagcgggtcgggccagtgtctgctgtgggcttgactgctcccgggaaggatgaagagatggcgccagcctcgaccgagccccccaccccagagccacccattaagcctcgactggaagaacttactgtcaccgacgctacgccagacagtctcagcctgtcctggacggtgcccgagggacagtttgatcattttctcgttcagtacaaaaatggagacggacaaccaaaagccacccgggtgcccggacacgaagatagagtgacaatctcaggcctggagcccgataataagtacaagatgaatttatatggatttcatgggggccaacgggtggggcctgtgagtgctatcggcgtgacagccgccgaggaagagacccctagtccaaccgagccatctatggaggctcccgagcccccagaagagcccctcttgggcgagttaaccgtaactggcagcagtcccgactctcttagcctcagctggaccgtgccacaaggacgatttgactcatttacagtgcagtataaagacagagacggacgaccccaagtggtacgcgtgggcggggaggagtccgaagtcaccgtcggtggtttagagcccggccgcaagtataagatgcacctgtacggactgcacgagggacggcgggtagggcctgtatctacggtgggggtgactgctcctcaggaagacgtagacgagactccaagccccaccgagccagggaccgaggcccccgggccacccgaggagccactgctgggtgaactcaccgtgacaggtagtagtcccgacagcctgtcgttaagctggaccgtgcctcagggccgtttcgactcttttacggtacaatacaaggacagggacggtcgcccacaggccgttagggttggaggtcaggagtccaaggtgactgtgcggggattggagccggggcggaagtataagatgcacctgtatggtctgcacgaggggcgtcggctcggccccgtttcagccgtcggggttacagaggacgaagctgagactactcaggctgttcccactatgacacccgaaccccctattaagcccaggctgggagagctgaccatgacagatgccactcccgactcactgagcctgtcctggaccgtaccagaagggcagttcgatcactttctggtgcagtatcggaatggggacgggcagcctaaagctgtgcgtgtgcccgggcacgaagatggggtgacaatcagtgggctggaaccagaccacaagtataaaatgaacttatacgggttccatggaggacagagggtggggcccatttctgtgatcggcgttactgctgcggaggaggaaaccccctcacccacggaactgtccacagaagcccccgagccaccagaggagcccctgttgggggagctgacagtcactggctcttcccctgactctctatccctttcctggacaataccccagggtcactttgacagtttcactgtgcagtacaaggatagggacggccggccccaggttatgcgcgttaggggcgaggaaagcgaagttaccgttggcggcctggaacccggccgcaagtataaaatgcatctgtatgggctgcatgaggggcgacgcgtgggccctgtgtctacagtgggagtgacagcaccagaggacgaagcggaaactacccaagctgtgccaactaccacacctgaacctcccaacaaaccccgtttgggtgagttaacagttaccgacgctaccccggattccctcagtctaagttggatggtcccggagggccagtttgatcatttcctggtccaatacaggaacggggacgggcaacccaaggttgtgcgggtgccaggccatgaggacggggtcaccatctccggactagagccagatcataaatacaaaatgaacctttacggcttccatggggggcaaagagttggcccaatttccgtcattggagtcaccgccgccgaagaagagacccccgcccccacagagccaagtaccgaggcgcctgagcctccagaggaaccactcctgggggaattgaccgtgactgggagctcccctgactctctctctctgagctggaccattccccagggcagatttgattctttcaccgtacagtacaaagatcgcgatggcaggccccaggtggtgcgcgtgcggggagaagagtctgaggtaacagttggcggcctcgagccagggtgtaagtacaaaatgcatctatatggtctgcacgaaggacagcgggtcgggcccgtgtccgcagtgggcgttacagcgcccaaagatgaggccgagaccacacaggccgttccaactatgacacctgaaccccccatcaaacccagactgggtgagctcacagtaaccgatgctacacccgattctctgtccctctcctggatggtaccggaaggccaatttgatcacttcctggttcagtacaggaacggtgatggacagcctaaagcggtccgggtaccaggacacgaggatggcgtcaccatcagcggattagagcccgaccataagtataaaatgaatctatatggcttccatggcgggcagagggtggggccggttagtgcgatcggggtcactgaagaggaaaccccgagccccacggaaccctcaaccgaggctcctgaagcccctgaggagccactattgggcgaactgaccgttaccggttcaagtcccgattccctgagtcttagctggacggtgccgcagggacgcttcgactcctttacagtgcagtataaagacagagacgggcaaccacaggttgtcagagtgaggggtgaagagtccgaagtgacagtcggaggccttgagccaggacgcaagtacaaaatgcacctctacggactgcacgagggacaaagagtggggcccgtctcgacggtaggcattaccgcacccttgcccacccccctgcctgttgaacctcggctgggcgaactggctgttgctgctgtgacaagcgactctgtgggactttcctggaccgtggctcagggacctttcgacagcttcctggtgcaatatcgcgacgcgcaaggccagccgcaggccgtgcctgtctctggagatttgagggcggtcgcggtgagtgggctggacccagcaagaaagtacaagttcttactcttcggactgcaaaatggcaaacgacacggacccgtacccgtagaagctcggacagccccggacacaaaaccatcccctcgcctgggggaactcacagtcactgacgctacacctgactcggtgggcctatcttggacggtcccagagggagaattcgattcatttgtcgtccagtacaaggataaagacggccgcctgcaggtagtaccagtggctgctaatcagcgggaagtgaccgtccaaggccttgaaccatcgcggaagtatcggttcttgctgtatggcctgtctggacgcaaacgccttggtccaatctctgccgattctaccaccgcccccctggagaaagagcttccgccccatctgggggaattgactgtcgcagaggaaacttccagtagcctgaggctatcctggaccgtggcacaaggcccctttgacagcttcgtggtccagtaccgggacacagatggacagccacgggccgtgcctgtggcagcggaccaacgcaccgttacagtggaagatttggaacctggtaagaaatacaagttcttattgtacggcttgctaggaggcaagaggctcgggcccgtgtcagctctggggatgaccgcacctgaggaggacacccccgctcccgagttagccccagaggcccccgaacctcctgaggagcctaggctgggggtcttgactgttacagacacaacacccgacagcatgcgcctgagctggtctgtcgcgcagggcccattcgatagttttgtggttcagtatgaagatacaaatggacagcctcaggccctgctggtcgacggagaccaaagcaagatccttattagcggattggagccaagtaccccctatcgctttttgctatacgggctccatgagggtaagcggctggggcctctaagcgcagaggggactaccggtctggccccggctggacagacgtctgaagaatctaggcctaggctctcacagttgtctgttaccgacgtcaccacatcatctctccgcctcaattgggaagctccaccgggagctttcgactcctttctcctgcgattcggagtgccgtccccttctactttggagcctcatcctagaccattgttacagagagagctcatggtcccaggcaccagacattctgcagtgttaagggacctgaggtctggcaccctatactcactgaccttgtatgggctgaggggtccacacaaggcagactccattcaggggaccgccagaacactctccccagtgctggagagccccagagacctgcagttcagcgaaattcgggagacttcggctaaagttaattggatgccacccccgtcacgagcggattcatttaaggtcagttatcagcttgccgacgggggcgagccacagagtgtccaagtcgatggccaggccagaacccagaagcttcaaggtctcatcccaggggcccgatacgaggtcacagtggtcagcgtgagaggattcgaagagagcgaaccactgactggtttcttaacgaccgtgcccgacggcccaactcagcttcgcgccctcaatttaacagaagggttcgctgtgctgcactggaagccaccccagaatcccgtcgacacatacgatgtccaggtgacagcacccggcgcccccccgctccaagccgagacccctggaagcgccgtcgactatcctctacacgacctggtgctgcatacgaattataccgctactgtgaggggtctcaggggaccaaatctgacatctcccgcatcgattacattcactacaggcctggaggctcccagggacttagaagcaaaggaagtgaccccccgaacagcccttctcacctggacagagccacctgtgaggcccgctggttacctgctaagttttcacactccaggcgggcagaaccaggaaattctgctccccggcggcataacctcccaccaactgctggggctgttccctagcaccagttacaatgcaagactgcaagccatgtggggccagagcctgctgccaccagtgagcacttcctttaccactggggggctacgcattcccttcccaagggactgtggggaggagatgcaaaacggagcaggcgcgtctagaacaagcacgatttttctgaacggcaatcgggaacggccactgaacgtgttctgcgacatggagactgacggcggtgggtggttagtgttccaaagaaggatggacggccaaacagacttctggagggactgggaggattacgcccatggatttggtaacatttctggcgagttctggttgggcaacgaggcactgcatagcctgacccaggccggggactactccatgagggtcgatttgagagcaggcgacgaagcggtctttgcccagtatgactcattccatgtggattctgctgccgaatactaccgactccacttggagggctaccatggaaccgccggagattccatgtcataccattctggctcagtgtttagcgctcgggaccgggaccccaattctctgcttatctcatgcgcagtgtcctatcgtggcgcctggtggtaccggaactgccattatgctaacctgaacggactctatggctccaccgtcgatcaccagggtgtgtcttggtaccattggaagggattcgagtttagcgtgccattcactgagatgaagcttagacccagaaattttcgtagtcccgccggaggaggctag

SEQ ID NO: 17610 - DNA, 12729 bp, Artificial Sequence
  Description of Artificial Sequence: Synthetic coding sequence
atgatgcctgctcaatatgccttaacaagtagtcttgtgctactggtcttgttaagcactgcccgggccggacctttttcctcccgctccaacgtcactctccccgccccccggccccctccgcagccgggcgggcacacagtgggcgccggcgtcggaagtcccagcagccagctgtacgagcatactgttgaaggcggagaaaaacaggtggtgtttacacatcggattaatctgccaccatccactggctgcgggtgcccacctggcactgagcctccagtcttagcctctgaggtgcaagccctacgcgtgagattagaaatcctggaagagttggtaaaaggcttgaaggagcagtgcaccggaggctgctgtccagccagtgcacaggcagggacgggccaaacggatgtgcgaaccctgtgctcgctacacggcgtcttcgatctctctcggtgcacgtgctcctgcgagccaggctggggcgggcctacttgcagcgacccaactgacgccgagattcctccgtcaagccccccctcagcgtctggatcttgccctgacgattgcaatgaccagggcagatgcgtcagaggccggtgtgtttgtttccctgggtacaccggacccagctgcggctggccgagctgtcctggcgactgccagggacgaggcagatgcgtgcaaggggtctgtgtatgtcgcgccgggttcagcggcccagactgttcacagaggagttgcccgcggggatgctcacagagggggcgctgtgagggcggacgatgcgtttgcgaccctggctacactggagatgactgcggcatgagatcctgtcccagaggttgttcacagcgcgggaggtgcgaaaacggtagatgcgtgtgtaatccaggctatacaggagaagactgtggagttcgtagttgtccccgtggctgtagtcagaggggacgatgtaaagacggtaggtgcgtgtgcgatccggggtatacaggggaagattgcggtactcgctcatgcccatgggattgcggggaaggtggtcgctgcgtggatggcagatgtgtgtgttggccaggctatacaggagaagattgttcaacgcgtacatgcccccgagattgcagagggcggggtcggtgcgaggatggcgagtgtatctgcgacaccggatactcaggagatgactgcggagttcgctcttgccccggggattgtaaccagaggggtagatgcgaggatggccggtgcgtttgctggcctgggtacacaggtacagactgtggaagcagggcttgtccccgcgactgccgtgggcgcggtcgttgcgagaacggggtgtgcgtgtgcaacgcgggatatagcggcgaggattgcggggtaaggtcatgtcccggcgattgcagaggcagagggcggtgcgagtcgggccgctgtatgtgttggcctggctacaccggcagagattgcggcactcgagcctgcccaggggactgtaggggaagggggcgctgtgttgacgggaggtgcgtttgcaatcccggcttcactggcgaggactgcggcagtcggcggtgtcctggagactgccgcgggcacggactttgtgaggacggcgtgtgcgtctgcgatgccggctactccggggaagactgcagcacacgaagctgtccaggagggtgccgtggtcgggggcagtgtttggacggacggtgtgtttgtgaggacggatacagcggcgaggattgtggcgtgcgccagtgccccaacgactgttcccagcacggagtctgccaagatggtgtgtgcatatgctgggagggttacgtgtcagaggattgttcaatacggacatgcccaagcaactgccacggccgcggacggtgcgaggagggaaggtgcctgtgcgaccccggctacactgggcctacctgcgcaacccggatgtgccccgccgactgcagggggagaggcagatgcgtgcagggagtgtgtttatgtcacgtggggtatggaggtgaggactgcggccaggaggaaccacctgcttcagcttgtcccggaggctgtggcccaagagaattgtgccgtgcaggccagtgtgtgtgcgtcgagggattcagaggcccagactgtgccatccaaacatgcccaggggattgccgcggccggggcgagtgccatgatggaagttgcgtttgtaaggacgggtacgccggagaagattgtggcgaagaggtgcccaccatcgagggaatgagaatgcatctcctggaagagacgaccgtacgaactgagtggacccctgcccccggccccgttgacgcctacgaaattcagttcatcccaacgactgagggtgcctcccctccatttacagctcgagtccctagctcagccagcgcatacgatcagcgtggccttgccccgggccaggaatatcaggtcaccgtaagagccctgcggggtacctcatggggactcccagcatcaaagacaatcacaacaatgattgatggaccccaggacttgagagttgtggccgtaacacccacgaccctggagctgggctggctcagaccgcaggccgaggtcgataggtttgtagtcagctacgtgagtgccggaaatcaacgcgtgcggcttgaggtaccacccgaggctgacgggacgctcctcacagatctgatgcctggagttgagtacgtcgtgactgtgaccgctgaacgcggacgcgccgtctcttacccagccagtgtgcgggcgaatacagggtcatctcctctgggactcctcgggactaccgacgaacccccacccagcgggccatcaaccacgcagggcgcgcaggcccccctgctacagcagcggcctcaagagctcggagaactgcgagtgctgggccgagatgaaactgggagattaagagtggtctggacggctcagcccgataccttcgcgtatttccaactgcgcatgcgtgtccccgagggccccggggcacacgaggaagtgcttccaggcgatgttcggcaggctctcgtgcccccacccccacccggtaccccttatgaactttccctgcacggcgtgccaccaggcggtaagccgagcgatcccatcatttaccaggggattatggataaagacgaggaaaaacccggcaagtcaagcgggcctccccgcctaggagaactgacagtgaccgaccgaaccagtgactcattactcctgaggtggacagtgccggaaggagagtttgattccttcgtcatacaatacaaagaccgggacggacagcctcaagtagtccctgtcgaaggtcctcagcggtccgccgtgatcacgagtctggatcccggacgcaaatataaatttgtcctgtacggcttcgtcggtaaaaagcgacatggtcctctcgtggcggaggctaagatcctgcctcaatcggacccttcaccgggtacgccgccccacttggggaacctgtgggtgactgacccaacgcccgattctctccacctttcctggaccgtccctgaagggcaattcgacacgttcatggtccagtaccgggatcgggatgggagaccccaagtggtcccagtggagggacccgagaggtcttttgtagtctcatcactggacccagaccataagtaccgcttcactctgttcggcatcgctaataaaaagcgctacggaccgctgacagccgatggcacaaccgcacctgagaggaaagaagagccacctagacctgagtttttagagcagccactgctgggggaactgacagtcaccggtgttacccctgatagcctgcggctatcatggacagtggcacaagggcctttcgattcctttatggtgcaatacaaagacgcccagggccagcctcaggccgtacctgtggctggggacgagaacgaggtcaccgtacccggactcgaccctgaccggaagtataagatgaatctatatggcctgaggggacggcaacgtgtggggccagagtccgtcgtagctaaaacagccccacaggaggatgttgatgagacgccttcccctaccgagctcggaactgaggcgcccgagagcccagaggagccccttttaggagaactgactgtgaccggatcctcgcctgatagcctctcgctgttttggacggtgccccagggcagcttcgactcgttcaccgttcagtacaaggaccgtgatggcaggccacgcgcagtgcgggttggaggtaaggaatccgaagtcacggttggcggattggagccagggcacaagtacaagatgcacctgtacgggctccacgagggccaacgggtgggacctgtatctgcggtcggggtgactgcccctcagcaggaagagacaccgcctgctacagaaagtcctcttgaacccagactcggcgaacttacggttacagacgtcaccccaaactctgtaggtctgtcttggaccgtgcctgaaggccagttcgactcttttattgtccagtacaaggataaagacggccagccgcaggtcgtgcccgttgcggccgatcagcgggaagtcaccgtgtacaacctggagccagagcgtaagtacaagatgaatatgtacggtttgcatgatgggcagcggatgggcccactctcagtggtcattgttacagctccactgccacctgcacccgccacagaggctagcaagccacctctcgaaccacgactgggggaattaacagtcacagacataaccccggattctgtcggtttaagctggactgtgcctgagggtgagttcgattcctttgtcgttcaatataaggaccgtgacggacagccccaggtggtgcctgtcgccgcggaccaacgcgaggtgacaattccagatttggaacccagccgcaaatacaagttcctgctgttcggcatacaggacggtaagagacgaagtcccgtgtcagttgaggctaaaacagttgctcggggcgacgcctccccgggcgcaccccctcgactcggggagctgtgggttaccgacccgacgccggactctctgcgactgtcctggacggtgcctgagggacagttcgactcatttgtagtgcagtttaaggataaggatggaccccaggtggtgccagtggagggccacgaacgctccgtgaccgtgaccccccttgacgctggtcggaagtacagatttctgctgtatgggctgttaggtaagaaacgacacggaccgctcacggccgatggcacaactgaggctcgatccgccatggacgataccggaaccaagcgcccgcccaagccaagactgggagaggaacttcaggtgacaaccgtgacgcaaaattccgtgggactctcctggactgtacccgaaggacagtttgactctttcgtcgtccagtataaagacagggacggccagccgcaagtagtgcctgtggaaggctctcttagagaagtatctgtgcctgggctcgacccggcacatcgctacaaactgttgctctacggcctgcaccacggcaaacgcgtcggtcctatttcagccgtcgctataaccgccgggagagaagagaccgaaactgaaaccacagccccaaccccccccgctccagagccacacctgggagagctgaccgtcgaagaagccacatctcacacattgcatctctcatggatggtgaccgagggcgaattcgactcctttgagatccaatacacagatcgtgacgggcagctgcagatggtgagaatcggaggcgatcgaaatgacataacactgagtgggctcgaatccgaccatcggtatctagtaaccctatacggctttagcgatggcaaacacgtgggacctgtgcacgttgaggcactcactgtcccggaagaggagaaaccctctgaaccccctaccgccacccctgaaccccccatcaagccccggctgggcgagctcaccgtgaccgatgctacgccagatagtctctccctgtcatggactgtccccgaaggccagttcgaccactttcttgtgcagtatcgaaacggggatgggcagcctaaagcagtgagggtgcctggccatgaggagggtgtgacaatttctgggctggagcccgaccataagtataaaatgaacctgtacggctttcacggaggacagcggatgggacccgtctctgttgtcggagtcactgcagcagaggaagagactccctcaccgactgaaccaagtatggaagctcccgagccggcagaagagccattgctgggagagcttaccgtgactggctcgtccccagattctctttccctgtcatggaccgtgccacaaggtagattcgattcgtttaccgtgcagtataaggacagagatgggaggccacaagtcgtacgtgtgggaggtgaagagagcgaagtgactgtaggtggattggagcctggacgcaagtataagatgcatctctacgggctgcatgaagggcggcgggtaggacccgtgtccgccgtgggcgtgacggctcccgaggaggaatcgcctgacgcgcctctggccaagttgaggctgggtcagatgacagttagagatattacatcagatagcctttccttatcttggaccgttccagaaggacagttcgatcactttcttgtgcagtttaagaatggtgatggtcaacccaaagcagtccgggtgcccggacacgaagatggggttaccatctcagggctggaacccgaccacaagtataagatgaatctgtacgggttccatggcgggcagcgggtcggccctgtttcagcggttggtctgacagctccaggaaaagacgaggagatggcccctgcgagcaccgaaccacctacccctgaaccccctattaaacctcgcctggaggaactcactgtgactgacgccacccctgatagtttatctctaagctggacagttccagaggggcaattcgaccatttcctggtgcagtataaaaatggggacggccaaccaaaagcaaccagagtgccagggcacgaggacagagtaactattagtggtctggaacctgacaacaagtacaaaatgaacctttatggcttccatggaggccaaagagtgggccccgtatcggctataggagtgactgccgcggaggaggagacaccaagccccacggagccatctatggaggctcctgaacctcccgaagagcctctcctcggtgagctgaccgtgacgggatctagtccagattcactgtccctgtcatggacagtacctcagggacgatttgacagtttcactgtacagtacaaagacagggatggcaggccacaggttgttcgagttggcggggaggagagcgaggtaaccgtgggaggcctcgagcccggccgcaaatacaaaatgcatctctatggccttcacgagggcagacgtgtggggccagtatccactgtgggggtaacagcacctcaggaggacgtagacgaaacgcccagtccaaccgaaccaggcactgaggcaccgggtccgccagaagaacctctgctcggggaacttaccgtaactggcagttcaccagactccctgtcgttgtcctggaccgtccctcagggccgttttgatagctttaccgtccagtataaggatagggatgggagaccgcaggctgtgcgagtaggtggacaagaatctaaagtgacggtccgaggtctcgagccaggccgtaagtataaaatgcatctttacgggctccatgagggaagaagactgggacctgtctcagccgttggggtgaccgaagatgaagccgagacaacccaggctgtgccgacaatgacgcccgagcctcccataaagcccagacttggggaactgacaatgacagacgccactcctgattcccttagcttatcctggaccgtgccagaggggcaattcgatcacttcctcgtacagtatagaaacggagatgggcagccaaaagcagtcagggtaccagggcatgaggacggggtgactatttctggccttgaaccagatcacaagtataagatgaacctttacgggtttcacggaggccagcgcgtgggccctatctcggtcatcggcgtgacggccgcggaagaagagactccttcacctactgagctgtccactgaagcccccgagcccccagaggagcccctcctgggcgaactgaccgtgacagggtcgagccccgattctctgagtctctcttggaccatacctcagggccacttcgacagttttactgtgcaatacaaagaccgggacgggcggcctcaggtgatgagagtgaggggtgaggaatcagaagttaccgttggtggtctggagccggggcggaagtataagatgcacctgtatggcctgcacgaggggcgccgggtcggccccgtctcgactgtgggtgtcaccgaagatgaagcggaaaccacacaggctgttccgaccacaacacctgagcctcccaataagcccaggctaggggagctgaccgttaccgacgcaactcctgactccttgagcctgtcttggatggtgccagaaggacagttcgaccattttctcgtccagtacaggaatggtgatgggcaacccaaggtcgtgagagtgccaggtcatgaagacggtgttaccatctcaggtctagaacctgaccataagtataagatgaacctctacggattccatgggggccagagagtgggaccaatcagcgtgatcggcgtgactgcagccgaggaggaaactcccgcccctactgagcccagtacggaggctccagaacctcctgaggagcccctcctcggagaactcaccgtgactgggtcgtcccccgacagcctgagcttgtcttggaccattccccaggggagattcgatagctttacagttcaatataaggacagggacggccgtccgcaggtggtacgggtccgcggagaagaaagcgaggtgacagttggaggtctggagccaggttgtaagtataagatgcacctgtacgggctccatgaaggccagcgtgtgggccccgtttcagctgtcggtgttacagcccctaaagatgaagccgagacaactcaggctgttccgaccatgacccccgaaccacctattaagcctcgcttaggggaattaacagtaacggacgctacaccagattccctgtctttgtcatggatggtcccagaaggacagtttgaccatttcctggtccaataccgtaacggtgacggacaacccaaggccgtgcgcgtgcctgggcacgaggacggcgtgactatcagtggcctggagccagatcacaagtacaaaatgaacctgtacggctttcacggagggcagagggtgggacctgtgtccgccatcggagtgacagaagaggaaacaccatccccaaccgagccttccactgaagcgccagaggccccagaggagcccctgcttggcgaactcactgttactggatcctcccccgattccctctcactttcatggacagtacctcaagggcggtttgattccttcacagtgcaatataaggacagggacggtcagccccaggtcgttcgggtccgaggagaggagtcagaagtcacagtgggtggtttggagccaggcaggaagtataaaatgcacctgtacggtctccacgaaggacagcgagtgggtcccgtgtccaccgtgggtataaccgccccactccccacccctctacctgtggagcccaggcttggcgaactggccgtcgcagctgtcaccagcgactcagtcggcctgtcttggaccgtggcgcagggaccctttgattcctttctggtgcagtatcgtgacgcgcagggccagccacaggctgtgcccgtatccggagaccttcgcgctgtcgccgtgagcgggctggaccccgcacgtaagtacaagttcctgttatttggccttcaaaatgggaagcggcatggacccgtgccagtcgaagcccggaccgcccccgatacaaagcccagtcctcgactgggtgaactgactgttactgacgccacccctgactccgtgggcctctcttggacagtcccggaaggtgagttcgattcctttgtggtgcaatacaaggacaaagatggcaggctgcaggtcgtcccggttgccgccaatcagcgagaggtcacggtgcaaggactcgaaccttctagaaagtacagattcttgctctacgggctgtccgggagaaaaagactgggccctatttccgccgattctaccaccgccccactagaaaaggagctgcctccccacttaggtgagctcacggtagccgaggagacatctagctcccttcggctctcttggacagtggcccagggaccttttgattcgttcgtcgtgcaataccgagataccgatggacagcctagggcagtccccgtagcagctgatcagaggactgtgacagtcgaagacctcgagcccggaaagaaatacaaattcctcctatatggcctgcttggcggcaagcggttggggcctgtgtccgctttgggcatgactgccccggaggaggataccccagccccagaattagcacccgaggcacccgaacctcccgaggagcccaggctcggggtgttgactgtcactgatacaactccggactcgatgaggctaagctggtccgtggcacagggacccttcgattcatttgtggtgcagtatgaggacacaaatggacagccccaggccctcttggtggacggggaccagtctaaaatactcattagcgggctggagccatccaccccctatcgcttcctcttatacggtctccatgagggaaaaagactggggcccctgagcgccgaagggacaacaggcctcgcaccggctgggcagactagcgaagagagcaggccaaggctctctcagctgagcgtcaccgatgttactacttccagtctgaggttgaactgggaggcaccacccggcgcgtttgattcctttctgttgcgctttggcgtgcccagcccatctaccctcgagccccatcctcgtccccttctgcagagagaactgatggtgcccggcacccggcactcagcagtcctgcgggacctgagatccggcacactgtactctttaacactgtatgggctgagaggtcctcacaaggccgatagtatccagggcactgcccggactctgagtccagttctagaatcccctcgggatctgcagttctcagaaatcagggagacctctgccaaggtgaattggatgccccctcccagccgtgcagatagtttcaaagtttcctaccagttagcggacgggggggaaccgcaaagcgtacaggtggatggccaggctcgcacccagaaactgcagggcctaattccaggcgcccggtatgaggtaacggtcgtctccgttcgagggttcgaagaatccgagcctctaactggcttcctgaccacggtgccagacggaccaactcaacttcgcgccctgaacttaacggaagggtttgccgtactacactggaaaccaccacaaaatcctgtcgatacctacgatgttcaggtaacagcgcctggcgcgccccccctacaggccgaaactccaggcagtgccgttgattatccactgcacgatcttgtgctgcatacaaactatacagcaaccgtgaggggactccggggccccaatttaacatccccggcgagcattacctttaccactggtctggaagcgccaagagatctggaagccaaagaggtgacgccaaggacagccctcctgacttggactgagcccccagtacgtccagcaggctacctcttgtctttccacacgccgggggggcaaaaccaagaaatcttgctccccggcgggataacgagccaccagctcctcgggctgttcccttcaacttcttacaatgcaaggctacaggcaatgtggggacagtcactcctgcctccagtgtctaccagctttacaacaggagggcttcgtatcccctttccaagagactgcggcgaagagatgcaaaatggagccggagctagcagaacctcaaccattttcttgaacggaaatcgggagaggccactcaacgtattctgtgatatggaaaccgatggcggaggatggttagtatttcagagaaggatggatgggcagacggatttctggagagactgggaagactacgcccatggctttggaaacatctccggcgaattctggctgggaaacgaggccctgcacagcctgactcaagctggtgactatagtatgcgggtggacttgagagctggcgatgaagcagtgtttgcacagtatgattcctttcacgtggactcagccgctgaatactataggttacatttggagggataccatggaaccgccggggactctatgtcctatcattccggatccgtattctctgccagggatcgcgaccctaattctctactcatctcctgtgcggtttcatatagaggtgcctggtggtaccgcaattgtcattacgctaacctgaatggtctgtacgggtcgacagtcgatcaccagggagtttcttggtatcactggaaaggtttcgagttttctgttccttttaccgagatgaaattaagacctcggaattttagaagccccgccggaggtgggtag

SEQ ID NO: 17611 - DNA, 2022 bp, Artificial Sequence
  Description of Artificial Sequence: Synthetic coding sequence
atgcgactttcatggtcagtagctcagggcccgtttgactccttcgtggtccagtacgaggacaccaatggccaaccacaggccttgctcgtcgacggcgaccagagcaagattctaatcagtgggttggaaccctctaccccctatcggttcctactttacggcttgcatgagggtaaaagattgggaccattgagtgcagagggaaccacaggtctcgcgcctgctgggcagactagcgaggaatcccggcccaggttatcccaactgagtgtgacggatgtgaccaccagctctctccgtctcaactgggaggcccctcccggtgcgttcgacagcttcctgttgcggtttggggtgccttctccctctacactggaacctcacccccggccgctgttgcaacgagagctgatggtacctggtacacgccattctgccgtcctccgcgatctccgctcagggaccctttacagtctaacactgtatgggttgagagggccgcacaaagccgatagcatccagggtaccgctagaactctaagtcctgtgcttgagtcacccagggatttacagttttctgaaataagggagacaagtgccaaagtgaactggatgccaccaccctctagggcggacagctttaaggtgagttaccagctggcagacgggggggagccccaatcagtgcaggtggacggccaggcccggacccaaaaactgcaggggctgattcccggcgcaaggtacgaagtgaccgttgtttcggtcaggggtttcgaggagtcagaacccctgacggggttcttgaccaccgttcctgacgggccaacccaactgagagcactgaacctgacggaaggattcgcagtgcttcactggaagcctccccagaaccctgtcgatacatatgatgttcaggtgacggcccccggagccccgcccctgcaggcggaaactcctggcagcgccgtggattatcccctccacgatctggtgctgcacacaaattacactgccacggtgcggggactccgcggccccaacctgaccagcccagcatctatcaccttcactacgggccttgaagccccccgcgacctggaggcgaaagaggttaccccgagaaccgccctgcttacctggactgaaccaccggtgcgccccgccggctacttactctcctttcatactcccggcggacaaaatcaggaaatccttctgcccggcggcatcacaagccaccagcttttgggtttgtttcctagcacgagttataatgcgcggcttcaggccatgtggggccagtcccttctccctccagtctcaacctctttcacaacaggaggcctgaggattccatttccccgcgactgtggagaggagatgcaaaacggtgcaggcgcttctcgcacctcaactatttttctgaatggcaacagggagagaccgctcaatgtcttctgcgacatggaaactgatggcgggggatggctagtcttccaacggcgtatggatggacagacagacttctggagggactgggaggattatgcacatggttttgggaatatatctggggagttttggttaggaaatgaagctctgcacagtctgacgcaggccggagattactctatgagagtagacctgagagctggggacgaagccgtgttcgcgcaatatgacagcttccacgtcgactccgcagcagagtactacagacttcacctggaagggtaccacgggaccgcgggggactcaatgagttatcacagtgggtccgtattctctgctagagaccgcgaccctaattccttactcatctcatgtgccgtcagctacagaggtgcttggtggtaccgtaactgccactatgccaacctgaacggattatatggttcaactgttgatcatcagggcgtgtcttggtatcactggaagggcttcgaattttctgtccccttcaccgagatgaagttacggccccggaatttccggtcaccagcgggcggaggctag

SEQ ID NO: 17612 - DNA, 954 bp, Artificial Sequence
  Description of Artificial Sequence: Synthetic coding sequence
atggcaaaaaatccacccgaaaactgcgaggattgtcacatactgaacgccgaggccttcaagtccaagaagatttgtaagagtctgaagatttgtggcctcgtctttggcattttggctttgaccctaattgtgctattttgggggagtaaacatttctggccagaagtgcctaagaaggcttatgatatggaacacacgttttacagcaatggtgagaaaaaaaaaatctacatggaaatcgatcccgttaccaggacagaaatcttcaggagtgggaatgggaccgacgagactctggaagtgcacgatttcaagaacggttacacgggaatctactttgtaggtcttcagaaatgctttatcaaaacccaaataaaggtgatcccagaattctcagaacccgaggaggagattgacgagaatgaagagattacaacgaccttcttcgagcagtcagttatttgggtgccagccgagaagcctatcgagaacagggattttctgaagaattctaagatactagagatttgcgataatgtgaccatgtactggattaatcctaccctgatcagtgtgagcgagcttcaggattttgaggaggagggagaggacctacatttccccgccaacgaaaagaaaggcattgaacagaatgagcaatgggtggttccccaggtgaaggtggagaagacacggcatgcaagacaggcctccgaagaagagcttcccattaacgactacaccgaaaacggaatcgaattcgaccctatgctggatgaaagggggtattgttgcatttattgccgaagggggaatcgatactgtcggcgggtatgcgagccattgctgggttattatccatacccttattgctatcaaggagggcgggtgatttgccgggttatcatgccttgcaactggtgggtggccaggatgttaggccgcgtctag

SEQ ID NO: 17613 - DNA, 1356 bp, Artificial Sequence
  Description of Artificial Sequence: Synthetic coding sequence
atggcaacccctctggttgccggacccgccgccctgcggtttgcggccgcagcttcttggcaggtggtgaggggccggtgcgtggaacactttcctcgcgttctcgaattcctgcggtcgctgagggctgtggcgcctggcttggtgaggtatagacatcatgaacggttgtgcatggggctcaaggcaaaggtggtagtggagctcattctgcagggaagaccctgggcacaggtcttaaaggcgcttaaccaccattttccggagagcggacctattgtgcgtgaccctaaagccactaagcaggaccttcgcaagatcctggaagctcaagagacattctaccagcaggttaaacagctgtctgaggcacctgtggacctggcaagcaagctgcaggaactcgaacaagagtacggagagccgtttctggccgccatggagaagctgctcttcgagtacctctgtcaactggagaaggctctccccacacctcaagctcaacaactccaggacgtattatcctggatgcagcccggtgtgtctattaccagtagcctggcgtggcggcagtacggagtcgatatgggatggctgctgccggaatgctcagtcaccgactcagtcaaccttgctgagcctatggagcagaaccccccccagcaacaacgcctggccttacacaatcccttacccaaggccaaaccaggcacccacttgccccagggcccgagttcccgtacccatccagagcctcttgctggccgacattttaacctggcacccttggggaggcgcagagttcaatcccaatgggcttccactcgcgggggccacaaggagcgcccaacagtgatgcttttccccttcagaaacctaggctcccccactcaagtgattagcaagcccgaaagcaaggaggaacacgccatatacacagcggatcttgctatggggacaagggctgcttcaaccgggaaatctaagagtccttgtcaaactctgggtgggcgcgctctcaaggagaatccagtagaccttccagcaacagaacagaaagagaactgtctggactgctatatggaccctttgcgactgtctcttttgccacccagggctcggaagcctgtgtgtcctccgtcactgtgcagctccgtgataaccattggcgacctggttcttgattcagacgaggaggaaaatggacagggagaggggaaagaaagcctagaaaactaccagaaaacaaagtttgacacattgattcctacactttgtgagtacctgccgccatccggtcacggagctatccccgtgagctcttgtgattgtagagactccagccgcccgctgtag

SEQ ID NO: 17614 - DNA, 1065 bp, Artificial Sequence
  Description of Artificial Sequence: Synthetic coding sequence
atggctacacctctggtggctgggcccgcagctctgagattcgccgccgcagcatcctggcaggtggtgagaggccgttgtgtcgagcatttcccacgtgtcttagagttcttgaggtctcttcgggctgtggcgcccggccttgttcggtatcgacaccatgagagattatgcatggggctgaaggcaaaggtagtcgtcgaacttattttgcagggtaggccatgggcacaggttctgaaggcccttaatcatcactttccagagagcggcccaatagttcgagaccccaaggccacaaaacaagacctaaggaagatcttggaggcacaggagacgttctaccagcaggttaagcagctgagtgaggcacctgtggaccttgcttcgaagttgcaggaactggagcaggaatacggagagcccttcctggcagccatggaaaagctgctcttcgagtacttgtgccaactcgaaaaggcactgcctacaccccaggcacagcagttgcaggacgttctgtcatggatgcagcctggggtgtccatcactagctcgttagcttggaggcagtacggggtcgacatgggatggctgcttcctgagtgctccgttactgacagtgtcaatctggcagagccgatggaacagaaccccccccaacagcagcggcttgcgttacataacccattgcctaaggccaaacctggtacccatttgccacagggcccctcttcccgcacccaccccgaaccgctggctggacggcacttcaacctggcccccctgggcagaaggcgtgtacaatcacagtgggcaagcactcgggggggtcacaaagagcgcccgaccgtaatgctgtttccctttagaaacctcggctcaccaacacaggtaatctcaaagccggaaagcaaagaggaacacgcaatatataccgccgatctggctatgggcacaagagccgctagtaccgggaaatctaagagcccctgccagacgctcgggggtcgcgcactgaaggagaacccagtagatcttcctgctaccgaacaaaaagagtag

SEQ ID NO: 17615 - DNA, 423 bp, Artificial Sequence
  Description of Artificial Sequence: Synthetic coding sequence
atggaacaaaaccccccgcaacagcagagactcgcgcttcataatcccctcccgaaggcaaagccaggaactcatttgccacagggtccaagtagccgtacgcaccccgaaccactcgcaggcaggcactttaacctggcaccattgggacggcggcgcgtgcagtcccaatgggcaagcaccagggggggacacaaggagcggcccactgtaatgctctttcctttcaggaacctcggaagtccaacacaggtaatcagcaagccagagtctaaggaggagcacgctatctacacagccgacctggcaatgggtacaagggccgcatctacggggaaatctaagtccccttgccagacactcggcggacgcgccctgaaggaaaatccagttgacctacccgcaacagaacagaaggagtag

SEQ ID NO: 17616 - DNA, 1251 bp, Artificial Sequence
  Description of Artificial Sequence: Synthetic coding sequence
atggctacccccctcgtagcaggacctgctgctttgcgcttcgcagccgccgcctcttggcaagtggtccggggaaggtgtgtggagcactttccaagggttcttgaatttctacgttcgctgcgagccgtcgcccctggacttgtccgttaccgccatcatgaaagactatgcatggggctcaaggctaagaccaagcaagacttgcgaaaaattctggaggcacaggagaccttctaccaacaagtgaagcagctttctgaagcacctgtcgatcttgcctccaagctgcaggaactggaacaggagtatggagagccatttttagctgccatggagaaactcttgttcgagtacctctgccagctggaaaaagcattacccacccctcaggctcagcaacttcaggatgtgctcagctggatgcaacccggcgtgtcgataacttcaagccttgcctggagacaatacggagtggatatgggatggctcttgcctgagtgtagcgtgacggatagtgtgaaccttgccgagcctatggagcagaatccaccccagcagcagagattggcgctgcacaaccctctccctaaagccaagcccgggacacatctcccacaaggcccctcttcgaggacacatccagagccattagctggccggcattttaatctcgcccctctcggaagaaggcgcgtgcaaagccaatgggcgagcacccggggaggtcacaaggagaggccaacagtgatgctatttccttttaggaacctggggtcccctacccaggtcatctcaaaacccgaatcaaaagaggaacacgcaatttataccgcggacttggcaatggggaccagggctgccagtactgggaagagtaaatccccgtgccaaacactgggaggccgcgctctcaaggagaatcctgtggacctgcccgctactgaacagaaagaaaattgcctggactgctacatggaccctcttcggctgagtcttttgccaccgagagctcgcaagcccgtttgcccccccagcctgtgtagctcagtgatcactatcggtgacctggtgctggattccgatgaagaggagaatggccagggcgaagggaaggagtccctagaaaattatcagaagactaaattcgacactctcataccaactttgtgcgagtacctgccaccttccggtcacggagcaatcccagtgagcagctgcgattgccgggactcaagcagacccctgtag

SEQ ID NO: 17617 - DNA, 3498 bp, Artificial Sequence
  Description of Artificial Sequence: Synthetic coding sequence
atggaacaggacaggacgaatcatgtagaaggcaatcgcctgtcccctttcctcatcccctcccctcccatttgtcagacagagccactggccacaaaactgcagaacggcagcccccttccggaaagagcccatccggaggtgaacggcgacaccaagtggcactcgttcaagagctattacggcatcccctgtatgaagggttctcagaattctagagtctcgcccgacttcactcaggagtcacgcggttattcaaagtgtctccagaacggtggcattaagcgtacagtatccgagccatcactgagcgggctgcttcagattaagaaactcaaacaagaccagaaggccaacggtgagagaaggaacttcggtgtcagccaggagcgcaacccaggcgagtcctctcagcctaacgtatcagacctatctgacaagaaggagtctgtgtcttccgtggcacaggaaaacgccgtaaaagattttacatccttctcgacgcacaattgtagtggtcctgaaaatcccgaacttcagattctgaatgaacaggagggaaaaagtgccaattaccacgacaaaaatattgtgcttcttaagaacaaggctgtcttgatgccaaatggcgccactgtgtcggcatcctccgtcgagcatacccacggtgagcttctggagaaaaccctgagccaatactatcctgattgtgtgagtattgctgtccaaaagacaacgagccatatcaatgccatcaacagccaggccactaacgagttgtcctgtgagattacccacccttctcacacttcaggacagataaacagcgcccaaacaagcaactctgaactcccaccaaagccagcagcggttgtgagcgaggcctgtgacgctgacgacgctgacaacgcaagtaaactcgctgccatgctgaacacatgtagctttcagaagcccgaacaactgcaacagcagaaatctgtattcgagatatgccctagcccagccgagaacaatatccagggcaccaccaaactcgcatccggagaagagttttgctctgggtcgagcagcaacctgcaggctccgggcgggtccagtgaacgctaccttaagcagaatgaaatgaatggagcatactttaaacagagttccgtgtttacaaaagacagtttcagcgcaaccactacccctccaccaccttcccagttactactcagccctcccccaccgctgccccaggtcccacagcttcccagcgaaggaaagagtacccttaacgggggcgttctcgaggagcaccatcactaccctaaccagtccaacaccactctgttacgagaagtaaagatcgaaggaaaacctgaagcccccccaagtcaatcacctaatccatctacgcacgtgtgctcccccagcccaatgttgagcgagcgtccccagaataactgcgttaataggaacgatatccagactgccgggaccatgacagttcctctgtgttcggagaaaactaggcctatgtccgagcacttaaaacacaacccaccaatttttggctctagcggagaacttcaggacaactgccagcaactaatgaggaacaaagaacaggagatcttgaaggggcgcgataaggagcagactagggatttggttcctccgacccaacactacctcaagcccgggtggatcgagctaaaggccccgaggtttcatcaggctgagtcgcacttgaaaaggaacgaagctagcttacccagtatcctgcaataccagccaaatctcagtaaccaaatgacatcaaagcagtatactggtaacagcaatatgccaggcggcttgccacgccaggcctacacacagaagacaactcaactcgagcacaagtcacagatgtaccaggtggaaatgaatcagggccaatctcaaggaacggtggatcagcatctgcagtttcagaaaccttctcaccaagtgcacttctcaaagacggatcacctgcctaaagctcacgtgcaaagtctctgtggtacccggttccattttcagcagcgggcagactcacagactgagaagctgatgtccccagtgctcaaacaacacttgaaccaacaggcatcagagacggagcctttcagtaattctcatcttctgcagcacaagcctcacaagcaggctgcccagacacagccctcccagtctagccacctgccccaaaaccagcaacagcagcagaaactgcaaatcaaaaacaaagaagagattctgcaaacatttccacaccctcagtctaataacgaccaacagagggaagggagcttctttggccagaccaaggtagaggagtgctttcacggcgagaatcaatacagcaagagcagcgagtttgaaactcacaacgtgcagatgggcctggaagaagtacagaatataaaccggcgcaactctccatacagtcaaactatgaagtccagcgcttgtaaaatccaggtgtcatgctccaacaacacccatctggtcagcgagaataaggaacagactactcaccctgagctgttcgccggaaacaagactcaaaatttgcaccacatgcagtattttccaaacaatgttataccaaaacaagacctacttcaccgatgtttccaagagcaggagcagaagagtcagcaggcaagtgtgcttcagggctacaaaaacagaaatcaggatatgagtggacagcaggctgcgcagctggcacagcagagatatctcatccacaaccacgccaatgtattcccagtccccgatcagggtgggtcacacacacagacaccaccacagaaagacacacagaaacacgctgctctcaggtggcacttgttgcagaagcaagagcaacagcagacgcagcagccacagaccgaatcctgccattcacagatgcaccgcccaataaaggtggagccgggatgtaaacctcacgcctgcatgcacacggctcccccagaaaataagacatggaagaaggtgactaagcaggaaaaccccccagcatcttgtgacaacgtgcagcagaagagcattattgagacaatggaacagcacttgaagcagtttcacgcaaagtctctattcgaccacaaggccctgacgcttaaaagccaaaagcaggtgaaggtagaaatgagcggaccggtgaccgtgctaaccagacagactactgctgcagaactcgatagccatacacccgcccttgaacagcaaaccacttcaagcgagaagactccaaccaagcggacagccgctagcgttcttaataactttatagagagccctagcaagctgcttgacactcctattaaaaatctgcttgatactcctgtcaaaacacaatacgattttccttcctgtcgctgcgtaggaaagtgtcaaaagtgtacagagacgcacggcgtgtaccctgagctcgccaatctatcctccgatatgggattctctttcttcttttag

SEQ ID NO: 17618 - DNA, 6009 bp, Artificial Sequence
  Description of Artificial Sequence: Synthetic coding sequence
atggaacaagacagaaccaaccacgtggagggcaacagactcagtccttttctgatcccgagtcctcctatttgccagactgaacctctcgctaccaaactccagaacgggagccctctccctgaaagagcccaccctgaagtgaatggggataccaagtggcattctttcaaatcttattacggcatcccctgcatgaaggggtcacagaattctcgggtgtctccggatttcacgcaggagagtagaggatactcaaagtgcctgcaaaacggaggcattaagcgcacagtgagtgaaccgagtttgtcgggtctcctccagattaagaagctcaaacaggatcagaaggcgaacggagaaagaagaaatttcggtgttagccaggagcgaaatcctggggaaagcagccagccaaatgtctcagacctcagcgacaagaaggaatcagtgagtagcgtggcccaagaaaatgcagtgaaggacttcacaagctttagtacgcacaactgcagcgggccagagaaccctgaactgcaaatcctgaatgagcaggagggaaaatcggcgaattatcatgacaagaacattgtgctgctgaaaaataaggcagttctgatgcctaatggcgccacagttagtgcctcaagcgtggagcacacccatggagagctgctagaaaagactctgtcgcagtactatccggattgcgtgtcaatagctgtacagaaaacgaccagccacataaatgccattaattcgcaagccactaatgaactttcttgtgagatcacccatccctcacatacatcaggccagatcaactccgctcagactagcaattctgaactgcctccaaaaccagcagctgtcgtaagtgaggcatgcgatgcagatgatgcggacaatgcttctaaactcgccgctatgctgaacacttgttcttttcagaaaccagagcaactacagcaacagaagtccgtgttcgaaatttgtccttcccctgcagagaacaacatacagggaaccactaagctggcctctggggaggagttctgttcaggcagcagctcaaatttgcaggccccaggcggttctagcgagcggtaccttaagcaaaatgaaatgaacggggcctacttcaagcagtcctcagtgttcactaaagactcttttagtgccacgacaactccccctcccccgtctcagttgcttctctcccctcctccaccgctcccccaagtgcctcagctcccctctgaggggaagtccacactgaacgggggagtgttggaagagcaccaccactatcccaatcagagcaatactacgctcctacgcgaggtcaagatcgagggtaaacctgaagccccccccagccagtcgcccaacccttccacacatgtgtgtagtcccagccccatgttaagcgaaagacctcagaacaactgtgtgaaccgaaacgacattcaaacggctggaacgatgactgtcccgttgtgttctgagaagacacgaccaatgagcgagcatctgaaacacaaccctccaattttcggaagtagcggcgagctgcaggacaattgccagcaactgatgagaaacaaggaacaagagattctcaagggacgagacaaagagcagaccagggatctggtaccacccacccaacattacctgaagcctgggtggatcgagcttaaagccccgaggtttcaccaagcggaatcccacctgaagaggaacgaagcctcactgccaagcattctgcagtaccaacctaacctgagcaaccagatgacaagtaaacaatataccggaaactcaaacatgccagggggacttcctcgacaggcatacacccagaaaacaacccagctggagcacaaaagccagatgtatcaagtagaaatgaaccaggggcaaagccagggcacagtggatcaacacctacagtttcagaagccatcacaccaggttcactttagcaagaccgaccacctgccgaaggcgcacgttcagtccctgtgcggaactcgatttcatttccagcaacgggcagattcccagacagaaaaactgatgtcacctgtgctgaagcagcatctcaaccagcaggcttccgaaacagagccgttttcgaacagccatctgctgcagcataagccgcacaagcaggctgcccagacgcagccctcccaaagtagtcacttgccgcaaaatcagcagcagcagcagaagctgcaaatcaaaaacaaggaagagattctccaaacctttcctcaccctcagtccaacaatgaccaacaaagggagggctcgttctttggccaaaccaaagtcgaggaatgcttccatggcgagaatcaatactcaaagagttccgagtttgaaacacacaatgtgcaaatgggcctcgaggaggttcagaacataaacagacgaaattcaccttatagccagaccatgaaatcatctgcttgtaagatccaggtgagttgctcaaacaacacacacctcgtgtcagagaataaagagcaaaccacccaccctgagctgtttgctggcaacaagacgcagaatcttcatcatatgcagtattttccgaacaatgtgatcccaaagcaggacttgctacatagatgcttccaggagcaagaacaaaagagccagcaggcgagtgtgcttcaggggtataagaaccgtaaccaggatatgtcaggacagcaggcagcacagctggcccaacagcgttacctgatacataatcacgccaacgtattcccggtccccgaccagggaggcagccacacccagactccaccgcagaaagatacccagaagcatgcagctctgcgttggcacttgctgcagaaacaggaacaacagcagacccagcagccacagaccgagagctgtcactcccagatgcatcgacctattaaagtagaacccggctgcaaacctcatgcctgcatgcatacggcaccacctgaaaataaaacttggaagaaagtgacaaaacaggagaaccccccagcttcctgtgacaatgttcaacaaaaatctatcattgaaaccatggagcagcacttgaaacagttccacgccaagtctcttttcgaccacaaggcgcttacactcaaaagtcaaaaacaggtcaaggtcgagatgtctggtcccgtgaccgtgcttacaaggcagaccacggccgcagagctggattcccatactccagccctggaacagcaaaccacgagctctgagaagaccccgaccaagcgcaccgcagccagcgtcctcaataattttattgagtcaccgtccaagctgcttgatacacctatcaaaaacttgctggatacgccggtaaaaacccaatatgacttcccttcgtgccggtgtgtggaacaaatcatcgagaaagacgagggaccgttctatacccacctcggcgccgggcccaacgtggccgcaattcgtgagattatggaagaacgttttggacagaagggaaaagcaatccgaattgagagggtaatttacacggggaaggaagggaagtcatcacaaggctgtcctatcgctaagtgggtggtccgcaggagtagttctgaagaaaagctgttgtgcctcgtgagggaacgagctggtcacacatgcgaagctgctgtcattgtgattttaatcctcgtatgggagggaataccacttagtttagccgacaagctatattccgagctgactgagactttacgaaaatacggaactctgaccaacaggcgctgcgccctgaacgaggagagaacatgcgcctgccaaggcctcgaccctgagacctgcggagcaagcttcagcttcggttgcagctggtctatgtattacaacggttgtaaatttgccaggtctaagatacccaggaagttcaaactccttggagatgaccccaaagaagaggagaagctggagtcccacctccagaatctgagtactttgatggcccctacttataagaaattggctcccgatgcctacaacaaccagatcgagtacgagcatagggccccagaatgccggctgggactgaaagaagggagaccattctcgggcgtaacagcctgtctcgacttttgcgcccatgcccaccgggacctgcacaacatgcaaaatggcagcacactggtgtgcaccttgaccagggaggacaaccgggagtttggaggtaagccagaagacgagcagttgcacgtcctacctctctataaggtaagtgatgtcgatgagttcggcagcgtggaggcacaagaggagaaaaagcggtccggggccattcaggtcctatcatcttttagacggaaggtgcggatgctggcagaacccgtgaagacgtgtaggcagcggaagctggaggcaaaaaaggccgcggcagagaaactgtcctcattggaaaactctagcaataagaacgaaaaggaaaagagcgcaccttctagaacaaaacaaacggagaatgcctcacaagccaagcagttggccgaattgctgagattgtcaggtcccgtcatgcaacaatctcagcaaccccagccccttcagaaacaacctccccagccacagcagcagcagagacctcagcaacaacaaccccatcatcctcagactgagagcgtaaactcatactctgctagcggaagtaccaacccttacatgcgaagaccgaaccccgtgtccccttatccaaactcttcacacacaagcgatatatacggcagcaccagcccaatgaacttttacagcacaagctcccaggcggccggtagttatctcaattctagcaaccccatgaatccctacccaggcctgctgaaccagaatacacagtacccaagctaccagtgtaatggcaaccttagcgtggacaattgctccccgtatctaggcagttactcgccacagtcacagcccatggatctctaccggtaccccagtcaggacccactgagcaaactctctctgcctcctattcataccttgtaccagccccggtttggcaattcacaatctttcacatctaagtacctggggtatggaaaccagaatatgcagggcgacggttttagctcctgtactatacgccccaacgtccatcatgtgggcaagctgccaccataccctacacatgaaatggatggccacttcatgggcgcaaccagtaggcttcccccgaacctgtcgaaccccaacatggactataagaacggggaacatcactcaccctcacatatcattcacaactacagcgccgcgccaggcatgttcaacagtagcctgcatgcactgcacttgcagaacaaggaaaacgacatgttaagtcacacagcaaacggcctgtcaaagatgctgcccgctctcaatcatgaccgtaccgcgtgcgtccaaggcggacttcacaaattgtccgatgccaacggtcaagaaaaacagcctctcgcccttgtgcagggcgtggcttcaggagcggaagacaatgacgaggtgtggtccgacagtgagcaatcttttcttgatccagacatcggaggggtggctgtagcgccgacccatggctcaatcctgatagagtgcgccaagagggagctgcacgcaactacacccctgaaaaatcctaatcgtaatcaccccacccggatcagccttgtgttctaccagcataagagtatgaacgagcctaagcacggcctcgccctctgggaagcgaaaatggccgagaaggcccgcgagaaagaagaggaatgtgagaagtacgggcctgactatgtgccccaaaagtctcacggcaagaaagttaaacgggagcccgcagagccccatgagacctcggagccaacatatttgcgatttatcaagtccctcgccgaaagaaccatgtcagtcacaaccgattccacagtcacgacaagcccatacgcatttactcgggttaccggaccctacaatcggtatatttag

SEQ ID NO: 17619 - DNA, 3498 bp, Artificial Sequence
  Description of Artificial Sequence: Synthetic coding sequence
atggaacaagacaggacaaatcatgttgagggcaaccgcctctcccctttcctgattccctctccccccatttgtcagacggaacccttagccacaaagctccagaacggcagtccgctcccggagagggcgcatccagaagtgaatggcgacactaagtggcacagttttaagtcttattatggaattccatgtatgaaggggtcacagaactctagggtgtctcccgacttcacccaggaatcacgaggctatagtaagtgtcttcagaatggtggtattaagaggactgtgtccgagcccagcctgtctgggttgcttcaaatcaagaagctaaagcaggaccagaaggccaatggcgagaggcgaaacttcggtgttagccaggagaggaatcccggggaatcctcacagcctaacgtgtctgatctgagtgacaagaaggagagcgtcagctctgtggcccaagagaacgccgtgaaggactttacctctttttctacccataactgttcagggcccgagaacccagagctccagatcctcaatgagcaggaagggaaatcagctaactaccatgacaagaatatagtcttgctaaagaataaggcagtgctgatgcctaatggcgcaacagttagcgcctcctctgtggaacatacccatggcgaattgcttgaaaaaacgctcagccaatactatcctgactgcgtgtctattgcggtacaaaagacaacaagccatatcaacgcgatcaacagccaggctacgaacgaactgagctgcgagattacgcatccctcccacacttcaggccaaattaattcagcacagacaagcaatagcgaactgcctcccaagccggccgctgttgtgagcgaagcatgtgacgccgacgatgcggataatgcaagcaagctcgcagctatgctgaatacctgttccttccagaagccggagcagctacagcagcagaagagcgtgtttgagatttgtccaagccccgcagaaaacaacattcagggaaccaccaaacttgcctcaggcgaggaattttgctctgggtcatcctccaacctacaggcgccaggcgggtcaagcgagcggtatctgaagcagaatgagatgaacggagcctacttcaagcagagctccgtgtttaccaaggactctttttccgccacaactacacctccacctcctagtcagctactcctttctcccccgccgcccctgccacaggttccgcaactgccaagcgaagggaagagcacattgaatggtggtgtgttggaagagcatcaccactacccaaatcagagcaacaccacgctgctgcgtgaagtcaagattgagggaaaacccgaggccccaccatcccagagccccaatcctagcacccatgtctgctctccaagccccatgctgtctgagcgaccgcagaacaactgtgtgaaccggaacgatattcagaccgccggcacaatgacagtcccactatgttctgaaaagactcgacctatgtccgagcacctgaagcacaatccaccaatttttggctcctctggggagctccaagacaactgccaacagctcatgcgaaacaaggagcaggagattctgaaaggacgtgataaggagcagacaagagatttggtgccacctacacagcattatctcaaaccaggatggatagagttgaaggcgccaagattccaccaggccgagagccatttgaagaggaacgaggcaagcctcccaagcattttacagtatcagccaaacttgtctaaccagatgacgagcaaacagtatacgggcaatagtaatatgccaggtggcctgcctcggcaggcctatacccagaaaactacccaactggaacataagtcccaaatgtaccaggtcgagatgaaccagggtcagtcccaggggaccgtcgaccagcatttacagtttcaaaagcctagccaccaggtgcacttctcaaagaccgatcacctaccgaaagcccacgtccagagcctgtgtggaacccgctttcattttcagcagcgggccgactcgcaaaccgagaaactgatgagccccgtgctgaagcagcatctaaatcagcaagctagcgagacagagcctttcagcaattcccatttgttgcagcacaagcctcacaagcaagcggcccagacgcagccttcccagagctcccatctgccgcagaatcagcagcagcagcagaagctccagatcaagaataaagaggagattcttcagacatttcctcatccccagtcaaacaacgaccagcagcgggaaggttccttcttcggccaaaccaaagtagaggagtgtttccacggcgagaaccaatactccaagtcaagtgaatttgaaacacacaatgtacagatgggactggaagaagtacagaatatcaataggagaaacagcccctatagccaaacaatgaagtcctctgcttgcaaaattcaggtgtcctgtagcaataacacacatctggtgagtgagaacaaggagcagaccacccaccctgagctcttcgccggtaacaaaacccaaaacttgcatcatatgcaatactttccgaataacgtgatcccaaagcaagacctgctccaccgctgcttccaggaacaggagcagaaaagccagcaggcttcagtgttgcaggggtataagaatcggaatcaagacatgtccggccaacaggccgcacagctggcacagcagcgctacctcattcacaatcatgctaatgtgttccctgtgccagaccagggtggaagccatacacagactcccccccagaaggacacacaaaagcacgccgccctccgctggcatctcctgcagaagcaggaacagcagcagacgcagcagcctcagacagagagctgccatagccagatgcatcgcccgataaaagtggagccgggttgtaaacctcacgcttgcatgcatacagcacctcctgagaataagacatggaagaaggttaccaagcaggagaaccctcctgcgtcttgtgataatgtacagcagaagtctatcatcgagacaatggagcagcacctgaaacaatttcacgctaagtcccttttcgatcataaggccctgacactaaaatcccaaaagcaggtcaaggtggagatgtctggtcccgttaccgtgcttactcggcaaaccactgccgccgaattggacagccatacccctgctttggaacagcagacgacatcttcagagaagacgcctaccaagcgcactgctgcgagtgtgttgaacaacttcatcgagagccctagcaaactcctggacacccccattaaaaatttactcgacactcccgtaaagacccaatatgactttccctcgtgtagatgcgttggcaaatgccagaagtgcacagaaacacatggcgtctatccggaactcgctaacttgtcaagtgacatgggcttctcatttttcttctag

SEQ ID NO: 17620 - DNA, 333 bp, Artificial Sequence
  Description of Artificial Sequence: Synthetic coding sequence
atggaacaagaccgcaccaaccacgttgaaggtaatagactaagcccattcctcatcccttccccgcctatctgtcagacagagccgctagccacaaagctccagaatggttcccctctacccgagagggcacatccagaagtgaacggagacacaaagtggcatagctttaaatcgtactacgggattccatgtatgaagggctctcaaaattccagggtctccccggacttcacccaggagtcacgggggtattctaagtgtctgcagaatggcggcattaagcgtaccgttagcgagccttccttgtccggcctcctgcagataaagtag

SEQ ID NO: 17621 - DNA, 1914 bp, Artificial Sequence
  Description of Artificial Sequence: Synthetic coding sequence
atggagcaggatcggacaaaccatgtggaagggaataggctgagcccattcctgatcccaagcccccccatctgccaaacagaacctttggcgacaaagctgcaaaatggctcacccttgcctgagagagctcaccccgaggtcaacggagatactaagtggcactctttcaaaagctactatgggatcccgtgcatgaaaggcagccagaattctagagtctcccccgacttcactcaggagtctcgcggatactcaaaatgtctgcagaatgggggcataaagaggactgtgagcgaaccatcactcagtgggctgctgcagatcaaaaagcttaagcaggaccaaaaggctaatggcgagcgtcgaaatttcggcgtatctcaggagcgcaacccaggcgagtcaagtcagcctaatgtgtcagatttgagtgacaagaaagagtctgtgtcctctgtggcccaggagaacgcagtgaaggacttcaccagtttctcaacacataactgtagcggacccgaaaatccagagctacagatcctgaatgagcaggaaggaaagtcagccaactaccacgacaaaaacatcgtgctgttgaaaaacaaagccgtcttaatgccgaatggcgccaccgtctcagcctcttcagttgaacacactcacggcgagctgctcgaaaaaaccctttcccagtactaccccgattgcgtatccattgcggtgcagaagactacgtctcacatcaatgcaatcaactctcaggctacgaatgagctaagctgtgagatcacccacccttcccacacctcggggcagattaacagcgctcagaccagtaatagtgaactgccacctaaaccggcagctgtcgtaagtgaagcttgtgatgctgacgacgctgacaatgcctctaagctggcagcaatgctgaacacatgcagcttccagaagcccgaacagctgcagcagcagaagagcgtctttgagatctgtccttcccccgccgagaacaacatacagggaacaacgaaactcgcttcaggcgaggagttctgctctggttcaagtagtaatctccaggcgccaggcggaagttccgagcgatacctcaagcagaacgagatgaacggggcatatttcaagcagtcttcagtgttcaccaaggattctttctctgctaccactaccccacctcccccatcacagcttcttttgtccccgccccctccactgccgcaggtgccacagctcccttccgagggcaagtcaacactcaacggcggtgttctcgaagagcatcatcactacccaaaccagtcaaacaccactttactgcgggaggtgaaaatagagggtaagcccgaagccccaccatcccagtcccctaacccctccactcatgtgtgcagcccctcccctatgctgtccgagaggcctcagaacaactgcgtgaacagaaatgacatccagaccgcgggcaccatgacggtgcccctttgttcagagaagacccggcccatgtcagaacaccttaagcacaatcctcctatcttcggctcaagcggggagcttcaggacaattgtcagcaactgatgcgtaacaaagagcaggaaatccttaaaggcagagataaagagcaaacccgagacttggtccctcctacacaacactatctgaaacccgggtggatcgagctaaaggcacccagatttcatcaggccgaatcacatctaaaaaggaacgaggcttctctgccctctatcctgcaatatcagcccaacctctccaaccagatgaccagcaagcagtatacagggaactcaaacatgccggggggcctgccccgacaagcttacactcagaagactactcagctgagcacctcacacaagtgcactaagctgaaatag

SEQ ID NO: 17622 - DNA, 6009 bp, Artificial Sequence
  Description of Artificial Sequence: Synthetic coding sequence
atggagcaggatcgcaccaaccacgtggagggcaaccgcctcagcccttttttgattccgtccccccccatctgtcagaccgagcccctagcaactaaacttcaaaatgggagccctcttcccgagcgagcccaccccgaggtgaatggagatacaaagtggcacagtttcaagagctattacggtatcccctgcatgaaggggagccagaacagtagagttagcccagacttcacccaggagtcacggggttattctaaatgcctgcagaacggcgggataaaacggactgtatccgagccctctttatcaggtctcctccagatcaagaaattgaagcaggaccagaaggccaatggcgaacgcagaaactttggtgtgtctcaggaacgaaacccaggcgaatccagccaacccaatgtgagcgacctttccgataagaaagaaagcgtttcatccgttgcccaggagaacgcagttaaggattttacctcattttctacccacaattgctctggccccgaaaatcccgaactgcagatcctaaatgagcaagaggggaaaagtgccaattaccacgacaagaacatcgtcctcttaaaaaacaaggcagtgctgatgccaaacggtgccacagtgtccgctagctcagtcgaacatacccacggtgagctcttggagaagaccctgagccagtactaccccgattgtgtatcaatcgcagtgcaaaaaactacaagtcatatcaacgctattaactctcaagccacaaacgagctgtcctgcgagatcacgcacccttcacacaccagtggccaaatcaactctgcgcaaacaagcaactcagagctgcctccaaaacctgccgctgtggtaagcgaggcttgcgacgccgacgatgctgacaatgctagtaagttagctgcaatgcttaacacttgtagcttccagaagcccgagcaactgcaacagcagaagagtgtgttcgagatttgtcctagcccagcagagaataacattcaagggaccacgaagttggccagcggtgaggagttttgctccgggtcgagcagtaatctgcaggccccaggaggaagctccgaacgataccttaagcaaaacgagatgaacggtgcgtatttcaagcaatcatctgtctttactaaggattccttctctgcgaccaccactcctccccctccaagccagctcctactctcccccccgccgcctctgccccaggtgcctcagcttccctcagagggcaagtctacgctgaacggaggtgtcctcgaagaacatcaccactatcccaaccagtcaaatactacactgctaagagaagtgaaaatagagggtaaacccgaggccccacctagccagagccccaacccgagtacccatgtgtgctcaccttctcccatgctgtctgaacgcccacagaacaattgtgtgaaccggaatgatatccagacagcaggaacaatgaccgtgcctttatgcagcgagaaaacccgacccatgtctgaacatctgaaacataatcctccaatttttggaagcagtggtgagctccaggacaattgccagcaactgatgagaaataaagaacaggagattctgaaagggcgagataaggagcagacgcgcgacttagttccgccaactcagcactatctgaagcccggctggattgagctcaaagctccccggttccaccaggcagaaagtcacttgaagaggaatgaagcctctcttcccagtatattacagtatcagcctaatttgagtaaccagatgacatccaaacagtatacaggcaattctaatatgccaggcggactcccacgtcaagcctacactcaaaagacaacacagctggagcataagtctcaaatgtaccaggtggaaatgaatcaggggcagtctcagggtacggtcgaccagcatctccaattccaaaagccttctcaccaggtgcatttctctaaaactgatcacctcccgaaggcccacgtccagtctctgtgtgggactcgcttccactttcagcagagggctgattcacagacagagaagctgatgtccccagtcctgaagcaacacttgaatcagcaggcctcagaaacagaacccttcagcaacagccatctgctgcagcacaagcctcacaagcaggcagcacagacccaaccaagccagagctcccatctaccacagaatcagcaacaacaacaaaagctccaaataaagaataaagaggagatcttacagacgttcccccacccccagagcaacaacgaccagcaacgcgagggcagctttttcggtcagaccaaagtggaggaatgcttccacggagagaaccagtactctaaatccagtgaattcgaaacgcacaatgtgcagatggggcttgaggaagttcagaatattaatcggaggaattctccgtatagccagactatgaagagctcagcttgtaagatacaggttagctgctccaataatacccacctggtctccgagaataaggagcaaacgacgcatccggagttgttcgctggcaataaaacgcagaatctccaccacatgcaatacttccctaataatgtaattccaaagcaggatctccttcaccggtgctttcaggagcaggaacaaaagtcgcagcaagcttcggtattgcagggctataaaaataggaaccaggatatgtcagggcagcaggcggctcagctcgcacagcagcgctacctcattcataaccatgcaaacgtgttcccagtgccagatcaagggggaagtcacacgcagaccccccctcagaaagacacgcaaaagcacgccgccttgcggtggcacctgctccagaaacaggagcagcagcagactcagcagccccagaccgagtcctgtcactcccaaatgcaccggcctataaaggtagaacctgggtgcaaacctcacgcttgcatgcacactgccccaccagaaaacaaaacgtggaagaaggttactaaacaggaaaaccctccagcgagttgcgataacgtgcagcagaagagtataatcgagacaatggagcaacacctgaagcaattccacgcgaaatcgttgttcgaccacaaagccctcactctaaagtcacagaagcaggtcaaagtcgagatgtctgggcccgtgacagtgttgaccaggcagactacagcagcagaattagatagccatactcccgcccttgaacaacagaccacctcttcagagaagacccccaccaagcgcactgctgcctcagtgctgaacaattttatagagagccccagcaaattgctcgacacccctatcaagaatctgctagatacgccggtcaaaactcagtatgatttcccatcctgccgatgcgtggaacaaataattgagaaagacgaggggccattttacacccatctgggggctgggcctaatgttgccgctatcagagagatcatggaagagcggtttggtcagaagggaaaagctatcaggatcgagcgcgtcatttatactgggaaggaggggaagagctcacagggatgcccaatcgccaaatgggtggttcgtcgctcatcctccgaagaaaagttactgtgcttagtgcgcgaaagagccggtcacacttgtgaagctgcggtgatagtgatcttaatcctggtttgggagggtatccccttgtcgctggcagataaactgtatagcgagctgaccgagacactgcgcaagtatggaaccctcacaaaccgacgatgtgcgctcaatgaggaaagaacgtgcgcttgccagggcctagatcccgaaacttgcggtgcttctttctccttcggatgcagctggtcaatgtattataatggttgcaagttcgcacggtctaaaatccccaggaagttcaagttgctaggagacgacccaaaagaagaagagaagttggaatctcacctgcagaacctgtccaccctgatggcaccgacatataagaaactggctccagacgcctacaataaccagattgaatacgagcacagagcaccggagtgcagattgggtctcaaagaaggtcgtccattcagcggggtaaccgcgtgcctggacttctgcgctcacgcccatagagatctgcataatatgcagaatgggagcacactggtttgtacccttacgcgagaggataaccgggaatttggcggcaagccagaggacgagcagctccatgtgctccccctgtacaaagtgtcagatgtggatgagttcgggtcagtagaagcccaagaggaaaaaaaaagaagtggcgccatacaagtcctgtcatcctttcgtaggaaggtgcggatgctggccgagccggtcaagacatgtcgtcagcggaaacttgaggctaagaaagccgcagccgaaaagttgtcctccttggaaaatagctctaacaagaacgaaaaagaaaagagcgccccctctcggaccaaacagacagagaatgcctctcaggccaagcagcttgccgagctactgcgccttagcggccccgtcatgcagcagagccagcaaccccagcccctgcagaaacagccgccacagcctcagcagcagcagaggccccagcagcaacaaccccaccacccacaaaccgagagcgttaacagctactcagcgtctggctccaccaatccttacatgcgacgtcctaatccggtctccccatacccgaatagctctcataccagtgacatatatgggtccacatcgcccatgaacttttactcaacctctagccaggcggcgggctcctatctcaactccagcaatccgatgaatccttacccaggtttgctgaatcagaacacccagtacccgtcctaccagtgtaacgggaacttaagcgtagacaactgtagtccctatctcggaagttactccccccagtcccagcccatggacctgtacagatacccaagccaggatcccttatctaaactgagcttgccacctatacatacattgtatcagccccggttcggtaatagccaatccttcactagtaaatacctcggatatggtaaccagaacatgcaaggtgacggcttttcaagttgtacaattcgccccaatgtgcaccacgtgggcaaactccccccttacccgactcatgagatggatggacactttatgggagccacatcgcgtctcccaccaaacctctctaatcctaacatggattacaaaaacggcgagcatcattccccaagccacattatccataactattcggccgctcccggaatgtttaactcctcattgcacgcccttcacttacagaacaaagagaacgacatgctctctcatacagcaaacggactgtctaaaatgttgcccgctttgaaccatgatagaacagcctgcgtccagggaggacttcacaaactgtctgatgctaacggccaggagaaacagccactggccctggtgcaaggcgtcgcatccggtgccgaggacaatgatgaggtgtggtcagatagcgagcagtcgttcctggaccctgacataggcggcgtggcagtggcaccaacacatggcagcatactcatcgagtgcgcaaagcgtgaactccacgcaacaacccccctgaaaaatccaaatcgcaaccatccgactcggatcagcctagtcttctaccaacacaaaagtatgaatgaaccgaagcacggtttggccctgtgggaagcgaagatggccgaaaaggccagagaaaaggaagaggagtgtgagaaatacggcccagattatgtgccacaaaagagtcacggcaaaaaggttaagagagaaccagctgagcctcacgaaacatccgagccaacttatctaagatttatcaagagcctagccgagcgaaccatgagtgtcacaaccgatagtacagtgacgacgtccccgtatgcgtttacccgcgtgactggtccctacaatcgctacatttag

SEQ ID NO: 17623 - DNA, 3585 bp, Artificial Sequence
  Description of Artificial Sequence: Synthetic coding sequence
atggagcaggatcggaccaaccacgttgaaggaaaccgcttgtcaccctttctcattccatcacctcctatttgtcagacagaacccctcgccacgaagttgcaaaacggaagtcccctgccagaaagggcacatcccgaagtgaacggggacactaaatggcactccttcaaatcgtactatggaatcccatgtatgaagggcagtcaaaatagtcgcgtttcccctgacttcacccaggaatctcgagggtacagtaaatgcctccagaatggtggtatcaagagaaccgtgtcagagccgtccctcagcggcctgttgcagattaaaaagttaaagcaggaccagaaagcaaatggtgagagaagaaactttggagttagccaggaacgtaacccaggcgagtcttcacaacccaatgtctctgacctgagtgacaagaaggaaagcgtttcatcagttgcgcaggagaatgccgtcaaagacttcacctcattctctacacataattgttccggcccagaaaatcccgaactgcagattttgaatgaacaggagggtaagagtgccaactaccacgataagaacattgttctgctgaagaataaagctgtgctcatgcctaacggtgctactgttagcgcctccagcgtggagcacacacatggagagttacttgagaagaccctcagtcagtactaccctgactgcgtgtccatcgcagtgcaaaagaccacgtcccacatcaatgcaatcaattcacaggccactaacgaactgtcttgcgagattacacatcctagtcatacgtctgggcagatcaacagcgcgcagacctccaattctgagctgccaccaaagccagcagccgtggtgtctgaagcctgtgatgccgatgatgcggataatgcctcaaagttggcagctatgctcaacacatgcagcttccagaagccagagcagctgcagcagcagaaatctgtgtttgaaatttgcccaagtcccgcagagaataacatccaaggcactaccaagctggcaagtggggaagagttctgtagcgggagtagttcgaatctgcaggcccctggcggctccagcgaacggtatctgaagcagaacgagatgaatggcgcgtatttcaagcagagtagtgtgttcactaaagattctttttccgcaacaactacacctccacctccgtctcagctcctgctaagcccccccccacccttgccacaagtgccccagctcccttctgaaggcaaaagtacacttaatggtggcgtactcgaggagcaccaccattaccccaaccaatctaacaccacgctgttgcgggaggtaaagatcgagggtaagcccgaggcccccccctcccagagtcccaacccaagtacacacgtttgttccccaagtcctatgctgagcgaaagaccccagaacaactgtgtgaatcggaatgacatacagaccgccggcacaatgaccgtccctttgtgcagtgaaaagactcgccctatgtcagagcacctgaagcacaatccaccaatcttcggttcatctggcgagctgcaggataattgccagcagctcatgaggaacaaagagcaagagatcctcaaaggccgggacaaggagcagaccagggatttagtgccacccacccagcactatttgaagccggggtggattgaacttaaggctcctcgtttccaccaggccgaatctcacctgaaacgtaacgaggcttcgctcccctccattctgcagtatcagcctaacctgagtaaccagatgacctcaaaacaatacaccggaaattccaacatgccaggaggtttgccacggcaggcctatacacagaagactacacagttggagcataaaagtcagatgtaccaggttgaaatgaatcaagggcagtcccaggggacagtggaccagcatctgcaattccagaagccttcacaccaggtccacttttcaaagactgaccatctgccgaaggctcatgtgcagtccctatgcgggacacgcttccacttccaacagagagcagattcacaaacagagaagctgatgtccccggtgctgaaacagcaccttaaccagcaggccagtgagaccgagcctttttcaaattcccacctactacagcacaaacctcacaaacaggccgctcaaacccaaccaagccaaagctctcatctgccgcaaaatcagcagcagcagcagaagttgcagattaaaaataaggaggagatcttgcagacctttccacaccctcagagtaataatgatcagcagcgcgagggatccttttttggacagactaaggtggaggaatgtttccatggggagaaccaatatagcaaatcgtctgagtttgagacacataatgtccaaatgggtctcgaggaggtgcagaatatcaatcgccggaacagtccttattcgcagacaatgaagagttctgcctgtaagattcaggtgtcttgctccaataatactcacctcgtgagtgagaacaaagaacagactacacatcccgagctctttgccggcaacaagactcaaaacttacatcacatgcaatatttcccaaataatgtgatacccaaacaggacctgctgcaccgctgttttcaagagcaggagcagaagagccagcaggcaagcgtcctacaggggtacaaaaacagaaaccaggacatgagcggacagcaggctgctcagcttgcccagcaaaggtacctgattcataatcacgcaaacgtgtttccggttccagatcaaggcggaagtcacacccaaaccccaccgcagaaggacacacagaagcacgctgccctgcggtggcacctactgcaaaaacaggaacaacagcagactcagcagccacagactgaatcatgccatagccagatgcaccggccgattaaggtggagcccggatgtaagccacatgcttgtatgcatacagctccgcccgaaaataagacttggaaaaaggtgacaaaacaagaaaacccaccggcgtcctgtgataacgttcagcaaaagtccataatcgagacgatggagcagcatctcaagcagttccacgcaaagagcttattcgaccacaaggcactcacactgaaatcgcagaaacaagttaaagtcgagatgtcagggcccgtgactgttctgacgcggcagacgacagccgcagaactggactcccacacccctgccctggagcaacagacaacctcatccgaaaagacaccaactaagagaacagccgccagcgtccttaataacttcatagaaagtccatctaagctgctggatacccccataaaaaatttgctggacacaccagtgaagacacagtacgacttcccatcttgtcggtgtgtcggactggataggcgcgtgaagttgctcgggctgaaggaatctagtatacttgtgaaaaaggctaaagtgcttagagacgtgttactgctgtctggttggtttgccgaagctgccgtgaagcgcagttattgcgtctggtgcggtagcgagctcgcgactcccgtgaggcttcagtag
